United States Patent 7,745,391 (HUMAN THROMBOSPONDIN POLYPEPTIDE) - sequence listing, part 91

SEQ ID NO: 299215 - DNA, 1026 bp, Homo sapiens
aggaatttgtgccttcataggctgaagacttaaaggttggagatgctatggagccctgcagaagagggatctgctttctggcaaaccgggtgttgatgattcatggcctacctcagatgacgaagacctcaattttgatactaagaatgtcccaaaaccaagcttagcaaagctaatgactgcttctcagcaatccaggaaaaatttagaagcaacatatggcactgtgagaacaggaaatagaactttgtttgaggatagagattccgatagtcaagatgaagttgtggttgaaagccttcctacaacatcaatcaaagtccagtgcttttctcatcctacctatcaatcacctgaccttcttccaaaaccttcccacaagtcgttagcaaaccctggtcttatgaaggtaagttgttttttaaaaaacttttttcatgtacccttcccctgccccaacaatcctcataatgatgcatctattgagatgatcatacagtttttgtttctaattatgtttatgtgatgaatcacatttaagacttgcatatgttgaaccatccctgcatccttgaaatgaaacccacttgatcatggtgaattattactttgtgatgtgctgttggattcggtttgctagtattttcttgaggatttttgtatctatattcatcagagatattggtctgcagttttctttttttgttatgtccttttctggctttggtattagggtgatactggctttatagaatgagttagggaggatttcccccttctcaaccttttggagtagtttcagtagaattgttatcagttcttttttgaatgtctggtagaatttagctgtgaatccgtgtggccctgggtttttttcttgttggcggttttaaaattactgattcaatctcactgcttattactggtctgttcaggatttctattttttcctaattcaagctagaggagttacgtgtttcccggaatttttcagtttcctctagattttctagtttgtgtgcatag

SEQ ID NO: 299216 - DNA, 536 bp, Homo sapiens
cccagttcgaggagactctcagatactgggattctgagagtatctctgagaattttccacagaagtatgttgatcctttagctggggctgcagacggaaaagaaaaaaatataggaaatgaacaagcagaagatgtgttttatataccttcttgcatgagtggatcaagaaactttaagatggctaaactagaggatacaagaaatgtaggcatgccagtagcccacatggatctcctgagagagtctccgtcgaactagttcgacggagactctcactttgaataacaaccaaagtgagagtccacgcaaaatataaatattaaaaagttagaaatactcatttttgctcagttttatcttttgaatttgatttaaacgtaaaaattaactagaaaactattaaaattcttcctatttcttatcccattctctgtctctcataggtaatcatttttaattaatttcagtttatccttctggttttcttttcttttctttttttttttccgaaaaaagccagtagctttatgtatt

SEQ ID NO: 299217 - DNA, 6770 bp, Homo sapiens
gtctagcgggatcgcttgcttggtaacccggagggagagattggaaaccgcggagtttcctttgggaggctgcggccagccggggctgacttgttatgttgggctccggaggccgttaagagccgagagagacatgaggtgtctctgaagcccggtcgcctgggccatgaagaagatttttagtaagaagggcgagtcgcccttgggctccttcgcgcggcggcggaggagcagcgcgggaggcgggggcgagccgggggagggcgcctactcgcagcccggctaccacgtccgagaccgagatctcggcaagatccacaaagctgccagcgcgggtaatgtggcgaaagtgcagcagatccttttgctcaggaagaatggcttgaacgatagagacaagatgaacaggacggctctacatttggcctgtgccaatggtcatccagaagtagtaactctcctggtggacagaaaatgccagctcaatgtctgtgacaacgaaaacaggacagctctgatgaaggctgtacaatgccaggaagagaaatgtgcaactattctgctagaacatggtgctgatccaaatcttgcggatgtccatggcaacactgctcttcactatgctgtctataatgaggacatatcagtagcaacaaagctgcttttgtatgatgcaaatattgaagcaaaaaacaaggatgacctcacaccacttttacttgcagtaagtggaaaaaagcagcaaatggtggaatttttaataaagaaaaaagcaaatgtaaatgcagtagataagttggaaagcagtcaccaactaatttcagaatataaagaagaaaggatacctaaacattcttctcaaaatagtaattcagtggatgaaagctctgaagactccttaagcaggctttctggcaaaccgggtgttgatgattcatggcctacctcagatgacgaagacctcaattttgatactaagaatgtcccaaaaccaagcttagcaaagctaatgactgcttctcagcaatccaggaaaaatttagaagcaacatatggcactgtgagaacaggaaatagaactttgtttgaggatagagattccgatagtcaagatgaagttgtggttgaaagccttcctacaacatcaatcaaagtccagtgcttttctcatcctacctatcaatcacctgaccttcttccaaaaccttcccacaagtcgttagcaaaccctggtcttatgaaggaagaaccaacaaagccaggcattgcaaaaaaagaaaatggtattgatattattgaaagtgctccactagagcaaacaaataatgacaatttgacttatgttgatgaagtgcacaaaaataatagaagtgatatgatgtccgcattaggattaggacaagaggaagatatagaatcaccttgggattctgagagtatctctgagaattttccacagaagtatgttgatcctttagctggggctgcagacggaaaagaaaaaaatataggaaatgaacaagcagaagatgtgttttatataccttcttgcatgagtggatcaagaaactttaagatggctaaactagaggatacaagaaatgtaggcatgccagtagcccacatggagtctcctgagagatatcttcacttgaagcctaccattgaaatgaaagattctgttccaaataaagcaggaggaatgaaggatgtacaaacatccaaagcagctgaacatgacttagaagtagcatcagaagaagagcaagaaagggaagggagtgaaaataaccagccacaggttgaagaagaaaggaaaaaacacagaaataatgaaatggaagtatcagcaaacatacatgatggtgctactgatgatgctgaagatgatgatgatgatgatggattaattcaaaaaagaaagagtggagaaactgatcatcagcaatttcccaggaaggaaaataaagagtatgctagtggtcctgccttgcaaatgaaggaagtaaagagcactgaaaaagaaaaacggacctcgaaagaatctgtgaattcaccagtgtttgggaaggccagtttactaactggtggcctgctacaagtggatgatgacagcagtttaagtgaaatagatgaggatgaaggaaggcctactaagaaaacatctaatgaaaagaacaaggtcaaaaaccaaatacagtctatggatgatgttgatgacttaactcagtcatctgaaacagcctcagaggattgtgagctaccccactctagttacaagaattttatgttgctcattgaacaacttggaatggagtgtaaagattctgttagcctattgaaaatccaggatgcagctctttcatgtgaaagattattagaacttaaaaaaaatcactgtgaactacttacagtaaaaattaaaaaaatggaagacaaggttaatgtactacaaagggagctatctgaaacaaaagaaataaaatcacagttagagcatcaaaaagttgaatgggaacgagaactgtgctctttgagatttagcttaaaccaagaagaagagaagagaagaaatgctgatacgttgtatgaaaaaattagggaacagttaagaagaaaagaagagcaatataggaaagaagttgaagtgaaacaacagcttgaactgagtctccaaacactggagatggaattgaggactgtaaaaagtaatttgaatcaggtcgttcaagagcgaaatgacgctcagaggcaactttctcgagaacagaatgccagaatgttacaagatggaattctgaccaatcacctttccaaacaaaaggagattgaaatggctcaaaagaaaatgaattctgagaattctcatagtcatgaagaagaaaaagacctatcgcataaaaatagcatgttgcaggaagaaattgctatgctaagactagaaatagacacaataaaaaatcaaaaccaggaaaaagaaaagaaatgttttgaggaccttaaaattgtaaaagaaaagaatgaagaccttcagaagactataaaacagaatgaggaaacattaacacaaacaatatcccagtataatggacggcttagtgttctgacagctgagaatgcaatgctaaattctaaactggagaatgaaaagcaaagcaaggaaagactggaagcagaagttgaatcataccattctagattggctgctgctatacatgatcgtgatcaaagtgagacatcaaaaagagaactagaacttgctttccagagagcaagagatgaatgttctcgtttacaggacaaaatgaattttgatgtgtctaacctaaaagataacaatgagattctttctcaacaactatttaaaactgaaagtaaactcaatagcctagaaattgagttccatcacacgagagatgccctcagagaaaagactttgggtttagaacgggtacaaaaggacctaagccaaacacagtgtcaaatgaaggaaatggaacaaaagtatcaaaatgaacaagttaaagtgaataaatacattggaaagcaggagtctgtagaggagagattgtctcaactacaaagtgagaatatgttgcttcgacaacaactggatgatgcccacaacaaggctgacaataaagagaagacagtgattaatatccaagaccagtttcatgctattgtgcaaaaacttcaagctgagagtgaaaagcaaagtcttctgctagaagaaagaaataaggagttaatcagtgaatgtaatcacttaaaagaaagacagtatcaatatgaaaatgaaaaggcagaaagagaagttgttgtgagacaacttcaacaagaactagctgataccctaaaaaaacaatctatgtcagaggcttcactggaggttacgtcacgttatcgtattaatttagaagatgagacacaggatttaaagaagaaattaggtcaaatcagaaatcaattgcaagaagcacaggatcgacatacagaagctgtcagatgtgctgagaagatgcaagatcacaagcaaaagcttgaaaaagataatgccaagttaaaagttacagtcaaaaagcaaatggacaaaattgaggagcttcagaaaaacctgttaaatgcaaatttgtctgaagatgaaaaggaacaattaaagaaacttatggaattaaaacagtcactggaatgtaatttggatcaagaaatgaagaaaaatgttgaattagaaagagagataactggatttaagaacctcttaaaaatgacaagaaagaagttaaatgaatatgaaaatggagaatttagtttccatggagatttaaaaactagtcaatttgaaatggatattcagattaataagctaaaacataagattgatgatcttacagcagaactggagactgcaggttcaaaatgtctacatctggatacaaagaaccaaattcttcaagaggagttgttatctatgaaaacagtacaaaagaaatgtgaaaaactacagaagaataaaaagaagttggaacaagaagtgatcaacctgagaagtcatatagaaaggaatatggtagaacttggtcaagtcaaacagtataaacaggagattgaagaaagagcaagacaggaaatagcagaaaaattaaaagaagtcaatctatttttacaggcacaagcagcatctcaagaaaacttagagcagtttagagagaataattttgcttcaatgaaaagtcagatggaactcagaattaaagatctggaatctgaactctccaaaataaaaacttctcaagaagactttaataaaaccgaactggaaaaatataagcaactctatctagaagaattaaaagttagaaaatctttgtcaagtaaactaaccaaaactaatgagaggctagcagaggtcaacaccaaacttcttgtggaaaaacagcagagcagatctttgttcaccactctcactaccaggccagtcatggagccaccttgtgtgggaaatcttaataatagtttagatctcaacagaaaacttattccaagagaaaacttagtgatctctacctcaaatccacgggcttcaaataatagcatggagaactacttgagcaagatgcagcaggagttggaaaaaaatataactagagaactcaaagaagctgctgctgaattggaatctggatcaatagcttcccctctagggtctactgatgagtcaaatctaaatcaagatctagtttggaaagcatcaagagaatatgtacaggttttaaagaaaaattatatgatctgaaagataagattttattactgggctgtttatgtgacattttgtttctcattaaatattaatatatgacatgtaaaaatattaaaggaacgtatttttgtatcatatatgtcagatcaaaatttatatagtattttaaacaatgttacttggcttctttaacttttaagtggattttgccaatgaaaaccaggaatattgagttttacatactcaaactgcccaaatgtgagctgtttaaacagccaaaccactaagttgtcattaatactttagtgcagttaattgatggcttatttgtattttgtaatttttatcactatatgtagtggtagatgtctaattggacttagacatcattttgttgtgcaggaactgtggtcattgttcatgtttggatgtattacaattgttacagtgccatcaaatttacataattttaattttaagcactgatttatatagctgttctcagggagaaacaagatttgcctgattcaccttttctgtttgtttatttatttttaattaaccttttggaaatagccttcagtttagagaaaatttcgaagttttagtacaaagactttctcctccgaacaatttgagagtaaattgctgacattatgtcatcacccctgattactttagtgggcattcctacaagtcaggacattctacataactacagtgcaaaccttgcaatcagaaagtcaacattaatacattctagtttgttacttctctgtaatgtcctttatagcaaaaggatcccattctaatccatggcttgtatttagttgttgtatctgttagatctttcagtctggaacagttcctcagtctttccttgaccttcatgaccttgaatattttgaagagtaaagtctggtaatataagaatgtccctcaattgggtttcatggtgattagatttagattatatgattttttggcaggagtatcacagaagtgacccagtgatcttctcattgcatcttacctgtgaccctacagttttgatttgccctgttactggtaatgttagcattgatcactaacagtggtatctgctgaatttctcctctgtaatgttattttttcaccttgtggttaattagtattttacagggaggtaatttgagactatgtacatatctctactccccatcgaaccctcaatttattcatttgcttgtatcaaataaaccatggattcatggtttattttattcagtgagttataattcattaatattgttattaaaaatttgtttttcttttaagaaatgttatattttgacaacttcagacttacagaaagattataagaggtagtacaaataatttttggatattattccccaaatgttaacattttactgcatttactttatcctttctcccccttctcctcctgtctttctagatgaatatgaatataggtacttaatacagattttttttctaaactgtt

SEQ ID NO: 299218 - DNA, 6846 bp, Homo sapiens
gtctagcgggatcgcttgcttggtaacccggagggagagattggaaaccgcggagtttcctttgggaggctgcggccagccggggctgacttgttatgttgggctccggaggccgttaagagccgagagagacatgaggtgtctctgaagcccggtcgcctgggccatgaagaagatttttagtaagaagggcgagtcgcccttgggctccttcgcgcggcggcggaggagcagcgcgggaggcgggggcgagccgggggagggcgcctactcgcagcccggctaccacgtccgagaccgagatctcggcaagatccacaaagctgccagcgcgggtaatgtggcgaaagtgcagcagatccttttgctcaggaagaatggcttgaacgatagagacaagatgaacaggacggctctacatttggcctgtgccaatggtcatccagaagtagtaactctcctggtggacagaaaatgccagctcaatgtctgtgacaacgaaaacaggacagctctgatgaaggctgtacaatgccaggaagagaaatgtgcaactattctgctagaacatggtgctgatccaaatcttgcggatgtccatggcaacactgctcttcactatgctgtctataatgaggacatatcagtagcaacaaagctgcttttgtatgatgcaaatattgaagcaaaaaacaaggatgacctcacaccacttttacttgcagtaagtggaaaaaagcagcaaatggtggaatttttaataaagaaaaaagcaaatgtaaatgcagtagataagttggaaagcagtcaccaactaatttcagaatataaagaagaaaggatacctaaacattcttctcaaaatagtaattcagtggatgaaagctctgaagactccttaagcaggctttctggcaaaccgggtgttgatgattcatggcctacctcagatgacgaagacctcaattttgatactaagaatgtcccaaaaccaagcttagcaaagctaatgactgcttctcagcaatccaggaaaaatttagaagcaacatatggcactgtgagaacaggaaatagaactttgtttgaggatagagattccgatagtcaagatgaagttgtggttgaaagccttcctacaacatcaatcaaagtccagtgcttttctcatcctacctatcaatcacctgaccttcttccaaaaccttcccacaagtcgttagcaaaccctggtcttatgaaggaagaaccaacaaagccaggcattgcaaaaaaagaaaatggtattgatattattgaaagtgctccactagagcaaacaaataatgacaatttgacttatgttgatgaagtgcacaaaaataatagaagtgatatgatgtccgcattaggattaggacaagaggaagatatagaatcaccttgggattctgagagtatctctgagaattttccacagaagtatgttgatcctttagctggggctgcagacggaaaagaaaaaaatataggaaatgaacaagcagaagatgtgttttatataccttcttgcatgagtggatcaagaaactttaagatggctaaactagaggatacaagaaatgtaggcatgccagtagcccacatggagtctcctgagagatatcttcacttgaagcctaccattgaaatgaaagattctgttccaaataaagcaggaggaatgaaggatgtacaaacatccaaagcagctgaacatgacttagaagtagcatcagaagaagagcaagaaagggaagggagtgaaaataaccagccacaggttgaagaagaaaggaaaaaacacagaaataatgaaatggaagtatcagcaaacatacatgatggtgctactgatgatgctgaagatgatgatgatgatgatggattaattcaaaaaagaaagagtggagaaactgatcatcagcaatttcccaggaaggaaaataaagagtatgctagtggtcctgccttgcaaatgaaggaagtaaagagcactgaaaaagaaaaacggacctcgaaagaatctgtgaattcaccagtgtttgggaaggccagtttactaactggtggcctgctacaagtggatgatgacagcagtttaagtgaaatagatgaggatgaaggaaggcctactaagaaaacatctaatgaaaagaacaaggtcaaaaaccaaatacagtctatggatgatgttgatgacttaactcagtcatctgaaacagcctcagaggattgtgagctaccccactctagttacaagaattttatgttgctcattgaacaacttggaatggagtgtaaagattctgttagcctattgaaaatccaggatgcagctctttcatgtgaaagattattagaacttaaaaaaaatcactgtgaactacttacagtaaaaattaaaaaaatggaagacaaggttaatgtactacaaagggagctatctgaaacaaaagaaataaaatcacagttagagcatcaaaaagttgaatgggaacgagaactgtgctctttgagatttagcttaaaccaagaagaagagaagagaagaaatgctgatacgttgtatgaaaaaattagggaacagttaagaagaaaagaagagcaatataggaaagaagttgaagtgaaacaacagcttgaactgagtctccaaacactggagatggaattgaggactgtaaaaagtaatttgaatcaggtcgttcaagagcgaaatgacgctcagaggcaactttctcgagaacagaatgccagaatgttacaagatggaattctgaccaatcacctttccaaacaaaaggagattgaaatggctcaaaagaaaatgaattctgagaattctcatagtcatgaagaagaaaaagacctatcgcataaaaatagcatgttgcaggaagaaattgctatgctaagactagaaatagacacaataaaaaatcaaaaccaggaaaaagaaaagaaatgttttgaggaccttaaaattgtaaaagaaaagaatgaagaccttcagaagactataaaacagaatgaggaaacattaacacaaacaatatcccagtataatggacggcttagtgttctgacagctgagaatgcaatgctaaattctaaactggagaatgaaaagcaaagcaaggaaagactggaagcagaagttgaatcataccattctagattggctgctgctatacatgatcgtgatcaaagtgagacatcaaaaagagaactagaacttgctttccagagagcaagagatgaatgttctcgtttacaggacaaaatgaattttgatgtgtctaacctaaaagataacaatgagattctttctcaacaactatttaaaactgaaagtaaactcaatagcctagaaattgagttccatcacacgagagatgccctcagagaaaagactttgggtttagaacgggtacaaaaggacctaagccaaacacagtgtcaaatgaaggaaatggaacaaaagtatcaaaatgaacaagttaaagtgaataaatacattggaaagcaggagtctgtagaggagagattgtctcaactacaaagtgagaatatgttgcttcgacaacaactggatgatgcccacaacaaggctgacaataaagagaagacagtgattaatatccaagaccagtttcatgctattgtgcaaaaacttcaagctgagagtgaaaagcaaagtcttctgctagaagaaagaaataaggagttaatcagtgaatgtaatcacttaaaagaaagacagtatcaatatgaaaatgaaaaggcagaaagagaagttgttgtgagacaacttcaacaagaactagctgataccctaaaaaaacaatctatgtcagaggcttcactggaggttacgtcacgttatcgtattaatttagaagatgagacacaggatttaaagaagaaattaggtcaaatcagaaatcaattgcaagaagcacaggatcgacatacagaagctgtcagatgtgctgagaagatgcaagatcacaagcaaaagcttgaaaaagataatgccaagttaaaagttacagtcaaaaagcaaatggacaaaattgaggagcttcagaaaaacctgttaaatgcaaatttgtctgaagatgaaaaggaacaattaaagaaacttatggaattaaaacagtcactggaatgtaatttggatcaagaaatgaagaaaaatgttgaattagaaagagagataactggatttaagaacctcttaaaaatgacaagaaagaagttaaatgaatatgaaaatggagaatttagtttccatggagatttaaaaactagtcaatttgaaatggatattcagattaataagctaaaacataagattgatgatcttacagcagaactggagactgcaggttcaaaatgtctacatctggatacaaagaaccaaattcttcaagaggagttgttatctatgaaaacagtacaaaagaaatgtgaaaaactacagaagaataaaaagaagttggaacaagaagtgatcaacctgagaagtcatatagaaaggaatatggtagaacttggtcaagtcaaacagtataaacaggagattgaagaaagagcaagacaggaaatagcagaaaaattaaaagaagtcaatctatttttacaggcacaagcagcatctcaagaaaacttagagcagtttagagagaataattttgcttcaatgaaaagtcagatggaactcagaattaaagatctggaatctgaactctccaaaataaaaacttctcaagaagactttaataaaaccgaactggaaaaatataagcaactctatctagaagaattaaaagttagaaaatctttgtcaagtaaactaaccaaaactaatgagaggctagcagaggtcaacaccaaacttcttgtggaaaaacagcagagcagatctttgttcaccactctcactaccaggccagtcatggagccaccttgtgtgggaaatcttaataatagtttagatctcaacagaaaacttattccaagagaaaacttagtgatctctacctcaaatccacgggcttcaaataatagcatggagaactacttgagcaagatgcagcaggagttggaaaaaaatataactagagaactcaaagaagctgctgctgaattggaatctggatcaatagcttcccctctagggtctactgatgagtcaaatctaaatcaagatctagtttggaaagcatcaagagaatatgtacaggttttaaagaaaaattatatgatctgaaagataagattttattactgggctgtttatgtgacattttgtttctcattaaatattaatatatgacatgtaaaaatattaaaggaacgtatttttgtatcatatatgtcagatcaaaatttatatagtattttaaacaatgttacttggcttctttaacttttaagtggattttgccaatgaaaaccaggaatattgagttttacatactcaaactgcccaaatgtgagctgtttaaacagccaaaccactaagttgtcattaatactttagtgcagttaattgatggcttatttgtattttgtaatttttatcactatatgtagtggtagatgtctaattggacttagacatcattttgttgtgcaggaactgtggtcattgttcatgtttggatgtattacaattgttacagtgccatcaaatttacataattttaattttaagcactgatttatatagctgttctcagggagaaacaagatttgcctgattcaccttttctgtttgtttatttatttttaattaaccttttggaaatagccttcagtttagagaaaatttcgaagttttagtacaaagactttctcctccgaacaatttgagagtaaattgctgacattatgtcatcacccctgattactttagtgggcattcctacaagtcaggacattctacataactacagtgcaaaccttgcaatcagaaagtcaacattaatacattctagtttgttacttctctgtaatgtcctttatagcaaaaggatcccattctaatccatggcttgtatttagttgttgtatctgttagatctttcagtctggaacagttcctcagtctttccttgaccttcatgaccttgaatattttgaagagtaaagtctggtaatataagaatgtccctcaattgggtttcatggtgattagatttagattatatgattttttggcaggagtatcacagaagtgacccagtgatcttctcattgcatcttacctgtgaccctacagttttgatttgccctgttactggtaatgttagcattgatcactaacagtggtatctgctgaatttctcctctgtaatgttattttttcaccttgtggttaattagtattttacagggaggtaatttgagactatgtacatatctctactccccatcgaaccctcaatttattcatttgcttgtatcaaataaaccatggattcatggtttattttattcagtgagttataattcattaatattgttattaaaaatttgtttttcttttaagaaatgttatattttgacaacttcagacttacagaaagattataagaggtagtacaaataatttttggatattattccccaaatgttaacattttactgcatttactttatcctttctcccccttctcctcctgtctttctagatgaatatgaatataggtacttaatacagattttttttctaaactgtttgtaggttgcagacacgatgcctctttatttctaaataatgtgtatttcctaaataaaaggaattaccttacataa

SEQ ID NO: 299219 - DNA, 6889 bp, Homo sapiens
gtctagcgggatcgcttgcttggtaacccggagggagagattggaaaccgcggagtttcctttgggaggctgcggccagccggggctgacttgttatgttgggctccggaggccgttaagagccgagagagacatgaggtgtctctgaagcccggtcgcctgggccatgaagaagatttttagtaagaagggcgagtcgcccttgggctccttcgcgcggcggcggaggagcagcgcgggaggcgggggcgagccgggggagggcgcctactcgcagcccggctaccacgtccgagaccgagatctcggcaagatccacaaagctgccagcgcgggtaatgtggcgaaagtgcagcagatccttttgctcaggaagaatggcttgaacgatagagacaagatgaacaggacggctctacatttggcctgtgccaatggtcatccagaagtagtaactctcctggtggacagaaaatgccagctcaatgtctgtgacaacgaaaacaggacagctctgatgaaggctgtacaatgccaggaagagaaatgtgcaactattctgctagaacatggtgctgatccaaatcttgcggatgtccatggcaacactgctcttcactatgctgtctataatgaggacatatcagtagcaacaaagctgcttttgtatgatgcaaatattgaagcaaaaaacaaggatgacctcacaccacttttacttgcagtaagtggaaaaaagcagcaaatggtggaatttttaataaagaaaaaagcaaatgtaaatgcagtagataagttggaaagcagtcaccaactaatttcagaatataaagaagaaaggatacctaaacattcttctcaaaatagtaattcagtggatgaaagctctgaagactccttaagcaggctttctggcaaaccgggtgttgatgattcatggcctacctcagatgacgaagacctcaattttgatactaagaatgtcccaaaaccaagcttagcaaagctaatgactgcttctcagcaatccaggaaaaatttagaagcaacatatggcactgtgagaacaggaaatagaactttgtttgaggatagagattccgatagtcaagatgaagttgtggttgaaagccttcctacaacatcaatcaaagtccagtgcttttctcatcctacctatcaatcacctgaccttcttccaaaaccttcccacaagtcgttagcaaaccctggtcttatgaaggaagaaccaacaaagccaggcattgcaaaaaaagaaaatggtattgatattattgaaagtgctccactagagcaaacaaataatgacaatttgacttatgttgatgaagtgcacaaaaataatagaagtgatatgatgtccgcattaggattaggacaagaggaagatatagaatcaccttgggattctgagagtatctctgagaattttccacagaagtatgttgatcctttagctggggctgcagacggaaaagaaaaaaatataggaaatgaacaagcagaagatgtgttttatataccttcttgcatgagtggatcaagaaactttaagatggctaaactagaggatacaagaaatgtaggcatgccagtagcccacatggagtctcctgagagatatcttcacttgaagcctaccattgaaatgaaagattctgttccaaataaagcaggaggaatgaaggatgtacaaacatccaaagcagctgaacatgacttagaagtagcatcagaagaagagcaagaaagggaagggagtgaaaataaccagccacaggttgaagaagaaaggaaaaaacacagaaataatgaaatggaagtatcagcaaacatacatgatggtgctactgatgatgctgaagatgatgatgatgatgatggattaattcaaaaaagaaagagtggagaaactgatcatcagcaatttcccaggaaggaaaataaagagtatgctagtggtcctgccttgcaaatgaaggaagtaaagagcactgaaaaagaaaaacggacctcgaaagaatctgtgaattcaccagtgtttgggaaggccagtttactaactggtggcctgctacaagtggatgatgacagcagtttaagtgaaatagatgaggatgaaggaaggcctactaagaaaacatctaatgaaaagaacaaggtcaaaaaccaaatacagtctatggatgatgttgatgacttaactcagtcatctgaaacagcctcagaggattgtgagctaccccactctagttacaagaattttatgttgctcattgaacaacttggaatggagtgtaaagattctgttagcctattgaaaatccaggatgcagctctttcatgtgaaagattattagaacttaaaaaaaatcactgtgaactacttacagtaaaaattaaaaaaatggaagacaaggttaatgtactacaaagggagctatctgaaacaaaagaaataaaatcacagttagagcatcaaaaagttgaatgggaacgagaactgtgctctttgagatttagcttaaaccaagaagaagagaagagaagaaatgctgatacgttgtatgaaaaaattagggaacagttaagaagaaaagaagagcaatataggaaagaagttgaagtgaaacaacagcttgaactgagtctccaaacactggagatggaattgaggactgtaaaaagtaatttgaatcaggtttaaaacaaaactgttatctcaagctgacctgtgacctttataactaaaattattcatgataaatcttggcacctaatagatgcttagtctctgttttctgaatgaaggaatggagggtcgttcaagagcgaaatgacgctcagaggcaactttctcgagaacagaatgccagaatgttacaagatggaattctgaccaatcacctttccaaacaaaaggagattgaaatggctcaaaagaaaatgaattctgagaattctcatagtcatgaagaagaaaaagacctatcgcataaaaatagcatgttgcaggaagaaattgctatgctaagactagaaatagacacaataaaaaatcaaaaccaggaaaaagaaaagaaatgttttgaggaccttaaaattgtaaaagaaaagaatgaagaccttcagaagactataaaacagaatgaggaaacattaacacaaacaatatcccagtataatggacggcttagtgttctgacagctgagaatgcaatgctaaattctaaactggagaatgaaaagcaaagcaaggaaagactggaagcagaagttgaatcataccattctagattggctgctgctatacatgatcgtgatcaaagtgagacatcaaaaagagaactagaacttgctttccagagagcaagagatgaatgttctcgtttacaggacaaaatgaattttgatgtgtctaacctaaaagataacaatgagattctttctcaacaactatttaaaactgaaagtaaactcaatagcctagaaattgagttccatcacacgagagatgccctcagagaaaagactttgggtttagaacgggtacaaaaggacctaagccaaacacagtgtcaaatgaaggaaatggaacaaaagtatcaaaatgaacaagttaaagtgaataaatacattggaaagcaggagtctgtagaggagagattgtctcaactacaaagtgagaatatgttgcttcgacaacaactggatgatgcccacaacaaggctgacaataaagagaagacagtgattaatatccaagaccagtttcatgctattgtgcaaaaacttcaagctgagagtgaaaagcaaagtcttctgctagaagaaagaaataaggagttaatcagtgaatgtaatcacttaaaagaaagacagtatcaatatgaaaatgaaaaggcagaaagagaagttgttgtgagacaacttcaacaagaactagctgataccctaaaaaaacaatctatgtcagaggcttcactggaggttacgtcacgttatcgtattaatttagaagatgagacacaggatttaaagaagaaattaggtcaaatcagaaatcaattgcaagaagcacaggatcgacatacagaagctgtcagatgtgctgagaagatgcaagatcacaagcaaaagcttgaaaaagataatgccaagttaaaagttacagtcaaaaagcaaatggacaaaattgaggagcttcagaaaaacctgttaaatgcaaatttgtctgaagatgaaaaggaacaattaaagaaacttatggaattaaaacagtcactggaatgtaatttggatcaagaaatgaagaaaaatgttgaattagaaagagagataactggatttaagaacctcttaaaaatgacaagaaagaagttaaatgaatatgaaaatggagaatttagtttccatggagatttaaaaactagtcaatttgaaatggatattcagattaataagctaaaacataagattgatgatcttacagcagaactggagactgcaggttcaaaatgtctacatctggatacaaagaaccaaattcttcaagaggagttgttatctatgaaaacagtacaaaagaaatgtgaaaaactacagaagaataaaaagaagttggaacaagaagtgatcaacctgagaagtcatatagaaaggaatatggtagaacttggtcaagtcaaacagtataaacaggagattgaagaaagagcaagacaggaaatagcagaaaaattaaaagaagtcaatctatttttacaggcacaagcagcatctcaagaaaacttagagcagtttagagagaataattttgcttcaatgaaaagtcagatggaactcagaattaaagatctggaatctgaactctccaaaataaaaacttctcaagaagactttaataaaaccgaactggaaaaatataagcaactctatctagaagaattaaaagttagaaaatctttgtcaagtaaactaaccaaaactaatgagaggctagcagaggtcaacaccaaacttcttgtggaaaaacagcagagcagatctttgttcaccactctcactaccaggccagtcatggagccaccttgtgtgggaaatcttaataatagtttagatctcaacagaaaacttattccaagagaaaacttagtgatctctacctcaaatccacgggcttcaaataatagcatggagaactacttgagcaagatgcagcaggagttggaaaaaaatataactagagaactcaaagaagctgctgctgaattggaatctggatcaatagcttcccctctagggtctactgatgagtcaaatctaaatcaagatctagtttggaaagcatcaagagaatatgtacaggttttaaagaaaaattatatgatctgaaagataagattttattactgggctgtttatgtgacattttgtttctcattaaatattaatatatgacatgtaaaaatattaaaggaacgtatttttgtatcatatatgtcagatcaaaatttatatagtattttaaacaatgttacttggcttctttaacttttaagtggattttgccaatgaaaaccaggaatattgagttttacatactcaaactgcccaaatgtgagctgtttaaacagccaaaccactaagttgtcattaatactttagtgcagttaattgatggcttatttgtattttgtaatttttatcactatatgtagtggtagatgtctaattggacttagacatcattttgttgtgcaggaactgtggtcattgttcatgtttggatgtattacaattgttacagtgccatcaaatttacataattttaattttaagcactgatttatatagctgttctcagggagaaacaagatttgcctgattcaccttttctgtttgtttatttatttttaattaaccttttggaaatagccttcagtttagagaaaatttcgaagttttagtacaaagactttctcctccgaacaatttgagagtaaattgctgacattatgtcatcacccctgattactttagtgggcattcctacaagtcaggacattctacataactacagtgcaaaccttgcaatcagaaagtcaacattaatacattctagtttgttacttctctgtaatgtcctttatagcaaaaggatcccattctaatccatggcttgtatttagttgttgtatctgttagatctttcagtctggaacagttcctcagtctttccttgaccttcatgaccttgaatattttgaagagtaaagtctggtaatataagaatgtccctcaattgggtttcatggtgattagatttagattatatgattttttggcaggagtatcacagaagtgacccagtgatcttctcattgcatcttacctgtgaccctacagttttgatttgccctgttactggtaatgttagcattgatcactaacagtggtatctgctgaatttctcctctgtaatgttattttttcaccttgtggttaattagtattttacagggaggtaatttgagactatgtacatatctctactccccatcgaaccctcaatttattcatttgcttgtatcaaataaaccatggattcatggtttattttattcagtgagttataattcattaatattgttattaaaaatttgtttttcttttaagaaatgttatattttgacaacttcagacttacagaaagattataagaggtagtacaaataatttttggatattattccccaaatgttaacattttactgcatttactttatcctttctcccccttctcctcctgtctttctagatgaatatgaatataggtacttaatacagattttttttctaaactgtt

SEQ ID NO: 299220 - DNA, 6798 bp, Homo sapiens
gtctagcgggatcgcttgcttggtaacccggagggagagattggaaaccgcggagtttcctttgggaggctgcggccagccggggctgacttgttatgttgggctccggaggccgttaagagccgagagagacatgaggtgtctctgaagcccggtcgcctgggccatgaagaagatttttagtaagaagggcgagtcgcccttgggctccttcgcgcggcggcggaggagcagcgcgggaggcgggggcgagccgggggagggcgcctactcgcagcccggctaccacgtccgagaccgagatctcggcaagatccacaaagctgccagcgcgggtaatgtggcgaaagtgcagcagatccttttgctcaggaagaatggcttgaacgatagagacaagatgaacaggacggctctacatttggcctgtgccaatggtcatccagaagtagtaactctcctggtggacagaaaatgccagctcaatgtctgtgacaacgaaaacaggacagctctgatgaaggctgtacaatgccaggaagagaaatgtgcaactattctgctagaacatggtgctgatccaaatcttgcggatgtccatggcaacactgctcttcactatgctgtctataatgaggacatatcagtagcaacaaagctgcttttgtatgatgcaaatattgaagcaaaaaacaaggatgacctcacaccacttttacttgcagtaagtggaaaaaagcagcaaatggtggaatttttaataaagaaaaaagcaaatgtaaatgcagtagataagttggaaagcagtcaccaactaatttcagaatataaagaagaaaggatacctaaacattcttctcaaaatagtaattcagtggatgaaagctctgaagactccttaagcaggctttctggcaaaccgggtgttgatgattcatggcctacctcagatgacgaagacctcaattttgatactaagaatgtcccaaaaccaagcttagcaaagctaatgactgcttctcagcaatccaggaaaaatttagaagcaacatatggcactgtgagaacaggaaatagaactttgtttgaggatagagattccgatagtcaagatgaagttgtggttgaaagccttcctacaacatcaatcaaagtccagtgcttttctcatcctacctatcaatcacctgaccttcttccaaaaccttcccacaagtcgttagcaaaccctggtcttatgaaggaagaaccaacaaagccaggcattgcaaaaaaagaaaatggtattgatattattgaaagtgctccactagagcaaacaaataatgacaatttgacttatgttgatgaagtgcacaaaaataatagaagtgatatgatgtccgcattaggattaggacaagaggaagatatagaatcaccttgggattctgagagtatctctgagaattttccacagaagtatgttgatcctttagctggggctgcagacggaaaagaaaaaaatataggaaatgaacaagcagaagatgtgttttatataccttcttgcatgagtggatcaagaaactttaagatggctaaactagaggatacaagaaatgtaggcatgccagtagcccacatggagtctcctgagagatatcttcacttgaagcctaccattgaaatgaaagattctgttccaaataaagcaggaggaatgaaggatgtacaaacatccaaagcagctgaacatgacttagaagtagcatcagaagaagagcaagaaagggaagggagtgaaaataaccagccacaggttgaagaagaaaggaaaaaacacagaaataatgaaatggaagtatcagcaaacatacatgatggtgctactgatgatgctgaagatgatgatgatgatgatggattaattcaaaaaagaaagagtggagaaactgatcatcagcaatttcccaggaaggaaaataaagagtatgctagtggtcctgccttgcaaatgaaggaagtaaagagcactgaaaaagaaaaacggacctcgaaagaatctgtgaattcaccagtgtttgggaaggccagtttactaactggtggcctgctacaagtggatgatgacagcagtttaagtgaaatagatgaggatgaaggaaggcctactaagaaaacatctaatgaaaagaacaaggtcaaaaaccaaatacagtctatggatgatgttgatgacttaactcagtcatctgaaacagcctcagaggattgtgagctaccccactctagttacaagaattttatgttgctcattgaacaacttggaatggagtgtaaagattctgttagcctattgaaaatccaggatgcagctctttcatgtgaaagattattagaacttaaaaaaaatcactgtgaactacttacagtaaaaattaaaaaaatggaagacaaggttaatgtactacaaagggagctatctgaaacaaaagaaataaaatcacagttagagcatcaaaaagttgaatgggaacgagaactgtgctctttgagattttaagataaacatatttaactgcagatttagcttaaaccaagaagaagagaagagaagaaatgctgatacgttgtatgaaaaaattagggaacagttaagaagaaaagaagagcaatataggaaagaagttgaagtgaaacaacagcttgaactgagtctccaaacactggagatggaattgaggactgtaaaaagtaatttgaatcaggtcgttcaagagcgaaatgacgctcagaggcaactttctcgagaacagaatgccagaatgttacaagatggaattctgaccaatcacctttccaaacaaaaggagattgaaatggctcaaaagaaaatgaattctgagaattctcatagtcatgaagaagaaaaagacctatcgcataaaaatagcatgttgcaggaagaaattgctatgctaagactagaaatagacacaataaaaaatcaaaaccaggaaaaagaaaagaaatgttttgaggaccttaaaattgtaaaagaaaagaatgaagaccttcagaagactataaaacagaatgaggaaacattaacacaaacaatatcccagtataatggacggcttagtgttctgacagctgagaatgcaatgctaaattctaaactggagaatgaaaagcaaagcaaggaaagactggaagcagaagttgaatcataccattctagattggctgctgctatacatgatcgtgatcaaagtgagacatcaaaaagagaactagaacttgctttccagagagcaagagatgaatgttctcgtttacaggacaaaatgaattttgatgtgtctaacctaaaagataacaatgagattctttctcaacaactatttaaaactgaaagtaaactcaatagcctagaaattgagttccatcacacgagagatgccctcagagaaaagactttgggtttagaacgggtacaaaaggacctaagccaaacacagtgtcaaatgaaggaaatggaacaaaagtatcaaaatgaacaagttaaagtgaataaatacattggaaagcaggagtctgtagaggagagattgtctcaactacaaagtgagaatatgttgcttcgacaacaactggatgatgcccacaacaaggctgacaataaagagaagacagtgattaatatccaagaccagtttcatgctattgtgcaaaaacttcaagctgagagtgaaaagcaaagtcttctgctagaagaaagaaataaggagttaatcagtgaatgtaatcacttaaaagaaagacagtatcaatatgaaaatgaaaaggcagaaagagaagttgttgtgagacaacttcaacaagaactagctgataccctaaaaaaacaatctatgtcagaggcttcactggaggttacgtcacgttatcgtattaatttagaagatgagacacaggatttaaagaagaaattaggtcaaatcagaaatcaattgcaagaagcacaggatcgacatacagaagctgtcagatgtgctgagaagatgcaagatcacaagcaaaagcttgaaaaagataatgccaagttaaaagttacagtcaaaaagcaaatggacaaaattgaggagcttcagaaaaacctgttaaatgcaaatttgtctgaagatgaaaaggaacaattaaagaaacttatggaattaaaacagtcactggaatgtaatttggatcaagaaatgaagaaaaatgttgaattagaaagagagataactggatttaagaacctcttaaaaatgacaagaaagaagttaaatgaatatgaaaatggagaatttagtttccatggagatttaaaaactagtcaatttgaaatggatattcagattaataagctaaaacataagattgatgatcttacagcagaactggagactgcaggttcaaaatgtctacatctggatacaaagaaccaaattcttcaagaggagttgttatctatgaaaacagtacaaaagaaatgtgaaaaactacagaagaataaaaagaagttggaacaagaagtgatcaacctgagaagtcatatagaaaggaatatggtagaacttggtcaagtcaaacagtataaacaggagattgaagaaagagcaagacaggaaatagcagaaaaattaaaagaagtcaatctatttttacaggcacaagcagcatctcaagaaaacttagagcagtttagagagaataattttgcttcaatgaaaagtcagatggaactcagaattaaagatctggaatctgaactctccaaaataaaaacttctcaagaagactttaataaaaccgaactggaaaaatataagcaactctatctagaagaattaaaagttagaaaatctttgtcaagtaaactaaccaaaactaatgagaggctagcagaggtcaacaccaaacttcttgtggaaaaacagcagagcagatctttgttcaccactctcactaccaggccagtcatggagccaccttgtgtgggaaatcttaataatagtttagatctcaacagaaaacttattccaagagaaaacttagtgatctctacctcaaatccacgggcttcaaataatagcatggagaactacttgagcaagatgcagcaggagttggaaaaaaatataactagagaactcaaagaagctgctgctgaattggaatctggatcaatagcttcccctctagggtctactgatgagtcaaatctaaatcaagatctagtttggaaagcatcaagagaatatgtacaggttttaaagaaaaattatatgatctgaaagataagattttattactgggctgtttatgtgacattttgtttctcattaaatattaatatatgacatgtaaaaatattaaaggaacgtatttttgtatcatatatgtcagatcaaaatttatatagtattttaaacaatgttacttggcttctttaacttttaagtggattttgccaatgaaaaccaggaatattgagttttacatactcaaactgcccaaatgtgagctgtttaaacagccaaaccactaagttgtcattaatactttagtgcagttaattgatggcttatttgtattttgtaatttttatcactatatgtagtggtagatgtctaattggacttagacatcattttgttgtgcaggaactgtggtcattgttcatgtttggatgtattacaattgttacagtgccatcaaatttacataattttaattttaagcactgatttatatagctgttctcagggagaaacaagatttgcctgattcaccttttctgtttgtttatttatttttaattaaccttttggaaatagccttcagtttagagaaaatttcgaagttttagtacaaagactttctcctccgaacaatttgagagtaaattgctgacattatgtcatcacccctgattactttagtgggcattcctacaagtcaggacattctacataactacagtgcaaaccttgcaatcagaaagtcaacattaatacattctagtttgttacttctctgtaatgtcctttatagcaaaaggatcccattctaatccatggcttgtatttagttgttgtatctgttagatctttcagtctggaacagttcctcagtctttccttgaccttcatgaccttgaatattttgaagagtaaagtctggtaatataagaatgtccctcaattgggtttcatggtgattagatttagattatatgattttttggcaggagtatcacagaagtgacccagtgatcttctcattgcatcttacctgtgaccctacagttttgatttgccctgttactggtaatgttagcattgatcactaacagtggtatctgctgaatttctcctctgtaatgttattttttcaccttgtggttaattagtattttacagggaggtaatttgagactatgtacatatctctactccccatcgaaccctcaatttattcatttgcttgtatcaaataaaccatggattcatggtttattttattcagtgagttataattcattaatattgttattaaaaatttgtttttcttttaagaaatgttatattttgacaacttcagacttacagaaagattataagaggtagtacaaataatttttggatattattccccaaatgttaacattttactgcatttactttatcctttctcccccttctcctcctgtctttctagatgaatatgaatataggtacttaatacagattttttttctaaactgtt

SEQ ID NO: 299221 - DNA, 5962 bp, Homo sapiens
tttttggagggggcatccagattgaaaattgtaagctggtttttgttttgtttttaaagaaatgaattcactcatttttctatatttttgttctaaaggctttctggcaaaccgggtgttgatgattcatggcctacctcagatgacgaagacctcaattttgatactaagaatgtcccaaaaccaagcttagcaaagctaatgactgcttctcagcaatccaggaaaaatttagaagcaacatatggcactgtgagaacaggaaatagaactttgtttgaggatagagattccgatagtcaagatgaagttgtggttgaaagccttcctacaacatcaatcaaagtccagtgcttttctcatcctacctatcaatcacctgaccttcttccaaaaccttcccacaagtcgttagcaaaccctggtcttatgaaggaagaaccaacaaagccaggcattgcaaaaaaagaaaatggtattgatattattgaaagtgctccactagagcaaacaaataatgacaatttgacttatgttgatgaagtgcacaaaaataatagaagtgatatgatgtccgcattaggattaggacaagaggaagatatagaatcaccttgggattctgagagtatctctgagaattttccacagaagtatgttgatcctttagctggggctgcagacggaaaagaaaaaaatataggaaatgaacaagcagaagatgtgttttatataccttcttgcatgagtggatcaagaaactttaagatggctaaactagaggatacaagaaatgtaggcatgccagtagcccacatggagtctcctgagagatatcttcacttgaagcctaccattgaaatgaaagattctgttccaaataaagcaggaggaatgaaggatgtacaaacatccaaagcagctgaacatgacttagaagtagcatcagaagaagagcaagaaagggaagggagtgaaaataaccagccacaggttgaagaagaaaggaaaaaacacagaaataatgaaatggaagtatcagcaaacatacatgatggtgctactgatgatgctgaagatgatgatgatgatgatggattaattcaaaaaagaaagagtggagaaactgatcatcagcaatttcccaggaaggaaaataaagagtatgctagtggtcctgccttgcaaatgaaggaagtaaagagcactgaaaaagaaaaacggacctcgaaagaatctgtgaattcaccagtgtttgggaaggccagtttactaactggtggcctgctacaagtggatgatgacagcagtttaagtgaaatagatgaggatgaaggaaggcctactaagaaaacatctaatgaaaagaacaaggtcaaaaaccaaatacagtctatggatgatgttgatgacttaactcagtcatctgaaacagcctcagaggattgtgagctaccccactctagttacaagaattttatgttgctcattgaacaacttggaatggagtgtaaagattctgttagcctattgaaaatccaggatgcagctctttcatgtgaaagattattagaacttaaaaaaaatcactgtgaactacttacagtaaaaattaaaaaaatggaagacaaggttaatgtactacaaagggagctatctgaaacaaaagaaataaaatcacagttagagcatcaaaaagttgaatgggaacgagaactgtgctctttgagatttagcttaaaccaagaagaagagaagagaagaaatgctgatacgttgtatgaaaaaattagggaacagttaagaagaaaagaagagcaatataggaaagaagttgaagtgaaacaacagcttgaactgagtctccaaacactggagatggaattgaggactgtaaaaagtaatttgaatcaggtcgttcaagagcgaaatgacgctcagaggcaactttctcgagaacagaatgccagaatgttacaagatggaattctgaccaatcacctttccaaacaaaaggagattgaaatggctcaaaagaaaatgaattctgagaattctcatagtcatgaagaagaaaaagacctatcgcataaaaatagcatgttgcaggaagaaattgctatgctaagactagaaatagacacaataaaaaatcaaaaccaggaaaaagaaaagaaatgttttgaggaccttaaaattgtaaaagaaaagaatgaagaccttcagaagactataaaacagaatgaggaaacattaacacaaacaatatcccagtataatggacggcttagtgttctgacagctgagaatgcaatgctaaattctaaactggagaatgaaaagcaaagcaaggaaagactggaagcagaagttgaatcataccattctagattggctgctgctatacatgatcgtgatcaaagtgagacatcaaaaagagaactagaacttgctttccagagagcaagagatgaatgttctcgtttacaggacaaaatgaattttgatgtgtctaacctaaaagataacaatgagattctttctcaacaactatttaaaactgaaagtaaactcaatagcctagaaattgagttccatcacacgagagatgccctcagagaaaagactttgggtttagaacgggtacaaaaggacctaagccaaacacagtgtcaaatgaaggaaatggaacaaaagtatcaaaatgaacaagttaaagtgaataaatacattggaaagcaggagtctgtagaggagagattgtctcaactacaaagtgagaatatgttgcttcgacaacaactggatgatgcccacaacaaggctgacaataaagagaagacagtgattaatatccaagaccagtttcatgctattgtgcaaaaacttcaagctgagagtgaaaagcaaagtcttctgctagaagaaagaaataaggagttaatcagtgaatgtaatcacttaaaagaaagacagtatcaatatgaaaatgaaaaggcagaaagagaagttgttgtgagacaacttcaacaagaactagctgataccctaaaaaaacaatctatgtcagaggcttcactggaggttacgtcacgttatcgtattaatttagaagatgagacacaggatttaaagaagaaattaggtcaaatcagaaatcaattgcaagaagcacaggatcgacatacagaagctgtcagatgtgctgagaagatgcaagatcacaagcaaaagcttgaaaaagataatgccaagttaaaagttacagtcaaaaagcaaatggacaaaattgaggagcttcagaaaaacctgttaaatgcaaatttgtctgaagatgaaaaggaacaattaaagaaacttatggaattaaaacagtcactggaatgtaatttggatcaagaaatgaagaaaaatgttgaattagaaagagagataactggatttaagaacctcttaaaaatgacaagaaagaagttaaatgaatatgaaaatggagaatttagtttccatggagatttaaaaactagtcaatttgaaatggatattcagattaataagctaaaacataagattgatgatcttacagcagaactggagactgcaggttcaaaatgtctacatctggatacaaagaaccaaattcttcaagaggagttgttatctatgaaaacagtacaaaagaaatgtgaaaaactacagaagaataaaaagaagttggaacaagaagtgatcaacctgagaagtcatatagaaaggaatatggtagaacttggtcaagtcaaacagtataaacaggagattgaagaaagagcaagacaggaaatagcagaaaaattaaaagaagtcaatctatttttacaggcacaagcagcatctcaagaaaacttagagcagtttagagagaataattttgcttcaatgaaaagtcagatggaactcagaattaaagatctggaatctgaactctccaaaataaaaacttctcaagaagactttaataaaaccgaactggaaaaatataagcaactctatctagaagaattaaaagttagaaaatctttgtcaagtaaactaaccaaaactaatgagaggctagcagaggtcaacaccaaacttcttgtggaaaaacagcagagcagatctttgttcaccactctcactaccaggccagtcatggagccaccttgtgtgggaaatcttaataatagtttagatctcaacagaaaacttattccaagagaaaacttagtgatctctacctcaaatccacgggcttcaaataatagcatggagaactacttgagcaagatgcagcaggagttggaaaaaaatataactagagaactcaaagaagctgctgctgaattggaatctggatcaatagcttcccctctagggtctactgatgagtcaaatctaaatcaagatctagtttggaaagcatcaagagaatatgtacaggttttaaagaaaaattatatgatctgaaagataagattttattactgggctgtttatgtgacattttgtttctcattaaatattaatatatgacatgtaaaaatattaaaggaacgtatttttgtatcatatatgtcagatcaaaatttatatagtattttaaacaatgttacttggcttctttaacttttaagtggattttgccaatgaaaaccaggaatattgagttttacatactcaaactgcccaaatgtgagctgtttaaacagccaaaccactaagttgtcattaatactttagtgcagttaattgatggcttatttgtattttgtaatttttatcactatatgtagtggtagatgtctaattggacttagacatcattttgttgtgcaggaactgtggtcattgttcatgtttggatgtattacaattgttacagtgccatcaaatttacataattttaattttaagcactgatttatatagctgttctcagggagaaacaagatttgcctgattcaccttttctgtttgtttatttatttttaattaaccttttggaaatagccttcagtttagagaaaatttcgaagttttagtacaaagactttctcctccgaacaatttgagagtaaattgctgacattatgtcatcacccctgattactttagtgggcattcctacaagtcaggacattctacataactacagtgcaaaccttgcaatcagaaagtcaacattaatacattctagtttgttacttctctgtaatgtcctttatagcaaaaggatcccattctaatccatggcttgtatttagttgttgtatctgttagatctttcagtctggaacagttcctcagtctttccttgaccttcatgaccttgaatattttgaagagtaaagtctggtaatataagaatgtccctcaattgggtttcatggtgattagatttagattatatgattttttggcaggagtatcacagaagtgacccagtgatcttctcattgcatcttacctgtgaccctacagttttgatttgccctgttactggtaatgttagcattgatcactaacagtggtatctgctgaatttctcctctgtaatgttattttttcaccttgtggttaattagtattttacagggaggtaatttgagactatgtacatatctctactccccatcgaaccctcaatttattcatttgcttgtatcaaataaaccatggattcatggtttattttattcagtgagttataattcattaatattgttattaaaaatttgtttttcttttaagaaatgttatattttgacaacttcagacttacagaaagattataagaggtagtacaaataatttttggatattattccccaaatgttaacattttactgcatttactttatcctttctcccccttctcctcctgtctttctagatgaatatgaatataggtacttaatacagattttttttctaaactgtt

SEQ ID NO: 299222 - DNA, 5868 bp, Homo sapiens
ggcggacgggatgtgctatcagtcacctgaccttcttccaaaccttcccacaagtcgttagcaaccctggtcttatgaatgtcccaaaaccaagcttagcaaagctaatgactgcttctcagcaatccaggaaaaatttagaagcaacatatggcactgtgagaacaggaaatagaactttgtttgaggatagagattccgatagtcaagatgaagttgtggttgaaagccttcctacaacatcaatcaaagtccagtgcttttctcatcctacctatcaatcacctgaccttcttccaaaaccttcccacaagtcgttagcaaaccctggtcttatgaaggaagaaccaacaaagccaggcattgcaaaaaaagaaaatggtattgatattattgaaagtgctccactagagcaaacaaataatgacaatttgacttatgttgatgaagtgcacaaaaataatagaagtgatatgatgtccgcattaggattaggacaagaggaagatatagaatcaccttgggattctgagagtatctctgagaattttccacagaagtatgttgatcctttagctggggctgcagacggaaaagaaaaaaatataggaaatgaacaagcagaagatgtgttttatataccttcttgcatgagtggatcaagaaactttaagatggctaaactagaggatacaagaaatgtaggcatgccagtagcccacatggagtctcctgagagatatcttcacttgaagcctaccattgaaatgaaagattctgttccaaataaagcaggaggaatgaaggatgtacaaacatccaaagcagctgaacatgacttagaagtagcatcagaagaagagcaagaaagggaagggagtgaaaataaccagccacaggttgaagaagaaaggaaaaaacacagaaataatgaaatggaagtatcagcaaacatacatgatggtgctactgatgatgctgaagatgatgatgatgatgatggattaattcaaaaaagaaagagtggagaaactgatcatcagcaatttcccaggaaggaaaataaagagtatgctagtggtcctgccttgcaaatgaaggaagtaaagagcactgaaaaagaaaaacggacctcgaaagaatctgtgaattcaccagtgtttgggaaggccagtttactaactggtggcctgctacaagtggatgatgacagcagtttaagtgaaatagatgaggatgaaggaaggcctactaagaaaacatctaatgaaaagaacaaggtcaaaaaccaaatacagtctatggatgatgttgatgacttaactcagtcatctgaaacagcctcagaggattgtgagctaccccactctagttacaagaattttatgttgctcattgaacaacttggaatggagtgtaaagattctgttagcctattgaaaatccaggatgcagctctttcatgtgaaagattattagaacttaaaaaaaatcactgtgaactacttacagtaaaaattaaaaaaatggaagacaaggttaatgtactacaaagggagctatctgaaacaaaagaaataaaatcacagttagagcatcaaaaagttgaatgggaacgagaactgtgctctttgagatttagcttaaaccaagaagaagagaagagaagaaatgctgatacgttgtatgaaaaaattagggaacagttaagaagaaaagaagagcaatataggaaagaagttgaagtgaaacaacagcttgaactgagtctccaaacactggagatggaattgaggactgtaaaaagtaatttgaatcaggtcgttcaagagcgaaatgacgctcagaggcaactttctcgagaacagaatgccagaatgttacaagatggaattctgaccaatcacctttccaaacaaaaggagattgaaatggctcaaaagaaaatgaattctgagaattctcatagtcatgaagaagaaaaagacctatcgcataaaaatagcatgttgcaggaagaaattgctatgctaagactagaaatagacacaataaaaaatcaaaaccaggaaaaagaaaagaaatgttttgaggaccttaaaattgtaaaagaaaagaatgaagaccttcagaagactataaaacagaatgaggaaacattaacacaaacaatatcccagtataatggacggcttagtgttctgacagctgagaatgcaatgctaaattctaaactggagaatgaaaagcaaagcaaggaaagactggaagcagaagttgaatcataccattctagattggctgctgctatacatgatcgtgatcaaagtgagacatcaaaaagagaactagaacttgctttccagagagcaagagatgaatgttctcgtttacaggacaaaatgaattttgatgtgtctaacctaaaagataacaatgagattctttctcaacaactatttaaaactgaaagtaaactcaatagcctagaaattgagttccatcacacgagagatgccctcagagaaaagactttgggtttagaacgggtacaaaaggacctaagccaaacacagtgtcaaatgaaggaaatggaacaaaagtatcaaaatgaacaagttaaagtgaataaatacattggaaagcaggagtctgtagaggagagattgtctcaactacaaagtgagaatatgttgcttcgacaacaactggatgatgcccacaacaaggctgacaataaagagaagacagtgattaatatccaagaccagtttcatgctattgtgcaaaaacttcaagctgagagtgaaaagcaaagtcttctgctagaagaaagaaataaggagttaatcagtgaatgtaatcacttaaaagaaagacagtatcaatatgaaaatgaaaaggcagaaagagaagttgttgtgagacaacttcaacaagaactagctgataccctaaaaaaacaatctatgtcagaggcttcactggaggttacgtcacgttatcgtattaatttagaagatgagacacaggatttaaagaagaaattaggtcaaatcagaaatcaattgcaagaagcacaggatcgacatacagaagctgtcagatgtgctgagaagatgcaagatcacaagcaaaagcttgaaaaagataatgccaagttaaaagttacagtcaaaaagcaaatggacaaaattgaggagcttcagaaaaacctgttaaatgcaaatttgtctgaagatgaaaaggaacaattaaagaaacttatggaattaaaacagtcactggaatgtaatttggatcaagaaatgaagaaaaatgttgaattagaaagagagataactggatttaagaacctcttaaaaatgacaagaaagaagttaaatgaatatgaaaatggagaatttagtttccatggagatttaaaaactagtcaatttgaaatggatattcagattaataagctaaaacataagattgatgatcttacagcagaactggagactgcaggttcaaaatgtctacatctggatacaaagaaccaaattcttcaagaggagttgttatctatgaaaacagtacaaaagaaatgtgaaaaactacagaagaataaaaagaagttggaacaagaagtgatcaacctgagaagtcatatagaaaggaatatggtagaacttggtcaagtcaaacagtataaacaggagattgaagaaagagcaagacaggaaatagcagaaaaattaaaagaagtcaatctatttttacaggcacaagcagcatctcaagaaaacttagagcagtttagagagaataattttgcttcaatgaaaagtcagatggaactcagaattaaagatctggaatctgaactctccaaaataaaaacttctcaagaagactttaataaaaccgaactggaaaaatataagcaactctatctagaagaattaaaagttagaaaatctttgtcaagtaaactaaccaaaactaatgagaggctagcagaggtcaacaccaaacttcttgtggaaaaacagcagagcagatctttgttcaccactctcactaccaggccagtcatggagccaccttgtgtgggaaatcttaataatagtttagatctcaacagaaaacttattccaagagaaaacttagtgatctctacctcaaatccacgggcttcaaataatagcatggagaactacttgagcaagatgcagcaggagttggaaaaaaatataactagagaactcaaagaagctgctgctgaattggaatctggatcaatagcttcccctctagggtctactgatgagtcaaatctaaatcaagatctagtttggaaagcatcaagagaatatgtacaggttttaaagaaaaattatatgatctgaaagataagattttattactgggctgtttatgtgacattttgtttctcattaaatattaatatatgacatgtaaaaatattaaaggaacgtatttttgtatcatatatgtcagatcaaaatttatatagtattttaaacaatgttacttggcttctttaacttttaagtggattttgccaatgaaaaccaggaatattgagttttacatactcaaactgcccaaatgtgagctgtttaaacagccaaaccactaagttgtcattaatactttagtgcagttaattgatggcttatttgtattttgtaatttttatcactatatgtagtggtagatgtctaattggacttagacatcattttgttgtgcaggaactgtggtcattgttcatgtttggatgtattacaattgttacagtgccatcaaatttacataattttaattttaagcactgatttatatagctgttctcagggagaaacaagatttgcctgattcaccttttctgtttgtttatttatttttaattaaccttttggaaatagccttcagtttagagaaaatttcgaagttttagtacaaagactttctcctccgaacaatttgagagtaaattgctgacattatgtcatcacccctgattactttagtgggcattcctacaagtcaggacattctacataactacagtgcaaaccttgcaatcagaaagtcaacattaatacattctagtttgttacttctctgtaatgtcctttatagcaaaaggatcccattctaatccatggcttgtatttagttgttgtatctgttagatctttcagtctggaacagttcctcagtctttccttgaccttcatgaccttgaatattttgaagagtaaagtctggtaatataagaatgtccctcaattgggtttcatggtgattagatttagattatatgattttttggcaggagtatcacagaagtgacccagtgatcttctcattgcatcttacctgtgaccctacagttttgatttgccctgttactggtaatgttagcattgatcactaacagtggtatctgctgaatttctcctctgtaatgttattttttcaccttgtggttaattagtattttacagggaggtaatttgagactatgtacatatctctactccccatcgaaccctcaatttattcatttgcttgtatcaaataaaccatggattcatggtttattttattcagtgagttataattcattaatattgttattaaaaatttgtttttcttttaagaaatgttatattttgacaacttcagacttacagaaagattataagaggtagtacaaataatttttggatattattccccaaatgttaacattttactgcatttactttatcctttctcccccttctcctcctgtctttctagatgaatatgaatataggtacttaatacagattttttttctaaactgtt

SEQ ID NO: 299223 - DNA, 3016 bp, Homo sapiens
cagtgtagtatgagaattatatcagctatgatcataagtacatctgtgtgaagtcaaggaaaaatttcagcattaagcaattttgaaatgcggatttttttatattatcctagaattttgtgcattatccacaaaccacaactagaaaaacgatagagttgccaaatcacctacttttgaaatctttaagaatttatgtaattatgccttcaggtgtttgctaagaaattacacagtattttaaaaatttatctgtgagaataattattttaaaatatacatttcaggcttgaaaaagataatgccaagttaaaagttacagtcaaaaagcaaatggacaaaattgaggagcttcagaaaaacctgttaaatgcaaatttgtctgaagatgaaaaggaacaattaaagaaacttatggaattaaaacagtcactggaatgtaatttggatcaagaaatgaagaaaaatgttgaattagaaagagagataactggatttaagaacctcttaaaaatgacaagaaagaagttaaatgaatatgaaaatggagaatttagtttccatggagatttaaaaactagtcaatttgaaatggatattcagattaataagctaaaacataagattgatgatcttacagcagaactggagactgcaggttcaaaatgtctacatctggatacaaagaaccaaattcttcaagaggagttgttatctatgaaaacagtacaaaagaaatgtgaaaaactacagaagaataaaaagaagttggaacaagaagtgatcaacctgagaagtcatatagaaaggaatatggtagaacttggtcaagtcaaacagtataaacaggagattgaagaaagagcaagacaggaaatagcagaaaaattaaaagaagtcaatctatttttacaggcacaagcagcatctcaagaaaacttagagcagtttagagagaataattttgcttcaatgaaaagtcagatggaactcagaattaaagatctggaatctgaactctccaaaataaaaacttctcaagaagactttaataaaaccgaactggaaaaatataagcaactctatctagaagaattaaaagttagaaaatctttgtcaagtaaactaaccaaaactaatgagaggctagcagaggtcaacaccaaacttcttgtggaaaaacagcagagcagatctttgttcaccactctcactaccaggccagtcatggagccaccttgtgtgggaaatcttaataatagtttagatctcaacagaaaacttattccaagagaaaacttagtgatctctacctcaaatccacgggcttcaaataatagcatggagaactacttgagcaagatgcagcaggagttggaaaaaaatataactagagaactcaaagaagctgctgctgaattggaatctggatcaatagcttcccctctagggtctactgatgagtcaaatctaaatcaagatctagtttggaaagcatcaagagaatatgtacaggttttaaagaaaaattatatgatctgaaagataagattttattactgggctgtttatgtgacattttgtttctcattaaatattaatatatgacatgtaaaaatattaaaggaacgtatttttgtatcatatatgtcagatcaaaatttatatagtattttaaacaatgttacttggcttctttaacttttaagtggattttgccaatgaaaaccaggaatattgagttttacatactcaaactgcccaaatgtgagctgtttaaacagccaaaccactaagttgtcattaatactttagtgcagttaattgatggcttatttgtattttgtaatttttatcactatatgtagtggtagatgtctaattggacttagacatcattttgttgtgcaggaactgtggtcattgttcatgtttggatgtattacaattgttacagtgccatcaaatttacataattttaattttaagcactgatttatatagctgttctcagggagaaacaagatttgcctgattcaccttttctgtttgtttatttatttttaattaaccttttggaaatagccttcagtttagagaaaatttcgaagttttagtacaaagactttctcctccgaacaatttgagagtaaattgctgacattatgtcatcacccctgattactttagtgggcattcctacaagtcaggacattctacataactacagtgcaaaccttgcaatcagaaagtcaacattaatacattctagtttgttacttctctgtaatgtcctttatagcaaaaggatcccattctaatccatggcttgtatttagttgttgtatctgttagatctttcagtctggaacagttcctcagtctttccttgaccttcatgaccttgaatattttgaagagtaaagtctggtaatataagaatgtccctcaattgggtttcatggtgattagatttagattatatgattttttggcaggagtatcacagaagtgacccagtgatcttctcattgcatcttacctgtgaccctacagttttgatttgccctgttactggtaatgttagcattgatcactaacagtggtatctgctgaatttctcctctgtaatgttattttttcaccttgtggttaattagtattttacagggaggtaatttgagactatgtacatatctctactccccatcgaaccctcaatttattcatttgcttgtatcaaataaaccatggattcatggtttattttattcagtgagttataattcattaatattgttattaaaaatttgtttttcttttaagaaatgttatattttgacaacttcagacttacagaaagattataagaggtagtacaaataatttttggatattattccccaaatgttaacattttactgcatttactttatcctttctcccccttctcctcctgtctttctagatgaatatgaatataggtacttaatacagattttttttctaaactgtt

SEQ ID NO: 299224 - DNA, 5463 bp, Homo sapiens
gtctagcgggatcgcttgcttggtaacccggagggagagattggaaaccgcggagtttcctttgggaggctgcggccagccggggctgacttgttatgttgggctccggaggccgttaagagccgagagagacatgaggtgtctctgaagcccggtcgcctgggccatgaagaagatttttagtaagaagggcgagtcgcccttgggctccttcgcgcggcggcggaggagcagcgcgggaggcgggggcgagccgggggagggcgcctactcgcagcccggctaccacgtccgagaccgagatctcggcaagatccacaaagctgccagcgcgggtaatgtggcgaaagtgcagcagatccttttgctcaggaagaatggcttgaacgatagagacaagatgaacaggacggctctacatttggcctgtgccaatggtcatccagaagtagtaactctcctggtggacagaaaatgccagctcaatgtctgtgacaacgaaaacaggacagctctgatgaaggctgtacaatgccaggaagagaaatgtgcaactattctgctagaacatggtgctgatccaaatcttgcggatgtccatggcaacactgctcttcactatgctgtctataatgaggacatatcagtagcaacaaagctgcttttgtatgatgcaaatattgaagcaaaaaacaaggatgacctcacaccacttttacttgcagtaagtggaaaaaagcagcaaatggtggaatttttaataaagaaaaaagcaaatgtaaatgcagtagataagttggaaagcagtcaccaactaatttcagaatataaagaagaaaggatacctaaacattcttctcaaaatagtaattcagtggatgaaagctctgaagactccttaagcaggctttctggcaaaccgggtgttgatgattcatggcctacctcagatgacgaagacctcaattttgatactaagaatgtcccaaaaccaagcttagcaaagctaatgactgcttctcagcaatccaggaaaaatttagaagcaacatatggcactgtgagaacaggaaatagaactttgtttgaggatagagattccgatagtcaagatgaagttgtggttgaaagccttcctacaacatcaatcaaagtccagtgcttttctcatcctacctatcaatcacctgaccttcttccaaaaccttcccacaagtcgttagcaaaccctggtcttatgaaggaagaaccaacaaagccaggcattgcaaaaaaagaaaatggtattgatattattgaaagtgctccactagagcaaacaaataatgacaatttgacttatgttgatgaagtgcacaaaaataatagaagtgatatgatgtccgcattaggattaggacaagaggaagatatagaatcaccttgggattctgagagtatctctgagaattttccacagaagtatgttgatcctttagctggggctgcagacggaaaagaaaaaaatataggaaatgaacaagcagaagatgtgttttatataccttcttgcatgagtggatcaagaaactttaagatggctaaactagaggatacaagaaatgtaggcatgccagtagcccacatggagtctcctgagagatatcttcacttgaagcctaccattgaaatgaaagattctgttccaaataaagcaggaggaatgaaggatgtacaaacatccaaagcagctgaacatgacttagaagtagcatcagaagaagagcaagaaagggaagggagtgaaaataaccagccacaggttgaagaagaaaggaaaaaacacagaaataatgaaatggaagtatcagcaaacatacatgatggtgctactgatgatgctgaagatgatgatgatgatgatggattaattcaaaaaagaaagagtggagaaactgatcatcagcaatttcccaggaaggaaaataaagagtatgctagtggtcctgccttgcaaatgaaggaagtaaagagcactgaaaaagaaaaacggacctcgaaagaatctgtgaattcaccagtgtttgggaaggccagtttactaactggtggcctgctacaagtggatgatgacagcagtttaagtgaaatagatgaggatgaaggaaggcctactaagaaaacatctaatgaaaagaacaaggtcaaaaaccaaatacagtctatggatgatgttgatgacttaactcagtcatctgaaacagcctcagaggattgtgagctaccccactctagttacaagaattttatgttgctcattgaacaacttggaatggagtgtaaagattctgttagcctattgaaaatccaggatgcagctctttcatgtgaaagattattagaacttaaaaaaaatcactgtgaactacttacagtaaaaattaaaaaaatggaagacaaggttaatgtactacaaagggagctatctgaaacaaaagaaataaaatcacagttagagcatcaaaaagttgaatgggaacgagaactgtgctctttgagatttagcttaaaccaagaagaagagaagagaagaaatgctgatacgttgtatgaaaaaattagggaacagttaagaagaaaagaagagcaatataggaaagaagttgaagtgaaacaacagcttgaactgagtctccaaacactggagatggaattgaggactgtaaaaagtaatttgaatcaggtcgttcaagagcgaaatgacgctcagaggcaactttctcgagaacagaatgccagaatgttacaagatggaattctgaccaatcacctttccaaacaaaaggagattgaaatggctcaaaagaaaatgaattctgagaattctcatagtcatgaagaagaaaaagacctatcgcataaaaatagcatgttgcaggaagaaattgctatgctaagactagaaatagacacaataaaaaatcaaaaccaggaaaaagaaaagaaatgttttgaggaccttaaaattgtaaaagaaaagaatgaagaccttcagaagactataaaacagaatgaggaaacattaacacaaacaatatcccagtataatggacggcttagtgttctgacagctgagaatgcaatgctaaattctaaactggagaatgaaaagcaaagcaaggaaagactggaagcagaagttgaatcataccattctagattggctgctgctatacatgatcgtgatcaaagtgagacatcaaaaagagaactagaacttgctttccagagagcaagagatgaatgttctcgtttacaggacaaaatgaattttgatgtgtctaacctaaaagataacaatgagattctttctcaacaactatttaaaactgaaagtaaactcaatagcctagaaattgagttccatcacacgagagatgccctcagagaaaagactttgggtttagaacgggtacaaaaggacctaagccaaacacagtgtcaaatgaaggaaatggaacaaaagtatcaaaatgaacaagttaaagtgaataaatacattggaaagcaggagtctgtagaggagagattgtctcaactacaaagtgagaatatgttgcttcgacaacaactggatgatgcccacaacaaggctgacaataaagagaagacagtgattaatatccaagaccagtttcatgctattgtgcaaaaacttcaagctgagagtgaaaagcaaagtcttctgctagaagaaagaaataaggagttaatcagtgaatgtaatcacttaaaagaaagacagtatcaatatgaaaatgaaaaggcagaaagagaagttgttgtgagacaacttcaacaagaactagctgataccctaaaaaaacaatctatgtcagaggcttcactggaggttacgtcacgttatcgtattaatttagaagatgagacacaggatttaaagaagaaattaggtcaaatcagaaatcaattgcaagaagcacaggatcgacatacagaagctgtcagatgtgctgagaagatgcaagatcacaagcaaaagcttgaaaaagataatgccaagttaaaagttacagtcaaaaagcaaatggacaaaattgaggagcttcagaaaaacctgttaaatgcaaatttgtctgaagatgaaaaggaacaattaaagaaacttatggaattaaaacagtcactggaatgtaatttggatcaagaaatgaagaaaaatgttgaattagaaagagagataactggatttaagaacctcttaaaaatgacaagaaagaagttaaatgaatatgaaaatggagaatttagtttccatggagatttaaaaactagtcaatttgaaatggatattcagattaataagctaaaacataagattgatgatcttacagcagaactggagactgcaggttcaaaatgtctacatctggatacaaagaaccaaattcttcaagaggagttgttatctatgaaaacagtacaaaagaaatgtgaaaaactacagaagaataaaaagaagttggaacaagaagtgatcaacctgagaagtcatatagaaaggaatatggtagaacttggtcaagtcaaacagtataaacaggagattgaagaaagagcaagacaggaaatagcagaaaaattaaaagaagtcaatctatttttacaggcacaagcagcatctcaagaaaacttagagcagtttagagagaataattttgcttcaatgaaaagtcagatggaactcagaattaaagatctggaatctgaactctccaaaataaaaacttctcaagaagactttaataaaaccgaactggaaaaatataagcaactctatctagaagaattaaaagttagaaaatctttgtcaagtaaactaaccaaaactaatgagaggctagcagaggtcaacaccaaacttcttgtggaaaaacagcagagcagatctttgttcaccactctcactaccaggccagtcatggagccaccttgtgtgggaaatcttaataatagtttagatctcaacagaaaacttattccaagagaaaacttagtgatctctacctcaaatccacgggcttcaaataatagcatggagaactacttgagcaagatgcagcaggagttggaaaaaaatataactagagaactcaaagaagctgctgctgaattggaatctggatcaatagcttcccctctagggtctactgatgagtcaaatctaaatcaagatctagtttggaaagcatcaagagaatatggaccttctgatgaaacccctcatgactatgttctgatgactgaccaatgtctcacttccaggacagacctgcaatagatgccactggataatgctgagatagactgggtgcaggacaaaggacagaactcaaagtcatccctctgctgacctgaggacaaatgtgtatctgagtgcttcctccgcctattgtctatgtc

SEQ ID NO: 299225 - DNA, 1860 bp, Homo sapiens
gtctagcgggatcgcttgcttggtaacccggagggagagattggaaaccgcggagtttcctttgggaggctgcggccagccggggctgacttgttatgttgggctccggaggccgttaagagccgagagagacatgaggtgtctctgaagcccggtcgcctgggccatgaagaagatttttagtaagaagggcgagtcgcccttgggctccttcgcgcggcggcggaggagcagcgcgggaggcgggggcgagccgggggagggcgcctactcgcagcccggctaccacgtccgagaccgagatctcggcaagatccacaaagctgccagcgcgggtaatgtggcgaaagtgcagcagatccttttgctcaggaagaatggcttgaacgatagagacaagatgaacaggacggctctacatttggcctgtgccaatggtcatccagaagtagtaactctcctggtggacagaaaatgccagctcaatgtctgtgacaacgaaaacaggacagctctgatgaaggctgtacaatgccaggaagagaaatgtgcaactattctgctagaacatggtgctgatccaaatcttgcggatgtccatggcaacactgctcttcactatgctgtctataatgaggacatatcagtagcaacaaagctgcttttgtatgatgcaaatattgaagcaaaaaacaaggatgacctcacaccacttttacttgcagtaagtggaaaaaagcagcaaatggtggaatttttaataaagaaaaaagcaaatgtaaatgcagtagataagttggaaagcagtcaccaactaatttcagaatataaagaagaaaggatacctaaacattcttctcaaaatagtaattcagtggatgaaagctctgaagactccttaagcaggctttctggcaaaccgggtgttgatgattcatggcctacctcagatgacgaagacctcaattttgatactaagaatgtcccaaaaccaagcttagcaaagctaatgactgcttctcagcaatccaggaaaaatttagaagcaacatatggcactgtgagaacaggaaatagaactttgtttgaggatagagattccgatagtcaagatgaagttgtggttgaaagccttcctacaacatcaatcaaagtccagtgcttttctcatcctacctatcaatcacctgaccttcttccaaaaccttcccacaagtcgttagcaaaccctggtcttatgaaggtaagttgttttttaaaaaacttttttcatgtacccttcccctgccccaacaatcctcataatgatgcatctattgagatgatcatacagtttttgtttctaattatgtttatgtgatgaatcacatttaagacttgcatatgttgaaccatccctgcatccttgaaatgaaacccacttgatcatggtgaattattactttgtgatgtgctgttggattcggtttgctagtattttcttgaggatttttgtatctatattcatcagagatattggtctgcagttttctttttttgttatgtccttttctggctttggtattagggtgatactggctttatagaatgagttagggaggatttcccccttctcaaccttttggagtagtttcagtagaattgttatcagttcttttttgaatgtctggtagaatttagctgtgaatccgtgtggccctgggtttttttcttgttggcggttttaaaattactgattcaatctcactgcttattactggtctgttcaggatttctattttttcctaattcaagctagaggagttacgtgtttcccggaatttttcagtttcctctagattttctagtttgtgtgcatag

SEQ ID NO: 299226 - DNA, 681 bp, Homo sapiens
tatgcagatgggtctgatttaagaggggagcatggaaatgttagagcaggatatgctgtgatttccttattagaggtaattgaagccagtcctcttccccaaggcagatcagctgaagtagccaagttgatttccctgacccgagcttttcaattggcgagctctatgttcacaaggttgtgaacataggccctgacagctgctctgcatttgggtttgctcatgactttgggatgctacagaaggagagaagatatttaaccttctcggggcaacccataaaaaatgaccaacaagcatcagagctgttagaaaccattctaaaaccagaacttctggcaattataaaaatcccaggtcactctaaattggacaccactgaaagcagggtaaccaatctgctgatgctacagctaaaagagcagtatttgagccaccagcccccatctggggaatggccataaaacctgaaacacttaaaaacatgttgaagaaaacccagagcatagcccaaacgagagggaaatctacttggaaacagaaagggggatacctgtctctgcaaactgaaatatgatgtgaacctaataataaacccattattccaatgggatgtcagatgccccttatggaatatgttcatcatcagacccattggaatccagagaaaatgatatcctg

SEQ ID NO: 299227 - DNA, 373 bp, Homo sapiens
aaatattcatgaatggagatagacttgtatatgtatttaattatgtatttaaaatttacaatagtaaatgttctcatgaatatatctgtgtatcacatttgatagatatgatgtccgcattaggattaggacaagaggaagatatagaatcaccttgggattctgaggtactttctatggttgttactattattttaaaatataagcattgagtgatgttaaaacataaagagatgctttgacttgacttttttacctctgcatacatccataaggaactactttcttatatttttcagttcataattaataaagtatgtgctaagtatattactgctgcatagtataattctgctaatttgcaggattcatt

SEQ ID NO: 299228 - DNA, 137 bp, Homo sapiens
ttcagttcagccgagaattatgtaattttatgcattttaacttgtttttgctgtcttacaggatgacctcacaccacttttacttgcagtaagtggaaaaaagcagcaaatggtggaatttttaataaagaaaaaag

SEQ ID NO: 299229 - DNA, 805 bp, Homo sapiens
ggccccactccaccagccggccccgcgggacggttactctgttcctgaggtaccccccgagattgtctgtggggtcagaaacagctctggaggggtctgcagaaattactttcccaagtctttgggctggaaggaacgaacagtgcctgaccaaggactttgagcaggagagagatgggagcagagaggagccaaggtctactattttcacttctgtcaattagatcaaagccctgcccagaagctttgagcgccgctgtcaagtcccattcctcccctaaaccatccaggttccatctgccttgaagccaaaggatcttcttagattcctcaagaaaaattcaggccccgagtttctccaccagcactctcctctccccgaaggagtgggtgggctgcatttctcttcatattctattccattccagaccgtcttggactaccagcctgtccgccacccctcggggccctccctcctactctgcccttgcccgctgaggtcccaagctgaggagatgagccgagcagtaaaaagagaggaggtttggaaaagcaatgtcctctcagtctttaataggtggcccccctgggaacctgctggaagtggaagttaataagctgaaggtggtcacaaccaatctctgccacactcgcaccctaccccaccccaaatcattccttttaattaatagtggaagacctttttaaaaatgtaacatgaattggctatttcttgaggcaaacaaaaggtggctctgaagcgatatatttgtactcgtataaattcattaaaatagaaagctta

SEQ ID NO: 299230 - DNA, 532 bp, Homo sapiens
acggttactctgttcctgaggtaccccccgaggtgggtgtatggggacctccgcctccctagacttctaggccaggggcgaggatcaccttagagggtttccccagacgtccctgatttcacatgtcctgtcctgctggcaggctgcgccttctttctgcgctttggggaatggtgccttcacgcactttgtaaagggtctggaactgagctgaagagaagtgattgagggctattgtggaaagtctccgctaattcaggtttcttcacccaccagattgtctgtggggtcagaaacagctctggaggggtctgcagaaattactttcccaagtctttgggctggaaggaacgaacagtgcctgaccaaggactttgagcaggagagagatgggagcagagaggagccaaggtctactattttcacttctgtcaattagatcaaagccctgcccagaagctttgagcgccgctgtcaagtcccattcctcccctaaaccatccaggttccatctgccttgaagccaaaggat

SEQ ID NO: 299231 - DNA, 1392 bp, Homo sapiens
tttgagacagagtgtctcactcttgcccagaacccaggctggagtgcagtggcccaatctcggctcactgcaacctccacctcccaggttccagcgattctcatgcctcagcctcctgagtagctgggactataggcatgcaccaccatgccccactaaattttgtatttttagtagaaacagagtttcaccatgttggccaggctggtctcgatctcctgacctcatgatctgcccgccttggcctcccaaagtgtgggattacaggcgtgagccactgtgcccagcatggtgtttcttatatcaggtgttttagggagctcgcttgcttattccattctttaatccttacagtgtgccacacgtataaagtttataacgtattaatgatctcattacccaaaaccagaacataatttcacaagggttcctacttctgtattgttttattatctcaaaaatttaaataacatgttctgctgtttattgttcttgttatccactgtattagcaccttccctgatgtgctttggaggttgatcaatgaatttctgagactttctgctggaattactttaagggtgtcttattagatgatgaaaagttggctgagacacccttcaagtgaccatgtcattgttttcttgctatgtctttagcttaatgattaagatacaattctttttaaaatcaaatggtattagttattatgtttcccaaattagaaatcgattttagttaacattttattttattttattctattttatttatttttgagacagagtctcgctctgttgcccaggctggagtacaatggcgcaatctcagctcactccaatctccgcctcccaggttcaagcgatttttctgcctcagcctcccgagtagctgggattacaggcacccactaccatgcccagctaatctttgtatttttagtagagacggggtttcaccatgttggccagtccggtctcgaacttctgacctgaggtgatctgcccaccttggcctcacaaagtgctgagattacaggcttgagccaccacgcctggcctagttagcattttaaagaaacacaaagccataacaaaaaccatcattgtttgtattccacactgttaatgaatgtaaagaggttagaaatgtagtgtttgattaatgatgtttatttttactgtatttaatatgagtaatttttcatcatctttcaagaggaataatgtttattgattaaaggtgagaaatgatagttaagacaccaattccatgtccagatctttgactgtatcatgcattgtacaattgatttcatattttatgaaatgccttaattttcctactataacataaagacaatgatgaataaagtttatgtgtatgattaaa

SEQ ID NO: 299232 - DNA, 1180 bp, Homo sapiens
  misc_feature (1139)..(1139): n is a, c, g, or t
tttgagacagagtgtctcactcttgcccagaacccaggctggagtgcagtggcccaatctcggctcactgcaacctccacctcccaggttccagcgattctcatgcctcagcctcctgagtagctgggactataggcatgcaccaccatgccccactaaattttgtatttttagtagaaacagagtttcaccatgttggccaggctggtctcgatctcctgacctcatgatctgcccgccttggcctcccaaagtgtgggattacaggcgtgagccactgtgcccagcatggtgtttcttatatcaggtgttttagggagctcgcttgcttattccattctttaatccttacagtgtgccacacgtataaagtttataacgtattaatgatctcattacccaaaaccagaacataatttcacaagggttcctacttctgtattgttttattatctcaaaaatttaaataacatgttctgctgtttattgttcttgttatccactgtattagcaccttccctgatgtgctttggaggttgatcaatgaatttctgagactttctgctggaattactttaagggtgtcttattagatgatgaaaagttggctgagacacccttcaagtgaccatgtcattgttttcttgctatgtctttagcttaatgattaagatacaattctttttaaaatcaaatggtattagttattatgtttcccaaattagaaatcgattttagttaacattttattttattttattctattttatttatttttgagacagagtctcgctctgttgcccaggctggagtacaatggcgcaatctcagctcactccaatctccgcctcccaggttcaagcgatttttctgcctcagcctcccgagtagctgggattacaggcacccactaccatgcccagctaatctttgtatttttagtagagacggggtttcaccatgttggccagtccggtctcgaacttctgacctgaggtgatctgcccaccttggcctcacaaagtgctgagattacaggcttgagccaccacgcctggcctagttagcattttaaagaaacacaaagccataacaaaaaccatcattgtttgtattccacactgttaatgaacatttcnaacctctttacattcattaacagtgtgtcgacgcggccgca

SEQ ID NO: 299233 - DNA, 4119 bp, Homo sapiens
agtgctcgcggggccgcggcggagtgtaccgtgctgctctactcgctgccattcgcccgcaggtcggcgcgctcgcccacctgagccgcgccggggctgcgggaccgtgggacagcgcgctcagcccagcctaggaaagaggcagcagtctcagcgcggagatggggagcgggcgaagttgacgagtctcccgcccacgctgcgcccctcctgcccagaggggctgcagccagcggtctgtcgcgcgtgcctgtgtgcccgaggagccgccccggggagaagacccggcgcggagttgttcccccagggaggatccgcagcccagccgagggggtcgggcggcctggctacgcaggacccagccccgcagccgcggactcccagcggcggcgaagtttggctgctgagcggcgcggcgccggaccactggacagcgggagcgatgcccgtggggggcctgttgccgctcttcagcagccccgcgggcggcgtcctgggcggggggctcggcggcggcggtggcaggaaggggtcgggccccgccgccctccgcctgacggagaagttcgtgctgctgctggtattcagcgccttcatcacgctctgcttcggggcgatcttcttcctgccagactcctccaagctgctcagcggggtcctgttccactccagccccgccttgcagccggccgccgaccacaagcccgggcccggggcgcgcgccgaggacgcggccgaggggcgagcccggcgccgcgaggagggggcacccggggacccggaggccgccctggaggacaacttggccaggatccgcgaaaaccacgagcgggctctcagggaagccaaggagaccctgcagaagctgcccgaggagatccaaagagacatcctactggagaagaagaaggtggcccaggaccagctgcgtgacaaggcgccgttcagaggcctgcccccggtggacttcgtgcccccaatcggggtggagagccgggagcccgccgacgccgccatccgcgagaaaagggcaaagatcaaagagatgatgaaacatgcttggaataattataaaggttatgcctggggattaaatgaactcaaacctatatcaaaaggaggccattcaagcagtttgtttggtaacatcaaaggagcaactatagtagatgccctggatacactttttattatggaaatgaaacatgaatttgaagaagcaaaatcatgggttgaagaaaatttagattttaatgtgaatgctgaaatttctgtctttgaagtaaatatacgctttgttggtggactactctcagcctactatctgtctggagaagagatttttcgaaagaaagcagtggaacttggggtaaaattgctacctgcatttcatactccctctggaataccttgggcattgctgaatatgaaaagtggtattggaaggaactggccctgggcctctggaggcagcagtattctggcagaatttggaaccctgcatttggagtttatgcacttgagccacttatcaggaaaccccatctttgctgaaaaggtaatgaatattcgaacagtactgaacaaactggaaaaaccacaaggcctttatcctaactatctgaatcccagtagtggacagtggggtcaacatcatgtatcagttggaggacttggagacagcttctatgagtatttgctgaaggcctggttaatgtctgacaagacagatctggaagctaagaagatgtattttgatgctgttcaggctatcgagactcatttgatccgcaagtctagcagcggactaacttatatcgcagagtggaaagggggcctcctggagcacaagatgggccacctgacctgcttcgctgggggcatgttcgcactcggggctgatgcagctcccgaaggcatggcccaacactaccttgaactcggggctgaaattgcccgtacttgtcatgaatcatataatcgaacatttatgaaactgggaccagaagctttcagatttgatggtggtgttgaagccatcgctacaagacaaaatgaaaaatactacatcttacggccagaagttatggagacttacatgtatatgtggagactgactcatgatccaaagtacaggaaatgggcctgggaagccgtagaggccttggaaaaccattgcagagtgaatggaggctattcaggcctaagggatgtttaccttcttcatgagagttatgatgatgtgcagcagagtttcttcctggcagagacattgaaatatttgtacctaatattttctgacgacgatcttcttccactggagcattggatcttcaatagcgaggcacatcttctccctatcctccctaaagataaaaaggaagttgaaatcagagaggaataaaaagacattttatattttattctgctccattcccttcactgtataccttaataattccttttctggtaatcaggcacatgatgaactttgattagtaggtctgtgattaagttcttaaattgttttgcagtcttttatgtttattatcataggtataggtggacctaaattccttatcatatcctttattaattcagccagtgtatccaccagttttttgtttatgtttttaagtaacctattatctctggatttcatgaaggtgtaatatcgtttttgttaaactgaatagaattgtatagcgatgacctcttaattataatttgatttgactgcaaaactttttcctcctctaagaggagatgatgtctgctttaagctgtaatgttttgccatgttgcaaaaagccataataataagtataaaaaagctttttcctttacaatttcatgttaatctggtttgtctgtccaccagagacagatcttctgtgacagcctccttatgcaggtctatcattatttgatagaatgtcttctaaaatacttcactcacattgtaattcaaattagaaagtcattccaaaaggatcatgtcatgttgacctcatttcatcggaactgcagtatatttttgttggttaattatattagtgttttctattttgtaaatgtgtcctttaattttactttaaatgccctgtgtcatttctggattatatactagttaatttcttccattccctactacacagagaggtgagctttcaaattttgcagagctctgctatcactgaattacatttatctgaagaaaatagtacaacttaatggattagcttttgggtttaactgaatatatgaagaaattgggtctgtctaaagagagggtatttcatatggcttttagttcacttgtttgtatttcatcttgatttttttctttggaaaataaagcattctatttggttcagatttctcagatttgaaaaaggctctatctcagatgtagtaaattatttcctttcagtttgtgaaagcaggatttgactctgaaagaagctttgccaattttacttattcgtgatcaatcaaggaaaatctaataaattttaggccaaataagaatatagcatatttagtatggttatagtcaacacagagatcacaacttagaagaaatataaagaaatggccactccccatcccccacagtcctggagtaaatcaaaatcaatatatgattcttttaaacattaagtttgaaataggaatggttttctcaagaatagatttggtgtgataccttgtgtttgcttacattggcccactatatatacatatatatttatgtagatatacttccatgaaagggctaatacgatgcatatactgaagggcaaggactttgaccatgtgaattttcagccgagaatggtcagaaagatcagtacaaccccatggattaggctgaaacatatgaaattgctgcatttgtagtttaaaaactgtcagcagtttcatatggttccacctaatattattgaagacaattattttcttagctatcaataggcttaatagttttagttattttagcttttgaaagtgttttaaaagatttcctttatcggacaggaccatctttatgacctgctttctgtttttcaatatcatacattggtgtatgtcaaagaataaattagtaaaattagt

SEQ ID NO: 299234 - DNA, 1681 bp, Homo sapiens
ttcctccaaaatcctttctagccagagaaggtttttctcaactgataaggcaaagtctatgctttccatcttcttggtagttggattaaatgggagaaaaatggggtacaattatatatgtaaaaaaaaaagagggacagaattatgatccacaggggaaaactgaaacgtaagtgaaaaatgacatgagaaactaagagtaagtatatcttgtttacattttctttatttcactataaaatatattagggttttagtcttaaactttattatttttgtctacagtcaataaatgagaaccagattgcagatggcaatttttgtacgatggaaatttttatttgaccatataattaataggattagtaggatgtgatggcagaaaataactttcctagagatgaatatgcctggtaactagcagagcaacaaatgtaatttcaaaatataaacagcacaaaaaaaaaaacaactcaaaatgaattaaagacttaaatgtaagacctgaaaccataaaactcctaggagaaaacaacaggggaaaagctccttgacattgagcttggcaatgattttttggattcgacccaaaaacacaggcaacaaaagcaaacataaacacatgaaactacatcaaactaaaaagtttccttacagcaaaggaaacaatcaactaaaaacacaacaaaaatgtgtgcaaaccatatatctgataaggggttaatatccaaaatatataaggaacttacaattcagtagcagaaaaacaacctgatttcaaaataggcaaaggacctgaagagacatttttccaaagaagacgtacagatggccagtagtgaaaagatgctcaacatcacaaatcatcagggaaatgcagattagaaccacagtgagatatcacctcatacctttttaaatggctattatcaaaaattcaagaggtaatcagtcttagtgaggatgcagaataaagggaacctttgtacactgttggtggcaatgaaaattgatatagccattatggaaaacagtatggaggtttctcaaaaaattaaaaatagagctaccatatgatccagcaatcctaattcttggtgtatatccacagaagatgatgtgtatccacatcagaagatgatgtatatccaccacagaagatggtgtatatccacagaagtagtgtatatcaaaacatcacactgtacaccttccagtatatactatttgtatttgtcatacatcggtaaagctggaaaaaggttaaagaaaaatagaaacaaacaaaagaaagaaagtgggctctgaaagggaaaaagaaaacacaaacagcagccatcttagtggtaaccaacaaagtggaaggcaggttggtttaggttgttacctaaatgttcatcctcacactgcccaacccatctgttttccaaatattcattaaattcagacaactacagaaatgtaggatcatttctctctagagagttgtcagtggagtcatcccatcttcttccatactagaatatttgtacctaatattttctgacgacgatcttcttccactggagcattggatcttcaatagcgaggcgaagttctcccttgttcccatcgaaggatttataaagagagacgggcgaggtcggttctgcgactgtgattgcgggtgcttgctttctgg

SEQ ID NO: 299235 - DNA, 5182 bp, Homo sapiens
ccaacttatttaaaacaaaacaattttgtaggtattattatacccatttcacagatgatgataaatgagaccaatagaagttaaataacttgccaaaggccacacagctggtgagtgatggagaacgaattaaaactcaagtgagcataattctaaaagccatcttctcgttagtgtttctcactatccaggtctgcctttgccttatttaactgaagttaagccatccttacctgtgatcacctagcctctcagtttggggggatcattacagcgggtttttaactcccaatgttctggtccagtttgctttacatgttcttatttatacattgtcaaggatgacctcaggacagtacagcaaggacacagtggcacttcacattttgttcccacgaaatgactggggcataatctcagatcatcttcctttagaatgtggaaacatcagcagaagaatattagtctttatacaagtcaaatccaaaatgacacatgtgaaaactaatagagctgactttcagccatgatagctttggcacacctcacatccctttgttcaacctctcttccctcaacggagagctgcattcctgggaatttctgttgtgcacttttcccacttgccctgctgtcatttaaaggtgaacattctagttttgctaagaaaaccctttccttcatttggaatgaacagcaattttattacttttgaccttaaaatgagtttgctgccttcaaatcttttcagcgccttcatcacgctctgcttcggggcgatcttcttcctgccagactcctccaagctgctcagcggggtcctgttccactccagccccgccttgcagccggccgccgaccacaagcccgggcccggggcgcgcgccgaggacgcggccgaggggcgagcccggcgccgcgaggagggggcacccggggacccggaggccgccctggaggacaacttggccaggatccgcgaaaaccacgagcgggctctcagggaagccaaggagaccctgcagaagctgcccgaggagatccaaagagacatcctactggagaagaagaaggtggcccaggaccagctgcgtgacaaggcgccgttcagaggcctgcccccggtggacttcgtgcccccaatcggggtggagagccgggagcccgccgacgccgccatccgcgagaaaagggcaaagatcaaagagatgatgaaacatgcttggaataattataaaggttatgcctggggattaaatgaactcaaacctatatcaaaaggaggccattcaagcagtttgtttggtaacatcaaaggagcaactatagtagatgccctggatacactttttattatggaaatgaaacatgaatttgaagaagcaaaatcatgggttgaagaaaatttagattttaatgtgaatgctgaaatttctgtctttgaagtaaatatacgctttgttggtggactactctcagcctactatctgtctggagaagagatttttcgaaagaaagcagtggaacttggggtaaaattgctacctgcatttcatactccctctggaataccttgggcattgctgaatatgaaaagtggtattggaaggaactggccctgggcctctggaggcagcagtattctggcagaatttggaaccctgcatttggagtttatgcacttgagccacttatcaggaaaccccatctttgctgaaaaggtaatgaatattcgaacagtactgaacaaactggaaaaaccacaaggcctttatcctaactatctgaatcccagtagtggacagtggggtcaacatcatgtatcagttggaggacttggagacagcttctatgagtatttgctgaaggcctggttaatgtctgacaagacagatctggaagctaagaagatgtattttgatgctgttcaggctatcgagactcatttgatccgcaagtctagcagcggactaacttatatcgcagagtggaaagggggcctcctggagcacaagatgggccacctgacctgcttcgctgggggcatgttcgcactcggggctgatgcagctcccgaaggcatggcccaacactaccttgaactcggggctgaaattgcccgtacttgtcatgaatcatataatcgaacatttatgaaactgggaccagaagctttcagatttgatggtggtgttgaagccatcgctacaagacaaaatgaaaaatactacatcttacggccagaagttatggagacttacatgtatatgtggagactgactcatgatccaaagtacaggaaatgggcctgggaagccgtagaggccttggaaaaccattgcagagtgaatggaggctattcaggcctaagggatgtttaccttcttcatgagagttatgatgatgtgcagcagagtttcttcctggcagagacattgaaatatttgtacctaatattttctgacgacgatcttcttccactggagcattggatcttcaatagcgaggcacatcttctccctatcctccctaaagataaaaaggaagttgaaatcagagaggaataaaaagacattttatattttattctgctccattcccttcactgtataccttaataattccttttctggtaatcaggcacatgatgaactttgattagtaggtctgtgattaagttcttaaattgttttgcagtcttttatgtttattatcataggtataggtggacctaaattccttatcatatcctttattaattcagccagtgtatccaccagttttttgtttatgtttttaagtaacctattatctctggatttcatgaaggtgtaatatcgtttttgttaaactgaatagaattgtatagcgatgacctcttaattataatttgatttgactgcaaaactttttcctcctctaagaggagatgatgtctgctttaagctgtaatgttttgccatgttgcaaaaagccataataataagtataaaaaagctttttcctttacaatttcatgttaatctggtttgtctgtccaccagagacagatcttctgtgacagcctccttatgcaggtctatcattatttgatagaatgtcttctaaaatacttcactcacattgtaattcaaattagaaagtcattccaaaaggatcatgtcatgttgacctcatttcatcggaactgcagtatatttttgttggttaattatattagtgttttctattttgtaaatgtgtcctttaattttactttaaatgccctgtgtcatttctggattatatactagttaatttcttccattccctactacacagagaggtgagctttcaaattttgcagagctctgctatcactgaattacatttatctgaagaaaatagtacaacttaatggattagcttttgggtttaactgaatatatgaagaaattgggtctgtctaaagagagggtatttcatatggcttttagttcacttgtttgtatttcatcttgatttttttctttggaaaataaagcattctatttggttcagatttctcagatttgaaaaaggctctatctcagatgtagtaaattatttcctttcagtttgtgaaagcaggatttgactctgaaagaagctttgccaattttacttattcgtgatcaatcaaggaaaatctaataaattttaggccaaataagaatatagcatatttagtatggttatagtcaacacagagatcacaacttagaagaaatataaagaaatggccactccccatcccccacagtcctggagtaaatcaaaatcaatatatgattcttttaaacattaagtttgaaataggaatggttttctcaagaatagatttggtgtgataccttgtgtttgcttacattggcccactatatatacatatatatttatgtagatatacttccatgaaagggctaatacgatgcatatactgaagggcaaggactttgaccatgtgaattttcagccgagaatggtcagaaagatcagtacaaccccatggattaggctgaaacatatgaaattgctgcatttgtagtttaaaaactgtcagcagtttcatatggttccacctaatattattgaagacaattattttcttagctatcaataggcttaatagttttagttattttagcttttgaaagtgttttaaaagatttcctttatcggacaggaccatctttatgacctgctttctgtttttcaatatcatacattggtgtatgtcaaagaataaattagtaaaattagtaaatgaaaaagactcttccgtacatcattatttccatgctaatgtgtgtctgtgatccagaataacttctcccactcatatcttcagttcacctaatgaaatgaatggatagcaagagccctttgttcccaggactttaaggcaaaatattaaaaattattgccaaaattaagaatataatgtttgtataaatgtccttgaatttgccatttaaattaactcattttcttttcactttgatttgaaagctgataagtatttctgcagcagatagaatattaaaatcaggttgtgtgtacacactgcactatgaggtaccttggtgtcctggtgtgaatagacaagaagctgtactatatgttgctctctcagtggcaacaatgaagtttttgcaattctagaacttggatttttttttaacaaaagtcccaaaacaccaaaaatgtaaacaagataagagattaatattgtagtgatgtaatttaattaaagttatattttgggttaattttaacaactgaagtcttattgttgaaacttattttcaacaaaactgtgcagttaaatttgtatacgtattcacatactgaaagatgaaccgttaaaatagcacttaattttgtgtttcttcaatatgtcttgatatactttgtgcaattaatattacacatgtaagttgtatggcagtttacagaactcaatgacttgtcatgaggttttcatatgagctacacattgtgtacattgattgttttttatttttacataaatccattctgtcattttcaactttatatataaatctccaatgttatgggaaacaatagattgacacataatttttaaaaattatatttgtaaaatttctctattgtgaataaagtcttttaatatatctcc

SEQ ID NO: 299236 - DNA, 5129 bp, Homo sapiens
ccaacttatttaaaacaaaacaattttgtaggtattattatacccatttcacagatgatgataaatgagaccaatagaagttaaataacttgccaaaggccacacagctggtgagtgatggagaacgaattaaaactcaagtgagcataattctaaaagccatcttctcgttagtgtttctcactatccaggtctgcctttgccttatttaactgaagttaagccatccttacctgtgatcacctagcctctcagtttggggggatcattacagcgggtttttaactcccaatgttctggtccagtttgctttacatgttcttatttatacattgtcaaggatgacctcaggacagtacagcaaggacacagtggcacttcacattttgttcccacgaaatgactggggcataatctcagatcatcttcctttagaatgtggaaacatcagcagaagaatattagtctttatacaagtcaaatccaaaatgacacatgtgaaaactaatagagctgactttcagccatgatagctttggcacacctcacatccctttgttcaacctctcttccctcaacggagagctgcattcctgggaatttctgttgtgcacttttcccacttgccctgctgtcatttaaaggtgaacattctagttttgctaagaaaaccctttccttcatttggaatgaacagcaattttattacttttgaccttaaaatgagtttgctgccttcaaatcttttcagcgccttcatcacgctctgcttcggggcgatcttcttcctgccagactcctccaagctgctcagcggggtcctgttccactccagccccgccttgcagccggccgccgaccacaagcccgggcccggggcgcgcgccgaggacgcggccgaggggcgagcccggcgccgcgaggagggggcacccggggacccggaggccgccctggaggacaacttggccaggatccgcgaaaaccacgagcgggctctcagggaagccaaggagaccctgcagaagctgcccgaggagatccaaagagacatcctactggagaagaagaaggtggcccaggaccagctgcgtgacaaggcgccgttcagaggcctgcccccggtggacttcgtgcccccaatcggggtggagagccgggagcccgccgacgccgccatccgcgagaaaagggcaaagatcaaagagatgatgaaacatgcttggaataattataaaggttatgcctggggattaaatgaactcaaacctatatcaaaaggaggccattcaagcagtttgtttggtaacatcaaaggagcaactatagtagatgccctggatacactttttattatggaaatgaaacatgaatttgaagaagcaaaatcatgggttgaagaaaatttagattttaatgtgaatgctgaaatttctgtctttgaagtaaatatacgctttgttggtggactactctcagcctactatctgtctggagaagagatttttcgaaagaaagcagtggaacttggggtaaaattgctacctgcatttcatactccctctggaataccttgggcattgctgaatatgaaaagtggtattggaaggaactggccctgggcctctggaggcagcagtattctggcagaatttggaaccctgcatttggagtttatgcacttgagccacttatcaggaaaccccatctttgctgaaaaggtaatgaatattcgaacagtactgaacaaactggaaaaaccacaaggcctttatcctaactatctgaatcccagtagtggacagtggggtcaacatcatgtatcagttggaggacttggagacagcttctatgagtatttgctgaaggcctggttaatgtctgacaagacagatctggaagctaagaagatgtattttgatgctgttcaggctatcgagactcatttgatccgcaagtctagcagcggactaacttatatcgcagagtggaaagggggcctcctggagcacaagatgggccacctgacctgcttcgctgggggcatgttcgcactcggggctgatgcagctcccgaaggcatggcccaacactaccttgaactcggggctgaaattgcccgtacttgtcatgaatcatataatcgaacatttatgaaactgggaccagaagctttcagatttgatggtggtgttgaagccatcgctacaagacaaaatgaaaaatactacatcttacggccagaagttatggagacttacatgtatatgtggagactgactcatgatccaaagtacaggaaatgggcctgggaagccgtagaggccttggaaaaccattgcagagtgaatggaggctattcaggcctaagggatgtttaccttcttcatgagagttatgatgatgtgcagcagagtttcttcctggcagagacattgaaatatttgtacctaatattttctgacgacgatcttcttccactggagcattggatcttcaatagcgaggcacatcttctccctatcctccctaaagataaaaaggaagttgaaatcagagaggaataaaaagacattttatattttattctgctccattcccttcactgtataccttaataattccttttctggtaatcaggcacatgatgaactttgattagtaggtctgtgattaagttcttaaattgttttgcagtcttttatgtttattatcataggtataggtggacctaaattccttatcatatcctttattaattcagccagtgtatccaccagttttttgtttatgtttttaagtaacctattatctctggatttcatgaaggtgtaatatcgtttttgttaaactgaatagaattgtatagcgatgacctcttaattataatttgatttgactgcaaaactttttcctcctctaagaggagatgatgtctgctttaagctgtaatgttttgccatgttgcaaaaagccataataataagtataaaaaagctttttcctttacaatttcatgttaatctggtttgtctgtccaccagagacagatcttctgtgacagcctccttatgcaggtctatcattatttgatagaatgtcttctaaaatacttcactcacattgtaattcaaattagaaagtcattccaaaaggatcatgtcatgttgacctcatttcatcggaactgcagtatatttttgttggttaattatattagtgttttctattttgtaaatgtgtcctttaattttactttaaatgccctgtgtcatttctggattatatactagttaatttcttccattccctactacacagagaggtgagctttcaaattttgcagagctctgctatcactgaattacatttatctgaagaaaatagtacaacttaatggattagcttttgggtttaactgaatatatgaagaaattgggtctgtctaaagagagggtatttcatatggcttttagttcacttgtttgtatttcatcttgatttttttctttggaaaataaagcattctatttggttcagatttctcagatttgaaaaaggctctatctcagatgtagtaaattatttcctttcagtttgtgaaagcaggatttgactctgaaagaagctttgccaattttacttattcgtgatcaatcaaggaaaatctaataaattttaggccaaataagaatatagcatatttagtatggttatagtcaacacagagatcacaacttagaagaaatataaagaaatggccactccccatcccccacagtcctggagtaaatcaaaatcaatatatgattcttttaaacattaagtttgaaataggaatggttttctcaagaatagatttggtgtgataccttgtgtttgcttacattggcccactatatatacatatatatttatgtagatatacttccatgaaagggctaatacgatgcatatactgaagggcaaggactttgaccatgtgaattttcagccgagaatggtcagaaagatcagtacaaccccatggattaggctgaaacatatgaaattgctgcatttgtagtttaaaaactgtcagcagtttcatatggttccacctaatattattgaagacaattattttcttagctatcaataggcttaatagttttagttattttagcttttgaaagtgttttaaaagatttcctttatcggacaggaccatctttatgacctgctttctgtttttcaatatcatacattggtgtatgtcaaagaataaattagtaaaattagtaaatgaaaaagactcttccgtacatcattatttccatgctaatgtgtgtctgtgatccagaataacttctcccactcatatcttcagttcacctaatgaaatgaatggatagcaagagccctttgttcccaggactttaaggcaaaatattaaaaattattgccaaaattaagaatataatgtttgtataaatgtccttgaatttgccatttaaattaactcattttcttttcactttgatttgaaagctgataagtatttctgcagcagatagaatattaaaatcaggttgtgtgtacacactgcactatgaggtaccttggtgtcctggtgtgaatgcaattctagaacttggatttttttttaacaaaagtcccaaaacaccaaaaatgtaaacaagataagagattaatattgtagtgatgtaatttaattaaagttatattttgggttaattttaacaactgaagtcttattgttgaaacttattttcaacaaaactgtgcagttaaatttgtatacgtattcacatactgaaagatgaaccgttaaaatagcacttaattttgtgtttcttcaatatgtcttgatatactttgtgcaattaatattacacatgtaagttgtatggcagtttacagaactcaatgacttgtcatgaggttttcatatgagctacacattgtgtacattgattgttttttatttttacataaatccattctgtcattttcaactttatatataaatctccaatgttatgggaaacaatagattgacacataatttttaaaaattatatttgtaaaatttctctattgtgaataaagtcttttaatatatctcc

SEQ ID NO: 299237 - DNA, 4264 bp, Homo sapiens
ttcctccaaaatcctttctagccagagaaggtttttctcaactgataaggcaaagtctatgctttccatcttcttggtagttggattaaatgggagaaaaatggggtacaattatatatgtaaaaaaaaaagagggacagaattatgatccacaggggaaaactgaaacgtaagtgaaaaatgacatgagaaactaagagtaagtatatcttgtttacattttctttatttcactataaaatatattagggttttagtcttaaactttattatttttgtctacagtcaataaatgagaaccagattgcagatggcaatttttgtacgatggaaatttttatttgaccatataattaataggattagtaggatgtgatggcagaaaataactttcctagagatgaatatgcctggtaactagcagagcaacaaatgtaatttcaaaatataaacagcacaaaaaaaaaaacaactcaaaatgaattaaagacttaaatgtaagacctgaaaccataaaactcctaggagaaaacaacaggggaaaagctccttgacattgagcttggcaatgattttttggattcgacccaaaaacacaggcaacaaaagcaaacataaacacatgaaactacatcaaactaaaaagtttccttacagcaaaggaaacaatcaactaaaaacacaacaaaaatgtgtgcaaaccatatatctgataaggggttaatatccaaaatatataaggaacttacaattcagtagcagaaaaacaacctgatttcaaaataggcaaaggacctgaagagacatttttccaaagaagacgtacagatggccagtagtgaaaagatgctcaacatcacaaatcatcagggaaatgcagattagaaccacagtgagatatcacctcatacctttttaaatggctattatcaaaaattcaagaggtaatcagtcttagtgaggatgcagaataaagggaacctttgtacactgttggtggcaatgaaaattgatatagccattatggaaaacagtatggaggtttctcaaaaaattaaaaatagagctaccatatgatccagcaatcctaattcttggtgtatatccacagaagatgatgtgtatccacatcagaagatgatgtatatccaccacagaagatggtgtatatccacagaagtagtgtatatcaaaacatcacactgtacaccttccagtatatactatttgtatttgtcatacatcggtaaagctggaaaaaggttaaagaaaaatagaaacaaacaaaagaaagaaagtgggctctgaaagggaaaaagaaaacacaaacagcagccatcttagtggtaaccaacaaagtggaaggcaggttggtttaggttgttacctaaatgttcatcctcacactgcccaacccatctgttttccaaatattcattaaattcagacaactacagaaatgtaggatcatttctctctagagagttgtcagtggagtcatcccatcttcttccatactagaatatttgtacctaatattttctgacgacgatcttcttccactggagcattggatcttcaatagcgaggcacatcttctccctatcctccctaaagataaaaaggaagttgaaatcagagaggaataaaaagacattttatattttattctgctccattcccttcactgtataccttaataattccttttctggtaatcaggcacatgatgaactttgattagtaggtctgtgattaagttcttaaattgttttgcagtcttttatgtttattatcataggtataggtggacctaaattccttatcatatcctttattaattcagccagtgtatccaccagttttttgtttatgtttttaagtaacctattatctctggatttcatgaaggtgtaatatcgtttttgttaaactgaatagaattgtatagcgatgacctcttaattataatttgatttgactgcaaaactttttcctcctctaagaggagatgatgtctgctttaagctgtaatgttttgccatgttgcaaaaagccataataataagtataaaaaagctttttcctttacaatttcatgttaatctggtttgtctgtccaccagagacagatcttctgtgacagcctccttatgcaggtctatcattatttgatagaatgtcttctaaaatacttcactcacattgtaattcaaattagaaagtcattccaaaaggatcatgtcatgttgacctcatttcatcggaactgcagtatatttttgttggttaattatattagtgttttctattttgtaaatgtgtcctttaattttactttaaatgccctgtgtcatttctggattatatactagttaatttcttccattccctactacacagagaggtgagctttcaaattttgcagagctctgctatcactgaattacatttatctgaagaaaatagtacaacttaatggattagcttttgggtttaactgaatatatgaagaaattgggtctgtctaaagagagggtatttcatatggcttttagttcacttgtttgtatttcatcttgatttttttctttggaaaataaagcattctatttggttcagatttctcagatttgaaaaaggctctatctcagatgtagtaaattatttcctttcagtttgtgaaagcaggatttgactctgaaagaagctttgccaattttacttattcgtgatcaatcaaggaaaatctaataaattttaggccaaataagaatatagcatatttagtatggttatagtcaacacagagatcacaacttagaagaaatataaagaaatggccactccccatcccccacagtcctggagtaaatcaaaatcaatatatgattcttttaaacattaagtttgaaataggaatggttttctcaagaatagatttggtgtgataccttgtgtttgcttacattggcccactatatatacatatatatttatgtagatatacttccatgaaagggctaatacgatgcatatactgaagggcaaggactttgaccatgtgaattttcagccgagaatggtcagaaagatcagtacaaccccatggattaggctgaaacatatgaaattgctgcatttgtagtttaaaaactgtcagcagtttcatatggttccacctaatattattgaagacaattattttcttagctatcaataggcttaatagttttagttattttagcttttgaaagtgttttaaaagatttcctttatcggacaggaccatctttatgacctgctttctgtttttcaatatcatacattggtgtatgtcaaagaataaattagtaaaattagtaaatgaaaaagactcttccgtacatcattatttccatgctaatgtgtgtctgtgatccagaataacttctcccactcatatcttcagttcacctaatgaaatgaatggatagcaagagccctttgttcccaggactttaaggcaaaatattaaaaattattgccaaaattaagaatataatgtttgtataaatgtccttgaatttgccatttaaattaactcattttcttttcactttgatttgaaagctgataagtatttctgcagcagatagaatattaaaatcaggttgtgtgtacacactgcactatgaggtaccttggtgtcctggtgtgaatagacaagaagctgtactatatgttgctctctcagtggcaacaatgaagtttttgcaattctagaacttggatttttttttaacaaaagtcccaaaacaccaaaaatgtaaacaagataagagattaatattgtagtgatgtaatttaattaaagttatattttgggttaattttaacaactgaagtcttattgttgaaacttattttcaacaaaactgtgcagttaaatttgtatacgtattcacatactgaaagatgaaccgttaaaatagcacttaattttgtgtttcttcaatatgtcttgatatactttgtgcaattaatattacacatgtaagttgtatggcagtttacagaactcaatgacttgtcatgaggttttcatatgagctacacattgtgtacattgattgttttttatttttacataaatccattctgtcattttcaactttatatataaatctccaatgttatgggaaacaatagattgacacataatttttaaaaattatatttgtaaaatttctctattgtgaataaagtcttttaatatatctcc

SEQ ID NO: 299238 - DNA, 5552 bp, Homo sapiens
  misc_feature (5460)..(5460): n is a, c, g, or t
  misc_feature (5552)..(5552): n is a, c, g, or t
ccaacttatttaaaacaaaacaattttgtaggtattattatacccatttcacagatgatgataaatgagaccaatagaagttaaataacttgccaaaggccacacagctggtgagtgatggagaacgaattaaaactcaagtgagcataattctaaaagccatcttctcgttagtgtttctcactatccaggtctgcctttgccttatttaactgaagttaagccatccttacctgtgatcacctagcctctcagtttggggggatcattacagcgggtttttaactcccaatgttctggtccagtttgctttacatgttcttatttatacattgtcaaggatgacctcaggacagtacagcaaggacacagtggcacttcacattttgttcccacgaaatgactggggcataatctcagatcatcttcctttagaatgtggaaacatcagcagaagaatattagtctttatacaagtcaaatccaaaatgacacatgtgaaaactaatagagctgactttcagccatgatagctttggcacacctcacatccctttgttcaacctctcttccctcaacggagagctgcattcctgggaatttctgttgtgcacttttcccacttgccctgctgtcatttaaaggtgaacattctagttttgctaagaaaaccctttccttcatttggaatgaacagcaattttattacttttgaccttaaaatgagtttgctgccttcaaatcttttcagcgccttcatcacgctctgcttcggggcgatcttcttcctgccagactcctccaagctgctcagcggggtcctgttccactccagccccgccttgcagccggccgccgaccacaagcccgggcccggggcgcgcgccgaggacgcggccgaggggcgagcccggcgccgcgaggagggggcacccggggacccggaggccgccctggaggacaacttggccaggatccgcgaaaaccacgagcgggctctcagggaagccaaggagaccctgcagaagctgcccgaggagatccaaagagacatcctactggagaagaagaaggtggcccaggaccagctgcgtgacaaggcgccgttcagaggcctgcccccggtggacttcgtgcccccaatcggggtggagagccgggagcccgccgacgccgccatccgcgagaaaagggcaaagatcaaagagatgatgaaacatgcttggaataattataaaggttatgcctggggattaaatgaactcaaacctatatcaaaaggaggccattcaagcagtttgtttggtaacatcaaaggagcaactatagtagatgccctggatacactttttattatggaaatgaaacatgaatttgaagaagcaaaatcatgggttgaagaaaatttagattttaatgtgaatgctgaaatttctgtctttgaagtaaatatacgctttgttggtggactactctcagcctactatctgtctggagaagagatttttcgaaagaaagcagtggaacttggggtaaaattgctacctgcatttcatactccctctggaataccttgggcattgctgaatatgaaaagtggtattggaaggaactggccctgggcctctggaggcagcagtattctggcagaatttggaaccctgcatttggagtttatgcacttgagccacttatcaggaaaccccatctttgctgaaaaggtaatgaatattcgaacagtactgaacaaactggaaaaaccacaaggcctttatcctaactatctgaatcccagtagtggacagtggggtcaacatcatgtatcagttggaggacttggagacagcttctatgagtatttgctgaaggcctggttaatgtctgacaagacagatctggaagctaagaagatgtattttgatgctgttcaggctatcgagactcatttgatccgcaagtctagcagcggactaacttatatcgcagagtggaaagggggcctcctggagcacaagatgggccacctgacctgcttcgctgggggcatgttcgcactcggggctgatgcagctcccgaaggcatggcccaacactaccttgaactcggggctgaaattgcccgtacttgtcatgaatcatataatcgaacatttatgaaactgggaccagaagctttcagatttgatggtggtgttgaagccatcgctacaagacaaaatgaaaaatactacatcttacggccagaagttatggagacttacatgtatatgtggagactgactcatgatccaaagtacaggaaatgggcctgggaagccgtagaggccttggaaaaccattgcagagtgaatggaggctattcaggcctaagggatgtttaccttcttcatgagagttatgatgatgtgcagcagagtttcttcctggcagagacattgaaatatttgtacctaatattttctgacgacgatcttcttccactggagcattggatcttcaatagcgaggcacatcttctccctatcctccctaaagataaaaaggaagttgaaatcagagaggaataaaaagacattttatattttattctgctccattcccttcactgtataccttaataattccttttctggtaatcaggcacatgatgaactttgattagtaggtctgtgattaagttcttaaattgttttgcagtcttttatgtttattatcataggtataggtggacctaaattccttatcatatcctttattaattcagccagtgtatccaccagttttttgtttatgtttttaagtaacctattatctctggatttcatgaaggtgtaatatcgtttttgttaaactgaatagaattgtatagcgatgacctcttaattataatttgatttgactgcaaaactttttcctcctctaagaggagatgatgtctgctttaagctgtaatgttttgccatgttgcaaaaagccataataataagtataaaaaagctttttcctttacaatttcatgttaatctggtttgtctgtccaccagagacagatcttctgtgacagcctccttatgcaggtctatcattatttgatagaatgtcttctaaaatacttcactcacattgtaattcaaattagaaagtcattccaaaaggatcatgtcatgttgacctcatttcatcggaactgcagtatatttttgttggttaattatattagtgttttctattttgtaaatgtgtcctttaattttactttaaatgccctgtgtcatttctggattatatactagttaatttcttccattccctactacacagagaggtgagctttcaaattttgcagagctctgctatcactgaattacatttatctgaagaaaatagtacaacttaatggattagcttttgggtttaactgaatatatgaagaaattgggtctgtctaaagagagggtatttcatatggcttttagttcacttgtttgtatttcatcttgatttttttctttggaaaataaagcattctatttggttcagatttctcagatttgaaaaaggctctatctcagatgtagtaaattatttcctttcagtttgtgaaagcaggatttgactctgaaagaagctttgccaattttacttattcgtgatcaatcaaggaaaatctaataaattttaggccaaataagaatatagcatatttagtatggttatagtcaacacagagatcacaacttagaagaaatataaagaaatggccactccccatcccccacagtcctggagtaaatcaaaatcaatatatgattcttttaaacattaagtttgaaataggaatggttttctcaagaatagatttggtgtgataccttgtgtttgcttacattggcccactatatatacatatatatttatgtagatatacttccatgaaagggctaatacgatgcatatactgaagggcaaggactttgaccatgtgaattttcagccgagaatggtcagaaagatcagtacaaccccatggattaggctgaaacatatgaaattgctgcatttgtagtttaaaaactgtcagcagtttcatatggttccacctaatattattgaagacaattattttcttagctatcaataggcttaatagttttagttattttagcttttgaaagtgttttaaaagatttcctttatcggacaggaccatctttatgacctgctttctgtttttcaatatcatacattggtgtatgtcaaagaataaattagtaaaattagtaaatgaaaaagactcttccgtacatcattatttccatgctaatgtgtgtctgtgatccagaataacttctcccactcatatcttcagttcacctaatgaaatgaatggatagcaagagccctttgttcccaggactttaaggcaaaatattaaaaattattgccaaaattaagaatataatgtttgtataaatgtccttgaatttgccatttaaattaactcattttcttttcactttgatttgaaagctgataagtatttctgcagcagatagaatattaaaatcaggttgtgtgtacacactgcactatgaggtaccttggtgtcctggtgtgaatagacaagaagctgtactatatgttgctctctcagtggcaacaatgaagtttttgcaattctagaacttggatttttttttaacaaaagtcccaaaacaccaaaaatgtaaacaagataagagattaatattgtagtgatgtaatttaattaaagttatattttgggttaattttaacaactgaagtcttattgttgaaacttattttcaacaaaactgtgcagttaaatttgtatacgtattcacatactgaaagatgaaccgttaaaatagcacttaattttgtgtttcttcaatatgtcttgatatactttgtgcaattaatattacacatgtaagttgtatggcagtttacagaactcaatgacttgtcatgaggttttcatatgagctacacattgtgtacattgattgttttttatttttacataaatccattctgtcattttcaactttatatataaatctccaatgttatgggaaacaatagattgacacataatttttaaaaattatatttgtaaaatttctctattgtgaataaagtcttttaatatatctccaaaaaaaaaaccactccaccttactaccagacaaccttagccaaaccatttacccaaataaagtataggcgatagaaattgagacctgtcgcaatagatatagtaccgcaagggaaagatgaaaaattataaccaagcataatatagcaaggactaacccctataccttctgcataatgaattaactagaaataactttgcaaggagagccaaagctaagacccccgaaaccagacgagctacctaagaacagctgagcacacccgtctatgtagcanaatagtgggaagatttataggtagaggcgacaaacctaccgagcctggtgatagctggttgtccaagatagaatttttgtcccttttttgcn

SEQ ID NO: 299239 - DNA, 4076 bp, Homo sapiens
ccgaccggccgtgtttttcagggagaaacggcaagcctttgaaactctgaagactgcaacaatgcaatgtatggggagatggaggtttgccccttccaccagatgatgaaacatgcttggaataattataaaggttatgcctggggattaaatgaactcaaacctatatcaaaaggaggccattcaagcagtttgtttggtaacatcaaaggagcaactatagtagatgccctggatacactttttattatggaaatgaaacatgaatttgaagaagcaaaatcatgggttgaagaaaatttagattttaatgtgaatgctgaaatttctgtctttgaagtaaatatacgctttgttggtggactactctcagcctactatctgtctggagaagagatttttcgaaagaaagcagtggaacttggggtaaaattgctacctgcatttcatactccctctggaataccttgggcattgctgaatatgaaaagtggtattggaaggaactggccctgggcctctggaggcagcagtattctggcagaatttggaaccctgcatttggagtttatgcacttgagccacttatcaggaaaccccatctttgctgaaaaggtaatgaatattcgaacagtactgaacaaactggaaaaaccacaaggcctttatcctaactatctgaatcccagtagtggacagtggggtcaacatcatgtatcagttggaggacttggagacagcttctatgagtatttgctgaaggcctggttaatgtctgacaagacagatctggaagctaagaagatgtattttgatgctgttcaggctatcgagactcatttgatccgcaagtctagcagcggactaacttatatcgcagagtggaaagggggcctcctggagcacaagatgggccacctgacctgcttcgctgggggcatgttcgcactcggggctgatgcagctcccgaaggcatggcccaacactaccttgaactcggggctgaaattgcccgtacttgtcatgaatcatataatcgaacatttatgaaactgggaccagaagctttcagatttgatggtggtgttgaagccatcgctacaagacaaaatgaaaaatactacatcttacggccagaagttatggagacttacatgtatatgtggagactgactcatgatccaaagtacaggaaatgggcctgggaagccgtagaggccttggaaaaccattgcagagtgaatggaggctattcaggcctaagggatgtttaccttcttcatgagagttatgatgatgtgcagcagagtttcttcctggcagagacattgaaatatttgtacctaatattttctgacgacgatcttcttccactggagcattggatcttcaatagcgaggcacatcttctccctatcctccctaaagataaaaaggaagttgaaatcagagaggaataaaaagacattttatattttattctgctccattcccttcactgtataccttaataattccttttctggtaatcaggcacatgatgaactttgattagtaggtctgtgattaagttcttaaattgttttgcagtcttttatgtttattatcataggtataggtggacctaaattccttatcatatcctttattaattcagccagtgtatccaccagttttttgtttatgtttttaagtaacctattatctctggatttcatgaaggtgtaatatcgtttttgttaaactgaatagaattgtatagcgatgacctcttaattataatttgatttgactgcaaaactttttcctcctctaagaggagatgatgtctgctttaagctgtaatgttttgccatgttgcaaaaagccataataataagtataaaaaagctttttcctttacaatttcatgttaatctggtttgtctgtccaccagagacagatcttctgtgacagcctccttatgcaggtctatcattatttgatagaatgtcttctaaaatacttcactcacattgtaattcaaattagaaagtcattccaaaaggatcatgtcatgttgacctcatttcatcggaactgcagtatatttttgttggttaattatattagtgttttctattttgtaaatgtgtcctttaattttactttaaatgccctgtgtcatttctggattatatactagttaatttcttccattccctactacacagagaggtgagctttcaaattttgcagagctctgctatcactgaattacatttatctgaagaaaatagtacaacttaatggattagcttttgggtttaactgaatatatgaagaaattgggtctgtctaaagagagggtatttcatatggcttttagttcacttgtttgtatttcatcttgatttttttctttggaaaataaagcattctatttggttcagatttctcagatttgaaaaaggctctatctcagatgtagtaaattatttcctttcagtttgtgaaagcaggatttgactctgaaagaagctttgccaattttacttattcgtgatcaatcaaggaaaatctaataaattttaggccaaataagaatatagcatatttagtatggttatagtcaacacagagatcacaacttagaagaaatataaagaaatggccactccccatcccccacagtcctggagtaaatcaaaatcaatatatgattcttttaaacattaagtttgaaataggaatggttttctcaagaatagatttggtgtgataccttgtgtttgcttacattggcccactatatatacatatatatttatgtagatatacttccatgaaagggctaatacgatgcatatactgaagggcaaggactttgaccatgtgaattttcagccgagaatggtcagaaagatcagtacaaccccatggattaggctgaaacatatgaaattgctgcatttgtagtttaaaaactgtcagcagtttcatatggttccacctaatattattgaagacaattattttcttagctatcaataggcttaatagttttagttattttagcttttgaaagtgttttaaaagatttcctttatcggacaggaccatctttatgacctgctttctgtttttcaatatcatacattggtgtatgtcaaagaataaattagtaaaattagtaaatgaaaaagactcttccgtacatcattatttccatgctaatgtgtgtctgtgatccagaataacttctcccactcatatcttcagttcacctaatgaaatgaatggatagcaagagccctttgttcccaggactttaaggcaaaatattaaaaattattgccaaaattaagaatataatgtttgtataaatgtccttgaatttgccatttaaattaactcattttcttttcactttgatttgaaagctgataagtatttctgcagcagatagaatattaaaatcaggttgtgtgtacacactgcactatgaggtaccttggtgtcctggtgtgaatagacaagaagctgtactatatgttgctctctcagtggcaacaatgaagtttttgcaattctagaacttggatttttttttaacaaaagtcccaaaacaccaaaaatgtaaacaagataagagattaatattgtagtgatgtaatttaattaaagttatattttgggttaattttaacaactgaagtcttattgttgaaacttattttcaacaaaactgtgcagttaaatttgtatacgtattcacatactgaaagatgaaccgttaaaatagcacttaattttgtgtttcttcaatatgtcttgatatactttgtgcaattaatattacacatgtaagttgtatggcagtttacagaactcaatgacttgtcatgaggttttcatatgagctacacattgtgtacattgattgttttttatttttacataaatccattctgtcattttcaactttatatataaatctccaatgttatgggaaacaatagattgacacataatttttaaaaattatatttgtaaaatttctctattgtgaataaagtcttttaatatatctcc

SEQ ID NO: 299240 - DNA, 5522 bp, Homo sapiens
ccaacttatttaaaacaaaacaattttgtaggtattattatacccatttcacagatgatgataaatgagaccaatagaagttaaataacttgccaaaggccacacagctggtgagtgatggagaacgaattaaaactcaagtgagcataattctaaaagccatcttctcgttagtgtttctcactatccaggtctgcctttgccttatttaactgaagttaagccatccttacctgtgatcacctagcctctcagtttggggggatcattacagcgggtttttaactcccaatgttctggtccagtttgctttacatgttcttatttatacattgtcaaggatgacctcaggacagtacagcaaggacacagtggcacttcacattttgttcccacgaaatgactggggcataatctcagatcatcttcctttagaatgtggaaacatcagcagaagaatattagtctttatacaagtcaaatccaaaatgacacatgtgaaaactaatagagctgactttcagccatgatagctttggcacacctcacatccctttgttcaacctctcttccctcaacggagagctgcattcctgggaatttctgttgtgcacttttcccacttgccctgctgtcatttaaaggtgaacattctagttttgctaagaaaaccctttccttcatttggaatgaacagcaattttattacttttgaccttaaaatgagtttgctgccttcaaatcttttcagcgccttcatcacgctctgcttcggggcgatcttcttcctgccagactcctccaagctgctcagcggggtcctgttccactccagccccgccttgcagccggccgccgaccacaagcccgggcccggggcgcgcgccgaggacgcggccgaggggcgagcccggcgccgcgaggagggggcacccggggacccggaggccgccctggaggacaacttggccaggatccgcgaaaaccacgagcgggctctcagggaagccaaggagaccctgcagaagctgcccgaggagatccaaagagacatcctactggagaagaagaaggtggcccaggaccagctgcgtgacaaggcgccgttcagaggcctgcccccggtggacttcgtgcccccaatcggggtggagagccgggagcccgccgacgccgccatccgcgagaaaagggcaaagatcaaagagatgatgaaacatgcttggaataattataaaggttatgcctggggattaaatgaactcaaacctatatcaaaaggaggccattcaagcagtttgtttggtaacatcaaaggagcaactatagtagatgccctggatacactttttattatggaaatgaaacatgaatttgaagaagcaaaatcatgggttgaagaaaatttagattttaatgtgaatgctgaaatttctgtctttgaagtaaatatacgctttgttggtggactactctcagcctactatctgtctggagaagagatttttcgaaagaaagcagtggaacttggggtaaaattgctacctgcatttcatactccctctggaataccttgggcattgctgaatatgaaaagtggtattggaaggaactggccctgggcctctggaggcagcagtattctggcagaatttggaaccctgcatttggagtttatgcacttgagccacttatcaggaaaccccatctttgctgaaaaggtaatgaatattcgaacagtactgaacaaactggaaaaaccacaaggcctttatcctaactatctgaatcccagtagtggacagtggggtcaacatcatgtatcagttggaggacttggagacagcttctatgagtatttgctgaaggcctggttaatgtctgacaagacagatctggaagctaagaagatgtattttgatgctgttcaggctatcgagactcatttgatccgcaagtctagcagcggactaacttatatcgcagagtggaaagggggcctcctggagcacaagatgggccacctgacctgcttcgctgggggcatgttcgcactcggggctgatgcagctcccgaaggcatggcccaacactaccttgaactcggggctgaaattgcccgtacttgtcatgaatcatataatcgaacatttatgaaactgggaccagaagctttcagatttgatggtggtgttgaagccatcgctacaagacaaaatgaaaaatactacatcttacggccagaagttatggagacttacatgtatatgtggagactgactcatgatccaaagtacaggaaatgggcctgggaagccgtagaggccttggaaaaccattgcagagtgaatggaggctattcaggcctaagggatgtttaccttcttcatgagagttatgatgatgtgcagcagagtttcttcctggcagagacattgaaatatttgtacctaatattttctgacgacgatcttcttccactggagcattggatcttcaatagcgaggcacatcttctccctatcctccctaaagataaaaaggaagttgaaatcagagaggaataaaaagacattttatattttattctgctccattcccttcactgtataccttaataattccttttctggtaatcaggcacatgatgaactttgattagtaggtctgtgattaagttcttaaattgttttgcagtcttttatgtttattatcataggtataggtggacctaaattccttatcatatcctttattaattcagccagtgtatccaccagttttttgtttatgtttttaagtaacctattatctctggatttcatgaaggtgtaatatcgtttttgttaaactgaatagaattgtatagcgatgacctcttaattataatttgatttgactgcaaaactttttcctcctctaagaggagatgatgtctgctttaagctgtaatgttttgccatgttgcaaaaagccataataataagtataaaaaagctttttcctttacaatttcatgttaatctggtttgtctgtccaccagagacagatcttctgtgacagcctccttatgcaggtctatcattatttgatagaatgtcttctaaaatacttcactcacattgtaattcaaattagaaagtcattccaaaaggatcatgtcatgttgacctcatttcatcggaactgcagtatatttttgttggttaattatattagtgttttctattttgtaaatgtgtcctttaattttactttaaatgccctgtgtcatttctggattatatactagttaatttcttccattccctactacacagagaggtgagctttcaaattttgcagagctctgctatcactgaattacatttatctgaagaaaatagtacaacttaatggattagcttttgggtttaactgaatatatgaagaaattgggtctgtctaaagagagggtatttcatatggcttttagttcacttgtttgtatttcatcttgatttttttctttggaaaataaagcattctatttggttcagatttctcagatttgaaaaaggctctatctcagatgtagtaaattatttcctttcagtttgtgaaagcaggatttgactctgaaagaagctttgccaattttacttattcgtgatcaatcaaggaaaatctaataaattttaggccaaataagaatatagcatatttagtatggttatagtcaacacagagatcacaacttagaagaaatataaagaaatggccactccccatcccccacagtcctggagtaaatcaaaatcaatatatgattcttttaaacattaagtttgaaataggaatggttttctcaagaatagatttggtgtgataccttgtgtttgcttacattggcccactatatatacatatatatttatgtagatatacttccatgaaagggctaatacgatgcatatactgaagggcaaggactttgaccatgtgaattttcagccgagaatggtcagaaagatcagtacaaccccatggattaggctgaaacatatgaaattgctgcatttgtagtttaaaaactgtcagcagtttcatatggttccacctaatattattgaagacaattattttcttagctatcaataggcttaatagttttagttattttagcttttgaaagtgttttaaaagatttcctttatcggacaggaccatctttatgacctgctttctgtttttcaatatcatacattggtgtatgtcaaagaataaattagtaaaattagtaaatgaaaaagactcttccgtacatcattatttccatgctaatgtgtgtctgtgatccagaataacttctcccactcatatcttcagttcacctaatgaaatgaatggatagcaagagccctttgttcccaggactttaaggcaaaatattaaaaattattgccaaaattaagaatataatgtttgtataaatgtccttgaatttgccatttaaattaactcattttcttttcactttgatttgaaagctgataagtatttctgcagcagatagaatattaaaatcaggttgtgtgtacacactgcactatgaggtaccttggtgtcctggtgtgaatagacaagaagctgtactatatgttgctctctcagtggcaacaatgaagtttttgcaattctagaacttggatttttttttaacaaaagtcccaaaacaccaaaaatgtaaacaagataagagattaatattgtagtgatgtaatttaattaaagttatattttgggttaattttaacaactgaagtcttattgttgaaacttattttcaacaaaactgtgcagttaaatttgtatacgtattcacatactgaaagatgaaccgttaaaatagcacttaattttgtgtttcttcaatatgtcttgatatactttgtgcaattaatattacacatgtaagttgtatggcagtttacagaactcaatgacttgtcatgaggttttcatatgagctacacattgtgtacattgattgttttttatttttacataaatccattctgtcattttcaactttatatataaatctccaatgttatgggaaacaatagattgacacataatttttaaaaattatatttgtaaaatttctctattgtgaataaagtcttttaatatatctccaaaaaaaaaaaaaaaaaaagaaacaaaaaaagaaaaaaaaaaaaaaaaaaaaaaaaaaaagggggggggggaaaaaaaaaccacggggggcacaaatctatccgccacccacgtttagatcaaaggggccccaagagagagacaaaagaaagcgacggcgacacaacaaccgggggcacacgcgtacgactagggagagcacaatcgcggtagtaggacacacacaaaaaacgagaacaaacaggaccgtgacaccacctgcgattgcctaataaaaaggcagaaacggcacgcacagcgacgagcacgcagcagaaacaccacacgcagcaccatgtac

SEQ ID NO: 299241 - DNA, 4022 bp, Homo sapiens
ccgaccggccgtgtttttcagggagaaacggcaagcctttgaaactctgaagactgcaacaatgcaatgtatggggagatggaggtttgccccttccaccagatgatgaaacatgcttggaataattataaaggttatgcctggggattaaatgaactcaaacctatatcaaaaggaggccattcaagcagtttgtttggtaacatcaaaggagcaactatagtagatgccctggatacactttttattatggaaatgaaacatgaatttgaagaagcaaaatcatgggttgaaggctttgttggtggactactctcagcctactatctgtctggagaagagatttttcgaaagaaagcagtggaacttggggtaaaattgctacctgcatttcatactccctctggaataccttgggcattgctgaatatgaaaagtggtattggaaggaactggccctgggcctctggaggcagcagtattctggcagaatttggaaccctgcatttggagtttatgcacttgagccacttatcaggaaaccccatctttgctgaaaaggtaatgaatattcgaacagtactgaacaaactggaaaaaccacaaggcctttatcctaactatctgaatcccagtagtggacagtggggtcaacatcatgtatcagttggaggacttggagacagcttctatgagtatttgctgaaggcctggttaatgtctgacaagacagatctggaagctaagaagatgtattttgatgctgttcaggctatcgagactcatttgatccgcaagtctagcagcggactaacttatatcgcagagtggaaagggggcctcctggagcacaagatgggccacctgacctgcttcgctgggggcatgttcgcactcggggctgatgcagctcccgaaggcatggcccaacactaccttgaactcggggctgaaattgcccgtacttgtcatgaatcatataatcgaacatttatgaaactgggaccagaagctttcagatttgatggtggtgttgaagccatcgctacaagacaaaatgaaaaatactacatcttacggccagaagttatggagacttacatgtatatgtggagactgactcatgatccaaagtacaggaaatgggcctgggaagccgtagaggccttggaaaaccattgcagagtgaatggaggctattcaggcctaagggatgtttaccttcttcatgagagttatgatgatgtgcagcagagtttcttcctggcagagacattgaaatatttgtacctaatattttctgacgacgatcttcttccactggagcattggatcttcaatagcgaggcacatcttctccctatcctccctaaagataaaaaggaagttgaaatcagagaggaataaaaagacattttatattttattctgctccattcccttcactgtataccttaataattccttttctggtaatcaggcacatgatgaactttgattagtaggtctgtgattaagttcttaaattgttttgcagtcttttatgtttattatcataggtataggtggacctaaattccttatcatatcctttattaattcagccagtgtatccaccagttttttgtttatgtttttaagtaacctattatctctggatttcatgaaggtgtaatatcgtttttgttaaactgaatagaattgtatagcgatgacctcttaattataatttgatttgactgcaaaactttttcctcctctaagaggagatgatgtctgctttaagctgtaatgttttgccatgttgcaaaaagccataataataagtataaaaaagctttttcctttacaatttcatgttaatctggtttgtctgtccaccagagacagatcttctgtgacagcctccttatgcaggtctatcattatttgatagaatgtcttctaaaatacttcactcacattgtaattcaaattagaaagtcattccaaaaggatcatgtcatgttgacctcatttcatcggaactgcagtatatttttgttggttaattatattagtgttttctattttgtaaatgtgtcctttaattttactttaaatgccctgtgtcatttctggattatatactagttaatttcttccattccctactacacagagaggtgagctttcaaattttgcagagctctgctatcactgaattacatttatctgaagaaaatagtacaacttaatggattagcttttgggtttaactgaatatatgaagaaattgggtctgtctaaagagagggtatttcatatggcttttagttcacttgtttgtatttcatcttgatttttttctttggaaaataaagcattctatttggttcagatttctcagatttgaaaaaggctctatctcagatgtagtaaattatttcctttcagtttgtgaaagcaggatttgactctgaaagaagctttgccaattttacttattcgtgatcaatcaaggaaaatctaataaattttaggccaaataagaatatagcatatttagtatggttatagtcaacacagagatcacaacttagaagaaatataaagaaatggccactccccatcccccacagtcctggagtaaatcaaaatcaatatatgattcttttaaacattaagtttgaaataggaatggttttctcaagaatagatttggtgtgataccttgtgtttgcttacattggcccactatatatacatatatatttatgtagatatacttccatgaaagggctaatacgatgcatatactgaagggcaaggactttgaccatgtgaattttcagccgagaatggtcagaaagatcagtacaaccccatggattaggctgaaacatatgaaattgctgcatttgtagtttaaaaactgtcagcagtttcatatggttccacctaatattattgaagacaattattttcttagctatcaataggcttaatagttttagttattttagcttttgaaagtgttttaaaagatttcctttatcggacaggaccatctttatgacctgctttctgtttttcaatatcatacattggtgtatgtcaaagaataaattagtaaaattagtaaatgaaaaagactcttccgtacatcattatttccatgctaatgtgtgtctgtgatccagaataacttctcccactcatatcttcagttcacctaatgaaatgaatggatagcaagagccctttgttcccaggactttaaggcaaaatattaaaaattattgccaaaattaagaatataatgtttgtataaatgtccttgaatttgccatttaaattaactcattttcttttcactttgatttgaaagctgataagtatttctgcagcagatagaatattaaaatcaggttgtgtgtacacactgcactatgaggtaccttggtgtcctggtgtgaatagacaagaagctgtactatatgttgctctctcagtggcaacaatgaagtttttgcaattctagaacttggatttttttttaacaaaagtcccaaaacaccaaaaatgtaaacaagataagagattaatattgtagtgatgtaatttaattaaagttatattttgggttaattttaacaactgaagtcttattgttgaaacttattttcaacaaaactgtgcagttaaatttgtatacgtattcacatactgaaagatgaaccgttaaaatagcacttaattttgtgtttcttcaatatgtcttgatatactttgtgcaattaatattacacatgtaagttgtatggcagtttacagaactcaatgacttgtcatgaggttttcatatgagctacacattgtgtacattgattgttttttatttttacataaatccattctgtcattttcaactttatatataaatctccaatgttatgggaaacaatagattgacacataatttttaaaaattatatttgtaaaatttctctattgtgaataaagtcttttaatatatctcc

SEQ ID NO: 299242 - DNA, 4553 bp, Homo sapiens
ccaacttatttaaaacaaaacaattttgtaggtattattatacccatttcacagatgatgataaatgagaccaatagaagttaaataacttgccaaaggccacacagctggtgagtgatggagaacgaattaaaactcaagtgagcataattctaaaagccatcttctcgttagtgtttctcactatccaggtctgcctttgccttatttaactgaagttaagccatccttacctgtgatcacctagcctctcagtttggggggatcattacagcgggtttttaactcccaatgttctggtccagtttgctttacatgttcttatttatacattgtcaaggatgacctcaggacagtacagcaaggacacagtggcacttcacattttgttcccacgaaatgactggggcataatctcagatcatcttcctttagaatgtggaaacatcagcagaagaatattagtctttatacaagtcaaatccaaaatgacacatgtgaaaactaatagagctgactttcagccatgatagctttggcacacctcacatccctttgttcaacctctcttccctcaacggagagctgcattcctgggaatttctgttgtgcacttttcccacttgccctgctgtcatttaaaggtgaacattctagttttgctaagaaaaccctttccttcatttggaatgaacagcaattttattacttttgaccttaaaatgagtttgctgccttcaaatcttttcagcgccttcatcacgctctgcttcggggcgatcttcttcctgccagactcctccaagctgctcagcggggtcctgttccactccagccccgccttgcagccggccgccgaccacaagcccgggcccggggcgcgcgccgaggacgcggccgaggggcgagcccggcgccgcgaggagggggcacccggggacccggaggccgccctggaggacaacttggccaggatccgcgaaaaccacgagcgggctctcagggaagccaaggagaccctaatttggaaccctgcatttggagtttatgcacttgagccacttatcaggaaaccccatctttgctgaaaaggtaatgaatattcgaacagtactgaacaaactggaaaaaccacaaggcctttatcctaactatctgaatcccagtagtggacagtggggtcaacatcatgtatcagttggaggacttggagacagcttctatgagtatttgctgaaggcctggttaatgtctgacaagacagatctggaagctaagaagatgtattttgatgctgttcaggctatcgagactcatttgatccgcaagtctagcagcggactaacttatatcgcagagtggaaagggggcctcctggagcacaagatgggccacctgacctgcttcgctgggggcatgttcgcactcggggctgatgcagctcccgaaggcatggcccaacactaccttgaactcggggctgaaattgcccgtacttgtcatgaatcatataatcgaacatttatgaaactgggaccagaagctttcagatttgatggtggtgttgaagccatcgctacaagacaaaatgaaaaatactacatcttacggccagaagttatggagacttacatgtatatgtggagactgactcatgatccaaagtacaggaaatgggcctgggaagccgtagaggccttggaaaaccattgcagagtgaatggaggctattcaggcctaagggatgtttaccttcttcatgagagttatgatgatgtgcagcagagtttcttcctggcagagacattgaaatatttgtacctaatattttctgacgacgatcttcttccactggagcattggatcttcaatagcgaggcacatcttctccctatcctccctaaagataaaaaggaagttgaaatcagagaggaataaaaagacattttatattttattctgctccattcccttcactgtataccttaataattccttttctggtaatcaggcacatgatgaactttgattagtaggtctgtgattaagttcttaaattgttttgcagtcttttatgtttattatcataggtataggtggacctaaattccttatcatatcctttattaattcagccagtgtatccaccagttttttgtttatgtttttaagtaacctattatctctggatttcatgaaggtgtaatatcgtttttgttaaactgaatagaattgtatagcgatgacctcttaattataatttgatttgactgcaaaactttttcctcctctaagaggagatgatgtctgctttaagctgtaatgttttgccatgttgcaaaaagccataataataagtataaaaaagctttttcctttacaatttcatgttaatctggtttgtctgtccaccagagacagatcttctgtgacagcctccttatgcaggtctatcattatttgatagaatgtcttctaaaatacttcactcacattgtaattcaaattagaaagtcattccaaaaggatcatgtcatgttgacctcatttcatcggaactgcagtatatttttgttggttaattatattagtgttttctattttgtaaatgtgtcctttaattttactttaaatgccctgtgtcatttctggattatatactagttaatttcttccattccctactacacagagaggtgagctttcaaattttgcagagctctgctatcactgaattacatttatctgaagaaaatagtacaacttaatggattagcttttgggtttaactgaatatatgaagaaattgggtctgtctaaagagagggtatttcatatggcttttagttcacttgtttgtatttcatcttgatttttttctttggaaaataaagcattctatttggttcagatttctcagatttgaaaaaggctctatctcagatgtagtaaattatttcctttcagtttgtgaaagcaggatttgactctgaaagaagctttgccaattttacttattcgtgatcaatcaaggaaaatctaataaattttaggccaaataagaatatagcatatttagtatggttatagtcaacacagagatcacaacttagaagaaatataaagaaatggccactccccatcccccacagtcctggagtaaatcaaaatcaatatatgattcttttaaacattaagtttgaaataggaatggttttctcaagaatagatttggtgtgataccttgtgtttgcttacattggcccactatatatacatatatatttatgtagatatacttccatgaaagggctaatacgatgcatatactgaagggcaaggactttgaccatgtgaattttcagccgagaatggtcagaaagatcagtacaaccccatggattaggctgaaacatatgaaattgctgcatttgtagtttaaaaactgtcagcagtttcatatggttccacctaatattattgaagacaattattttcttagctatcaataggcttaatagttttagttattttagcttttgaaagtgttttaaaagatttcctttatcggacaggaccatctttatgacctgctttctgtttttcaatatcatacattggtgtatgtcaaagaataaattagtaaaattagtaaatgaaaaagactcttccgtacatcattatttccatgctaatgtgtgtctgtgatccagaataacttctcccactcatatcttcagttcacctaatgaaatgaatggatagcaagagccctttgttcccaggactttaaggcaaaatattaaaaattattgccaaaattaagaatataatgtttgtataaatgtccttgaatttgccatttaaattaactcattttcttttcactttgatttgaaagctgataagtatttctgcagcagatagaatattaaaatcaggttgtgtgtacacactgcactatgaggtaccttggtgtcctggtgtgaatagacaagaagctgtactatatgttgctctctcagtggcaacaatgaagtttttgcaattctagaacttggatttttttttaacaaaagtcccaaaacaccaaaaatgtaaacaagataagagattaatattgtagtgatgtaatttaattaaagttatattttgggttaattttaacaactgaagtcttattgttgaaacttattttcaacaaaactgtgcagttaaatttgtatacgtattcacatactgaaagatgaaccgttaaaatagcacttaattttgtgtttcttcaatatgtcttgatatactttgtgcaattaatattacacatgtaagttgtatggcagtttacagaactcaatgacttgtcatgaggttttcatatgagctacacattgtgtacattgattgttttttatttttacataaatccattctgtcattttcaactttatatataaatctccaatgttatgggaaacaatagattgacacataatttttaaaaattatatttgtaaaatttctctattgtgaataaagtcttttaatatatctcc

SEQ ID NO: 299243 - DNA, 3143 bp, Homo sapiens
tttttgagatggagtcttgctgtgtcaccaggctggagtgcaatggaacgaccttggctcactgtaacctccgcctccctggttcaggagaatcacctgagcccaagaggtagaagctgcagtgacccatgatggtgccactgtactccgcccaggcaacagagtgaggccctgtctcaaaaaaaaaaaaatgttttatctgaacttgacaatctaataataaaaattagtgacaatcagtttactgaaatgtgacttttttttttttcctcctctataatttaggccttggaaaaccattgcagagtgaatggaggctattcaggcctaagggatgtttaccttcttcatgagagttatgatgatgtgcagcagagtttcttcctggcagagacattgaaatatttgtacctaatattttctgacgacgatcttcttccactggagcattggatcttcaatagcgaggcacatcttctccctatcctccctaaagataaaaaggaagttgaaatcagagaggaataaaaagacattttatattttattctgctccattcccttcactgtataccttaataattccttttctggtaatcaggcacatgatgaactttgattagtaggtctgtgattaagttcttaaattgttttgcagtcttttatgtttattatcataggtataggtggacctaaattccttatcatatcctttattaattcagccagtgtatccaccagttttttgtttatgtttttaagtaacctattatctctggatttcatgaaggtgtaatatcgtttttgttaaactgaatagaattgtatagcgatgacctcttaattataatttgatttgactgcaaaactttttcctcctctaagaggagatgatgtctgctttaagctgtaatgttttgccatgttgcaaaaagccataataataagtataaaaaagctttttcctttacaatttcatgttaatctggtttgtctgtccaccagagacagatcttctgtgacagcctccttatgcaggtctatcattatttgatagaatgtcttctaaaatacttcactcacattgtaattcaaattagaaagtcattccaaaaggatcatgtcatgttgacctcatttcatcggaactgcagtatatttttgttggttaattatattagtgttttctattttgtaaatgtgtcctttaattttactttaaatgccctgtgtcatttctggattatatactagttaatttcttccattccctactacacagagaggtgagctttcaaattttgcagagctctgctatcactgaattacatttatctgaagaaaatagtacaacttaatggattagcttttgggtttaactgaatatatgaagaaattgggtctgtctaaagagagggtatttcatatggcttttagttcacttgtttgtatttcatcttgatttttttctttggaaaataaagcattctatttggttcagatttctcagatttgaaaaaggctctatctcagatgtagtaaattatttcctttcagtttgtgaaagcaggatttgactctgaaagaagctttgccaattttacttattcgtgatcaatcaaggaaaatctaataaattttaggccaaataagaatatagcatatttagtatggttatagtcaacacagagatcacaacttagaagaaatataaagaaatggccactccccatcccccacagtcctggagtaaatcaaaatcaatatatgattcttttaaacattaagtttgaaataggaatggttttctcaagaatagatttggtgtgataccttgtgtttgcttacattggcccactatatatacatatatatttatgtagatatacttccatgaaagggctaatacgatgcatatactgaagggcaaggactttgaccatgtgaattttcagccgagaatggtcagaaagatcagtacaaccccatggattaggctgaaacatatgaaattgctgcatttgtagtttaaaaactgtcagcagtttcatatggttccacctaatattattgaagacaattattttcttagctatcaataggcttaatagttttagttattttagcttttgaaagtgttttaaaagatttcctttatcggacaggaccatctttatgacctgctttctgtttttcaatatcatacattggtgtatgtcaaagaataaattagtaaaattagtaaatgaaaaagactcttccgtacatcattatttccatgctaatgtgtgtctgtgatccagaataacttctcccactcatatcttcagttcacctaatgaaatgaatggatagcaagagccctttgttcccaggactttaaggcaaaatattaaaaattattgccaaaattaagaatataatgtttgtataaatgtccttgaatttgccatttaaattaactcattttcttttcactttgatttgaaagctgataagtatttctgcagcagatagaatattaaaatcaggttgtgtgtacacactgcactatgaggtaccttggtgtcctggtgtgaatagacaagaagctgtactatatgttgctctctcagtggcaacaatgaagtttttgcaattctagaacttggatttttttttaacaaaagtcccaaaacaccaaaaatgtaaacaagataagagattaatattgtagtgatgtaatttaattaaagttatattttgggttaattttaacaactgaagtcttattgttgaaacttattttcaacaaaactgtgcagttaaatttgtatacgtattcacatactgaaagatgaaccgttaaaatagcacttaattttgtgtttcttcaatatgtcttgatatactttgtgcaattaatattacacatgtaagttgtatggcagtttacagaactcaatgacttgtcatgaggttttcatatgagctacacattgtgtacattgattgttttttatttttacataaatccattctgtcattttcaactttatatataaatctccaatgttatgggaaacaatagattgacacataatttttaaaaattatatttgtaaaatttctctattgtgaataaagtcttttaatatatctcc

SEQ ID NO: 299244 - DNA, 4022 bp, Homo sapiens
ccgaccggccgtgtttttcagggagaaacggcaagcctttgaaactctgaagactgcaacaatgcaatgtatggggagatggaggtttgccccttccaccagatgatgaaacatgcttggaataattataaaggttatgcctggggattaaatgaactcaaacctatatcaaaaggaggccattcaagcagtttgtttggtaacatcaaaggagcaactatagtagatgccctggatacactttttattatggaaatgaaacatgaatttgaagaagcaaaatcatgggttgaagaaaatttagattttaatgtgaatgctgaaatttctgtctttgaagtaaatatacgctttgttggtggactactctcagcctactatctgtctggagaagagatttttcgaaagaaagcagtggaacttggggtaaaattgctacctgcatttcatactccctctggaataccttgggcattgctgaatatgaaaagtggtattggaaggaactggccctgggcctctggaggcagcagtattctggcagaatttggaaccctgcatttggagtttatgcacttgagccacttatcaggaaaccccatctttgctgaaaaggtaatgaatattcgaacagtactgaacaaactggaaaaaccacaaggcctttatcctaactatctgaatcccagtagtggacagtggggtcaacatcatgtatcagttggaggacttggagacagcttctatgagtatttgctgaaggcctggttaatgtctgacaagacagatctggaagctaagaagatgtattttgatgctgttcaggctatcgagactcatttgatccgcaagtctagcagcggactaacttatatcgcagagtggaaagggggcctcctggagcacaagatgggccacctgacctgcttcgctgggggcatgttcgcactcggggctgatgcagctcccgaaggcatggcccaacactaccttgaactcggggctgaaattgcccgtacttgtcatgaatcatataatcgaacatttatgaaactgggaccagaagctttcagatttgatggtggtgttgaagccatcgctacaagacaaaatgaaaaatactacatcttacggccagaagttatggagacttacatgtatatgtggagactgactcatgatccaaagtacaggaaatgggcctgggaagccgtagaggccttggaaaaccattgcagagtgaatggaggctattcaggcctaagggatgtttaccttcttcatgagagttatgatgatgtgcagcagagtttcttcctggcagagacattgaaatatttgtacctaatattttctgacgacgatcttcttccactggagcattggatcttcaatagcgaggcacatcttctccctatcctccctaaagataaaaaggaagttgaaatcagagaggaataattccttttctggtaatcaggcacatgatgaactttgattagtaggtctgtgattaagttcttaaattgttttgcagtcttttatgtttattatcataggtataggtggacctaaattccttatcatatcctttattaattcagccagtgtatccaccagttttttgtttatgtttttaagtaacctattatctctggatttcatgaaggtgtaatatcgtttttgttaaactgaatagaattgtatagcgatgacctcttaattataatttgatttgactgcaaaactttttcctcctctaagaggagatgatgtctgctttaagctgtaatgttttgccatgttgcaaaaagccataataataagtataaaaaagctttttcctttacaatttcatgttaatctggtttgtctgtccaccagagacagatcttctgtgacagcctccttatgcaggtctatcattatttgatagaatgtcttctaaaatacttcactcacattgtaattcaaattagaaagtcattccaaaaggatcatgtcatgttgacctcatttcatcggaactgcagtatatttttgttggttaattatattagtgttttctattttgtaaatgtgtcctttaattttactttaaatgccctgtgtcatttctggattatatactagttaatttcttccattccctactacacagagaggtgagctttcaaattttgcagagctctgctatcactgaattacatttatctgaagaaaatagtacaacttaatggattagcttttgggtttaactgaatatatgaagaaattgggtctgtctaaagagagggtatttcatatggcttttagttcacttgtttgtatttcatcttgatttttttctttggaaaataaagcattctatttggttcagatttctcagatttgaaaaaggctctatctcagatgtagtaaattatttcctttcagtttgtgaaagcaggatttgactctgaaagaagctttgccaattttacttattcgtgatcaatcaaggaaaatctaataaattttaggccaaataagaatatagcatatttagtatggttatagtcaacacagagatcacaacttagaagaaatataaagaaatggccactccccatcccccacagtcctggagtaaatcaaaatcaatatatgattcttttaaacattaagtttgaaataggaatggttttctcaagaatagatttggtgtgataccttgtgtttgcttacattggcccactatatatacatatatatttatgtagatatacttccatgaaagggctaatacgatgcatatactgaagggcaaggactttgaccatgtgaattttcagccgagaatggtcagaaagatcagtacaaccccatggattaggctgaaacatatgaaattgctgcatttgtagtttaaaaactgtcagcagtttcatatggttccacctaatattattgaagacaattattttcttagctatcaataggcttaatagttttagttattttagcttttgaaagtgttttaaaagatttcctttatcggacaggaccatctttatgacctgctttctgtttttcaatatcatacattggtgtatgtcaaagaataaattagtaaaattagtaaatgaaaaagactcttccgtacatcattatttccatgctaatgtgtgtctgtgatccagaataacttctcccactcatatcttcagttcacctaatgaaatgaatggatagcaagagccctttgttcccaggactttaaggcaaaatattaaaaattattgccaaaattaagaatataatgtttgtataaatgtccttgaatttgccatttaaattaactcattttcttttcactttgatttgaaagctgataagtatttctgcagcagatagaatattaaaatcaggttgtgtgtacacactgcactatgaggtaccttggtgtcctggtgtgaatagacaagaagctgtactatatgttgctctctcagtggcaacaatgaagtttttgcaattctagaacttggatttttttttaacaaaagtcccaaaacaccaaaaatgtaaacaagataagagattaatattgtagtgatgtaatttaattaaagttatattttgggttaattttaacaactgaagtcttattgttgaaacttattttcaacaaaactgtgcagttaaatttgtatacgtattcacatactgaaagatgaaccgttaaaatagcacttaattttgtgtttcttcaatatgtcttgatatactttgtgcaattaatattacacatgtaagttgtatggcagtttacagaactcaatgacttgtcatgaggttttcatatgagctacacattgtgtacattgattgttttttatttttacataaatccattctgtcattttcaactttatatataaatctccaatgttatgggaaacaatagattgacacataatttttaaaaattatatttgtaaaatttctctattgtgaataaagtcttttaatatatctcc

SEQ ID NO: 299245 - DNA, 4211 bp, Homo sapiens
ttcctccaaaatcctttctagccagagaaggtttttctcaactgataaggcaaagtctatgctttccatcttcttggtagttggattaaatgggagaaaaatggggtacaattatatatgtaaaaaaaaaagagggacagaattatgatccacaggggaaaactgaaacgtaagtgaaaaatgacatgagaaactaagagtaagtatatcttgtttacattttctttatttcactataaaatatattagggttttagtcttaaactttattatttttgtctacagtcaataaatgagaaccagattgcagatggcaatttttgtacgatggaaatttttatttgaccatataattaataggattagtaggatgtgatggcagaaaataactttcctagagatgaatatgcctggtaactagcagagcaacaaatgtaatttcaaaatataaacagcacaaaaaaaaaaacaactcaaaatgaattaaagacttaaatgtaagacctgaaaccataaaactcctaggagaaaacaacaggggaaaagctccttgacattgagcttggcaatgattttttggattcgacccaaaaacacaggcaacaaaagcaaacataaacacatgaaactacatcaaactaaaaagtttccttacagcaaaggaaacaatcaactaaaaacacaacaaaaatgtgtgcaaaccatatatctgataaggggttaatatccaaaatatataaggaacttacaattcagtagcagaaaaacaacctgatttcaaaataggcaaaggacctgaagagacatttttccaaagaagacgtacagatggccagtagtgaaaagatgctcaacatcacaaatcatcagggaaatgcagattagaaccacagtgagatatcacctcatacctttttaaatggctattatcaaaaattcaagaggtaatcagtcttagtgaggatgcagaataaagggaacctttgtacactgttggtggcaatgaaaattgatatagccattatggaaaacagtatggaggtttctcaaaaaattaaaaatagagctaccatatgatccagcaatcctaattcttggtgtatatccacagaagatgatgtgtatccacatcagaagatgatgtatatccaccacagaagatggtgtatatccacagaagtagtgtatatcaaaacatcacactgtacaccttccagtatatactatttgtatttgtcatacatcggtaaagctggaaaaaggttaaagaaaaatagaaacaaacaaaagaaagaaagtgggctctgaaagggaaaaagaaaacacaaacagcagccatcttagtggtaaccaacaaagtggaaggcaggttggtttaggttgttacctaaatgttcatcctcacactgcccaacccatctgttttccaaatattcattaaattcagacaactacagaaatgtaggatcatttctctctagagagttgtcagtggagtcatcccatcttcttccatactagaatatttgtacctaatattttctgacgacgatcttcttccactggagcattggatcttcaatagcgaggcacatcttctccctatcctccctaaagataaaaaggaagttgaaatcagagaggaataaaaagacattttatattttattctgctccattcccttcactgtataccttaataattccttttctggtaatcaggcacatgatgaactttgattagtaggtctgtgattaagttcttaaattgttttgcagtcttttatgtttattatcataggtataggtggacctaaattccttatcatatcctttattaattcagccagtgtatccaccagttttttgtttatgtttttaagtaacctattatctctggatttcatgaaggtgtaatatcgtttttgttaaactgaatagaattgtatagcgatgacctcttaattataatttgatttgactgcaaaactttttcctcctctaagaggagatgatgtctgctttaagctgtaatgttttgccatgttgcaaaaagccataataataagtataaaaaagctttttcctttacaatttcatgttaatctggtttgtctgtccaccagagacagatcttctgtgacagcctccttatgcaggtctatcattatttgatagaatgtcttctaaaatacttcactcacattgtaattcaaattagaaagtcattccttggttaattatattagtgttttctattttgtaaatgtgtcctttaattttactttaaatgccctgtgtcatttctggattatatactagttaatttcttccattccctactacacagagaggtgagctttcaaattttgcagagctctgctatcactgaattacatttatctgaagaaaatagtacaacttaatggattagcttttgggtttaactgaatatatgaagaaattgggtctgtctaaagagagggtatttcatatggcttttagttcacttgtttgtatttcatcttgatttttttctttggaaaataaagcattctatttggttcagatttctcagatttgaaaaaggctctatctcagatgtagtaaattatttcctttcagtttgtgaaagcaggatttgactctgaaagaagctttgccaattttacttattcgtgatcaatcaaggaaaatctaataaattttaggccaaataagaatatagcatatttagtatggttatagtcaacacagagatcacaacttagaagaaatataaagaaatggccactccccatcccccacagtcctggagtaaatcaaaatcaatatatgattcttttaaacattaagtttgaaataggaatggttttctcaagaatagatttggtgtgataccttgtgtttgcttacattggcccactatatatacatatatatttatgtagatatacttccatgaaagggctaatacgatgcatatactgaagggcaaggactttgaccatgtgaattttcagccgagaatggtcagaaagatcagtacaaccccatggattaggctgaaacatatgaaattgctgcatttgtagtttaaaaactgtcagcagtttcatatggttccacctaatattattgaagacaattattttcttagctatcaataggcttaatagttttagttattttagcttttgaaagtgttttaaaagatttcctttatcggacaggaccatctttatgacctgctttctgtttttcaatatcatacattggtgtatgtcaaagaataaattagtaaaattagtaaatgaaaaagactcttccgtacatcattatttccatgctaatgtgtgtctgtgatccagaataacttctcccactcatatcttcagttcacctaatgaaatgaatggatagcaagagccctttgttcccaggactttaaggcaaaatattaaaaattattgccaaaattaagaatataatgtttgtataaatgtccttgaatttgccatttaaattaactcattttcttttcactttgatttgaaagctgataagtatttctgcagcagatagaatattaaaatcaggttgtgtgtacacactgcactatgaggtaccttggtgtcctggtgtgaatagacaagaagctgtactatatgttgctctctcagtggcaacaatgaagtttttgcaattctagaacttggatttttttttaacaaaagtcccaaaacaccaaaaatgtaaacaagataagagattaatattgtagtgatgtaatttaattaaagttatattttgggttaattttaacaactgaagtcttattgttgaaacttattttcaacaaaactgtgcagttaaatttgtatacgtattcacatactgaaagatgaaccgttaaaatagcacttaattttgtgtttcttcaatatgtcttgatatactttgtgcaattaatattacacatgtaagttgtatggcagtttacagaactcaatgacttgtcatgaggttttcatatgagctacacattgtgtacattgattgttttttatttttacataaatccattctgtcattttcaactttatatataaatctccaatgttatgggaaacaatagattgacacataatttttaaaaattatatttgtaaaatttctctattgtgaataaagtcttttaatatatctcc

SEQ ID NO: 299246 - DNA, 4282 bp, Homo sapiens
ccaacttatttaaaacaaaacaattttgtaggtattattatacccatttcacagatgatgataaatgagaccaatagaagttaaataacttgccaaaggccacacagctggtgagtgatggagaacgaattaaaactcaagtgagcataattctaaaagccatcttctcgttagtgtttctcactatccaggtctgcctttgccttatttaactgaagttaagccatccttacctgtgatcacctagcctctcagtttggggggatcattacagcgggtttttaactcccaatgttctggtccagtttgctttacatgttcttatttatacattgtcaaggatgacctcaggacagtacagcaaggacacagtggcacttcacattttgttcccacgaaatgactggggcataatctcagatcatcttcctttagaatgtggaaacatcagcagaagaatattagtctttatacaagtcaaatccaaaatgacacatgtgaaaactaatagagctgactttcagccatgatagctttggcacacctcacatccctttgttcaacctctcttccctcaacggagagctgcattcctgggaatttctgttgtgcacttttcccacttgccctgctgtcatttaaaggtgaacattctagttttgctaagaaaaccctttccttcatttggaatgaacagcaattttattacttttgaccttaaaatgagtttgctgccttcaaatcttttcagcgccttcatcacgctctgcttcggggcgatcttcttcctgccagactcctccaagctgctcagcggggtcctgttccactccagccccgccttgcagccggccgccgaccacaagcccgggcccggggcgcgcgccgaggacgcggccgaggggcgagcccggcgccgcgaggagggggcacccggggacccggaggccgccctggaggacaacttggccaggatccgcgaaaaccacgagcgggctctcagggaagccaaggagaccctgcagaagctgcccgaggagatccaaagagacatcctactggagaagaagaaggtggcccaggaccagctgcgtgacaaggcgccgttcagaggcctgcccccggtggacttcgtgcccccaatcggggtggagagccgggagcccgccgacgccgccatccgcgagaaaagggcaaagatcaaagagatgatgaaacatgcttggaataattataaaggttatgcctggggattaaatgaactcaaacctatatcaaaaggaggccattcaagcagtttgtttggtaacatcaaaggagcaactatagtagatgccctggatacactttttattatggaaatgaaacatgaatttgaagaagcaaaatcatgggttgaagaaaatttagattttaatgtgaatgctgaaatttctgtctttgaagtaaatatacgctttgttggtggactactctcagcctactatctgtctggagaagagatttttcgaaagaaagcagtggaacttggggtaaaattgctacctgcatttcatactccctctggaataccttgggcattgctgaatatgaaaagtggtattggaaggaactggccctgggcctctggaggcagcagtattctggcagaatttggaaccctgcatttggagtttatgcacttgagccacttatcaggaaaccccatctttgctgaaaaggtaatgaatattcgaacagtactgaacaaactggaaaaaccacaaggcctttatcctaactatctgaatcccagtagtggacagtggggtcaacatcatgtatcagttggaggacttggagacagcttctatgagtatttgctgaaggcctggttaatgtctgacaagacagatctggaagctaagaagatgtattttgatgctgttcaggctatcgagactcatttgatccgcaagtctagcagcggactaacttatatcgcagagtggaaagggggcctcctggagcacaagatgggccacctgacctgcttcgctgggggcatgttcgcactcggggctgatgcagctcccgaaggcatggcccaacactaccttgaactcggggctgaaattgcccgtacttgtcatgaatcatataatcgaacatttatgaaactgggaccagaagctttcagatttgatggtggtgttgaagccatcgctacaagacaaaatgaaaaatactacatcttacggccagaagttatggagacttacatgtatatgtggagactgactcatgatccaaagtacaggaaatgggcctgggaagccgtagaggccttggaaaaccattgcagagtgaatggaggctattcaggcctaagggatgtttaccttcttcatgagagttatgatgatgtgcagcagagtttcttcctggcagagacattgaaatatttgtacctaatattttctgacgacgatcttcttccactggagcattggatcttcaatagcgaggcacatcttctccctatcctccctaaagataaaaaggaagttgaaatcagagaggaataaaaagacattttatattttattctgctccattcccttcactgtataccttaataattccttttctggtaatcaggcacatgatgaactttgattagtaggtctgtgattaagttcttaaattgttttgcagtcttttatgtttattatcataggtataggtggacctaaattccttatcatatcctttattaattcagccagtgtatccaccagttttttgtttatgtttttaagtaacctattatctctggatttcatgaaggtgtaatatcgtttttgttaaactgaatagaattgtatagcgatgacctcttaattataatttgatttgactgcaaaactttttcctcctctaagaggagatgatgtctgctttaagctgtaatgttttgccatgttgcaaaaagccataataataagtataaaaaagctttttcctttacaatttcatgttaatctggtttgtctgtccaccagagacagatcttctgtgacagcctccttatgcaggtctatcattatttgatagaatgtcttctaaaatacttcactcacattgtaattcaaattagaaagtcattccaaaaggatcatgtcatgttgacctcatttcatcggaactgcagtatatttttgttggttaattatattagtgttttctattttgtaaatgtgtcctttaattttactttaaatgccctgtgtcatttctggattatatactagttaatttcttccattccctactacacagagaggtgagctttcaaattttgcagagctctgctatcactgaattacatttatctgaagaaaatagtacaacttaatggattagcttttgggtttaactgaatatatgaagaaattgggtctgtctaaagagagggtatttcatatggcttttagttcacttgtttgtatttcatcttgatttttttctttggaaaataaagcattctatttggttcagatttctcagatttgaaaaaggctctatctcagatgtagtaaattatttcctttcagtttgtgaaagcaggatttgactctgaaagaagctttgccaattttacttattcgtgatcaatcaaggaaaatctaataaattttaggccaaataagaatatagcatatttagtatggttatagtcaacacagagatcacaacttagaagaaatataaagaaatggccactccccatcccccacagtcctggagtaaatcaaaatcaatatatgattcttttaaacattaagtttgaaataggaatggttttctcaagaatagatttggtgtgataccttgtgtttgcttacattggcccactatatatacatatatatttatgtagatatacttccatgaaagggctaatacgatgcatatactgaagggcaaggactttgaccatgtgaattttcagccgagaatggtcagaaagatcagtacaaccccatggattaggctgaaacatatgaaattgctgcatttgtagtttaaaaactgtcagcagtttcatatggttccacctaatattattgaagacaattattttcttagctatcaataggcttaatagttttagttattttagcttttgaaagtgttttaaaagatttcctttatcggacaggaccatctttatgacctgctttctgtttttcaatatcatacattggtgtatgtcaaagaataaattagtaaaattagt

SEQ ID NO: 299247 - DNA, 3324 bp, Homo sapiens
ccaacttatttaaaacaaaacaattttgtaggtattattatacccatttcacagatgatgataaatgagaccaatagaagttaaataacttgccaaaggccacacagctggtgagtgatggagaacgaattaaaactcaagtgagcataattctaaaagccatcttctcgttagtgtttctcactatccaggtctgcctttgccttatttaactgaagttaagccatccttacctgtgatcacctagcctctcagtttggggggatcattacagcgggtttttaactcccaatgttctggtccagtttgctttacatgttcttatttatacattgtcaaggatgacctcaggacagtacagcaaggacacagtggcacttcacattttgttcccacgaaatgactggggcataatctcagatcatcttcctttagaatgtggaaacatcagcagaagaatattagtctttatacaagtcaaatccaaaatgacacatgtgaaaactaatagagctgactttcagccatgatagctttggcacacctcacatccctttgttcaacctctcttccctcaacggagagctgcattcctgggaatttctgttgtgcacttttcccacttgccctgctgtcatttaaaggtgaacattctagttttgctaagaaaaccctttccttcatttggaatgaacagcaattttattacttttgaccttaaaatgagtttgctgccttcaaatcttttcagcgccttcatcacgctctgcttcggggcgatcttcttcctgccagactcctccaagctgctcagcggggtcctgttccactccagccccgccttgcagccggccgccgaccacaagcccgggcccggggcgcgcgccgaggacgcggccgaggggcgagcccggcgccgcgaggagggggcacccggggacccggaggccgccctggaggacaacttggccaggatccgcgaaaaccacgagcgggctctcagggaagccaaggagaccctgcagaagctgcccgaggagatccaaagagacatcctactggagaagaagaaggtggcccaggaccagctgcgtgacaaggcgccgttcagaggcctgcccccggtggacttcgtgcccccaatcggggtggagagccgggagcccgccgacgccgccatccgcgagaaaagggcaaagatcaaagagatgatgaaacatgcttggaataattataaaggttatgcctggggattaaatgaactcaaacctatatcaaaaggaggccattcaagcagtttgtttggtaacatcaaaggagcaactatagtagatgccctggatacactttttattatggaaatgaaacatgaatttgaagaagcaaaatcatgggttgaagaaaatttagattttaatgtgaatgctgaaatttctgtctttgaagtaaatatacgctttgttggtggactactctcagcctactatctgtctggagaagagatttttcgaaagaaagcagtggaacttggggtaaaattgctacctgcatttcatactccctctggaataccttgggcattgctgaatatgaaaagtggtattggaaggaactggccctgggcctctggaggcagcagtattctggcagaatttggaaccctgcatttggagtttatgcacttgagccacttatcaggaaaccccatctttgctgaaaaggtaatgaatattcgaacagtactgaacaaactggaaaaaccacaaggcctttatcctaactatctgaatcccagtagtggacagtggggtcaacatcatgtatcagttggaggacttggagacagcttctatgagtatttgctgaaggcctggttaatgtctgacaagacagatctggaagctaagaagatgtattttgatgctgttcaggctatcgagactcatttgatccgcaagtctagcagcggactaacttatatcgcagagtggaaagggggcctcctggagcacaagatgggccacctgacctgcttcgctgggggcatgttcgcactcggggctgatgcagctcccgaaggcatggcccaacactaccttgaactcggggctgaaattgcccgtacttgtcatgaatcatataatcgaacatttatgaaactgggaccagaagctttcagatttgatggtggtgttgaagccatcgctacaagacaaaatgaaaaatactacatcttacggccagaagttatggagacttacatgtatatgtggagactgactcatgatccaaagtacaggaaatgggcctgggaagccgtagaggccttggaaaaccattgcagagtgaatggaggctattcaggcctaagggatgtttaccttcttcatgagagttatgatgatgtgcagcagagtttcttcctggcagagacattgaaatatttgtacctaatattttctgacgacgatcttcttccactggagcattggatcttcaatagcgaggcacatcttctccctatcctccctaaagataaaaaggaagttgaaatcagagaggaataaaaagacattttatattttattctgctccattcccttcactgtataccttaataattccttttctggtaatcaggcacatgatgaactttgattagtaggtctgtgattaagttcttaaattgttttgcagtcttttatgtttattatcataggtataggtggacctaaattccttatcatatcctttattaattcagccagtgtatccaccagttttttgtttatgtttttaagtaacctattatctctggatttcatgaaggtgtaatatcgtttttgttaaactgaatagaattgtatagcgatgacctcttaattataatttgatttgactgcaaaactttttcctcctctaagaggagatgatgtctgctttaagctgtaatgttttgccatgttgcaaaaagccataataataagtataaaaaagctttttcctttacaatttcatgttaatctggtttgtctgtccaccagagacagatcttctgtgacagcctccttatgcaggtctatcattatttgatagaatgtcttctaaaatacttcactcacattgtaattcaaattagaaagtcattccaaaaggatcatgtcatgttgacctcatttcatcggaactgcagtatatttttgttggttaattatattagtgttttctattttgtaaatgtgtcctttaattttactttaaatgccctgtgtagtagggaatggaagaaattaactagtatataatccagaaatgacacagggc

SEQ ID NO: 299248 - DNA, 1141 bp, Homo sapiens
atacataggtgtatgtcaaagaataaattagtaaaattagtaaatgaaaaagactcttcctaatattattgaagacaattattttcttagctatcaataggcttaatagttttagttattttagcttttgaaagtgttttaaaagatttcctttatcggacaggaccatctttatgacctgctttctgtttttcaatatcatacattggtgtatgtcaaagaataaattagtaaaattagtaaatgaaaaagactcttccgtacatcattatttccatgctaatgtgtgtctgtgatccagaataacttctcccactcatatcttcagttcacctaatgaaatgaatggatagcaagagccctttgttcccaggactttaaggcaaaatattaaaaattattgccaaaattaagaatataatgtttgtataaatgtccttgaatttgccatttaaattaactcattttcttttcactttgatttgaaagctgataagtatttctgcagcagatagaatattaaaatcaggttgtgtgtacacactgcactatgaggtaccttggtgtcctggtgtgaatagacaagaagctgtactatatgttgctctctcagtggcaacaatgaagtttttgcaattctagaacttggatttttttttaacaaaagtcccaaaacaccaaaaatgtaaacaagataagagattaatattgtagtgatgtaatttaattaaagttatattttgggttaattttaacaactgaagtcttattgttgaaacttattttcaacaaaactgtgcagttaaatttgtatacgtattcacatactgaaagatgaaccgttaaaatagcacttaattttgtgtttcttcaatatgtcttgatatactttgtgcaattaatattacacatgtaagttgtatggcagtttacagaactcaatgacttgtcatgaggttttcatatgagctacacattgtgtacattgattgttttttatttttacataaatccattctgtcattttcaactttatatataaatctccaatgttatgggaaacaatagattgacacataatttttaaaaattatatttgtaaaatttctctattgtgaataaagtcttttaatatatctcc

SEQ ID NO: 299249 - DNA, 511 bp, Homo sapiens
ccgaccggccgtgtttttcagggagaaacggcaagcctttgaaactctgaagactgcaacaatgcaatgtatggggagatggaggtttgccccttccaccagatgatgaaacatgcttggaataattataaaggttatgcctggggattaaatgaactcaaacctatatcaaaaggaggccattcaagcagtttgtttggtaacatcaaaggagcaactatagtagatgccctggatacactttttattatggaaatgaaacatgaatttgaagaagcaaaatcatgggttgaagaaaatttagattttaatgtgaatgctgaaatttctgtctttgaagtaaatatacgctttgttggtggactactctcagcctactatctgtctggagaagagatttttcgaaagaaagcagtggaacttggggtaaaattgctacctgcatttcatactccctctggaataccttgggcattgctgaatatgaaaaggtaaaactcttcattttcaa

SEQ ID NO: 299250 - DNA, 336 bp, Homo sapiens
gcctgtggtcccagctacttgggaggctgaggcaggagaatcacctgagcccaagaggtagaagctgcagtgacccatgatggtgccactgtactccgcccaggcaacagagtgaggccctgtctcaaaaaaaaaaaaatgttttatctgaacttgacaatctaataataaaaattagtgacaatcagtttactgaaatgtgacttttttttttttcctcctctataatttaggccttggaaaaccattgcagagtgaatggaggctattcaggcctaagggatgtttaccttcttcatgagagttatgatgatgtgcagcagagtttcttcctgg

SEQ ID NO: 299251 - DNA, 269 bp, Homo sapiens
ttttgccatgttgcaaaaagccataataataagtataaaaaagctttttcctttacaatttcatgttaatctggtttgtctgtccaccagagacagatcttctgtgacagcctccttatgcaggtctatcattatttgatagaatgtcttctaaaatacttcactcacattgtaattcaaattagaaagtcattccaaaaggatcatgtcatgttgacctcatttcatcggaactgcagtatatttttgttggttaattatattagtgt

SEQ ID NO: 299252 - DNA, 855 bp, Homo sapiens
ctgggattactggtgtgagccaccatgcccggccacccacaccttctgacgcatcttctatctgctttccggacaggttcatgacatcttctatcccttcccccaatcagagggagaggacgagctctgctttctccgcgccaatgaatgcaagaccggcttctgccatttgtacaaagtcaccgccgttttaaaatcccagggctacgattggagtgagcccttcagccccggggaaggtgagcagagcctgacgaatgctgtcgactcatcgcgttagtcacgtgtggttcaatatgctgtttgttcattggtcggcccccccactcagccagcacaccctgcgggagaaggaacagggatcggcaggaagccagccttccccagtgactgcatgatctggcagggcttagagcacccaactgttggcttattcaggcagcagatttactgagcacctcccctgtgccaggcccttagcacaaccaggggttggccacctacggcccacaggtcaaatccggcccaccacctgtgttcataaataaagttttattggcactgagccacagccacttgtttacagagactgtctgtggtcgcttttgtgctgcagcagcagaactgggtagtcccagcagaaactgttgtgcaaggccaagatttactgtctagccctttgtagaaacatttgccagctcctgctgtaggtagctgtgatggaattgttcactgtaaataaagaaaaaggaaaatccctgctcttgggaccttctagtggaggaggcagtattccagaaacagttagaggtgctgcctctggtgtgctgtgcgtggcagatgcagatcctagtc

SEQ ID NO: 299253 - DNA, 4302 bp, Homo sapiens
caggccgccgcctgggtcgctcaacttccgggtcaaaggtgcctgagccggcgggtcccctgtgtccgccgcggctgtcgtcccccgctcccgccacttccggggtcgcagtcccgggcatggagccgcgaccgtgaggcgccgctggacccgggacgacctgcccagtccggccgccgccccacgtcccggtctgtgtcccacgcctgcagctggaatggaggctctctggaccctttagaaggcacccctgccctcctgaggtcagctgagcggttaatgcggaaggttaagaaactgcgcctggacaaggagaacaccggaagttggagaagcttctcgctgaattccgagggggctgagaggatggccaccaccgggaccccaacggccgaccgaggcgacgcagccgccacagatgacccggccgcccgcttccaggtgcagaagcactcgtgggacgggctccggagcatcatccacggcagccgcaagtactcgggcctcattgtcaacaaggcgccccacgacttccagtttgtgcagaagacggatgagtctgggccccactcccaccgcctctactacctgggaatgccatatggcagccgagagaactccctcctctactctgagattcccaagaaggtccggaaagaggctctgctgctcctgtcctggaagcagatgctggatcatttccaggccacgccccaccatggggtctactctcgggaggaggagctgctgagggagcggaaacgcctgggggtcttcggcatcacctcctacgacttccacagcgagagtggcctcttcctcttccaggccagcaacagcctcttccactgccgcgacggcggcaagaacggcttcatggtgtcccctatgaaaccgctggaaatcaagacccagtgctcagggccccggatggaccccaaaatctgccctgccgaccctgccttcttctccttcatcaataacagcgacctgtgggtggccaacatcgagacaggcgaggagcggcggctgaccttctgccaccaaggtttatccaatgtcctggatgaccccaagtctgcgggtgtggccaccttcgtcatacaggaagagttcgaccgcttcactgggtactggtggtgccccacagcctcctgggaaggttcagagggcctcaagacgctgcgaatcctgtatgaggaagtcgatgagtccgaggtggaggtcattcacgtcccctctcctgcgctagaagaaaggaagacggactcgtatcggtaccccaggacaggcagcaagaatcccaagattgccttgaaactggctgagttccagactgacagccagggcaagatcgtctcgacccaggagaaggagctggtgcagcccttcagctcgctgttcccgaaggtggagtacatcgccagggccgggtggacccgggatggcaaatacgcctgggccatgttcctggaccggccccagcagtggctccagctcgtcctcctccccccggccctgttcatcccgagcacagagaatgaggagcagcggctagcctctgccagagctgtccccaggaatgtccagccgtatgtggtgtacgaggaggtcaccaacgtctggatcaatgttcatgacatcttctatcccttcccccaatcagagggagaggacgagctctgctttctccgcgccaatgaatgcaagaccggcttctgccatttgtacaaagtcaccgccgttttaaaatcccagggctacgattggagtgagcccttcagccccggggaagatgaatttaagtgccccattaaggaagagattgctctgaccagcggtgaatgggaggttttggcgaggcacggctccaagatctgggtcaatgaggagaccaagctggtgtacttccagggcaccaaggacacgccgctggagcaccacctctacgtggtcagctatgaggcggccggcgagatcgtacgcctcaccacgcccggcttctcccatagctgctccatgagccagaacttcgacatgttcgtcagccactacagcagcgtgagcacgccgccctgcgtgcacgtctacaagctgagcggccccgacgacgaccccctgcacaagcagccccgcttctgggctagcatgatggaggcagccagctgccccccggattatgttcctccagagatcttccatttccacacgcgctcggatgtgcggctctacggcatgatctacaagccccacgccttgcagccagggaagaagcaccccaccgtcctctttgtatatggaggcccccaggtgcagctggtgaataactccttcaaaggcatcaagtacttgcggctcaacacactggcctccctgggctacgccgtggttgtgattgacggcaggggctcctgtcagcgagggcttcggttcgaaggggccctgaaaaaccaaatgggccaggtggagatcgaggaccaggtggagggcctgcagttcgtggccgagaagtatggcttcatcgacctgagccgagttgccatccatggctggtcctacgggggcttcctctcgctcatggggctaatccacaagccccaggtgttcaaggtggccatcgcgggtgccccggtcaccgtctggatggcctacgacacagggtacactgagcgctacatggacgtccctgagaacaaccagcacggctatgaggcgggttccgtggccctgcacgtggagaagctgcccaatgagcccaaccgcttgcttatcctccacggcttcctggacgaaaacgtgcactttttccacacaaacttcctcgtctcccaactgatccgagcagggaaaccttaccagctccagatctaccccaacgagagacacagtattcgctgccccgagtcgggcgagcactatgaagtcacgttgctgcactttctacaggaatacctctgagcctgcccaccgggagccgccacatcacagcacaagtggctgcagcctccgcggggaaccaggcgggagggactgagtggcccgcgggccccagtgaggcactttgtcccgcccagcgctggccagccccgaggagccgctgccttcaccgccccgacgccttttatccttttttaaacgctcttgggttttatgtccgctgcttcttggttgccgagacagagagatggtggtctcgggccagcccctcctctccccgccttctgggaggaggaggtcacacgctgatgggcactggagaggccagaagagactcagaggagcgggctgccttccgcctggggctccctgtgacctctcagtcccctggcccggccagccaccgtccccagcacccaagcatgcaattgcctgtcccccccggccagcctccccaacttgatgtttgtgttttgtttggggggatatttttcataattatttaaaagacaggccgggcgcggtggctcacgtctgtaatcccagcactttgggaggctgaggcgggcggatcacctgaggttgggagttcaagaccagcctggccaacatggggaaaccccgtctctactaaaaatacaaaaaattagccgggtgtggtggcgcgtgcctataatcccagctactcgggaggctgaggcaggagaatcgcttgaacccgggaggtggaggttgcggtgagccaagatcgcaccattgcactccagcctgggcaacaagagcgaaactctgtctcaaaataaataaaaaataaaagacagaaagcaaggggtgcctaaatctagacttggggtccacaccgggcagcggggttgcaacccagcacctggtaggctccatttcttcccaagcccgagcagagggtcatgcgggccccacaggagaagcggccagggcccgcggggggcaccacctgtggacagccctcctgtccccaagctttcaggcaggcactgaaacgcaccgaacttccacgctctgctggtcagtggcggctgtcccctccccagcccagccgcccagccacatgtgtctgcctgacccgtacacaccaggggttccggggttgggagctgaaccatccccacctcagggttatatttccctctccccttccctccccgccaagagctctgccaggggcgggcaaaaaaaaaagtaaaaagaaaagaaaaaaaaaaaaaagaaacaaaccacctctacatattatggaaagaaaatatttttgtcgattcttattcttttataattatgcgtggaagaagtagacacattaaacgattccagttggaaacatgtcacctg

SEQ ID NO: 299254 - DNA, 3813 bp, Homo sapiens
caggccgccgcctgggtcgctcaacttccgggtcaaaggtgcctgagccggcgggtcccctgtgtccgccgcggctgtcgtcccccgctcccgccacttccggggtcgcagtcccgggcatggagccgcgaccgtgaggcgccgctggacccgggacgacctgcccagtccggccgccgccccacgtcccggtctgtgtcccacgcctgcagctggaatggaggctctctggaccctttagaaggcacccctgccctcctgaggtcagctgagcggttaatgcggaaggttaagaaactgcgcctggacaaggagaacaccggaagttggagaagcttctcgctgaattccgagggggctgagaggatggccaccaccgggaccccaacggccgaccgaggcgacgcagccgccacagatgacccggccgcccgcttccaggtgcagaagcactcgtgggacgggctccggagcatcatccacggcagccgcaagtactcgggcctcattgtcaacatcgagacaggcgaggagcggcggctgaccttctgccaccaaggtttatccaatgtcctggatgaccccaagtctgcgggtgtggccaccttcgtcatacaggaagagttcgaccgcttcactgggtactggtggtgccccacagcctcctgggaaggttcagagggcctcaagacgctgcgaatcctgtatgaggaagtcgatgagtccgaggtggaggtcattcacgtcccctctcctgcgctagaagaaaggaagacggactcgtatcggtaccccaggacaggcagcaagaatcccaagattgccttgaaactggctgagttccagactgacagccagggcaagatcgtctcgacccaggagaaggagctggtgcagcccttcagctcgctgttcccgaaggtggagtacatcgccagggccgggtggacccgggatggcaaatacgcctgggccatgttcctggaccggccccagcagtggctccagctcgtcctcctccccccggccctgttcatcccgagcacagagaatgaggagcagcggctagcctctgccagagctgtccccaggaatgtccagccgtatgtggtgtacgaggaggtcaccaacgtctggatcaatgttcatgacatcttctatcccttcccccaatcagagggagaggacgagctctgctttctccgcgccaatgaatgcaagaccggcttctgccatttgtacaaagtcaccgccgttttaaaatcccagggctacgattggagtgagcccttcagccccggggaagatgaatttaagtgccccattaaggaagagattgctctgaccagcggtgaatgggaggttttggcgaggcacggctccaagatctgggtcaatgaggagaccaagctggtgtacttccagggcaccaaggacacgccgctggagcaccacctctacgtggtcagctatgaggcggccggcgagatcgtacgcctcaccacgcccggcttctcccatagctgctccatgagccagaacttcgacatgttcgtcagccactacagcagcgtgagcacgccgccctgcgtgcacgtctacaagctgagcggccccgacgacgaccccctgcacaagcagccccgcttctgggctagcatgatggaggcagccagctgccccccggattatgttcctccagagatcttccatttccacacgcgctcggatgtgcggctctacggcatgatctacaagccccacgccttgcagccagggaagaagcaccccaccgtcctctttgtatatggaggcccccaggtgcagctggtgaataactccttcaaaggcatcaagtacttgcggctcaacacactggcctccctgggctacgccgtggttgtgattgacggcaggggctcctgtcagcgagggcttcggttcgaaggggccctgaaaaaccaaatgggccaggtggagatcgaggaccaggtggagggcctgcagttcgtggccgagaagtatggcttcatcgacctgagccgagttgccatccatggctggtcctacgggggcttcctctcgctcatggggctaatccacaagccccaggtgttcaaggtggccatcgcgggtgccccggtcaccgtctggatggcctacgacacagggtacactgagcgctacatggacgtccctgagaacaaccagcacggctatgaggcgggttccgtggccctgcacgtggagaagctgcccaatgagcccaaccgcttgcttatcctccacggcttcctggacgaaaacgtgcactttttccacacaaacttcctcgtctcccaactgatccgagcagggaaaccttaccagctccagatctaccccaacgagagacacagtattcgctgccccgagtcgggcgagcactatgaagtcacgttgctgcactttctacaggaatacctctgagcctgcccaccgggagccgccacatcacagcacaagtggctgcagcctccgcggggaaccaggcgggagggactgagtggcccgcgggccccagtgaggcactttgtcccgcccagcgctggccagccccgaggagccgctgccttcaccgccccgacgccttttatccttttttaaacgctcttgggttttatgtccgctgcttcttggttgccgagacagagagatggtggtctcgggccagcccctcctctccccgccttctgggaggaggaggtcacacgctgatgggcactggagaggccagaagagactcagaggagcgggctgccttccgcctggggctccctgtgacctctcagtcccctggcccggccagccaccgtccccagcacccaagcatgcaattgcctgtcccccccggccagcctccccaacttgatgtttgtgttttgtttggggggatatttttcataattatttaaaagacaggccgggcgcggtggctcacgtctgtaatcccagcactttgggaggctgaggcgggcggatcacctgaggttgggagttcaagaccagcctggccaacatggggaaaccccgtctctactaaaaatacaaaaaattagccgggtgtggtggcgcgtgcctataatcccagctactcgggaggctgaggcaggagaatcgcttgaacccgggaggtggaggttgcggtgagccaagatcgcaccattgcactccagcctgggcaacaagagcgaaactctgtctcaaaataaataaaaaataaaagacagaaagcaaggggtgcctaaatctagacttggggtccacaccgggcagcggggttgcaacccagcacctggtaggctccatttcttcccaagcccgagcagagggtcatgcgggccccacaggagaagcggccagggcccgcggggggcaccacctgtggacagccctcctgtccccaagctttcaggcaggcactgaaacgcaccgaacttccacgctctgctggtcagtggcggctgtcccctccccagcccagccgcccagccacatgtgtctgcctgacccgtacacaccaggggttccggggttgggagctgaaccatccccacctcagggttatatttccctctccccttccctccccgccaagagctctgccaggggcgggcaaaaaaaaaagtaaaaagaaaagaaaaaaaaaaaaaagaaacaaaccacctctacatattatggaaagaaaatatttttgtcgattcttattcttttataattatgcgtggaagaagtagacacattaaacgattccagttggaaacatgtcacctg

SEQ ID NO: 299255 - DNA, 3480 bp, Homo sapiens
gctcttacccgactttgctcttttggggtctttgctcttttggggtctttgctcatggtgtcccctatgaaaccgctggaaatcaagacccagtgctcagggccccggatggaccccaaaatctgccctgccgaccctgccttcttctccttcatcaataacagcgacctgtgggtggccaacatcgagacaggcgaggagcggcggctgaccttctgccaccaaggtttatccaatgtcctggatgaccccaagtctgcgggtgtggccaccttcgtcatacaggaagagttcgaccgcttcactgggtactggtggtgccccacagcctcctgggaaggttcagagggcctcaagacgctgcgaatcctgtatgaggaagtcgatgagtccgaggtggaggtcattcacgtcccctctcctgcgctagaagaaaggaagacggactcgtatcggtaccccaggacaggcagcaagaatcccaagattgccttgaaactggctgagttccagactgacagccagggcaagatcgtctcgacccaggagaaggagctggtgcagcccttcagctcgctgttcccgaaggtggagtacatcgccagggccgggtggacccgggatggcaaatacgcctgggccatgttcctggaccggccccagcagtggctccagctcgtcctcctccccccggccctgttcatcccgagcacagagaatgaggagcagcggctagcctctgccagagctgtccccaggaatgtccagccgtatgtggtgtacgaggaggtcaccaacgtctggatcaatgttcatgacatcttctatcccttcccccaatcagagggagaggacgagctctgctttctccgcgccaatgaatgcaagaccggcttctgccatttgtacaaagtcaccgccgttttaaaatcccagggctacgattggagtgagcccttcagccccggggaagatgaatttaagtgccccattaaggaagagattgctctgaccagcggtgaatgggaggttttggcgaggcacggctccaagatctgggtcaatgaggagaccaagctggtgtacttccagggcaccaaggacacgccgctggagcaccacctctacgtggtcagctatgaggcggccggcgagatcgtacgcctcaccacgcccggcttctcccatagctgctccatgagccagaacttcgacatgttcgtcagccactacagcagcgtgagcacgccgccctgcgtgcacgtctacaagctgagcggccccgacgacgaccccctgcacaagcagccccgcttctgggctagcatgatggaggcagccagctgccccccggattatgttcctccagagatcttccatttccacacgcgctcggatgtgcggctctacggcatgatctacaagccccacgccttgcagccagggaagaagcaccccaccgtcctctttgtatatggaggcccccaggtgcagctggtgaataactccttcaaaggcatcaagtacttgcggctcaacacactggcctccctgggctacgccgtggttgtgattgacggcaggggctcctgtcagcgagggcttcggttcgaaggggccctgaaaaaccaaatgggccaggtggagatcgaggaccaggtggagggcctgcagttcgtggccgagaagtatggcttcatcgacctgagccgagttgccatccatggctggtcctacgggggcttcctctcgctcatggggctaatccacaagccccaggtgttcaaggtggccatcgcgggtgccccggtcaccgtctggatggcctacgacacagggtacactgagcgctacatggacgtccctgagaacaaccagcacggctatgaggcgggttccgtggccctgcacgtggagaagctgcccaatgagcccaaccgcttgcttatcctccacggcttcctggacgaaaacgtgcactttttccacacaaacttcctcgtctcccaactgatccgagcagggaaaccttaccagctccagatctaccccaacgagagacacagtattcgctgccccgagtcgggcgagcactatgaagtcacgttgctgcactttctacaggaatacctctgagcctgcccaccgggagccgccacatcacagcacaagtggctgcagcctccgcggggaaccaggcgggagggactgagtggcccgcgggccccagtgaggcactttgtcccgcccagcgctggccagccccgaggagccgctgccttcaccgccccgacgccttttatccttttttaaacgctcttgggttttatgtccgctgcttcttggttgccgagacagagagatggtggtctcgggccagcccctcctctccccgccttctgggaggaggaggtcacacgctgatgggcactggagaggccagaagagactcagaggagcgggctgccttccgcctggggctccctgtgacctctcagtcccctggcccggccagccaccgtccccagcacccaagcatgcaattgcctgtcccccccggccagcctccccaacttgatgtttgtgttttgtttggggggatatttttcataattatttaaaagacaggccgggcgcggtggctcacgtctgtaatcccagcactttgggaggctgaggcgggcggatcacctgaggttgggagttcaagaccagcctggccaacatggggaaaccccgtctctactaaaaatacaaaaaattagccgggtgtggtggcgcgtgcctataatcccagctactcgggaggctgaggcaggagaatcgcttgaacccgggaggtggaggttgcggtgagccaagatcgcaccattgcactccagcctgggcaacaagagcgaaactctgtctcaaaataaataaaaaataaaagacagaaagcaaggggtgcctaaatctagacttggggtccacaccgggcagcggggttgcaacccagcacctggtaggctccatttcttcccaagcccgagcagagggtcatgcgggccccacaggagaagcggccagggcccgcggggggcaccacctgtggacagccctcctgtccccaagctttcaggcaggcactgaaacgcaccgaacttccacgctctgctggtcagtggcggctgtcccctccccagcccagccgcccagccacatgtgtctgcctgacccgtacacaccaggggttccggggttgggagctgaaccatccccacctcagggttatatttccctctccccttccctccccgccaagagctctgccaggggcgggcaaaaaaaaaagtaaaaagaaaagaaaaaaaaaaaaaagaaacaaaccacctctacatattatggaaagaaaatatttttgtcgattcttattcttttataattatgcgtggaagaagtagacacattaaacgattccagttggaaacatgtcacctg

SEQ ID NO: 299256 - DNA, 2913 bp, Homo sapiens
gtgacgcgtgggtcgacccacgcgtcgtacatcgccaggtccgggtggacccgggatggcaaatacgcctgggccatgttcctggaccggccccagcagtggctccagctcgtcctcctccccccggccctgttcatcccgagcacagagaatgaggagcagcggctagcctctgccagagctgtccccaggaatgtccagccgtatgtggtgtacgaggaggtcaccaacgtctggatcaatgttcatgacatcttctatcccttcccccaatcagagggagaggacgagctctgctttctccgcgccaatgaatgcaagaccggcttctgccatttgtacaaagtcaccgccgttttaaaatcccagggctacgattggagtgagcccttcagccccggggaagatgaatttaagtgccccattaaggaagagattgctctgaccagcggtgaatgggaggttttggcgaggcacggctccaagatctgggtcaatgaggagaccaagctggtgtacttccagggcaccaaggacacgccgctggagcaccacctctacgtggtcagctatgaggcggccggcgagatcgtacgcctcaccacgcccggcttctcccatagctgctccatgagccagaacttcgacatgttcgtcagccactacagcagcgtgagcacgccgccctgcgtgcacgtctacaagctgagcggccccgacgacgaccccctgcacaagcagccccgcttctgggctagcatgatggaggcagccagctgccccccggattatgttcctccagagatcttccatttccacacgcgctcggatgtgcggctctacggcatgatctacaagccccacgccttgcagccagggaagaagcaccccaccgtcctctttgtatatggaggcccccaggtgcagctggtgaataactccttcaaaggcatcaagtacttgcggctcaacacactggcctccctgggctacgccgtggttgtgattgacggcaggggctcctgtcagcgagggcttcggttcgaaggggccctgaaaaaccaaatgggccaggtggagatcgaggaccaggtggagggcctgcagttcgtggccgagaagtatggcttcatcgacctgagccgagttgccatccatggctggtcctacgggggcttcctctcgctcatggggctaatccacaagccccaggtgttcaaggtggccatcgcgggtgccccggtcaccgtctggatggcctacgacacagggtacactgagcgctacatggacgtccctgagaacaaccagcacggctatgaggcgggttccgtggccctgcacgtggagaagctgcccaatgagcccaaccgcttgcttatcctccacggcttcctggacgaaaacgtgcactttttccacacaaacttcctcgtctcccaactgatccgagcagggaaaccttaccagctccagatctaccccaacgagagacacagtattcgctgccccgagtcgggcgagcactatgaagtcacgttgctgcactttctacaggaatacctctgagcctgcccaccgggagccgccacatcacagcacaagtggctgcagcctccgcggggaaccaggcgggagggactgagtggcccgcgggccccagtgaggcactttgtcccgcccagcgctggccagccccgaggagccgctgccttcaccgccccgacgccttttatccttttttaaacgctcttgggttttatgtccgctgcttcttggttgccgagacagagagatggtggtctcgggccagcccctcctctccccgccttctgggaggaggaggtcacacgctgatgggcactggagaggccagaagagactcagaggagcgggctgccttccgcctggggctccctgtgacctctcagtcccctggcccggccagccaccgtccccagcacccaagcatgcaattgcctgtcccccccggccagcctccccaacttgatgtttgtgttttgtttggggggatatttttcataattatttaaaagacaggccgggcgcggtggctcacgtctgtaatcccagcactttgggaggctgaggcgggcggatcacctgaggttgggagttcaagaccagcctggccaacatggggaaaccccgtctctactaaaaatacaaaaaattagccgggtgtggtggcgcgtgcctataatcccagctactcgggaggctgaggcaggagaatcgcttgaacccgggaggtggaggttgcggtgagccaagatcgcaccattgcactccagcctgggcaacaagagcgaaactctgtctcaaaataaataaaaaataaaagacagaaagcaaggggtgcctaaatctagacttggggtccacaccgggcagcggggttgcaacccagcacctggtaggctccatttcttcccaagcccgagcagagggtcatgcgggccccacaggagaagcggccagggcccgcggggggcaccacctgtggacagccctcctgtccccaagctttcaggcaggcactgaaacgcaccgaacttccacgctctgctggtcagtggcggctgtcccctccccagcccagccgcccagccacatgtgtctgcctgacccgtacacaccaggggttccggggttgggagctgaaccatccccacctcagggttatatttccctctccccttccctccccgccaagagctctgccaggggcgggcaaaaaaaaaagtaaaaagaaaagaaaaaaaaaaaaaagaaacaaaccacctctacatattatggaaagaaaatatttttgtcgattcttattcttttataattatgcgtggaagaagtagacacattaaacgattccagttggaaacatgtcacctg

SEQ ID NO: 299257 - DNA, 2958 bp, Homo sapiens
cagcaatctattccttaatggggcacttaaattcatcttccccggtgctgaaaggggctcactccaatcgtagccctgggatttaaaacggcggtgactttgtacaaatggcagaagccggtcttgcatttcattggcgcggagaaagcagagctcgtcctcctccccccggccctgttcatcccgagcacagagaatgaggagcagcggctagcctctgccagagctgtccccaggaatgtccagccgtatgtggtgtacgaggaggtcaccaacgtctggatcaatgttcatgacatcttctatcccttcccccaatcagagggagaggacgagctctgctttctccgcgccaatgaatgcaagaccggcttctgccatttgtacaaagtcaccgccgttttaaaatcccagggctacgattggagtgagcccttcagccccggggaagatgaatttaagtgccccattaaggaagagattgctctgaccagcggtgaatgggaggttttggcgaggcacggctccaagatctgggtcaatgaggagaccaagctggtgtacttccagggcaccaaggacacgccgctggagcaccacctctacgtggtcagctatgaggcggccggcgagatcgtacgcctcaccacgcccggcttctcccatagctgctccatgagccagaacttcgacatgttcgtcagccactacagcagcgtgagcacgccgccctgcgtgcacgtctacaagctgagcggccccgacgacgaccccctgcacaagcagccccgcttctgggctagcatgatggaggcagccagctgccccccggattatgttcctccagagatcttccatttccacacgcgctcggatgtgcggctctacggcatgatctacaagccccacgccttgcagccagggaagaagcaccccaccgtcctctttgtatatggaggcccccaggtgcagctggtgaataactccttcaaaggcatcaagtacttgcggctcaacacactggcctccctgggctacgccgtggttgtgattgacggcaggggctcctgtcagcgagggcttcggttcgaaggggccctgaaaaaccaaatgggccaggtggagatcgaggaccaggtggagggcctgcagttcgtggccgagaagtatggcttcatcgacctgagccgagttgccatccatggctggtcctacgggggcttcctctcgctcatggggctaatccacaagccccaggtgttcaaggtggccatcgcgggtgccccggtcaccgtctggatggcctacgacacagggtacactgagcgctacatggacgtccctgagaacaaccagcacggctatgaggcgggttccgtggccctgcacgtggagaagctgcccaatgagcccaaccgcttgcttatcctccacggcttcctggacgaaaacgtgcactttttccacacaaacttcctcgtctcccaactgatccgagcagggaaaccttaccagctccagatctaccccaacgagagacacagtattcgctgccccgagtcgggcgagcactatgaagtcacgttgctgcactttctacaggaatacctctgagcctgcccaccgggagccgccacatcacagcacaagtggctgcagcctccgcggggaaccaggcgggagggactgagtggcccgcgggccccagtgaggcactttgtcccgcccagcgctggccagccccgaggagccgctgccttcaccgccccgacgccttttatccttttttaaacgctcttgggttttatgtccgctgcttcttggttgccgagacagagagatggtggtctcgggccagcccctcctctccccgccttctgggaggaggaggtcacacgctgatgggcactggagaggccagaagagactcagaggagcgggctgccttccgcctggggctccctgtgacctctcagtcccctggcccggccagccaccgtccccagcacccaagcatgcaattgcctgtcccccccggccagcctccccaacttgatgtttgtgttttgtttggggggatatttttcataattatttaaaagacaggccgggcgcggtggctcacgtctgtaatcccagcactttgggaggctgaggcgggcggatcacctgaggttgggagttcaagaccagcctggccaacatggggaaaccccgtctctactaaaaatacaaaaaattagccgggtgtggtggcgcgtgcctataatcccagctactcgggaggctgaggcaggagaatcgcttgaacccgggaggtggaggttgcggtgagccaagatcgcaccattgcactccagcctgggcaacaagagcgaaactctgtctcaaaataaataaaaaataaaagacagaaagcaaggggtgcctaaatctagacttggggtccacaccgggcagcggggttgcaacccagcacctggtaggctccatttcttcccaagcccgagcagagggtcatgcgggccccacaggagaagcggccagggcccgcggggggcaccacctgtggacagccctcctgtccccaagctttcaggcaggcactgaaacgcaccgaacttccacgctctgctggtcagtggcggctgtcccctccccagcccagccgcccagccacatgtgtctgcctgacccgtacacaccaggggttccggggttgggagctgaaccatccccacctcagggttatatttccctctccccttccctccccgccaagagctctgccaggggcgggcaaaaaaaaaagtaaaaagaaaagaaaaaaaaaaaaaagaaacaaaccacctctacatattatggaaagaaaatatttttgtcgattcttattcttttataattatgcgtggaagaagtagacacattaaacgattccagttggaaacatgtcacctg

SEQ ID NO: 299258 - DNA, 2746 bp, Homo sapiens
ctgggattactggtgtgagccaccatgcccggccacccacaccttctgacgcatcttctatctgctttccggacaggttcatgacatcttctatcccttcccccaatcagagggagaggacgagctctgctttctccgcgccaatgaatgcaagaccggcttctgccatttgtacaaagtcaccgccgttttaaaatcccagggctacgattggagtgagcccttcagccccggggaagatgaatttaagtgccccattaaggaagagattgctctgaccagcggtgaatgggaggttttggcgaggcacggctccaagatctgggtcaatgaggagaccaagctggtgtacttccagggcaccaaggacacgccgctggagcaccacctctacgtggtcagctatgaggcggccggcgagatcgtacgcctcaccacgcccggcttctcccatagctgctccatgagccagaacttcgacatgttcgtcagccactacagcagcgtgagcacgccgccctgcgtgcacgtctacaagctgagcggccccgacgacgaccccctgcacaagcagccccgcttctgggctagcatgatggaggcagccagctgccccccggattatgttcctccagagatcttccatttccacacgcgctcggatgtgcggctctacggcatgatctacaagccccacgccttgcagccagggaagaagcaccccaccgtcctctttgtatatggaggcccccaggtgcagctggtgaataactccttcaaaggcatcaagtacttgcggctcaacacactggcctccctgggctacgccgtggttgtgattgacggcaggggctcctgtcagcgagggcttcggttcgaaggggccctgaaaaaccaaatgggccaggtggagatcgaggaccaggtggagggcctgcagttcgtggccgagaagtatggcttcatcgacctgagccgagttgccatccatggctggtcctacgggggcttcctctcgctcatggggctaatccacaagccccaggtgttcaaggtggccatcgcgggtgccccggtcaccgtctggatggcctacgacacagggtacactgagcgctacatggacgtccctgagaacaaccagcacggctatgaggcgggttccgtggccctgcacgtggagaagctgcccaatgagcccaaccgcttgcttatcctccacggcttcctggacgaaaacgtgcactttttccacacaaacttcctcgtctcccaactgatccgagcagggaaaccttaccagctccagatctaccccaacgagagacacagtattcgctgccccgagtcgggcgagcactatgaagtcacgttgctgcactttctacaggaatacctctgagcctgcccaccgggagccgccacatcacagcacaagtggctgcagcctccgcggggaaccaggcgggagggactgagtggcccgcgggccccagtgaggcactttgtcccgcccagcgctggccagccccgaggagccgctgccttcaccgccccgacgccttttatccttttttaaacgctcttgggttttatgtccgctgcttcttggttgccgagacagagagatggtggtctcgggccagcccctcctctccccgccttctgggaggaggaggtcacacgctgatgggcactggagaggccagaagagactcagaggagcgggctgccttccgcctggggctccctgtgacctctcagtcccctggcccggccagccaccgtccccagcacccaagcatgcaattgcctgtcccccccggccagcctccccaacttgatgtttgtgttttgtttggggggatatttttcataattatttaaaagacaggccgggcgcggtggctcacgtctgtaatcccagcactttgggaggctgaggcgggcggatcacctgaggttgggagttcaagaccagcctggccaacatggggaaaccccgtctctactaaaaatacaaaaaattagccgggtgtggtggcgcgtgcctataatcccagctactcgggaggctgaggcaggagaatcgcttgaacccgggaggtggaggttgcggtgagccaagatcgcaccattgcactccagcctgggcaacaagagcgaaactctgtctcaaaataaataaaaaataaaagacagaaagcaaggggtgcctaaatctagacttggggtccacaccgggcagcggggttgcaacccagcacctggtaggctccatttcttcccaagcccgagcagagggtcatgcgggccccacaggagaagcggccagggcccgcggggggcaccacctgtggacagccctcctgtccccaagctttcaggcaggcactgaaacgcaccgaacttccacgctctgctggtcagtggcggctgtcccctccccagcccagccgcccagccacatgtgtctgcctgacccgtacacaccaggggttccggggttgggagctgaaccatccccacctcagggttatatttccctctccccttccctccccgccaagagctctgccaggggcgggcaaaaaaaaaagtaaaaagaaaagaaaaaaaaaaaaaagaaacaaaccacctctacatattatggaaagaaaatatttttgtcgattcttattcttttataattatgcgtggaagaagtagacacattaaacgattccagttggaaacatgtcacctg

SEQ ID NO: 299259 - DNA, 4159 bp, Homo sapiens
caggccgccgcctgggtcgctcaacttccgggtcaaaggtgcctgagccggcgggtcccctgtgtccgccgcggctgtcgtcccccgctcccgccacttccggggtcgcagtcccgggcatggagccgcgaccgtgaggcgccgctggacccgggacgacctgcccagtccggccgccgccccacgtcccggtctgtgtcccacgcctgcagctggaatggaggctctctggaccctttagaaggcacccctgccctcctgaggtcagctgagcggttaatgcggaaggttaagaaactgcgcctggacaaggagaacaccggaagttggagaagcttctcgctgaattccgagggggctgagaggatggccaccaccgggaccccaacggccgaccgaggcgacgcagccgccacagatgacccggccgcccgcttccaggtgcagaagcactcgtgggacgggctccggagcatcatccacggcagccgcaagtactcgggcctcattgtcaacaaggcgccccacgacttccagtttgtgcagaagacggatgagtctgggccccactcccaccgcctctactacctgggaatgccatatggcagccgagagaactccctcctctactctgagattcccaagaaggtccggaaagaggctctgctgctcctgtcctggaagcagatgctggatcatttccaggccacgccccaccatggggtctactctcgggaggaggagctgctgagggagcggaaacgcctgggggtcttcggcatcacctcctacgacttccacagcgagagtggcctcttcctcttccaggccagcaacagcctcttccactgccgcgacggcggcaagaacggcttcatggtgtcccctatgaaaccgctggaaatcaagacccagtgctcagggccccggatggaccccaaaatctgccctgccgaccctgccttcttctccttcatcaataacagcgacctgtgggtggccaacatcgagacaggcgaggagcggcggctgaccttctgccaccaaggtttatccaatgtcctggatgaccccaagtctgcgggtgtggccaccttcgtcatacaggaagagttcgaccgcttcactgggtactggtggtgccccacagcctcctgggaaggttcagagggcctcaagacgctgcgaatcctgtatgaggaagtcgatgagtccgaggtggaggtcattcacgtcccctctcctgcgctagaagaaaggaagacggactcgtatcggtaccccaggacaggcagcaagaatcccaagattgccttgaaactggctgagttccagactgacagccagggcaagatcgtctcgacccaggagaaggagctggtgcagcccttcagctcgctgttcccgaaggtggagtacatcgccagggccgggtggacccgggatggcaaatacgcctgggccatgttcctggaccggccccagcagtggctccagctcgtcctcctccccccggccctgttcatcccgagcacagagaatgaggagcagcggctagcctctgccagagctgtccccaggaatgtccagccgtatgtggtgtacgaggaggtcaccaacgtctggatcaatgttcatgacatcttctatcccttcccccaatcagagggagaggacgagctctgctttctccgcgccaatgaatgcaagaccggcttctgccatttgtacaaagtcaccgccgttttaaaatcccagggctacgattggagtgagcccttcagccccggggaagatgaatttaagtgccccattaaggaagagattgctctgaccagcggtgaatgggaggttttggcgaggcacggctccaagatctgggtcaatgaggagaccaagctggtgtacttccagggcaccaaggacacgccgctggagcaccacctctacgtggtcagctatgaggcggccggcgagatcgtacgcctcaccacgcccggcttctcccatagctgctccatgagccagaacttcgacatgttcgtcagccactacagcagcgtgagcacgccgccctgcgtgcacgtctacaagctgagcggccccgacgacgaccccctgcacaagcagccccgcttctgggctagcatgatggaggcagccagctgccccccggattatgttcctccagagatcttccatttccacacgcgctcggatgtgcggctctacggcatgatctacaagccccacgccttgcagccagggaagaagcaccccaccgtcctctttgtatatggaggcccccaggtgcagctggtgaataactccttcaaaggcatcaagtacttgcggctcaacacactggcctccctgggctacgccgtggttgtgattgacggcaggggctcctgtcagcgagggcttcggttcgaaggggccctgaaaaaccaaatgggccaggtggagatcgaggaccaggtggagggcctgcagttcgtggccgagaagtatggcttcatcgacctgagccgagttgccatccatggctggtcctacgggggcttcctctcgctcatggggctaatccacaagccccaggtgttcaaggcccaaccgcttgcttatcctccacggcttcctggacgaaaacgtgcactttttccacacaaacttcctcgtctcccaactgatccgagcagggaaaccttaccagctccagatctaccccaacgagagacacagtattcgctgccccgagtcgggcgagcactatgaagtcacgttgctgcactttctacaggaatacctctgagcctgcccaccgggagccgccacatcacagcacaagtggctgcagcctccgcggggaaccaggcgggagggactgagtggcccgcgggccccagtgaggcactttgtcccgcccagcgctggccagccccgaggagccgctgccttcaccgccccgacgccttttatccttttttaaacgctcttgggttttatgtccgctgcttcttggttgccgagacagagagatggtggtctcgggccagcccctcctctccccgccttctgggaggaggaggtcacacgctgatgggcactggagaggccagaagagactcagaggagcgggctgccttccgcctggggctccctgtgacctctcagtcccctggcccggccagccaccgtccccagcacccaagcatgcaattgcctgtcccccccggccagcctccccaacttgatgtttgtgttttgtttggggggatatttttcataattatttaaaagacaggccgggcgcggtggctcacgtctgtaatcccagcactttgggaggctgaggcgggcggatcacctgaggttgggagttcaagaccagcctggccaacatggggaaaccccgtctctactaaaaatacaaaaaattagccgggtgtggtggcgcgtgcctataatcccagctactcgggaggctgaggcaggagaatcgcttgaacccgggaggtggaggttgcggtgagccaagatcgcaccattgcactccagcctgggcaacaagagcgaaactctgtctcaaaataaataaaaaataaaagacagaaagcaaggggtgcctaaatctagacttggggtccacaccgggcagcggggttgcaacccagcacctggtaggctccatttcttcccaagcccgagcagagggtcatgcgggccccacaggagaagcggccagggcccgcggggggcaccacctgtggacagccctcctgtccccaagctttcaggcaggcactgaaacgcaccgaacttccacgctctgctggtcagtggcggctgtcccctccccagcccagccgcccagccacatgtgtctgcctgacccgtacacaccaggggttccggggttgggagctgaaccatccccacctcagggttatatttccctctccccttccctccccgccaagagctctgccaggggcgggcaaaaaaaaaagtaaaaagaaaagaaaaaaaaaaaaaagaaacaaaccacctctacatattatggaaagaaaatatttttgtcgattcttattcttttataattatgcgtggaagaagtagacacattaaacgattccagttggaaacatgtcacctg

SEQ ID NO: 299260 - DNA, 4427 bp, Homo sapiens
  misc_feature (2810)..(2810): n is a, c, g, or t
  misc_feature (2832)..(2832): n is a, c, g, or t
caggccgccgcctgggtcgctcaacttccgggtcaaaggtgcctgagccggcgggtcccctgtgtccgccgcggctgtcgtcccccgctcccgccacttccggggtcgcagtcccgggcatggagccgcgaccgtgaggcgccgctggacccgggacgacctgcccagtccggccgccgccccacgtcccggtctgtgtcccacgcctgcagctggaatggaggctctctggaccctttagaaggcacccctgccctcctgaggtcagctgagcggttaatgcggaaggttaagaaactgcgcctggacaaggagaacaccggaagttggagaagcttctcgctgaattccgagggggctgagaggatggccaccaccgggaccccaacggccgaccgaggcgacgcagccgccacagatgacccggccgcccgcttccaggtgcagaagcactcgtgggacgggctccggagcatcatccacggcagccgcaagtactcgggcctcattgtcaacaaggcgccccacgacttccagtttgtgcagaagacggatgagtctgggccccactcccaccgcctctactacctgggaatgccatatggcagccgagagaactccctcctctactctgagattcccaagaaggtccggaaagaggctctgctgctcctgtcctggaagcagatgctggatcatttccaggccacgccccaccatggggtctactctcgggaggaggagctgctgagggagcggaaacgcctgggggtcttcggcatcacctcctacgacttccacagcgagagtggcctcttcctcttccaggccagcaacagcctcttccactgccgcgacggcggcaagaacggcttcatggtgtcccctatgaaaccgctggaaatcaagacccagtgctcagggccccggatggaccccaaaatctgccctgccgaccctgccttcttctccttcatcaataacagcgacctgtgggtggccaacatcgagacaggcgaggagcggcggctgaccttctgccaccaaggtttatccaatgtcctggatgaccccaagtctgcgggtgtggccaccttcgtcatacaggaagagttcgaccgcttcactgggtactggtggtgccccacagcctcctgggaaggttcagagggcctcaagacgctgcgaatcctgtatgaggaagtcgatgagtccgaggtggaggtcattcacgtcccctctcctgcgctagaagaaaggaagacggactcgtatcggtaccccaggacaggcagcaagaatcccaagattgccttgaaactggctgagttccagactgacagccagggcaagatcgtctcgacccaggagaaggagctggtgcagcccttcagctcgctgttcccgaaggtggagtacatcgccagggccgggtggacccgggatggcaaatacgcctgggccatgttcctggaccggccccagcagtggctccagctcgtcctcctccccccggccctgttcatcccgagcacagagaatgaggagcagcggctagcctctgccagagctgtccccaggaatgtccagccgtatgtggtgtacgaggaggtcaccaacgtctggatcaatgttcatgacatcttctatcccttcccccaatcagagggagaggacgagctctgctttctccgcgccaatgaatgcaagaccggcttctgccatttgtacaaagtcaccgccgttttaaaatcccagggctacgattggagtgagcccttcagccccggggaagatgaatttaagtgccccattaaggaagagattgctctgaccagcggtgaatgggaggttttggcgaggcacggctccaagatctgggtcaatgaggagaccaagctggtgtacttccagggcaccaaggacacgccgctggagcaccacctctacgtggtcagctatgaggcggccggcgagatcgtacgcctcaccacgcccggcttctcccatagctgctccatgagccagaacttcgacatgttcgtcagccactacagcagcgtgagcacgccgccctgcgtgcacgtctacaagctgagcggccccgacgacgaccccctgcacaagcagccccgcttctgggctagcatgatggaggcagccagctgccccccggattatgttcctccagagatcttccatttccacacgcgctcggatgtgcggctctacggcatgatctacaagccccacgccttgcagccagggaagaagcaccccaccgtcctctttgtatatggaggcccccaggtgcagctggtgaataactccttcaaaggcatcaagtacttgcggctcaacacactggcctccctgggctacgccgtggttgtgattgacggcaggggctcctgtcagcgagggcttcggttcgaaggggccctgaaaaaccaaatgggccaggtggagatcgaggaccaggtggagggcctgcagttcgtggccgagaagtatggcttcatcgacctgagccgagttgccatccatggctggtcctacgggggcttcctctcgctcatggggctaatccacaagccccaggtgttcaaggtggccatcgcgggtgccccggtcaccgtctggatggcctacgacacagggtacactgagcgctacatggacgtccctgagaacaaccagcacggctatgaggcgggttccgtggccctgcacgtggagaagctgcccaatgatgtgagaatggcctgccccaaatgagcccccaaaccccgcctttgcctttaatcccntccccacgtggcgttttccctntgtgttaaccggaaaaaacgttgcaacacttatatttttcgccaagcgaaggccaaaaacaacggttttccccaattacggtgattcctttcccccccaagaaccttggaaaattccccggtaatgcccaggggggaaaaaccttaccaagctcccagatctaccccaacgagagacacagtattcgctgccccgagtcgggcgagcactatgaagtcacgttgctgcactttctacaggaatacctctgagcctgcccaccgggagccgccacatcacagcacaagtggctgcagcctccgcggggaaccaggcgggagggactgagtggcccgcgggccccagtgaggcactttgtcccgcccagcgctggccagccccgaggagccgctgccttcaccgccccgacgccttttatccttttttaaacgctcttgggttttatgtccgctgcttcttggttgccgagacagagagatggtggtctcgggccagcccctcctctccccgccttctgggaggaggaggtcacacgctgatgggcactggagaggccagaagagactcagaggagcgggctgccttccgcctggggctccctgtgacctctcagtcccctggcccggccagccaccgtccccagcacccaagcatgcaattgcctgtcccccccggccagcctccccaacttgatgtttgtgttttgtttggggggatatttttcataattatttaaaagacaggccgggcgcggtggctcacgtctgtaatcccagcactttgggaggctgaggcgggcggatcacctgaggttgggagttcaagaccagcctggccaacatggggaaaccccgtctctactaaaaatacaaaaaattagccgggtgtggtggcgcgtgcctataatcccagctactcgggaggctgaggcaggagaatcgcttgaacccgggaggtggaggttgcggtgagccaagatcgcaccattgcactccagcctgggcaacaagagcgaaactctgtctcaaaataaataaaaaataaaagacagaaagcaaggggtgcctaaatctagacttggggtccacaccgggcagcggggttgcaacccagcacctggtaggctccatttcttcccaagcccgagcagagggtcatgcgggccccacaggagaagcggccagggcccgcggggggcaccacctgtggacagccctcctgtccccaagctttcaggcaggcactgaaacgcaccgaacttccacgctctgctggtcagtggcggctgtcccctccccagcccagccgcccagccacatgtgtctgcctgacccgtacacaccaggggttccggggttgggagctgaaccatccccacctcagggttatatttccctctccccttccctccccgccaagagctctgccaggggcgggcaaaaaaaaaagtaaaaagaaaagaaaaaaaaaaaaaagaaacaaaccacctctacatattatggaaagaaaatatttttgtcgattcttattcttttataattatgcgtggaagaagtagacacattaaacgattccagttggaaacatgtcacctg

SEQ ID NO: 299261 - DNA, 2436 bp, Homo sapiens
tggcgaattcggcacgagggggaggttttggcgaggcacggctccaagggcaccaaggacacgccgctggagcaccacctctacgtggtcagctatgaggcggccggcgagatcgtacgcctcaccacgcccggcttctcccatagctgctccatgagccagaacttcgacatgttcgtcagccactacagcagcgtgagcacgccgccctgcgtgcacgtctacaagctgagcggccccgacgacgaccccctgcacaagcagccccgcttctgggctagcatgatggaggcagccagctgccccccggattatgttcctccagagatcttccatttccacacgcgctcggatgtgcggctctacggcatgatctacaagccccacgccttgcagccagggaagaagcaccccaccgtcctctttgtatatggaggcccccaggtgcagctggtgaataactccttcaaaggcatcaagtacttgcggctcaacacactggcctccctgggctacgccgtggttgtgattgacggcaggggctcctgtcagcgagggcttcggttcgaaggggccctgaaaaaccaaatgggccaggtggagatcgaggaccaggtggagggcctgcagttcgtggccgagaagtatggcttcatcgacctgagccgagttgccatccatggctggtcctacgggggcttcctctcgctcatggggctaatccacaagccccaggtgttcaaggtggccatcgcgggtgccccggtcaccgtctggatggcctacgacacagggtacactgagcgctacatggacgtccctgagaacaaccagcacggctatgaggcgggttccgtggccctgcacgtggagaagctgcccaatgagcccaaccgcttgcttatcctccacggcttcctggacgaaaacgtgcactttttccacacaaacttcctcgtctcccaactgatccgagcagggaaaccttaccagctccagatctaccccaacgagagacacagtattcgctgccccgagtcgggcgagcactatgaagtcacgttgctgcactttctacaggaatacctctgagcctgcccaccgggagccgccacatcacagcacaagtggctgcagcctccgcggggaaccaggcgggagggactgagtggcccgcgggccccagtgaggcactttgtcccgcccagcgctggccagccccgaggagccgctgccttcaccgccccgacgccttttatccttttttaaacgctcttgggttttatgtccgctgcttcttggttgccgagacagagagatggtggtctcgggccagcccctcctctccccgccttctgggaggaggaggtcacacgctgatgggcactggagaggccagaagagactcagaggagcgggctgccttccgcctggggctccctgtgacctctcagtcccctggcccggccagccaccgtccccagcacccaagcatgcaattgcctgtcccccccggccagcctccccaacttgatgtttgtgttttgtttggggggatatttttcataattatttaaaagacaggccgggcgcggtggctcacgtctgtaatcccagcactttgggaggctgaggcgggcggatcacctgaggttgggagttcaagaccagcctggccaacatggggaaaccccgtctctactaaaaatacaaaaaattagccgggtgtggtggcgcgtgcctataatcccagctactcgggaggctgaggcaggagaatcgcttgaacccgggaggtggaggttgcggtgagccaagatcgcaccattgcactccagcctgggcaacaagagcgaaactctgtctcaaaataaataaaaaataaaagacagaaagcaaggggtgcctaaatctagacttggggtccacaccgggcagcggggttgcaacccagcacctggtaggctccatttcttcccaagcccgagcagagggtcatgcgggccccacaggagaagcggccagggcccgcggggggcaccacctgtggacagccctcctgtccccaagctttcaggcaggcactgaaacgcaccgaacttccacgctctgctggtcagtggcggctgtcccctccccagcccagccgcccagccacatgtgtctgcctgacccgtacacaccaggggttccggggttgggagctgaaccatccccacctcagggttatatttccctctccccttccctccccgccaagagctctgccaggggcgggcaaaaaaaaaagtaaaaagaaaagaaaaaaaaaaaaaagaaacaaaccacctctacatattatggaaagaaaatatttttgtcgattcttattcttttataattatgcgtggaagaagtagacacattaaacgattccagttggaaacatgtcacctg

SEQ ID NO: 299262 - DNA, 4219 bp, Homo sapiens
caggccgccgcctgggtcgctcaacttccgggtcaaaggtgcctgagccggcgggtcccctgtgtccgccgcggctgtcgtcccccgctcccgccacttccggggtcgcagtcccgggcatggagccgcgaccgtgaggcgccgctggacccgggacgacctgcccagtccggccgccgccccacgtcccggtctgtgtcccacgcctgcagctggaatggaggctctctggaccctttagaaggcacccctgccctcctgaggtcagctgagcggttaatgcggaaggttaagaaactgcgcctggacaaggagaacaccggaagttggagaagcttctcgctgaattccgagggggctgagaggatggccaccaccgggaccccaacggccgaccgaggcgacgcagccgccacagatgacccggccgcccgcttccaggtgcagaagcactcgtgggacgggctccggagcatcatccacggcagccgcaagtactcgggcctcattgtcaacaaggcgccccacgacttccagtttgtgcagaagacggatgagtctgggccccactcccaccgcctctactacctgggaatgccatatggcagccgagagaactccctcctctactctgagattcccaagaaggtccggaaagaggctctgctgctcctgtcctggaagcagatgctggatcatttccaggccacgccccaccatggggtctactctcgggaggaggagctgctgagggagcggaaacgcctgggggtcttcggcatcacctcctacgacttccacagcgagagtggcctcttcctcttccaggccagcaacagcctcttccactgccgcgacggcggcaagaacggcttcatggtgtcccctatgaaaccgctggaaatcaagacccagtgctcagggccccggatggaccccaaaatctgccctgccgaccctgccttcttctccttcatcaataacagcgacctgtgggtggccaacatcgagacaggcgaggagcggcggctgaccttctgccaccaaggtttatccaatgtcctggatgaccccaagtctgcgggtgtggccaccttcgtcatacaggaagagttcgaccgcttcactgggtactggtggtgccccacagcctcctgggaaggttcagagggcctcaagacgctgcgaatcctgtatgaggaagtcgatgagtccgaggtggaggtcattcacgtcccctctcctgcgctagaagaaaggaagacggactcgtatcggtaccccaggacaggcagcaagaatcccaagattgccttgaaactggctgagttccagactgacagccagggcaagatcgtctcgacccaggagaaggagctggtgcagcccttcagctcgctgttcccgaaggtggagtacatcgccagggccgggtggacccgggatggcaaatacgcctgggccatgttcctggaccggccccagcagtggctccagctcgtcctcctccccccggccctgttcatcccgagcacagagaatgaggagcagcggctagcctctgccagagctgtccccaggaatgtccagccgtatgtggtgtacgaggaggtcaccaacgtctggatcaatgttcatgacatcttctatcccttcccccaatcagagggagaggacgagctctgctttctccgcgccaatgaatgcaagaccggcttctgccatttgtacaaagtcaccgccgttttaaaatcccagggctacgattggagtgagcccttcagccccggggaagatgaatttaagtgccccattaaggaagagattgctctgaccagcggtgaatgggaggttttggcgaggcacggctccaagatctgggtcaatgaggagaccaagctggtgtacttccagggcaccaaggacacgccgctggagcaccacctctacgtggtcagctatgaggcggccggcgagatcgtacgcctcaccacgcccggcttctcccatagctgctccatgagccagaacttcgacatgttcgtcagccactacagcagcgtgagcacgccgccctgcgtgcacgtctacaagctgagcggccccgacgacgaccccctgcacaagcagccccgcttctgggctagcatgatggaggcagccagctgccccccggattatgttcctccagagatcttccatttccacacgcgctcggatgtgcggctctacggcatgatctacaagccccacgccttgcagccagggaagaagcaccccaccgtcctctttgtatatggaggcccccaggtgcagctggtgaataactccttcaaaggcatcaagtacttgcggctcaacacactggcctccctgggctacgccgtggttgtgattgacggcaggggctcctgtcagcgagggcttcggttcgaaggggccctgaaaaaccaaatgggccaggtggagatcgaggaccaggtggagggcctgcagttcgtggccgagaagtatggcttcatcgacctgagccgagttgccatccatggctggtcctacgggggcttcctctcgctcatggggctaatccacaagccccaggtgttcaaggtggccatcgcgggtgccccggtcaccgtctggatggcctacgacacagggtacactgagcgctacatggacgtccctgagaacaaccagcacggctatgaggcgggttccgtggccctgcacgtggagaagctgcccaatgagcccaaccgcttgcttatcctccacggcttcctggacgaaaacgtgcactttttccacacaaacttcctcgtctcccaactgatccgagcagggaaaccttaccagctccagatctaccccaacgagagacacagtattcgctgccccgagtcgggcgagcactatgaagtcacgttgctgcactttctacaggaatacctctgagcctgcccaccgggagccgccacatcacagcacaagtggctgcagcctccgcggggaaccaggcgggagggactgagtggcccgcgggccccagtgaggcactttgtcccgcccagcgctggccagccccgaggagccgctgccttcaccgccccgacgccttttatccttttttaaacgctcttgggttttatgtccgctgcttcttggttgccgagacagagagatggtggtctcgggccagcccctcctctccccgccttctgggaggaggaggtcacacgctgatgggcactggagaggccagaagagactcagaggagcgggctgccttccgcctggggctccctgtgacctctcagtcccctggcccggccagccaccgtccccagcacccaagcatgcaattgcctgtcccccccggccagcctccccaacttgatgtttgtgttttgtttggggggatatttttcataattatttaaaagacaggccgggcgcggtggctcacgtctgtaatcccagcactttgggaggctgaggcgggcggatcacctgaggttgggagttcaagaccagcctggccaacatggggaaaccccgtctctactaaaaatacaaaaaattagccgggtgtggtggcgcgtgcctataatcccagctactcgggaggctgaggcaggagaatcgcttgaacccgggaggtggaggttgcggtgagccaagatcgcaccattgcactccagcctgggcaacaagagcgaaactctgtctcaaaataaataaaaaataaaagacagaaagcaaggggtgcctaaatctagacttggggtccacaccgggcagcggggttgcaacccagcacctggtaggctccatttcttcccaagcccgactttcaggcaggcactgaaacgcaccgaacttccacgctctgctggtcagtggcggctgtcccctccccagcccagccgcccagccacatgtgtctgcctgacccgtacacaccaggggttccggggttgggagctgaaccatccccacctcagggttatatttccctctccccttccctccccgccaagagctctgccaggggcgggcaaaaaaaaaagtaaaaagaaaagaaaaaaaaaaaaaagaaacaaaccacctctacatattatggaaagaaaatatttttgtcgattcttattcttttataattatgcgtggaagaagtagacacattaaacgattccagttggaaacatgtcacctg

SEQ ID NO: 299263 - DNA, 4161 bp, Homo sapiens
caggccgccgcctgggtcgctcaacttccgggtcaaaggtgcctgagccggcgggtcccctgtgtccgccgcggctgtcgtcccccgctcccgccacttccggggtcgcagtcccgggcatggagccgcgaccgtgaggcgccgctggacccgggacgacctgcccagtccggccgccgccccacgtcccggtctgtgtcccacgcctgcagctggaatggaggctctctggaccctttagaaggcacccctgccctcctgaggtcagctgagcggttaatgcggaaggttaagaaactgcgcctggacaaggagaacaccggaagttggagaagcttctcgctgaattccgagggggctgagaggatggccaccaccgggaccccaacggccgaccgaggcgacgcagccgccacagatgacccggccgcccgcttccaggtgcagaagcactcgtgggacgggctccggagcatcatccacggcagccgcaagtactcgggcctcattgtcaacaaggcgccccacgacttccagtttgtgcagaagacggatgagtctgggccccactcccaccgcctctactacctgggaatgccatatggcagccgagagaactccctcctctactctgagattcccaagaaggtccggaaagaggctctgctgctcctgtcctggaagcagatgctggatcatttccaggccacgccccaccatggggtctactctcgggaggaggagctgctgagggagcggaaacgcctgggggtcttcggcatcacctcctacgacttccacagcgagagtggcctcttcctcttccaggccagcaacagcctcttccactgccgcgacggcggcaagaacggcttcatggtgtcccctatgaaaccgctggaaatcaagacccagtgctcagggccccggatggaccccaaaatctgccctgccgaccctgccttcttctccttcatcaataacagcgacctgtgggtggccaacatcgagacaggcgaggagcggcggctgaccttctgccaccaaggtttatccaatgtcctggatgaccccaagtctgcgggtgtggccaccttcgtcatacaggaagagttcgaccgcttcactgggtactggtggtgccccacagcctcctgggaaggttcagagggcctcaagacgctgcgaatcctgtatgaggaagtcgatgagtccgaggtggaggtcattcacgtcccctctcctgcgctagaagaaaggaagacggactcgtatcggtaccccaggacaggcagcaagaatcccaagattgccttgaaactggctgagttccagactgacagccagggcaagatcgtctcgacccaggagaaggagctggtgcagcccttcagctcgctgttcccgaaggtggagtacatcgccagggccgggtggacccgggatggcaaatacgcctgggccatgttcctggaccggccccagcagtggctccagctcgtcctcctccccccggccctgttcatcccgagcacagagaatgaggagcagcggctagcctctgccagagctgtccccaggaatgtccagccgtatgtggtgtacgaggaggtcaccaacgtctggatcaatgttcatgacatcttctatcccttcccccaatcagagggagaggacgagctctgctttctccgcgccaatgaatgcaagaccggcttctgccatttgtacaaagtcaccgccgttttaaaatcccagggctacgattggagtgagcccttcagccccggggaagatgaatttaagtgccccattaaggaagagattgctctgaccagcggtgaatgggaggttttggcgaggcacggctccaagatctgggtcaatgaggagaccaagctggtgtacttccagggcaccaaggacacgccgctggagcaccacctctacgtggtcagctatgaggcggccggcgagatcgtacgcctcaccacgcccggcttctcccatagctgctccatgagccagaacttcgacatgttcgtcagccactacagcagcgtgagcacgccgccctgcgtgcacgtctacaagctgagcggccccgacgacgaccccctgcacaagcagccccgcttctgggctagcatgatggaggcagccagctgccccccggattatgttcctccagagatcttccatttccacacgcgctcggatgtgcggctctacggcatgatctacaagccccacgccttgcagccagggaagaagcaccccaccgtcctctttgtatatggaggcccccaggtgcagctggtgaataactccttcaaaggcatcaagtacttgcggctcaacacactggcctccctgggctacgccgtggttgtgattgacggcaggggctcctgtcagcgagggcttcggttcgaaggggccctgaaaaaccaaatgggccaggtggagatcgaggaccaggtggagggcctgcagttcgtggccgagaagtatggcttcatcgacctgagccgagttgccatccatggctggtcctacgggggcttcctctcgctcatggggctaatccacaagccccaggtgttcaaggtggccatcgcgggtgccccggtcaccgtctggatggcctacgacacagggtacactgagcgctacatggacgtccctgagaacaaccagcacggctatgaggcgggttccgtggccctgcacgtggagaagctgcccaatgagcccaaccgcttgcttatcctccacggcttcctggacgaaaacgtgcactttttccacacaaacttcctcgtctcccaactgatccgagcagggaaaccttaccagctccagatctaccccaacgagagacacagtattcgctgccccgagtcgggcgagcactatgaagtcacgttgctgcactttctacaggaatacctctgagcctgcccaccgggagccgccacatcacagcacaagtggctgcagcctccgcggggaaccaggcgggagggactgagtggcccgcgggccccagtgaggcactttgtcccgcccagcgctggccagccccgaggagccgctgccttcaccgccccgacgccttttatccttttttaaacgctcttgggttttatgtccgctgcttcttggttgccgagacagagagatggtggtctcgggccagcccctcctctccccgccttctgggaggaggaggtcacacgctgatgggcactggagaggccagaagagactcagaggagcgggctgccttccgcctggggctccctgtgacctctcagtcccctggcccggccagccaccgtccccagcacccaagcatgcaattgcctgtcccccccggccagcctccccaacttgatgtttgtgttttgtttggggggatatttttcataattatttaaaagacaggccgggcgcggtggctcacgtctgtaatcccagcactttgggaggctgaggcgggcggatcacctgaggttgggagttcaagaccagcctggccaacatggggaaaccccgtctctactaaaaatacaaaaaattagccgggtgtggtggcgcgtgcctataatcccagctactcgggaggctgaggcaggagaatcgcttgaacccgggaggtggaggttgcggtgagccaagatcgcaccattgcactccagcctgggcaacaagagcgaaactctgtctcaaacaacaaccaaacttctggaatagcattactgtcatgtattgtaaagtacagaagcttcactaaagtcactcattttgacttctacgtagttgttggagcaattacactagagtcaagaaccccagttaaaagtaaactcaatttaaaataacttggaaatatcctcctcttaaccctaccagggtgtctgcaagtaaacctgaaactacagtgcataggtattagaaatgagtatctttctagacgttcaaattgaaaaccaaccttcatgtacaatatactcaaattccagtgaaagagctaatggaagactaggggttttacccgcggggaaccaggcgggagggactgagtggcccgcgggccccagtgaggcactttgtcccgcccagcgctggccagccccgaggagccgctgccttcac

SEQ ID NO: 299264 - DNA, 2411 bp, Homo sapiens
caggccgccgcctgggtcgctcaacttccgggtcaaaggtgcctgagccggcgggtcccctgtgtccgccgcggctgtcgtcccccgctcccgccacttccggggtcgcagtcccgggcatggagccgcgaccgtgaggcgccgctggacccgggacgacctgcccagtccggccgccgccccacgtcccggtctgtgtcccacgcctgcagctggaatggaggctctctggaccctttagaaggcacccctgccctcctgaggtcagctgagcggttaatgcggaaggttaagaaactgcgcctggacaaggagaacaccggaagttggagaagcttctcgctgaattccgagggggctgagaggatggccaccaccgggaccccaacggccgaccgaggcgacgcagccgccacagatgacccggccgcccgcttccaggtgcagaagcactcgtgggacgggctccggagcatcatccacggcagccgcaagtactcgggcctcattgtcaacaaggcgccccacgacttccagtttgtgcagaagacggatgagtctgggccccactcccaccgcctctactacctgggaatgccatatggcagccgagagaactccctcctctactctgagattcccaagaaggtccggaaagaggctctgctgctcctgtcctggaagcagatgctggatcatttccaggccacgccccaccatggggtctactctcgggaggaggagctgctgagggagcggaaacgcctgggggtcttcggcatcacctcctacgacttccacagcgagagtggcctcttcctcttccaggccagcaacagcctcttccactgccgcgacggcggcaagaacggcttcatggtgtcccctatgaaaccgctggaaatcaagacccagtgctcagggccccggatggaccccaaaatctgccctgccgaccctgccttcttctccttcatcaataacagcgacctgtgggtggccaacatcgagacaggcgaggagcggcggctgaccttctgccaccaaggtttatccaatgtcctggatgaccccaagtctgcgggtgtggccaccttcgtcatacaggaagagttcgaccgcttcactgggtactggtggtgccccacagcctcctgggaaggttcagagggcctcaagacgctgcgaatcctgtatgaggaagtcgatgagtccgaggtggaggtcattcacgtcccctctcctgcgctagaagaaaggaagacggactcgtatcggtaccccaggacaggcagcaagaatcccaagattgccttgaaactggctgagttccagactgacagccagggcaagatcgtctcgacccaggagaaggagctggtgcagcccttcagctcgctgttcccgaaggtggagtacatcgccagggccgggtggacccgggatggcaaatacgcctgggccatgttcctggaccggccccagcagtggctccagctcgtcctcctccccccggccctgttcatcccgagcacagagaatgaggagcagcggctagcctctgccagagctgtccccaggaatgtccagccgtatgtggtgtacgaggaggtcaccaacgtctggatcaatgttcatgacatcttctatcccttcccccaatcagagggagaggacgagctctgctttctccgcgccaatgaatgcaagaccggcttctgccatttgtacaaagtcaccgccgttttaaaatcccagggctacgattggagtgagcccttcagccccggggaaggtgagcagagcctgacgaatgctgtcgactcatcgcgttagtcacgtgtggttcaatatgctgtttgttcattggtcggcccccccactcagccagcacaccctgcgggagaaggaacagggatcggcaggaagccagccttccccagtgactgcatgatctggcagggcttagagcacccaactgttggcttattcaggcagcagatttactgagcacctcccctgtgccaggcccttagcacaaccaggggttggccacctacggcccacaggtcaaatccggcccaccacctgtgttcataaataaagttttattggcactgagccacagccacttgtttacagagactgtctgtggtcgcttttgtgctgcagcagcagaactgggtagtcccagcagaaactgttgtgcaaggccaagatttactgtctagccctttgtagaaacatttgccagctcctgctgtaggtagctgtgatggaattgttcactgtaaataaagaaaaaggaaaatccctgctcttgggaccttctagtggaggaggcagtattccagaaacagttagaggtgctgcctctggtgtgctgtgcgtggcagatgcagatcctagtc

SEQ ID NO: 299265 - DNA, 916 bp, Homo sapiens
caggccgccgcctgggtcgctcaacttccgggtcaaaggtgcctgagccggcgggtcccctgtgtccgccgcggctgtcgtcccccgctcccgccacttccggggtcgcagtcccgggcatggagccgcgaccgtgaggcgccgctggacccgggacgacctgcccagtccggccgccgccccacgtcccggtctgtgtcccacgcctgcagctggaatggaggctctctggaccctttagaaggctgaggcaggagaatcgcttgaacccgggaggtggaggttgcggtgagccaagatcgcaccattgcactccagcctgggcaacaagagcgaaactctgtctcaaaataaataaaaaataaaagacagaaagcaaggggtgcctaaatctagacttggggtccacaccgggcagcggggttgcaacccagcacctggtaggctccatttcttcccaagcccgagcagagggtcatgcgggccccacaggagaagcggccagggcccgcggggggcaccacctgtggacagccctcctgtccccaagctttcaggcaggcactgaaacgcaccgaacttccacgctctgctggtcagtggcggctgtcccctccccagcccagccgcccagccacatgtgtctgcctgacccgtacacaccaggggttccggggttgggagctgaaccatccccacctcagggttatatttccctctccccttccctccccgccaagagctctgccaggggcgggcaaaaaaaaaagtaaaaagaaaagaaaaaaaaaaaaaagaaacaaaccacctctacatattatggaaagaaaatatttttgtcgattcttattcttttataattatgcgtggaagaagtagacacattaaacgattccagttggaaacatgtcacctg

SEQ ID NO: 299266 - DNA, 2796 bp, Homo sapiens
caggccgccgcctgggtcgctcaacttccgggtcaaaggtgcctgagccggcgggtcccctgtgtccgccgcggctgtcgtcccccgctcccgccacttccggggtcgcagtcccgggcatggagccgcgaccgtgaggcgccgctggacccgggacgacctgcccagtccggccgccgccccacgtcccggtctgtgtcccacgcctgcagctggaatggaggctctctggaccctttagaaggcacccctgccctcctgaggtcagctgagcggttaatgcggaaggttaagaaactgcgcctggacaaggagaacaccggaagttggagaagcttctcgctgaattccgagggggctgagaggatggccaccaccgggaccccaacggccgaccgaggcgacgcagccgccacagatgacccggccgcccgcttccaggtgcagaagcactcgtgggacgggctccggagcatcatccacggcagccgcaagtactcgggcctcattgtcaacaaggcgccccacgacttccagtttgtgcagaagacggatgagtctgggccccactcccaccgcctctactacctgggaatgccatatggcagccgagagaactccctcctctactctgagattcccaagaaggtccggaaagaggctctgctgctcctgtcctggaagcagatgctggatcatttccaggccacgccccaccatggggtctactctcgggaggaggagctgctgagggagcggaaacgcctgggggtcttcggcatcacctcctacgacttccacagcgagagtggcctcttcctcttccaggccagcaacagcctcttccactgccgcgacggcggcaagaacggcttcatggtgtcccctatgaaaccgctggaaatcaagacccagtgctcagggccccggatggaccccaaaatctgccctgccgaccctgccttcttctccttcatcaataacagcgacctgtgggtggccaacatcgagacaggcgaggagcggcggctgaccttctgccaccaaggtttatccaatgtcctggatgaccccaagtctgcgggtgtggccaccttcgtcatacaggaagagttcgaccgcttcactgggtactggtggtgccccacagcctcctgggaaggttcagagggcctcaagacgctgcgaatcctgtatgaggaagtcgatgagtccgaggtggaggtcattcacgtcccctctcctgcgctagaagaaaggaagacggactcgtatcggtaccccaggacaggcagcaagaatcccaagattgccttgaaactggctgagttccagactgacagccagggcaagatcgtctcgacccaggagaaggagctggtgcagcccttcagctcgctgttcccgaaggtggagtacatcgccagggccgggtggacccgggatggcaaatacgcctgggccatgttcctggaccggccccagcagtggctccagctcgtcctcctccccccggccctgttcatcccgagcacagagaatgaggagcagcggctagcctctgccagagctgtccccaggaatgtccagccgtatgtggtgtacgaggaggtcaccaacgtctggatcaatgttcatgacatcttctatcccttcccccaatcagagggagaggacgagctctgctttctccgcgccaatgaatgcaagaccggcttctgccatttgtacaaagtcaccgccgttttaaaatcccagggctacgattggagtgagcccttcagccccggggaagatgaatttaagtgccccattaaggaagagattgctctgaccagcggtgaatgggaggttttggcgaggcacggctccaagatctgggtcaatgaggagaccaagctggtgtacttccagggcaccaaggacacgccgctggagcaccacctctacgtggtcagctatgaggcggccggcgagatcgtacgcctcaccacgcccggcttctcccatagctgctccatgagccagaacttcgacatgttcgtcagccactacagcagcgtgagcacgccgccctgcgtgcacgtctacaagctgagcggccccgacgacgaccccctgcacaagcagccccgcttctgggctagcatgatggaggcagccagctgccccccggattatgttcctccagagatcttccatttccacacgcgctcggatgtgcggctctacggcatgatctacaagccccacgccttgcagccagggaagaagcaccccaccgtcctctttgtatatggaggcccccaggtgcagctggtgaataactccttcaaaggcatcaagtacttgcggctcaacacactggcctccctgggctacgccgtggttgtgattgacggcaggggctcctgtcagcgagggcttcggttcgaaggggccctgaaaaaccaaatgggccaggtggagatcgaggaccaggtggagggcctgcagttcgtggccgagaagtatggcttcatcgacctgagccgagttgccatccatggctggtcctacgggggcttcctctcgctcatggggctaatccacaagccccaggtgttcaaggtggccatcgcgggtgccccggtcaccgtctggatggcctacgacacagggtacactgagcgctacatggacgtccctgagaacaaccagcacggctatgaggcgggttccgtggccctgcacgtggagaagctgcccaatgaccacgagccacccaaagtccacaccatgccacgcacgaccaga

SEQ ID NO: 299267 - DNA, 1980 bp, Homo sapiens
caggccgccgcctgggtcgctcaacttccgggtcaaaggtgcctgagccggcgggtcccctgtgtccgccgcggctgtcgtcccccgctcccgccacttccggggtcgcagtcccgggcatggagccgcgaccgtgaggcgccgctggacccgggacgacctgcccagtccggccgccgccccacgtcccggtctgtgtcccacgcctgcagctggaatggaggctctctggaccctttagaaggcacccctgccctcctgaggtcagctgagcggttaatgcggaaggttaagaaactgcgcctggacaaggagaacaccggaagttggagaagcttctcgctgaattccgagggggctgagaggatggccaccaccgggaccccaacggccgaccgaggcgacgcagccgccacagatgacccggccgcccgcttccaggtgcagaagcactcgtgggacgggctccggagcatcatccacggcagccgcaagtactcgggcctcattgtcaacaaggcgccccacgacttccagtttgtgcagaagacggatgagtctgggccccactcccaccgcctctactacctgggaatgccatatggcagccgagagaactccctcctctactctgagattcccaagaaggtccggaaagaggctctgctgctcctgtcctggaagcagatgctggatcatttccaggccacgccccaccatggggtctactctcgggaggaggagctgctgagggagcggaaacgcctgggggtcttcggcatcacctcctacgacttccacagcgagagtggcctcttcctcttccaggccagcaacagcctcttccactgccgcgacggcggcaagaacggcttcatggtgtcccctatgaaaccgctggaaatcaagacccagtgctcagggccccggatggaccccaaaatctgccctgccgaccctgccttcttctccttcatcaataacagcgacctgtgggtggccaacatcgagacaggcgaggagcggcggctgaccttctgccaccaaggtttatccaatgtcctggatgaccccaagtctgcgggtgtggccaccttcgtcatacaggaagagttcgaccgcttcactgggtactggtggtgccccacagcctcctgggaaggttcagagggcctcaagacgctgcgaatcctgtatgaggaagtcgatgagtccgaggtggaggtcattcacgtcccctctcctgcgctagaagaaaggaagacggactcgtatcggtaccccaggacaggcagcaagaatcccaagattgccttgaaactggctgagttccagactgacagccagggcaagatcgtctcgacccaggagaaggagctggtgcagcccttcagctcgctgttcccgaaggtggagtacatcgccagggccgggtggacccgggatggcaaatacgcctgggccatgttcctggaccggccccagcagtggctccagctcgtcctcctccccccggccctgttcatcccgagcacagagaatgaggagcagcggctagcctctgccagagctgtccccaggaatgtccagccgtatgtggtgtacgaggaggtcaccaacgtctggatcaatgttcatgacatcttctatcccttcccccaatcagagggagaggacgagctctgctttctccgcgccaatgaatgcaagaccggcttctgccatttgtacaaagtcaccgccgttttaaaatcccagggctacgattggagtgagcccttcagccccggggaagatgaatttaagtgccccattaaggaagagattgctctgaccagcggtgaatgggaggttttggcgaggcacggctccaagatctgcgtcaatgaggagaccagcggggtccttcacggcccaggacacccgttgagccactctagtggtcgtatgaggggcggaaatagcctacaccggttccta

SEQ ID NO: 299268 - DNA, 874 bp, Homo sapiens
ctgtcctggtcagggcgtttggaggagttttctgtggctgccattgtgaaaattattcacacttctggagggcagaaatccaagatcaaggtttcctcagggccacgctccctctggaggctccagaggagaaccagtcctggcctcttgcagcttctggtggcggccagcatcccttggcttgtggccacaacgttggaacttctggcctgatggtcacacagcttcctcctcctcctcttcttctcttctgtctgaaattcccctctgctccagcctgggcaacaagagcgaaactctgtctcaaaataaataaaaaataaaagacagaaagcaaggggtgcctaaatctagacttggggtccacaccgggcagcggggttgcaacccagcacctggtaggctccatttcttcccaagcccgagcagagggtcatgcgggccccacaggagaagcggccagggcccgcggggggcaccacctgtggacagccctcctgtccccaagctttcaggcaggcactgaaacgcaccgaacttccacgctctgctggtcagtggcggctgtcccctccccagcccagccgcccagccacatgtgtctgcctgacccgtacacaccaggggttccggggttgggagctgaaccatccccacctcagggttatatttccctctccccttccctccccgccaagagctctgccaggggcgggcaaaaaaaaaagtaaaaagaaaagaaaaaaaaaaaaaagaaacaaaccacctctacatattatggaaagaaaatatttttgtcgattcttattcttttataattatgcgtggaagaagtagacacattaaacgattccagttggaaacatgtcacctg

SEQ ID NO: 299269 - DNA, 346 bp, Homo sapiens
cccatctctaaaaaaagaaaaatacataaataaacaaatcaatatcccagttcctttttcccttagcgtgaaaactctgcggtacatgtttttcacaggctcccagggttccccagaaggatgaagctttggttacccacagtcacaccctgcttgctaaggagaactttattaacttttctaccctctctcacttccctattgcctttccgagtatctcctggatcacttctcaagtaaactgctagcacccaaatcctcttctcaagaatctgcttctgggaaacctaaaccaggatgctattccccttgcagaaaacattccctgccatgaacagcccaactg

SEQ ID NO: 299270 - DNA, 3941 bp, Homo sapiens
  misc_feature (1788)..(1788): n is a, c, g, or t
  misc_feature (1809)..(1809): n is a, c, g, or t
gtgcattgagcgcgctccagctgccgggacggagggggcggcccccgcgctcggggcgctcggctacagctgcggggcccgaggtctccgcgcactcgctcccggcccatgctggaggcggcggaaccgcggggacctaggacggaggcggcgggcgctgggcggcccccggcacgctgagctcgggatgcggacgctgctgcctcccgcgctgctgacctgctggctgctcgcccccgtgaacagcattcacccagaatgccgatttcatctggaaatacaggaggaagaaacaaaatgtgcagagcttctgaggtctcaaacagaaaaacacaaagcctgcagtggcgtctgggacaacatcacgtgctggcggcctgccaatgtgggagagaccgtcacggtgccctgcccaaaagtcttcagcaatttttacagcaaagcaggaaacataagcaaaaactgtacgagtgacggatggtcagagacgttcccagatttcgtcgatgcctgtggctacagcgacccggaggatgagagcaagatcacgttttatattctggtgaaggccatttataccctgggctacagtgtctctctgatgtctcttgcaacaggaagcataattctgtgcctcttcaggaagctgcactgcaccaggaattacatccacctgaacctgttcctgtccttcatcctgagagccatctcagtgctggtcaaggacgacgttctctactccagctctggcacgttgcactgccctgaccagccatcctcctgggtgggctgcaagctgagcctggtcttcctgcagtactgcatcatggccaacttcttctggctgctggtggaggggctctacctccacaccctcctggtggccatgctcccccctagaaggtgcttcctggcctacctcctgatcggatggggcctccccaccgtctgcatcggtgcatggactgcggccaggctctacttagaagacaccggttgctgggatacaaacgaccacagtgtgccctggtgggtcatacgaataccgattttaatttccatcatcgtcaattttgtccttttcattagtattatacgaattttgctgcagaagttaacatccccagatgtcggcggcaacgaccagtctcagtacaagaggctggccaagtccacgctcctgcttatcccgctgttcggcgtccactacatggtgtttgccgtgtttcccatcagcatctcctccaaataccagatactgtttgagctgtgcctcgggtcgttccagggcctggtggtggccgtcctctactgtttcctgaacagtgaggtgcagtgcgagctgaagcgaaaatggcgaagccggtgcccgaccccgtccgcgagccgggattacagggtctgcggttcctccttctcccgcaacggctcggagggcgccctgcagttccaccgcggctcccgcgcccagtccttcctgcaaacggagacctcggtcatctagccccacccctgcctgtcggacgcggcgggaggcccacggttcggggcttctgcggggctgagacgccggcttcctccttccagatgcccgagcaccgtgtcgggcaggtcagcgcggtcctgactccgtcaagctggttgtccactaaaccccatacctggaattggagtcgtgttgtcattgactcgatttaaactccagcatttagataatcttgtgcaaaatgtgtttcagccgtatagtggatccacttttttttttttttttttttgagacggagtctngctctgtcgcccaggctggantgcagtggcctgatctctgctccctgcaagctccgcctcccgggttcacgccattctcctgcctcagcctcccatagctgggactacaggcgcccgccaacacgcctggctaattttttgtatttttagtagagacagggtttcaccatgttagccaggatggtctcgatctcctgacctcgtgatgggcccgcctcggcctcccaaagtgctgggattaaggcgtgagccactgcgcccggcccaagagaataggggagccaaggaggaaatgtggaaacgcagttgtgtggcccagcacgagcctgggcgaccaccgggtgacatccgtcccacatcagggcggcctcccaggtcccataagggtagccccctcatctgcaggacagagggaagccagtcagggcccccctgacgttaggaccaggagaaatcaacaggagggcagcccgtcctctctcttggggcgcccacccggcccggctgagccctgccccacccaactccacagggctgttttgcctccccacggaaggcgggctgaggagacaaccagatcaggagagcaaggtcatgaaggaggggacctctccacacaggtgttccgtgggaccctcagcagctctggctctgcctcaggaggtcacctgccgccctgtgggagccgcagagcctgacgctcagccccaggccagctgcggccaggcctgcgggcccctggtgatggggttacgtggggtgcgggatacagctgagtgggaaccggaaacctattctctttttaacaaaaataatcttaggataagaattattttaacaacatataaaactgtttcaagccctcctccccagagctggcgctcagcagccctagcggctgctccttcaggcgaagggtggtttgcagatgtggggagggtgtctggggacgttgctgagctggctgcagaagggtggggatatcagggcacagtctccatgtgtgtgccaagccctggcccccacagcgctcgatggacctcagcaagctgcccagccctggcccaggtgccccgactgtgggactcagttgttctgagcacatttgactccacttttcccttaaaaatgaatgtcttgttcctgtgcattggtggcatcacagaccccagctggggcgcgatgtcaaaggtcgggacagctgtgccgggaggcagccacagggaagctcacacatcctgtcagtgtcaccttggtttgcaaaacccatatccccggtaaaatgaggccggacagaggggctgttaggacagcaaagcagcagtgtccagagacccctcaatccccaaaggtccgcaccctgtcctgcacaccctgggccacgccggccacacccctctgctgcaacaagctcatccctggacttctgggagaatgaacccgaggttggtttggggagacaggtgaggcggttggatctacagaacaacccaccatttctgggggccgcagaggatccatcacagacggatactggggagtaaacggcccaggccaggtgcccaggaaaggacggctgagcatgtggagcgagagggaggcaggtggacgctgcagaccccaggttcagtgcggcccctcggctgttcctcccctgtagggtttggacagacccacccccagccttgcccagctttcaaaggacaaaagggagcatcccccacctactctcaggtttttgaggaaacaaagatttgtggtaactgaaggtgttgggtcagtggccaggtgccgacactgagctgtgacccagaggggacgctgaggaagtgggcgtgagtggacatgtcaggtggttaccaggcactggttgttgatggtcggtggttgggtgtgggcagtcatcagtcatcaggtgtgctcaggggacaatctcccctcaaccgcacatgtgccactgttcagcggagctgactggtttctcctggtagaggggccggctgtttcctgacagatgcctggtgagcaggggaagcaggacccagtggtcaacaggtgtctttaactgtcattgtgtgtggaatgtcgcagactcctccacgtggcgggaatgagctgtgtaaatacttcaataaagcctgacttcacatctg

SEQ ID NO: 299271 - DNA, 1665 bp, Homo sapiens
gtgcattgagcgcgctccagctgccgggacggagggggcggcccccgcgctcggggcgctcggctacagctgcggggcccgaggtctccgcgcactcgctcccggcccatgctggaggcggcggaaccgcggggacctaggacggaggcggcgggcgctgggcggcccccggcacgctgagctcgggatgcggacgctgctgcctcccgcgctgctgacctgctggctgctcgcccccgtgaacagcattcacccagaatgccgatttcatctggaaatacaggaggaagaaacaaaatgtgcagagcttctgaggtctcaaacagaaaaacacaaagcctgcagtggcgtctgggacaacatcacgtgctggcggcctgccaatgtgggagagaccgtcacggtgccctgcccaaaagtcttcagcaatttttacagcaaagcaggaaacataagcaaaaactgtacgagtgacggatggtcagagacgttcccagatttcgtcgatgcctgtggctacagcgacccggaggatgagagcaagatcacgttttatattctggtgaaggccatttataccctgggctacagtgtctctctgatgtctcttgcaacaggaagcataattctgtgcctcttcaggaagctgcactgcaccaggaattacatccacctgaacctgttcctgtccttcatcctgagagccatctcagtgctggtcaaggacgacgttctctactccagctctggcacgttgcactgccctgaccagccatcctcctgggtgggctgcaagctgagcctggtcttcctgcagtactgcatcatggccaacttcttctggctgctggtggaggggctctacctccacaccctcctggtggccatgctcccccctagaaggtgcttcctggcctacctcctgatcggatggggcctccccaccgtctgcatcggtgcatggactgcggccaggctctacttagaagacaccggttgctgggatacaaacgaccacagtgtgccctggtgggtcatacgaataccgattttaatttccatcatcgtcaattttgtccttttcattagtattatacgaattttgctgcagaagttaacatccccagatgtcggcggcaacgaccagtctcagtacaagaggctggccaagtccacgctcctgcttatcccgctgttcggcgtccactacatggtgtttgccgtgtttcccatcagcatctcctccaaataccagatactgtttgagctgtgcctcgggtcgttccagggcctggtggtggccgtcctctactgtttcctgaacagtgaggtgcagtgcgagctgaagcgaaaatggcgaagccggtgcccgaccccgtccgcgagccgggattacagggtctgcggttcctccttctcccgcaacggctcggagggcgccctgcagttccaccgcggctcccgcgcccagtccttcctgcaaacggagacctcggtcatctagccccacccctgcctgtcggacgcggcgggaggcccacggttcggggcttctgcggggctgagacgccggcttcctccttccagatgcccgagcaccgtgtcgggcaggtcagcgcggtcctgactccgtcaagctggttgtccactaaaccccatacctgg

SEQ ID NO: 299272 - DNA, 1837 bp, Homo sapiens
gtgcattgagcgcgctccagctgccgggacggagggggcggcccccgcgctcggggcgctcggctacagctgcggggcccgaggtctccgcgcactcgctcccggcccatgctggaggcggcggaaccgcggggacctaggacggaggcggcgggcgctgggcggcccccggcacgctgagctcgggatgcggacgctgctgcctcccgcgctgctgacctgctggctgctcgcccccgtgaacagcattcacccagaatgccgatttcatctggaaatacaggaggaagaaacaaaatgtgcagagcttctgaggtctcaaacagaaaaacacaaagcctgcagtggcgtctgggacaacatcacgtgctggcggcctgccaatgtgggagagaccgtcacggtgccctgcccaaaagtcttcagcaatttttacagcaaagcaggaaacataagcaaaaactgtacgagtgacggatggtcagagacgttcccagatttcgtcgatgcctgtggctacagcgacccggaggatgagagcaagatcacgttttatattctggtgaaggccatttataccctgggctacagtgtctctctgatgtctcttgcaacaggaagcataattctgtgcctcttcaggaagctgcactgcaccaggaattacatccacctgaacctgttcctgtccttcatcctgagagccatctcagtgctggtcaaggacgacgttctctactccagctctggcacgttgcactgccctgaccagccatcctcctgggtgggctgcaagctgagcctggtcttcctgcagtactgcatcatggccaacttcttctggctgctggtggaggggctctacctccacaccctcctggtggccatgctcccccctagaaggtgcttcctggcctacctcctgatcggatggggcctccccaccgtctgcatcggtgcatggactgcggccaggctctacttagaagacaccggttgctgggatacaaacgaccacagtgtgccctggtgggtcatacgaataccgattttaatttccatcatcgtcaattttgtccttttcattagtattatacgaattttgctgcagaagttaacatccccagatgtcggcggcaacgaccagtctcagtacaagaggctggccaagtccacgctcctgcttatcccgctgttcggcgtccactacatggtgtttgccgtgtttcccatcagcatctcctccaaataccagatactgtttgagctgtgcctcgggtcgttccagggcctggtggtggccgtcctctactgtttcctgaacagtgaggtgcagtgcgagctgaagcgaaaatggcgaagccggtgcccgaccccgtccgcgagccgggattacagggtctgcggttcctccttctcccgcaacggctcggagggcgccctgcagttccaccgcggctcccgcgcccagtccttcctgcaaacggagacctcggtcatctagccccacccctgcctgtcggacgcggcgggaggcccacggttcggggcttctgcggggctgagacgccggcttcctccttccagatgcccgagcaccgtgtcgggcaggtcagcgcggtcctgactccgtcaagctggttgtccactaaaccccatacctggaattggagtcgtgttgtcattgactcgatttaaactccagcaccacgaccctgctgctatctcgcacctgaaacaagctaacatgactaacacccttaattccatccaccctcctctccctaggaggcctgcgcccgctaaccggctttttcgcaaatgggccattatcgaa

SEQ ID NO: 299273 - DNA, 633 bp, Homo sapiens
gtgcattgagcgcgctccagctgccgggacggagggggcggcccccgcgctcggggcgctcggctacagctgcggggcccgaggtctccgcgcactcgctcccggcccatgctggaggcggcggaaccgcggggacctaggacggaggcggcgggcgctgggcggcccccggcacgctgagctcgggatgcggacgctgctgcctcccgcgctgctgacctgctggctgctcgcccccgtgaacagcattcacccagaatgccgatttcatctggaaatacaggaggaagaaacaaaatgtgcagagcttctgaggtctcaaacagaaaaacacaaaggccatacaaagggattcatcctcattcacgccggaggtttaaagaggatcctggacccacatacctacccattggctccatgaccagtgcttttataattacaaaatcattgagaaattaagtcacaggaagcctcgtgtgtggtatacactggtgataaagcaagtcccatgcagtctgagatggcaagggaccttctagggaaagggcagtgacccagaagcccgactgctcggctggctcccgcactccgtcctgtggtcagagtgtgtttcctcccctctgtgaacctggt

SEQ ID NO: 299274 - DNA, 4725 bp, Homo sapiens
  misc_feature (1788)..(1788): n is a, c, g, or t
  misc_feature (1809)..(1809): n is a, c, g, or t
gtgcattgagcgcgctccagctgccgggacggagggggcggcccccgcgctcggggcgctcggctacagctgcggggcccgaggtctccgcgcactcgctcccggcccatgctggaggcggcggaaccgcggggacctaggacggaggcggcgggcgctgggcggcccccggcacgctgagctcgggatgcggacgctgctgcctcccgcgctgctgacctgctggctgctcgcccccgtgaacagcattcacccagaatgccgatttcatctggaaatacaggaggaagaaacaaaatgtgcagagcttctgaggtctcaaacagaaaaacacaaagcctgcagtggcgtctgggacaacatcacgtgctggcggcctgccaatgtgggagagaccgtcacggtgccctgcccaaaagtcttcagcaatttttacagcaaagcaggaaacataagcaaaaactgtacgagtgacggatggtcagagacgttcccagatttcgtcgatgcctgtggctacagcgacccggaggatgagagcaagatcacgttttatattctggtgaaggccatttataccctgggctacagtgtctctctgatgtctcttgcaacaggaagcataattctgtgcctcttcaggaagctgcactgcaccaggaattacatccacctgaacctgttcctgtccttcatcctgagagccatctcagtgctggtcaaggacgacgttctctactccagctctggcacgttgcactgccctgaccagccatcctcctgggtgggctgcaagctgagcctggtcttcctgcagtactgcatcatggccaacttcttctggctgctggtggaggggctctacctccacaccctcctggtggccatgctcccccctagaaggtgcttcctggcctacctcctgatcggatggggcctccccaccgtctgcatcggtgcatggactgcggccaggctctacttagaagacaccggttgctgggatacaaacgaccacagtgtgccctggtgggtcatacgaataccgattttaatttccatcatcgtcaattttgtccttttcattagtattatacgaattttgctgcagaagttaacatccccagatgtcggcggcaacgaccagtctcagtacaagaggctggccaagtccacgctcctgcttatcccgctgttcggcgtccactacatggtgtttgccgtgtttcccatcagcatctcctccaaataccagatactgtttgagctgtgcctcgggtcgttccagggcctggtggtggccgtcctctactgtttcctgaacagtgaggtgcagtgcgagctgaagcgaaaatggcgaagccggtgcccgaccccgtccgcgagccgggattacagggtctgcggttcctccttctcccgcaacggctcggagggcgccctgcagttccaccgcggctcccgcgcccagtccttcctgcaaacggagacctcggtcatctagccccacccctgcctgtcggacgcggcgggaggcccacggttcggggcttctgcggggctgagacgccggcttcctccttccagatgcccgagcaccgtgtcgggcaggtcagcgcggtcctgactccgtcaagctggttgtccactaaaccccatacctggaattggagtcgtgttgtcattgactcgatttaaactccagcatttagataatcttgtgcaaaatgtgtttcagccgtatagtggatccacttttttttttttttttttttgagacggagtctngctctgtcgcccaggctggantgcagtggcctgatctctgctccctgcaagctccgcctcccgggttcacgccattctcctgcctcagcctcccatagctgggactacaggcgcccgccaacacgcctggctaattttttgtatttttagtagagacagggtttcaccatgttagccaggatggtctcgatctcctgacctcgtgatgggcccgcctcggcctcccaaagtgctgggattaaggcgtgagccactgcgcccggcccaagagaataggggagccaaggaggaaatgtggaaacgcagttgtgtggcccagcacgagcctgggcgaccaccgggtgacatccgtcccacatcagggcggcctcccaggtcccataagggtagccccctcatctgcaggacagagggaagccagtcagggcccccctgacgttaggaccaggagaaatcaacaggagggcagcccgtcctctctcttggggcgcccacccggcccggctgagccctgccccacccaactccacagggctgttttgcctccccacggaaggcgggctgaggagacaaccagatcaggagagcaaggtcatgaaggaggggacctctccacacaggtgttccgtgggaccctcagcagctctggctctgcctcaggaggtcacctgccgccctgtgggagccgcagagcctgacgctcagccccaggccagctgcggccaggcctgcgggcccctggtgatggggttacgtggggtgcgggatacagctgagtgggaaccggaaacctattctctttttaacaaaaataatcttaggataagaattattttaacaacatataaaactgtttcaagccctcctccccagagctggcgctcagcagccctagcggctgctccttcaggcgaagggtggtttgcagatgtggggagggtgtctggggacgttgctgagctggctgcagaagggtggggatatcagggcacagtctccatgtgtgtgccaagccctggcccccacagcgctcgatggacctcagcaagctgcccagccctggcccaggtgccccgactgtgggactcagttgttctgagcacatttgactccacttttcccttaaaaatgaatgtcttgttcctgtgcattggtggcatcacagaccccagctggggcgcgatgtcaaaggtcgggacagctgtgccgggaggcagccacagggaagctcacacatcctgtcagtgtcaccttggtttgcaaaacccatatccccggtaaaatgaggccggacagaggggctgttaggacagcaaagcagcagtgtccagagacccctcaatccccaaaggtccgcaccctgtcctgcacaccctgggccacgccggccacacccctctgctgcaacaagctcatccctggacttctgggagaatgaacccgaggttggtttggggagacaggtgaggcggttggatctacagaacaacccaccatttctgggggccgcagaggatccatcacagacggatactggggagtaaacggcccaggccaggtgcccaggaaaggacggctgagcatgtggagcgagagggaggcaggtggacgctgcagaccccaggttcagtgcggcccctcggctgttcctcccctgtagggtttggacagacccacccccagccttgcccagctttcaaaggacaaaagggagcatcccccacctactctcaggtttttgaggaaacaaagatttgtggtaactgaaggtgttgggtcagtggccaggtgccgacactgagctgtgacccagaggggacgctgaggaagtgggcgtgagtggacatgtcaggtggttaccaggcactggttgttgatggtcggtggttgggtgtgggcagtcatcagtcatcaggtgtgctcaggggacaatctcccctcaaccgcacatgtgccactgttcagcggagctgactggtttctcctggtagaggggccggctgtttcctgacagatgcctggtgagcaggggaagcaggacccagtggtcaacaggtgtctttaactgtcattgtgtgtggaatgtcgcagactcctccacgtggcgggaatgagctgtgtaaatacttcaataaagcctgacttcacatctgcatgctgagtaagaacttgctctgaccagatctgaggctctggagcatggaggacacacttggcgtgttagtcgtggctgctgcattcagatgaaaacagagcttggacggggagggagagggtgggcagggtcctgccagccacagggcaccagggaggacattggaaacagccacctctccctgaggagagtcacggacccctgtcagagcgtcgccattggggagcctccgtctggcagctgtgacgcatgagcagtgccctgtggaggaggcgcctgcacgcccagccttgtcctgccgcacccaacacggcctctgtcagctctgcagagcccaagaacctgttaatagagcaggactgagtgcaggagtgtgtgtgtgcacgcgcgttcatgtgatgcacacgcgtgtgtgggtgtgtgcgtgggggtgtgcacacatatgcgaatctccgtgtgtgctgagccttagccacatgtatgctacaagcaaataaaatgcatttccaatgaactccacgctccaccagatggctgtgttgtcaggagggatacagcacgctggtaaaagccacattcctaaggagtcaaacctagaatgagccacaccaaccagcctttggtgactttcctaagagcaaagcaggtgggaagggggagaaggggctgggcacacagccctccagggagtcactgttttgtctgactcaggagcttagtgtccatttgcctgaggtgggaaatattcagccgcctgaggagactcagccctgatgggaggc

SEQ ID NO: 299275 - DNA, 4370 bp, Homo sapiens
  misc_feature (1788)..(1788): n is a, c, g, or t
  misc_feature (1809)..(1809): n is a, c, g, or t
gtgcattgagcgcgctccagctgccgggacggagggggcggcccccgcgctcggggcgctcggctacagctgcggggcccgaggtctccgcgcactcgctcccggcccatgctggaggcggcggaaccgcggggacctaggacggaggcggcgggcgctgggcggcccccggcacgctgagctcgggatgcggacgctgctgcctcccgcgctgctgacctgctggctgctcgcccccgtgaacagcattcacccagaatgccgatttcatctggaaatacaggaggaagaaacaaaatgtgcagagcttctgaggtctcaaacagaaaaacacaaagcctgcagtggcgtctgggacaacatcacgtgctggcggcctgccaatgtgggagagaccgtcacggtgccctgcccaaaagtcttcagcaatttttacagcaaagcaggaaacataagcaaaaactgtacgagtgacggatggtcagagacgttcccagatttcgtcgatgcctgtggctacagcgacccggaggatgagagcaagatcacgttttatattctggtgaaggccatttataccctgggctacagtgtctctctgatgtctcttgcaacaggaagcataattctgtgcctcttcaggaagctgcactgcaccaggaattacatccacctgaacctgttcctgtccttcatcctgagagccatctcagtgctggtcaaggacgacgttctctactccagctctggcacgttgcactgccctgaccagccatcctcctgggtgggctgcaagctgagcctggtcttcctgcagtactgcatcatggccaacttcttctggctgctggtggaggggctctacctccacaccctcctggtggccatgctcccccctagaaggtgcttcctggcctacctcctgatcggatggggcctccccaccgtctgcatcggtgcatggactgcggccaggctctacttagaagacaccggttgctgggatacaaacgaccacagtgtgccctggtgggtcatacgaataccgattttaatttccatcatcgtcaattttgtccttttcattagtattatacgaattttgctgcagaagttaacatccccagatgtcggcggcaacgaccagtctcagtacaagaggctggccaagtccacgctcctgcttatcccgctgttcggcgtccactacatggtgtttgccgtgtttcccatcagcatctcctccaaataccagatactgtttgagctgtgcctcgggtcgttccagggcctggtggtggccgtcctctactgtttcctgaacagtgaggtgcagtgcgagctgaagcgaaaatggcgaagccggtgcccgaccccgtccgcgagccgggattacagggtctgcggttcctccttctcccgcaacggctcggagggcgccctgcagttccaccgcggctcccgcgcccagtccttcctgcaaacggagacctcggtcatctagccccacccctgcctgtcggacgcggcgggaggcccacggttcggggcttctgcggggctgagacgccggcttcctccttccagatgcccgagcaccgtgtcgggcaggtcagcgcggtcctgactccgtcaagctggttgtccactaaaccccatacctggaattggagtcgtgttgtcattgactcgatttaaactccagcatttagataatcttgtgcaaaatgtgtttcagccgtatagtggatccacttttttttttttttttttttgagacggagtctngctctgtcgcccaggctggantgcagtggcctgatctctgctccctgcaagctccgcctcccgggttcacgccattctcctgcctcagcctcccatagctgggactacaggcgcccgccaacacgcctggctaattttttgtatttttagtagagacagggtttcaccatgttagccaggatggtctcgatctcctgacctcgtgatgggcccgcctcggcctcccaaagtgctgggattaaggcgtgagccactgcgcccggcccaagagaataggggagccaaggaggaaatgtggaaacgcagttgtgtggcccagcacgagcctgggcgaccaccgggtgacatccgtcccacatcagggcggcctcccaggtcccataagggtagccccctcatctgcaggacagagggaagccagtcagggcccccctgacgttaggaccaggagaaatcaacaggagggcagcccgtcctctctcttggggcgcccacccggcccggctgagccctgccccacccaactccacagggctgttttgcctccccacggaaggcgggctgaggagacaaccagatcaggagagcaaggtcatgaaggaggggacctctccacacaggtgttccgtgggaccctcagcagctctggctctgcctcaggaggtcacctgccgccctgtgggagccgcagagcctgacgctcagccccaggccagctgcggccaggcctgcgggcccctggtgatggggttacgtggggtgcgggatacagctgagtgggaaccggaaacctattctctttttaacaaaaataatcttaggataagaattattttaacaacatataaaactgtttcaagccctcctccccagagctggcgctcagcagccctagcggctgctccttcaggcgaagggtggtttgcagatgtggggagggtgtctggggacgttgctgagctggctgcagaagggtggggatatcagggcacagtctccatgtgtgtgccaagccctggcccccacagcgctcgatggacctcagcaagctgcccagccctggcccaggtgccccgactgtgggactcagttgttctgagcacatttgactccacttttcccttaaaaatgaatgtcttgttcctgtgcattggtggcatcacagaccccagctggggcgcgatgtcaaaggtcgggacagctgtgccgggaggcagccacagggaagctcacacatcctgtcagtgtcaccttggtttgcaaaacccatatccccggtaaaatgaggccggacagaggggctgttaggacagcaaagcagcagtgtccagagacccctcaatccccaaaggtccgcaccctgtcctgcacaccctgggccacgccggccacacccctctgctgcaacaagctcatccctggacttctgggagaatgaacccgaggttggtttggggagacaggtgaggcggttggatctacagaacaacccaccatttctgggggccgcagaggatccatcacagacggatactggggagtaaacggcccaggccaggtgcccaggaaaggacggctgagcatgtggagcgagagggaggcaggtggacgctgcagaccccaggttcagtgcggcccctcggctgttcctcccctgtagggtttggacagacccacccccagccttgcccagctttcaaaggacaaaagggagcatcccccacctactctcaggtttttgaggaaacaaagatttgtggtaactgaaggtgttgggtcagtggccaggtgccgacactgagctgtgacccagaggggacgctgaggaagtgggcgtgagtggacatgtcaggtggttaccaggcactggttgttgatggtcggtggttgggtgtgggcagtcatcagtcatcaggtgtgctcaggggacaatctcccctcaaccgcacatgtgccactgttcagcggagctgactggtttctcctggtagaggggccggctgtttcctgacagatgcctggtgagcaggggaagcaggacccagtggtcaacaggtgtctttaactgtcattgtgtgtggaatgtcgcagactcctccacgtggcgggaatgagctgtgtaaatacttcaataaagcctgacttcacatctgcatgctgagtaagaacttgctctgaccagatctgaggctctggagcatggaggacacacttggcgtgttagtcgtggctgctgcattcagatgaaaacagagcttggacggggagggagagggtgggcagggtcctgccagccacagggcaccagggaggacattggaaacagccacctctccctgaggagagtcacggacccctgtcagagcgtcgccattggggagcctccgtctggcagctgtgacgcatgagcagtgccctgtggaggaggcgcctgcacgcccagccttgtcctgccgcacccaacacggcctctgtcagctctgcagagcccaagaacctgttaatagagcaggactgagtgcaggagtgtggagttcattggaaatgcattttatttgcttgtagcatacatgtggctaagg

SEQ ID NO: 299276 - DNA, 4395 bp, Homo sapiens
  misc_feature (1458)..(1458): n is a, c, g, or t
  misc_feature (1479)..(1479): n is a, c, g, or t
cccgaataagatcgttcttggttgcctttcaggttgaacttggatttcctgtgaatcttgtttagtttctatgctgacctttgcattggttctttgggagtgtttgttaaattgaacttggagatggatgcttttatttggaaacaaaatctgttccctttccaggacaacagaaaaggccgagacacccttgaggccacacgaggtcctttctgtgtaactctggtcacagaagtagcaaaacctccctggataggggccaagagctcagccgcagataggcctcttttccagcaaacttcagatgcgttaatagagggaatcaggcaggtcctctgccgctgactgagggacctggctcccacggagcccagctgttacgagctgcaggtccgggagcaggatcggttctcatcatttaaacctgcgtgtggcagcggtggaggccagccttcttgtcccatgcctgcctcaggatgggccgggctcccaggcggggcctgtgtaggtttggggtcactcacagggaatcttgcccctgccagccatgaaccccaggacacagcgtgtgtccttgtgagggaatttgggagaaacggacacttccggaatgcacgttcccaggccctgagtgctagatatgcacaggggcctcagacataaacgtaaagaaacagtggtttttcttgttgggcggggactccagcagtggagaggaggtgtggagcccctcccacacccagctgccccctcctgagaaggacccagccaggcttgcagagggtccgagggtccagcagctgagctggctcatctccttctgtgcaggaggctggccaagtccacgctcctgcttatcccgctgttcggcgtccactacatggtgtttgccgtgtttcccatcagcatctcctccaaataccagatactgtttgagctgtgcctcgggtcgttccagggcctggtggtggccgtcctctactgtttcctgaacagtgaggtgcagtgcgagctgaagcgaaaatggcgaagccggtgcccgaccccgtccgcgagccgggattacagggtctgcggttcctccttctcccgcaacggctcggagggcgccctgcagttccaccgcggctcccgcgcccagtccttcctgcaaacggagacctcggtcatctagccccacccctgcctgtcggacgcggcgggaggcccacggttcggggcttctgcggggctgagacgccggcttcctccttccagatgcccgagcaccgtgtcgggcaggtcagcgcggtcctgactccgtcaagctggttgtccactaaaccccatacctggaattggagtcgtgttgtcattgactcgatttaaactccagcatttagataatcttgtgcaaaatgtgtttcagccgtatagtggatccacttttttttttttttttttttgagacggagtctngctctgtcgcccaggctggantgcagtggcctgatctctgctccctgcaagctccgcctcccgggttcacgccattctcctgcctcagcctcccatagctgggactacaggcgcccgccaacacgcctggctaattttttgtatttttagtagagacagggtttcaccatgttagccaggatggtctcgatctcctgacctcgtgatgggcccgcctcggcctcccaaagtgctgggattaaggcgtgagccactgcgcccggcccaagagaataggggagccaaggaggaaatgtggaaacgcagttgtgtggcccagcacgagcctgggcgaccaccgggtgacatccgtcccacatcagggcggcctcccaggtcccataagggtagccccctcatctgcaggacagagggaagccagtcagggcccccctgacgttaggaccaggagaaatcaacaggagggcagcccgtcctctctcttggggcgcccacccggcccggctgagccctgccccacccaactccacagggctgttttgcctccccacggaaggcgggctgaggagacaaccagatcaggagagcaaggtcatgaaggaggggacctctccacacaggtgttccgtgggaccctcagcagctctggctctgcctcaggaggtcacctgccgccctgtgggagccgcagagcctgacgctcagccccaggccagctgcggccaggcctgcgggcccctggtgatggggttacgtggggtgcgggatacagctgagtgggaaccggaaacctattctctttttaacaaaaataatcttaggataagaattattttaacaacatataaaactgtttcaagccctcctccccagagctggcgctcagcagccctagcggctgctccttcaggcgaagggtggtttgcagatgtggggagggtgtctggggacgttgctgagctggctgcagaagggtggggatatcagggcacagtctccatgtgtgtgccaagccctggcccccacagcgctcgatggacctcagcaagctgcccagccctggcccaggtgccccgactgtgggactcagttgttctgagcacatttgactccacttttcccttaaaaatgaatgtcttgttcctgtgcattggtggcatcacagaccccagctggggcgcgatgtcaaaggtcgggacagctgtgccgggaggcagccacagggaagctcacacatcctgtcagtgtcaccttggtttgcaaaacccatatccccggtaaaatgaggccggacagaggggctgttaggacagcaaagcagcagtgtccagagacccctcaatccccaaaggtccgcaccctgtcctgcacaccctgggccacgccggccacacccctctgctgcaacaagctcatccctggacttctgggagaatgaacccgaggttggtttggggagacaggtgaggcggttggatctacagaacaacccaccatttctgggggccgcagaggatccatcacagacggatactggggagtaaacggcccaggccaggtgcccaggaaaggacggctgagcatgtggagcgagagggaggcaggtggacgctgcagaccccaggttcagtgcggcccctcggctgttcctcccctgtagggtttggacagacccacccccagccttgcccagctttcaaaggacaaaagggagcatcccccacctactctcaggtttttgaggaaacaaagatttgtggtaactgaaggtgttgggtcagtggccaggtgccgacactgagctgtgacccagaggggacgctgaggaagtgggcgtgagtggacatgtcaggtggttaccaggcactggttgttgatggtcggtggttgggtgtgggcagtcatcagtcatcaggtgtgctcaggggacaatctcccctcaaccgcacatgtgccactgttcagcggagctgactggtttctcctggtagaggggccggctgtttcctgacagatgcctggtgagcaggggaagcaggacccagtggtcaacaggtgtctttaactgtcattgtgtgtggaatgtcgcagactcctccacgtggcgggaatgagctgtgtaaatacttcaataaagcctgacttcacatctgcatgctgagtaagaacttgctctgaccagatctgaggctctggagcatggaggacacacttggcgtgttagtcgtggctgctgcattcagatgaaaacagagcttggacggggagggagagggtgggcagggtcctgccagccacagggcaccagggaggacattggaaacagccacctctccctgaggagagtcacggacccctgtcagagcgtcgccattggggagcctccgtctggcagctgtgacgcatgagcagtgccctgtggaggaggcgcctgcacgcccagccttgtcctgccgcacccaacacggcctctgtcagctctgcagagcccaagaacctgttaatagagcaggactgagtgcaggagtgtgtgtgtgcacgcgcgttcatgtgatgcacacgcgtgtgtgggtgtgtgcgtgggggtgtgcacacatatgcgaatctccgtgtgtgctgagccttagccacatgtatgctacaagcaaataaaatgcatttccaatgaactccacgctccaccagatggctgtgttgtcaggagggatacagcacgctggtaaaagccacattcctaaggagtcaaacctagaatgagccacaccaaccagcctttggtgactttcctaagagcaaagcaggtgggaagggggagaaggggctgggcacacagccctccagggagtcactgttttgtctgactcaggagcttagtgtccatttgcctgaggtgggaaatattcagccgcctgaggagactcagccctgatgggaggc

SEQ ID NO: 299277 - DNA, 4797 bp, Homo sapiens
  misc_feature (1860)..(1860): n is a, c, g, or t
  misc_feature (1881)..(1881): n is a, c, g, or t
cccgaataagatcgttcttggttgcctttcaggttgaacttggatttcctgtgaatcttgtttagtttctatgctgacctttgcattggttctttgggagtgtttgttaaattgaacttggagatggatgcttttatttggaaacaaaatctgttccctttccaggacaacagaaaaggccgagacacccttgaggccacacgaggtcctttctgtgtaactctggtcacagaagtagcaaaacctccctggataggggccaagagctcagccgcagataggcctcttttccagcaaacttcagatgcgttaatagagggaatcaggcaggtcctctgccgctgactgagggacctggctcccacggagcccagctgttacgagctgcaggtccgggagcaggatcggttctcatcatttaaacctgcgtgtggcagcggtggaggccagccttcttgtcccatgcctgcctcaggatgggccgggctcccaggcggggcctgtgtaggtttggggtcactcacagggaatcttgcccctgccagccatgaaccccaggacacagcgtgtgtccttgtgagggaatttgggagaaacggacacttccggaatgcacgttcccaggccctgagtgctagatatgcacaggggcctcagacataaacgtaaagaaacagtggtttttcttgttgggcggggactccagcagtggagaggaggtgtggagcccctcccacacccagctgccccctcctgagaaggacccagccaggcttgcagagggtccgagggtccagcagctgagctggctcatctccttctgtgcaggaggctggccaagtccacgctcctgcttatcccgctgttcggcgtccactacatggtgtttgccgtgtttcccatcagcatctcctccaaataccagatactgtttgagctgtgcctcgggtcgttccaggtaggtgtgcggaggcggccgccctcccccgagcgcgggtcctgcctgaccatctcttctcattgcagggcctggtggtggccgtcctctactgtttcctgaacagtgaggtaagttcatggccgccttggaaccaagcacaggtactcacttgcttcctgagatgctgcccagcctggtgccgcagcccccacacatgcctgtcttccgcgggctcgagttactgcccgggaccccacagttctgtgtccccatcagagaacccacaacgacacaggcaaacccactcttctgggcccagcttccaaaccccgccgtccttccgtccaccctaagtagcatcgactgccgtccgtctcggagccctctcgggaaagctcccggccgggtctagacagaatctgtttttccccatggtcggcgtctcgctcctgaccatagcttgtgcagtgcgagctgaagcgaaaatggcgaagccggtgcccgaccccgtccgcgagccgggattacagggtctgcggttcctccttctcccgcaacggctcggagggcgccctgcagttccaccgcggctcccgcgcccagtccttcctgcaaacggagacctcggtcatctagccccacccctgcctgtcggacgcggcgggaggcccacggttcggggcttctgcggggctgagacgccggcttcctccttccagatgcccgagcaccgtgtcgggcaggtcagcgcggtcctgactccgtcaagctggttgtccactaaaccccatacctggaattggagtcgtgttgtcattgactcgatttaaactccagcatttagataatcttgtgcaaaatgtgtttcagccgtatagtggatccacttttttttttttttttttttgagacggagtctngctctgtcgcccaggctggantgcagtggcctgatctctgctccctgcaagctccgcctcccgggttcacgccattctcctgcctcagcctcccatagctgggactacaggcgcccgccaacacgcctggctaattttttgtatttttagtagagacagggtttcaccatgttagccaggatggtctcgatctcctgacctcgtgatgggcccgcctcggcctcccaaagtgctgggattaaggcgtgagccactgcgcccggcccaagagaataggggagccaaggaggaaatgtggaaacgcagttgtgtggcccagcacgagcctgggcgaccaccgggtgacatccgtcccacatcagggcggcctcccaggtcccataagggtagccccctcatctgcaggacagagggaagccagtcagggcccccctgacgttaggaccaggagaaatcaacaggagggcagcccgtcctctctcttggggcgcccacccggcccggctgagccctgccccacccaactccacagggctgttttgcctccccacggaaggcgggctgaggagacaaccagatcaggagagcaaggtcatgaaggaggggacctctccacacaggtgttccgtgggaccctcagcagctctggctctgcctcaggaggtcacctgccgccctgtgggagccgcagagcctgacgctcagccccaggccagctgcggccaggcctgcgggcccctggtgatggggttacgtggggtgcgggatacagctgagtgggaaccggaaacctattctctttttaacaaaaataatcttaggataagaattattttaacaacatataaaactgtttcaagccctcctccccagagctggcgctcagcagccctagcggctgctccttcaggcgaagggtggtttgcagatgtggggagggtgtctggggacgttgctgagctggctgcagaagggtggggatatcagggcacagtctccatgtgtgtgccaagccctggcccccacagcgctcgatggacctcagcaagctgcccagccctggcccaggtgccccgactgtgggactcagttgttctgagcacatttgactccacttttcccttaaaaatgaatgtcttgttcctgtgcattggtggcatcacagaccccagctggggcgcgatgtcaaaggtcgggacagctgtgccgggaggcagccacagggaagctcacacatcctgtcagtgtcaccttggtttgcaaaacccatatccccggtaaaatgaggccggacagaggggctgttaggacagcaaagcagcagtgtccagagacccctcaatccccaaaggtccgcaccctgtcctgcacaccctgggccacgccggccacacccctctgctgcaacaagctcatccctggacttctgggagaatgaacccgaggttggtttggggagacaggtgaggcggttggatctacagaacaacccaccatttctgggggccgcagaggatccatcacagacggatactggggagtaaacggcccaggccaggtgcccaggaaaggacggctgagcatgtggagcgagagggaggcaggtggacgctgcagaccccaggttcagtgcggcccctcggctgttcctcccctgtagggtttggacagacccacccccagccttgcccagctttcaaaggacaaaagggagcatcccccacctactctcaggtttttgaggaaacaaagatttgtggtaactgaaggtgttgggtcagtggccaggtgccgacactgagctgtgacccagaggggacgctgaggaagtgggcgtgagtggacatgtcaggtggttaccaggcactggttgttgatggtcggtggttgggtgtgggcagtcatcagtcatcaggtgtgctcaggggacaatctcccctcaaccgcacatgtgccactgttcagcggagctgactggtttctcctggtagaggggccggctgtttcctgacagatgcctggtgagcaggggaagcaggacccagtggtcaacaggtgtctttaactgtcattgtgtgtggaatgtcgcagactcctccacgtggcgggaatgagctgtgtaaatacttcaataaagcctgacttcacatctgcatgctgagtaagaacttgctctgaccagatctgaggctctggagcatggaggacacacttggcgtgttagtcgtggctgctgcattcagatgaaaacagagcttggacggggagggagagggtgggcagggtcctgccagccacagggcaccagggaggacattggaaacagccacctctccctgaggagagtcacggacccctgtcagagcgtcgccattggggagcctccgtctggcagctgtgacgcatgagcagtgccctgtggaggaggcgcctgcacgcccagccttgtcctgccgcacccaacacggcctctgtcagctctgcagagcccaagaacctgttaatagagcaggactgagtgcaggagtgtgtgtgtgcacgcgcgttcatgtgatgcacacgcgtgtgtgggtgtgtgcgtgggggtgtgcacacatatgcgaatctccgtgtgtgctgagccttagccacatgtatgctacaagcaaataaaatgcatttccaatgaactccacgctccaccagatggctgtgttgtcaggagggatacagcacgctggtaaaagccacattcctaaggagtcaaacctagaatgagccacaccaaccagcctttggtgactttcctaagagcaaagcaggtgggaagggggagaaggggctgggcacacagccctccagggagtcactgttttgtctgactcaggagcttagtgtccatttgcctgaggtgggaaatattcagccgcctgaggagactcagccctgatgggaggc

SEQ ID NO: 299278 - DNA, 5148 bp, Homo sapiens
  misc_feature (2211)..(2211): n is a, c, g, or t
  misc_feature (2232)..(2232): n is a, c, g, or t
gtgcattgagcgcgctccagctgccgggacggagggggcggcccccgcgctcggggcgctcggctacagctgcggggcccgaggtctccgcgcactcgctcccggcccatgctggaggcggcggaaccgcggggacctaggacggaggcggcgggcgctgggcggcccccggcacgctgagctcgggatgcggacgctgctgcctcccgcgctgctgacctgctggctgctcgcccccgtgagtgcgcccgcgacccccgccccacggcgcctcggacccggttctccccttccgagaagagcgctcctcccgccggtcttcgccttcctcccgggtgctggagcgcgggcggggtccgggagagggagcggggtcgcccggggtccggagcttcctcccggagagcgtgaagcgctgagctccggtcccgccgggttgcgggactcgggttgggaggctgcctgcgcccttccccgcgccccaccgtccggggtttgctggaaacgggatcgtttcttcctggacgcgtcaacgatgagctcgttcggggccgtcccgggagctgggagctgcgggcgcctgcgcgggctgcgcgtttcacggggagatcggggttggcgttggccgcagatgcctctcggtccctccctgtacttactggtgaacagcattcacccagaatgccgatttcatctggaaatacaggaggaagaaacaaaatgtgcagagcttctgaggtctcaaacagaaaaacacaaagcctgcagtggcgtctgggacaacatcacgtgctggcggcctgccaatgtgggagagaccgtcacggtgccctgcccaaaagtcttcagcaatttttacagcaaagcaggaaacataagcaaaaactgtacgagtgacggatggtcagagacgttcccagatttcgtcgatgcctgtggctacagcgacccggaggatgagagcaagatcacgttttatattctggtgaaggccatttataccctgggctacagtgtctctctgatgtctcttgcaacaggaagcataattctgtgcctcttcaggaagctgcactgcaccaggaattacatccacctgaacctgttcctgtccttcatcctgagagccatctcagtgctggtcaaggacgacgttctctactccagctctggcacgttgcactgccctgaccagccatcctcctgggtgggctgcaagctgagcctggtcttcctgcagtactgcatcatggccaacttcttctggctgctggtggaggggctctacctccacaccctcctggtggccatgctcccccctagaaggtgcttcctggcctacctcctgatcggatggggcctccccaccgtctgcatcggtgcatggactgcggccaggctctacttagaagacaccggttgctgggatacaaacgaccacagtgtgccctggtgggtcatacgaataccgattttaatttccatcatcgtcaattttgtccttttcattagtattatacgaattttgctgcagaagttaacatccccagatgtcggcggcaacgaccagtctcagtacaagaggctggccaagtccacgctcctgcttatcccgctgttcggcgtccactacatggtgtttgccgtgtttcccatcagcatctcctccaaataccagatactgtttgagctgtgcctcgggtcgttccagggcctggtggtggccgtcctctactgtttcctgaacagtgaggtgcagtgcgagctgaagcgaaaatggcgaagccggtgcccgaccccgtccgcgagccgggattacagggtctgcggttcctccttctcccgcaacggctcggagggcgccctgcagttccaccgcggctcccgcgcccagtccttcctgcaaacggagacctcggtcatctagccccacccctgcctgtcggacgcggcgggaggcccacggttcggggcttctgcggggctgagacgccggcttcctccttccagatgcccgagcaccgtgtcgggcaggtcagcgcggtcctgactccgtcaagctggttgtccactaaaccccatacctggaattggagtcgtgttgtcattgactcgatttaaactccagcatttagataatcttgtgcaaaatgtgtttcagccgtatagtggatccacttttttttttttttttttttgagacggagtctngctctgtcgcccaggctggantgcagtggcctgatctctgctccctgcaagctccgcctcccgggttcacgccattctcctgcctcagcctcccatagctgggactacaggcgcccgccaacacgcctggctaattttttgtatttttagtagagacagggtttcaccatgttagccaggatggtctcgatctcctgacctcgtgatgggcccgcctcggcctcccaaagtgctgggattaaggcgtgagccactgcgcccggcccaagagaataggggagccaaggaggaaatgtggaaacgcagttgtgtggcccagcacgagcctgggcgaccaccgggtgacatccgtcccacatcagggcggcctcccaggtcccataagggtagccccctcatctgcaggacagagggaagccagtcagggcccccctgacgttaggaccaggagaaatcaacaggagggcagcccgtcctctctcttggggcgcccacccggcccggctgagccctgccccacccaactccacagggctgttttgcctccccacggaaggcgggctgaggagacaaccagatcaggagagcaaggtcatgaaggaggggacctctccacacaggtgttccgtgggaccctcagcagctctggctctgcctcaggaggtcacctgccgccctgtgggagccgcagagcctgacgctcagccccaggccagctgcggccaggcctgcgggcccctggtgatggggttacgtggggtgcgggatacagctgagtgggaaccggaaacctattctctttttaacaaaaataatcttaggataagaattattttaacaacatataaaactgtttcaagccctcctccccagagctggcgctcagcagccctagcggctgctccttcaggcgaagggtggtttgcagatgtggggagggtgtctggggacgttgctgagctggctgcagaagggtggggatatcagggcacagtctccatgtgtgtgccaagccctggcccccacagcgctcgatggacctcagcaagctgcccagccctggcccaggtgccccgactgtgggactcagttgttctgagcacatttgactccacttttcccttaaaaatgaatgtcttgttcctgtgcattggtggcatcacagaccccagctggggcgcgatgtcaaaggtcgggacagctgtgccgggaggcagccacagggaagctcacacatcctgtcagtgtcaccttggtttgcaaaacccatatccccggtaaaatgaggccggacagaggggctgttaggacagcaaagcagcagtgtccagagacccctcaatccccaaaggtccgcaccctgtcctgcacaccctgggccacgccggccacacccctctgctgcaacaagctcatccctggacttctgggagaatgaacccgaggttggtttggggagacaggtgaggcggttggatctacagaacaacccaccatttctgggggccgcagaggatccatcacagacggatactggggagtaaacggcccaggccaggtgcccaggaaaggacggctgagcatgtggagcgagagggaggcaggtggacgctgcagaccccaggttcagtgcggcccctcggctgttcctcccctgtagggtttggacagacccacccccagccttgcccagctttcaaaggacaaaagggagcatcccccacctactctcaggtttttgaggaaacaaagatttgtggtaactgaaggtgttgggtcagtggccaggtgccgacactgagctgtgacccagaggggacgctgaggaagtgggcgtgagtggacatgtcaggtggttaccaggcactggttgttgatggtcggtggttgggtgtgggcagtcatcagtcatcaggtgtgctcaggggacaatctcccctcaaccgcacatgtgccactgttcagcggagctgactggtttctcctggtagaggggccggctgtttcctgacagatgcctggtgagcaggggaagcaggacccagtggtcaacaggtgtctttaactgtcattgtgtgtggaatgtcgcagactcctccacgtggcgggaatgagctgtgtaaatacttcaataaagcctgacttcacatctgcatgctgagtaagaacttgctctgaccagatctgaggctctggagcatggaggacacacttggcgtgttagtcgtggctgctgcattcagatgaaaacagagcttggacggggagggagagggtgggcagggtcctgccagccacagggcaccagggaggacattggaaacagccacctctccctgaggagagtcacggacccctgtcagagcgtcgccattggggagcctccgtctggcagctgtgacgcatgagcagtgccctgtggaggaggcgcctgcacgcccagccttgtcctgccgcacccaacacggcctctgtcagctctgcagagcccaagaacctgttaatagagcaggactgagtgcaggagtgtgtgtgtgcacgcgcgttcatgtgatgcacacgcgtgtgtgggtgtgtgcgtgggggtgtgcacacatatgcgaatctccgtgtgtgctgagccttagccacatgtatgctacaagcaaataaaatgcatttccaatgaactccacgctccaccagatggctgtgttgtcaggagggatacagcacgctggtaaaagccacattcctaaggagtcaaacctagaatgagccacaccaaccagcctttggtgactttcctaagagcaaagcaggtgggaagggggagaaggggctgggcacacagccctccagggagtcactgttttgtctgactcaggagcttagtgtccatttgcctgaggtgggaaatattcagccgcctgaggagactcagccctgatgggaggc

SEQ ID NO: 299279 - DNA, 4729 bp, Homo sapiens
  misc_feature (1792)..(1792): n is a, c, g, or t
  misc_feature (1813)..(1813): n is a, c, g, or t
cccgaataagatcgttcttggttgcctttcaggttgaacttggatttcctgtgaatcttgtttagtttctatgctgacctttgcattggttctttgggagtgtttgttaaattgaacttggagatggatgcttttatttggaaacaaaatctgttccctttccaggacaacagaaaaggccgagacacccttgaggccacacgaggtcctttctgtgtaactctggtcacagaagtagcaaaacctccctggataggggccaagagctcagccgcagataggcctcttttccagcaaacttcagatgcgttaatagagggaatcaggcaggtcctctgccgctgactgagggacctggctcccacggagcccagctgttacgagctgcaggtccgggagcaggatcggttctcatcatttaaacctgcgtgtggcagcggtggaggccagccttcttgtcccatgcctgcctcaggatgggccgggctcccaggcggggcctgtgtaggtttggggtcactcacagggaatcttgcccctgccagccatgaaccccaggacacagcgtgtgtccttgtgagggaatttgggagaaacggacacttccggaatgcacgttcccaggccctgagtgctagatatgcacaggggcctcagacataaacgtaaagaaacagtggtttttcttgttgggcggggactccagcagtggagaggaggtgtggagcccctcccacacccagctgccccctcctgagaaggacccagccaggcttgcagagggtccgagggtccagcagctgagctggctcatctccttctgtgcaggaggctggccaagtccacgctcctgcttatcccgctgttcggcgtccactacatggtgtttgccgtgtttcccatcagcatctcctccaaataccagatactgtttgagctgtgcctcgggtcgttccagggcctggtggtggccgtcctctactgtttcctgaacagtgaggtaagttcatggccgccttggaaccaagcacaggtactcacttgcttcctgagatgctgcccagcctggtgccgcagcccccacacatgcctgtcttccgcgggctcgagttactgcccgggaccccacagttctgtgtccccatcagagaacccacaacgacacaggcaaacccactcttctgggcccagcttccaaaccccgccgtccttccgtccaccctaagtagcatcgactgccgtccgtctcggagccctctcgggaaagctcccggccgggtctagacagaatctgtttttccccatggtcggcgtctcgctcctgaccatagcttgtgcagtgcgagctgaagcgaaaatggcgaagccggtgcccgaccccgtccgcgagccgggattacagggtctgcggttcctccttctcccgcaacggctcggagggcgccctgcagttccaccgcggctcccgcgcccagtccttcctgcaaacggagacctcggtcatctagccccacccctgcctgtcggacgcggcgggaggcccacggttcggggcttctgcggggctgagacgccggcttcctccttccagatgcccgagcaccgtgtcgggcaggtcagcgcggtcctgactccgtcaagctggttgtccactaaaccccatacctggaattggagtcgtgttgtcattgactcgatttaaactccagcatttagataatcttgtgcaaaatgtgtttcagccgtatagtggatccacttttttttttttttttttttgagacggagtctngctctgtcgcccaggctggantgcagtggcctgatctctgctccctgcaagctccgcctcccgggttcacgccattctcctgcctcagcctcccatagctgggactacaggcgcccgccaacacgcctggctaattttttgtatttttagtagagacagggtttcaccatgttagccaggatggtctcgatctcctgacctcgtgatgggcccgcctcggcctcccaaagtgctgggattaaggcgtgagccactgcgcccggcccaagagaataggggagccaaggaggaaatgtggaaacgcagttgtgtggcccagcacgagcctgggcgaccaccgggtgacatccgtcccacatcagggcggcctcccaggtcccataagggtagccccctcatctgcaggacagagggaagccagtcagggcccccctgacgttaggaccaggagaaatcaacaggagggcagcccgtcctctctcttggggcgcccacccggcccggctgagccctgccccacccaactccacagggctgttttgcctccccacggaaggcgggctgaggagacaaccagatcaggagagcaaggtcatgaaggaggggacctctccacacaggtgttccgtgggaccctcagcagctctggctctgcctcaggaggtcacctgccgccctgtgggagccgcagagcctgacgctcagccccaggccagctgcggccaggcctgcgggcccctggtgatggggttacgtggggtgcgggatacagctgagtgggaaccggaaacctattctctttttaacaaaaataatcttaggataagaattattttaacaacatataaaactgtttcaagccctcctccccagagctggcgctcagcagccctagcggctgctccttcaggcgaagggtggtttgcagatgtggggagggtgtctggggacgttgctgagctggctgcagaagggtggggatatcagggcacagtctccatgtgtgtgccaagccctggcccccacagcgctcgatggacctcagcaagctgcccagccctggcccaggtgccccgactgtgggactcagttgttctgagcacatttgactccacttttcccttaaaaatgaatgtcttgttcctgtgcattggtggcatcacagaccccagctggggcgcgatgtcaaaggtcgggacagctgtgccgggaggcagccacagggaagctcacacatcctgtcagtgtcaccttggtttgcaaaacccatatccccggtaaaatgaggccggacagaggggctgttaggacagcaaagcagcagtgtccagagacccctcaatccccaaaggtccgcaccctgtcctgcacaccctgggccacgccggccacacccctctgctgcaacaagctcatccctggacttctgggagaatgaacccgaggttggtttggggagacaggtgaggcggttggatctacagaacaacccaccatttctgggggccgcagaggatccatcacagacggatactggggagtaaacggcccaggccaggtgcccaggaaaggacggctgagcatgtggagcgagagggaggcaggtggacgctgcagaccccaggttcagtgcggcccctcggctgttcctcccctgtagggtttggacagacccacccccagccttgcccagctttcaaaggacaaaagggagcatcccccacctactctcaggtttttgaggaaacaaagatttgtggtaactgaaggtgttgggtcagtggccaggtgccgacactgagctgtgacccagaggggacgctgaggaagtgggcgtgagtggacatgtcaggtggttaccaggcactggttgttgatggtcggtggttgggtgtgggcagtcatcagtcatcaggtgtgctcaggggacaatctcccctcaaccgcacatgtgccactgttcagcggagctgactggtttctcctggtagaggggccggctgtttcctgacagatgcctggtgagcaggggaagcaggacccagtggtcaacaggtgtctttaactgtcattgtgtgtggaatgtcgcagactcctccacgtggcgggaatgagctgtgtaaatacttcaataaagcctgacttcacatctgcatgctgagtaagaacttgctctgaccagatctgaggctctggagcatggaggacacacttggcgtgttagtcgtggctgctgcattcagatgaaaacagagcttggacggggagggagagggtgggcagggtcctgccagccacagggcaccagggaggacattggaaacagccacctctccctgaggagagtcacggacccctgtcagagcgtcgccattggggagcctccgtctggcagctgtgacgcatgagcagtgccctgtggaggaggcgcctgcacgcccagccttgtcctgccgcacccaacacggcctctgtcagctctgcagagcccaagaacctgttaatagagcaggactgagtgcaggagtgtgtgtgtgcacgcgcgttcatgtgatgcacacgcgtgtgtgggtgtgtgcgtgggggtgtgcacacatatgcgaatctccgtgtgtgctgagccttagccacatgtatgctacaagcaaataaaatgcatttccaatgaactccacgctccaccagatggctgtgttgtcaggagggatacagcacgctggtaaaagccacattcctaaggagtcaaacctagaatgagccacaccaaccagcctttggtgactttcctaagagcaaagcaggtgggaagggggagaaggggctgggcacacagccctccagggagtcactgttttgtctgactcaggagcttagtgtccatttgcctgaggtgggaaatattcagccgcctgaggagactcagccctgatgggaggc

SEQ ID NO: 299280 - DNA, 1692 bp, Homo sapiens
cccgaataagatcgttcttggttgcctttcaggttgaacttggatttcctgtgaatcttgtttagtttctatgctgacctttgcattggttctttgggagtgtttgttaaattgaacttggagatggatgcttttatttggaaacaaaatctgttccctttccaggacaacagaaaaggccgagacacccttgaggccacacgaggtcctttctgtgtaactctggtcacagaagtagcaaaacctccctggataggggccaagagctcagccgcagataggcctcttttccagcaaacttcagatgcgttaatagagggaatcaggcaggtcctctgccgctgactgagggacctggctcccacggagcccagctgttacgagctgcaggtccgggagcaggatcggttctcatcatttaaacctgcgtgtggcagcggtggaggccagccttcttgtcccatgcctgcctcaggatgggccgggctcccaggcggggcctgtgtaggtttggggtcactcacagggaatcttgcccctgccagccatgaaccccaggacacagcgtgtgtccttgtgagggaatttgggagaaacggacacttccggaatgcacgttcccaggccctgagtgctagatatgcacaggggcctcagacataaacgtaaagaaacagtggtttttcttgttgggcggggactccagcagtggagaggaggtgtggagcccctcccacacccagctgccccctcctgagaaggacccagccaggcttgcagagggtccgagggtccagcagctgagctggctcatctccttctgtgcaggaggctggccaagtccacgctcctgcttatcccgctgttcggcgtccactacatggtgtttgccgtgtttcccatcagcatctcctccaaataccagatactgtttgagctgtgcctcgggtcgttccaggtaggtgtgcggaggcggccgccctcccccgagcgcgggtcctgcctgaccatctcttctcattgcagggcctggtggtggccgtcctctactgtttcctgaacagtgaggtaagttcatggccgccttggaaccaagcacaggtactcacttgcttcctgagatgctgcccagcctggtgccgcagcccccacacatgcctgtcttccgcgggctcgagttactgcccgggaccccacagttctgtgtccccatcagagaacccacaacgacacaggcaaacccactcttctgggcccagcttccaaaccccgccgtccttccgtccaccctaagtagcatcgactgccgtccgtctcggagccctctcgggaaagctcccggccgggtctagacagaatctgtttttccccatggtcggcgtctcgctcctgaccatagcttgtgagtcccagaaagccgggcctgggttggggggtggggctgcacagcgtcctgtgagtccctggggaggaagcccggagccgagctctgccctgcgttcattcccagccagggaggctgtctccgggctgctccaacggcctggccccgtcccctgacccctgaccctcccgccccacgctgcggttgctggcgctttctttgcttgacatgcagctttcaccagcacggcttctgcaaagctgagcccgagtagtgccacttgtcctcctccctcctctgccgtccgg

SEQ ID NO: 299281 - DNA, 3969 bp, Homo sapiens
  misc_feature (10)..(10): n is a, c, g, or t
  misc_feature (66)..(66): n is a, c, g, or t
  misc_feature (73)..(73): n is a, c, g, or t
  misc_feature (87)..(87): n is a, c, g, or t
  misc_feature (103)..(103): n is a, c, g, or t
  misc_feature (127)..(127): n is a, c, g, or t
  misc_feature (134)..(134): n is a, c, g, or t
  misc_feature (174)..(174): n is a, c, g, or t
  misc_feature (178)..(178): n is a, c, g, or t
  misc_feature (195)..(195): n is a, c, g, or t
  misc_feature (245)..(245): n is a, c, g, or t
  misc_feature (251)..(251): n is a, c, g, or t
  misc_feature (257)..(257): n is a, c, g, or t
  misc_feature (260)..(261): n is a, c, g, or t
  misc_feature (263)..(263): n is a, c, g, or t
  misc_feature (270)..(272): n is a, c, g, or t
  misc_feature (274)..(274): n is a, c, g, or t
  misc_feature (280)..(280): n is a, c, g, or t
  misc_feature (284)..(284): n is a, c, g, or t
  misc_feature (290)..(291): n is a, c, g, or t
  misc_feature (297)..(297): n is a, c, g, or t
  misc_feature (302)..(304): n is a, c, g, or t
  misc_feature (307)..(307): n is a, c, g, or t
  misc_feature (310)..(311): n is a, c, g, or t
  misc_feature (320)..(320): n is a, c, g, or t
  misc_feature (322)..(323): n is a, c, g, or t
  misc_feature (333)..(333): n is a, c, g, or t
  misc_feature (341)..(341): n is a, c, g, or t
  misc_feature (349)..(350): n is a, c, g, or t
  misc_feature (353)..(353): n is a, c, g, or t
  misc_feature (363)..(363): n is a, c, g, or t
  misc_feature (366)..(369): n is a, c, g, or t
  misc_feature (376)..(376): n is a, c, g, or t
  misc_feature (379)..(379): n is a, c, g, or t
  misc_feature (382)..(382): n is a, c, g, or t
  misc_feature (385)..(386): n is a, c, g, or t
  misc_feature (388)..(389): n is a, c, g, or t
  misc_feature (395)..(395): n is a, c, g, or t
  misc_feature (400)..(400): n is a, c, g, or t
  misc_feature (405)..(405): n is a, c, g, or t
  misc_feature (407)..(407): n is a, c, g, or t
  misc_feature (411)..(412): n is a, c, g, or t
  misc_feature (417)..(418): n is a, c, g, or t
  misc_feature (420)..(420): n is a, c, g, or t
  misc_feature (424)..(424): n is a, c, g, or t
  misc_feature (434)..(435): n is a, c, g, or t
  misc_feature (444)..(444): n is a, c, g, or t
  misc_feature (454)..(454): n is a, c, g, or t
  misc_feature (458)..(458): n is a, c, g, or t
  misc_feature (460)..(460): n is a, c, g, or t
  misc_feature (465)..(465): n is a, c, g, or t
  misc_feature (467)..(467): n is a, c, g, or t
  misc_feature (499)..(499): n is a, c, g, or t
  misc_feature (522)..(522): n is a, c, g, or t
  misc_feature (542)..(542): n is a, c, g, or t
  misc_feature (544)..(544): n is a, c, g, or t
  misc_feature (565)..(565): n is a, c, g, or t
  misc_feature (570)..(570): n is a, c, g, or t
  misc_feature (1032)..(1032): n is a, c, g, or t
  misc_feature (1053)..(1053): n is a, c, g, or t
tttcactccncttaccatccatcctcctatttttcatcaatctcaacctcttcttcctcactactncatcatntccaacttcttctntcttctcttttatttnctctacctccacaccctcctattntccattntccccccctataatctactacctatcctacctccttatcntatntttcctccccaccatcntcatctattcatacactccacccactctctacttataatacacctttttnttaaanacaaanaannanatttttnnntnttattnaaanaaatanntatttnaattnnnatnatnntcaattttntnnttttaattantattatancaattttnntcnaaaaattaanatnnnnatatttnttnttnaannannattatnattanaatantntttnnaattnnantctncttcttatcnntcttttctncttccaatanattntntttgncntttttaccatcagcatctcctccaaataccanatacttttttagcttttcctctnttctttccatttcctttttntngccttcctctactttttcctnaacantgaggtgcagtgcgagctgaagcgaaaatggcgaagccggtgcccgaccccgtccgcgagccgggattacagggtctgcggttcctccttctcccgcaacggctcggagggcgccctgcagttccaccgcggctcccgcgcccagtccttcctgcaaacggagacctcggtcatctagccccacccctgcctgtcggacgcggcgggaggcccacggttcggggcttctgcggggctgagacgccggcttcctccttccagatgcccgagcaccgtgtcgggcaggtcagcgcggtcctgactccgtcaagctggttgtccactaaaccccatacctggaattggagtcgtgttgtcattgactcgatttaaactccagcatttagataatcttgtgcaaaatgtgtttcagccgtatagtggatccacttttttttttttttttttttgagacggagtctngctctgtcgcccaggctggantgcagtggcctgatctctgctccctgcaagctccgcctcccgggttcacgccattctcctgcctcagcctcccatagctgggactacaggcgcccgccaacacgcctggctaattttttgtatttttagtagagacagggtttcaccatgttagccaggatggtctcgatctcctgacctcgtgatgggcccgcctcggcctcccaaagtgctgggattaaggcgtgagccactgcgcccggcccaagagaataggggagccaaggaggaaatgtggaaacgcagttgtgtggcccagcacgagcctgggcgaccaccgggtgacatccgtcccacatcagggcggcctcccaggtcccataagggtagccccctcatctgcaggacagagggaagccagtcagggcccccctgacgttaggaccaggagaaatcaacaggagggcagcccgtcctctctcttggggcgcccacccggcccggctgagccctgccccacccaactccacagggctgttttgcctccccacggaaggcgggctgaggagacaaccagatcaggagagcaaggtcatgaaggaggggacctctccacacaggtgttccgtgggaccctcagcagctctggctctgcctcaggaggtcacctgccgccctgtgggagccgcagagcctgacgctcagccccaggccagctgcggccaggcctgcgggcccctggtgatggggttacgtggggtgcgggatacagctgagtgggaaccggaaacctattctctttttaacaaaaataatcttaggataagaattattttaacaacatataaaactgtttcaagccctcctccccagagctggcgctcagcagccctagcggctgctccttcaggcgaagggtggtttgcagatgtggggagggtgtctggggacgttgctgagctggctgcagaagggtggggatatcagggcacagtctccatgtgtgtgccaagccctggcccccacagcgctcgatggacctcagcaagctgcccagccctggcccaggtgccccgactgtgggactcagttgttctgagcacatttgactccacttttcccttaaaaatgaatgtcttgttcctgtgcattggtggcatcacagaccccagctggggcgcgatgtcaaaggtcgggacagctgtgccgggaggcagccacagggaagctcacacatcctgtcagtgtcaccttggtttgcaaaacccatatccccggtaaaatgaggccggacagaggggctgttaggacagcaaagcagcagtgtccagagacccctcaatccccaaaggtccgcaccctgtcctgcacaccctgggccacgccggccacacccctctgctgcaacaagctcatccctggacttctgggagaatgaacccgaggttggtttggggagacaggtgaggcggttggatctacagaacaacccaccatttctgggggccgcagaggatccatcacagacggatactggggagtaaacggcccaggccaggtgcccaggaaaggacggctgagcatgtggagcgagagggaggcaggtggacgctgcagaccccaggttcagtgcggcccctcggctgttcctcccctgtagggtttggacagacccacccccagccttgcccagctttcaaaggacaaaagggagcatcccccacctactctcaggtttttgaggaaacaaagatttgtggtaactgaaggtgttgggtcagtggccaggtgccgacactgagctgtgacccagaggggacgctgaggaagtgggcgtgagtggacatgtcaggtggttaccaggcactggttgttgatggtcggtggttgggtgtgggcagtcatcagtcatcaggtgtgctcaggggacaatctcccctcaaccgcacatgtgccactgttcagcggagctgactggtttctcctggtagaggggccggctgtttcctgacagatgcctggtgagcaggggaagcaggacccagtggtcaacaggtgtctttaactgtcattgtgtgtggaatgtcgcagactcctccacgtggcgggaatgagctgtgtaaatacttcaataaagcctgacttcacatctgcatgctgagtaagaacttgctctgaccagatctgaggctctggagcatggaggacacacttggcgtgttagtcgtggctgctgcattcagatgaaaacagagcttggacggggagggagagggtgggcagggtcctgccagccacagggcaccagggaggacattggaaacagccacctctccctgaggagagtcacggacccctgtcagagcgtcgccattggggagcctccgtctggcagctgtgacgcatgagcagtgccctgtggaggaggcgcctgcacgcccagccttgtcctgccgcacccaacacggcctctgtcagctctgcagagcccaagaacctgttaatagagcaggactgagtgcaggagtgtgtgtgtgcacgcgcgttcatgtgatgcacacgcgtgtgtgggtgtgtgcgtgggggtgtgcacacatatgcgaatctccgtgtgtgctgagccttagccacatgtatgctacaagcaaataaaatgcatttccaatgaactccacgctccaccagatggctgtgttgtcaggagggatacagcacgctggtaaaagccacattcctaaggagtcaaacctagaatgagccacaccaaccagcctttggtgactttcctaagagcaaagcaggtgggaagggggagaaggggctgggcacacagccctccagggagtcactgttttgtctgactcaggagcttagtgtccatttgcctgaggtgggaaatattcagccgcctgaggagactcagccctgatgggaggc

SEQ ID NO: 299282 - DNA, 3622 bp, Homo sapiens
  misc_feature (685)..(685): n is a, c, g, or t
  misc_feature (706)..(706): n is a, c, g, or t
cgcacagtcttagagtctggcagcgtcccccgccctcctgtggccgtccagttcccgctccctccagcctctgcccccaaggccgtttctgtttctgtccatctgctggcaacacagatacgggagcaggcgggagggagagctggaggctcgcgggccgcgcttcccatagcagccgcccgcacctgcccaggctcacgggcgttcccgctgccctcacctcccaggtgcagtgcgagctgaagcgaaaatggcgaagccggtgcccgaccccgtccgcgagccgggattacagggtctgcggttcctccttctcccgcaacggctcggagggcgccctgcagttccaccgcggctcccgcgcccagtccttcctgcaaacggagacctcggtcatctagccccacccctgcctgtcggacgcggcgggaggcccacggttcggggcttctgcggggctgagacgccggcttcctccttccagatgcccgagcaccgtgtcgggcaggtcagcgcggtcctgactccgtcaagctggttgtccactaaaccccatacctggaattggagtcgtgttgtcattgactcgatttaaactccagcatttagataatcttgtgcaaaatgtgtttcagccgtatagtggatccacttttttttttttttttttttgagacggagtctngctctgtcgcccaggctggantgcagtggcctgatctctgctccctgcaagctccgcctcccgggttcacgccattctcctgcctcagcctcccatagctgggactacaggcgcccgccaacacgcctggctaattttttgtatttttagtagagacagggtttcaccatgttagccaggatggtctcgatctcctgacctcgtgatgggcccgcctcggcctcccaaagtgctgggattaaggcgtgagccactgcgcccggcccaagagaataggggagccaaggaggaaatgtggaaacgcagttgtgtggcccagcacgagcctgggcgaccaccgggtgacatccgtcccacatcagggcggcctcccaggtcccataagggtagccccctcatctgcaggacagagggaagccagtcagggcccccctgacgttaggaccaggagaaatcaacaggagggcagcccgtcctctctcttggggcgcccacccggcccggctgagccctgccccacccaactccacagggctgttttgcctccccacggaaggcgggctgaggagacaaccagatcaggagagcaaggtcatgaaggaggggacctctccacacaggtgttccgtgggaccctcagcagctctggctctgcctcaggaggtcacctgccgccctgtgggagccgcagagcctgacgctcagccccaggccagctgcggccaggcctgcgggcccctggtgatggggttacgtggggtgcgggatacagctgagtgggaaccggaaacctattctctttttaacaaaaataatcttaggataagaattattttaacaacatataaaactgtttcaagccctcctccccagagctggcgctcagcagccctagcggctgctccttcaggcgaagggtggtttgcagatgtggggagggtgtctggggacgttgctgagctggctgcagaagggtggggatatcagggcacagtctccatgtgtgtgccaagccctggcccccacagcgctcgatggacctcagcaagctgcccagccctggcccaggtgccccgactgtgggactcagttgttctgagcacatttgactccacttttcccttaaaaatgaatgtcttgttcctgtgcattggtggcatcacagaccccagctggggcgcgatgtcaaaggtcgggacagctgtgccgggaggcagccacagggaagctcacacatcctgtcagtgtcaccttggtttgcaaaacccatatccccggtaaaatgaggccggacagaggggctgttaggacagcaaagcagcagtgtccagagacccctcaatccccaaaggtccgcaccctgtcctgcacaccctgggccacgccggccacacccctctgctgcaacaagctcatccctggacttctgggagaatgaacccgaggttggtttggggagacaggtgaggcggttggatctacagaacaacccaccatttctgggggccgcagaggatccatcacagacggatactggggagtaaacggcccaggccaggtgcccaggaaaggacggctgagcatgtggagcgagagggaggcaggtggacgctgcagaccccaggttcagtgcggcccctcggctgttcctcccctgtagggtttggacagacccacccccagccttgcccagctttcaaaggacaaaagggagcatcccccacctactctcaggtttttgaggaaacaaagatttgtggtaactgaaggtgttgggtcagtggccaggtgccgacactgagctgtgacccagaggggacgctgaggaagtgggcgtgagtggacatgtcaggtggttaccaggcactggttgttgatggtcggtggttgggtgtgggcagtcatcagtcatcaggtgtgctcaggggacaatctcccctcaaccgcacatgtgccactgttcagcggagctgactggtttctcctggtagaggggccggctgtttcctgacagatgcctggtgagcaggggaagcaggacccagtggtcaacaggtgtctttaactgtcattgtgtgtggaatgtcgcagactcctccacgtggcgggaatgagctgtgtaaatacttcaataaagcctgacttcacatctgcatgctgagtaagaacttgctctgaccagatctgaggctctggagcatggaggacacacttggcgtgttagtcgtggctgctgcattcagatgaaaacagagcttggacggggagggagagggtgggcagggtcctgccagccacagggcaccagggaggacattggaaacagccacctctccctgaggagagtcacggacccctgtcagagcgtcgccattggggagcctccgtctggcagctgtgacgcatgagcagtgccctgtggaggaggcgcctgcacgcccagccttgtcctgccgcacccaacacggcctctgtcagctctgcagagcccaagaacctgttaatagagcaggactgagtgcaggagtgtgtgtgtgcacgcgcgttcatgtgatgcacacgcgtgtgtgggtgtgtgcgtgggggtgtgcacacatatgcgaatctccgtgtgtgctgagccttagccacatgtatgctacaagcaaataaaatgcatttccaatgaactccacgctccaccagatggctgtgttgtcaggagggatacagcacgctggtaaaagccacattcctaaggagtcaaacctagaatgagccacaccaaccagcctttggtgactttcctaagagcaaagcaggtgggaagggggagaaggggctgggcacacagccctccagggagtcactgttttgtctgactcaggagcttagtgtccatttgcctgaggtgggaaatattcagccgcctgaggagactcagccctgatgggaggc

SEQ ID NO: 299283 - DNA, 3605 bp, Homo sapiens
  misc_feature (1788)..(1788): n is a, c, g, or t
  misc_feature (1809)..(1809): n is a, c, g, or t
gtgcattgagcgcgctccagctgccgggacggagggggcggcccccgcgctcggggcgctcggctacagctgcggggcccgaggtctccgcgcactcgctcccggcccatgctggaggcggcggaaccgcggggacctaggacggaggcggcgggcgctgggcggcccccggcacgctgagctcgggatgcggacgctgctgcctcccgcgctgctgacctgctggctgctcgcccccgtgaacagcattcacccagaatgccgatttcatctggaaatacaggaggaagaaacaaaatgtgcagagcttctgaggtctcaaacagaaaaacacaaagcctgcagtggcgtctgggacaacatcacgtgctggcggcctgccaatgtgggagagaccgtcacggtgccctgcccaaaagtcttcagcaatttttacagcaaagcaggaaacataagcaaaaactgtacgagtgacggatggtcagagacgttcccagatttcgtcgatgcctgtggctacagcgacccggaggatgagagcaagatcacgttttatattctggtgaaggccatttataccctgggctacagtgtctctctgatgtctcttgcaacaggaagcataattctgtgcctcttcaggaagctgcactgcaccaggaattacatccacctgaacctgttcctgtccttcatcctgagagccatctcagtgctggtcaaggacgacgttctctactccagctctggcacgttgcactgccctgaccagccatcctcctgggtgggctgcaagctgagcctggtcttcctgcagtactgcatcatggccaacttcttctggctgctggtggaggggctctacctccacaccctcctggtggccatgctcccccctagaaggtgcttcctggcctacctcctgatcggatggggcctccccaccgtctgcatcggtgcatggactgcggccaggctctacttagaagacaccggttgctgggatacaaacgaccacagtgtgccctggtgggtcatacgaataccgattttaatttccatcatcgtcaattttgtccttttcattagtattatacgaattttgctgcagaagttaacatccccagatgtcggcggcaacgaccagtctcagtacaagaggctggccaagtccacgctcctgcttatcccgctgttcggcgtccactacatggtgtttgccgtgtttcccatcagcatctcctccaaataccagatactgtttgagctgtgcctcgggtcgttccagggcctggtggtggccgtcctctactgtttcctgaacagtgaggtgcagtgcgagctgaagcgaaaatggcgaagccggtgcccgaccccgtccgcgagccgggattacagggtctgcggttcctccttctcccgcaacggctcggagggcgccctgcagttccaccgcggctcccgcgcccagtccttcctgcaaacggagacctcggtcatctagccccacccctgcctgtcggacgcggcgggaggcccacggttcggggcttctgcggggctgagacgccggcttcctccttccagatgcccgagcaccgtgtcgggcaggtcagcgcggtcctgactccgtcaagctggttgtccactaaaccccatacctggaattggagtcgtgttgtcattgactcgatttaaactccagcatttagataatcttgtgcaaaatgtgtttcagccgtatagtggatccacttttttttttttttttttttgagacggagtctngctctgtcgcccaggctggantgcagtggcctgatctctgctccctgcaagctccgcctcccgggttcacgccattctcctgcctcagcctcccatagctgggactacaggcgcccgccaacacgcctggctaattttttgtatttttagtagagacagggtttcaccatgttagccaggatggtctcgatctcctgacctcgtgatgggcccgcctcggcctcccaaagtgctgggattaaggcgtgagccactgcgcccggcccaagagaataggggagccaaggaggaaatgtggaaacgcagttgtgtggcccagcacgagcctgggcgaccaccgggtgacatccgtcccacatcagggcggcctcccaggtcccataagggtagccccctcatctgcaggacagagggaagccagtcagggcccccctgacgttaggaccaggagaaatcaacaggagggcagcccgtcctctctcttggggcgcccacccggcccggctgagccctgccccacccaactccacagggctgttttgcctccccacggaaggcgggctgaggagacaaccagatcaggagagcaaggtcatgaaggaggggacctctccacacaggtgttccgtgggaccctcagcagctctggctctgcctcaggaggtcacgtgccgacactgagctgtgacccagaggggacgctgaggaagtgggcgtgagtggacatgtcaggtggttaccaggcactggttgttgatggtcggtggttgggtgtgggcagtcatcagtcatcaggtgtgctcaggggacaatctcccctcaaccgcacatgtgccactgttcagcggagctgactggtttctcctggtagaggggccggctgtttcctgacagatgcctggtgagcaggggaagcaggacccagtggtcaacaggtgtctttaactgtcattgtgtgtggaatgtcgcagactcctccacgtggcgggaatgagctgtgtaaatacttcaataaagcctgacttcacatctgcatgctgagtaagaacttgctctgaccagatctgaggctctggagcatggaggacacacttggcgtgttagtcgtggctgctgcattcagatgaaaacagagcttggacggggagggagagggtgggcagggtcctgccagccacagggcaccagggaggacattggaaacagccacctctccctgaggagagtcacggacccctgtcagagcgtcgccattggggagcctccgtctggcagctgtgacgcatgagcagtgccctgtggaggaggcgcctgcacgcccagccttgtcctgccgcacccaacacggcctctgtcagctctgcagagcccaagaacctgttaatagagcaggactgagtgcaggagtgtgtgtgtgcacgcgcgttcatgtgatgcacacgcgtgtgtgggtgtgtgcgtgggggtgtgcacacatatgcgaatctccgtgtgtgctgagccttagccacatgtatgctacaagcaaataaaatgcatttccaatgaactccacgctccaccagatggctgtgttgtcaggagggatacagcacgctggtaaaagccacattcctaaggagtcaaacctagaatgagccacaccaaccagcctttggtgactttcctaagagcaaagcaggtgggaagggggagaaggggctgggcacacagccctccagggagtcactgttttgtctgactcaggagcttagtgtccatttgcctgaggtgggaaatattcagccgcctgaggagactcagccctgatgggaggc

SEQ ID NO: 299284 - DNA, 1445 bp, Homo sapiens
cccgaataagatcgttcttggttgcctttcaggttgaacttggatttcctgtgaatcttgtttagtttctatgctgacctttgcattggttctttgggagtgtttgttaaattgaacttggagatggatgcttttatttggaaacaaaatctgttccctttccaggacaacagaaaaggccgagacacccttgaggccacacgaggtcctttctgtgtaactctggtcacagaagtagcaaaacctccctggataggggccaagagctcagccgcagataggcctcttttccagcaaacttcagatgcgttaatagagggaatcaggcaggtcctctgccgctgactgagggacctggctcccacggagcccagctgttacgagctgcaggtccgggagcaggatcggttctcatcatttaaacctgcgtgtggcagcggtggaggccagccttcttgtcccatgcctgcctcaggatgggccgggctcccaggcggggcctgtgtaggtttggggtcactcacagggaatcttgcccctgccagccatgaaccccaggacacagcgtgtgtccttgtgagggaatttgggagaaacggacacttccggaatgcacgttcccaggccctgagtgctagatatgcacaggggcctcagacataaacgtaaagaaacagtggtttttcttgttgggcggggactccagcagtggagaggaggtgtggagcccctcccacacccagctgccccctcctgagaaggacccagccaggcttgcagagggtccgagggtccagcagctgagctggctcatctccttctgtgcaggaggctggccaagtccacgctcctgcttatcccgctgttcggcgtccactacatggtgtttgccgtgtttcccatcagcatctcctccaaataccagatactgtttgagctgtgcctcgggtcgttccagggcctggtggtggccgtcctctactgtttcctgaacagtgaggtaagttcatggccgccttggaaccaagcacaggtactcacttgcttcctgagatgctgcccagcctggtgccgcagcccccacacatgcctgtcttccgcgggctcgagttactgcccgggaccccacagttctgtgtccccatcagagaacccacaacgacacaggcaaacccactcttctggggggtggggctgcacagcgtcctgtgagtccctggggaggaagcccggagccgagctctgccctgcgttcattcccagccagggaggctgtctccgggctgctccaacggcctggccccgtcccctgacccctgaccctcccgccccacgctgcggttgctggcgctttctttgcttgacatgcagctttcaccagcacggcttctgcaaagctgagcccgagtagtgccacttgtcctcctccctcctctgccgtccgg

SEQ ID NO: 299285 - DNA, 862 bp, Homo sapiens
tcactgagggtggggatcagagaggagaggcacaccaggtagcggaagccttgccttgcccagggttggaaaggggtgcaaatttgggacatcctcatggacaggatgaggcaaacgtagccgatagctccgtgggtggtcgcaaaaatcagtgaacacatctccttctccgcacgttcaactccatggcctccagtaataacccttctcatgaggaatggcaagtctcagattctcagctctcaagcgtgtgtttaattatcttcactgcttactaaggcatgagcataaacttgtaaatatttacaaagactttaaacaagagattgcacttaatattcccgtgagaaagcgtgtccttgagggttttgctggtgaaggcacccacctgtgtgcgtgcacaccgctccgctccacctgtgtaaccaggcgtctctctgcaggcctccccaccgtctgcatcggtgcatggactgcggccaggctctacttagaagacaccgggtgagtccatgaccagactgcaacctcgaaaacgggcccggcaacatctggcaacatgaagtcctttggaagccagaaggttacctggttggaaggacagggagcgtttgcggccaaccgacagccacgcaggaagcatctgggcgattcatggggagaaatcctgtgaggttggagtgttggaggaagccccgtgcaggagacaggaagtgagccaggttttgcagcatagttgagattgggataagccaggcagagactggggcagcccctgcggtgggcacagcgatgtccacagaagaaagccaagtgccctgcatgttgtttacccggagcaaagtggaaggtcaggtgatgg

SEQ ID NO: 299286 - DNA, 530 bp, Homo sapiens
atggagtcttgctctgtcacccaggctggagtgcggtggccagtctcagctcactgcaacctccacctcccgggttcaagtgattctcctgcctcagcctcccaagtagctgagattacagagatgcaccaccatgctcagctaattttgtattgttagtagagacagggtttctccatgttggtcaggctggccttgaactcccgacctcagatgatccgcccgcctcggcctcccatagtgctgggattacaggcgtgacgaacgcgcccggcctactactgcttttctttttaaaaattttcctccaactttttattttgaacatcttttaatcccacagaaaaggtaaaagaatagacacctgcatctttcaccgagatttaccaattattcatgttttgtcatatttactttcatcactacaaaaaaaatacttttttttttctgaattacttggaagtaaaatgcagacatcatggcacttaaataccctttaatacccaagtatccattgtctgagattaagg

SEQ ID NO: 299287 - DNA, 2270 bp, Homo sapiens
cctactggagatcgcggcggcctcgcgggcggtctggtcggtgaggtcttggccgcgcgcggcaatgctgaggctgctggcgtccgggtgcgcccggggcccggggcccggcgtgggcgcgcgtcctgccgcagggctctttcatccggggcgccgccagagccgccaggcttccgatgcgccccggaaccagccccccagccccgagttcgtggcccggccggtgggcgtctgctccatgatgcgcctgccggtgcagacctcccccgaggggctggacgctgccttcatcggggtgcccctggatactgggacctccaaccggcctggggcgagattcggacctcgccgcatccgggaagaatcagtgatgcttcggacagtcaatcctagcacgggggccctccccttccagtccctcatggttgcagacctaggcgatgtgaatgtcaatctttacaaccttcaggacagctgccggcgaattcaagaggcctgtgagaaaattgtagcagctggctgtattcctctgaccttgggtggagatcacacaatcacatatcccatattgcaagcgatggcaaaaaagcatggcccagtggggctgctgcacgtggatgcgcacacggacacgaccgacaaggccctaggagagaagctctaccacggggcgcccttccgccggtgtgtggatgagggtctcctggactgtaagcgtgtggtgcagattggcatccggggctcttccacgaccttggatccctacagatacaaccggagccagggcttccgggtagtcctggctgaagactgctggatgaagtcgctggttcctctgatgggggaagtcaggcagcagatgggaggcaaacccatttatatcagctttgatattgacgctctggatcctgcctatgcgccagggacagggacacctgaaattgctggtctcactcctagtcaggctctggagatcatcaggggttgtcaaggcctgaacgtgatgggctgtgatcttgtcgaagtttcaccaccgtatgatctttctgggaacacagccctgctggcggctaacctgctgtttgagatgctatgtgctctccccaaagtgacaaccgtctgagtcttgtgctcttcaagacaaaacagattgcgtcgctgacaagttctcaagaagaacttatgagtaagcagtctgagaactaaagagtttatgccaagaaaactttctgctgaaagtgtcattgctggctgtgaagtcgggataatcagtagaattctcacccaaacagcaacatttctaaggaacttggattaattgggggaaaaaaaaaggagtacttgtactgctttgattttttttcctttgatgaaagatggaggataaaggggaagtgaggagaatttctttcaagattatctaaacattagaaacatgacatttaaaaaaactatgaaataatactgtataagcattccatatttctatatcttccttttaaacattttttttttttgagatagagttttgcttgtcacccaggctggagtgcagtggcccgatcttagctcacgcctgtaatcccaggcctaggcgggaagatcacttgagatcaggagttcaagatcagcctgcccaacatggtgaaacctcgtctctactaaaaatacaaaaaagattagccagacgtggtgtggtgcacacccattgtcccaactacttgggaggctgaggcaggagaatcgcttaagcccaggaagcggaggctgcagtgagccgagatcgtgtcactgcactccaccctgggcaacacagtaagattccctctcaagaaaaaaaaaaaaaaaaattagttgagaaagaaaacccaactgttgtgcgtttgttggattttctctggaaacgccatccagtctgtaataaaatttcagttgtcattaccctggatggaattcatcttggctggagtgagtggcttcatgcagggcaaccccactgcaaagaatgtgagcatcagctaggctgacacaggggtccgcagacccaggcccctcattccatcagtttctttcagcatgtttccatgttttcatattttgaaaaaagtcaaaatccaaattgattttcaatgtgtttccctttggttattccccactcccatgcctgtcctctcttaaaatctctgttgttggtactgtttgtttttggctgttggaactgttgtgatcccccaccacaagcagattaaaaggtataccacattaagaag

SEQ ID NO: 299288 - DNA, 5448 bp, Homo sapiens
ggcgctcggagcgggctccgcggcttgcaaggcgcctgcgactcggtcccaggtcggcgggcggcgcgcggcgggctcgcgcgggggccccggcgcgccgggcggcgcagtacgcagcgcgcggacccacgccacggccaggagcccagagcagcgcggccacactgcccaggggtcggccctcggccccggcgctcggagcgcggcggctgcctgggctttaatggctgctccgcggagcagcgcctagggctggaaggcggctgcggctcaggaagtcacccgagcaagcctccttcggggccggccgcacccgccgcggcgcgctccatgggggcgcgctccccccgggcggcccgctgacccgggacgccggggcccgctcgctcgccggccgcgcgtcccggccatgaactgagcccgcgggccagccccgcgcctgctccgcccgcgcctttcttctcgcgcctcctccgcccgccgccggcgggcccggctccccgggggctgcggcgccccgggctcggcggcccgcgggccccggggcgcggggcggcggcggcggggggcgcgcggctccgggcgcggcgcctgcaccatgaactaccagcagcagctggccaactcggctgccatccgggccgagatccagcgcttcgagtcggtccaccccaacatctactccatctacgagctgctggagcgcgtggaggagccggtgctgcagaaccagatccgggagcacgtcatcgccatcgaagatgccttcgtgaacagccaggaatggacgctgagtcgatctgtcccggagctcaaagtgggaattgtgggtaacttggccagcggcaagtctgccctggtgcaccggtacctgacgggcacatatgtccaggaggagtctccggaaggtggcaggttcaagaaagagattgtcgttgatggacagagctatctgctgctgatcagagatgaagggggccccccggaggcgcagtttgccatgtgggtggacgctgttatatttgtcttcagcttggaggatgaaataagtttccagaccgtttaccactactacagtcgaatggccaactatcggaacacgagcgagattcctctggttctggtgggaacccaggatgccataagttctgctaacccgagggtcatcgatgacgccagggcgaggaagctctccaacgacctgaaacggtgcacgtactacgagacgtgtgctacatacgggctgaatgtggagagggtcttccaggacgttgcccagaagattgttgccacaaggaagaagcagcagctgtccataggaccctgcaagtcgctacctaattctcccagccattcctccgtctgttccgcgcaggtgtctgccgtgcacatcagccagacaagtaatggaggtgggagtttaagcgactattcctcctccgttccatcgactcccagcaccagccagaaggaacttcggatcgatgttcctcccactgccaacacgcccacgcccgttcgcaagcagtctaagcgccggtccaacctgttcacctctcggaaagggagcgacccagacaaagagaagaaaggcctggagagtcgtgcggacagcattgggagcggccgagccatcccaattaaacagggcatgctgttgaagcgaagtggcaaatcgttgaataaagagtggaaaaagaaatatgtcaccctgtgtgacaatggcgtgctgacctatcatcccagtttacatgattacatgcagaatgttcatggtaaggagattgaccttctgagaaccactgtgaaagtcccagggaagaggccaccccgagccacgtcagcctgcgcacccatctccagccctaaaaccaatggcctatccaaggacatgagcagtttacacatctcacccaattcagacacagggctgggtgactccgtatgctccagccccagtatctccagcaccaccagccccaagctcgacccgcccccctcccctcacgccaacagaaagaagcaccgaaggaagaaaagcactagcaacttcaaagccgacggcctgtccggcactgctgaagaacaagaagaaaattttgagtttatcattgtgtccctcactggccaaacatggcactttgaagccacgacgtatgaggagcgggacgcctgggtccaagccatcgagagccagatcctggccagcctgcagtcgtgcgagagcagcaagaacaagtcccggctgacgagccagagcgaggccatggccctgcagtcgatccggaacatgcgcgggaactcccactgtgtggactgcgagacccagaatcccaactgggccagtttgaacttgggagccctcatgtgcatcgaatgctcagggatccaccggaatcttggcacccacctttcccgagtccgatctctggacctggatgactggccaatcgagctcatcaaggtgatgtcatccatcgggaacgagctagccaacagcgtctgggaagagagcagccaggggcggacgaaaccatcggtagactccacaagggaagagaaggaacggtggatccgtgccaagtacgagcagaagctcttcctggccccgctgccctgcacggagctgtccctgggccagcacctgctgcgggccaccgccgacgaggacctgcggacggccatcctgctgctggcacacggctcccgggacgaggtgaacgagacctgcggggagggagacggccgcacggcgctgcatctggcctgccgcaaggggaatgtggtcctggcgcagctcctgatctggtacggagtggacgtcacggcccgagatgcccacgggaacacagctctggcctacgcccggcaggcctccagccaggagtgcatcgacgtgctgctgcagtacggctgccccgacgagcgcttcgtgctcatggccacccctaacctgtccaggagaaacaataaccggaacaacagcagtgggagggtgcccaccatcatctgaggaacagccgtgcccgcctgctcgccgcacctgggacgcggcagcctcgccgcattctcgctcagaagtcgcagcacgtgagtcccgtcgcatcccctccctcttcctggtggccacctccctcccgcccacccactctcaccccaaacaaaatcacaaaacctggacatccctcaaggggcgaagaggcggccgggagactgcagaagtggctccttttcataaactcccctaaaccacacacaggagagagcgacgggcctcggccctttgatgatagcacatggcgcaggacccttgtcctggtggcacaagggatggggacgcgagggggaggggaggcgaggaacaaggagaaggggcaactttccttaactggcagttgagcacatagtacatttcccctctaccaaacggaacacttggattccatctcttctctgaggagctcgacggcataaatcagaagcaagcacagagtttgtcaggtttgaagcccctatgatggtgtgtgtcaaatcagttgtagctaatctgtccagggagaatactggcttcattacacttgtacagccgagttcttcccgcattactgctgtttaatagaacgtgattagtcatcgccgagaagaaagcatattagccgaggaggtagtcacgcggcacgcgccggtgattgccacgatgtgattgcaatactcttagaagcaccatattatcccagacatgttctttcaagcccttggagccctctctaaattcactgtcatcatttagtatctgtttaatttttcagtccaaagagaggaaatcagtcgctgagtattatttgactccggtctccttggtgcaaaaacaaaatgggaaaaataaataagaataactcagaaactcaaaaggaaaccacaaattcagctaataatagcatttcgagtatatttcgtaaactaaggaaatacacaaaaggctgttttttccgactgtaagagatatttgatgtccttttgccgaggtggatgtgttagtctcaggccctcctggaccacgttgcccaagtcacacaggcttctgtgttatgtatttagataagatgtgtgaaaatatatttgaataaaagaagttcataaatatgcattgatttttgtacagacaaatggcacctctcttaatttataaattgaactggatgtgaactaataatgtgcaactagttgagataagagggttacagatcattgtacatggaaaatattcccagcagtaaacacttccattaatgtgatctacggcttttgaaaaggagcatctcagaataagatggtggtacaatttgcttattaaaattgagaaagaaaaaaaaagacacactggagtatattagaaaggaaaaagaaggaatgtggtctctcatgattgaaagcatgatttagatcggatacggcttttgctaaccaaggaccaagggactctggcaagatggggtggttttccgaatgccagaccgaggtgccttacgaaggcagctgccaatggttctgtggcacagactggctcctgagaacccagacgaccttgacctggcagcccggccctccacgctagtacctcgcctgattttccatcgttgcggtatccagccgcttcagacgtccgccgccttcagtggtggtagtcaaatgtagtcaaccaaaccacagcatcccttaggttaaaagcaaacggggcagctttgcctagagctcattgacagtgtgatggggggagaagggttgtcacaatggaagatgaggacactagactcatgtagcacagaaacatgaagccacacgcaccggcagcctccggggtgttcctcgctctctcgtatgttaaaccttatattttataagagtttttcctcttatttcactttttaaaaaaaattaaagtaggtggggaaaaaaataaagctttacacagaatttatatgtgggtaagtgtttcatggaaatttctaatcttaacgaagctaagtggagctcactcgtatccaaaagtataacaggtgcagaagccacaagtctgagaaccttgacgacagttccatcgtcctgccatattgatttttcagtctgcgtttcatcactgtgtagctattgtaaatgtgaatagaaaaaaacaggtcattgcctatttttgaagaacgcgttggtgttcgagtccactagacacactcgctccacacagccttcaccgtagactctgtagtggacacagatatagcataaatgaaattgttaaattatttcattgtagttaattcccactataggaatgctttatcatagtgaagtttcttttgagaagaaacggaactccttgaggcttctctttgggatgtatatgagcgtgtacatattattctatgtgtttataatataatattttcccaaatg

SEQ ID NO: 299289 - DNA, 5393 bp, Homo sapiens
ggcgctcggagcgggctccgcggcttgcaaggcgcctgcgactcggtcccaggtcggcgggcggcgcgcggcgggctcgcgcgggggccccggcgcgccgggcggcgcagtacgcagcgcgcggacccacgccacggccaggagcccagagcagcgcggccacactgcccaggggtcggccctcggccccggcgctcggagcgcggcggctgcctgggctttaatggctgctccgcggagcagcgcctagggctggaaggcggctgcggctcaggaagtcacccgagcaagcctccttcggggccggccgcacccgccgcggcgcgctccatgggggcgcgctccccccgggcggcccgctgacccgggacgccggggcccgctcgctcgccggccgcgcgtcccggccatgaactgagcccgcgggccagccccgcgcctgctccgcccgcgcctttcttctcgcgcctcctccgcccgccgccggcgggcccggctccccgggggctgcggcgccccgggctcggcggcccgcgggccccggggcgcggggcggcggcggcggggggcgcgcggctccgggcgcggcgcctgcaccatgaactaccagcagcagctggccaactcggctgccatccgggccgagatccagcgcttcgagtcggtccaccccaacatctactccatctacgagctgctggagcgcgtggaggagccggtgctgcagaaccagatccgggagcacgtcatcgccatcgaagatgccttcgtgaacagccaggaatggacgctgagtcgatctgtcccggagctcaaagtgggaattgtgggtaacttggccagcggcaagtctgccctggtgcaccggtacctgacgggcacatatgtccaggaggagtctccggaaggtggcaggttcaagaaagagattgtcgttgatggacagagctatctgctgctgatcagagatgaagggggccccccggaggcgcagtttgccatgtgggtggacgctgttatatttgtcttcagcttggaggatgaaataagtttccagaccgtttaccactactacagtcgaatggccaactatcggaacacgagcgagattcctctggttctggtgggaacccaggatgccataagttctgctaacccgagggtcatcgatgacgccagggcgaggaagctctccaacgacctgaaacggtgcacgtactacgagacgtgtgctacatacgggctgaatgtggagagggtcttccaggacgttgcccagaagattgttgccacaaggaagaagcagcagctgtccataggaccctgcaagtcgctacctaattctcccagccattcctccgtctgttccgcgcaggtgtctgccgtgcacatcagccagacaagtaatggaggtgggagtttaagcgactattcctcctccgttccatcgactcccagcaccagccagaaggaacttcggatcgatgttcctcccactgccaacacgcccacgcccgttcgcaagcagtctaagcgccggtccaacctgttcacctctcggaaagggagcgacccagacaaagagaagaaaggcctggagagtcgtgcggacagcattgggagcggccgagccatcccaattaaacagggcatgctgttgaagcgaagtggcaaatcgttgaataaagagtggaaaaagaaatatgtcaccctgtgtgacaatggcgtgctgacctatcatcccagtttacatgattacatgcagaatgttcatggtaaggagattgaccttctgagaaccactgtgaaagtcccagggaagaggccaccccgagccacgtcagcctgcgcacccatctccagccctaaaaccaatggcctatccaaggacatgagcagtttacacatctcacccaattcagacacagggctgggtgactccgtatgctccagccccagtatctccagcaccaccagccccaagctcgacccgcccccctcccctcacgccaacagaaagaagcaccgaaggaagaaaagcactagcaacttcaaagccgacggcctgtccggcactgctgaagaacaagaagaaaattttgagtttatcattgtgtccctcactggccaaacatggcactttgaagccacgacgtatgaggagcgggacgcctgggtccaagccatcgagagccagatcctggccagcctgcagtcgtgcgagagcagcaagaacaagtcccggctgacgagccagagcgaggccatggccctgcagtcgatccggaacatgcgcgggaactcccactgtgtggactgcgagacccagaatcccaactgggccagtttgaacttgggagccctcatgtgcatcgaatgctcagggatccaccggaatcttggcacccacctttcccgagtccgatctctggacctggatgactggccaatcgagctcatcaaggtgatgtcatccatcgggaacgagctagccaacagcgtctgggaagagagcagccaggggcggacgaaaccatcggtagactccacaagggaagagaaggaacggtggatccgtgccaagtacgagcagaagctcttcctggccccgctgccctgcacggagctgtccctgggccagcacctgctgcgggccaccgccgacgaggacctgcggacggccatcctgctgctggcacacggctcccgggacgaggtgaacgagacctgcggggagggagacggccgcacggcgctgcatctggcctgccgcaaggggaatgtggtcctggcgcagctcctgatctggtacggagtggacgtcacggcccgagatgcccacgggaacacagctctggcctacgcccggcaggcctccagccaggagtgcatcgacgtgctgctgcagtacggctgccccgacgagcgcttcgtgctcatggccacccctaacctgtccaggagaaacaataaccggaacaacagcagtgggagggtgcccaccatcatctgaggaacagccgtgcccgcctgctcgccgcacctgggacgcggcagcctcgccgcattctcgctcagaagtcgcagcacgtgagtcccgtcgcatcccctccctcttcctggtggccacctccctcccgcccacccactctcaccccaaacaaaatcacaaaacctggacatccctcaaggggcgaagaggcggccgggagactgcagaagtggctccttttcataaactcccctaaaccacacacaggagagagcgacgggcctcggccctttgatgatagcacatggcgcaggacccttgtcctggtggcacaagggatggggacgcgagggggaggggaggcgaggaacaaggagaaggggcaactttccttaactggcagttgagcacatagtacatttcccctctaccaaacggaacacttggattccatctcttctctgaggagctcgacggcataaatcagaagcaagcacagagtttgtcaggtttgaagcccctatgatggtgtgtgtcaaatcagttgtagctaatctgtccagggagaatactggcttcattacacttgtacagccgagttcttcccgcattactgctgtttaatagaacgtgattagtcatcgccgagaagaaagcatattagccgaggaggtagtcacgcggcacgcgccggtgattgccacgatgtgattgcaatactcttagaagcaccatattatcccagacatgttctttcaagcccttggagccctctctaaattcactgtcatcatttagtatctgtttaatttttcagtccaaagagaggaaatcagtcgctgagtattatttgactccggtctccttggtgcaaaaacaaaatgggaaaaataaataagaataactcagaaactcaaaaggaaaccacaaattcagctaataatagcatttcgagtatatttcgtaaactaaggaaatacacaaaaggctgttttttccgactgtaagagatatttgatgtccttttgccgaggtggatgtgttagtctcaggccctcctggaccacgttgcccaagtcacacaggcttctgtgttatgtatttagataagatgtgtgaaaatatatttgaataaaagaagttcataaatatgcattgatttttgtacagacaaatggcacctctcttaatttataaattgaactggatgtgaactaataatgtgcaactagttgagataagagggttacagatcattgtacatggaaaatattcccagcagtaaacacttccattaatgtgatctacggcttttgaaaaggagcatctcagaataagatggtggtacaatttgcttattaaaattgagaaagaaaaaaaaagacacactggagtatattagaaaggaaaaagaaggaatgtggtctctcatgattgaaagcatgatttagatcggatacggcttttgctaaccaaggaccaagggactctggcaagatggggtggttttccgaatgccagaccgaggtgccttacgaaggcagctgccaatggttctgtggcacagactggctcctgagaacccagacgaccttgacctggcagcccggccctccacgctagtacctcgcctgattttccatcgttgcggtatccagccgcttcagacgtccgccgccttcagtggtggtagtcaaatgtagtcaaccaaaccacagcatcccttaggttaaaagcaaacggggcagctttgcctagagctcattgacagtgtgatggggggagaagggttgtcacaatggaagatgaggacactagactcatgtagcacagaaacatgaagccacacgcaccggcagcctccggggtgttcctcgctctctcgtatgttaaaccttatattttataagagtttttcctcttatttcactttttaaaaaaaattaaagtaggtggggaaaaaaataaagctttacacagaatttatatgtgggtaagtgtttcatggaaatttctaatcttaacgaagctaagtggagctcactcgtatccaaaagtataacaggtgcagatcagtctgcgtttcatcactgtgtagctattgtaaatgtgaatagaaaaaaacaggtcattgcctatttttgaagaacgcgttggtgttcgagtccactagacacactcgctccacacagccttcaccgtagactctgtagtggacacagatatagcataaatgaaattgttaaattatttcattgtagttaattcccactataggaatgctttatcatagtgaagtttcttttgagaagaaacggaactccttgaggcttctctttgggatgtatatgagcgtgtacatattattctatgtgtttataatataatattttcccaaatg

SEQ ID NO: 299290 - DNA, 5607 bp, Homo sapiens
ggcgctcggagcgggctccgcggcttgcaaggcgcctgcgactcggtcccaggtcggcgggcggcgcgcggcgggctcgcgcgggggccccggcgcgccgggcggcgcagtacgcagcgcgcggacccacgccacggccaggagcccagagcagcgcggccacactgcccaggggtcggccctcggccccggcgctcggagcgcggcggctgcctgggctttaatggctgctccgcggagcagcgcctagggctggaaggcggctgcggctcaggaagtcacccgagcaagcctccttcggggccggccgcacccgccgcggcgcgctccatgggggcgcgctccccccgggcggcccgctgacccgggacgccggggcccgctcgctcgccggccgcgcgtcccggccatgaactgagcccgcgggccagccccgcgcctgctccgcccgcgcctttcttctcgcgcctcctccgcccgccgccggcgggcccggctccccgggggctgcggcgccccgggctcggcggcccgcgggccccggggcgcggggcggcggcggcggggggcgcgcggctccgggcgcggcgcctgcaccatgaactaccagcagcagctggccaactcggctgccatccgggccgagatccagcgcttcgagtcggtccaccccaacatctactccatctacgagctgctggagcgcgtggaggagccggtgctgcagaaccagatccgggagcacgtcatcgccatcgaagatgccttcgtgaacagccaggaatggacgctgagtcgatctgtcccggagctcaaagtgggaattgtgggtaacttggccagcggcaagtctgccctggtgcaccggtacctgacgggcacatatgtccaggaggagtctccggaaggtggcaggttcaagaaagagattgtcgttgatggacagagctatctgctgctgatcagagatgaagggggccccccggaggcgcagtttgccatgtgggtggacgctgttatatttgtcttcagcttggaggatgaaataagtttccagaccgtttaccactactacagtcgaatggccaactatcggaacacgagcgagattcctctggttctggtgggaacccaggatgccataagttctgctaacccgagggtcatcgatgacgccagggcgaggaagctctccaacgacctgaaacggtgcacgtactacgagacgtgtgctacatacgggctgaatgtggagagggtcttccaggacgttgcccagaagattgttgccacaaggaagaagcagcagctgtccataggaccctgcaagtcgctacctaattctcccagccattcctccgtctgttccgcgcaggtgtctgccgtgcacatcagccagacaagtaatggaggtgggagtttaagcgactattcctcctccgttccatcgactcccagcaccagccagaaggaacttcggatcgatgttcctcccactgccaacacgcccacgcccgttcgcaagcagtctaagcgccggtccaacctgttcacctctcggaaagggagcgacccagacaaagagaagaaaggcctggagagtcgtgcggacagcattgggagcggccgagccatcccaattaaacagggcatgctgttgaagcgaagtggcaaatcgttgaataaagagtggaaaaagaaatatgtcaccctgtgtgacaatggcgtgctgacctatcatcccagtttacatgattacatgcagaatgttcatggtaaggagattgaccttctgagaaccactgtgaaagtcccagggaagaggccaccccgagccacgtcagcctgcgcacccatctccagccctaaaaccaatggcctatccaaggacatgagcagtttacacatctcacccaattcagggaatgtcactagtgcatctgggtctcagatggcaagcggcatcagcctggtctccttcaacagccgacccgacggcatgcaccagcgctcctactcagtctccagtgccgaccagtggagtgaggctacggtcattgcaaactcggccatcagcagtgacacagggctgggtgactccgtatgctccagccccagtatctccagcaccaccagccccaagctcgacccgcccccctcccctcacgccaacagaaagaagcaccgaaggaagaaaagcactagcaacttcaaagccgacggcctgtccggcactgctgaagaacaagaagaaaattttgagtttatcattgtgtccctcactggccaaacatggcactttgaagccacgacgtatgaggagcgggacgcctgggtccaagccatcgagagccagatcctggccagcctgcagtcgtgcgagagcagcaagaacaagtcccggctgacgagccagagcgaggccatggccctgcagtcgatccggaacatgcgcgggaactcccactgtgtggactgcgagacccagaatcccaactgggccagtttgaacttgggagccctcatgtgcatcgaatgctcagggatccaccggaatcttggcacccacctttcccgagtccgatctctggacctggatgactggccaatcgagctcatcaaggtgatgtcatccatcgggaacgagctagccaacagcgtctgggaagagagcagccaggggcggacgaaaccatcggtagactccacaagggaagagaaggaacggtggatccgtgccaagtacgagcagaagctcttcctggccccgctgccctgcacggagctgtccctgggccagcacctgctgcgggccaccgccgacgaggacctgcggacggccatcctgctgctggcacacggctcccgggacgaggtgaacgagacctgcggggagggagacggccgcacggcgctgcatctggcctgccgcaaggggaatgtggtcctggcgcagctcctgatctggtacggagtggacgtcacggcccgagatgcccacgggaacacagctctggcctacgcccggcaggcctccagccaggagtgcatcgacgtgctgctgcagtacggctgccccgacgagcgcttcgtgctcatggccacccctaacctgtccaggagaaacaataaccggaacaacagcagtgggagggtgcccaccatcatctgaggaacagccgtgcccgcctgctcgccgcacctgggacgcggcagcctcgccgcattctcgctcagaagtcgcagcacgtgagtcccgtcgcatcccctccctcttcctggtggccacctccctcccgcccacccactctcaccccaaacaaaatcacaaaacctggacatccctcaaggggcgaagaggcggccgggagactgcagaagtggctccttttcataaactcccctaaaccacacacaggagagagcgacgggcctcggccctttgatgatagcacatggcgcaggacccttgtcctggtggcacaagggatggggacgcgagggggaggggaggcgaggaacaaggagaaggggcaactttccttaactggcagttgagcacatagtacatttcccctctaccaaacggaacacttggattccatctcttctctgaggagctcgacggcataaatcagaagcaagcacagagtttgtcaggtttgaagcccctatgatggtgtgtgtcaaatcagttgtagctaatctgtccagggagaatactggcttcattacacttgtacagccgagttcttcccgcattactgctgtttaatagaacgtgattagtcatcgccgagaagaaagcatattagccgaggaggtagtcacgcggcacgcgccggtgattgccacgatgtgattgcaatactcttagaagcaccatattatcccagacatgttctttcaagcccttggagccctctctaaattcactgtcatcatttagtatctgtttaatttttcagtccaaagagaggaaatcagtcgctgagtattatttgactccggtctccttggtgcaaaaacaaaatgggaaaaataaataagaataactcagaaactcaaaaggaaaccacaaattcagctaataatagcatttcgagtatatttcgtaaactaaggaaatacacaaaaggctgttttttccgactgtaagagatatttgatgtccttttgccgaggtggatgtgttagtctcaggccctcctggaccacgttgcccaagtcacacaggcttctgtgttatgtatttagataagatgtgtgaaaatatatttgaataaaagaagttcataaatatgcattgatttttgtacagacaaatggcacctctcttaatttataaattgaactggatgtgaactaataatgtgcaactagttgagataagagggttacagatcattgtacatggaaaatattcccagcagtaaacacttccattaatgtgatctacggcttttgaaaaggagcatctcagaataagatggtggtacaatttgcttattaaaattgagaaagaaaaaaaaagacacactggagtatattagaaaggaaaaagaaggaatgtggtctctcatgattgaaagcatgatttagatcggatacggcttttgctaaccaaggaccaagggactctggcaagatggggtggttttccgaatgccagaccgaggtgccttacgaaggcagctgccaatggttctgtggcacagactggctcctgagaacccagacgaccttgacctggcagcccggccctccacgctagtacctcgcctgattttccatcgttgcggtatccagccgcttcagacgtccgccgccttcagtggtggtagtcaaatgtagtcaaccaaaccacagcatcccttaggttaaaagcaaacggggcagctttgcctagagctcattgacagtgtgatggggggagaagggttgtcacaatggaagatgaggacactagactcatgtagcacagaaacatgaagccacacgcaccggcagcctccggggtgttcctcgctctctcgtatgttaaaccttatattttataagagtttttcctcttatttcactttttaaaaaaaattaaagtaggtggggaaaaaaataaagctttacacagaatttatatgtgggtaagtgtttcatggaaatttctaatcttaacgaagctaagtggagctcactcgtatccaaaagtataacaggtgcagaagccacaagtctgagaaccttgacgacagttccatcgtcctgccatattgatttttcagtctgcgtttcatcactgtgtagctattgtaaatgtgaatagaaaaaaacaggtcattgcctatttttgaagaacgcgttggtgttcgagtccactagacacactcgctccacacagccttcaccgtagactctgtagtggacacagatatagcataaatgaaattgttaaattatttcattgtagttaattcccactataggaatgctttatcatagtgaagtttcttttgagaagaaacggaactccttgaggcttctctttgggatgtatatgagcgtgtacatattattctatgtgtttataatataatattttcccaaatg

SEQ ID NO: 299291 - DNA, 3955 bp, Homo sapiens
cttttccacagggcagtgccattcctaggggaagtgaggtcagcacgccattgtcacccctgtgtgacaatggcgtgctgacctatcatcccagtttacatgattacatgcagaatgttcatggtaaggagattgaccttctgagaaccactgtgaaagtcccagggaagaggccaccccgagccacgtcagcctgcgcacccatctccagccctaaaaccaatggcctatccaaggacatgagcagtttacacatctcacccaattcagggaatgtcactagtgcatctgggtctcagatggcaagcggcatcagcctggtctccttcaacagccgacccgacggcatgcaccagcgctcctactcagtctccagtgccgaccagtggagtgaggctacggtcattgcaaactcggccatcagcagtgacacagggctgggtgactccgtatgctccagccccagtatctccagcaccaccagccccaagctcgacccgcccccctcccctcacgccaacagaaagaagcaccgaaggaagaaaagcactagcaacttcaaagccgacggcctgtccggcactgctgaagaacaagaagaaaattttgagtttatcattgtgtccctcactggccaaacatggcactttgaagccacgacgtatgaggagcgggacgcctgggtccaagccatcgagagccagatcctggccagcctgcagtcgtgcgagagcagcaagaacaagtcccggctgacgagccagagcgaggccatggccctgcagtcgatccggaacatgcgcgggaactcccactgtgtggactgcgagacccagaatcccaactgggccagtttgaacttgggagccctcatgtgcatcgaatgctcagggatccaccggaatcttggcacccacctttcccgagtccgatctctggacctggatgactggccaatcgagctcatcaaggtgatgtcatccatcgggaacgagctagccaacagcgtctgggaagagagcagccaggggcggacgaaaccatcggtagactccacaagggaagagaaggaacggtggatccgtgccaagtacgagcagaagctcttcctggccccgctgccctgcacggagctgtccctgggccagcacctgctgcgggccaccgccgacgaggacctgcggacggccatcctgctgctggcacacggctcccgggacgaggtgaacgagacctgcggggagggagacggccgcacggcgctgcatctggcctgccgcaaggggaatgtggtcctggcgcagctcctgatctggtacggagtggacgtcacggcccgagatgcccacgggaacacagctctggcctacgcccggcaggcctccagccaggagtgcatcgacgtgctgctgcagtacggctgccccgacgagcgcttcgtgctcatggccacccctaacctgtccaggagaaacaataaccggaacaacagcagtgggagggtgcccaccatcatctgaggaacagccgtgcccgcctgctcgccgcacctgggacgcggcagcctcgccgcattctcgctcagaagtcgcagcacgtgagtcccgtcgcatcccctccctcttcctggtggccacctccctcccgcccacccactctcaccccaaacaaaatcacaaaacctggacatccctcaaggggcgaagaggcggccgggagactgcagaagtggctccttttcataaactcccctaaaccacacacaggagagagcgacgggcctcggccctttgatgatagcacatggcgcaggacccttgtcctggtggcacaagggatggggacgcgagggggaggggaggcgaggaacaaggagaaggggcaactttccttaactggcagttgagcacatagtacatttcccctctaccaaacggaacacttggattccatctcttctctgaggagctcgacggcataaatcagaagcaagcacagagtttgtcaggtttgaagcccctatgatggtgtgtgtcaaatcagttgtagctaatctgtccagggagaatactggcttcattacacttgtacagccgagttcttcccgcattactgctgtttaatagaacgtgattagtcatcgccgagaagaaagcatattagccgaggaggtagtcacgcggcacgcgccggtgattgccacgatgtgattgcaatactcttagaagcaccatattatcccagacatgttctttcaagcccttggagccctctctaaattcactgtcatcatttagtatctgtttaatttttcagtccaaagagaggaaatcagtcgctgagtattatttgactccggtctccttggtgcaaaaacaaaatgggaaaaataaataagaataactcagaaactcaaaaggaaaccacaaattcagctaataatagcatttcgagtatatttcgtaaactaaggaaatacacaaaaggctgttttttccgactgtaagagatatttgatgtccttttgccgaggtggatgtgttagtctcaggccctcctggaccacgttgcccaagtcacacaggcttctgtgttatgtatttagataagatgtgtgaaaatatatttgaataaaagaagttcataaatatgcattgatttttgtacagacaaatggcacctctcttaatttataaattgaactggatgtgaactaataatgtgcaactagttgagataagagggttacagatcattgtacatggaaaatattcccagcagtaaacacttccattaatgtgatctacggcttttgaaaaggagcatctcagaataagatggtggtacaatttgcttattaaaattgagaaagaaaaaaaaagacacactggagtatattagaaaggaaaaagaaggaatgtggtctctcatgattgaaagcatgatttagatcggatacggcttttgctaaccaaggaccaagggactctggcaagatggggtggttttccgaatgccagaccgaggtgccttacgaaggcagctgccaatggttctgtggcacagactggctcctgagaacccagacgaccttgacctggcagcccggccctccacgctagtacctcgcctgattttccatcgttgcggtatccagccgcttcagacgtccgccgccttcagtggtggtagtcaaatgtagtcaaccaaaccacagcatcccttaggttaaaagcaaacggggcagctttgcctagagctcattgacagtgtgatggggggagaagggttgtcacaatggaagatgaggacactagactcatgtagcacagaaacatgaagccacacgcaccggcagcctccggggtgttcctcgctctctcgtatgttaaaccttatattttataagagtttttcctcttatttcactttttaaaaaaaattaaagtaggtggggaaaaaaataaagctttacacagaatttatatgtgggtaagtgtttcatggaaatttctaatcttaacgaagctaagtggagctcactcgtatccaaaagtataacaggtgcagaagccacaagtctgagaaccttgacgacagttccatcgtcctgccatattgatttttcagtctgcgtttcatcactgtgtagctattgtaaatgtgaatagaaaaaaacaggtcattgcctatttttgaagaacgcgttggtgttcgagtccactagacacactcgctccacacagccttcaccgtagactctgtagtggacacagatatagcataaatgaaattgttaaattatttcattgtagttaattcccactataggaatgctttatcatagtgaagtttcttttgagaagaaacggaactccttgaggcttctctttgggatgtatatgagcgtgtacatattattctatgtgtttataatataatattttcccaaatg

SEQ ID NO: 299292 - DNA, 3229 bp, Homo sapiens
ggcgctcggagcgggctccgcggcttgcaaggcgcctgcgactcggtcccaggtcggcgggcggcgcgcggcgggctcgcgcgggggccccggcgcgccgggcggcgcagtacgcagcgcgcggacccacgccacggccaggagcccagagcagcgcggccacactgcccaggggtcggccctcggccccggcgctcggagcgcggcggctgcctgggctttaatggctgctccgcggagcagcgcctagggctggaaggcggctgcggctcaggaagtcacccgagcaagcctccttcggggccggccgcacccgccgcggcgcgctccatgggggcgcgctccccccgggcggcccgctgacccgggacgccggggcccgctcgctcgccggccgcgcgtcccggccatgaactgagcccgcgggccagccccgcgcctgctccgcccgcgcctttcttctcgcgcctcctccgcccgccgccggcgggcccggctccccgggggctgcggcgccccgggctcggcggcccgcgggccccggggcgcggggcggcggcggcggggggcgcgcggctccgggcgcggcgcctgcaccatgaactaccagcagcagctggccaactcggctgccatccgggccgagatccagcgcttcgagtcggtccaccccaacatctactccatctacgagctgctggagcgcgtggaggagccggtgctgcagaaccagatccgggagcacgtcatcgccatcgaagatgccttcgtgaacagccaggaatggacgctgagtcgatctgtcccggagctcaaagtgggaattgtgggtaacttggccagcggcaagtctgccctggtgcaccggtacctgacgggcacatatgtccaggaggagtctccggaaggtggcaggttcaagaaagagattgtcgttgatggacagagctatctgctgctgatcagagatgaagggggccccccggaggcgcagtttgccatgtgggtggacgctgttatatttgtcttcagcttggaggatgaaataagtttccagaccgtttaccactactacagtcgaatggccaactatcggaacacgagcgagattcctctggttctggtgggaacccaggatgccataagttctgctaacccgagggtcatcgatgacgccagggcgaggaagctctccaacgacctgaaacggtgcacgtactacgagacgtgtgctacatacgggctgaatgtggagagggtcttccaggacgttgcccagaagattgttgccacaaggaagaagcagcagctgtccataggaccctgcaagtcgctacctaattctcccagccattcctccgtctgttccgcgcaggtgtctgccgtgcacatcagccagacaagtaatggaggtgggagtttaagcgactattcctcctccgttccatcgactcccagcaccagccagaaggaacttcggatcgatgttcctcccactgccaacacgcccacgcccgttcgcaagcagtctaagcgccggtccaacctgttcacctctcggaaagggagcgacccagacaaagagaagaaaggcctggagagtcgtgcggacagcattgggagcggccgagccatcccaattaaacagggcatgctgttgaagcgaagtggcaaatcgttgaataaagagtggaaaaagaaatatgtcaccctgtgtgacaatggcgtgctgacctatcatcccagtttacatgattacatgcagaatgttcatggtaaggagattgaccttctgagaaccactgtgaaagtcccagggaagaggccaccccgagccacgtcagcctgcgcacccatctccagccctaaaaccaatggcctatccaaggacatgagcagtttacacatctcacccaattcagggaatgtcactagtgcatctgggtctcagatggcaagcggcatcagcctggtctccttcaacagccgacccgacggcatgcaccagcgctcctactcagtctccagtgccgaccagtggagtgaggctacggtcattgcaaactcggccatcagcagtgacacagggctgggtgactccgtatgctccagccccagtatctccagcaccaccagccccaagctcgacccgcccccctcccctcacgccaacagaaagaagcaccgaaggaagaaaagcactagcaacttcaaagccgacggcctgtccggcactgctgaagaacaagaagaaaattttgagtttatcattgtgtccctcactggccaaacatggcactttgaagccacgacgtatgaggagcgggacgcctgggtccaagccatcgagagccagatcctggccagcctgcagtcgtgcgagagcagcaagaacaagtcccggctgacgagccagagcgaggccatggccctgcagtcgatccggaacatgcgcgggaactcccactgtgtggactgcgagacccagaatcccaactgggccagtttgaacttgggagccctcatgtgcatcgaatgctcagggatccaccggaatcttggcacccacctttcccgagtccgatctctggacctggatgactggccaatcgagctcatcaaggtgatgtcatccatcgggaacgagctagccaacagcgtctgggaagagagcagccaggggcggacgaaaccatcggtagactccacaaggtaggaactttggaagatgcctggctcccgacacgtttgccaacagttaggcaactggaagtgatcataatgacagccacggttgggaaggccctgataacctgtaggaattcgggaattccgattcatccggcataggaatgtctgtgtttaaagttggtcttgagcagacgtggataattcacactccttaattttttatgtttgtttttaggcctggggatttctctcccccctcttagaaatgtattaagcttctaaccttatgaatatattactttaattaatacatttctaataggcataagctgtgccgttaacactaattatgaatttttgatcctttaattttgttattcttatagcttggataagcatctgctctgtcgatcccccccccgcaccatcacacaaaagttatttttatggtaacaaaatctattttattttctaaaatatatctcaacacatttagtcaaccaagttcagcataatgtatgatgtaactcctcattaa

SEQ ID NO: 299293 - DNA, 2003 bp, Homo sapiens
  misc_feature (2001)..(2001): n is a, c, g, or t
  misc_feature (2003)..(2003): n is a, c, g, or t
ggcgctcggagcgggctccgcggcttgcaaggcgcctgcgactcggtcccaggtcggcgggcggcgcgcggcgggctcgcgcgggggccccggcgcgccgggcggcgcagtacgcagcgcgcggacccacgccacggccaggagcccagagcagcgcggccacactgcccaggggtcggccctcggccccggcgctcggagcgcggcggctgcctgggctttaatggctgctccgcggagcagcgcctagggctggaaggcggctgcggctcaggaagtcacccgagcaagcctccttcggggccggccgcacccgccgcggcgcgctccatgggggcgcgctccccccgggcggcccgctgacccgggacgccggggcccgctcgctcgccggccgcgcgtcccggccatgaactgagcccgcgggccagccccgcgcctgctccgcccgcgcctttcttctcgcgcctcctccgcccgccgccggcgggcccggctccccgggggctgcggcgccccgggctcggcggcccgcgggccccggggcgcggggcggcggcggcggggggcgcgcggctccgggcgcggcgcctgcaccatgaactaccagcagcagctggccaactcggctgccatccgggccgagatccagcgcttcgagtcggtccaccccaacatctactccatctacgagctgctggagcgcgtggaggagccggtgctgcagaaccagatccgggagcacgtcatcgccatcgaagatgccttcgtgaacagccaggaatggacgctgagtcgatctgtcccggagctcaaagtgggaattgtgggtaacttggccagcggcaagtctgccctggtgcaccggtacctgacgggcacatatgtccaggaggagtctccggaaggtggcaggttcaagaaagagattgtcgttgatggacagagctatctgctgctgatcagagatgaagggggccccccggaggcgcagtttgccatgtgggtggacgctgttatatttgtcttcagcttggaggatgaaataagtttccagaccgtttaccactactacagtcgaatggccaactatcggaacacgagcgagattcctctggttctggtgggaacccaggatgccataagttctgctaacccgagggtcatcgatgacgccagggcgaggaagctctccaacgacctgaaacggtgcacgtactacgagacgtgtgctacatacgggctgaatgtggagagggtcttccaggacgttgcccagaagattgttgccacaaggaagaagcagcagctgtccataggaccctgcaagtcgctacctaattctcccagccattcctccgtctgttccgcgcaggtgtctgccgtgcacatcagccagacaagtaatggaggtgggagtttaagcgactattcctcctccgttccatcgactcccagcaccagccagaaggaacttcggatcgatgttcctcccactgccaacacgcccacgcccgttcgcaagcagtctaagcgccggtccaacctgttcacctctcggaaagggagcgacccagacaaagagaagaaaggcctggagagtcgtgcggacagcattgggagcggccgagccatcccaattaaacagggcatgctgttgaagcgaagtggcaaatcgttgaataaagagtggaaaaagaaatatgtcaccctgtgtgacaatggcgtgctgacctatcatcccagtttacatgacactgccggatgtcatggtacgagatggccttctgggacactgggaaggtccagaagaggcacgagcactttactgggcacctttcagagctaaacatgcgcttcgctgttctctattttaatcctggaggcaagctcggtcaaggaggaccgtctaaggcgaggacagctaaccagtggagggggggaagcacaaggggtgcgcgccaacagcccaaagaagcgggtcgggagtgttgccgcggngn

SEQ ID NO: 299294 - DNA, 186 bp, Homo sapiens
cactgtgccgttactttttggtcttctgttccagatgccataagttctgctaacccgagggtcatcgatgacgccagggcgaggaagctctccaacgacctgaaacggtgcacgtactacgagacgtgtgctacatacgggctgaatgtggagagggtcttccaggacggtaaatgcgcgtggctg

SEQ ID NO: 299295 - DNA, 597 bp, Homo sapiens
cctgcccagcagcttaagtcctaaaacttccctggactaagcttaccctaggttctttcccaccttccccttctgactgccccagggagtggccaaacccaggggccaggctcacaaaaccatgaaggatttctaaagacactttagatgctcttaatgaaatataaagtgtgctcccaggatacaaatacaggacaggaattactgaggaccggtaaatctaatacttccctccctgacatcacttgtagttccaggccagcaaaagtctgacaatgtgcttaagccaaattcagaagtgtagctgaggccgggcacggtggctcacatttgtaatcccagcatcttcggaggccaaagggagtggaatacttgaggcaggagttaccagcctgaccaacatgatgaaaactcatatctactaaaaatacaaaaatgcatcaggtgtggtagtgtgactgtaatcccagctacttgggacgctgaggcatgagaattgcttgaacccgggagagggaggttgcagtgagctgagaccatgccactgcaatccagcctgggtaacagagtgacactctgtctttcaaaaaaaaaaaa

SEQ ID NO: 299296 - DNA, 177 bp, Homo sapiens
tgccgagcagagactggtttggaggggaggtgaccacatgaagaatccataaaatcctgactgagtatccccctctgtgacagacctgaagtggggaactgagaaacaacagagcccccacaaggagtgcaccttccagccttgaagaaagtggggaacagtgggcggggcacgaca

SEQ ID NO: 299297 - DNA, 821 bp, Homo sapiens
  misc_feature (475)..(475): n is a, c, g, or t
  misc_feature (785)..(785): n is a, c, g, or t
aaggaaaataaaggagacttgaaatttttgaactaaatagtggtgatggctacacattgtgaatgtaattaacaccactgagttaaacacttaaaatggttaaaatggcaaattgtatgttatacctattttactacaataaaaagtataaaaaagagaagatatttaggtgacttacagcaaccaattgcaacaaaacaaaatgttaagaaatgatctttttatgaggcaattggaaatttgaacactgatcaactataggatgattggaattattaatttttaaaggtgtgataagatactgcacttggctgggcacagtggcacatgcctgtaatcccagctaacagtcggcacgactctaaagcgtcgtgcgaggcaattcgacgtgggagtctctatggcgtttcgacgactcccccactgagtctacgatgtacgaagagtctcccagtcgtataccacccagctcttncaggatcttcactaattaatagagtatctgcaccacgcgacagtaagctgcccaaactcgtgagtcagcagctactattacgtgcgaacacaaggtacgcgtaaagatctacggagagaatcgagagtatggcaatgacccaagtctgcgccgaaacatggagcacaatgtaccgctctggcgacagcagagcagatagcgaagaacacgagcatgtagcaactagtggacacacgcacgagagtatgaccggacaccagtcgagagcgacttgaggtacacgagcagtatgactggacagacctatganatacgtgcctggtcctgaaacacatgggaagcttac

SEQ ID NO: 299298 - DNA, 4045 bp, Homo sapiens
tccgggcttgcggccgggcggcgcagaggcgcggaggctccccgggcggctgcatcccggggctgccccggacatgccccgcaccccttgtcggacgcccgcgccgcttcaccggctgccactccccggagtgctctgggactagagcgccctccgccccaacttctgactttggggtcccccagccctagaggaacgggcgcccggctgggggagccccgggcatggtgtgacggggcagtcaggtcagctttgcggcgcccccaaactccagccacccgtcgtctccgtgccctccagaatgtagctgctgaccccgcgccccccggactccagcagcagtctccgccacctccgggctccagcagccaactcttgtgtctctcaggaacccgccgacgtctccgcgtcccccggattccaggttcgcgacccccgccgtcttcgcgcctccgggactctagcagcggtctccgcgaccccctaggatccagccactgtacccgtgctccccaaacccaggctccagccgtcgtctccgcgctcccggggatccagctgtcgcgccagtacccgcgaggacagcggcaccgcccacaccccgcgcgctcagagcccggccgggcctcggcgtggagatgaacgcgccgctggacggcctgtcggtgagctcgtcctccaccggctcgctgggctcggcggccggggcgggcggcggcgggggcgcggggctgcggttactgtctgccaacgtgcgccagctgcaccaagcgctgaccgcgctgctgagcgaggcggagcgggagcagttcacccactgcctgaacgcttaccacgcgcgccgcaacgtcttcgacctggtgcgcaccctgcgcgtgctgctggacagtccggtcaagcggcgcctgctgcccatgcttcgtctggtcatcccgcgctccgaccagctgctcttcgaccaatacacggccgagggcctctacctgcccgccaccaccccctacaggcagcccgcctggggcggccccgacagcgcggggccaggggaggtgcgcctggtgagtttgcggcgtgccaaggcccacgagggcttgggcttcagcatccgtgggggctcggagcacggcgtgggcatctacgtgtctctggtggaaccaggctctctagctgagaaggaaggactgcgggtcggggaccagattctgcgcgtcaacgacaaatccctggcccgggtgacccacgcggaggccgtcaaggctctgaagggctccaagaagctggtgctgtctgtgtactcagcagggcgcatccctgggggctacgtcaccaaccacatctacacctgggtggacccgcagggccgcagcatctccccaccctcgggcctgccccagccccacggtggtgccctgaggcagcaggagggtgaccggaggagcaccctgcacctcctgcaaggaggggatgagaaaaaggtgaacctggtgctgggggacggccggtccctgggcctcacgatccgtgggggagctgagtacggccttggcatttacatcactggcgtggacccaggctctgaagcagaaggcagcgggctcaaggttggggaccagattctagaagtgaatgggcggagctttctcaacatcctacacgacgaggctgtcaggctgcttaagtcatctcggcacctcatcctgacagtgaaggacgtcgggaggctgccccatgcccgcaccattgtggacgagaccaagtggatcgccagttcccggatcagggagaccatggcgaactcggcagggtttcttggcgatctcacaacagaaggaataaacaagccaggattttacaagggcccagccggctcccaggtgaccctgagcagcctggggaaccagacacgagtgctgctggaggagcaggctcggcacctgctgaacgagcaggaacacgccaccatggcctactacctggatgagtaccgtggcggcagcgtctctgtggaggccctcgtcatggccctgttcaagctgctcaacacccacgccaagttctcactcctctctgaggtgagaggcaccatttccccgcaagacctagaacgcttcgaccacctggtgctgaggcgtgagattgagtccatgaaggcgcggcagcccccaggccccggggctggggacacctactccatggtctcctacagtgacacgggttcatccacaggcagccacggcacctccaccaccgtcagctcggccaggaacactctggacctggaggaaactggcgaggctgtccagggcaatatcaacgccctcccagatgtgtccgtggatgatgtcagatccacctcccaggggctgtcaagcttcaagccactgcctcgcccaccacctctggcccaaggcaacgacctcccactaggccagccaaggaagctggggagagaggacctccagccaccttcctccatgccttcctgctcgggcactgtcttctcggctccacagaaccgcagcccgccagcgggcaccgcacccaccccagggacctcctctgcacaggacttgccctcttcccccatctatgcctccgtctcccctgccaaccccagctccaagaggccgctggacgcccatctggccctggtcaaccaacaccccatcggccccttcccacgggtccagtcacccccgcacctgaaaagcccctctgcagaggccacagtggctgggggctgccttctgcccccatcaccctctggccacccagaccagacaggcacaaaccagcactttgtcatggtggaggtccaccgccccgacagcgagccagacgtcaatgaagtgagggcgctgccccagacgcgcacagcctctacgctctcccagctctcggacagcgggcagactctaagcgaggacagtggtgtggatgctggcgaggcagaggccagcgccccaggccgaggaaggcagtcggtgtccaccaagagcaggagtagcaaggagctgcctcggaacgagaggcccacagatggggccaacaaaccgcctggacttctggagcccacgtccactctggtccgtgtgaagaaaagtgcggccaccctgggcatcgccatcgagggtggcgccaacacccgccagcccctgcctaggattgtcactattcagagaggcggctcagctcacaactgtgggcagctcaaggtgggccacgtgattctggaagtgaatgggctgacgcttcggggcaaggagcaccgggaggccgcccgcattatcgccgaggccttcaagactaaggaccgtgactacattgactttctggtcactgagttcaatgtgatgctctagaggccaaggcctgagggcctcccaccactgcccagcccctggtcccagtccctttccaccgttggcttcatcaagctccttgcggggttggggctgcatggccagggtggcaggaagacatcccccctccatcccagcccactggaccagaactgggagaggaagagagcaggacaaggcagacagaaggtcaggtcaggaactggtgctgtactgggtacacagtaggcgcccaggacaagtgggttgcaagacaggaagaaaggaaaaggaagggcagagtgctggtttctccaggttgggttgggggcactgctgtcccccctccagctaggacccagcccatccccagatgcctgagcctttgtccaaagtgaggtcactcgagaattcatggacacggcccccagtcagggggcatcttgcaagacctttagtgccacaaataagcatcgagcacctccccattcacacccccattcctcctggctccttatcccccatggtgtttattatttatttccctccccatgcccctggggaccccaaggccccagcttccctctgcacccccagcctatcccagaggccttgcaggtgaccagcagtgtcattgtatttatatacagagcttatgactttaatttttcaataaagaaatctgaacaaggttaaaaaaaagc

SEQ ID NO: 299299 - DNA, 2776 bp, Homo sapiens
tagtattaaacattttcaaagttacttgccaacatctagaaagataccaggttttctataaaaaagaaaactggatttctggatgcttcttaaaaatcaggaagtctggcagcctgagcccacatcggctggagctgagccgcacctgcgagttgcatctgggatctccagttcaccggcccctaagctcctgagggttggcctgaccctgaggttgcctgtcaatcaccatttcttccctccactccttgtgttacctgcctggtcctgcggggttggcaacaactcaggagcccacctcgggtggttttggaggtgccgtgcacactgctgattgggaggctggacgctgccagtctgtccggagtttcctttacccctgagtagcccccagactgaactggcagcgagtggaggccacgatgcatggttctcttgaagctttgctcttcctgccccaagtcaccctgtcccttgcccacgcccatttgatctgctcaaatgcacaactggagatgtgtgtctttccccacaggtttcttggcgatctcacaacagaaggaataaacaagccaggattttacaagggcccagccggctcccaggtgaccctgagcagcctggggaaccagacacgagtgctgctggaggagcaggctcggcacctgctgaacgagcaggaacacgccaccatggcctactacctggatgagtaccgtggcggcagcgtctctgtggaggccctcgtcatggccctgttcaagctgctcaacacccacgccaagttctcactcctctctgaggtgagaggcaccatttccccgcaagacctagaacgcttcgaccacctggtgctgaggcgtgagattgagtccatgaaggcgcggcagcccccaggccccggggctggggacacctactccatggtctcctacagtgacacgggttcatccacaggcagccacggcacctccaccaccgtcagctcggccaggaacactctggacctggaggaaactggcgaggctgtccagggcaatatcaacgccctcccagatgtgtccgtggatgatgtcagatccacctcccaggggctgtcaagcttcaagccactgcctcgcccaccacctctggcccaaggcaacgacctcccactaggccagccaaggaagctggggagagaggacctccagccaccttcctccatgccttcctgctcgggcactgtcttctcggctccacagaaccgcagcccgccagcgggcaccgcacccaccccagggacctcctctgcacaggacttgccctcttcccccatctatgcctccgtctcccctgccaaccccagctccaagaggccgctggacgcccatctggccctggtcaaccaacaccccatcggccccttcccacgggtccagtcacccccgcacctgaaaagcccctctgcagaggccacagtggctgggggctgccttctgcccccatcaccctctggccacccagaccagacaggcacaaaccagcactttgtcatggtggaggtccaccgccccgacagcgagccagacgtcaatgaagtgagggcgctgccccagacgcgcacagcctctacgctctcccagctctcggacagcgggcagactctaagcgaggacagtggtgtggatgctggcgaggcagaggccagcgccccaggccgaggaaggcagtcggtgtccaccaagagcaggagtagcaaggagctgcctcggaacgagaggcccacagatggggccaacaaaccgcctggacttctggagcccacgtccactctggtccgtgtgaagaaaagtgcggccaccctgggcatcgccatcgagggtggcgccaacacccgccagcccctgcctaggattgtcactattcagagaggcggctcagctcacaactgtgggcagctcaaggtgggccacgtgattctggaagtgaatgggctgacgcttcggggcaaggagcaccgggaggccgcccgcattatcgccgaggccttcaagactaaggaccgtgactacattgactttctggtcactgagttcaatgtgatgctctagaggccaaggcctgagggcctcccaccactgcccagcccctggtcccagtccctttccaccgttggcttcatcaagctccttgcggggttggggctgcatggccagggtggcaggaagacatcccccctccatcccagcccactggaccagaactgggagaggaagagagcaggacaaggcagacagaaggtcaggtcaggaactggtgctgtactgggtacacagtaggcgcccaggacaagtgggttgcaagacaggaagaaaggaaaaggaagggcagagtgctggtttctccaggttgggttgggggcactgctgtcccccctccagctaggacccagcccatccccagatgcctgagcctttgtccaaagtgaggtcactcgagaattcatggacacggcccccagtcagggggcatcttgcaagacctttagtgccacaaataagcatcgagcacctccccattcacacccccattcctcctggctccttatcccccatggtgtttattatttatttccctccccatgcccctggggaccccaaggccccagcttccctctgcacccccagcctatcccagaggccttgcaggtgaccagcagtgtcattgtatttatatacagagcttatgactttaatttttcaataaagaaatctgaacaaggttaaaaaaaagc

SEQ ID NO: 299300 - DNA, 2856 bp, Homo sapiens
gaaactcctaggcagcagaggcccacgactacttcctcctgagtgccgttcagtggcctgtgtccaggctctgaagggctccaagaagctggtgctgtctgtgtactcagcagggcgcatccctgggggctacgtcaccaaccacatctacacctgggtggacccgcagggccgcagcatctccccaccctcgggcctgccccagccccacggtggtgccctgaggcagcaggagggtgaccggaggagcaccctgcacctcctgcaaggaggggatgagaaaaaggtgaacctggtgctgggggacggccggtccctgggcctcacgatccgtgggggagctgagtacggccttggcatttacatcactggcgtggacccaggctctgaagcagaaggcagcgggctcaaggttggggaccagattctagaagtgaatgggcggagctttctcaacatcctacacgacgaggctgtcaggctgcttaagtcatctcggcacctcatcctgacagtgaaggacgtcgggaggctgccccatgcccgcaccattgtggacgagaccaagtggatcgccagttcccggatcagggagaccatggcgaactcggcagggtttcttggcgatctcacaacagaaggaataaacaagccaggattttacaagggcccagccggctcccaggtgaccctgagcagcctggggaaccagacacgagtgctgctggaggagcaggctcggcacctgctgaacgagcaggaacacgccaccatggcctactacctggatgagtaccgtggcggcagcgtctctgtggaggccctcgtcatggccctgttcaagctgctcaacacccacgccaagttctcactcctctctgaggtgagaggcaccatttccccgcaagacctagaacgcttcgaccacctggtgctgaggcgtgagattgagtccatgaaggcgcggcagcccccaggccccggggctggggacacctactccatggtctcctacagtgacacgggttcatccacaggcagccacggcacctccaccaccgtcagctcggccaggaacactctggacctggaggaaactggcgaggctgtccagggcaatatcaacgccctcccagatgtgtccgtggatgatgtcagatccacctcccaggggctgtcaagcttcaagccactgcctcgcccaccacctctggcccaaggcaacgacctcccactaggccagccaaggaagctggggagagaggacctccagccaccttcctccatgccttcctgctcgggcactgtcttctcggctccacagaaccgcagcccgccagcgggcaccgcacccaccccagggacctcctctgcacaggacttgccctcttcccccatctatgcctccgtctcccctgccaaccccagctccaagaggccgctggacgcccatctggccctggtcaaccaacaccccatcggccccttcccacgggtccagtcacccccgcacctgaaaagcccctctgcagaggccacagtggctgggggctgccttctgcccccatcaccctctggccacccagaccagacaggcacaaaccagcactttgtcatggtggaggtccaccgccccgacagcgagccagacgtcaatgaagtgagggcgctgccccagacgcgcacagcctctacgctctcccagctctcggacagcgggcagactctaagcgaggacagtggtgtggatgctggcgaggcagaggccagcgccccaggccgaggaaggcagtcggtgtccaccaagagcaggagtagcaaggagctgcctcggaacgagaggcccacagatggggccaacaaaccgcctggacttctggagcccacgtccactctggtccgtgtgaagaaaagtgcggccaccctgggcatcgccatcgagggtggcgccaacacccgccagcccctgcctaggattgtcactattcagagaggcggctcagctcacaactgtgggcagctcaaggtgggccacgtgattctggaagtgaatgggctgacgcttcggggcaaggagcaccgggaggccgcccgcattatcgccgaggccttcaagactaaggaccgtgactacattgactttctggtcactgagttcaatgtgatgctctagaggccaaggcctgagggcctcccaccactgcccagcccctggtcccagtccctttccaccgttggcttcatcaagctccttgcggggttggggctgcatggccagggtggcaggaagacatcccccctccatcccagcccactggaccagaactgggagaggaagagagcaggacaaggcagacagaaggtcaggtcaggaactggtgctgtactgggtacacagtaggcgcccaggacaagtgggttgcaagacaggaagaaaggaaaaggaagggcagagtgctggtttctccaggttgggttgggggcactgctgtcccccctccagctaggacccagcccatccccagatgcctgagcctttgtccaaagtgaggtcactcgagaattcatggacacggcccccagtcagggggcatcttgcaagacctttagtgccacaaataagcatcgagcacctccccattcacacccccattcctcctggctccttatcccccatggtgtttattatttatttccctccccatgcccctggggaccccaaggccccagcttccctctgcacccccagcctatcccagaggccttgcaggtgaccagcagtgtcattgtatttatatacagagcttatgactttaatttttcaataaagaaatctgaacaaggttaaaaaaaagc

SEQ ID NO: 299301 - DNA, 384 bp, Homo sapiens
ttgtcgtctagaggatccctcacgccatgtcacaaccttgagcaccctgcacctcctgcaaggaggggatgagaaaaaggtgaacctggtgctgggggacggccggtccctgggcctcacgatccgtgggggagctgagtacggccttggcatttacatcactggcgtggacccaggctctgaagcagaaggcagcgggctcaaggttggggaccagattctagaagtgaatgggcggagctttctcaacatcctacacgacgaggctgtcaggctgcttaagtcatctcggcacctcatcctgacagtgaaggacgtcgggaggctgccccatgcccgcaccattgtgacatggcgtgagggatcctctagatcaccacacat

SEQ ID NO: 299302 - DNA, 1682 bp, Homo sapiens
tccgggcttgcggccgggcggcgcagaggcgcggaggctccccgggcggctgcatcccggggctgccccggacatgccccgcaccccttgtcggacgcccgcgccgcttcaccggctgccactccccggagtgctctgggactagagcgccctccgccccaacttctgactttggggtcccccagccctagaggaacgggcgcccggctgggggagccccgggcatggtgtgacggggcagtcaggtcagctttgcggcgcccccaaactccagccacccgtcgtctccgtgccctccagaatgtagctgctgaccccgcgccccccggactccagcagcagtctccgccacctccgggctccagcagccaactcttgtgtctctcaggaacccgccgacgtctccgcgtcccccggattccaggttcgcgacccccgccgtcttcgcgcctccgggactctagcagcggtctccgcgaccccctaggatccagccactgtacccgtgctccccaaacccaggctccagccgtcgtctccgcgctcccggggatccagctgtcgcgccagtacccgcgaggacagcggcaccgcccacaccccgcgcgctcagagcccggccgggcctcggcgtggagatgaacgcgccgctggacggcctgtcggtgagctcgtcctccaccggctcgctgggctcggcggccggggcgggcggcggcgggggcgcggggctgcggttactgtctgccaacgtgcgccagctgcaccaagcgctgaccgcgctgctgagcgaggcggagcgggagcagttcacccactgcctgaacgcttaccacgcgcgccgcaacgtcttcgacctggtgcgcaccctgcgcgtgctgctggacagtccggtcaagcggcgcctgctgcccatgcttcgtctggtcatcccgcgctccgaccagctgctcttcgaccaatacacggccgagggcctctacctgcccgccaccaccccctacaggcagcccgcctggggcggccccgacagcgcggggccaggggaggtgcgcctggtgagtttgcggcgtgccaaggcccacgagggcttgggcttcagcatccgtgggggctcggagcacggcgtgggcatctacgtgtctctggtggaaccaggctctctagctgagaaggaaggactgcgggtcggggaccagattctgcgcgtcaacgacaaatccctggcccgggtgacccacgcggaggccgtcaaggctctgaagggctccaagaagctggtgctgtctgtgtactcagcagggcgcatccctgggggctacgtcaccaaccacatctacacctgggtggacccgcagggccgcagcatctccccaccctcgggcctgccccagccccacggtggtgccctgaggcagcaggagggtgaccggaggagcaccctgcacctcctgcaaggaggggatgagaaaaaggtgagtggggtggggaaaggaggccagcctctcagacaccgtattctccctccgaacccagaacagcagagctgcttggaggccgcaagaagaggctggttctgtccaggctctgtcttccctcaagtctgtactgaagggtggtgttttttctttgcttttctttttgacctgtgtagtgtatgttataatacaggctaagctgcc

SEQ ID NO: 299303 - DNA, 1405 bp, Homo sapiens
tccgggcttgcggccgggcggcgcagaggcgcggaggctccccgggcggctgcatcccggggctgccccggacatgccccgcaccccttgtcggacgcccgcgccgcttcaccggctgccactccccggagtgctctgggactagagcgccctccgccccaacttctgactttggggtcccccagccctagaggaacgggcgcccggctgggggagccccgggcatggtgtgacggggcagtcaggtcagctttgcggcgcccccaaactccagccacccgtcgtctccgtgccctccagaatgtagctgctgaccccgcgccccccggactccagcagcagtctccgccacctccgggctccagcagccaactcttgtgtctctcaggaacccgccgacgtctccgcgtcccccggattccaggttcgcgacccccgccgtcttcgcgcctccgggactctagcagcggtctccgcgaccccctaggatccagccactgtacccgtgctccccaaacccaggctccagccgtcgtctccgcgctcccggggatccagctgtcgcgccagtacccgcgaggacagcggcaccgcccacaccccgcgcgctcagagcccggccgggcctcggcgtggagatgaacgcgccgctggacggcctgtcggtgagctcgtcctccaccggctcgctgggctcggcggccggggcgggcggcggcgggggcgcggggctgcggttactgtctgccaacgtgcgccagctgcaccaagcgctgaccgcgctgctgagcgaggcggagcgggagcagttcacccactgcctgaacgcttaccacgcgcgccgcaacgtcttcgacctggtgcgcaccctgcgcgtgctgctggacagtccggtcaagcggcgcctgctgcccatgcttcgtctggtcatcccgcgctccgaccagctgctcttcgaccaatacacggccgagggcctctacctgcccgccaccaccccctacaggcagcccgcctggggcggccccgacagcgcggggccaggggaggtgcgcctggtgagtttgcggcgtgccaaggcccacgagggcttgggcttcagcatccgtgggggctcggagcacggcgtgggcatctacgtgtctctggtggaaccaggctctctagctgagaaggaaggactgcgggtcggggaccagattctgcgcgtcaacgacaaatccctggcccgggtgacccacgcggaggccgtcaaggttgtgtatcctgaagcaagtcacttgccctctcaggacctcttgttctccacttggaaaatggggccactggaccaaataagcggtccctaacctttttggaaatgagactcctgcctgaatgtaaaaaataaattccctagcccctg

SEQ ID NO: 299304 - DNA, 2649 bp, Homo sapiens
ttgtcgtctagaggatccctcacgccatgtcacaaccttgagcaccctgcacctcctgcaaggaggggatgagaaaaaggtgaacctggtgctgggggacggccggtccctgggcctcacgatccgtgggggagctgagtacggccttggcatttacatcactggcgtggacccaggctctgaagcagaaggcagcgggctcaaggttggggaccagattctagaagtgaatgggcggagctttctcaacatcctacacgacgaggctgtcaggctgcttaagtcatctcggcacctcatcctgacagtgaaggacgtcgggaggctgccccatgcccgcaccattgtggacgagaccaagtggatcgccagttcccggatcagggagaccatggcgaactcggcagggtttcttggcgatctcacaacagaaggaataaacaagccaggattttacaagggcccagccggctcccaggtgaccctgagcagcctggggaaccagacacgagtgctgctggaggagcaggctcggcacctgctgaacgagcaggaacacgccaccatggcctactacctggatgagtaccgtggcggcagcgtctctgtggaggccctcgtcatggccctgttcaagctgctcaacacccacgccaagttctcactcctctctgaggtgagaggcaccatttccccgcaagacctagaacgcttcgaccacctggtgctgaggcgtgagattgagtccatgaaggcgcggcagcccccaggccccggggctggggacacctactccatggtctcctacagtgacacgggttcatccacaggcagccacggcacctccaccaccgtcagctcggccaggaacactctggacctggaggaaactggcgaggctgtccagggcaatatcaacgccctcccagatgtgtccgtggatgatgtcagatccacctcccaggggctgtcaagcttcaagccactgcctcgcccaccacctctggcccaaggcaacgacctcccactaggccagccaaggaagctggggagagaggacctccagccaccttcctccatgccttcctgctcgggcactgtcttctcggctccacagaaccgcagcccgccagcgggcaccgcacccaccccagggacctcctctgcacaggacttgccctcttcccccatctatgcctccgtctcccctgccaaccccagctccaagaggccgctggacgcccatctggccctggtcaaccaacaccccatcggccccttcccacgggtccagtcacccccgcacctgaaaagcccctctgcagaggccacagtggctgggggctgccttctgcccccatcaccctctggccacccagaccagacaggcacaaaccagcactttgtcatggtggaggtccaccgccccgacagcgagccagacgtcaatgaagtgagggcgctgccccagacgcgcacagcctctacgctctcccagctctcggacagcgggcagactctaagcgaggacagtggtgtggatgctggcgaggcagaggccagcgccccaggccgaggaaggcagtcggtgtccaccaagagcaggagtagcaaggagctgcctcggaacgagaggcccacagatggggccaacaaaccgcctggacttctggagcccacgtccactctggtccgtgtgaagaaaagtgcggccaccctgggcatcgccatcgagggtggcgccaacacccgccagcccctgcctaggattgtcactattcagagaggcggctcagctcacaactgtgggcagctcaaggtgggccacgtgattctggaagtgaatgggctgacgcttcggggcaaggagcaccgggaggccgcccgcattatcgccgaggccttcaagactaaggaccgtgactacattgactttctggtcactgagttcaatgtgatgctctagaggccaaggcctgagggcctcccaccactgcccagcccctggtcccagtccctttccaccgttggcttcatcaagctccttgcggggttggggctgcatggccagggtggcaggaagacatcccccctccatcccagcccactggaccagaactgggagaggaagagagcaggacaaggcagacagaaggtcaggtcaggaactggtgctgtactgggtacacagtaggcgcccaggacaagtgggttgcaagacaggaagaaaggaaaaggaagggcagagtgctggtttctccaggttgggttgggggcactgctgtcccccctccagctaggacccagcccatccccagatgcctgagcctttgtccaaagtgaggtcactcgagaattcatggacacggcccccagtcagggggcatcttgcaagacctttagtgccacaaataagcatcgagcacctccccattcacacccccattcctcctggctccttatcccccatggtgtttattatttatttccctccccatgcccctggggaccccaaggccccagcttccctctgcacccccagcctatcccagaggccttgcaggtgaccagcagtgtcattgtatttatatacagagcttatgactttaatttttcaataaagaaatctgaacaaggttaaaaaaaagc

SEQ ID NO: 299305 - DNA, 932 bp, Homo sapiens
catcgagctcgcacccccgcagcacctccttgaaccgtagcacctccttggattgtcactattcagagaggcggctcagctcacaactgtgggcagctcaaggtgggccacgtgattctggaagtgaatgggctgacgcttcggggcaaggagcaccgggaggccgcccgcattatcgccgaggccttcaagactaaggaccgtgactacattgactttctggtcactgagttcaatgtgatgctctagaggccaaggcctgagggcctcccaccactgcccagcccctggtcccagtccctttccaccgttggcttcatcaagctccttgcggggttggggctgcatggccagggtggcaggaagacatcccccctccatcccagcccactggaccagaactgggagaggaagagagcaggacaaggcagacagaaggtcaggtcaggaactggtgctgtactgggtacacagtaggcgcccaggacaagtgggttgcaagacaggaagaaaggaaaaggaagggcagagtgctggtttctccaggttgggttgggggcactgctgtcccccctccagctaggacccagcccatccccagatgcctgagcctttgtccaaagtgaggtcactcgagaattcatggacacggcccccagtcagggggcatcttgcaagacctttagtgccacaaataagcatcgagcacctccccattcacacccccattcctcctggctccttatcccccatggtgtttattatttatttccctccccatgcccctggggaccccaaggccccagcttccctctgcacccccagcctatcccagaggccttgcaggtgaccagcagtgtcattgtatttatatacagagcttatgactttaatttttcaataaagaaatctgaacaaggttaaaaaaaagc

SEQ ID NO: 299306 - DNA, 1282 bp, Homo sapiens
ttgtcgtctagaggatccctcacgccatgtcacaaccttgagcaccctgcacctcctgcaaggaggggatgagaaaaaggtgaacctggtgctgggggacggccggtccctgggcctcacgatccgtgggggagctgagtacggccttggcatttacatcactggcgtggacccaggctctgaagcagaaggcagcgggctcaaggttggggaccagattctagaagtgaatgggcggagctttctcaacatcctacacgacgaggctgtcaggctgcttaagtcatctcggcacctcatcctgacagtgaaggacgtcgggaggctgccccatgcccgcaccattgtggacgagaccaagtggatcgccagttcccggatcagggagaccatggcgaactcggcagggtttcttggcgatctcacaacagaaggaataaacaagccaggattttacaagggcccagccggctcccaggtgaccctgagcagcctggggaaccagacacgagtgctgctggaggagcaggctcggcacctgctgaacgagcaggaacacgccaccatggcctactacctggatgagtaccgtggcggcagcgtctctgtggaggccctcgtcatggccctgttcaagctgctcaacacccacgccaagttctcactcctctctgaggtgagaggcaccatttccccgcaagacctagaacgcttcgaccacctggtgctgaggcgtgagattgagtccatgaaggcgcggcagcccccaggccccggggctggggacacctactccatggtctcctacagtgacacgggttcatccacaggcagccacggcacctccaccaccgtcagctcggccaggaacactctggacctggaggaaactggcgaggctgtccagggcaatatcaacgccctcccagatgtgtccgtggatgatgtcagatccacctcccaggggctgtcaagcttcaagccactgcctcgcccaccacctctggcccaaggcaacgacctcccactaggccagccaaggaagctggggagagaggacctccagccaccttcctccatgccttcctgctcgggcactgtcttctcggctccacagaaccgcagcccgccagcgggcaccgcacccaccccagggacctcctctgcacaggacttgcccctatcctgcgtcccgccttcgtcccccacgtgctacagagacagatccgctctctcactctcagcaaccgcatcaggtaccagctcgattcgtatatgtatc

SEQ ID NO: 299307 - DNA, 887 bp, Homo sapiens
ctcggcccgggtggctcaacagttcgcaaagtccgggcttgcggccgggcggcgcagaggcgcggaggctccccgggcggctgcatcccggggctgccccggacatgccccgcaccccttgtcggacgcccgcgccgcttcaccggctgccactccccggagtgctctgggactagagcgccctccgccccaacttctgactttggggtcccccagccctagaggaacgggcgcccggctgggggagccccgggcatggtgtgacggggcagtcaggtcagctttgcggcgcccccaaactccagccacccgtcgtctccgtgccctccagaatgtagctgctgaccccgcgccccccggactccagcagcagtctccgccacctccgggctccagcagccaactcttgtgtctctcaggaacccgccgacgtctccgcgtcccccggattccaggttcgcgacccccgccgtcttcgcgcctccgggactctagcagcggtctccgcgaccccctaggatccagccactgtacccgtgctccccaaacccaggctccagccgtcgtctccgcgctcccggggatccagctgtcgcgccagtacccgcgaggacagcggcaccgcccacaccccgcgcgctcagagcccggccgggcctcggcgtggagatgaacgcgccgctggacggcctgtcggtgagctcgtcctccaccggctcgctgggctcggcggccggggcgggcggcggcgggggcgcggggctgcggttactgtctgccaacgtgcgccagctgcaccaagcgctgaccgcgctgctgagcgaggcggagcgggagcagttcacccactgcctgaacgcttaccacgcgcgccgcaacgtcttcga

SEQ ID NO: 299308 - DNA, 2446 bp, Homo sapiens
tcctactggctaccagagcctctcagtcatcatactgagacttcagaaggccaaaattccctagatgttttcctctgtcccactaagagctagtttatggatatgatcatatcaggaagagactgagcctctcacaaagggtgacatgaaaggtgtaaagggatcagggcttcagttattctatatttcccaatctttgtgggaatctgttcctcaccatatcatcccacgcctttccatgggataatagggacctaacaaagcatgatatccttatttctcaccactaggacatcaaaggccagttctggaatgatgacgactcggagggagataatgaatcagaggaatttctctatggcgttcaggggagctgtgcagctgacctgtatcgacacccacagcttgatgcagacattgaagccgtgaaggagatctacagtgagaactctgtatccatcagagaatatggaactatcgatgacgtggacattgacctccacatcaacatcagcttcctcgatgaggaagtctctacagcctggaaggtcctccggacagaacctattgtgttgaggctgcgattttctctctcccagtacctagatggaccagaaccatccattgaggttttccagccatcaaataaggaaggatttgggctgggtcttcagttgaaaaagatcctgggtatgtttacatcccaacaatggaaacatctgagcaatgatttcttgaagacccagcaggagaagaggcacagttggttcaaggcaagtggtaccatcaagaagttccgagctggcctcagcatcttttcacccatccccaagtctcccagtttccctatcatacaggactccatgctgaaaggcaaactaggtgtaccagagcttcgggttgggcgcctcatgaaccgttccatctcctgtaccatgaagaaccccaaagtggaagtgtttggctaccctcccagcccccaggtcagtggtcactgcaagaacattcccactctggagtatggattcctcgttcagatcatgaagtatgcagaacagaggattccaacattgaatgagtactgtgtggtgtgtgatgagcagcatgtcttccaaaatggatctatgctgaagccagctgtctgtactcgtgaactatgcgttttctccttctacacactgggcgtcatgtctggagctgcagaggaggtggccactggagcagaggtggtggatctgctggtggccatgtgtagggcagctttagagtcccctagaaagagcatcatctttgagccttatccctctgtggtggaccccactgatcccaagactctggcctttaaccctaagaagaagaattatgagcggcttcagaaagctctggatagtgtgatgtctattcgggagatgacccagggctgtaggaattgcataaaatgagggagacccacctgcatgttgttttggctcatatttggaaatcaagaaacagatggacaagttggatcccctggcccatcctctcctgcagtggatcatctctagcaacaggtcacacattgtcaaactacctctcagcaggcagctgaagttcatgcacacctcacaccagttcctcctgctgagcagccctcctgccaaggaggctcggttccggaccgccaagaagctctatggcagcacctttgccttccatgggtcccacattgagaactggcattcgatcctgcgcaatgggctggtcaatgcatcctacaccaaactgcagctgcatggagcagcctatggcaaaggcatctacctgagccccatctccagtatttcctttggatactcaggaatgggaaaaggacagcacaggatgccctccaaggatgagctggtccagagatacaacaggatgaataccatcccccagacccgatccattcagtcacggttcctgcagagtcggaatctaaactgtatagcactttgtgaagtgattacatctaaggacctccagaagcatgggaacatctgggtgtgccctgtgtccgaccatgtctgcacaagattcttctttgtatatgaggatggtcaggtgggcgatgccaacattaatactcaggaccccaagatacagaaggaaatcatgcgtgtgatcggaactcaggtttacacaaactgagggggccccagccctcgtaccacccctgttaccccaggatccatctgccctcataaaagtgttcaggtacagcagctgaggctgccctgaggaatcaaggggccattaccaaggggcaggaaaaggatatgtaagaggtggccttcatggtagagcttgacccaagaactactccacattcggatggcccagactgactccatcccctgactttccctttgacttcaccctgtttgtaaataaaacaataaaatggaaggtgctgtggactgga

SEQ ID NO: 299309 - DNA, 662 bp, Homo sapiens
tcctactggctaccagagcctctcagtcatcatactgagacttcagaaggccaaaattccctagatgttttcctctgtcccactaagagctagtttatggatatgatcatatcaggaagagactgagcctctcacaaagggtgacatgaaaggtgtaaagggatcagggcttcagttattctatatttcccaatctttgtgggaatctgttcctcaccatatcatcccacgcctttccatgggataatagggacctaacaaagcatgatatccttatttctcaccactaggacatcaaaggccagttctggaatgatgacgactcggagggagataatgaatcagaggaatttctctatggcgttcaggtgaggttacatctcccaagacccccgtgttggatggtctagatatgtgctgctttttggatacatcaggagtgaaagaggttctggagcacagatgagatgaggttataatgttgatgtggtctgagcatggtcttgtcagagctgatcccgtgcccttgctctttctttggagtcatacctgttccagagtaaactacatcctctgtatgtggagactacccatatcttaattagacataattattttctgacttttataacactagccagtgggggtagtttcattcatta

SEQ ID NO: 299310 - DNA, 497 bp, Homo sapiens
cggcttgatctgatcctagcttgcctcttctacatcatttctcaccactcctctgcaattcactattctctatgcaactaacacacactaccttatctttccttcaggccttctgtatcctattacttcttcccagacacttccccgctgtttatttaattaactcttcctaatcctgcagttctcagtctagctgtcaccacatgacttctttaaactcttaggctaggctagttgccctcctctaggctcacaccatgctctataatctgcatcacaaccccttaccatgctgtgttgttaattacttgttcttgcttgtaatttccagcagactaaattctgtgggggaaaataatcttctttgttttattctctgctgttttgatgagcatctagctcagtgctgggacatagtaggcactttcgtaaatttttgataaattagccgggcgtggtggcgcatgcctgtagtcccagcatctccgctttggaaa

SEQ ID NO: 299311 - DNA, 4362 bp, Homo sapiens
gaatttttaaaagcccgaggtgttcgacttccattgtcgaaccagagaatcctgcagtcagcaaggcctcaggacttccctcagtctctacctgccggccccaacctccggcgaggggactccctcccggcctacaggcaacctgggttgcccttcctgcttgttcctcccaaccactcggggcgctaaatgcaagtattctcctttggaaggctccccgcactcccccagagtccctgttccttctccactgcctcccctacccacggcgcaggcgccaccccccactccgcaccctttcccgactagcgaccgccgcgcaggcgtctcagggctggcgtcggctgctgaggcgcgcccaggagcaggccgtcaggctgttggtcaggagcgggccacgtgccatcgtgtcaccgcgcgagcgtgcgcagagtggctgagcgcgcccgtgacggaacgacgaggcgtggggtgcgcgacctcgcccgccaggcccggcccccgccccttggcctgccgctccgcccccgcggggcgtcccgggccgctcgtcccgtcggctgcggccgcgcgcggcccggggtcgccgtgagtactcgccaggctggcctgtgtggccgccaccacgggcacagggcggtgcggccgggccacgggaagggtgcggggctcgccccgtctccgcaggggtggacgaagtgagaggcttggaccgggaggttctgagggcccctcctaggctggacaggcttcactcaggcccggcggccgggcggcatagatcgggcccagagcgtctttcctggggaggcaggtgttgggtgtttttggggtcttcaggggagccccggagaacaggtgtaactgcttccccgggagaggcctcagggcctgtcctggaagcacgggtgccagagagtgttttcgcggggcagccgtatcctctctccctgcggggtgcccgagatagcgctaacctgcgggagtcgcccctcagtgattcttcctagtagtctttgtttagtggcctactcctgagaagggagcacacgggatggagtggagtaacctcctccaggaccacaaagccgggagcccaacccacaatttaaacattgagctctgaagctgctttgactagacgtgaagttgtcacacctagagaagcgcccatggacctagggaaagacctttgtgatccagacttgaggctcatttacatttgacttattctcgtggaaactcataaagcgttctatattagccgctgagttttaacaccttctctggacactcatcatatagtctatttttggcccaacttcttttgaaagggcccattctttacctcatttagataaatcagataggtctttcttgcttacttcattaacaactcaattaattataaccacatcacatgaagattagatgtaattaggacctgtccaatgtctttacatcccagtccttctgtactcctaaccttaagcaaattggtcgacctctgtaggtctaagtattctgtgtgtaacatgaaagctttgaattaggccacgtttccggctaattttttaaaaagtgtttgtgatcctgtgaattccataacccaccaccttccttttccaactcttcaccttttaaatccactttccatctctccagaggaaagggcattgagagtagaggaagcaagtccctttcactaaagcagcctggtttgaaaaagccggtaatctctgaactgtctcttgcttgaacaagaaaaactccctctgaaatacctttttctccttgtgatagcaacagaaaccaagcagcaacagcccttggaaagaggctaaatttttcttgacttctgcagcaacaaagaccgtgaaaagttggcacttctggcctaacgctgccgtcatcctacccctcaccccagggcaacccaggctggacatttagtgcctccctctttattcctctgtgatcatccagatcagcacttgactgtttattttcaaatctcacgaacctcaccccaagatcttcacattctggatctcagctgctcttgaaggacagtgacttgttaccaccgcaacagcagagcctgccatccccaacagatcaccagttgtccctgacatcgtgccctaccttgtctccctttgtggtctcctaaatgcccatctcgttggccttggttcggctagtggtatggaggggtgctgcctagcactgacctgagagtgtgtgtgacccactgacccaatggacatcaaaggccagttctggaatgatgacgactcggagggagataatgaatcagaggaatttctctatggcgttcaggggagctgtgcagctgacctgtatcgacacccacagcttgatgcagacattgaagccgtgaaggagatctacagtgagaactctgtatccatcagagaatatggaactatcgatgacgtggacattgacctccacatcaacatcagcttcctcgatgaggaagtctctacagcctggaaggtcctccggacagaacctattgtgttgaggctgcgattttctctctcccagtacctagatggaccagaaccatccattgaggttttccagccatcaaataaggaaggatttgggctgggtcttcagttgaaaaagatcctgggtatgtttacatcccaacaatggaaacatctgagcaatgatttcttgaagacccagcaggagaagaggcacagttggttcaaggcaagtggtaccatcaagaagttccgagctggcctcagcatcttttcacccatccccaagtctcccagtttccctatcatacaggactccatgctgaaaggcaaactaggtgtaccagagcttcgggttgggcgcctcatgaaccgttccatctcctgtaccatgaagaaccccaaagtggaagtgtttggctaccctcccagcccccaggcaggtctcctgtgccctcagcacgtgggcctccctcccccagcacggacctctcctttggtcagtggtcactgcaagaacattcccactctggagtatggattcctcgttcagatcatgaagtatgcagaacagaggattccaacattgaatgagtactgtgtggtgtgtgatgagcagcatgtcttccaaaatggatctatgctgaagccagctgtctgtactcgtgaactatgcgttttctccttctacacactgggcgtcatgtctggagctgcagaggaggtggccactggagcagaggtggtggatctgctggtggccatgtgtagggcagctttagagtcccctagaaagagcatcatctttgagccttatccctctgtggtggaccccactgatcccaagactctggcctttaaccctaagaagaagaattatgagcggcttcagaaagctctggatagtgtgatgtctattcgggagatgacccagggctcatatttggaaatcaagaaacagatggacaagttggatcccctggcccatcctctcctgcagtggatcatctctagcaacaggtcacacattgtcaaactacctctcagcaggcagctgaagttcatgcacacctcacaccagttcctcctgctgagcagccctcctgccaaggaggctcggttccggaccgccaagaagctctatggcagcacctttgccttccatgggtcccacattgagaactggcattcgatcctgcgcaatgggctggtcaatgcatcctacaccaaactgcaggaatgggaaaaggacagcacaggatgccctccaaggatgagctggtccagagatacaacaggatgaataccatcccccagacccgatccattcagtcacggttcctgcagagtcggaatctaaactgtatagcactttgtgaagtgattacatctaaggacctccagaagcatgggaacatctgggtgtgccctgtgtccgaccatgtctgcacaagattcttctttgtatatgaggatggtcaggtgggcgatgccaacattaatactcaggaccccaagatacagaaggaaatcatgcgtgtgatcggaactcaggtttacacaaactgagggggccccagccctcgtaccacccctgttaccccaggatccatctgccctcataaaagtgttcaggtacagcagctgaggctgccctgaggaatcaaggggccattaccaaggggcaggaaaaggatatgtaagaggtggccttcatggtagagcttgacccaagaactactccacattcggatggcccagactgactccatcccctgactttccctttgacttcaccctgtttgtaaataaaacaataaaatggaaggtgctgtggactgga

SEQ ID NO: 299312 - DNA, 3260 bp, Homo sapiens
gaatttttaaaagcccgaggtgttcgacttccattgtcgaaccagagaatcctgcagtcagcaaggcctcaggacttccctcagtctctacctgccggccccaacctccggcgaggggactccctcccggcctacaggcaacctgggttgcccttcctgcttgttcctcccaaccactcggggcgctaaatgcaagtattctcctttggaaggctccccgcactcccccagagtccctgttccttctccactgcctcccctacccacggcgcaggcgccaccccccactccgcaccctttcccgactagcgaccgccgcgcaggcgtctcagggctggcgtcggctgctgaggcgcgcccaggagcaggccgtcaggctgttggtcaggagcgggccacgtgccatcgtgtcaccgcgcgagcgtgcgcagagtggctgagcgcgcccgtgacggaacgacgaggcgtggggtgcgcgacctcgcccgccaggcccggcccccgccccttggcctgccgctccgcccccgcggggcgtcccgggccgctcgtcccgtcggctgcggccgcgcgcggcccggggtcgccgtgagtactcgccaggctggcctgtgtggccgccaccacgggcacagggcggtgcggccgggccacgggaagggtgcggggctcgccccgtctccgcaggggtggacgaagtgcaacagaaaccaagcagcaacagcccttggaaagaggctaaatttttcttgacttctgcagcaacaaagaccgtgaaaagttggcacttctggcctaacgctgccgtcatcctacccctcaccccagggcaacccaggctggacatttagtgcctccctctttattcctctgtgatcatccagatcagcacttgactgtttattttcaaatctcacgaacctcaccccaagatcttcacattctggatctcagctgctcttgaaggacagtgacttgttaccaccgcaacagcagagcctgccatccccaacagatcaccagttgtccctgacatcgtgccctaccttgtctccctttgtggtctcctaaatgcccatctcgttggccttggttcggctagtggtatggaggggtgctgcctagcactgacctgagagtgtgtgtgacccactgacccaatggacatcaaaggccagttctggaatgatgacgactcggagggagataatgaatcagaggaatttctctatggcgttcaggggagctgtgcagctgacctgtatcgacacccacagcttgatgcagacattgaagccgtgaaggagatctacagtgagaactctgtatccatcagagaatatggaactatcgatgacgtggacattgacctccacatcaacatcagcttcctcgatgaggaagtctctacagcctggaaggtcctccggacagaacctattgtgttgaggctgcgattttctctctcccagtacctagatggaccagaaccatccattgaggttttccagccatcaaataaggaaggatttgggctgggtcttcagttgaaaaagatcctgggtatgtttacatcccaacaatggaaacatctgagcaatgatttcttgaagacccagcaggagaagaggcacagttggttcaaggcaagtggtaccatcaagaagttccgagctggcctcagcatcttttcacccatccccaagtctcccagtttccctatcatacaggactccatgctgaaaggcaaactaggtgtaccagagcttcgggttgggcgcctcatgaaccgttccatctcctgtaccatgaagaaccccaaagtggaagtgtttggctaccctcccagcccccaggcaggtctcctgtgccctcagcacgtgggcctccctcccccagcacggacctctcctttggtcagtggtcactgcaagaacattcccactctggagtatggattcctcgttcagatcatgaagtatgcagaacagaggattccaacattgaatgagtactgtgtggtgtgtgatgagcagcatgtcttccaaaatggatctatgctgaagccagctgtctgtactcgtgaactatgcgttttctccttctacacactgggcgtcatgtctggagctgcagaggaggtggccactggagcagaggtggtggatctgctggtggccatgtgtagggcagctttagagtcccctagaaagagcatcatctttgagccttatccctctgtggtggaccccactgatcccaagactctggcctttaaccctaagaagaagaattatgagcggcttcagaaagctctggatagtgtgatgtctattcgggagatgacccagggctcatatttggaaatcaagaaacagatggacaagttggatcccctggcccatcctctcctgcagtggatcatctctagcaacaggtcacacattgtcaaactacctctcagcaggcagctgaagttcatgcacacctcacaccagttcctcctgctgagcagccctcctgccaaggaggctcggttccggaccgccaagaagctctatggcagcacctttgccttccatgggtcccacattgagaactggcattcgatcctgcgcaatgggctggtcaatgcatcctacaccaaactgcaggaatgggaaaaggacagcacaggatgccctccaaggatgagctggtccagagatacaacaggatgaataccatcccccagacccgatccattcagtcacggttcctgcagagtcggaatctaaactgtatagcactttgtgaagtgattacatctaaggacctccagaagcatgggaacatctgggtgtgccctgtgtccgaccatgtctgcacaagattcttctttgtatatgaggatggtcaggtgggcgatgccaacattaatactcaggaccccaagatacagaaggaaatcatgcgtgtgatcggaactcaggtttacacaaactgagggggccccagccctcgtaccacccctgttaccccaggatccatctgccctcataaaagtgttcaggtacagcagctgaggctgccctgaggaatcaaggggccattaccaaggggcaggaaaaggatatgtaagaggtggccttcatggtagagcttgacccaagaactactccacattcggatggcccagactgactccatcccctgactttccctttgacttcaccctgtttgtaaataaaacaataaaatggaaggtgctgtggactgga

SEQ ID NO: 299313 - DNA, 3369 bp, Homo sapiens
gaatttttaaaagcccgaggtgttcgacttccattgtcgaaccagagaatcctgcagtcagcaaggcctcaggacttccctcagtctctacctgccggccccaacctccggcgaggggactccctcccggcctacaggcaacctgggttgcccttcctgcttgttcctcccaaccactcggggcgctaaatgcaagtattctcctttggaaggctccccgcactcccccagagtccctgttccttctccactgcctcccctacccacggcgcaggcgccaccccccactccgcaccctttcccgactagcgaccgccgcgcaggcgtctcagggctggcgtcggctgctgaggcgcgcccaggagcaggccgtcaggctgttggtcaggagcgggccacgtgccatcgtgtcaccgcgcgagcgtgcgcagagtggctgagcgcgcccgtgacggaacgacgaggcgtggggtgcgcgacctcgcccgccaggcccggcccccgccccttggcctgccgctccgcccccgcggggcgtcccgggccgctcgtcccgtcggctgcggccgcgcgcggcccggggtcgccgtgagtactcgccaggctggcctgtgtggccgccaccacgggcacagggcggtgcggccgggccacgggaagggtgcggggctcgccccgtctccgcaggggtggacgaagtgagaggcttggaccgggaggttctgagggcccctcctaggctggacaggcttcactcaggcccggcggccgggcggcatagatcgggcccagagcgtctttcctggggagcaacagaaaccaagcagcaacagcccttggaaagaggctaaatttttcttgacttctgcagcaacaaagaccgtgaaaagttggcacttctggcctaacgctgccgtcatcctacccctcaccccagggcaacccaggctggacatttagtgcctccctctttattcctctgtgatcatccagatcagcacttgactgtttattttcaaatctcacgaacctcaccccaagatcttcacattctggatctcagctgctcttgaaggacagtgacttgttaccaccgcaacagcagagcctgccatccccaacagatcaccagttgtccctgacatcgtgccctaccttgtctccctttgtggtctcctaaatgcccatctcgttggccttggttcggctagtggtatggaggggtgctgcctagcactgacctgagagtgtgtgtgacccactgacccaatggacatcaaaggccagttctggaatgatgacgactcggagggagataatgaatcagaggaatttctctatggcgttcaggggagctgtgcagctgacctgtatcgacacccacagcttgatgcagacattgaagccgtgaaggagatctacagtgagaactctgtatccatcagagaatatggaactatcgatgacgtggacattgacctccacatcaacatcagcttcctcgatgaggaagtctctacagcctggaaggtcctccggacagaacctattgtgttgaggctgcgattttctctctcccagtacctagatggaccagaaccatccattgaggttttccagccatcaaataaggaaggatttgggctgggtcttcagttgaaaaagatcctgggtatgtttacatcccaacaatggaaacatctgagcaatgatttcttgaagacccagcaggagaagaggcacagttggttcaaggcaagtggtaccatcaagaagttccgagctggcctcagcatcttttcacccatccccaagtctcccagtttccctatcatacaggactccatgctgaaaggcaaactaggtgtaccagagcttcgggttgggcgcctcatgaaccgttccatctcctgtaccatgaagaaccccaaagtggaagtgtttggctaccctcccagcccccaggcaggtctcctgtgccctcagcacgtgggcctccctcccccagcacggacctctcctttggtcagtggtcactgcaagaacattcccactctggagtatggattcctcgttcagatcatgaagtatgcagaacagaggattccaacattgaatgagtactgtgtggtgtgtgatgagcagcatgtcttccaaaatggatctatgctgaagccagctgtctgtactcgtgaactatgcgttttctccttctacacactgggcgtcatgtctggagctgcagaggaggtggccactggagcagaggtggtggatctgctggtggccatgtgtagggcagctttagagtcccctagaaagagcatcatctttgagccttatccctctgtggtggaccccactgatcccaagactctggcctttaaccctaagaagaagaattatgagcggcttcagaaagctctggatagtgtgatgtctattcgggagatgacccagggctcatatttggaaatcaagaaacagatggacaagttggatcccctggcccatcctctcctgcagtggatcatctctagcaacaggtcacacattgtcaaactacctctcagcaggcagctgaagttcatgcacacctcacaccagttcctcctgctgagcagccctcctgccaaggaggctcggttccggaccgccaagaagctctatggcagcacctttgccttccatgggtcccacattgagaactggcattcgatcctgcgcaatgggctggtcaatgcatcctacaccaaactgcaggaatgggaaaaggacagcacaggatgccctccaaggatgagctggtccagagatacaacaggatgaataccatcccccagacccgatccattcagtcacggttcctgcagagtcggaatctaaactgtatagcactttgtgaagtgattacatctaaggacctccagaagcatgggaacatctgggtgtgccctgtgtccgaccatgtctgcacaagattcttctttgtatatgaggatggtcaggtgggcgatgccaacattaatactcaggaccccaagatacagaaggaaatcatgcgtgtgatcggaactcaggtttacacaaactgagggggccccagccctcgtaccacccctgttaccccaggatccatctgccctcataaaagtgttcaggtacagcagctgaggctgccctgaggaatcaaggggccattaccaaggggcaggaaaaggatatgtaagaggtggccttcatggtagagcttgacccaagaactactccacattcggatggcccagactgactccatcccctgactttccctttgacttcaccctgtttgtaaataaaacaataaaatggaaggtgctgtggactgga

SEQ ID NO: 299314 - DNA, 3147 bp, Homo sapiens
gaatttttaaaagcccgaggtgttcgacttccattgtcgaaccagagaatcctgcagtcagcaaggcctcaggacttccctcagtctctacctgccggccccaacctccggcgaggggactccctcccggcctacaggcaacctgggttgcccttcctgcttgttcctcccaaccactcggggcgctaaatgcaagtattctcctttggaaggctccccgcactcccccagagtccctgttccttctccactgcctcccctacccacggcgcaggcgccaccccccactccgcaccctttcccgactagcgaccgccgcgcaggcgtctcagggctggcgtcggctgctgaggcgcgcccaggagcaggccgtcaggctgttggtcaggagcgggccacgtgccatcgtgtcaccgcgcgagcgtgcgcagagtggctgagcgcgcccgtgacggaacgacgaggcgtggggtgcgcgacctcgcccgccaggcccggcccccgccccttggcctgccgctccgcccccgcggggcgtcccgggccgctcgtcccgtcggctgcggccgcgcgcggcccggggtcgcccaacagaaaccaagcagcaacagcccttggaaagaggctaaatttttcttgacttctgcagcaacaaagaccgtgaaaagttggcacttctggcctaacgctgccgtcatcctacccctcaccccagggcaacccaggctggacatttagtgcctccctctttattcctctgtgatcatccagatcagcacttgactgtttattttcaaatctcacgaacctcaccccaagatcttcacattctggatctcagctgctcttgaaggacagtgacttgttaccaccgcaacagcagagcctgccatccccaacagatcaccagttgtccctgacatcgtgccctaccttgtctccctttgtggtctcctaaatgcccatctcgttggccttggttcggctagtggtatggaggggtgctgcctagcactgacctgagagtgtgtgtgacccactgacccaatggacatcaaaggccagttctggaatgatgacgactcggagggagataatgaatcagaggaatttctctatggcgttcaggggagctgtgcagctgacctgtatcgacacccacagcttgatgcagacattgaagccgtgaaggagatctacagtgagaactctgtatccatcagagaatatggaactatcgatgacgtggacattgacctccacatcaacatcagcttcctcgatgaggaagtctctacagcctggaaggtcctccggacagaacctattgtgttgaggctgcgattttctctctcccagtacctagatggaccagaaccatccattgaggttttccagccatcaaataaggaaggatttgggctgggtcttcagttgaaaaagatcctgggtatgtttacatcccaacaatggaaacatctgagcaatgatttcttgaagacccagcaggagaagaggcacagttggttcaaggcaagtggtaccatcaagaagttccgagctggcctcagcatcttttcacccatccccaagtctcccagtttccctatcatacaggactccatgctgaaaggcaaactaggtgtaccagagcttcgggttgggcgcctcatgaaccgttccatctcctgtaccatgaagaaccccaaagtggaagtgtttggctaccctcccagcccccaggcaggtctcctgtgccctcagcacgtgggcctccctcccccagcacggacctctcctttggtcagtggtcactgcaagaacattcccactctggagtatggattcctcgttcagatcatgaagtatgcagaacagaggattccaacattgaatgagtactgtgtggtgtgtgatgagcagcatgtcttccaaaatggatctatgctgaagccagctgtctgtactcgtgaactatgcgttttctccttctacacactgggcgtcatgtctggagctgcagaggaggtggccactggagcagaggtggtggatctgctggtggccatgtgtagggcagctttagagtcccctagaaagagcatcatctttgagccttatccctctgtggtggaccccactgatcccaagactctggcctttaaccctaagaagaagaattatgagcggcttcagaaagctctggatagtgtgatgtctattcgggagatgacccagggctcatatttggaaatcaagaaacagatggacaagttggatcccctggcccatcctctcctgcagtggatcatctctagcaacaggtcacacattgtcaaactacctctcagcaggcagctgaagttcatgcacacctcacaccagttcctcctgctgagcagccctcctgccaaggaggctcggttccggaccgccaagaagctctatggcagcacctttgccttccatgggtcccacattgagaactggcattcgatcctgcgcaatgggctggtcaatgcatcctacaccaaactgcaggaatgggaaaaggacagcacaggatgccctccaaggatgagctggtccagagatacaacaggatgaataccatcccccagacccgatccattcagtcacggttcctgcagagtcggaatctaaactgtatagcactttgtgaagtgattacatctaaggacctccagaagcatgggaacatctgggtgtgccctgtgtccgaccatgtctgcacaagattcttctttgtatatgaggatggtcaggtgggcgatgccaacattaatactcaggaccccaagatacagaaggaaatcatgcgtgtgatcggaactcaggtttacacaaactgagggggccccagccctcgtaccacccctgttaccccaggatccatctgccctcataaaagtgttcaggtacagcagctgaggctgccctgaggaatcaaggggccattaccaaggggcaggaaaaggatatgtaagaggtggccttcatggtagagcttgacccaagaactactccacattcggatggcccagactgactccatcccctgactttccctttgacttcaccctgtttgtaaataaaacaataaaatggaaggtgctgtggactgga

SEQ ID NO: 299315 - DNA, 2750 bp, Homo sapiens
gaatttttaaaagcccgaggtgttcgacttccattgtcgaaccagagaatcctgcagtcagcaaggcctcaggacttccctcagtctctacctgccggccccaacctccggcgaggggactccctcccggcctacaggcaacctgggttgcccttcctgcttgttcctcccaaccactcggggcgctaaatcaacagaaaccaagcagcaacagcccttggaaagaggctaaatttttcttgacttctgcagcaacaaagaccgtgaaaagttggcacttctggcctaacgctgccgtcatcctacccctcaccccagggcaacccaggctggacatttagtgcctccctctttattcctctgtgatcatccagatcagcacttgactgtttattttcaaatctcacgaacctcaccccaagatcttcacattctggatctcagctgctcttgaaggacagtgacttgttaccaccgcaacagcagagcctgccatccccaacagatcaccagttgtccctgacatcgtgccctaccttgtctccctttgtggtctcctaaatgcccatctcgttggccttggttcggctagtggtatggaggggtgctgcctagcactgacctgagagtgtgtgtgacccactgacccaatggacatcaaaggccagttctggaatgatgacgactcggagggagataatgaatcagaggaatttctctatggcgttcaggggagctgtgcagctgacctgtatcgacacccacagcttgatgcagacattgaagccgtgaaggagatctacagtgagaactctgtatccatcagagaatatggaactatcgatgacgtggacattgacctccacatcaacatcagcttcctcgatgaggaagtctctacagcctggaaggtcctccggacagaacctattgtgttgaggctgcgattttctctctcccagtacctagatggaccagaaccatccattgaggttttccagccatcaaataaggaaggatttgggctgggtcttcagttgaaaaagatcctgggtatgtttacatcccaacaatggaaacatctgagcaatgatttcttgaagacccagcaggagaagaggcacagttggttcaaggcaagtggtaccatcaagaagttccgagctggcctcagcatcttttcacccatccccaagtctcccagtttccctatcatacaggactccatgctgaaaggcaaactaggtgtaccagagcttcgggttgggcgcctcatgaaccgttccatctcctgtaccatgaagaaccccaaagtggaagtgtttggctaccctcccagcccccaggcaggtctcctgtgccctcagcacgtgggcctccctcccccagcacggacctctcctttggtcagtggtcactgcaagaacattcccactctggagtatggattcctcgttcagatcatgaagtatgcagaacagaggattccaacattgaatgagtactgtgtggtgtgtgatgagcagcatgtcttccaaaatggatctatgctgaagccagctgtctgtactcgtgaactatgcgttttctccttctacacactgggcgtcatgtctggagctgcagaggaggtggccactggagcagaggtggtggatctgctggtggccatgtgtagggcagctttagagtcccctagaaagagcatcatctttgagccttatccctctgtggtggaccccactgatcccaagactctggcctttaaccctaagaagaagaattatgagcggcttcagaaagctctggatagtgtgatgtctattcgggagatgacccagggctcatatttggaaatcaagaaacagatggacaagttggatcccctggcccatcctctcctgcagtggatcatctctagcaacaggtcacacattgtcaaactacctctcagcaggcagctgaagttcatgcacacctcacaccagttcctcctgctgagcagccctcctgccaaggaggctcggttccggaccgccaagaagctctatggcagcacctttgccttccatgggtcccacattgagaactggcattcgatcctgcgcaatgggctggtcaatgcatcctacaccaaactgcaggaatgggaaaaggacagcacaggatgccctccaaggatgagctggtccagagatacaacaggatgaataccatcccccagacccgatccattcagtcacggttcctgcagagtcggaatctaaactgtatagcactttgtgaagtgattacatctaaggacctccagaagcatgggaacatctgggtgtgccctgtgtccgaccatgtctgcacaagattcttctttgtatatgaggatggtcaggtgggcgatgccaacattaatactcaggaccccaagatacagaaggaaatcatgcgtgtgatcggaactcaggtttacacaaactgagggggccccagccctcgtaccacccctgttaccccaggatccatctgccctcataaaagtgttcaggtacagcagctgaggctgccctgaggaatcaaggggccattaccaaggggcaggaaaaggatatgtaagaggtggccttcatggtagagcttgacccaagaactactccacattcggatggcccagactgactccatcccctgactttccctttgacttcaccctgtttgtaaataaaacaataaaatggaaggtgctgtggactgga

SEQ ID NO: 299316 - DNA, 2689 bp, Homo sapiens
gaatttttaaaagcccgaggtgttcgacttccattgtcgaaccagagaatcctgcagtcagcaaggcctcaggacttccctcagtctctacctgccggccccaacctccggcgaggggactccctcccggcctacaggcaacctgggttgcccttcctgcttgttcctcccaaccactcggggcgctaaatcaacaaagaccgtgaaaagttggcacttctggcctaacgctgccgtcatcctacccctcaccccagggcaacccaggctggacatttagtgcctccctctttattcctctgtgatcatccagatcagcacttgactgtttattttcaaatctcacgaacctcaccccaagatcttcacattctggatctcagctgctcttgaaggacagtgacttgttaccaccgcaacagcagagcctgccatccccaacagatcaccagttgtccctgacatcgtgccctaccttgtctccctttgtggtctcctaaatgcccatctcgttggccttggttcggctagtggtatggaggggtgctgcctagcactgacctgagagtgtgtgtgacccactgacccaatggacatcaaaggccagttctggaatgatgacgactcggagggagataatgaatcagaggaatttctctatggcgttcaggggagctgtgcagctgacctgtatcgacacccacagcttgatgcagacattgaagccgtgaaggagatctacagtgagaactctgtatccatcagagaatatggaactatcgatgacgtggacattgacctccacatcaacatcagcttcctcgatgaggaagtctctacagcctggaaggtcctccggacagaacctattgtgttgaggctgcgattttctctctcccagtacctagatggaccagaaccatccattgaggttttccagccatcaaataaggaaggatttgggctgggtcttcagttgaaaaagatcctgggtatgtttacatcccaacaatggaaacatctgagcaatgatttcttgaagacccagcaggagaagaggcacagttggttcaaggcaagtggtaccatcaagaagttccgagctggcctcagcatcttttcacccatccccaagtctcccagtttccctatcatacaggactccatgctgaaaggcaaactaggtgtaccagagcttcgggttgggcgcctcatgaaccgttccatctcctgtaccatgaagaaccccaaagtggaagtgtttggctaccctcccagcccccaggcaggtctcctgtgccctcagcacgtgggcctccctcccccagcacggacctctcctttggtcagtggtcactgcaagaacattcccactctggagtatggattcctcgttcagatcatgaagtatgcagaacagaggattccaacattgaatgagtactgtgtggtgtgtgatgagcagcatgtcttccaaaatggatctatgctgaagccagctgtctgtactcgtgaactatgcgttttctccttctacacactgggcgtcatgtctggagctgcagaggaggtggccactggagcagaggtggtggatctgctggtggccatgtgtagggcagctttagagtcccctagaaagagcatcatctttgagccttatccctctgtggtggaccccactgatcccaagactctggcctttaaccctaagaagaagaattatgagcggcttcagaaagctctggatagtgtgatgtctattcgggagatgacccagggctcatatttggaaatcaagaaacagatggacaagttggatcccctggcccatcctctcctgcagtggatcatctctagcaacaggtcacacattgtcaaactacctctcagcaggcagctgaagttcatgcacacctcacaccagttcctcctgctgagcagccctcctgccaaggaggctcggttccggaccgccaagaagctctatggcagcacctttgccttccatgggtcccacattgagaactggcattcgatcctgcgcaatgggctggtcaatgcatcctacaccaaactgcaggaatgggaaaaggacagcacaggatgccctccaaggatgagctggtccagagatacaacaggatgaataccatcccccagacccgatccattcagtcacggttcctgcagagtcggaatctaaactgtatagcactttgtgaagtgattacatctaaggacctccagaagcatgggaacatctgggtgtgccctgtgtccgaccatgtctgcacaagattcttctttgtatatgaggatggtcaggtgggcgatgccaacattaatactcaggaccccaagatacagaaggaaatcatgcgtgtgatcggaactcaggtttacacaaactgagggggccccagccctcgtaccacccctgttaccccaggatccatctgccctcataaaagtgttcaggtacagcagctgaggctgccctgaggaatcaaggggccattaccaaggggcaggaaaaggatatgtaagaggtggccttcatggtagagcttgacccaagaactactccacattcggatggcccagactgactccatcccctgactttccctttgacttcaccctgtttgtaaataaaacaataaaatggaaggtgctgtggactgga

SEQ ID NO: 299317 - DNA, 2567 bp, Homo sapiens
gaatttttaaaagcccgaggtgttcgacttccattgtcgaaccagagaatcctgcagtcagcaaggcctcaggacttccctcagtctctacctgccggccccaacctccggcgaggggactccctcccggcctacaggcaacctgggttgcccttcctgcttgttcctcccaaccactcggggcgctaaatatcagcacttgactgtttattttcaaatctcacgaacctcaccccaagatcttcacattctggatctcagctgctcttgaaggacagtgacttgttaccaccgcaacagcagagcctgccatccccaacagatcaccagttgtccctgacatcgtgccctaccttgtctccctttgtggtctcctaaatgcccatctcgttggccttggttcggctagtggtatggaggggtgctgcctagcactgacctgagagtgtgtgtgacccactgacccaatggacatcaaaggccagttctggaatgatgacgactcggagggagataatgaatcagaggaatttctctatggcgttcaggggagctgtgcagctgacctgtatcgacacccacagcttgatgcagacattgaagccgtgaaggagatctacagtgagaactctgtatccatcagagaatatggaactatcgatgacgtggacattgacctccacatcaacatcagcttcctcgatgaggaagtctctacagcctggaaggtcctccggacagaacctattgtgttgaggctgcgattttctctctcccagtacctagatggaccagaaccatccattgaggttttccagccatcaaataaggaaggatttgggctgggtcttcagttgaaaaagatcctgggtatgtttacatcccaacaatggaaacatctgagcaatgatttcttgaagacccagcaggagaagaggcacagttggttcaaggcaagtggtaccatcaagaagttccgagctggcctcagcatcttttcacccatccccaagtctcccagtttccctatcatacaggactccatgctgaaaggcaaactaggtgtaccagagcttcgggttgggcgcctcatgaaccgttccatctcctgtaccatgaagaaccccaaagtggaagtgtttggctaccctcccagcccccaggcaggtctcctgtgccctcagcacgtgggcctccctcccccagcacggacctctcctttggtcagtggtcactgcaagaacattcccactctggagtatggattcctcgttcagatcatgaagtatgcagaacagaggattccaacattgaatgagtactgtgtggtgtgtgatgagcagcatgtcttccaaaatggatctatgctgaagccagctgtctgtactcgtgaactatgcgttttctccttctacacactgggcgtcatgtctggagctgcagaggaggtggccactggagcagaggtggtggatctgctggtggccatgtgtagggcagctttagagtcccctagaaagagcatcatctttgagccttatccctctgtggtggaccccactgatcccaagactctggcctttaaccctaagaagaagaattatgagcggcttcagaaagctctggatagtgtgatgtctattcgggagatgacccagggctcatatttggaaatcaagaaacagatggacaagttggatcccctggcccatcctctcctgcagtggatcatctctagcaacaggtcacacattgtcaaactacctctcagcaggcagctgaagttcatgcacacctcacaccagttcctcctgctgagcagccctcctgccaaggaggctcggttccggaccgccaagaagctctatggcagcacctttgccttccatgggtcccacattgagaactggcattcgatcctgcgcaatgggctggtcaatgcatcctacaccaaactgcaggaatgggaaaaggacagcacaggatgccctccaaggatgagctggtccagagatacaacaggatgaataccatcccccagacccgatccattcagtcacggttcctgcagagtcggaatctaaactgtatagcactttgtgaagtgattacatctaaggacctccagaagcatgggaacatctgggtgtgccctgtgtccgaccatgtctgcacaagattcttctttgtatatgaggatggtcaggtgggcgatgccaacattaatactcaggaccccaagatacagaaggaaatcatgcgtgtgatcggaactcaggtttacacaaactgagggggccccagccctcgtaccacccctgttaccccaggatccatctgccctcataaaagtgttcaggtacagcagctgaggctgccctgaggaatcaaggggccattaccaaggggcaggaaaaggatatgtaagaggtggccttcatggtagagcttgacccaagaactactccacattcggatggcccagactgactccatcccctgactttccctttgacttcaccctgtttgtaaataaaacaataaaatggaaggtgctgtggactgga

SEQ ID NO: 299318 - DNA, 4302 bp, Homo sapiens
gaatttttaaaagcccgaggtgttcgacttccattgtcgaaccagagaatcctgcagtcagcaaggcctcaggacttccctcagtctctacctgccggccccaacctccggcgaggggactccctcccggcctacaggcaacctgggttgcccttcctgcttgttcctcccaaccactcggggcgctaaatgcaagtattctcctttggaaggctccccgcactcccccagagtccctgttccttctccactgcctcccctacccacggcgcaggcgccaccccccactccgcaccctttcccgactagcgaccgccgcgcaggcgtctcagggctggcgtcggctgctgaggcgcgcccaggagcaggccgtcaggctgttggtcaggagcgggccacgtgccatcgtgtcaccgcgcgagcgtgcgcagagtggctgagcgcgcccgtgacggaacgacgaggcgtggggtgcgcgacctcgcccgccaggcccggcccccgccccttggcctgccgctccgcccccgcggggcgtcccgggccgctcgtcccgtcggctgcggccgcgcgcggcccggggtcgccgtgagtactcgccaggctggcctgtgtggccgccaccacgggcacagggcggtgcggccgggccacgggaagggtgcggggctcgccccgtctccgcaggggtggacgaagtgagaggcttggaccgggaggttctgagggcccctcctaggctggacaggcttcactcaggcccggcggccgggcggcatagatcgggcccagagcgtctttcctggggaggcaggtgttgggtgtttttggggtcttcaggggagccccggagaacaggtgtaactgcttccccgggagaggcctcagggcctgtcctggaagcacgggtgccagagagtgttttcgcggggcagccgtatcctctctccctgcggggtgcccgagatagcgctaacctgcgggagtcgcccctcagtgattcttcctagtagtctttgtttagtggcctactcctgagaagggagcacacgggatggagtggagtaacctcctccaggaccacaaagccgggagcccaacccacaatttaaacattgagctctgaagctgctttgactagacgtgaagttgtcacacctagagaagcgcccatggacctagggaaagacctttgtgatccagacttgaggctcatttacatttgacttattctcgtggaaactcataaagcgttctatattagccgctgagttttaacaccttctctggacactcatcatatagtctatttttggcccaacttcttttgaaagggcccattctttacctcatttagataaatcagataggtctttcttgcttacttcattaacaactcaattaattataaccacatcacatgaagattagatgtaattaggacctgtccaatgtctttacatcccagtccttctgtactcctaaccttaagcaaattggtcgacctctgtaggtctaagtattctgtgtgtaacatgaaagctttgaattaggccacgtttccggctaattttttaaaaagtgtttgtgatcctgtgaattccataacccaccaccttccttttccaactcttcaccttttaaatccactttccatctctccagaggaaagggcattgagagtagaggaagcaagtccctttcactaaagcagcctggtttgaaaaagccggtaatctctgaactgtctcttgcttgaacaagaaaaactccctctgaaatacctttttctccttgtgatagcaacagaaaccaagcagcaacagcccttggaaagaggctaaatttttcttgacttctgcagcaacaaagaccgtgaaaagttggcacttctggcctaacgctgccgtcatcctacccctcaccccagggcaacccaggctggacatttagtgcctccctctttattcctctgtgatcatccagatcagcacttgactgtttattttcaaatctcacgaacctcaccccaagatcttcacattctggatctcagctgctcttgaaggacagtgacttgttaccaccgcaacagcagagcctgccatccccaacagatcaccagttgtccctgacatcgtgccctaccttgtctccctttgtggtctcctaaatgcccatctcgttggccttggttcggctagtggtatggaggggtgctgcctagcactgacctgagagtgtgtgtgacccactgacccaatggacatcaaaggccagttctggaatgatgacgactcggagggagataatgaatcagaggaatttctctatggcgttcaggggagctgtgcagctgacctgtatcgacacccacagcttgatgcagacattgaagccgtgaaggagatctacagtgagaactctgtatccatcagagaatatggaactatcgatgacgtggacattgacctccacatcaacatcagcttcctcgatgaggaagtctctacagcctggaaggtcctccggacagaacctattgtgttgaggctgcgattttctctctcccagtacctagatggaccagaaccatccattgaggttttccagccatcaaataaggaaggatttgggctgggtcttcagttgaaaaagatcctgggtatgtttacatcccaacaatggaaacatctgagcaatgatttcttgaagacccagcaggagaagaggcacagttggttcaaggcaagtggtaccatcaagaagttccgagctggcctcagcatcttttcacccatccccaagtctcccagtttccctatcatacaggactccatgctgaaaggcaaactaggtgtaccagagcttcgggttgggcgcctcatgaaccgttccatctcctgtaccatgaagaaccccaaagtggaagtgtttggctaccctcccagcccccaggtcagtggtcactgcaagaacattcccactctggagtatggattcctcgttcagatcatgaagtatgcagaacagaggattccaacattgaatgagtactgtgtggtgtgtgatgagcagcatgtcttccaaaatggatctatgctgaagccagctgtctgtactcgtgaactatgcgttttctccttctacacactgggcgtcatgtctggagctgcagaggaggtggccactggagcagaggtggtggatctgctggtggccatgtgtagggcagctttagagtcccctagaaagagcatcatctttgagccttatccctctgtggtggaccccactgatcccaagactctggcctttaaccctaagaagaagaattatgagcggcttcagaaagctctggatagtgtgatgtctattcgggagatgacccagggctcatatttggaaatcaagaaacagatggacaagttggatcccctggcccatcctctcctgcagtggatcatctctagcaacaggtcacacattgtcaaactacctctcagcaggcagctgaagttcatgcacacctcacaccagttcctcctgctgagcagccctcctgccaaggaggctcggttccggaccgccaagaagctctatggcagcacctttgccttccatgggtcccacattgagaactggcattcgatcctgcgcaatgggctggtcaatgcatcctacaccaaactgcaggaatgggaaaaggacagcacaggatgccctccaaggatgagctggtccagagatacaacaggatgaataccatcccccagacccgatccattcagtcacggttcctgcagagtcggaatctaaactgtatagcactttgtgaagtgattacatctaaggacctccagaagcatgggaacatctgggtgtgccctgtgtccgaccatgtctgcacaagattcttctttgtatatgaggatggtcaggtgggcgatgccaacattaatactcaggaccccaagatacagaaggaaatcatgcgtgtgatcggaactcaggtttacacaaactgagggggccccagccctcgtaccacccctgttaccccaggatccatctgccctcataaaagtgttcaggtacagcagctgaggctgccctgaggaatcaaggggccattaccaaggggcaggaaaaggatatgtaagaggtggccttcatggtagagcttgacccaagaactactccacattcggatggcccagactgactccatcccctgactttccctttgacttcaccctgtttgtaaataaaacaataaaatggaaggtgctgtggactgga

SEQ ID NO: 299319 - DNA, 4189 bp, Homo sapiens
gaatttttaaaagcccgaggtgttcgacttccattgtcgaaccagagaatcctgcagtcagcaaggcctcaggacttccctcagtctctacctgccggccccaacctccggcgaggggactccctcccggcctacaggcaacctgggttgcccttcctgcttgttcctcccaaccactcggggcgctaaatgcaagtattctcctttggaaggctccccgcactcccccagagtccctgttccttctccactgcctcccctacccacggcgcaggcgccaccccccactccgcaccctttcccgactagcgaccgccgcgcaggcgtctcagggctggcgtcggctgctgaggcgcgcccaggagcaggccgtcaggctgttggtcaggagcgggccacgtgccatcgtgtcaccgcgcgagcgtgcgcagagtggctgagcgcgcccgtgacggaacgacgaggcgtggggtgcgcgacctcgcccgccaggcccggcccccgccccttggcctgccgctccgcccccgcggggcgtcccgggccgctcgtcccgtcggctgcggccgcgcgcggcccggggtcgccgtgagtactcgccaggctggcctgtgtggccgccaccacgggcacagggcggtgcggccgggccacgggaagggtgcggggctcgccccgtctccgcaggggtggacgaagtgagaggcttggaccgggaggttctgagggcccctcctaggctggacaggcttcactcaggcccggcggccgggcggcatagatcgggcccagagcgtctttcctggggaggcaggtgttgggtgtttttggggtcttcaggggagccccggagaacaggtgtaactgcttccccgggagaggcctcagggcctgtcctggaagcacgggtgccagagagtgttttcgcggggcagccgtatcctctctccctgcggggtgcccgagatagcgctaacctgcgggagtcgcccctcagtgattcttcctagtagtctttgtttagtggcctactcctgagaagggagcacacgggatggagtggagtaacctcctccaggaccacaaagccgggagcccaacccacaatttaaacattgagctctgaagctgctttgactagacgtgaagttgtcacacctagagaagcgcccatggacctagggaaagacctttgtgatccagacttgaggctcatttacatttgacttattctcgtggaaactcataaagcgttctatattagccgctgagttttaacaccttctctggacactcatcatatagtctatttttggcccaacttcttttgaaagggcccattctttacctcatttagataaatcagataggtctttcttgcttacttcattaacaactcaattaattataaccacatcacatgaagattagatgtaattaggacctgtccaatgtctttacatcccagtccttctgtactcctaaccttaagcaaattggtcgacctctgtaggtctaagtattctgtgtgtaacatgaaagctttgaattaggccacgtttccggctaattttttaaaaagtgtttgtgatcctgtgaattccataacccaccaccttccttttccaactcttcaccttttaaatccactttccatctctccagaggaaagggcattgagagtagaggaagcaagtccctttcactaaagcagcctggtttgaaaaagccggtaatctctgaactgtctcttgcttgaacaagaaaaactccctctgaaatacctttttctccttgtgatagcaacagaaaccaagcagcaacagcccttggaaagaggctaaatttttcttgacttctgcagcaacaaagaccgtgaaaagttggcacttctggcctaacgctgccgtcatcctacccctcaccccagggcaacccaggctggacatttagtgcctccctctttattcctctgtgatcatccagatcagcacttgactgtttattttcaaatctcacgaacctcaccccaagatcttcacattctggatctcagctgctcttgaaggacagtgacttgttaccaccgcaacagcagagcctgccatccccaacagatcaccagttgtccctgacatcgtgccctaccttgtctccctttgtggtctcctaaatgcccatctcgttggccttggttcggctagtggtatggaggggtgctgcctagcactgacctgagagtgtgtgtgacccactgacccaatggacatcaaaggccagttctggaatgatgacgactcggagggagataatgaatcagaggaatttctctatggcgttcaggggagctgtgcagctgacctgtatcgacacccacagcttgatgcagacattgaagccgtgaaggagatctacagtgagaactctgtatccatcagagaatatggaactatcgatgacgtggacattgacctccacatcaacatcagcttcctcgatgaggaagtctctacagcctggaaggtcctccggacagaacctattgtgttgaggctgcgattttctctctcccagtacctagatggaccagaaccatccattgaggttttccagccatcaaataaggaaggatttgggctgggtcttcagttgaaaaagatcctgggtatgtttacatcccaacaatggaaacatctgagcaatgatttcttgaagacccagcaggagaagaggcacagttggttcaaggcaagtggtaccatcaagaagttccgagctggcctcagcatcttttcacccatccccaagtctcccagtttccctatcatacaggactccatgctgaaaggcaaactaggtgtaccagagcttcgggttgggcgcctcatgaaccgttccatctcctgtaccatgaagaaccccaaagtggaagtgtttggctaccctcccagcccccaggtcagtggtcactgcaagaacattcccactctggagtatggattcctcgttcagatcatgaagtatgcagaacagaggattccaacattgaatgagtactgtgtggtgtgtgatgagcagcatgtcttccaaaatggatctatgctgaagccagctgtctgtactcgtgaactatgcgttttctccttctacacactgggcgtcatgtctggagctgcagaggaggtggccactggagcagaggtggtggatctgctggtggccatgtgtagggcagctttagagtcccctagaaagagcatcatctttgagccttatccctctgtggtggaccccactgatcccaagactctggcctttaaccctaagaagaagaattatgagcggcttcagaaagctctggatagtgtgatgtctattcgggagatgacccagggctcatatttggaaatcaagaaacagatggacaagttggatcccctggcccatcctctcctgcagtggatcatctctagcaacaggtcacacattgtcaaactacctctcagcaggtgggtcccacattgagaactggcattcgatcctgcgcaatgggctggtcaatgcatcctacaccaaactgcaggaatgggaaaaggacagcacaggatgccctccaaggatgagctggtccagagatacaacaggatgaataccatcccccagacccgatccattcagtcacggttcctgcagagtcggaatctaaactgtatagcactttgtgaagtgattacatctaaggacctccagaagcatgggaacatctgggtgtgccctgtgtccgaccatgtctgcacaagattcttctttgtatatgaggatggtcaggtgggcgatgccaacattaatactcaggaccccaagatacagaaggaaatcatgcgtgtgatcggaactcaggtttacacaaactgagggggccccagccctcgtaccacccctgttaccccaggatccatctgccctcataaaagtgttcaggtacagcagctgaggctgccctgaggaatcaaggggccattaccaaggggcaggaaaaggatatgtaagaggtggccttcatggtagagcttgacccaagaactactccacattcggatggcccagactgactccatcccctgactttccctttgacttcaccctgtttgtaaataaaacaataaaatggaaggtgctgtggactgga

SEQ ID NO: 299320 - DNA, 4372 bp, Homo sapiens
gaatttttaaaagcccgaggtgttcgacttccattgtcgaaccagagaatcctgcagtcagcaaggcctcaggacttccctcagtctctacctgccggccccaacctccggcgaggggactccctcccggcctacaggcaacctgggttgcccttcctgcttgttcctcccaaccactcggggcgctaaatgcaagtattctcctttggaaggctccccgcactcccccagagtccctgttccttctccactgcctcccctacccacggcgcaggcgccaccccccactccgcaccctttcccgactagcgaccgccgcgcaggcgtctcagggctggcgtcggctgctgaggcgcgcccaggagcaggccgtcaggctgttggtcaggagcgggccacgtgccatcgtgtcaccgcgcgagcgtgcgcagagtggctgagcgcgcccgtgacggaacgacgaggcgtggggtgcgcgacctcgcccgccaggcccggcccccgccccttggcctgccgctccgcccccgcggggcgtcccgggccgctcgtcccgtcggctgcggccgcgcgcggcccggggtcgccgtgagtactcgccaggctggcctgtgtggccgccaccacgggcacagggcggtgcggccgggccacgggaagggtgcggggctcgccccgtctccgcaggggtggacgaagtgagaggcttggaccgggaggttctgagggcccctcctaggctggacaggcttcactcaggcccggcggccgggcggcatagatcgggcccagagcgtctttcctggggaggcaggtgttgggtgtttttggggtcttcaggggagccccggagaacaggtgtaactgcttccccgggagaggcctcagggcctgtcctggaagcacgggtgccagagagtgttttcgcggggcagccgtatcctctctccctgcggggtgcccgagatagcgctaacctgcgggagtcgcccctcagtgattcttcctagtagtctttgtttagtggcctactcctgagaagggagcacacgggatggagtggagtaacctcctccaggaccacaaagccgggagcccaacccacaatttaaacattgagctctgaagctgctttgactagacgtgaagttgtcacacctagagaagcgcccatggacctagggaaagacctttgtgatccagacttgaggctcatttacatttgacttattctcgtggaaactcataaagcgttctatattagccgctgagttttaacaccttctctggacactcatcatatagtctatttttggcccaacttcttttgaaagggcccattctttacctcatttagataaatcagataggtctttcttgcttacttcattaacaactcaattaattataaccacatcacatgaagattagatgtaattaggacctgtccaatgtctttacatcccagtccttctgtactcctaaccttaagcaaattggtcgacctctgtaggtctaagtattctgtgtgtaacatgaaagctttgaattaggccacgtttccggctaattttttaaaaagtgtttgtgatcctgtgaattccataacccaccaccttccttttccaactcttcaccttttaaatccactttccatctctccagaggaaagggcattgagagtagaggaagcaagtccctttcactaaagcagcctggtttgaaaaagccggtaatctctgaactgtctcttgcttgaacaagaaaaactccctctgaaatacctttttctccttgtgatagcaacagaaaccaagcagcaacagcccttggaaagaggctaaatttttcttgacttctgcagcaacaaagaccgtgaaaagttggcacttctggcctaacgctgccgtcatcctacccctcaccccagggcaacccaggctggacatttagtgcctccctctttattcctctgtgatcatccagatcagcacttgactgtttattttcaaatctcacgaacctcaccccaagatcttcacattctggatctcagctgctcttgaaggacagtgacttgttaccaccgcaacagcagagcctgccatccccaacagatcaccagttgtccctgacatcgtgccctaccttgtctccctttgtggtctcctaaatgcccatctcgttggccttggttcggctagtggtatggaggggtgctgcctagcactgacctgagagtgtgtgtgacccactgacccaatggacatcaaaggccagttctggaatgatgacgactcggagggagataatgaatcagaggaatttctctatggcgttcaggggagctgtgcagctgacctgtatcgacacccacagcttgatgcagacattgaagccgtgaaggagatctacagtgagaactctgtatccatcagagaatatggaactatcgatgacgtggacattgacctccacatcaacatcagcttcctcgatgaggaagtctctacagcctggaaggtcctccggacagaacctattgtgttgaggctgcgattttctctctcccagtacctagatggaccagaaccatccattgaggttttccagccatcaaataaggaaggatttgggctgggtcttcagttgaaaaagatcctgggtatgtttacatcccaacaatggaaacatctgagcaatgatttcttgaagacccagcaggagaagaggcacagttggttcaaggcaagtggtaccatcaagaagttccgagctggcctcagcatcttttcacccatccccaagtctcccagtttccctatcatacaggactccatgctgaaaggcaaactaggtgtaccagagcttcgggttgggcgcctcatgaaccgttccatctcctgtaccatgaagaaccccaaagtggaagtgtttggctaccctcccagcccccaggtcagtggtcactgcaagaacattcccactctggagtatggattcctcgttcagatcatgaagtatgcagaacagaggattccaacattgaatgagtactgtgtggtgtgtgatgagcagcatgtcttccaaaatggatctatgctgaagccagctgtctgtactcgtgaactatgcgttttctccttctacacactgggcgtcatgtctggagctgcagaggaggtggccactggagcagaggtggtggatctgctggtggccatgtgtagggcagctttagagtcccctagaaagagcatcatctttgagccttatccctctgtggtggaccccactgatcccaagactctggcctttaaccctaagaagaagaattatgagcggcttcagaaagctctggatagtgtgatgtctattcgggagatgacccagggctcatatttggaaatcaagaaacagatggacaagttggatcccctggcccatcctctcctgcagtggatcatctctagcaacaggtcacacattgtcaaactacctctcagcaggcagctgaagttcatgcacacctcacaccagttcctcctgctgagcagccctcctgccaaggaggctcggttccggaccgccaagaagctctatggcagcacctttgccttccatgggtcccacattgagaactggcattcgatcctgcgcaatgggctggtcaatgcatcctacaccaaactgcagctgcatggagcagcctatggcaaaggcatctacctgagccccatctccagtatttcctttggatactcaggaatgggaaaaggacagcacaggatgccctccaaggatgagctggtccagagatacaacaggatgaataccatcccccagacccgatccattcagtcacggttcctgcagagtcggaatctaaactgtatagcactttgtgaagtgattacatctaaggacctccagaagcatgggaacatctgggtgtgccctgtgtccgaccatgtctgcacaagattcttctttgtatatgaggatggtcaggtgggcgatgccaacattaatactcaggaccccaagatacagaaggaaatcatgcgtgtgatcggaactcaggtttacacaaactgagggggccccagccctcgtaccacccctgttaccccaggatccatctgccctcataaaagtgttcaggtacagcagctgaggctgccctgaggaatcaaggggccattaccaaggggcaggaaaaggatatgtaagaggtggccttcatggtagagcttgacccaagaactactccacattcggatggcccagactgactccatcccctgactttccctttgacttcaccctgtttgtaaataaaacaataaaatggaaggtgctgtggactgga

SEQ ID NO: 299321 - DNA, 4432 bp, Homo sapiens
gaatttttaaaagcccgaggtgttcgacttccattgtcgaaccagagaatcctgcagtcagcaaggcctcaggacttccctcagtctctacctgccggccccaacctccggcgaggggactccctcccggcctacaggcaacctgggttgcccttcctgcttgttcctcccaaccactcggggcgctaaatgcaagtattctcctttggaaggctccccgcactcccccagagtccctgttccttctccactgcctcccctacccacggcgcaggcgccaccccccactccgcaccctttcccgactagcgaccgccgcgcaggcgtctcagggctggcgtcggctgctgaggcgcgcccaggagcaggccgtcaggctgttggtcaggagcgggccacgtgccatcgtgtcaccgcgcgagcgtgcgcagagtggctgagcgcgcccgtgacggaacgacgaggcgtggggtgcgcgacctcgcccgccaggcccggcccccgccccttggcctgccgctccgcccccgcggggcgtcccgggccgctcgtcccgtcggctgcggccgcgcgcggcccggggtcgccgtgagtactcgccaggctggcctgtgtggccgccaccacgggcacagggcggtgcggccgggccacgggaagggtgcggggctcgccccgtctccgcaggggtggacgaagtgagaggcttggaccgggaggttctgagggcccctcctaggctggacaggcttcactcaggcccggcggccgggcggcatagatcgggcccagagcgtctttcctggggaggcaggtgttgggtgtttttggggtcttcaggggagccccggagaacaggtgtaactgcttccccgggagaggcctcagggcctgtcctggaagcacgggtgccagagagtgttttcgcggggcagccgtatcctctctccctgcggggtgcccgagatagcgctaacctgcgggagtcgcccctcagtgattcttcctagtagtctttgtttagtggcctactcctgagaagggagcacacgggatggagtggagtaacctcctccaggaccacaaagccgggagcccaacccacaatttaaacattgagctctgaagctgctttgactagacgtgaagttgtcacacctagagaagcgcccatggacctagggaaagacctttgtgatccagacttgaggctcatttacatttgacttattctcgtggaaactcataaagcgttctatattagccgctgagttttaacaccttctctggacactcatcatatagtctatttttggcccaacttcttttgaaagggcccattctttacctcatttagataaatcagataggtctttcttgcttacttcattaacaactcaattaattataaccacatcacatgaagattagatgtaattaggacctgtccaatgtctttacatcccagtccttctgtactcctaaccttaagcaaattggtcgacctctgtaggtctaagtattctgtgtgtaacatgaaagctttgaattaggccacgtttccggctaattttttaaaaagtgtttgtgatcctgtgaattccataacccaccaccttccttttccaactcttcaccttttaaatccactttccatctctccagaggaaagggcattgagagtagaggaagcaagtccctttcactaaagcagcctggtttgaaaaagccggtaatctctgaactgtctcttgcttgaacaagaaaaactccctctgaaatacctttttctccttgtgatagcaacagaaaccaagcagcaacagcccttggaaagaggctaaatttttcttgacttctgcagcaacaaagaccgtgaaaagttggcacttctggcctaacgctgccgtcatcctacccctcaccccagggcaacccaggctggacatttagtgcctccctctttattcctctgtgatcatccagatcagcacttgactgtttattttcaaatctcacgaacctcaccccaagatcttcacattctggatctcagctgctcttgaaggacagtgacttgttaccaccgcaacagcagagcctgccatccccaacagatcaccagttgtccctgacatcgtgccctaccttgtctccctttgtggtctcctaaatgcccatctcgttggccttggttcggctagtggtatggaggggtgctgcctagcactgacctgagagtgtgtgtgacccactgacccaatggacatcaaaggccagttctggaatgatgacgactcggagggagataatgaatcagaggaatttctctatggcgttcaggggagctgtgcagctgacctgtatcgacacccacagcttgatgcagacattgaagccgtgaaggagatctacagtgagaactctgtatccatcagagaatatggaactatcgatgacgtggacattgacctccacatcaacatcagcttcctcgatgaggaagtctctacagcctggaaggtcctccggacagaacctattgtgttgaggctgcgattttctctctcccagtacctagatggaccagaaccatccattgaggttttccagccatcaaataaggaaggatttgggctgggtcttcagttgaaaaagatcctgggtatgtttacatcccaacaatggaaacatctgagcaatgatttcttgaagacccagcaggagaagaggcacagttggttcaaggcaagtggtaccatcaagaagttccgagctggcctcagcatcttttcacccatccccaagtctcccagtttccctatcatacaggactccatgctgaaaggcaaactaggtgtaccagagcttcgggttgggcgcctcatgaaccgttccatctcctgtaccatgaagaaccccaaagtggaagtgtttggctaccctcccagcccccaggcaggtctcctgtgccctcagcacgtgggcctccctcccccagcacggacctctcctttggtcagtggtcactgcaagaacattcccactctggagtatggattcctcgttcagatcatgaagtatgcagaacagaggattccaacattgaatgagtactgtgtggtgtgtgatgagcagcatgtcttccaaaatggatctatgctgaagccagctgtctgtactcgtgaactatgcgttttctccttctacacactgggcgtcatgtctggagctgcagaggaggtggccactggagcagaggtggtggatctgctggtggccatgtgtagggcagctttagagtcccctagaaagagcatcatctttgagccttatccctctgtggtggaccccactgatcccaagactctggcctttaaccctaagaagaagaattatgagcggcttcagaaagctctggatagtgtgatgtctattcgggagatgacccagggctcatatttggaaatcaagaaacagatggacaagttggatcccctggcccatcctctcctgcagtggatcatctctagcaacaggtcacacattgtcaaactacctctcagcaggcagctgaagttcatgcacacctcacaccagttcctcctgctgagcagccctcctgccaaggaggctcggttccggaccgccaagaagctctatggcagcacctttgccttccatgggtcccacattgagaactggcattcgatcctgcgcaatgggctggtcaatgcatcctacaccaaactgcagctgcatggagcagcctatggcaaaggcatctacctgagccccatctccagtatttcctttggatactcaggaatgggaaaaggacagcacaggatgccctccaaggatgagctggtccagagatacaacaggatgaataccatcccccagacccgatccattcagtcacggttcctgcagagtcggaatctaaactgtatagcactttgtgaagtgattacatctaaggacctccagaagcatgggaacatctgggtgtgccctgtgtccgaccatgtctgcacaagattcttctttgtatatgaggatggtcaggtgggcgatgccaacattaatactcaggaccccaagatacagaaggaaatcatgcgtgtgatcggaactcaggtttacacaaactgagggggccccagccctcgtaccacccctgttaccccaggatccatctgccctcataaaagtgttcaggtacagcagctgaggctgccctgaggaatcaaggggccattaccaaggggcaggaaaaggatatgtaagaggtggccttcatggtagagcttgacccaagaactactccacattcggatggcccagactgactccatcccctgactttccctttgacttcaccctgtttgtaaataaaacaataaaatggaaggtgctgtggactgga

SEQ ID NO: 299322 - DNA, 3997 bp, Homo sapiens
gaatttttaaaagcccgaggtgttcgacttccattgtcgaaccagagaatcctgcagtcagcaaggcctcaggacttccctcagtctctacctgccggccccaacctccggcgaggggactccctcccggcctacaggcaacctgggttgcccttcctgcttgttcctcccaaccactcggggcgctaaatgcaagtattctcctttggaaggctccccgcactcccccagagtccctgttccttctccactgcctcccctacccacggcgcaggcgccaccccccactccgcaccctttcccgactagcgaccgccgcgcaggcgtctcagggctggcgtcggctgctgaggcgcgcccaggagcaggccgtcaggctgttggtcaggagcgggccacgtgccatcgtgtcaccgcgcgagcgtgcgcagagtggctgagcgcgcccgtgacggaacgacgaggcgtggggtgcgcgacctcgcccgccaggcccggcccccgccccttggcctgccgctccgcccccgcggggcgtcccgggccgctcgtcccgtcggctgcggccgcgcgcggcccggggtcgccgtgagtactcgccaggctggcctgtgtggccgccaccacgggcacagggcggtgcggccgggccacgggaagggtgcggggctcgccccgtctccgcaggggtggacgaagtgagaggcttggaccgggaggttctgagggcccctcctaggctggacaggcttcactcaggcccggcggccgggcggcatagatcgggcccagagcgtctttcctggggaggcaggtgttgggtgtttttggggtcttcaggggagccccggagaacaggtgtaactgcttccccgggagaggcctcagggcctgtcctggaagcacgggtgccagagagtgttttcgcggggcagccgtatcctctctccctgcggggtgcccgagatagcgctaacctgcgggagtcgcccctcagtgattcttcctagtagtctttgtttagtggcctactcctgagaagggagcacacgggatggagtggagtaacctcctccaggaccacaaagccgggagcccaacccacaatttaaacattgagctctgaagctgctttgactagacgtgaagttgtcacacctagagaagcgcccatggacctagggaaagacctttgtgatccagacttgaggctcatttacatttgacttattctcgtggaaactcataaagcgttctatattagccgctgagttttaacaccttctctggacactcatcatatagtctatttttggcccaacttcttttgaaagggcccattctttacctcatttagataaatcagataggtctttcttgcttacttcattaacaactcaattaattataaccacatcacatgaagattagatgtaattaggacctgtccaatgtctttacatcccagtccttctgtactcctaaccttaagcaaattggtcgacctctgtaggtctaagtattctgtgtgtaacatgaaagctttgaattaggccacgtttccggctaattttttaaaaagtgtttgtgatcctgtgaattccataacccaccaccttccttttccaactcttcaccttttaaatccactttccatctctccagaggaaagggcattgagagtagaggaagcaagtccctttcactaaagcagcctggtttgaaaaagccggtaatctctgaactgtctcttgcttgaacaagaaaaactccctctgaaatacctttttctccttgtgatagcaacagaaaccaagcagcaacagcccttggaaagaggctaaatttttcttgacttctgcagcaacaaagaccgtgaaaagttggcacttctggcctaacgctgccgtcatcctacccctcaccccagggcaacccaggctggacatttagtgcctccctctttattcctctgtgatcatccagatcagcacttgactgtttattttcaaatctcacgaacctcaccccaagatcttcacattctggatctcagctgctcttgaaggacagtgacttgttaccaccgcaacagcagagcctgccatccccaacagatcaccagttgtccctgacatcgtgccctaccttgtctccctttgtggtctcctaaatgcccatctcgttggccttggttcggctagtggtatggaggggtgctgcctagcactgacctgagagtgtgtgtgacccactgacccaatggacatcaaaggccagttctggaatgatgacgactcggagggagataatgaatcagaggaatttctctatggcgttcaggggagctgtgcagctgacctgtatcgacacccacagcttgatgcagacattgaagccgtgaaggagatctacagtgagaactctgtatccatcagagaatatggaactatcgatgacgtggacattgacctccacatcaacatcagcttcctcgatgaggaagtctctacagcctggaaggtcctccggacagaacctattgtgttgaggctgcgattttctctctcccagtacctagatggaccagaaccatccattgaggttttccagccatcaaataaggaaggatttgggctgggtcttcagttgaaaaagatcctgggtatgtttacatcccaacaatggaaacatctgagcaatgatttcttgaagacccagcaggagaagaggcacagttggttcaaggcaagtggtaccatcaagaagttccgagctggcctcagcatcttttcacccatccccaagtctcccagtttccctatcatacaggactccatgctgaaaggcaaactaggtgtaccagagcttcgggttgggcgcctcatgaaccgttccatctcctgtaccatgaagaaccccaaagtggaagtgtttggctaccctcccagcccccaggtcagtggtcactgcaagaacattcccactctggagtatggattcctcgttcagatcatgaagtatgcagaacagaggattccaacattgaatgagtactgtgtggtgtgtgatgagcagcatgtcttccaaaatggatctatgctgaagccagctgtctgtactcgtgaactatgcgttttctccttctacacactgggcgtcatgtctggagctgcagaggaggtggccactggagcagagggctcatatttggaaatcaagaaacagatggacaagttggatcccctggcccatcctctcctgcagtggatcatctctagcaacaggtcacacattgtcaaactacctctcagcaggtgggtcccacattgagaactggcattcgatcctgcgcaatgggctggtcaatgcatcctacaccaaactgcaggaatgggaaaaggacagcacaggatgccctccaaggatgagctggtccagagatacaacaggatgaataccatcccccagacccgatccattcagtcacggttcctgcagagtcggaatctaaactgtatagcactttgtgaagtgattacatctaaggacctccagaagcatgggaacatctgggtgtgccctgtgtccgaccatgtctgcacaagattcttctttgtatatgaggatggtcaggtgggcgatgccaacattaatactcaggaccccaagatacagaaggaaatcatgcgtgtgatcggaactcaggtttacacaaactgagggggccccagccctcgtaccacccctgttaccccaggatccatctgccctcataaaagtgttcaggtacagcagctgaggctgccctgaggaatcaaggggccattaccaaggggcaggaaaaggatatgtaagaggtggccttcatggtagagcttgacccaagaactactccacattcggatggcccagactgactccatcccctgactttccctttgacttcaccctgtttgtaaataaaacaataaaatggaaggtgctgtggactgga

SEQ ID NO: 299323 - DNA, 4351 bp, Homo sapiens
gaatttttaaaagcccgaggtgttcgacttccattgtcgaaccagagaatcctgcagtcagcaaggcctcaggacttccctcagtctctacctgccggccccaacctccggcgaggggactccctcccggcctacaggcaacctgggttgcccttcctgcttgttcctcccaaccactcggggcgctaaatgcaagtattctcctttggaaggctccccgcactcccccagagtccctgttccttctccactgcctcccctacccacggcgcaggcgccaccccccactccgcaccctttcccgactagcgaccgccgcgcaggcgtctcagggctggcgtcggctgctgaggcgcgcccaggagcaggccgtcaggctgttggtcaggagcgggccacgtgccatcgtgtcaccgcgcgagcgtgcgcagagtggctgagcgcgcccgtgacggaacgacgaggcgtggggtgcgcgacctcgcccgccaggcccggcccccgccccttggcctgccgctccgcccccgcggggcgtcccgggccgctcgtcccgtcggctgcggccgcgcgcggcccggggtcgccgtgagtactcgccaggctggcctgtgtggccgccaccacgggcacagggcggtgcggccgggccacgggaagggtgcggggctcgccccgtctccgcaggggtggacgaagtgagaggcttggaccgggaggttctgagggcccctcctaggctggacaggcttcactcaggcccggcggccgggcggcatagatcgggcccagagcgtctttcctggggaggcaggtgttgggtgtttttggggtcttcaggggagccccggagaacaggtgtaactgcttccccgggagaggcctcagggcctgtcctggaagcacgggtgccagagagtgttttcgcggggcagccgtatcctctctccctgcggggtgcccgagatagcgctaacctgcgggagtcgcccctcagtgattcttcctagtagtctttgtttagtggcctactcctgagaagggagcacacgggatggagtggagtaacctcctccaggaccacaaagccgggagcccaacccacaatttaaacattgagctctgaagctgctttgactagacgtgaagttgtcacacctagagaagcgcccatggacctagggaaagacctttgtgatccagacttgaggctcatttacatttgacttattctcgtggaaactcataaagcgttctatattagccgctgagttttaacaccttctctggacactcatcatatagtctatttttggcccaacttcttttgaaagggcccattctttacctcatttagataaatcagataggtctttcttgcttacttcattaacaactcaattaattataaccacatcacatgaagattagatgtaattaggacctgtccaatgtctttacatcccagtccttctgtactcctaaccttaagcaaattggtcgacctctgtaggtctaagtattctgtgtgtaacatgaaagctttgaattaggccacgtttccggctaattttttaaaaagtgtttgtgatcctgtgaattccataacccaccaccttccttttccaactcttcaccttttaaatccactttccatctctccagaggaaagggcattgagagtagaggaagcaagtccctttcactaaagcagcctggtttgaaaaagccggtaatctctgaactgtctcttgcttgaacaagaaaaactccctctgaaatacctttttctccttgtgatagcaacagaaaccaagcagcaacagcccttggaaagaggctaaatttttcttgacttctgcagcaacaaagaccgtgaaaagttggcacttctggcctaacgctgccgtcatcctacccctcaccccagggcaacccaggctggacatttagtgcctccctctttattcctctgtgatcatccagatcagcacttgactgtttattttcaaatctcacgaacctcaccccaagatcttcacattctggatctcagctgctcttgaaggacagtgacttgttaccaccgcaacagcagagcctgccatccccaacagatcaccagttgtccctgacatcgtgccctaccttgtctccctttgtggtctcctaaatgcccatctcgttggccttggttcggctagtggtatggaggggtgctgcctagcactgacctgagagtgtgtgtgacccactgacccaatggacatcaaaggccagttctggaatgatgacgactcggagggagataatgaatcagaggaatttctctatggcgttcaggggagctgtgcagctgacctgtatcgacacccacagcttgatgcagacattgaagccgtgaaggagatctacagtgagaactctgtatccatcagagaatatggaactatcgatgacgtggacattgacctccacatcaacatcagcttcctcgatgaggaagtctctacagcctggaaggtcctccggacagaacctattgtgttgaggctgcgattttctctctcccagtacctagatggaccagaaccatccattgaggttttccagccatcaaataaggaaggatttgggctgggtcttcagttgaaaaagatcctgggtatgtttacatcccaacaatggaaacatctgagcaatgatttcttgaagacccagcaggagaagaggcacagttggttcaaggcaagtggtaccatcaagaagttccgagctggcctcagcatcttttcacccatccccaagtctcccagtttccctatcatacaggactccatgctgaaaggcaaactaggtgtaccagagcttcgggttgggcgcctcatgaaccgttccatctcctgtaccatgaagaaccccaaagtggaagtgtttggctaccctcccagcccccaggtcagtggtcactgcaagaacattcccactctggagtatggattcctcgttcagatcatgaagtatgcagaacagaggattccaacattgaatgagtactgtgtggtgtgtgatgagcagcatgtcttccaaaatggatctatgctgaagccagctgtctgtactcgtgaactatgcgttttctccttctacacactgggcgtcatgtctggagctgcagaggaggtggccactggagcagaggtggtggatctgctggtggccatgtgtagggcagctttagagtcccctagaaagagcatcatctttgagccttatccctctgtggtggaccccactgatcccaagactctggcctttaaccctaagaagaagaattatgagcggcttcagaaagctctggatagtgtgatgtctattcgggagatgacccagggctcatatttggaaatcaagaaacagatggacaagttggatcccctggcccatcctctcctgcagtggatcatctctagcaacaggtcacacattgtcaaactacctctcagcaggcagctgaagttcatgcacacctcacaccagttcctcctgctgagcagccctcctgccaaggaggctcggttccggaccgccaagaagctctatggcagcacctttgccttccatgggtcccacattgagaactggcattcgatcctgcgcaatgggctggtcaatgcatcctacaccaaactgcaggaatgggaaaaggacagcacaggatgccctccaaggatgagctggtccagagatacaacaggatgaataccatcccccagacccgatccattcagtcacggttcctgcagagtcggaatctaaactgtatagcactttgtgaagtgattacatctaaggacctccagaagcatgggaacatctgggtgtgccctgtgtccgaccatgtctgcacaagattcttctttgtatatgaggatggtcaggtgggcgatgccaacattaatactcaggaccccaagatacagaaggaaatcatgcgtgtgatcggaactcaggtttacacaaactgagggggccccagccctcgtaccacccctgttaccccaggatccatctgccctcataaaagtgttcaggtacagcagctgaggctgccctgaggaatcaaggggccattaccaaggggcaggaaaaggatatgtaagaggtggccttcatggtagagcttgacccaagaactactccacattcggatggcccagactgactccatcccctgactttccctttgacttcaccctgtttgtaaataaaacaataaaatggaaggtgctgtggactggaaaaaaaccgccaccaaaggcgaacaacaaagacaacaaaacaaaggggg

SEQ ID NO: 299324 - DNA, 5048 bp, Homo sapiens
gaatttttaaaagcccgaggtgttcgacttccattgtcgaaccagagaatcctgcagtcagcaaggcctcaggacttccctcagtctctacctgccggccccaacctccggcgaggggactccctcccggcctacaggcaacctgggttgcccttcctgcttgttcctcccaaccactcggggcgctaaatgcaagtattctcctttggaaggctccccgcactcccccagagtccctgttccttctccactgcctcccctacccacggcgcaggcgccaccccccactccgcaccctttcccgactagcgaccgccgcgcaggcgtctcagggctggcgtcggctgctgaggcgcgcccaggagcaggccgtcaggctgttggtcaggagcgggccacgtgccatcgtgtcaccgcgcgagcgtgcgcagagtggctgagcgcgcccgtgacggaacgacgaggcgtggggtgcgcgacctcgcccgccaggcccggcccccgccccttggcctgccgctccgcccccgcggggcgtcccgggccgctcgtcccgtcggctgcggccgcgcgcggcccggggtcgccgtgagtactcgccaggctggcctgtgtggccgccaccacgggcacagggcggtgcggccgggccacgggaagggtgcggggctcgccccgtctccgcaggggtggacgaagtgagaggcttggaccgggaggttctgagggcccctcctaggctggacaggcttcactcaggcccggcggccgggcggcatagatcgggcccagagcgtctttcctggggaggcaggtgttgggtgtttttggggtcttcaggggagccccggagaacaggtgtaactgcttccccgggagaggcctcagggcctgtcctggaagcacgggtgccagagagtgttttcgcggggcagccgtatcctctctccctgcggggtgcccgagatagcgctaacctgcgggagtcgcccctcagtgattcttcctagtagtctttgtttagtggcctactcctgagaagggagcacacgggatggagtggagtaacctcctccaggaccacaaagccgggagcccaacccacaatttaaacattgagctctgaagctgctttgactagacgtgaagttgtcacacctagagaagcgcccatggacctagggaaagacctttgtgatccagacttgaggctcatttacatttgacttattctcgtggaaactcataaagcgttctatattagccgctgagttttaacaccttctctggacactcatcatatagtctatttttggcccaacttcttttgaaagggcccattctttacctcatttagataaatcagataggtctttcttgcttacttcattaacaactcaattaattataaccacatcacatgaagattagatgtaattaggacctgtccaatgtctttacatcccagtccttctgtactcctaaccttaagcaaattggtcgacctctgtaggtctaagtattctgtgtgtaacatgaaagctttgaattaggccacgtttccggctaattttttaaaaagtgtttgtgatcctgtgaattccataacccaccaccttccttttccaactcttcaccttttaaatccactttccatctctccagaggaaagggcattgagagtagaggaagcaagtccctttcactaaagcagcctggtttgaaaaagccggtaatctctgaactgtctcttgcttgaacaagaaaaactccctctgaaatacctttttctccttgtgatagcaacagaaaccaagcagcaacagcccttggaaagaggctaaatttttcttgacttctgcagcaacaaagaccgtgaaaagttggcacttctggcctaacgctgccgtcatcctacccctcaccccagggcaacccaggctggacatttagtgcctccctctttattcctctgtgatcatccagatcagcacttgactgtttattttcaaatctcacgaacctcaccccaagatcttcacattctggatctcagctgctcttgaaggacagtgacttgttaccaccgcaacagcagagcctgccatccccaacagatcaccagttgtccctgacatcgtgccctaccttgtctccctttgtggtctcctaaatgcccatctcgttggccttggttcggctagtggtatggaggggtgctgcctagcactgacctgagagtgtgtgtgacccactgacccaatggacatcaaaggccagttctggaatgatgacgactcggagggagataatgaatcagaggaatttctctatggcgttcaggggagctgtgcagctgacctgtatcgacacccacagcttgatgcagacattgaagccgtgaaggagatctacagtgagaactctgtatccatcagagaatatggaactatcgatgacgtggacattgacctccacatcaacatcagcttcctcgatgaggaagtctctacagcctggaaggtcctccggacagaacctattgtgttgaggctgcgattttctctctcccagtacctagatggaccagaaccatccattgaggttttccagccatcaaataaggaaggatttgggctgggtcttcagttgaaaaagatcctgggtatgtttacatcccaacaatggaaacatctgagcaatgatttcttgaagacccagcaggagaagaggcacagttggttcaaggcaagtggtaccatcaagaagttccgagctggcctcagcatcttttcacccatccccaagtctcccagtttccctatcatacaggactccatgctgaaaggcaaactaggtgtaccagagcttcgggttgggcgcctcatgaaccgttccatctcctgtaccatgaagaaccccaaagtggaagtgtttggctaccctcccagcccccaggtcagtggtcactgcaagaacattcccactctggagtatggattcctcgttcagatcatgaagtatgcagaacagaggattccaacattgaatgagtactgtgtggtgtgtgatgagcagcatgtcttccaaaatggatctatgctgaagccagctgtctgtactcgtgaactatgcgttttctccttctacacactgggcgtcatgtctggagctgcagaggaggtggccactggagcagaggtggtggatctgctggtggccatgtgtagggcagctttagagtcccctagaaagagcatcatctttgagccttatccctctgtggtggaccccactgatcccaagactctggcctttaaccctaagaagaagaattatgagcggcttcagaaagctctggatagtgtgatgtctattcgggagatgacccagggctcatatttggaaatcaagaaacagatggacaagttggatcccctggcccatcctctcctgcagtggatcatctctagcaacaggtcacacattgtcaaactacctctcagcaggcagctgaagttcatgcacacctcacaccagttcctcctgctgagcagccctcctgccaaggaggctcggttccggaccgccaagaagctctatggcagcacctttgccttccatgggtcccacattgagaactggcattcgatcctgcgcaatgggctggtcaatgcatcctacaccaaactgcaggaatgggaaaaggacagcacaggatgccctccaaggatgagctggtccagagatacaacaggatgaataccatcccccagacccgatccattcagtcacggttcctgcagagtcggaatctaaactgtatagcactttgtgaagtgattacatctaaggacctccagaagcatgggaacatctgggtgtgccctgtgtccgaccatgtctgcacaagattcttctttgtatatgaggatggtcaggtgggcgatgccaacattaatactcaggaccccaagatacagaaggaaatcatgcgtgtgatcggaactcaggtttacacaaactgagggggccccagccctcgtaccacccctgttaccccaggatccatctgccctcataaaagtgttcaggtacagcagctgaggctgccctgaggaatcaaggggccattaccaaggggcaggaaaaggatatgtaagaggtggccttcatggtagagcttgacccaagaactactccacattcggatggcccagactgactccatcccctgactttccctttgacttcaccctgtttgtaaataaaacaataaaatggaaggtgctgtggactggaacaacagaacaacagaaacaacaaacaactgaaatcacaacacacaaacactagaaacacacacaacaaacaaacggggggccctccttaaaaaatcacccccaaaggaggagcccaatagacataacgacactcacccacaaagtatttttagtgaataaccagaaaggtgcccccacaatagagtggcacgggcgggacaagatttattttaacatgaatcttggagcgaaagtgcgtagctctcgaccgatccttttatctcaaccacaatcaagactgtgaactgcaatccggtggagaaaaaaaacaacgtggatggaataatgcatggagacaactctactcttcaggtgaaagtcgaagcaaccctccctcgtccatccccacctgccagtcacgactgcaccagtcagcccaatccccacaaactgcttcaccacaatatcaacaataactccctatacccacgtcgagaaggcacacgatcgtctcctcgcagctccgcgacccaacgtagcggtgaagatatacataatatcaataattcacatatcttcatataggtagatgattctgtcagtataatacagatctctgtcatgacataaagataacatgctcaagtccacggtccgtgtaactcataccatacgtagccagtgccgcgaccctgtgtcgtccacaagatacagatttatttgcgtgctgcagttgtccgaacagaggtgcggtccgactgttca

SEQ ID NO: 299325 - DNA, 4304 bp, Homo sapiens
gaatttttaaaagcccgaggtgttcgacttccattgtcgaaccagagaatcctgcagtcagcaaggcctcaggacttccctcagtctctacctgccggccccaacctccggcgaggggactccctcccggcctacaggcaacctgggttgcccttcctgcttgttcctcccaaccactcggggcgctaaatgcaagtattctcctttggaaggctccccgcactcccccagagtccctgttccttctccactgcctcccctacccacggcgcaggcgccaccccccactccgcaccctttcccgactagcgaccgccgcgcaggcgtctcagggctggcgtcggctgctgaggcgcgcccaggagcaggccgtcaggctgttggtcaggagcgggccacgtgccatcgtgtcaccgcgcgagcgtgcgcagagtggctgagcgcgcccgtgacggaacgacgaggcgtggggtgcgcgacctcgcccgccaggcccggcccccgccccttggcctgccgctccgcccccgcggggcgtcccgggccgctcgtcccgtcggctgcggccgcgcgcggcccggggtcgccgtgagtactcgccaggctggcctgtgtggccgccaccacgggcacagggcggtgcggccgggccacgggaagggtgcggggctcgccccgtctccgcaggggtggacgaagtgagaggcttggaccgggaggttctgagggcccctcctaggctggacaggcttcactcaggcccggcggccgggcggcatagatcgggcccagagcgtctttcctggggaggcaggtgttgggtgtttttggggtcttcaggggagccccggagaacaggtgtaactgcttccccgggagaggcctcagggcctgtcctggaagcacgggtgccagagagtgttttcgcggggcagccgtatcctctctccctgcggggtgcccgagatagcgctaacctgcgggagtcgcccctcagtgattcttcctagtagtctttgtttagtggcctactcctgagaagggagcacacgggatggagtggagtaacctcctccaggaccacaaagccgggagcccaacccacaatttaaacattgagctctgaagctgctttgactagacgtgaagttgtcacacctagagaagcgcccatggacctagggaaagacctttgtgatccagacttgaggctcatttacatttgacttattctcgtggaaactcataaagcgttctatattagccgctgagttttaacaccttctctggacactcatcatatagtctatttttggcccaacttcttttgaaagggcccattctttacctcatttagataaatcagataggtctttcttgcttacttcattaacaactcaattaattataaccacatcacatgaagattagatgtaattaggacctgtccaatgtctttacatcccagtccttctgtactcctaaccttaagcaaattggtcgacctctgtaggtctaagtattctgtgtgtaacatgaaagctttgaattaggccacgtttccggctaattttttaaaaagtgtttgtgatcctgtgaattccataacccaccaccttccttttccaactcttcaccttttaaatccactttccatctctccagaggaaagggcattgagagtagaggaagcaagtccctttcactaaagcagcctggtttgaaaaagccggtaatctctgaactgtctcttgcttgaacaagaaaaactccctctgaaatacctttttctccttgtgatagcaacagaaaccaagcagcaacagcccttggaaagaggctaaatttttcttgacttctgcagcaacaaagaccgtgaaaagttggcacttctggcctaacgctgccgtcatcctacccctcaccccagggcaacccaggctggacatttagtgcctccctctttattcctctgtgatcatccagatcagcacttgactgtttattttcaaatctcacgaacctcaccccaagatcttcacattctggatctcagctgctcttgaaggacagtgacttgttaccaccgcaacagcagagcctgccatccccaacagatcaccagttgtccctgacatcgtgccctaccttgtctccctttgtggtctcctaaatgcccatctcgttggccttggttcggctagtggtatggaggggtgctgcctagcactgacctgagagtgtgtgtgacccactgacccaatggacatcaaaggccagttctggaatgatgacgactcggagggagataatgaatcagaggaatttctctatggcgttcaggggagctgtgcagctgacctgtatcgacacccacagcttgatgcagacattgaagccgtgaaggagatctacagtgagaactctgtatccatcagagaatatggaactatcgatgacgtggacattgacctccacatcaacatcagcttcctcgatgaggaagtctctacagcctggaaggtcctccggacagaacctattgtgttgaggctgcgattttctctctcccagtacctagatggaccagaaccatccattgaggttttccagccatcaaataaggaaggatttgggctgggtcttcagttgaaaaagatcctgggtatgtttacatcccaacaatggaaacatctgagcaatgatttcttgaagacccagcaggagaagaggcacagttggttcaaggcaagtggtaccatcaagaagttccgagctggcctcagcatcttttcacccatccccaagtctcccagtttccctatcatacaggactccatgctgaaaggcaaactaggtgtaccagagcttcgggttgggcgcctcatgaaccgttccatctcctgtaccatgaagaaccccaaagtggaagtgtttggctaccctcccagcccccaggtcagtggtcactgcaagaacattcccactctggagtatggattcctcgttcagatcatgaagtatgcagaacagaggattccaacattgaatgagtactgtgtggtgtgtgatgagcagcatgtcttccaaaatggatctatgctgaagccagctgtctgtactcgtgaactatgcgttttctccttctacacactgggcgtcatgtctggagctgcagaggaggtggccactggagcagaggtggtggatctgctggtggccatgtgtagggcagctttagagtcccctagaaagagcatcatctttgagccttatccctctgtggtggaccccactgatcccaagactctggcctttaaccctaagaagaagaattatgagcggcttcagaaagctctggatagtgtgatgtctattcgggagatgacccagggctcatatttggaaatcaagaaacagatggacaagttggatcccctggcccatcctctcctgcagtggatcatctctagcaacaggtcacacattgtcaaactacctctcagcaggcagctgaagttcatgcacacctcacaccagttcctcctgctgagcagccctcctgccaaggaggctcggttccggaccgccaagaagctctatggcagcacctttgccttccatgggtcccacattgagaactggcattcgatcctgcgcaatgggctggtcaatgcatcctacaccaaactgcaggaatgggaaaaggacagcacaggatgccctccaaggatgagctggtccagagatacaacaggatgaataccatcccccagacccgatccattcagtcacggttcctgcagagtcggaatctaaactgtatagcactttgtgaagtgattacatctaaggacctccagaagcatgggaacatctgggtgtgccctgtgtccgaccatgtctgcacaagattcttctttgtatatgaggatggtcaggtgggcgatgccaacattaatactcaggaccccaagatacagaaggaaatcatgcgtgtgatcggaactcaggtttacacaaactgagggggccccagccctcgtaccacccctgttaccccaggatccatctgccctcataaaagtgttcaggtacagcagctgaggctgccctgaggaatcaaggggccattaccaaggggcaggaaaaggatatgtaagaggtggccttcatggtagagcttgacccaagaactactccacattcggatggcccagactgactccatcccctgactttccctttgacttcaccctgcctcgatcccttccccccacaaggcaatgaatttcgttttttta

SEQ ID NO: 299326 - DNA, 989 bp, Homo sapiens
cagatgaatttattgaatttgaaatgtcaggataatgggcaaataaaaatactgaaccagcagttgaggatttaggatgggagtagctgaagcaccgaagagaggatgggactggaaatagagacgtagagtttaaccacacacacacatcttgcatgcctgtgactgtatccatgtgcatgtccatcactaggtgtacctgtccatcttcatgtcctgtgtgggtgagaatgggtgggaatggcagtcttgggagtgttcctgggaacctcatatcataaggagacatgtattctaccctgccttacagtgggtcccacattgagaactggcattcgatcctgcgcaatgggctggtcaatgcatcctacaccaaactgcaggaatgggaaaaggacagcacaggatgccctccaaggatgagctggtccagagatacaacaggatgaataccatcccccagacccgatccattcagtcacggttcctgcagagtcggaatctaaactgtatagcactttgtgaagtgattacatctaaggacctccagaagcatgggaacatctgggtgtgccctgtgtccgaccatgtctgcacaagattcttctttgtatatgaggatggtcaggtgggcgatgccaacattaatactcaggaccccaagatacagaaggaaatcatgcgtgtgatcggaactcaggtttacacaaactgagggggccccagccctcgtaccacccctgttaccccaggatccatctgccctcataaaagtgttcaggtacagcagctgaggctgccctgaggaatcaaggggccattaccaaggggcaggaaaaggatatgtaagaggtggccttcatggtagagcttgacccaagaactactccacattcggatggcccagactgactccatcccctgactttccctttgacttcaccctgtttgtaaataaaacaataaaatggaaggtgctgtggactgga

SEQ ID NO: 299327 - DNA, 4645 bp, Homo sapiens
gaatttttaaaagcccgaggtgttcgacttccattgtcgaaccagagaatcctgcagtcagcaaggcctcaggacttccctcagtctctacctgccggccccaacctccggcgaggggactccctcccggcctacaggcaacctgggttgcccttcctgcttgttcctcccaaccactcggggcgctaaatgcaagtattctcctttggaaggctccccgcactcccccagagtccctgttccttctccactgcctcccctacccacggcgcaggcgccaccccccactccgcaccctttcccgactagcgaccgccgcgcaggcgtctcagggctggcgtcggctgctgaggcgcgcccaggagcaggccgtcaggctgttggtcaggagcgggccacgtgccatcgtgtcaccgcgcgagcgtgcgcagagtggctgagcgcgcccgtgacggaacgacgaggcgtggggtgcgcgacctcgcccgccaggcccggcccccgccccttggcctgccgctccgcccccgcggggcgtcccgggccgctcgtcccgtcggctgcggccgcgcgcggcccggggtcgccgtgagtactcgccaggctggcctgtgtggccgccaccacgggcacagggcggtgcggccgggccacgggaagggtgcggggctcgccccgtctccgcaggggtggacgaagtgagaggcttggaccgggaggttctgagggcccctcctaggctggacaggcttcactcaggcccggcggccgggcggcatagatcgggcccagagcgtctttcctggggaggcaggtgttgggtgtttttggggtcttcaggggagccccggagaacaggtgtaactgcttccccgggagaggcctcagggcctgtcctggaagcacgggtgccagagagtgttttcgcggggcagccgtatcctctctccctgcggggtgcccgagatagcgctaacctgcgggagtcgcccctcagtgattcttcctagtagtctttgtttagtggcctactcctgagaagggagcacacgggatggagtggagtaacctcctccaggaccacaaagccgggagcccaacccacaatttaaacattgagctctgaagctgctttgactagacgtgaagttgtcacacctagagaagcgcccatggacctagggaaagacctttgtgatccagacttgaggctcatttacatttgacttattctcgtggaaactcataaagcgttctatattagccgctgagttttaacaccttctctggacactcatcatatagtctatttttggcccaacttcttttgaaagggcccattctttacctcatttagataaatcagataggtctttcttgcttacttcattaacaactcaattaattataaccacatcacatgaagattagatgtaattaggacctgtccaatgtctttacatcccagtccttctgtactcctaaccttaagcaaattggtcgacctctgtaggtctaagtattctgtgtgtaacatgaaagctttgaattaggccacgtttccggctaattttttaaaaagtgtttgtgatcctgtgaattccataacccaccaccttccttttccaactcttcaccttttaaatccactttccatctctccagaggaaagggcattgagagtagaggaagcaagtccctttcactaaagcagcctggtttgaaaaagccggtaatctctgaactgtctcttgcttgaacaagaaaaactccctctgaaatacctttttctccttgtgatagcaacagaaaccaagcagcaacagcccttggaaagaggctaaatttttcttgacttctgcagcaacaaagaccgtgaaaagttggcacttctggcctaacgctgccgtcatcctacccctcaccccagggcaacccaggctggacatttagtgcctccctctttattcctctgtgatcatccagatcagcacttgactgtttattttcaaatctcacgaacctcaccccaagatcttcacattctggatctcagctgctcttgaaggacagtgacttgttaccaccgcaacagcagagcctgccatccccaacagatcaccagttgtccctgacatcgtgccctaccttgtctccctttgtggtctcctaaatgcccatctcgttggccttggttcggctagtggtatggaggggtgctgcctagcactgacctgagagtgtgtgtgacccactgacccaatggacatcaaaggccagttctggaatgatgacgactcggagggagataatgaatcagaggaatttctctatggcgttcaggggagctgtgcagctgacctgtatcgacacccacagcttgatgcagacattgaagccgtgaaggagatctacagtgagaactctgtatccatcagagaatatggaactatcgatgacgtggacattgacctccacatcaacatcagcttcctcgatgaggaagtctctacagcctggaaggtcctccggacagaacctattgtgttgaggctgcgattttctctctcccagtacctagatggaccagaaccatccattgaggttttccagccatcaaataaggaaggatttgggctgggtcttcagttgaaaaagatcctgggtatgtttacatcccaacaatggaaacatctgagcaatgatttcttgaagacccagcaggagaagaggcacagttggttcaaggcaagtggtaccatcaagaagttccgagctggcctcagcatcttttcacccatccccaagtctcccagtttccctatcatacaggactccatgctgaaaggcaaactaggtgtaccagagcttcgggttgggcgcctcatgaaccgttccatctcctgtaccatgaagaaccccaaagtggaagtgtttggctaccctcccagcccccaggtcagtggtcactgcaagaacattcccactctggagtatggattcctcgttcagatcatgaagtatgcagaacagaggattccaacattgaatgagtactgtgtggtgtgtgatgagcagcatgtcttccaaaatggatctatgctgaagccagctgtctgtactcgtgaactatgcgttttctccttctacacactgggcgtcatgtctggagctgcagaggaggtggccactggagcagaggtggtggatctgctggtggccatgtgtagggcagctttagagtcccctagaaagagcatcatctttgagccttatccctctgtggtggaccccactgatcccaagactctggcctttaaccctaagaagaagaattatgagcggcttcagaaagctctggatagtgtgatgtctattcgggagatgacccagggctcatatttggaaatcaagaaacagatggacaagttggatcccctggcccatcctctcctgcagtggatcatctctagcaacaggtcacacattgtcaaactacctctcagcaggcagctgaagttcatgcacacctcacaccagttcctcctgctgagcagccctcctgccaaggaggctcggttccggaccgccaagaagctctatggcagcacctttgccttccatgggtcccacattgagaactggcattcgatcctgcgcaatgggctggtcaatgcatcctacaccaaactgcaggaatgggaaaaggacagcacaggatgccctccaaggatgagctggtccagagatacaacaggatgaataccatcccccagacccgatccattcagtcacggttcctgcagagtcggaatctaaactgtatagcactttgtgaagtgattacatctaaggacctccagaagcatgggaacatctgggtgtgccctgtgtccgaccatgtctgcacaagattcttctttgtgtaagtgtcggagggactctggggattactcgaggagtgaggttgggggtgtgatggtgtgtggctactgggaaaagtctatttctgttatctgagacatgtccttggctacctgagtggagctgtcactgggactttaccattggaggatgggaatgggtatagatggttgggatctatctagaggaaaccagataagctgaatatcttccactatgaagcagtgagaaagggctttgacttctgggatgggatggccataccttgaaatacagttccactgattgatgttattctggtattgttctccctcttatgctcacacttgccctatctttggcagatatgaggatggtcaggtgggcgatgccaacattaatactcaggaccccaagatacagaaggaaatcatgcgtgtgatcggaactcaggtttacacaaactgagggggccccagccctcgtaccacccctgttaccccaggatccatctgccctcataaaagtgttcaggtacagcagctgaggctgccctgaggaatcaaggggccattaccaaggggcaggaaaaggatatgtaagaggtggccttcatggtagagcttgacccaagaactactccacattcggatggcccagactgactccatcccctgactttccctttgacttcaccctgtttgtaaataaaacaataaaatggaaggtgctgtggactgga

SEQ ID NO: 299328 - DNA, 1077 bp, Homo sapiens
cggcttgatctgatcctagcttgcctcttctacatcatttctcaccactcctctgcaattcactattctctatgcaactaacacacactaccttatctttccttcaggccttctgtatcctattacttcttcccagacacttccccgctgtttatttaattaactcttcctaatcctgcagttctcagtctagctgtcaccacatgacttctttaaactcttaggctaggctagttgccctcctctaggctcacaccatgctctataatctgcatcacaaccccttaccatgctgtgttgttaattacttgttcttgcttgtaatttccagcagactaaattctgtgggggaaaataatcttctttgttttattctctgctgttttgatgagcatctagctcagtgctgggacatagtaggcactttcgtaaatttttgataaatgaagtgggtgtattgttctgtgacaggaatgggaaaaggacagcacaggatgccctccaaggatgagctggtccagagatacaacaggatgaataccatcccccagacccgatccattcagtcacggttcctgcagagtcggaatctaaactgtatagcactttgtgaagtgattacatctaaggacctccagaagcatgggaacatctgggtgtgccctgtgtccgaccatgtctgcacaagattcttctttgtatatgaggatggtcaggtgggcgatgccaacattaatactcaggaccccaagatacagaaggaaatcatgcgtgtgatcggaactcaggtttacacaaactgagggggccccagccctcgtaccacccctgttaccccaggatccatctgccctcataaaagtgttcaggtacagcagctgaggctgccctgaggaatcaaggggccattaccaaggggcaggaaaaggatatgtaagaggtggccttcatggtagagcttgacccaagaactactccacattcggatggcccagactgactccatcccctgactttccctttgacttcaccctgtttgtaaataaaacaataaaatggaaggtgctgtggactgga

SEQ ID NO: 299329 - DNA, 4103 bp, Homo sapiens
gaatttttaaaagcccgaggtgttcgacttccattgtcgaaccagagaatcctgcagtcagcaaggcctcaggacttccctcagtctctacctgccggccccaacctccggcgaggggactccctcccggcctacaggcaacctgggttgcccttcctgcttgttcctcccaaccactcggggcgctaaatgcaagtattctcctttggaaggctccccgcactcccccagagtccctgttccttctccactgcctcccctacccacggcgcaggcgccaccccccactccgcaccctttcccgactagcgaccgccgcgcaggcgtctcagggctggcgtcggctgctgaggcgcgcccaggagcaggccgtcaggctgttggtcaggagcgggccacgtgccatcgtgtcaccgcgcgagcgtgcgcagagtggctgagcgcgcccgtgacggaacgacgaggcgtggggtgcgcgacctcgcccgccaggcccggcccccgccccttggcctgccgctccgcccccgcggggcgtcccgggccgctcgtcccgtcggctgcggccgcgcgcggcccggggtcgccgtgagtactcgccaggctggcctgtgtggccgccaccacgggcacagggcggtgcggccgggccacgggaagggtgcggggctcgccccgtctccgcaggggtggacgaagtgagaggcttggaccgggaggttctgagggcccctcctaggctggacaggcttcactcaggcccggcggccgggcggcatagatcgggcccagagcgtctttcctggggaggcaggtgttgggtgtttttggggtcttcaggggagccccggagaacaggtgtaactgcttccccgggagaggcctcagggcctgtcctggaagcacgggtgccagagagtgttttcgcggggcagccgtatcctctctccctgcggggtgcccgagatagcgctaacctgcgggagtcgcccctcagtgattcttcctagtagtctttgtttagtggcctactcctgagaagggagcacacgggatggagtggagtaacctcctccaggaccacaaagccgggagcccaacccacaatttaaacattgagctctgaagctgctttgactagacgtgaagttgtcacacctagagaagcgcccatggacctagggaaagacctttgtgatccagacttgaggctcatttacatttgacttattctcgtggaaactcataaagcgttctatattagccgctgagttttaacaccttctctggacactcatcatatagtctatttttggcccaacttcttttgaaagggcccattctttacctcatttagataaatcagataggtctttcttgcttacttcattaacaactcaattaattataaccacatcacatgaagattagatgtaattaggacctgtccaatgtctttacatcccagtccttctgtactcctaaccttaagcaaattggtcgacctctgtaggtctaagtattctgtgtgtaacatgaaagctttgaattaggccacgtttccggctaattttttaaaaagtgtttgtgatcctgtgaattccataacccaccaccttccttttccaactcttcaccttttaaatccactttccatctctccagaggaaagggcattgagagtagaggaagcaagtccctttcactaaagcagcctggtttgaaaaagccggtaatctctgaactgtctcttgcttgaacaagaaaaactccctctgaaatacctttttctccttgtgatagcaacagaaaccaagcagcaacagcccttggaaagaggctaaatttttcttgacttctgcagcaacaaagaccgtgaaaagttggcacttctggcctaacgctgccgtcatcctacccctcaccccagggcaacccaggctggacatttagtgcctccctctttattcctctgtgatcatccagatcagcacttgactgtttattttcaaatctcacgaacctcaccccaagatcttcacattctggatctcagctgctcttgaaggacagtgacttgttaccaccgcaacagcagagcctgccatccccaacagatcaccagttgtccctgacatcgtgccctaccttgtctccctttgtggtctcctaaatgcccatctcgttggccttggttcggctagtggtatggaggggtgctgcctagcactgacctgagagtgtgtgtgacccactgacccaatggacatcaaaggccagttctggaatgatgacgactcggagggagataatgaatcagaggaatttctctatggcgttcaggggagctgtgcagctgacctgtatcgacacccacagcttgatgcagacattgaagccgtgaaggagatctacagtgagaactctgtatccatcagagaatatggaactatcgatgacgtggacattgacctccacatcaacatcagcttcctcgatgaggaagtctctacagcctggaaggtcctccggacagaacctattgtgttgaggctgcgattttctctctcccagtacctagatggaccagaaccatccattgaggttttccagccatcaaataaggaaggatttgggctgggtcttcagttgaaaaagatcctgggtatgtttacatcccaacaatggaaacatctgagcaatgatttcttgaagacccagcaggagaagaggcacagttggttcaaggcaagtggtaccatcaagaagttccgagctggcctcagcatcttttcacccatccccaagtctcccagtttccctatcatacaggactccatgctgaaaggcaaactaggtgtaccagagcttcgggttgggcgcctcatgaaccgttccatctcctgtaccatgaagaaccccaaagtggaagtgtttggctaccctcccagcccccaggtcagtggtcactgcaagaacattcccactctggagtatggattcctcgttcagatcatgaagtatgcagaacagaggattccaacattgaatgagtactgtgtggtgtgtgatgagcagcatgtcttccaaaatggatctatgctgaagccagctgtctgtactcgtgaactatgcgttttctccttctacacactgggcgtcatgtctggagctgcagaggaggtggccactggagcagaggtggtggatctgctggtggccatgtgtagggcagctttagagtcccctagaaagagcatcatctttgagccttatccctctgtggtggaccccactgatcccaagactctggcctttaaccctaagaagaagaattatgagcggcttcagaaagctctggatagtgtgatgtctattcgggagatgacccagggctcatatttggaaatcaagaaacagatggacaagttggatcccctggcccatcctctcctgcagtggatcatctctagcaacaggtcacacattgtcaaactacctctcagcaggcagctgaagttcatgcacacctcacaccagttcctcctgctgagcagccctcctgccaaggaggctcggttccggaccgccaagaagctctatggcagcacctttgccttccatgggtcccacattgagaactggcattcgatcctgcgcaatgggctggtcaatgcatcctacaccaaactgcaggaatgggaaaaggacagcacaggatgccctccaaggatgagctggtccagagatacaacaggatgaataccatcccccagacccgatccattcagtcacggttcctgcagagtcggaatctaaactgtatagcactttgtgaagtgattacatctaaggacctccagaagcatgggaacatctgggtgtgccctgtgtccgaccatgtctgcacaagattcttctttgtatatgaggatggtcaggtgggcgatgccaacattaatactcaggaccccaagatacagaaggaaatcatgcgtgtgatcggaactcaggtttacacaaactgagggggccccagccctcgtaccacatggtaacaccaagtgggctacgtcgggatcctctagatcagccgcagcatc

SEQ ID NO: 299330 - DNA, 3519 bp, Homo sapiens
gaatttttaaaagcccgaggtgttcgacttccattgtcgaaccagagaatcctgcagtcagcaaggcctcaggacttccctcagtctctacctgccggccccaacctccggcgaggggactccctcccggcctacaggcaacctgggttgcccttcctgcttgttcctcccaaccactcggggcgctaaatgcaagtattctcctttggaaggctccccgcactcccccagagtccctgttccttctccactgcctcccctacccacggcgcaggcgccaccccccactccgcaccctttcccgactagcgaccgccgcgcaggcgtctcagggctggcgtcggctgctgaggcgcgcccaggagcaggccgtcaggctgttggtcaggagcgggccacgtgccatcgtgtcaccgcgcgagcgtgcgcagagtggctgagcgcgcccgtgacggaacgacgaggcgtggggtgcgcgacctcgcccgccaggcccggcccccgccccttggcctgccgctccgcccccgcggggcgtcccgggccgctcgtcccgtcggctgcggccgcgcgcggcccggggtcgccgtgagtactcgccaggctggcctgtgtggccgccaccacgggcacagggcggtgcggccgggccacgggaagggtgcggggctcgccccgtctccgcaggggtggacgaagtgagaggcttggaccgggaggttctgagggcccctcctaggctggacaggcttcactcaggcccggcggccgggcggcatagatcgggcccagagcgtctttcctggggaggcaggtgttgggtgtttttggggtcttcaggggagccccggagaacaggtgtaactgcttccccgggagaggcctcagggcctgtcctggaagcacgggtgccagagagtgttttcgcggggcagccgtatcctctctccctgcggggtgcccgagatagcgctaacctgcgggagtcgcccctcagtgattcttcctagtagtctttgtttagtggcctactcctgagaagggagcacacgggatggagtggagtaacctcctccaggaccacaaagccgggagcccaacccacaatttaaacattgagctctgaagctgctttgactagacgtgaagttgtcacacctagagaagcgcccatggacctagggaaagacctttgtgatccagacttgaggctcatttacatttgacttattctcgtggaaactcataaagcgttctatattagccgctgagttttaacaccttctctggacactcatcatatagtctatttttggcccaacttcttttgaaagggcccattctttacctcatttagataaatcagataggtctttcttgcttacttcattaacaactcaattaattataaccacatcacatgaagattagatgtaattaggacctgtccaatgtctttacatcccagtccttctgtactcctaaccttaagcaaattggtcgacctctgtaggtctaagtattctgtgtgtaacatgaaagctttgaattaggccacgtttccggctaattttttaaaaagtgtttgtgatcctgtgaattccataacccaccaccttccttttccaactcttcaccttttaaatccactttccatctctccagaggaaagggcattgagagtagaggaagcaagtccctttcactaaagcagcctggtttgaaaaagccggtaatctctgaactgtctcttgcttgaacaagaaaaactccctctgaaatacctttttctccttgtgatagcaacagaaaccaagcagcaacagcccttggaaagaggctaaatttttcttgacttctgcagcaacaaagaccgtgaaaagttggcacttctggcctaacgctgccgtcatcctacccctcaccccagggcaacccaggctggacatttagtgcctccctctttattcctctgtgatcatccagatcagcacttgactgtttattttcaaatctcacgaacctcaccccaagatcttcacattctggatctcagctgctcttgaaggacagtgacttgttaccaccgcaacagcagagcctgccatccccaacagatcaccagttgtccctgacatcgtgccctaccttgtctccctttgtggtctcctaaatgcccatctcgttggccttggttcggctagtggtatggaggggtgctgcctagcactgacctgagagtgtgtgtgacccactgacccaatggacatcaaaggccagttctggaatgatgacgactcggagggagataatgaatcagaggaatttctctatggcgttcaggggagctgtgcagctgacctgtatcgacacccacagcttgatgcagacattgaagccgtgaaggagatctacagtgagaactctgtatccatcagagaatatggaactatcgatgacgtggacattgacctccacatcaacatcagcttcctcgatgaggaagtctctacagcctggaaggtcctccggacagaacctattgtgttgaggctgcgattttctctctcccagtacctagatggaccagaaccatccattgaggttttccagccatcaaataaggaaggatttgggctgggtcttcagttgaaaaagatcctgggtatgtttacatcccaacaatggaaacatctgagcaatgatttcttgaagacccagcaggagaagaggcacagttggttcaaggcaagtggtaccatcaagaagttccgagctggcctcagcatcttttcacccatccccaagtctcccagtttccctatcatacaggactccatgctgaaaggcaaactaggtgtaccagagcttcgggttgggcgcctcatgaaccgttccatctcctgtaccatgaagaaccccaaagtggaagtgtttggctaccctcccagcccccaggcaggtctcctgtgccctcagcacgtgggcctccctcccccagcacggacctctcctttggtcagtggtcactgcaagaacattcccactctggagtatggattcctcgttcagatcatgaagtatgcagaacagaggattccaacattgaatgagtactgtgtggtgtgtgatgagcagcatgtcttccaaaatggatctatgctgaagccagctgtctgtactcgtgaactatgcgttttctccttctacacactgggcgtcatgtctggagctgcagaggaggtggccactggagcagaggtggtggatctgctggtggccatgtgtagggcagctttagagtcccctagaaagagcatcatctttgagccttatccctctgtggtggaccccactgatcccaagactctggcctttaaccctaagcttcatggtagagcttgacccaagaactactccacattcggatggcccagactgactccatcccctgactttccctttgacttcaccctgtttgtaaataaaacaataaaatggaaggtgctgtggactgga

SEQ ID NO: 299331 - DNA, 3913 bp, Homo sapiens
gaatttttaaaagcccgaggtgttcgacttccattgtcgaaccagagaatcctgcagtcagcaaggcctcaggacttccctcagtctctacctgccggccccaacctccggcgaggggactccctcccggcctacaggcaacctgggttgcccttcctgcttgttcctcccaaccactcggggcgctaaatgcaagtattctcctttggaaggctccccgcactcccccagagtccctgttccttctccactgcctcccctacccacggcgcaggcgccaccccccactccgcaccctttcccgactagcgaccgccgcgcaggcgtctcagggctggcgtcggctgctgaggcgcgcccaggagcaggccgtcaggctgttggtcaggagcgggccacgtgccatcgtgtcaccgcgcgagcgtgcgcagagtggctgagcgcgcccgtgacggaacgacgaggcgtggggtgcgcgacctcgcccgccaggcccggcccccgccccttggcctgccgctccgcccccgcggggcgtcccgggccgctcgtcccgtcggctgcggccgcgcgcggcccggggtcgccgtgagtactcgccaggctggcctgtgtggccgccaccacgggcacagggcggtgcggccgggccacgggaagggtgcggggctcgccccgtctccgcaggggtggacgaagtgagaggcttggaccgggaggttctgagggcccctcctaggctggacaggcttcactcaggcccggcggccgggcggcatagatcgggcccagagcgtctttcctggggaggcaggtgttgggtgtttttggggtcttcaggggagccccggagaacaggtgtaactgcttccccgggagaggcctcagggcctgtcctggaagcacgggtgccagagagtgttttcgcggggcagccgtatcctctctccctgcggggtgcccgagatagcgctaacctgcgggagtcgcccctcagtgattcttcctagtagtctttgtttagtggcctactcctgagaagggagcacacgggatggagtggagtaacctcctccaggaccacaaagccgggagcccaacccacaatttaaacattgagctctgaagctgctttgactagacgtgaagttgtcacacctagagaagcgcccatggacctagggaaagacctttgtgatccagacttgaggctcatttacatttgacttattctcgtggaaactcataaagcgttctatattagccgctgagttttaacaccttctctggacactcatcatatagtctatttttggcccaacttcttttgaaagggcccattctttacctcatttagataaatcagataggtctttcttgcttacttcattaacaactcaattaattataaccacatcacatgaagattagatgtaattaggacctgtccaatgtctttacatcccagtccttctgtactcctaaccttaagcaaattggtcgacctctgtaggtctaagtattctgtgtgtaacatgaaagctttgaattaggccacgtttccggctaattttttaaaaagtgtttgtgatcctgtgaattccataacccaccaccttccttttccaactcttcaccttttaaatccactttccatctctccagaggaaagggcattgagagtagaggaagcaagtccctttcactaaagcagcctggtttgaaaaagccggtaatctctgaactgtctcttgcttgaacaagaaaaactccctctgaaatacctttttctccttgtgatagcaacagaaaccaagcagcaacagcccttggaaagaggctaaatttttcttgacttctgcagcaacaaagaccgtgaaaagttggcacttctggcctaacgctgccgtcatcctacccctcaccccagggcaacccaggctggacatttagtgcctccctctttattcctctgtgatcatccagatcagcacttgactgtttattttcaaatctcacgaacctcaccccaagatcttcacattctggatctcagctgctcttgaaggacagtgacttgttaccaccgcaacagcagagcctgccatccccaacagatcaccagttgtccctgacatcgtgccctaccttgtctccctttgtggtctcctaaatgcccatctcgttggccttggttcggctagtggtatggaggggtgctgcctagcactgacctgagagtgtgtgtgacccactgacccaatggacatcaaaggccagttctggaatgatgacgactcggagggagataatgaatcagaggaatttctctatggcgttcaggggagctgtgcagctgacctgtatcgacacccacagcttgatgcagacattgaagccgtgaaggagatctacagtgagaactctgtatccatcagagaatatggaactatcgatgacgtggacattgacctccacatcaacatcagcttcctcgatgaggaagtctctacagcctggaaggtcctccggacagaacctattgtgttgaggctgcgattttctctctcccagtacctagatggaccagaaccatccattgaggttttccagccatcaaataaggaaggatttgggctgggtcttcagttgaaaaagatcctgggtatgtttacatcccaacaatggaaacatctgagcaatgatttcttgaagacccagcaggagaagaggcacagttggttcaaggcaagtggtaccatcaagaagttccgagctggcctcagcatcttttcacccatccccaagtctcccagtttccctatcatacaggactccatgctgaaaggcaaactaggtgtaccagagcttcgggttgggcgcctcatgaaccgttccatctcctgtaccatgaagaaccccaaagtggaagtgtttggctaccctcccagcccccaggtcagtggtcactgcaagaacattcccactctggagtatggattcctcgttcagatcatgaagtatgcagaacagaggattccaacattgaatgagtactgtgtggtgtgtgatgagcagcatgtcttccaaaatggatctatgctgaagccagctgtctgtactcgtgaactatgcgttttctccttctacacactgggcgtcatgtctggagctgcagaggaggtggccactggagcagaggtggtggatctgctggtggccatgtgtagggcagctttagagtcccctagaaagagcatcatctttgagccttatccctctgtggtggaccccactgatcccaagactctggcctttaaccctaagaagaagaattatgagcggcttcagaaagctctggatagtgtgatgtctattcgggagatgacccagggctcatatttggaaatcaagaaacagatggacaagttggatcccctggcccatcctctcctgcagtggatcatctctagcaacaggtcacacattgtcaaactacctctcagcaggcagctgaagttcatgcacacctcacaccagttcctcctgctgagcagccctcctgccaaggaggctcggttccggaccgccaagaagctctatggcagcacctttgccttccagtgaggaggctgggggctgggcagtgggggtggtgagggggcggggatgagcaagaaggatgcccttgagatatgagtttgtgttacatgtgtccatcaaccagtcagcagatacttactaaatgctattgtggtaggtgctatagaggacaaaaaggtacatataatgtggtctttattctcaaactatttatgatgtagttgaggaaaaatgacatttacatgtgaaaagatgtggctgaagaaatagattggagagaacagatctgaaagctactttgatggaaaaa

SEQ ID NO: 299332 - DNA, 3765 bp, Homo sapiens
gaatttttaaaagcccgaggtgttcgacttccattgtcgaaccagagaatcctgcagtcagcaaggcctcaggacttccctcagtctctacctgccggccccaacctccggcgaggggactccctcccggcctacaggcaacctgggttgcccttcctgcttgttcctcccaaccactcggggcgctaaatgcaagtattctcctttggaaggctccccgcactcccccagagtccctgttccttctccactgcctcccctacccacggcgcaggcgccaccccccactccgcaccctttcccgactagcgaccgccgcgcaggcgtctcagggctggcgtcggctgctgaggcgcgcccaggagcaggccgtcaggctgttggtcaggagcgggccacgtgccatcgtgtcaccgcgcgagcgtgcgcagagtggctgagcgcgcccgtgacggaacgacgaggcgtggggtgcgcgacctcgcccgccaggcccggcccccgccccttggcctgccgctccgcccccgcggggcgtcccgggccgctcgtcccgtcggctgcggccgcgcgcggcccggggtcgccgtgagtactcgccaggctggcctgtgtggccgccaccacgggcacagggcggtgcggccgggccacgggaagggtgcggggctcgccccgtctccgcaggggtggacgaagtgagaggcttggaccgggaggttctgagggcccctcctaggctggacaggcttcactcaggcccggcggccgggcggcatagatcgggcccagagcgtctttcctggggaggcaggtgttgggtgtttttggggtcttcaggggagccccggagaacaggtgtaactgcttccccgggagaggcctcagggcctgtcctggaagcacgggtgccagagagtgttttcgcggggcagccgtatcctctctccctgcggggtgcccgagatagcgctaacctgcgggagtcgcccctcagtgattcttcctagtagtctttgtttagtggcctactcctgagaagggagcacacgggatggagtggagtaacctcctccaggaccacaaagccgggagcccaacccacaatttaaacattgagctctgaagctgctttgactagacgtgaagttgtcacacctagagaagcgcccatggacctagggaaagacctttgtgatccagacttgaggctcatttacatttgacttattctcgtggaaactcataaagcgttctatattagccgctgagttttaacaccttctctggacactcatcatatagtctatttttggcccaacttcttttgaaagggcccattctttacctcatttagataaatcagataggtctttcttgcttacttcattaacaactcaattaattataaccacatcacatgaagattagatgtaattaggacctgtccaatgtctttacatcccagtccttctgtactcctaaccttaagcaaattggtcgacctctgtaggtctaagtattctgtgtgtaacatgaaagctttgaattaggccacgtttccggctaattttttaaaaagtgtttgtgatcctgtgaattccataacccaccaccttccttttccaactcttcaccttttaaatccactttccatctctccagaggaaagggcattgagagtagaggaagcaagtccctttcactaaagcagcctggtttgaaaaagccggtaatctctgaactgtctcttgcttgaacaagaaaaactccctctgaaatacctttttctccttgtgatagcaacagaaaccaagcagcaacagcccttggaaagaggctaaatttttcttgacttctgcagcaacaaagaccgtgaaaagttggcacttctggcctaacgctgccgtcatcctacccctcaccccagggcaacccaggctggacatttagtgcctccctctttattcctctgtgatcatccagatcagcacttgactgtttattttcaaatctcacgaacctcaccccaagatcttcacattctggatctcagctgctcttgaaggacagtgacttgttaccaccgcaacagcagagcctgccatccccaacagatcaccagttgtccctgacatcgtgccctaccttgtctccctttgtggtctcctaaatgcccatctcgttggccttggttcggctagtggtatggaggggtgctgcctagcactgacctgagagtgtgtgtgacccactgacccaatggacatcaaaggccagttctggaatgatgacgactcggagggagataatgaatcagaggaatttctctatggcgttcaggggagctgtgcagctgacctgtatcgacacccacagcttgatgcagacattgaagccgtgaaggagatctacagtgagaactctgtatccatcagagaatatggaactatcgatgacgtggacattgacctccacatcaacatcagcttcctcgatgaggaagtctctacagcctggaaggtcctccggacagaacctattgtgttgaggctgcgattttctctctcccagtacctagatggaccagaaccatccattgaggttttccagccatcaaataaggaaggatttgggctgggtcttcagttgaaaaagatcctgggtatgtttacatcccaacaatggaaacatctgagcaatgatttcttgaagacccagcaggagaagaggcacagttggttcaaggcaagtggtaccatcaagaagttccgagctggcctcagcatcttttcacccatccccaagtctcccagtttccctatcatacaggactccatgctgaaaggcaaactaggtgtaccagagcttcgggttgggcgcctcatgaaccgttccatctcctgtaccatgaagaaccccaaagtggaagtgtttggctaccctcccagcccccaggtcagtggtcactgcaagaacattcccactctggagtatggattcctcgttcagatcatgaagtatgcagaacagaggattccaacattgaatgagtactgtgtggtgtgtgatgagcagcatgtcttccaaaatggatctatgctgaagccagctgtctgtactcgtgaactatgcgttttctccttctacacactgggcgtcatgtctggagctgcagaggaggtggccactggagcagaggtggtggatctgctggtggccatgtgtagggcagctttagagtcccctagaaagagcatcatctttgagccttatccctctgtggtggaccccactgatcccaagactctggcctttaaccctaagaagaagaattatgagcggcttcagaaagctctggatagtgtgatgtctattcgggagatgacccagggctcatatttggaaatcaagaaacagatggacaagttggatcccctggcccatcctctcctgcagtggatcatctctagcaacaggtcacacattgtcaaactacctctcagcaggtgggtcccaaatctagcctgttggtggagcagcacctgtatcaggcgttccaccttatccatccgagacaccacggcatgattcgggcccatggcaagatggcagcttctagcctcagtcacaggcttccgtttgccatcgaggcacagcagcgcaaagtctgccagcttcaaatccttagcccatgcctcattgttatttccatcagtgttctgcaagacagtgacatctttcacaaatgcaccgtctccagaa

SEQ ID NO: 299333 - DNA, 2458 bp, Homo sapiens
gaatttttaaaagcccgaggtgttcgacttccattgtcgaaccagagaatcctgcagtcagcaaggcctcaggacttccctcagtctctacctgccggccccaacctccggcgaggggactccctcccggcctacaggcaacctgggttgcccttcctgcttgttcctcccaaccactcggggcgctaaatgcaagtattctcctttggaaggctccccgcactcccccagagtccctgttccttctccactgcctcccctacccacggcgcaggcgccaccccccactccgcaccctttcccgactagcgaccgccgcgcaggcgtctcagggctggcgtcggctgctgaggcgcgcccaggagcaggccgtcaggctgttggtcaggagcgggccacgtgccatcgtgtcaccgcgcgagcgtgcgcagagtggctgagcgcgcccgtgacggaacgacgaggcgtggggtgcgcgacctcgcccgccaggcccggcccccgccccttggcctgccgctccgcccccgcggggcgtcccgggccgctcgtcccgtcggctgcggccgcgcgcggcccggggtcgccgtgagtactcgccaggctggcctgtgtggccgccaccacgggcacagggcggtgcggccgggccacgggaagggtgcggggctcgccccgtctccgcaggggtggacgaagtgagaggcttggaccgggaggttctgagggcccctcctaggctggacaggcttcactcaggcccggcggccgggcggcatagatcgggcccagagcgtctttcctggggaggcaggtgttgggtgtttttggggtcttcaggggagccccggagaacaggtgtaactgcttccccgggagaggcctcagggcctgtcctggaagcacgggtgccagagagtgttttcgcggggcagccgtatcctctctccctgcggggtgcccgagatagcgctaacctgcgggagtcgcccctcagtgattcttcctagtagtctttgtttagtggcctactcctgagaagggagcacacgggatggagtggagtaacctcctccaggaccacaaagccgggagcccaacccacaatttaaacattgagctctgaagctgctttgactagacgtgaagttgtcacacctagagaagcgcccatggacctagggaaagacctttgtgatccagacttgaggctcatttacatttgacttattctcgtggaaactcataaagcgttctatattagccgctgagttttaacaccttctctggacactcatcatatagtctatttttggcccaacttcttttgaaagggcccattctttacctcatttagataaatcagataggtctttcttgcttacttcattaacaactcaattaattataaccacatcacatgaagattagatgtaattaggacctgtccaatgtctttacatcccagtccttctgtactcctaaccttaagcaaattggtcgacctctgtaggtctaagtattctgtgtgtaacatgaaagctttgaattaggccacgtttccggctaattttttaaaaagtgtttgtgatcctgtgaattccataacccaccaccttccttttccaactcttcaccttttaaatccactttccatctctccagaggaaagggcattgagagtagaggaagcaagtccctttcactaaagcagcctggtttgaaaaagccggtaatctctgaactgtctcttgcttgaacaagaaaaactccctctgaaatacctttttctccttgtgatagcaacagaaaccaagcagcaacagcccttggaaagaggctaaatttttcttgacttctgcagcaacaaagaccgtgaaaagttggcacttctggcctaacgctgccgtcatcctacccctcaccccagggcaacccaggctggacatttagtgcctccctctttattcctctgtgatcatccagatcagcacttgactgtttattttcaaatctcacgaacctcaccccaagatcttcacattctggatctcagctgctcttgaaggacagtgacttgttaccaccgcaacagcagagcctgccatccccaacagatcaccagttgtccctgacatcgtgccctaccttgtctccctttgtggtctcctaaatgcccatctcgttggccttggttcggctagtggtatggaggggtgctgcctagcactgacctgagagtgtgtgtgacccactgacccaatggtgagaactgactgcccacctctccaactgattgttcaaagggtagaggagacaaagtgcagatctcaccctttcttggtattttcccttctacccttttggaagatagagtggctatttgaagttaaaggaaagggaaggggcacagaaacagtattacttggtgtgtttgtgtagtgggttttcttgggga

SEQ ID NO: 299334 - DNA, 375 bp, Homo sapiens
gctcatattactcatcctggtgtttccctgcaagctgcatggagcagcctatggcaaaggcatctacctgagccccatctccagtatttcctttggatactcaggtaagaaatattctgtggccaccttgactctatttacattgcctccatttgtgaatacatgatttgtgctgtctgttcctccctcattatggatacttggtctgtgtcagctctctccccgatcatggatacatattctctctctctctacattttcttattagaaatttagattctttacaaggtgaggccagttattgttaaaaatgatggttttattcatagcaggggcttggccctgggaatgggtggaggaataacagggacataa

SEQ ID NO: 299335 - DNA, 2609 bp, Homo sapiens
ccccagtgaggctggaccgactgtcggaggcagccaaggtgaacacagacgctatgcgctcagcgcaggaggagataactgagtaccggcgtcagctgcaggccaggaccacagagctggaggcactgaaaagcaccaaggactcactggagaggcagcgctctgagctggaggaccgtcatcaggccgacattgcctcctaccaggaagccattcagcagctggacgctgagctgaggaacaccaagtgggagatggccgcccagctgcgagaataccaggacctgctcaatgtcaagatggctctggatatagagatagccgcttacagaaaactcctggaaggtgaagagtgtcggattggctttggcccaattcctttctcgcttccagaaggactccccaaaattccctctgtgtccactcacataaaggtgaaaagcgaagagaagatcaaagtggtggagaagtctgagaaagaaactgtgattgtggaggaacagacagaggagacccaagtgactgaagaagtgactgaagaagaggagaaagaggccaaagaggaggagggcaaggaggaagaagggggtgaagaagaggaggcagaagggggagaagaagaaacaaagtctcccccagcagaagaggctgcatccccagagaaggaagccaagtcaccagtaaaggaagaggcaaagtcaccggctgaggccaagtccccagagaaggaggaagcaaaatccccagccgaagtcaagtcccctgagaaggccaagtctccagcaaaggaagaggcaaagtcaccgcctgaggccaagtccccagagaaggaggaagcaaaatctccagctgaggtcaagtcccccgagaaggccaagtccccagcaaaggaagaggcaaagtcaccggctgaggccaagtctccagagaaggccaagtccccagtgaaggaagaagcaaagtcaccggctgaggccaagtccccagtgaaggaagaagcaaaatctccagctgaggtcaagtccccggaaaaggccaagtctccaacgaaggaggaagcaaagtcccctgagaaggcagtcccctgagaaggccaagtccccagtgaaggaagaagcaaagtcccctgagaaggccaagtccccagtgaaggaagaagcaaagacccccgagaaggccaagtccccagtgaaggaagaagccaagtccccagagaaggccaagtccccagagaaggccaagactcttgatgtgaagtctccagaagccaagactccagcgaaggaggaagcaaggtcccctgcagacaaattccctgaaaaggccaaaagccctgtcaaggaggaggtcaagtccccagagaaggcgaaatctcccctgaaggaggatgccaaggcccctgagaaggagatcccaaaaaaggaagaggtgaagtccccagtgaaggaggaggagaagccccaggaggtgaaagtcaaagagcccccaaagaaggcagaggaagagaaagcccctgccacaccaaaaacagaggagaagaaggacagcaagaaagaggaggcacccaagaaggaggctccaaagcccaaggtggaggagaagaaggaacctgctgtcgaaaagcccaaagaatccaaagttgaagccaagaaggaagaggctgaagataagaaaaaagtccccaccccagagaaggaggctcctgccaaggtggaggtgaaggaagacgctaaacccaaagaaaagacagaggtggccaagaaggaaccagatgatgccaaggccaaggaacccagcaaaccagcagagaagaaggaggcagcaccggagaaaaaagacaccaaggaggagaaggccaagaagcctgaggagaaacccaagacagaggccaaagccaaggaagatgacaagaccctctcaaaagagcctagcaagcctaaggcagaaaaggctgaaaaatcctccagcacagaccaaaaagacagcaagcctccagagaaggccacagaagacaaggccgccaaggggaagtaaggcagggagaaaggaacatccggaacagccaaagaaactcagaagagtcccggagctcaaggatcagagtaacacaattttcactttttctgtctttatgtaagaagaaactgcttagatgacggggcctccttcttcaaacaggaatttctgttagcaatatgttagcaagagagggcactcccaggcccctgcccccatgccctccccaggcgatggacaattatgatagcttatgtagctgaatgtgatacatgccgaatgccacacgtaaacacttgactataaaaactgcccccctcctttccaaataagtgcatttattgcctctatgtgcaactgacagatgaccgcaataatgaatgagcagttagaaatacattatgcttgagatgtcttaacctattcccaaatgccttctgttttccaaaggagtggtcaagcccttgcccagagctctctattctggaagagcggtccaggtggggccgggcactggccactgaattatgccagggcgcactttccactggagttcactttcaattgcttctgtgcaataaaaccaagtgctt

SEQ ID NO: 299336 - DNA, 2425 bp, Homo sapiens
gtgtgtcacctctccttcccaggaagccattcagcagctggacgctgagctgaggaacaccaagtgggagatggccgcccagctgcgagaataccaggacctgctcaatgtcaagatggctctggatatagagatagccgcttacagaaaactcctggaaggtgaagagtgtcggattggctttggcccaattcctttctcgcttccagaaggactccccaaaattccctctgtgtccactcacataaaggtgaaaagcgaagagaagatcaaagtggtggagaagtctgagaaagaaactgtgattgtggaggaacagacagaggagacccaagtgactgaagaagtgactgaagaagaggagaaagaggccaaagaggaggagggcaaggaggaagaagggggtgaagaagaggaggcagaagggggagaagaagaaacaaagtctcccccagcagaagaggctgcatccccagagaaggaagccaagtcaccagtaaaggaagaggcaaagtcaccggctgaggccaagtccccagagaaggaggaagcaaaatccccagccgaagtcaagtcccctgagaaggccaagtctccagcaaaggaagaggcaaagtcaccgcctgaggccaagtccccagagaaggaggaagcaaaatctccagctgaggtcaagtcccccgagaaggccaagtccccagcaaaggaagaggcaaagtcaccggctgaggccaagtctccagagaaggccaagtccccagtgaaggaagaagcaaagtcaccggctgaggccaagtccccagtgaaggaagaagcaaaatctccagctgaggtcaagtccccggaaaaggccaagtctccaacgaaggaggaagcaaagtcccctgagaaggcagtcccctgagaaggccaagtccccagtgaaggaagaagcaaagtcccctgagaaggccaagtccccagtgaaggaagaagcaaagacccccgagaaggccaagtccccagtgaaggaagaagccaagtccccagagaaggccaagtccccagagaaggccaagactcttgatgtgaagtctccagaagccaagactccagcgaaggaggaagcaaggtcccctgcagacaaattccctgaaaaggccaaaagccctgtcaaggaggaggtcaagtccccagagaaggcgaaatctcccctgaaggaggatgccaaggcccctgagaaggagatcccaaaaaaggaagaggtgaagtccccagtgaaggaggaggagaagccccaggaggtgaaagtcaaagagcccccaaagaaggcagaggaagagaaagcccctgccacaccaaaaacagaggagaagaaggacagcaagaaagaggaggcacccaagaaggaggctccaaagcccaaggtggaggagaagaaggaacctgctgtcgaaaagcccaaagaatccaaagttgaagccaagaaggaagaggctgaagataagaaaaaagtccccaccccagagaaggaggctcctgccaaggtggaggtgaaggaagacgctaaacccaaagaaaagacagaggtggccaagaaggaaccagatgatgccaaggccaaggaacccagcaaaccagcagagaagaaggaggcagcaccggagaaaaaagacaccaaggaggagaaggccaagaagcctgaggagaaacccaagacagaggccaaagccaaggaagatgacaagaccctctcaaaagagcctagcaagcctaaggcagaaaaggctgaaaaatcctccagcacagaccaaaaagacagcaagcctccagagaaggccacagaagacaaggccgccaaggggaagtaaggcagggagaaaggaacatccggaacagccaaagaaactcagaagagtcccggagctcaaggatcagagtaacacaattttcactttttctgtctttatgtaagaagaaactgcttagatgacggggcctccttcttcaaacaggaatttctgttagcaatatgttagcaagagagggcactcccaggcccctgcccccatgccctccccaggcgatggacaattatgatagcttatgtagctgaatgtgatacatgccgaatgccacacgtaaacacttgactataaaaactgcccccctcctttccaaataagtgcatttattgcctctatgtgcaactgacagatgaccgcaataatgaatgagcagttagaaatacattatgcttgagatgtcttaacctattcccaaatgccttctgttttccaaaggagtggtcaagcccttgcccagagctctctattctggaagagcggtccaggtggggccgggcactggccactgaattatgccagggcgcactttccactggagttcactttcaattgcttctgtgcaataaaaccaagtgctt

SEQ ID NO: 299337 - DNA, 2045 bp, Homo sapiens
gcggccgcctactactactaaattcgcggccggtcgacgcagaagggggagaagaagaaacaaagtctcccccagcagaagaggctgcatccccagagaaggaagccaagtcaccagtaaaggaagaggcaaagtcaccggctgaggccaagtccccagagaaggaggaagcaaaatccccagccgaagtcaagtcccctgagaaggccaagtctccagcaaaggaagaggcaaagtcaccgcctgaggccaagtccccagagaaggaggaagcaaaatctccagctgaggtcaagtcccccgagaaggccaagtccccagcaaaggaagaggcaaagtcaccggctgaggccaagtctccagagaaggccaagtccccagtgaaggaagaagcaaagtcaccggctgaggccaagtccccagtgaaggaagaagcaaaatctccagctgaggtcaagtccccggaaaaggccaagtctccaacgaaggaggaagcaaagtcccctgagaaggcagtcccctgagaaggccaagtccccagtgaaggaagaagcaaagtcccctgagaaggccaagtccccagtgaaggaagaagcaaagacccccgagaaggccaagtccccagtgaaggaagaagccaagtccccagagaaggccaagtccccagagaaggccaagactcttgatgtgaagtctccagaagccaagactccagcgaaggaggaagcaaggtcccctgcagacaaattccctgaaaaggccaaaagccctgtcaaggaggaggtcaagtccccagagaaggcgaaatctcccctgaaggaggatgccaaggcccctgagaaggagatcccaaaaaaggaagaggtgaagtccccagtgaaggaggaggagaagccccaggaggtgaaagtcaaagagcccccaaagaaggcagaggaagagaaagcccctgccacaccaaaaacagaggagaagaaggacagcaagaaagaggaggcacccaagaaggaggctccaaagcccaaggtggaggagaagaaggaacctgctgtcgaaaagcccaaagaatccaaagttgaagccaagaaggaagaggctgaagataagaaaaaagtccccaccccagagaaggaggctcctgccaaggtggaggtgaaggaagacgctaaacccaaagaaaagacagaggtggccaagaaggaaccagatgatgccaaggccaaggaacccagcaaaccagcagagaagaaggaggcagcaccggagaaaaaagacaccaaggaggagaaggccaagaagcctgaggagaaacccaagacagaggccaaagccaaggaagatgacaagaccctctcaaaagagcctagcaagcctaaggcagaaaaggctgaaaaatcctccagcacagaccaaaaagacagcaagcctccagagaaggccacagaagacaaggccgccaaggggaagtaaggcagggagaaaggaacatccggaacagccaaagaaactcagaagagtcccggagctcaaggatcagagtaacacaattttcactttttctgtctttatgtaagaagaaactgcttagatgacggggcctccttcttcaaacaggaatttctgttagcaatatgttagcaagagagggcactcccaggcccctgcccccatgccctccccaggcgatggacaattatgatagcttatgtagctgaatgtgatacatgccgaatgccacacgtaaacacttgactataaaaactgcccccctcctttccaaataagtgcatttattgcctctatgtgcaactgacagatgaccgcaataatgaatgagcagttagaaatacattatgcttgagatgtcttaacctattcccaaatgccttctgttttccaaaggagtggtcaagcccttgcccagagctctctattctggaagagcggtccaggtggggccgggcactggccactgaattatgccagggcgcactttccactggagttcactttcaattgcttctgtgcaataaaaccaagtgctt

SEQ ID NO: 299338 - DNA, 1180 bp, Homo sapiens
gcggccgcctactactactaaattcgcggccggtcgacgtgaaagtcaaagagcccccaaagaaggcagaggaagagaaagcccctgccacaccaaaaacagaggagaagaaggacagcaagaaagaggaggcacccaagaaggaggctccaaagcccaaggtggaggagaagaaggaacctgctgtcgaaaagcccaaagaatccaaagttgaagccaagaaggaagaggctgaagataagaaaaaagtccccaccccagagaaggaggctcctgccaaggtggaggtgaaggaagacgctaaacccaaagaaaagacagaggtggccaagaaggaaccagatgatgccaaggccaaggaacccagcaaaccagcagagaagaaggaggcagcaccggagaaaaaagacaccaaggaggagaaggccaagaagcctgaggagaaacccaagacagaggccaaagccaaggaagatgacaagaccctctcaaaagagcctagcaagcctaaggcagaaaaggctgaaaaatcctccagcacagaccaaaaagacagcaagcctccagagaaggccacagaagacaaggccgccaaggggaagtaaggcagggagaaaggaacatccggaacagccaaagaaactcagaagagtcccggagctcaaggatcagagtaacacaattttcactttttctgtctttatgtaagaagaaactgcttagatgacggggcctccttcttcaaacaggaatttctgttagcaatatgttagcaagagagggcactcccaggcccctgcccccatgccctccccaggcgatggacaattatgatagcttatgtagctgaatgtgatacatgccgaatgccacacgtaaacacttgactataaaaactgcccccctcctttccaaataagtgcatttattgcctctatgtgcaactgacagatgaccgcaataatgaatgagcagttagaaatacattatgcttgagatgtcttaacctattcccaaatgccttctgttttccaaaggagtggtcaagcccttgcccagagctctctattctggaagagcggtccaggtggggccgggcactggccactgaattatgccagggcgcactttccactggagttcactttcaattgcttctgtgcaataaaaccaagtgctt

SEQ ID NO: 299339 - DNA, 1868 bp, Homo sapiens
ccccagtgaggctggaccgactgtcggaggcagccaaggtgaacacagacgctatgcgctcagcgcaggaggagataactgagtaccggcgtcagctgcaggccaggaccacagagctggaggcactgaaaagcaccaaggactcactggagaggcagcgctctgagctggaggaccgtcatcaggccgacattgcctcctaccaggaagccattcagcagctggacgctgagctgaggaacaccaagtgggagatggccgcccagctgcgagaataccaggacctgctcaatgtcaagatggctctggatatagagatagccgcttacagaaaactcctggaaggtgaagagtgtcggattggctttggcccaattcctttctcgcttccagaaggactccccaaaattccctctgtgtccactcacataaaggtgaaaagcgaagagaagatcaaagtggtggagaagtctgagaaagaaactgtgattgtggaggaacagacagaggagacccaagtgactgaagaagtgactgaagaagaggagaaagaggccaaagaggaggagggcaaggaggaagaagggggtgaagaagaggaggcagaagggggagaagaagaaacaaagtctcccccagcagaagaggctgcatccccagagaaggaagccaagtcaccagtaaaggaagaggcaaagtcaccggctgaggccaagtccccagagaaggaggaagcaaaatccccagccgaagtcaagtcccctgagaaggccaagtctccagcaaaggaagaggcaaagtcaccgcctgaggccaagtccccagagaaggaggaagcaaaatctccagctgaggtcaagtcccccgagaaggccaagtccccagcaaaggaagaggcaaagtcaccggctgaggccaagtctccagagaaggccaagtccccagtgaaggaagaagcaaagtcaccggctgaggccaagtccccagtgaaggaagaagcaaaatctccagctgaggtcaagtccccggaaaaggccaagtctccaacgaaggaggaagcaaagtcccctgagaaggcagtcccctgagaaggccaagtccccagtgaaggaagaagcaaagtcccctgagaaggccaagtccccagtgaaggaagaagcaaagacccccgagaaggccaagtccccagtgaaggaagaagccaagtccccagagaaggccaagtccccagagaaggccaagactcttgatgtgaagtctccagaagccaagactccagcgaaggaggaagcaaggtcccctgcagacaaattccctgaaaaggccaaaagccctgtcaaggaggaggtcaagtccccagagaaggcgaaatctcccctgaaggaggatgccaaggcccctgagaaggagatcccaaaaaaggaagaggtgaagtccccagtgaaggaggaggagaagccccaggaggtgaaagtcaaagagcccccaaagaaggcagaggaagagaaagcccctgccacaccaaaaacagaggagaagaaggacagcaagaaagaggaggcacccaagaaggaggctccaaagcccaaggtggaggagaagaaggaacctgctgtcgaaaagcccaaagaatccaaagttgaagccaagaaggaagaggctgaagataagaaaaaagtccccaccccagagaaggaggctcctgccaaggtggaggtgaaggaagacgctaaacccaaagaaaagacagaggtggccaagaaggaaccagatgatgccaaggccaaggaacccagcaaaccagcagagacaatccagcagcccaggaggtcgacgcggccgcgaatttagtagtagtaggcggccgc

SEQ ID NO: 299340 - DNA, 1141 bp, Homo sapiens
ccccagtgaggctggaccgactgtcggaggcagccaaggtgaacacagacgctatgcgctcagcgcaggaggagataactgagtaccggcgtcagctgcaggccaggaccacagagctggaggcactgaaaagcaccaaggactcactggagaggcagcgctctgagctggaggaccgtcatcaggccgacattgcctcctaccaggaagccattcagcagctggacgctgagctgaggaacaccaagtgggagatggccgcccagctgcgagaataccaggacctgctcaatgtcaagatggctctggatatagagatagccgcttacagaaaactcctggaaggtgaagagtgtcggattggctttggcccaattcctttctcgcttccagaaggactccccaaaattccctctgtgtccactcacataaaggtgaaaagcgaagagaagatcaaagtggtggagaagtctgagaaagaaactgtgattgtggaggaacagacagaggagacccaagtgactgaagaagtgactgaagaagaggagaaagaggccaaagaggaggagggcaaggaggaagaagggggtgaagaagaggaggcagaagggggagaagaagaaacaaagtctcccccagcagaagaggctgcatccccagagaaggaagccaagtcaccagtaaaggaagaggcaaagtcaccggctgaggccaagtccccagagaaggaggaagcaaaatccccagccgaagtcaagtcccctgagaaggccaagtctccagcaaaggaagaggcaaagtcaccgcctgaggccaagtccccagagaaggaggaagcaaaatctccagctgaggtcaagtcccccgagaaggccaagtccccagcaaaggaagaggcaaagtcaccggctgaggccaagtctccagagaaggccaagtccccagtgaaggaagaagcaaagtcaccggctgaggccaagtccccagtgaaggccaagtctccaacgaaggaggaagcaaagtcccctgagaaggcagccaagtcccctgagaaggccaagtccccagagaaggaagaggccaagtcccctgagaaggccaagtccccagtgaaggcagaagcaaagtccactgacaacgg

SEQ ID NO: 299341 - DNA, 1130 bp, Homo sapiens
ccccagtgaggctggaccgactgtcggaggcagccaaggtgaacacagacgctatgcgctcagcgcaggaggagataactgagtaccggcgtcagctgcaggccaggaccacagagctggaggcactgaaaagcaccaaggactcactggagaggcagcgctctgagctggaggaccgtcatcaggccgacattgcctcctaccaggaagccattcagcagctggacgctgagctgaggaacaccaagtgggagatggccgcccagctgcgagaataccaggacctgctcaatgtcaagatggctctggatatagagatagccgcttacagaaaactcctggaaggtgaagagtgtcggattggctttggcccaattcctttctcgcttccagaaggactccccaaaattccctctgtgtccactcacataaaggtgaaaagcgaagagaagatcaaagtggtggagaagtctgagaaagaaactgtgattgtggaggaacagacagaggagacccaagtgactgaagaagtgactgaagaagaggagaaagaggccaaagaggaggagggcaaggaggaagaagggggtgaagaagaggaggcagaagggggagaagaagaaacaaagtctcccccagcagaagaggctgcatccccagagaaggaagccaagtcaccagtaaaggaagaggcaaagtcaccggctgaggccaagtccccagagaaggaggaagcaaaatccccagccgaagtcaagtcccctgagaaggccaagtctccagcaaaggaagaggcaaagtcaccgcctgaggccaagtccccagagaaggaggaagcaaaatctccagctgaggtcaagtcccccgagaaggccaagtccccagcaaaggaagaggcaaagtcaccggctgaggccaagtctccagagaaggccaagtccccagtgaaggaagaagcaaagtcaccggctgaggccaagtccccagtgaaggaagaagcaaaatctccagctgaggtcaagtccccggaaaaggccaagtctccaacgaaggaggaagcaaagtcccctgagaaggcataatcactctgacacagccaactcgctatgagaatgactactcattagaga

SEQ ID NO: 299342 - DNA, 1534 bp, Homo sapiens
ttctaccaacaccccgccccctgcaggctctctccgagagcaccaagtccttttgctctccatccccggaagacccggctgaaaatccggaaaaagaatcgggaaacgccaggaggcatattgcgcttgcgcacggaggggccggaagtcgaggcgggagtgactctgcttccgtttctggttttgctctagtgtttgggtttcttcgcggctgctcaagatgaaccgactcttcgggaaagcgaaacccaaggctccgccgcccagcctgactgactgcattggcacggtggacagtagagcagaatccattgacaagaagatttctcgattggatgctgagctagtgaagtataaggatcagatcaagaagatgagagagggtcctgcaaagaatatggtcaagcagaaagccttgcgagttttaaagcaaaagaggatgtatgagcagcagcgggacaatcttgcccaacagtcattcaacatggaacaagccaattataccatccagtctttgaaggacaccaagaccacggttgatgctatgaaactgggagtaaaggaaatgaagaaggcatacaagcaagtgaagatcgaccagattgaggatttacaagaccagctagaggatatgatggaagatgcaaatgaaatccaagaagcactgagtcgcagttatggcaccccagaactggatgaagatgatttagaagcagagttggatgcactaggtgatgagcttctggctgatgaagacagttcttatttggatgaggcagcatctgcacctgcaattccagaaggtgttcccactgatacaaaaaacaaggatggagttctggtggatgaatttggattgccacagatccctgcttcatagatttgcatcattcaagcatatcttgtaaaacaaacacatattatgggactaggaaatatttatctttccaaatttgccataacagatttaggtttctttcctttctttgaaggaaagtttaattacattgctcttttattttttccattaagagactcattgcttgggaaatgctttcttcgtactaaaatttgattcctttttttcttatgaaaaacgaactcagtttaaaagtatttttagctcgtatgacttgttttcattcattaataataatttgaaataaaactaaggaaatggaatcttaaaagtctatgacagtgtaactctacagtctcaaaatgacctgataaattgataagacaaagatgagattattggggctgttcatattatgattcagaatcattttctattgtggtattataggttggttaaagtgatggcctttttgatgggttttgttgtgtcttgtgaacaagtcgttactgtgtccattattggaatggaattatcactactgtatcatgagtgggtattttgattctatggttccctcagtattacatcttgacttgtaatcaattatgaatatttcttgatatttaatgtataggacatttatttatactcaataaatatttttcaaaagga

SEQ ID NO: 299343 - DNA, 1034 bp, Homo sapiens
  misc_feature (965)..(965): n is a, c, g, or t
ttctaccaacaccccgccccctgcaggctctctccgagagcaccaagtccttttgctctccatccccggaagacccggctgaaaatccggaaaaagaatcgggaaacgccaggaggcatattgcgcttgcgcacggaggggccggaagtcgaggcgggagtgactctgcttccgtttctggttttgctctagtgtttgggtttcttcgcggctgctcaagatgaaccgactcttcgggaaagcgaaacccaaggctccgccgcccagcctgactgactgcattggcacggtggacagtagagcagaatccattgacaagaagatttctcgattggatgctgagctagtgaagtataaggatcagatcaagaagatgagagagggtcctgcaaagaatatggtcaagcagaaagccttgcgagttttaaagcaaaagaggatgtatgagcagcagcgggacaatcttgcccaacagtcattcaacatggaacaagccaattataccatccagtctttgaaggacaccaagaccacggttgatgctatgaaactgggagtaaaggaaatgaagaaggcatacaagcaagtgaagatcgaccagattgaggatttacaagaccagctagaggatatgatggaagatgcaaatgaaatccaagaagcactgagtcgcagttatggcaccccagaactggatgaagatgatttagaagcagagttggatgcactaggtgatgagcttctggctgatgaagacagttcttatttggatgaggcagcatctgcacctgcaattccagaaggtgttcccactgatacaaaaaacaagggatggggtctggtggatgaattgggttgccaagatcctggtcatagattggtcattcaagctttttgtgaacacacctttttggggtgagaattttttttcaattggcaaagattgggtttcttttgagggaganaaatggtttttcaaaaaggggggagagtgtgaaaagtctttttaaagcggaaagcggggtaaataaagg

SEQ ID NO: 299344 - DNA, 1192 bp, Homo sapiens
ttctaccaacaccccgccccctgcaggctctctccgagagcaccaagtccttttgctctccatccccggaagacccggctgaaaatccggaaaaagaatcgggaaacgccaggaggcatattgcgcttgcgcacggaggggccggaagtcgaggcgggagtgactctgcttccgtttctggttttgctctagtgtttgggtttcttcgcggctgctcaagatgaaccgactcttcgggaaagcgaaacccaaggctccgccgcccagcctgactgactgcattggcacggtggacagtagagcagaatccattgacaagaagatttctcgattggatgctgagctagtgaagtataaggatcagatcaagaagatgagagagggtcctgcaaagaatatggtcaagcagaaagccttgcgagttttaaagcaaaagaggatgtatgagcagcagcgggacaatcttgcccaacagtcattcaacatggaacaagccaattataccatccagtctttgaaggacaccaagaccacggttgatgctatgaaactgggagtaaaggaaatgaagaaggcatacaagcaagtgaagatcgaccagattgaggatttacaagaccagctagaggatatgatggaagatgcaaatgaaatccaagaagcactgagtcgcagttatggcaccccagaactggatgaagatgatttagaagcagagttggatgcactaggtgatgagcttctggctgatgaagacagttcttatttggatgaggcagcatctgcacctgcaattccagaaggtgttcccactgatacaaaaaacaagatggagtctggtgggtgaatttggattgtgaattgccagtttagcagcaattgtagcaagcataggatggaggtggggttaaattctggagcatctctgcttgtctatctggacttccaggctctgagcttggtggtgacgggagacagtaagtggcctgttgtgcaagacactgacttggcattgtgtatgtgcaagggggcctgccctggaattgtttcactgcagtctgcggaacagcacaggtgtgtgtgttacggcctgccatggcagctgacatagaacacattaagagtgtccattgctgctgtctgatatgcagaactgggcatatctagatccggtgtattcagtagctggtac

SEQ ID NO: 299345 - DNA, 1639 bp, Homo sapiens
caagcagtgtttgttaaaataccaggcattttattgcctctgcaaagatattctctcataaagctgatctttagtaagagtgaaggcaggctgggcatggtggctcacgcctgtaatcccaacactttgggaggctgaggtgggtggatcacctgatgtcaggagtttgagaccagcctgaccaacatggtgaaaccctgcctctactaaaaatacaaaaattagctgggtgtggtggcgtgcacctgtaatcccagctacctgggagtctgaggcaggagaatcacttgaacccaggaggcggaggttgcagtgagccattgcactccagcctgggcagcaagagtgcaactctgtctcaaataaataaataaataaataaagacaatttaaccaacatgacttactaaaacattgtgttttcttcttccttttcttaggttgatgctatgaaactgggagtaaaggaaatgaagaaggcatacaagcaagtgaagatcgaccagattgaggtgagacatatgctagtttctgcaagaatgtgcactagtttctgagagaatccaaacgagtgtgcatgtgataggaagagcacaggagaggaactgaatcttggggctgccatttactagtagagtaacttcgagaaagggtaccaaatgtctcagtttcctcagtgcaaggatcctaataccacatacagttacagacagtccccgatttaagacggttcaacttaacgatttttcagtttgatgatggtgcgaaaactatatgcattcagtagaaaccatactttgagtatccacgtaaccattctgtttttcagtttccatacaatatttaataaattacatgagatactcaacactttattatgaaataggctgttagatgattttgcccaactgtaggctaatgtaagtgttctgagcacaattaaggtaggctaggctaagtgatggttcagtaagttaggtgtattgaatgcactttctacttaagatattttgaacttaagatgggtttatcaggatgtaaccctatcataagtcaaggaacttctatattatgaggatgaaataaatgagctagtatctctacacacacaatgcctggcctatgataagcatccagtagttacttttaactaattcgatgatatttagtctgtttcttcgatggtagtggtgttgttgcctattcccaggattgtcatgagtgttaaatgaaggtatgtaggtaaagtgtatgtaaaatgtttaacccaactcctggcgtggtagacttggttcccttttctagtaattctctttagatttttaataataatgtcattagttccttaaagttagcatttcttattggaattgggttttgaccagggagatgagccctaagagcttggcagctctcagctgtcagatgaacagcccaggtggcaagaagagatagcagagggagtgagtggtgactggtcagaggagagaggcttcctttctgcatataaaatggcgctcttgacctttacccccctgactagaatgtccatttccttgaatgcagggacttgattttgttcactactgtgtccccagtgcccataacaatgccctgccatggttggtgctcagaaagt

SEQ ID NO: 299346 - DNA, 955 bp, Homo sapiens
ttctaccaacaccccgccccctgcaggctctctccgagagcaccaagtccttttgctctccatccccggaagacccggctgaaaatccggaaaaagaatcgggaaacgccaggaggcatattgcgcttgcgcacggaggggccggaagtcgaggcgggagtgactctgcttccgtttctggttttgctctagtgtttgggtttcttcgcggctgctcaagatgaaccgactcttcgggaaagcgaaacccaaggctccgccgcccagcctgactgactgcattggcacggtggacagtagagcagaatccattgacaagaagatttctcgattggatgctgagctagtgaagtataaggatcagatcaagaagatgagagagggtcctgcaaaggtaaggtgggcagcaactgctgcacaaggtgctggcagagcctagttttagcacctatagaaatagggcctagttcggctgggcgcagtggctcatgcatgtaatcccagcactttgggaggctgaggcgggtggatcacgaggtcaggcatttgagactagcctggccaacatagcgaaaccctgtctctactgaaaatacaaaaacttagctgggcatggtggcaggcgcctgtaatcccagctactcaggaggctgaggcaggagaatcgcttgaacctgggaggcggaggttgcagtgagcagagaccacaccgtagcactctagcccgagtgacagtgtgagactccgtctcaaaaaataagtgaaataggacctagtgcaggggctgtgagcatccctacagaagagatgcttacagtctggtaaggagaaaacatgtgagggtgtatcctttagggaggagagtttgcaatcaaatatggaagggaggctggggattgatctggtggaaagagatgctggtcacacgtctaaaagcatgtacatgagaattagc

SEQ ID NO: 299347 - DNA, 1187 bp, Homo sapiens
ttctaccaacaccccgccccctgcaggctctctccgagagcaccaagtccttttgctctccatccccggaagacccggctgaaaatccggaaaaagaatcgggaaacgccaggaggcatattgcgcttgcgcacggaggggccggaagtcgaggcgggagtgactctgcttccgtttctggttttgctctagtgtttgggtttcttcgcggctgctcaagatgaaccgactcttcgggaaagcgaaacccaaggctccgccgcccagcctgactgactgcattggcacggtggacagtagagcagaatccattgacaagaagatttctcgattggatgctgagctagtgaagtataaggatcagatcaagaagatgagagagggtcctgcaaagaatatggtcaagcagaaagccttgcgagttttaaagcaaaagaggatgtatgagcagcagcgggacaatcttgcccaacagtcattcaacatggaacaagccaattataccatccagtctttgaaggacaccaagaccacggttgatgctatgaaactgggagtaaaggaaatgaagaaggcatacaagcaagtgaagatcgaccagattgaggatttacaagaccagctagaggatatgatggaagatgcaaatgaaatccaagaagcactgagtcgcagttatggcaccccagaactggatgaagatgatttagaagcagagttggatgcactaggtgatgagcttctggctgatgaagacagttcttatttggatgaggcagcatctgcacctgcaattccagaaggtgttcccactgatacaaaaaacaaggatggagttctggtggatgaatttggattgccacagatccctgcttcatagatttgcatcattcaagcatatcttgtaaaacaaacacatattatgggactaggaaatatttatctttccaaatttgccataacagatttaggtttctttcctttctttgaaggaaagtttaattacattgctcttttattttttccattaagagactcattgcttgggaaatgctttcttcgtactaaaatttgattcctttttttcttatgaaaaacgaactcagtttaaaagtatttttagctcgtatgacttgttttcattcattaataataatttgaaataaaactaaggaaatggaatctta

SEQ ID NO: 299348 - DNA, 1490 bp, Homo sapiens
ttctaccaacaccccgccccctgcaggctctctccgagagcaccaagtccttttgctctccatccccggaagacccggctgaaaatccggaaaaagaatcgggaaacgccaggaggcatattgcgcttgcgcacggaggggccggaagtcgaggcgggagtgactctgcttccgtttctggttttgctctagtgtttgggtttcttcgcggctgctcaagatgaaccgactcttcgggaaagcgaaacccaaggctccgccgcccagcctgactgactgcattggcacggtggacagtagagcagaatccattgacaagaagatttctcgattggatgctgagctagtgaagtataaggatcagatcaagaagatgagagagggtcctgcaaagaatatggtcaagcagaaagccttgcgagttttaaagcaaaagaggatgtatgagcagcagcgggacaatcttgcccaacagtcattcaacatggaacaagccaattataccatccagtctttgaaggacaccaagaccacggttgatgctatgaaactgggagtaaaggaaatgaagaaggcatacaagcaagtgaagatcgaccagattgaggatttacaagaccagctagaggatatgatggaagatgcaaatgaaatccaagaagcactgagtcgcagttatggcaccccagaactggatgaagatgatttagaagcagagttggatgcactaggtgatgagcttctggctgatgaagacagttcttatttggatgaggcagcatctgcacctgcaattccagaaggtgttcccactgatacaaaaaacaaggatggagttctggtggatgaatttggattgccacagatccctgcttcatagatttgcatcattcaagcatatcttgtaaaacaaacacatattatgggactaggaaatatttatctttccaaatttgccataacagatttaggtttctttcctttctttgaaggaaagtttaattacattgctcttttattttttccattaagagactcattgcttgggaaatgctttcttcgtactaaaatttgattcctttttttcttatgaaaaacgaactcagtttaaaagtatttttagctcgtatgacttgttttcattcattaataataatttgaaataaaactaaggaaatggaatcttaaaagtctatgacagtgtaactctacagtctcaaaatgacctgataaattgataagacaaagatgagattattggggctgttcatattatgattcagaatcattttctattgtggtattataggtggcagaagcgtttaaattcccttggaaatttaactgttagtccaaagaggaacaactcttcggacactaggaaaaaaccttggagagagagtcacaaatctaacacccattgtaggcccttaagctgccaccattttagaatgcgttaagcctcaacacccactacctaaaaattccca

SEQ ID NO: 299349 - DNA, 1480 bp, Homo sapiens
ttctaccaacaccccgccccctgcaggctctctccgagagcaccaagtccttttgctctccatccccggaagacccggctgaaaatccggaaaaagaatcgggaaacgccaggaggcatattgcgcttgcgcacggaggggccggaagtcgaggcgggagtgactctgcttccgtttctggttttgctctagtgtttgggtttcttcgcggctgctcaagatgaaccgactcttcgggaaagcgaaacccaaggctccgccgcccagcctgactgactgcattggcacggtggacagtagagcagaatccattgacaagaagatttctcgattggatgctgagctagtgaagtataaggatcagatcaagaagatgagagagggtcctgcaaagaatatggtcaagcagaaagccttgcgagttttaaagcaaaagaggatgtatgagcagcagcgggacaatcttgcccaacagtcattcaacatggaacaagccaattataccatccagtctttgaaggacaccaagaccacggttgatgctatgaaactgggagtaaaggaaatgaagaaggcatacaagcaagtgaagatcgaccagattgaggatttacaagaccagctagaggatatgatggaagatgcaaatgaaatccaagaagcactgagtcgcagttatggcaccccagaactggatgaagatgatttagaagcagagttggatgcactaggtgatgagcttctggctgatgaagacagttcttatttggatgaggcagcatctgcacctgcaattccagaaggtgttcccactgatacaaaaaacaaggatggagttctggtggatgaatttggattgccacagatccctgcttcatagatttgcatcattcaagcatatcttgtaaaacaaacacatattatgggactaggaaatatttatctttccaaatttgccataacagatttaggtttctttcctttctttgaaggaaagtttaattacattgctcttttattttttccattaagagactcattgcttgggaaatgctttcttcgtactaaaatttgattcctttttttcttatgaaaaacgaactcagtttaaaagtatttttagctcgtatgacttgttttcattcattaataataatttgaaataaaactaaggaaatggaatcttaaaagtctatgacagtgtaactctacagtctcttatgattcagaatcattttctattgtggtattataggttggttaaagtgatggcctttttgatgggttttgttgtgtcttgtgaacaagtcgttactgtgtccattattggaatggaattatcactactgtatcatgagtgggtattttgattctatggttccctcagtattacatcttgacttgtaatcaattatgaatatttcttgatatttaatgtataggacatttatttatactcaataaatatttttcaaaagga

SEQ ID NO: 299350 - DNA, 1561 bp, Homo sapiens
ttctaccaacaccccgccccctgcaggctctctccgagagcaccaagtccttttgctctccatccccggaagacccggctgaaaatccggaaaaagaatcgggaaacgccaggaggcatattgcgcttgcgcacggaggggccggaagtcgaggcgggagtgactctgcttccgtttctggttttgctctagtgtttgggtttcttcgcggctgctcaagatgaaccgactcttcgggaaagcgaaacccaaggctccgccgcccagcctgactgactgcattggcacggtggacagtagagcagaatccattgacaagaagatttctcgattggatgctgagctagtgaagtataaggatcagatcaagaagatgagagagggtcctgcaaagaatatggtcaagcagaaagccttgcgagttttaaagcaaaagaggattttctttcctctgcttctgcatacgtggtatgagcagcagcgggacaatcttgcccaacagtcattcaacatggaacaagccaattataccatccagtctttgaaggacaccaagaccacggttgatgctatgaaactgggagtaaaggaaatgaagaaggcatacaagcaagtgaagatcgaccagattgaggatttacaagaccagctagaggatatgatggaagatgcaaatgaaatccaagaagcactgagtcgcagttatggcaccccagaactggatgaagatgatttagaagcagagttggatgcactaggtgatgagcttctggctgatgaagacagttcttatttggatgaggcagcatctgcacctgcaattccagaaggtgttcccactgatacaaaaaacaaggatggagttctggtggatgaatttggattgccacagatccctgcttcatagatttgcatcattcaagcatatcttgtaaaacaaacacatattatgggactaggaaatatttatctttccaaatttgccataacagatttaggtttctttcctttctttgaaggaaagtttaattacattgctcttttattttttccattaagagactcattgcttgggaaatgctttcttcgtactaaaatttgattcctttttttcttatgaaaaacgaactcagtttaaaagtatttttagctcgtatgacttgttttcattcattaataataatttgaaataaaactaaggaaatggaatcttaaaagtctatgacagtgtaactctacagtctcaaaatgacctgataaattgataagacaaagatgagattattggggctgttcatattatgattcagaatcattttctattgtggtattataggttggttaaagtgatggcctttttgatgggttttgttgtgtcttgtgaacaagtcgttactgtgtccattattggaatggaattatcactactgtatcatgagtgggtattttgattctatggttccctcagtattacatcttgacttgtaatcaattatgaatatttcttgatatttaatgtataggacatttatttatactcaataaatatttttcaaaagga

SEQ ID NO: 299351 - DNA, 1487 bp, Homo sapiens
gagctatctctgtttgtgggccctgggtcgctcatgtggtgttactgctgacagcgacttggcttccaataagactggatatctcgcatatgcgtatgcagtcgcatgaggtcgaatgaacctcaagatggcttcgcgattgctcctacgcacattgaaatagaactgccctgtgggggcgagccggaagccggttcgtagacaacgaagattccaatgtagtagcgaaggtactagtaggctcagtattacgtggagtagtcttgaatgccatacatggaaaggtcctaaaggcgatgcctgcagtctaatgcaagaattgacgacgcacgcggtcctgacaaaggaatatggtcaagcagaaagccttgcgagttttaaagcaaaagaggatgtatgagcagcagcgggacaatcttgcccaacagtcattcaacatggaacaagccaattataccatccagtctttgaaggacaccaagaccacggttgatgctatgaaactgggagtaaaggaaatgaagaaggcatacaagcaagtgaagatcgaccagattgaggatttacaagaccagctagaggatatgatggaagatgcaaatgaaatccaagaagcactgagtcgcagttatggcaccccagaactggatgaagatgatttagaagcagagttggatgcactaggtgatgagcttctggctgatgaagacagttcttatttggatgaggcagcatctgcacctgcaattccagaaggtgttcccactgatacaaaaaacaaggatggagttctggtggatgaatttggattgccacagatccctgcttcatagatttgcatcattcaagcatatcttgtaaaacaaacacatattatgggactaggaaatatttatctttccaaatttgccataacagatttaggtttctttcctttctttgaaggaaagtttaattacattgctcttttattttttccattaagagactcattgcttgggaaatgctttcttcgtactaaaatttgattcctttttttcttatgaaaaacgaactcagtttaaaagtatttttagctcgtatgacttgttttcattcattaataataatttgaaataaaactaaggaaatggaatcttaaaagtctatgacagtgtaactctacagtctcaaaatgacctgataaattgataagacaaagatgagattattggggctgttcatattatgattcagaatcattttctattgtggtattataggttggttaaagtgatggcctttttgatgggttttgttgtgtcttgtgaacaagtcgttactgtgtccattattggaatggaattatcactactgtatcatgagtgggtattttgattctatggttccctcagtattacatcttgacttgtaatcaattatgaatatttcttgatatttaatgtataggacatttatttatactcaataaatatttttcaaaagga

SEQ ID NO: 299352 - DNA, 1431 bp, Homo sapiens
gctttcctgtatctggcttttggtctagctgtctgggttatcttcgccggattgtgcgaacgatgaatcgcgactctttcgaggaaataacgggaaactcgcaaatggctgccgtgcgatcatcactgaatgactgacgttcgggacgggtgagacgagtcagtagcctgaaatccatctcgacataggaaggtatttgcctcgtaacttatggacgtgctagtaccgtcatacggatgcaggtagtaccggatcgagatcaagtatcatgatggagagggccctgcgaagaatatggtcaagcagaaagccttgcgagttttaaagcaaaagaggatgtatgagcagcagcgggacaatcttgcccaacagtcattcaacatggaacaagccaattataccatccagtctttgaaggacaccaagaccacggttgatgctatgaaactgggagtaaaggaaatgaagaaggcatacaagcaagtgaagatcgaccagattgaggatttacaagaccagctagaggatatgatggaagatgcaaatgaaatccaagaagcactgagtcgcagttatggcaccccagaactggatgaagatgatttagaagcagagttggatgcactaggtgatgagcttctggctgatgaagacagttcttatttggatgaggcagcatctgcacctgcaattccagaaggtgttcccactgatacaaaaaacaaggatggagttctggtggatgaatttggattgccacagatccctgcttcatagatttgcatcattcaagcatatcttgtaaaacaaacacatattatgggactaggaaatatttatctttccaaatttgccataacagatttaggtttctttcctttctttgaaggaaagtttaattacattgctcttttattttttccattaagagactcattgcttgggaaatgctttcttcgtactaaaatttgattcctttttttcttatgaaaaacgaactcagtttaaaagtatttttagctcgtatgacttgttttcattcattaataataatttgaaataaaactaaggaaatggaatcttaaaagtctatgacagtgtaactctacagtctcaaaatgacctgataaattgataagacaaagatgagattattggggctgttcatattatgattcagaatcattttctattgtggtattataggttggttaaagtgatggcctttttgatgggttttgttgtgtcttgtgaacaagtcgttactgtgtccattattggaatggaattatcactactgtatcatgagtgggtattttgattctatggttccctcagtattacatcttgacttgtaatcaattatgaatatttcttgatatttaatgtataggacatttatttatactcaataaatatttttcaaaagga

SEQ ID NO: 299353 - DNA, 1488 bp, Homo sapiens
ttctaccaacaccccgccccctgcaggctctctccgagagcaccaagtccttttgctctccatccccggaagacccggctgaaaatccggaaaaagaatcgggaaacgccaggaggcatattgcgcttgcgcacggaggggccggaagtcgaggcgggagtgactctgcttccgtttctggttttgctctagtgtttgggtttcttcgcggctgctcaagatgaaccgactcttcgggaaagcgaaacccaaggctccgccgcccagcctgactgactgcattggcacggtggacagtagagcagaatccattgacaagaagatttctcgattggatgctgagctagtgaagtataaggatcagatcaagaagatgagagagggtcctgcaaagaatatggtcaagcagaaagccttgcgagttttaaagcaaaagaggatgaacaagccaattataccatccagtctttgaaggacaccaagaccacggttgatgctatgaaactgggagtaaaggaaatgaagaaggcatacaagcaagtgaagatcgaccagattgaggatttacaagaccagctagaggatatgatggaagatgcaaatgaaatccaagaagcactgagtcgcagttatggcaccccagaactggatgaagatgatttagaagcagagttggatgcactaggtgatgagcttctggctgatgaagacagttcttatttggatgaggcagcatctgcacctgcaattccagaaggtgttcccactgatacaaaaaacaaggatggagttctggtggatgaatttggattgccacagatccctgcttcatagatttgcatcattcaagcatatcttgtaaaacaaacacatattatgggactaggaaatatttatctttccaaatttgccataacagatttaggtttctttcctttctttgaaggaaagtttaattacattgctcttttattttttccattaagagactcattgcttgggaaatgctttcttcgtactaaaatttgattcctttttttcttatgaaaaacgaactcagtttaaaagtatttttagctcgtatgacttgttttcattcattaataataatttgaaataaaactaaggaaatggaatcttaaaagtctatgacagtgtaactctacagtctcaaaatgacctgataaattgataagacaaagatgagattattggggctgttcatattatgattcagaatcattttctattgtggtattataggttggttaaagtgatggcctttttgatgggttttgttgtgtcttgtgaacaagtcgttactgtgtccattattggaatggaattatcactactgtatcatgagtgggtattttgattctatggttccctcagtattacatcttgacttgtaatcaattatgaatatttcttgatatttaatgtataggacatttatttatactcaataaatatttttcaaaagga

SEQ ID NO: 299354 - DNA, 1605 bp, Homo sapiens
  misc_feature (365)..(365): n is a, c, g, or t
ttctaccaacaccccgccccctgcaggctctctccgagagcaccaagtccttttgctctccatccccggaagacccggctgaaaatccggaaaaagaatcgggaaacgccaggaggcatattgcgcttgcgcacggaggggccggaagtcgaggcgggagtgactctgcttccgtttctggttttgctctagtgtttgggtttcttcgcggctgctcaagatgaaccgactcttcgggaaagcgaaacccaaggctccgccgcccagcctgactgactgcattggcacgctgggggacagcagtagccgaatatccattgaccgagagagaattccttcgtacttggcatgcctgaagtgctaantgaacgctatcatggactcatgaattcaaccaatgaatgacgtatgcagcgtgctcactctataattcaattattgcatcaagtcatgaaaatagcctcttgcagagattctcatagaagacaatacagcagggagtgtcttgagtcacgacagccgtggactaattcttgacccaataagttcaattctcatgaacaagccaattataccatccagtctttgaaggacaccaagaccacggttgatgctatgaaactgggagtaaaggaaatgaagaaggcatacaagcaagtgaagatcgaccagattgaggatttacaagaccagctagaggatatgatggaagatgcaaatgaaatccaagaagcactgagtcgcagttatggcaccccagaactggatgaagatgatttagaagcagagttggatgcactaggtgatgagcttctggctgatgaagacagttcttatttggatgaggcagcatctgcacctgcaattccagaaggtgttcccactgatacaaaaaacaaggatggagttctggtggatgaatttggattgccacagatccctgcttcatagatttgcatcattcaagcatatcttgtaaaacaaacacatattatgggactaggaaatatttatctttccaaatttgccataacagatttaggtttctttcctttctttgaaggaaagtttaattacattgctcttttattttttccattaagagactcattgcttgggaaatgctttcttcgtactaaaatttgattcctttttttcttatgaaaaacgaactcagtttaaaagtatttttagctcgtatgacttgttttcattcattaataataatttgaaataaaactaaggaaatggaatcttaaaagtctatgacagtgtaactctacagtctcaaaatgacctgataaattgataagacaaagatgagattattggggctgttcatattatgattcagaatcattttctattgtggtattataggttggttaaagtgatggcctttttgatgggttttgttgtgtcttgtgaacaagtcgttactgtgtccattattggaatggaattatcactactgtatcatgagtgggtattttgattctatggttccctcagtattacatcttgacttgtaatcaattatgaatatttcttgatatttaatgtataggacatttatttatactcaataaatatttttcaaaagga

SEQ ID NO: 299355 - DNA, 1611 bp, Homo sapiens
ttctaccaacaccccgccccctgcaggctctctccgagagcaccaagtccttttgctctccatccccggaagacccggctgaaaatccggaaaaagaatcgggaaacgccaggaggcatattgcgcttgcgcacggaggggccggaagtcgaggcgggagtgactctgcttccgtttctggttttgctctagtgtttgggtttcttcgcggctgctcaagatgaaccgactcttcgggaaagcgaaacccaaggctccgccgcccagcctgactgactgcattggcacggtggacagtagagcagaatccattgacaagaagatttctcgattggatgctgagctagtgaagtataaggatcagatcaagaagatgagagagggtcctgcaaagaatatggtcaagcagaaagccttgcgagttttaaagcaaaagaggatgtatgagcagcagcgggacaatcttgcccaacagtcattcaacatggaacaagccaattataccatccagtctttgaaggacaccaagaccacggttgatgctatgaaactgggagtaaaggaaatgaagaaggcatacaagcaagtgaagatcgaccagattgaggatttacaagaccagctagaggatatgatggaagatgcaaatgaaatccaagaagcactgagtcgcagttatggcaccccagaactggatgaagatgatttagaagcagaggactgtgggaaactttttttttttaaaaggggaaaaaaaggccaagaagatttgggaatggccaactaaagggggagttggatgcactaggtgatgagcttctggctgatgaagacagttcttatttggatgaggcagcatctgcacctgcaattccagaaggtgttcccactgatacaaaaaacaaggatggagttctggtggatgaatttggattgccacagatccctgcttcatagatttgcatcattcaagcatatcttgtaaaacaaacacatattatgggactaggaaatatttatctttccaaatttgccataacagatttaggtttctttcctttctttgaaggaaagtttaattacattgctcttttattttttccattaagagactcattgcttgggaaatgctttcttcgtactaaaatttgattcctttttttcttatgaaaaacgaactcagtttaaaagtatttttagctcgtatgacttgttttcattcattaataataatttgaaataaaactaaggaaatggaatcttaaaagtctatgacagtgtaactctacagtctcaaaatgacctgataaattgataagacaaagatgagattattggggctgttcatattatgattcagaatcattttctattgtggtattataggttggttaaagtgatggcctttttgatgggttttgttgtgtcttgtgaacaagtcgttactgtgtccattattggaatggaattatcactactgtatcatgagtgggtattttgattctatggttccctcagtattacatcttgacttgtaatcaattatgaatatttcttgatatttaatgtataggacatttatttatactcaataaatatttttcaaaagga

SEQ ID NO: 299356 - DNA, 1421 bp, Homo sapiens
ttctaccaacaccccgccccctgcaggctctctccgagagcaccaagtccttttgctctccatccccggaagacccggctgaaaatccggaaaaagaatcgggaaacgccaggaggcatattgcgcttgcgcacggaggggccggaagtcgaggcgggagtgactctgcttccgtttctggttttgctctagtgtttgggtttcttcgcggctgctcaagatgaaccgactcttcgggaaagcgaaacccaaggctccgccgcccagcctgactgactgcattggcacggtggacagtagagcagaatccattgacaagaagatttctcgattggatgctgagctagtgaagtataaggatcagatcaagaagatgagagagggtcctgcaaagaatatggtcaagcagaaagccttgcgagttttaaagcaaaagaggatgtatgagcagcagcgggacaatcttgcccaacagtcattcaacatggaacaagccaattataccatccagtctttgaaggacaccaagaccacggttgatgctatgaaactgggagtaaaggaaatgaagaaggcatacaagcaagtgaagatcgaccagattgaggatttacaagaccagctagaggatatgatggaagatgcaaatgaaatccaagaagcactgagtcgcagttatggcaccccagaactggatgaagatgatttagaagcaggatggagttctggtggatgaatttggattgccacagatccctgcttcatagatttgcatcattcaagcatatcttgtaaaacaaacacatattatgggactaggaaatatttatctttccaaatttgccataacagatttaggtttctttcctttctttgaaggaaagtttaattacattgctcttttattttttccattaagagactcattgcttgggaaatgctttcttcgtactaaaatttgattcctttttttcttatgaaaaacgaactcagtttaaaagtatttttagctcgtatgacttgttttcattcattaataataatttgaaataaaactaaggaaatggaatcttaaaagtctatgacagtgtaactctacagtctcaaaatgacctgataaattgataagacaaagatgagattattggggctgttcatattatgattcagaatcattttctattgtggtattataggttggttaaagtgatggcctttttgatgggttttgttgtgtcttgtgaacaagtcgttactgtgtccattattggaatggaattatcactactgtatcatgagtgggtattttgattctatggttccctcagtattacatcttgacttgtaatcaattatgaatatttcttgatatttaatgtataggacatttatttatactcaataaatatttttcaaaagga

SEQ ID NO: 299357 - DNA, 1366 bp, Homo sapiens
ttctaccaacaccccgccccctgcaggctctctccgagagcaccaagtccttttgctctccatccccggaagacccggctgaaaatccggaaaaagaatcgggaaacgccaggaggcatattgcgcttgcgcacggaggggccggaagtcgaggcgggagtgactctgcttccgtttctggttttgctctagtgtttgggtttcttcgcggctgctcaagatgaaccgactcttcgggaaagcgaaacccaaggctccgccgcccagcctgactgactgcattggcacggtggacagtagagcagaatccattgacaagaagatttctcgattggatgctgagctagtgaagtataaggatcagatcaagaagatgagagagggtcctgcaaagaatatggtcaagcagaaagccttgcgagttttaaagcaaaagaggatgtatgagcagcagcgggacaatcttgcccaacagtcattcaacatggaacaagccaattataccatccagtctttgaaggacaccaagaccacggttgatgctatgaaactgggagtaaaggaaatgaagaaggcatacaagcaagtgaagatcgaccagattgaggcagcatctgcacctgcaattccagaaggtgttcccactgatacaaaaaacaaggatggagttctggtggatgaatttggattgccacagatccctgcttcatagatttgcatcattcaagcatatcttgtaaaacaaacacatattatgggactaggaaatatttatctttccaaatttgccataacagatttaggtttctttcctttctttgaaggaaagtttaattacattgctcttttattttttccattaagagactcattgcttgggaaatgctttcttcgtactaaaatttgattcctttttttcttatgaaaaacgaactcagtttaaaagtatttttagctcgtatgacttgttttcattcattaataataatttgaaataaaactaaggaaatggaatcttaaaagtctatgacagtgtaactctacagtctcaaaatgacctgataaattgataagacaaagatgagattattggggctgttcatattatgattcagaatcattttctattgtggtattataggttggttaaagtgatggcctttttgatgggttttgttgtgtcttgtgaacaagtcgttactgtgtccattattggaatggaattatcactactgtatcatgagtgggtattttgattctatggttccctcagtattacatcttgacttgtaatcaattatgaatatttcttgatatttaatgtataggacatttatttatactcaataaatatttttcaaaagga

SEQ ID NO: 299358 - DNA, 1192 bp, Homo sapiens
ttctaccaacaccccgccccctgcaggctctctccgagagcaccaagtccttttgctctccatccccggaagacccggctgaaaatccggaaaaagaatcgggaaacgccaggaggcatattgcgcttgcgcacggaggggccggaagtcgaggcgggagtgactctgcttccgtttctggttttgctctagtgtttgggtttcttcgcggctgctcaagatgaaccgactcttcgggaaagcgaaacccaaggctccgccgcccagcctgactgactgcattggcacggtggacagtagagcagaatccattgacaagaagatttctcgattggatgctgagctagtgaagtataaggatcagatcaagaagatgagagagggtcctgcaaagaatatggtcaagcagaaagccttgcgagttttaaagcaaaagaggatgtatgagcagcagcgggacaatcttgcccaacagtcattcaacatggatggagttctggtggatgaatttggattgccacagatccctgcttcatagatttgcatcattcaagcatatcttgtaaaacaaacacatattatgggactaggaaatatttatctttccaaatttgccataacagatttaggtttctttcctttctttgaaggaaagtttaattacattgctcttttattttttccattaagagactcattgcttgggaaatgctttcttcgtactaaaatttgattcctttttttcttatgaaaaacgaactcagtttaaaagtatttttagctcgtatgacttgttttcattcattaataataatttgaaataaaactaaggaaatggaatcttaaaagtctatgacagtgtaactctacagtctcaaaatgacctgataaattgataagacaaagatgagattattggggctgttcatattatgattcagaatcattttctattgtggtattataggttggttaaagtgatggcctttttgatgggttttgttgtgtcttgtgaacaagtcgttactgtgtccattattggaatggaattatcactactgtatcatgagtgggtattttgattctatggttccctcagtattacatcttgacttgtaatcaattatgaatatttcttgatatttaatgtataggacatttatttatactcaataaatatttttcaaaagga

SEQ ID NO: 299359 - DNA, 1117 bp, Homo sapiens
ttctaccaacaccccgccccctgcaggctctctccgagagcaccaagtccttttgctctccatccccggaagacccggctgaaaatccggaaaaagaatcgggaaacgccaggaggcatattgcgcttgcgcacggaggggccggaagtcgaggcgggagtgactctgcttccgtttctggttttgctctagtgtttgggtttcttcgcggctgctcaagatgaaccgactcttcgggaaagcgaaacccaaggctccgccgcccagcctgactgactgcattggcacggtggacagtagagcagaatccattgacaagaagatttctcgattggatgctgagctagtgaagtataaggatcagatcaagaagatgagagagggtcctgcaaagaatatggtcaagcagaaagccttgcgagttttaaagcaaaagaggatgtatgagcagcagcgggacaatcttgcccaacagtcattcaacatggaacaagccaattataccatccagtctttgaaggacaccaagaccacggttgatgctatgaaactgggagtaaaggaaatgaagaaggcatacaagcaagtgaagatcgaccagattgaggatttacaagaccagctagaggatatgatggaagatgcaaatgaaatccaagaagcactgagtcgcagttatggcaccccagaactggatgaagatgatttagaagcaggatggagttctggtggatgaatttggattgccacagatccctgcttcatagatttgcatcattcaagcatatcttgtaaaacaaacacatattatgggactaggaaatatttatctttccaaatttgccataacagatttaggtttctttcctttctttgaaggaaagtttaattacattgctcttttattttttccattaagagactcattgcttgggaaatgctttcttcgtactaaaatttgattcctttttttcttatgaaaaacgaactcagtttaaaagtatttttagctcgtatgacttgttttcattcattaataataatttgaaataaaactaaggaaatggaatcttataaaaaaaaaagacaaaacaaaaaactggcctcgttggcctca

SEQ ID NO: 299360 - DNA, 1354 bp, Homo sapiens
ttctaccaacaccccgccccctgcaggctctctccgagagcaccaagtccttttgctctccatccccggaagacccggctgaaaatccggaaaaagaatcgggaaacgccaggaggcatattgcgcttgcgcacggaggggccggaagtcgaggcgggagtgactctgcttccgtttctggttttgctctagtgtttgggtttcttcgcggctgctcaagatgaaccgactcttcgggaaagcgaaacccaaggctccgccgcccagcctgactgactgcattggcacggtggacagtagagcagaatccattgacaagaagatttctcgattggatgctgagctagtgaagtataaggatcagatcaagaagatgagagagggtcctgcaaagaatatggtcaagcagaaagccttgcgagttttaaagcaaaagaggatgtatgagcagcagcgggacaatcttgcccaacagtcattcaacatggaacaagccaattataccatccagtctttgaaggacaccaagaccacggttgatgctatgaaactgggagtaaaggaaatgaagaaggcatacaagcaagtgaagatcgaccagattgaggatttacaagaccagctagaggatatgatggaagatgcaaatgaaatccaagaagcactgagtcgcagttatggcaccccagaactggatgaagatgatttagaagcagaggtaagttatgagaaaagtaatgtatatttagttttggagtccaaaagcaacagctgcctgggaccttttctcaaatgctagtgaaaatttctatcaggatttcctgaaggttagtttatggtactgtccctgggcaaagagcttgtgaggcagccacatcagattgcatactccaccaacaacagtgggatggatcaactctgaaggaagtccaggtacaggctgacctggtgcttggtatctgtaagtgtcctccacgtggcctttccttgctgtattccttttgattttgttctcactattttcctagttggagtcctctccctcagaacagcaaaaccaattaagaaacaataattagggccaggtgccctaatcccagcactttggaaggccaaggtaggcggatccactcaagcccaggagttcgagacctggctgagcaatatggcgtcaccccgtctctataaaaaatacaaaaattacccaggcatggtggtgtgcgcctgcggtcctagctactcgggaggctgaggtggaaggatcacttgatcccaggaggtagaggttccagtgagccgagattgccccactgcagcctgggcaacagagtgagaccttctctcaaaaaaaaaa

SEQ ID NO: 299361 - DNA, 1734 bp, Homo sapiens
ttctaccaacaccccgccccctgcaggctctctccgagagcaccaagtccttttgctctccatccccggaagacccggctgaaaatccggaaaaagaatcgggaaacgccaggaggcatattgcgcttgcgcacggaggggccggaagtcgaggcgggagtgactctgcttccgtttctggttttgctctagtgtttgggtttcttcgcggctgctcaagatgaaccgactcttcgggaaagcgaaacccaaggctccgccgcccagcctgactgactgcattggcacggtggacagtagagcagaatccattgacaagaagatttctcgattggatgctgagctagtgaagtataaggatcagatcaagaagatgagagagggtcctgcaaagaatatggtcaagcagaaagccttgcgagttttaaagcaaaagaggatgtatgagcagcagcgggacaatcttgcccaacagtcattcaacatggaacaagccaattataccatccagtctttgaaggacaccaagaccacggttgatgctatgaaactgggagtaaaggaaatgaagaaggcatacaagcaagtgaagatcgaccagattgaggtgagacatatgctagtttctgcaagaatgtgcactagtttctgagagaatccaaacgagtgtgcatgtgataggaagagcacaggagaggaactgaatcttggggctgccatttactagtagagtaacttcgagaaagggtaccaaatgtctcagtttcctcagtgcaaggatcctaataccacatacagttacagacagtccccgatttaagacggttcaacttaacgatttttcagtttgatgatggtgcgaaaactatatgcattcagtagaaaccatactttgagtatccacgtaaccattctgtttttcagtttccatacaatatttaataaattacatgagatactcaacactttattatgaaataggctgttagatgattttgcccaactgtaggctaatgtaagtgttctgagcacaattaaggtaggctaggctaagtgatggttcagtaagttaggtgtattgaatgcactttctacttaagatattttgaacttaagatgggtttatcaggatgtaaccctatcataagtcaaggaacttctatattatgaggatgaaataaatgagctagtatctctacacacacaatgcctggcctatgataagcatccagtagttacttttaactaattcgatgatatttagtctgtttcttcgatggtagtggtgttgttgcctattcccaggattgtcatgagtgttaaatgaaggtatgtaggtaaagtgtatgtaaaatgtttaacccaactcctggcgtggtagacttggttcccttttctagtaattctctttagatttttaataataatgtcattagttccttaaagttagcatttcttattggaattgggttttgaccagggagatgagccctaagagcttggcagctctcagctgtcagatgaacagcccaggtggcaagaagagatagcagagggagtgagtggtgactggtcagaggagagaggcttcctttctgcatataaaatggcgctcttgacctttacccccctgactagaatgtccatttccttgaatgcagggacttgattttgttcactactgtgtccccagtgcccataacaatgccctgccatggttggtgctcagaaagt

SEQ ID NO: 299362 - DNA, 758 bp, Homo sapiens
ttctaccaacaccccgccccctgcaggctctctccgagagcaccaagtccttttgctctccatccccggaagacccggctgaaaatccggaaaaagaatcgggaaacgccaggaggcatattgcgcttgcgcacggaggggccggaagtcgaggcgggagtgactctgcttccgtttctggttttgctctagtgtttgggtttcttcgcggctgctcaagatgaaccgactcttcgggaaagcgaaacccaaggctccgccgcccagcctgactgactgcattggcacggtggacagtagagcagaatccattgacaagaagatttctcgattggatgctgagctagtgaagtataaggatcagatcaagaagatgagagagggtcctgcaaagaatatggtcaagcagaaagccttgcgagttttaaagcaaaagaggatgtatgagcagcagcgggacaatcttgcccaacagtcattcaacatggaacaagccaattataccatccagtctttgaaggacaccaagaccacggttgatgctatgaaactgggagtaaaggaaatgaagaaggcatacaagcaatcgttactgtgtccattattggaatggaattatcactactgtatcatgagtgggtattttgattctatggttccctcagtattacatcttgacttgtaatcaattatgaatatttcttgatatttaatgtataggacatttatttatactcaataaatatttttcaaaagga

SEQ ID NO: 299363 - DNA, 1057 bp, Homo sapiens
  misc_feature (988)..(988): n is a, c, g, or t
ttctaccaacaccccgccccctgcaggctctctccgagagcaccaagtccttttgctctccatccccggaagacccggctgaaaatccggaaaaagaatcgggaaacgccaggaggcatattgcgcttgcgcacggaggggccggaagtcgaggcgggagtgactctgcttccgtttctggttttgctctagtgtttgggtttcttcgcggctgctcaagatgaaccgactcttcgggaaagcgaaacccaaggctccgccgcccagcctgactgactgcattggcacgggtgggcatttgatcatgcataagtggacagtagagcagaatccattgacaagaagatttctcgattggatgctgagctagtgaagtataaggatcagatcaagaagatgagagagggtcctgcaaagaatatggtcaagcagaaagccttgcgagttttaaagcaaaagaggatgtatgagcagcagcgggacaatcttgcccaacagtcattcaacatggaacaagccaattataccatccagtctttgaaggacaccaagaccacggttgatgctatgaaactgggagtaaaggaaatgaagaaggcatacaagcaagtgaagatcgaccagattgaggatttacaagaccagctagaggatatgatggaagatgcaaatgaaatccaagaagcactgagtcgcagttatggcaccccagaactggatgaagatgatttagaagcagagttggatgcactaggtgatgagcttctggctgatgaagacagttcttatttggatgaggcagcatctgcacctgcaattccagaaggtgttcccactgatacaaaaaacaagggatggggtctggtggatgaattgggttgccaagatcctggtcatagattggtcattcaagctttttgtgaacacacctttttggggtgagaattttttttcaattggcaaagattgggtttcttttgagggaganaaatggtttttcaaaaaggggggagagtgtgaaaagtctttttaaagcggaaagcggggtaaataaagg

SEQ ID NO: 299364 - DNA, 1713 bp, Homo sapiens
ggatgggcatactatctcggaatctggggcatgctgcattctggcccgatgacatgtggatagaagtcctcgccgacaggtagtggccctacttgtggtaggtttcgtgcccagaggtgttgtagatgaggccgattccctcccgctagtgtgttagccggtggggacagtcgctgagaggaaggtagggaacatgtcgctcagcggcaagagcgcaaggctatggcttgcggcggaattgagcgaacgcctttcagggcgttcttgaaagtcgggtacggtccttgtctacctgcggcggcccttgggaagttggcaacaacggacagtcgaaggtgttttgccgtgttaagcttgttctggtggaaactaggatagggggcccaaagggaccaacattgagcatggggccagtccgcgcgtgggcccgagagacgtgttcgccacaagctggaacaacggggggccgagcgtgttgcggccgctggcgcgctcaggaagacgtaagccagagggggatagacgaatgcccaggaaggggggaaagctcgggggtaggggcttcgttgccgtctggggacttgggaggaatgttaggagaagcttgcgtttcgaggcatagtgtttcgcaccgccaagcccacgggaagttgccccgcgcgtgggcgttgttgacaagttagtgtgaaggtgttgttgcggcacacgtttgcaagggtgtgtgccagaatgtgacaagttgaggttggcgtgttgtgggttaatacggatctccagtgtagcgagtccaggttgagtgtgtgaggtcggggtgaagccgttatcgggggagaagatggtaagtgggtgtaaggtgccgtttgtgccgccataagaattgttttggccgcaagttagtaggcatggaggtgttatagaggggtgtgtggcgtggtttgcgcgtgttgtgcagtggtgtggaagaagccgtatatgacgggtgtgtgttaggaggtgttagccaaggttgtgggacgtgccgtgtgtgtcagcttgtgtggtgttgtgccgcaggtttaagagggagggatggcgtgcagttgtggccgttttggttgggagagagttggcttgttgcggtgtgcggcttagctttagatagagtgtgtggagttgtgcgcgtgtgtgtgtgtgtgcgtgtagtcgaaaaagagaggcggagaggcgtgcgagggtttgtagagagaggtaggttggttgtagggcgtgcggtagtggagcgttggtgtgttgcagtgtgcagttaagtgaagtgaaggtgttggaagagtagaagagctagagggagaagttgggagagtgcgttagagaagggtcgtagtggaggcaggttgtaagctgctagcaggtgcgtcaagaaaatgacctgataaattgataagacaaagatgagattattggggctgttcatattatgattcagaatcattttctattgtggtattataggttggttaaagtgatggcctttttgatgggttttgttgtgtcttgtgaacaagtcgttactgtgtccattattggaatggaattatcactactgtatcatgagtgggtattttgattctatggttccctcagtattacatcttgacttgtaatcaattatgaatatttcttgatatttaatgtataggacatttatttatactcaataaatatttttcaaaagga

SEQ ID NO: 299365 - DNA, 1299 bp, Homo sapiens
taatcttggtgatgccttggacagcagcaactccatgcaaaccatccaaaagaccaccacccgccggatagtggatggcaaagtggtgtctgagaccaatgacaccaaagttctgaggcattaagccagcagaagcagggtaccctttggggagcaggaggccaataaaaagttcagagttcaaaaaaaaaaacccaaggctccgccagccagcctgactgactgcttggcacggtggacagtagagcagaatccattgacaagaagatttctcgattggatgctgagctagtgaagtataaggatcagatcaagaagatgagagagggtcctgcaaagaatatggtcaagcagaaagccttgcgagttttaaagcaaaagaggatgtatgagcagcagcgggacaatcttgcccaacagtcattcaacatggaacaagccaattataccatccagtctttgaaggacaccaagaccacggttgatgctatgaaactgggagtaaaggaaatgaagaaggcatacaagcaagtgaagatcgaccagattgaggatttacaagaccagctagaggatatgatggaagatgcaaatgaaatccaagaagcactgagtcgcagttatggcaccccagaactggatgaagatgatttagaagcagaggtaagttatgagaaaagtaatgtatatttagttttggagtccaaaagcaacagctgcctgggaccttttctcaaatgctagtgaaaatttctatcaggatttcctgaaggttagtttatggtactgtccctgggcaaagagcttgtgaggcagccacatcagattgcatactccaccaacaacagtgggatggatcaactctgaaggaagtccaggtacaggctgacctggtgcttggtatctgtaagtgtcctccacgtggcctttccttgctgtattccttttgattttgttctcactattttcctagttggagtcctctccctcagaacagcaaaaccaattaagaaacaataattagggccaggtgccctaatcccagcactttggaaggccaaggtaggcggatccactcaagcccaggagttcgagacctggctgagcaatatggcgtcaccccgtctctataaaaaatacaaaaattacccaggcatggtggtgtgcgcctgcggtcctagctactcgggaggctgaggtggaaggatcacttgatcccaggaggtagaggttccagtgagccgagattgccccactgcagcctgggcaacagagtgagaccttctctcaaaaaaaaaa

SEQ ID NO: 299366 - DNA, 794 bp, Homo sapiens
ttctaccaacaccccgccccctgcaggctctctccgagagcaccaagtccttttgctctccatccccggaagacccggctgaaaatccggaaaaagaatcgggaaacgccaggaggcatattgcgcttgcgcacggaggggccggaagtcgaggcgggagtgactctgcttccgtttctggttttgctctagtgtttgggtttcttcgcggctgctcaagatgaaccgactcttcgggaaagcgaaacccaaggctccgccgcccagcctgactgactgcattggcacggtggacagtagagcagaatccattgacaagaagatttctcgattggatgctgagctagtgaagtataaggatcagatcaagaagatgagagagggtcctgcaaagaatatggtcaagcagaaagccttgcgagttttaaagcaaaagaggattttctttcctctgcttctgcatacgtggtatgtgtgcatataactttttagaagaaatgaaattgtagtgtgtatatgtaggttttccttttccacttaatgttatatcatgagcatctccctgttcttttaaatattctttggaaactttacactttttaatgagattataatattctaccatttgcttgcaccatgaacggaccattctttttctagttggatagttagattgtttccaatattgtataaagaacatagtgacataagtctttgaggtagaggttccagtgagccgagattgccccactgcagcctgggcaacagagtgagaccttctctcaaaaaaaaaa

SEQ ID NO: 299367 - DNA, 367 bp, Homo sapiens
tgtttgggtttcttcgcggctgctcaagatgaaccgactcttcgggaaagcgaaacccaaggctccgccgcccagcctgactgactgcattggcacgggtgggcatttgatcatgcataagtaggctcaggacctctgacacacccgaccccgcccacccccagccccgggcccatattcttccacttcatttcgggtcctgggccccttacacgtcgtccctctctatctcaccttctccccttcatccctgttacccaagtcattcctaacgccacaaaccagggaacccctaaccccatcactgccttgccctgccagcacccaacccgttttgatgcccattgcccgtccactcgctctcgcc

SEQ ID NO: 299368 - DNA, 261 bp, Homo sapiens
ttatgattcagaatcattttctattgtggtattataggttggttaaagtgatggcctttttgatgggttttgttgtgtcttgtgaacaagtcgttactgtgtccattattggaatggaattatcactactgtatcatgagtgggtattttgattctatggttccctcagtattacatcttgacttgtaatcaattatgaatatttcttgatatttaatgtataggacatttatttatactcaataaatatttttcaaaagg

SEQ ID NO: 299369 - DNA, 1016 bp, Homo sapiens
actttggtggccactgaaagtcagcggcgcggactgccctgagggcgggaaagggtggtcactgggtcagcccgaagcacctgacatgagggcggggaccccgaaatgcacacgaagtccggaactggtcttctgtgattttcattcgccctggtctctgttccctttcgtactcaaagctcgtgcatccagggaggggaaaccggagatagggtcttcgggccccgggcagaccctctgtgccgctgcaaaccgttgcagcctgaggctgtcaggtcctcccccagacacctgcggaccctccctctcctggcttcccgtctggtcatggcgagattctgggtctgcgtagccggtgctggcttctttcttgcatttttggttttgcattcgcgtttttgtggctctccagttttgaggaactttacttttgcagtttcctggagaactgagaaaattctttaccggctggatgtgggttggcctaagcacccagaatattttaccggaacaacattttgtgttgcagttgactccctcaatggattggtttacataggtcaaagaggggataacatcccaaagatattagtgttcacagaggatggatatttcctacgagcctggaattatacagttgacacacctcatggtatatttgcagccagtactctatatgaacaatccgtctggatcacggatgtaggaagtggtatgtatagtaatatctattaaattatcttactggaaatcacatctttgcacatgtccttgtttgtattgtttaaaatcagagttgctgaatctaattgtaatttctttaacgattcatgaaatcacatgtttttaacaaactttattttgtacttctgtggaattaagaaatttaacaagggctggacgccgtggctcacgcctgtaatcccagcactttgggaggccgaggcgggcggatcacgaggtcaggagatcgagacgatcctggccaacacggtgaaacccccgtctccactaaa

SEQ ID NO: 299370 - DNA, 1681 bp, Homo sapiens
cgatctcttcattttttccattacagctaattttctacccagagatctgaagacagttttatattcccatttcccaaaggaataaatttcctctaatgaaaaatatggctacaaattagccttttttttttgagaaaattttttattggtagtcttttttgctagtttttagaaacttggaggcttatgtgttttttattgctatgaactttagctcaactgtctaaaagtgtaatagtaaataaattatttaacatagaattgtaatgcaagctgattcactttctttctggtaagctcaatgtatccagtttgtcttttgaatacctatcaattaatttggcatatgtaccttcaaattgatttctgttcactgctttatgatattcccttattagtagtctgctttatgctcttgcttgtaagataattttaacttaaagaaattttaacgtgagaaaataagatactcatgatttacaaagattattttcttcttagcaaagaaaagttgggttgaattttgaatgtctccacaaggtgaaaatgcagttaaaaaaaaaatctgtaccatagagaacgtttttgttgacttactgaaatttaaggtctgtatgtgagtgattgaaataacagtttcaaatataagttgttccctttacattttcttcttgatttcctttcataagcaatgcttattcaaggtcataagattaaaaaagaaaatggtgcaccaatactttgttagcattctgagtttcctgtataatgagtcaattatggggatgttatttatttgaatttagaatccgcttattttggactaatggagattttaattcgtgatcaaatttggctgtaatttacgaagaagctatagtgcttgtcaattatatgtaatttcctaagcctatcacctatttgttattatttacttctatcaaatttttgctcttagcttacttgaaaaatctgaatgtttgtatagtggttttatttgtgagatgtacatatctatctttataggattctttggtcatactgttaaaaaatacagttcttttggtgatcttgttcaagtcttgggtactccaggcaaaaaaggcactagtttgaatcctttgcagtttgataacccagcagaattatatgtagaggacacaggagatatttacattgtggatggagatggaggattgaataacagattgatcaaactgtcccaagatttcatgatcctttggctgcatggagaaaatgggacagggcctgctaagttcaacatacctcacagtgttacacttgattcagctggtcgggtacaaatacagcgtcattgtgtctgggactttgtgtctgaatatgtttgtggtgtgtgtgtgtgtgtgtgtgtgtgtgtgtgtgtgtcgtgggcatgtatatatagattggggtatacatgtgtgtctgggcatgtggatacatgtgtgttagtgggtatgtctgggtaattactctggggctgggtgtgcacacatactttttttgtttccctgcccattcaacaggaccaaggcacaactttggctctcgacataagttacctgagggaaagctcgactctcctcggaaaccgacttaatgggtgtcatatttttcacctcgagaatacgtggtgacttatcggcagggcgagggtacc

SEQ ID NO: 299371 - DNA, 4016 bp, Homo sapiens
acaatgaaatgtagtctatgctattgattcttaaagcaaaatggacttaggaggagaaactaaattgcctggagaaatagaacaagatatcatgaaggaagtagttattgaactaaactagttttggtgggaggagaggggaggatggatggaacattcatggagggtttatcatgcatggtctacaggcatttattagcaggaaagaaggtgaagatgcactttttcagcagcagaaaatacaatttgggatgtttctgaagtcttatttgaggattattaaagccatgtttttgcctataacatttttgaggttttcctagtagaaaagtgatgttacaacagcaggttttataagacattcttttaggatctacttcaagtgagctctgtcatttggaggctgtgtagtcaatttatcaattagtaactgaatttggttgataacagttgaaagggaaatgtagaataaggataaagcaagaatccaaaaaattgaatgaaagaaacaacgaaatctaggagacagattgaatataagtgtattagtttcctgtggttgccataacaaattgccacaaactgcgtggctttaaacaacataaatttattctcacagttttggaatccagaagttagaaatctggtagactgtgctcactctaaaggtcctgccttgccgcttctagtttctggtggctcaagcattccttggcttgtggcagcaaaactctgatgtctgtctccatattcacatggcggccccttcttctctgtgtgtttttgtgcctccagtctttcccttctttctcttaataaggatttagggcccaccctaaatccagggatgatctcatgagatccctaatttaattttatctgcaaaaactatttccaaatagcatcacattcccaggtatcaggagttaggacttggacatctttttaaaggaccacagttgaacccaccgtagtgcgtaataaaggagatagacggtaaaatcataatgtgaatttttaaggtctgtggaatactaatatcaagtaacagataagttgggaaggggaaccagttttagggagaggatggcataaaccctaaacaatgattttgaagcagtcatgaaaaattcaagtggagataataattaaagaagtagattaattccctaaagcagagaaggaactttaaaaaaaaaactgtaagaaatgggcaaatgggcatatagacaggaaagccgagaaagcatagtcaagtgaaccagcggtgtaattaaatagttctttgtaacctgtttcataaaatatgcaaatgcatgagacattctatatgttgctctgactatatatttttaccgtttatagatttcatgatcctttggctgcatggagaaaatgggacagggcctgctaagttcaacatacctcacagtgttacacttgattcagctggtcgggtgtgggttgctgaccgaggaaataaaagaatccaagtatttgataaagacactggggagtggttaggagcatggaataattgtttcacagaagagggaccttcttcagtcaggtttactcctgatgggaagtacttgattgtggcccagctgaatcttagcaggctctcagtcgtagcagcacccccagtgggaagcattggggagtgttctgtgatcagcacaatccaactagcagatcaagttttgccacatctcctagaagtcgacagaaagactggagcagtctatgtagcagaaattggagcaaaacaagtacaaaaatatgtccctttgaatagctatgttccttcatttggttcataatgtttctttcccgggaatatttcaagtggcagttcagattctcaattcactaagtgcttaaaaatgatgttcaagcacaagaatttatttttctagtataaaagatctagtatcagaaagatttgtttttgtatcattaagaatcttatattttgttgccctcttgggacttagttttatttgtaagtgcataaggatattttaatgaaaggaaagtaactaaaaaatggggttgggaagagggactaaggtggtaacctcattatttgccctggtagactgattctccctgggtaaaaaaaatgggaataaaaatgagcttgcatgataatttattaaatttcatgtgaagaactccagacctccagattgtgcaactaacataaaatgagctgcttgagagattgtaaataagatgaactattgattaatttgagtacccacagagtgctgtgtcttgacgacttaaaaatgaaaaagcaggattgccttttgagtagcttgcagtctagtggggagacaagcaggcaaacagtcacaacacagcaaaagcgaccttggagcatagtgggacttttggagtaggagtgctgcatttgactgagggaatcatggatacttcgcaggagaagtgaatttgagctcagacttgaaaactgaggaggagcttaccaagggacaaggaggagaaaacaataatttccaagtaaagaaggtataaaaagttagaagtgtactgtaaactttgataggcttttaggccttttttaaagcccaacttggcttctgtccattacctataagatatttaatgtcagtcagcctttaaatgtaggaataaaatggctggcatctaagcacttttagtaaaagaggtttttacaaataactaaggattgtagagcttccttctctttttttttctttttctttcttttgttttacatgaactcaacttattcctaacatttgtctacctcaaagaaatttcaagattatttagataacatggatatgtgccaaatcctttgagctgttaagatgataatttcctgctttcctcctacatcttctcctcccactccctcctttggtgtgaatattggcttcccaattaagacctttttttttttttttccagtttgttttagcttattataggttttggaggaactttgccattttgtaatctttcaaatcattcttcacccttcctcacatcagcttcctgcttttcccagtgttttactgtaaattgtgtagcatatgacaaatcttgagctgactttcctcttcacctgttatggctggagtattttccagacctgaagggactcacacttgttttgatacttggatcacatctccgtgaggttaggaaggtaaatctaccaacaggaagccctgtactctgtattccaaggccattggtaaatgtgttggtgccactgatcggactgtatgaccttaaacaagtcaccttagttttcagtgaaatgggaatatcattgtctcctctttcatgaatgctgtgagaatcagatgtgcaacaggtacagacttgccctttgaaatctatacctctggatacattagaggcattttattaacaaaggcccttctaaatgtgctatttatttgacaataactatcagatttgccttaattttgtgtttatagcatttatcaaaacgtatcctcatagactttatgcagattaatatggtcaattgatttggataaaagaaagtaatttcagggtttgtttttaagccaggacaagaagtgcaaatgcctctttgaagcaatttaggctaaactgattttgaaatttcaaaatgttttattttactttgttttattaagccaggacaagaagtgcaaatgcctctttgaagcaattcaggctaggtaaaccgattttgccatttcaaaacgttttattttactttgttttatatcagagtcttataaaacctgctgcaaatatttctgaatgtctttgtaaaagtgtttgttagtgtacctgtgattatagtacttcacttttttcctttggattaattggttaaatgaatgagaaatgtgttatgttttttactaaaaagtataaattaaaattttggaaagaaaaggcaatattatctggctccccaattaaagtttgattttattgtcacaaaaaagaaataa

SEQ ID NO: 299372 - DNA, 3564 bp, Homo sapiens
actttggtggccactgaaagtcagcggcgcggactgccctgagggcgggaaagggtggtcactgggtcagcccgaagcacctgacatgagggcggggaccccgaaatgcacacgaagtccggaactggtcttctgtgattttcattcgccctggtctctgttccctttcgtactcaaagctcgtgcatccagggaggggaaaccggagatagggtcttcgggccccgggcagaccctctgtgccgctgcaaaccgttgcagcctgaggctgtcaggtcctcccccagacacctgcggaccctccctctcctggcttcccgtctggtcatggcgagattctgggtctgcgtagccggtgctggcttctttcttgcatttttggttttgcattcgcgtttttgtggctctccagttttgaggaactttacttttgcagtttcctggagaactgagaaaattctttaccggctggatgtgggttggcctaagcacccagaatattttaccggaacaacattttgtgttgcagttgactccctcaatggattggtttacataggtcaaagaggggataacatcccaaagatattagtgttcacagaggatggatatttcctacgagcctggaattatacagttgacacacctcatggtatatttgcagccagtactctatatgaacaatccgtctggatcacggatgtaggaagtggattctttggtcatactgttaaaaaatacagttcttttggtgatcttgttcaagtcttgggtactccaggcaaaaaaggcactagtttgaatcctttgcagtttgataacccagcagaattatatgtagaggacacaggagatatttacattgtggatggagatggaggattgaataacagattgatcaaactgtcccaagatttcatgatcctttggctgcatggagaaaatgggacagggcctgctaagttcaacatacctcacagtgttacacttgattcagctggtcgggtgtgggttgctgaccgaggaaataaaagaatccaagtatttgataaagacactggggagtggttaggagcatggaataattgtttcacagaagagggaccttcttcagtcaggtttactcctgatgggaagtacttgattgtggcccagctgaatcttagcaggctctcagtcgtagcagcacccccagtgggaagcattggggagtgttctgtgatcagcacaatccaactagcagatcaagttttgccacatctcctagaagtcgacagaaagactggagcagtctatgtagcagaaattggagcaaaacaagtacaaaaatatgtccctttgaatagctatgttccttcatttggttcataatgtttctttcccgggaatatttcaagtggcagttcagattctcaattcactaagtgcttaaaaatgatgttcaagcacaagaatttatttttctagtataaaagatctagtatcagaaagatttgtttttgtatcattaagaatcttatattttgttgccctcttgggacttagttttatttgtaagtgcataaggatattttaatgaaaggaaagtaactaaaaaatggggttgggaagagggactaaggtggtaacctcattatttgccctggtagactgattctccctgggtaaaaaaaatgggaataaaaatgagcttgcatgataatttattaaatttcatgtgaagaactccagacctccagattgtgcaactaacataaaatgagctgcttgagagattgtaaataagatgaactattgattaatttgagtacccacagagtgctgtgtcttgacgacttaaaaatgaaaaagcaggattgccttttgagtagcttgcagtctagtggggagacaagcaggcaaacagtcacaacacagcaaaagcgaccttggagcatagtgggacttttggagtaggagtgctgcatttgactgagggaatcatggatacttcgcaggagaagtgaatttgagctcagacttgaaaactgaggaggagcttaccaagggacaaggaggagaaaacaataatttccaagtaaagaaggtataaaaagttagaagtgtactgtaaactttgataggcttttaggccttttttaaagcccaacttggcttctgtccattacctataagatatttaatgtcagtcagcctttaaatgtaggaataaaatggctggcatctaagcacttttagtaaaagaggtttttacaaataactaaggattgtagagcttccttctctttttttttctttttctttcttttgttttacatgaactcaacttattcctaacatttgtctacctcaaagaaatttcaagattatttagataacatggatatgtgccaaatcctttgagctgttaagatgataatttcctgctttcctcctacatcttctcctcccactccctcctttggtgtgaatattggcttcccaattaagacctttttttttttttttccagtttgttttagcttattataggttttggaggaactttgccattttgtaatctttcaaatcattcttcacccttcctcacatcagcttcctgcttttcccagtgttttactgtaaattgtgtagcatatgacaaatcttgagctgactttcctcttcacctgttatggctggagtattttccagacctgaagggactcacacttgttttgatacttggatcacatctccgtgaggttaggaaggtaaatctaccaacaggaagccctgtactctgtattccaaggccattggtaaatgtgttggtgccactgatcggactgtatgaccttaaacaagtcaccttagttttcagtgaaatgggaatatcattgtctcctctttcatgaatgctgtgagaatcagatgtgcaacaggtacagacttgccctttgaaatctatacctctggatacattagaggcattttattaacaaaggcccttctaaatgtgctatttatttgacaataactatcagatttgccttaattttgtgtttatagcatttatcaaaacgtatcctcatagactttatgcagattaatatggtcaattgatttggataaaagaaagtaatttcagggtttgtttttaagccaggacaagaagtgcaaatgcctctttgaagcaatttaggctaaactgattttgaaatttcaaaatgttttattttactttgttttattaagccaggacaagaagtgcaaatgcctctttgaagcaattcaggctaggtaaaccgattttgccatttcaaaacgttttattttactttgttttatatcagagtcttataaaacctgctgcaaatatttctgaatgtctttgtaaaagtgtttgttagtgtacctgtgattatagtacttcacttttttcctttggattaattggttaaatgaatgagaaatgtgttatgttttttactaaaaagtataaattaaaattttggaaagaaaaggcaatattatctggctccccaattaaagtttgattttattgtcacaaaaaagaaataa

SEQ ID NO: 299373 - DNA, 3878 bp, Homo sapiens
cgatctcttcattttttccattacagctaattttctacccagagatctgaagacagttttatattcccatttcccaaaggaataaatttcctctaatgaaaaatatggctacaaattagccttttttttttgagaaaattttttattggtagtcttttttgctagtttttagaaacttggaggcttatgtgttttttattgctatgaactttagctcaactgtctaaaagtgtaatagtaaataaattatttaacatagaattgtaatgcaagctgattcactttctttctggtaagctcaatgtatccagtttgtcttttgaatacctatcaattaatttggcatatgtaccttcaaattgatttctgttcactgctttatgatattcccttattagtagtctgctttatgctcttgcttgtaagataattttaacttaaagaaattttaacgtgagaaaataagatactcatgatttacaaagattattttcttcttagcaaagaaaagttgggttgaattttgaatgtctccacaaggtgaaaatgcagttaaaaaaaaaatctgtaccatagagaacgtttttgttgacttactgaaatttaaggtctgtatgtgagtgattgaaataacagtttcaaatataagttgttccctttacattttcttcttgatttcctttcataagcaatgcttattcaaggtcataagattaaaaaagaaaatggtgcaccaatactttgttagcattctgagtttcctgtataatgagtcaattatggggatgttatttatttgaatttagaatccgcttattttggactaatggagattttaattcgtgatcaaatttggctgtaatttacgaagaagctatagtgcttgtcaattatatgtaatttcctaagcctatcacctatttgttattatttacttctatcaaatttttgctcttagcttacttgaaaaatctgaatgtttgtatagtggttttatttgtgagatgtacatatctatctttataggattctttggtcatactgttaaaaaatacagttcttttggtgatcttgttcaagtcttgggtactccaggcaaaaaaggcactagtttgaatcctttgcagtttgataacccagcagaattatatgtagaggacacaggagatatttacattgtggatggagatggaggattgaataacagattgatcaaactgtcccaagatttcatgatcctttggctgcatggagaaaatgggacagggcctgctaagttcaacatacctcacagtgttacacttgattcagctggtcgggtgtgggttgctgaccgaggaaataaaagaatccaagtatttgataaagacactggggagtggttaggagcatggaataattgtttcacagaagagggaccttcttcagtcaggtttactcctgatgggaagtacttgattgtggcccagctgaatcttagcaggctctcagtcgtagcagcacccccagtgggaagcattggggagtgttctgtgatcagcacaatccaactagcagatcaagttttgccacatctcctagaagtcgacagaaagactggagcagtctatgtagcagaaattggagcaaaacaagtacaaaaatatgtccctttgaatagctatgttccttcatttggttcataatgtttctttcccgggaatatttcaagtggcagttcagattctcaattcactaagtgcttaaaaatgatgttcaagcacaagaatttatttttctagtataaaagatctagtatcagaaagatttgtttttgtatcattaagaatcttatattttgttgccctcttgggacttagttttatttgtaagtgcataaggatattttaatgaaaggaaagtaactaaaaaatggggttgggaagagggactaaggtggtaacctcattatttgccctggtagactgattctccctgggtaaaaaaaatgggaataaaaatgagcttgcatgataatttattaaatttcatgtgaagaactccagacctccagattgtgcaactaacataaaatgagctgcttgagagattgtaaataagatgaactattgattaatttgagtacccacagagtgctgtgtcttgacgacttaaaaatgaaaaagcaggattgccttttgagtagcttgcagtctagtggggagacaagcaggcaaacagtcacaacacagcaaaagcgaccttggagcatagtgggacttttggagtaggagtgctgcatttgactgagggaatcatggatacttcgcaggagaagtgaatttgagctcagacttgaaaactgaggaggagcttaccaagggacaaggaggagaaaacaataatttccaagtaaagaaggtataaaaagttagaagtgtactgtaaactttgataggcttttaggccttttttaaagcccaacttggcttctgtccattacctataagatatttaatgtcagtcagcctttaaatgtaggaataaaatggctggcatctaagcacttttagtaaaagaggtttttacaaataactaaggattgtagagcttccttctctttttttttctttttctttcttttgttttacatgaactcaacttattcctaacatttgtctacctcaaagaaatttcaagattatttagataacatggatatgtgccaaatcctttgagctgttaagatgataatttcctgctttcctcctacatcttctcctcccactccctcctttggtgtgaatattggcttcccaattaagacctttttttttttttttccagtttgttttagcttattataggttttggaggaactttgccattttgtaatctttcaaatcattcttcacccttcctcacatcagcttcctgcttttcccagtgttttactgtaaattgtgtagcatatgacaaatcttgagctgactttcctcttcacctgttatggctggagtattttccagacctgaagggactcacacttgttttgatacttggatcacatctccgtgaggttaggaaggtaaatctaccaacaggaagccctgtactctgtattccaaggccattggtaaatgtgttggtgccactgatcggactgtatgaccttaaacaagtcaccttagttttcagtgaaatgggaatatcattgtctcctctttcatgaatgctgtgagaatcagatgtgcaacaggtacagacttgccctttgaaatctatacctctggatacattagaggcattttattaacaaaggcccttctaaatgtgctatttatttgacaataactatcagatttgccttaattttgtgtttatagcatttatcaaaacgtatcctcatagactttatgcagattaatatggtcaattgatttggataaaagaaagtaatttcagggtttgtttttaagccaggacaagaagtgcaaatgcctctttgaagcaatttaggctaaactgattttgaaatttcaaaatgttttattttactttgttttattaagccaggacaagaagtgcaaatgcctctttgaagcaattcaggctaggtaaaccgattttgccatttcaaaacgttttattttactttgttttatatcagagtcttataaaacctgctgcaaatatttctgaatgtctttgtaaaagtgtttgttagtgtacctgtgattatagtacttcacttttttcctttggattaattggttaaatgaatgagaaatgtgttatgttttttactaaaaagtataaattaaaattttggaaagaaaaggcaatattatctggctccccaattaaagtttgattttattgtcacaaaaaagaaataa

SEQ ID NO: 299374 - DNA, 3306 bp, Homo sapiens
actttggtggccactgaaagtcagcggcgcggactgccctgagggcgggaaagggtggtcactgggtcagcccgaagcacctgacatgagggcggggaccccgaaatgcacacgaagtccggaactggtcttctgtgattttcattcgccctggttttgaggaactttacttttgcagtttcctggagaactgagaaaattctttaccggctggatgtgggttggcctaagcacccagaatattttaccggaacaacattttgtgttgcagttgactccctcaatggattggtttacataggtcaaagaggggataacatcccaaagatattagtgttcacagaggatggatatttcctacgagcctggaattatacagttgacacacctcatggtatatttgcagccagtactctatatgaacaatccgtctggatcacggatgtaggaagtggattctttggtcatactgttaaaaaatacagttcttttggtgatcttgttcaagtcttgggtactccaggcaaaaaaggcactagtttgaatcctttgcagtttgataacccagcagaattatatgtagaggacacaggagatatttacattgtggatggagatggaggattgaataacagattgatcaaactgtcccaagatttcatgatcctttggctgcatggagaaaatgggacagggcctgctaagttcaacatacctcacagtgttacacttgattcagctggtcgggtgtgggttgctgaccgaggaaataaaagaatccaagtatttgataaagacactggggagtggttaggagcatggaataattgtttcacagaagagggaccttcttcagtcaggtttactcctgatgggaagtacttgattgtggcccagctgaatcttagcaggctctcagtcgtagcagcacccccagtgggaagcattggggagtgttctgtgatcagcacaatccaactagcagatcaagttttgccacatctcctagaagtcgacagaaagactggagcagtctatgtagcagaaattggagcaaaacaagtacaaaaatatgtccctttgaatagctatgttccttcatttggttcataatgtttctttcccgggaatatttcaagtggcagttcagattctcaattcactaagtgcttaaaaatgatgttcaagcacaagaatttatttttctagtataaaagatctagtatcagaaagatttgtttttgtatcattaagaatcttatattttgttgccctcttgggacttagttttatttgtaagtgcataaggatattttaatgaaaggaaagtaactaaaaaatggggttgggaagagggactaaggtggtaacctcattatttgccctggtagactgattctccctgggtaaaaaaaatgggaataaaaatgagcttgcatgataatttattaaatttcatgtgaagaactccagacctccagattgtgcaactaacataaaatgagctgcttgagagattgtaaataagatgaactattgattaatttgagtacccacagagtgctgtgtcttgacgacttaaaaatgaaaaagcaggattgccttttgagtagcttgcagtctagtggggagacaagcaggcaaacagtcacaacacagcaaaagcgaccttggagcatagtgggacttttggagtaggagtgctgcatttgactgagggaatcatggatacttcgcaggagaagtgaatttgagctcagacttgaaaactgaggaggagcttaccaagggacaaggaggagaaaacaataatttccaagtaaagaaggtataaaaagttagaagtgtactgtaaactttgataggcttttaggccttttttaaagcccaacttggcttctgtccattacctataagatatttaatgtcagtcagcctttaaatgtaggaataaaatggctggcatctaagcacttttagtaaaagaggtttttacaaataactaaggattgtagagcttccttctctttttttttctttttctttcttttgttttacatgaactcaacttattcctaacatttgtctacctcaaagaaatttcaagattatttagataacatggatatgtgccaaatcctttgagctgttaagatgataatttcctgctttcctcctacatcttctcctcccactccctcctttggtgtgaatattggcttcccaattaagacctttttttttttttttccagtttgttttagcttattataggttttggaggaactttgccattttgtaatctttcaaatcattcttcacccttcctcacatcagcttcctgcttttcccagtgttttactgtaaattgtgtagcatatgacaaatcttgagctgactttcctcttcacctgttatggctggagtattttccagacctgaagggactcacacttgttttgatacttggatcacatctccgtgaggttaggaaggtaaatctaccaacaggaagccctgtactctgtattccaaggccattggtaaatgtgttggtgccactgatcggactgtatgaccttaaacaagtcaccttagttttcagtgaaatgggaatatcattgtctcctctttcatgaatgctgtgagaatcagatgtgcaacaggtacagacttgccctttgaaatctatacctctggatacattagaggcattttattaacaaaggcccttctaaatgtgctatttatttgacaataactatcagatttgccttaattttgtgtttatagcatttatcaaaacgtatcctcatagactttatgcagattaatatggtcaattgatttggataaaagaaagtaatttcagggtttgtttttaagccaggacaagaagtgcaaatgcctctttgaagcaatttaggctaaactgattttgaaatttcaaaatgttttattttactttgttttattaagccaggacaagaagtgcaaatgcctctttgaagcaattcaggctaggtaaaccgattttgccatttcaaaacgttttattttactttgttttatatcagagtcttataaaacctgctgcaaatatttctgaatgtctttgtaaaagtgtttgttagtgtacctgtgattatagtacttcacttttttcctttggattaattggttaaatgaatgagaaatgtgttatgttttttactaaaaagtataaattaaaattttggaaagaaaaggcaatattatctggctccccaattaaagtttgattttattgtcacaaaaaagaaataa

SEQ ID NO: 299375 - DNA, 1819 bp, Homo sapiens
acaatgaaatgtagtctatgctattgattcttaaagcaaaatggacttaggaggagaaactaaattgcctggagaaatagaacaagatatcatgaaggaagtagttattgaactaaactagttttggtgggaggagaggggaggatggatggaacattcatggagggtttatcatgcatggtctacaggcatttattagcaggaaagaaggtgaagatgcactttttcagcagcagaaaatacaatttgggatgtttctgaagtcttatttgaggattattaaagccatgtttttgcctataacatttttgaggttttcctagtagaaaagtgatgttacaacagcaggttttataagacattcttttaggatctacttcaagtgagctctgtcatttggaggctgtgtagtcaatttatcaattagtaactgaatttggttgataacagttgaaagggaaatgtagaataaggataaagcaagaatccaaaaaattgaatgaaagaaacaacgaaatctaggagacagattgaatataagtgtattagtttcctgtggttgccataacaaattgccacaaactgcgtggctttaaacaacataaatttattctcacagttttggaatccagaagttagaaatctggtagactgtgctcactctaaaggtcctgccttgccgcttctagtttctggtggctcaagcattccttggcttgtggcagcaaaactctgatgtctgtctccatattcacatggcggccccttcttctctgtgtgtttttgtgcctccagtctttcccttctttctcttaataaggatttagggcccaccctaaatccagggatgatctcatgagatccctaatttaattttatctgcaaaaactatttccaaatagcatcacattcccaggtatcaggagttaggacttggacatctttttaaaggaccacagttgaacccaccgtagtgcgtaataaaggagatagacggtaaaatcataatgtgaatttttaaggtctgtggaatactaatatcaagtaacagataagttgggaaggggaaccagttttagggagaggatggcataaaccctaaacaatgattttgaagcagtcatgaaaaattcaagtggagataataattaaagaagtagattaattccctaaagcagagaaggaactttaaaaaaaaaactgtaagaaatgggcaaatgggcatatagacaggaaagccgagaaagcatagtcaagtgaaccagcggtgtaattaaatagttctttgtaacctgtttcataaaatatgcaaatgcatgagacattctatatgttgctctgactatatatttttaccgtttatagatttcatgatcctttggctgcatggagaaaatgggacagggcctgctaagttcaacatacctcacagtgttacacttgattcagctggtcgggtacaaatacagcgtcattgtgtctgggactttgtgtctgaatatgtttgtggtgtgtgtgtgtgtgtgtgtgtgtgtgtgtgtgtgtcgtgggcatgtatatatagattggggtatacatgtgtgtctgggcatgtggatacatgtgtgttagtgggtatgtctgggtaattactctggggctgggtgtgcacacatactttttttgtttccctgcccattcaacaggaccaaggcacaactttggctctcgacataagttacctgagggaaagctcgactctcctcggaaaccgacttaatgggtgtcatatttttcacctcgagaatacgtggtgacttatcggcagggcgagggtacc

SEQ ID NO: 299376 - DNA, 1034 bp, Homo sapiens
actttggtggccactgaaagtcagcggcgcggactgccctgagggcgggaaagggtggtcactgggtcagcccgaagcacctgacatgagggcggggaccccgaaatgcacacgaagtccggaactggtcttctgtgattttcattcgccctggtctctgttccctttcgtactcaaagctcgtgcatccagggaggggaaaccggagatagggtcttcgggccccgggcagaccctctgtgccgctgcaaaccgttgcagcctgaggctgtcaggtcctcccccagacacctgcggaccctccctctcctggcttcccgtctggtcatggcgagattctgggtctgcgtagccggtgctggcttctttcttgcatttttggttttgcattcgcgtttttgtggctctccagttttgaggaactttacttttgcagtttcctggagaactgagaaaattctttaccggctggatgtgggttggcctaagcacccagaatattttaccggaacaacattttgtgttgcagttgactccctcaatggattggtttacataggtcaaagaggggataacatcccaaagatattagtgttcacagaggatggatatttcctacgagcctggaattatacagttgacacacctcatggtatatttgcagccagtactctatatgaacaatccgtctggatcacggatgtaggaagtggattctttggtcatactgttaaaaaatacagttcttttggtgatcttgttcaagtcttgggtactccaggcaaaaaaggcactagtttgaatcctttgcagtttgataacccagcagaattatatgtagaggacacaggagatatttacattgtggatggagatggaggattgaataacagattgatcaaactgtcccaagatttcatgatcctttggctgcatggagaaaatgggacagggcctgctaagttcaacatacctcacagtgttacacttgattcagctggtcgggtacaaatacagcgtcattgtgtctggga

SEQ ID NO: 299377 - DNA, 1152 bp, Homo sapiens
actttggtggccactgaaagtcagcggcgcggactgccctgagggcgggaaagggtggtcactgggtcagcccgaagcacctgacatgagggcggggaccccgaaatgcacacgaagtccggaactggtcttctgtgattttcattcgccctggtctctgttccctttcgtactcaaagctcgtgcatccagggaggggaaaccggagatagggtcttcgggccccgggcagaccctctgtgccgctgcaaaccgttgcagcctgaggctgtcaggtcctcccccagacacctgcggaccctccctctcctggcttcccgtctggtcatggcgagattctgggtctgcgtagccggtgctggcttctttcttgcatttttggttttgcattcgcgtttttgtggctctccagttttgaggaactttacttttgcagtttcctggagaactgagaaaattctttaccggctggatgtgggttggcctaagcacccagaatattttaccggaacaacattttgtgttgcagttgactccctcaatggattggtttacataggtcaaagaggggataacatcccaaagatattagtgttcacagaggatggatatttcctacgagcctggaattatacagttgacacacctcatggtatatttgcagccagtactctatatgaacaatccgtctggatcacggatgtaggaagtggtatgtatagtaatatctattaaattatcttactggaaatcacatctttgcacatgtccttgtttgtattgtttaaaatcagagttgctgaatctaattgtaatttctttaacgattcatgaaatcacatgtttttaacaaactttattttgtacttctgtggaattaagaaatttaacaagggctggacgccgtggctcacgcctgtaatcccaaagtgctaggactttgttcttaggtcacttaacagattaaaagactgcttcaagcaatgtagtgtaaggctacggcaataaagtcctattttgttttgcctttgctgtttttaagcacttttgcatttgaaaacaggacagattggatagtcagcattaaaatggaaactcaaatttttgctttttaggcttaccaaaataaatgagagtttttaaaagtcctaa

SEQ ID NO: 299378 - DNA, 1367 bp, Homo sapiens
actttggtggccactgaaagtcagcggcgcggactgccctgagggcgggaaagggtggtcactgggtcagcccgaagcacctgacatgagggcggggaccccgaaatgcacacgaagtccggaactggtcttctgtgattttcattcgccctggtctctgttccctttcgtactcaaagctcgtgcatccagggaggggaaaccggagatagggtcttcgggccccgggcagaccctctgtgccgctgcaaaccgttgcagcctgaggctgtcaggtcctcccccagacacctgcggaccctccctctcctggcttcccgtctggtcatggcgagattctgggtctgcgtagccggtgctggcttctttcttgcatttttggttttgcattcgcgtttttgtggctctccagttttgaggaactttacttttgcagtttcctggagaactgagaaaattctttaccggctggatgtgggttggcctaagcacccagaatattttaccggaacaacattttgtgttgcagttgactccctcaatggattggtttacataggtcaaagaggggataacatcccaaagatattagtgttcacagaggatggatatttcctacgagcctggaattatacagttgacacacctcatggtatatttgcagccagtactctatatgaacaatccgtctggatcacggatgtaggaagtggattctttggtcatactgttaaaaaatacagttcttttggtgatcttgttcaagtcttgggtactccaggcaaaaaaggcactagtttgaatcctttgcagtttgataacccagcagaattatatgtagaggacacaggagatatttacattgtggatggagatggaggattgaataacagattgatcaaactgtcccaagatttcatgatcctttggctgcatggagaaaatgggacagggcctgctaagttcaacatacctcacagtgttacacttgattcagctggtcgggtacaaatacagcgtcattgtgtctgggactttgtgtctgaatatgtttgtggtgtgtgtgtgtgtgtgtgtgtgtgtgtgtgtgtgtcgtgggcatgtatatatagattggggtatacatgtgtgtctgggcatgtggatacatgtgtgttagtgggtatgtctgggtaattactctggggctgggtgtgcacacatactttttttgtttccctgcccattcaacaggaccaaggcacaactttggctctcgacataagttacctgagggaaagctcgactctcctcggaaaccgacttaatgggtgtcatatttttcacctcgagaatacgtggtgacttatcggcagggcgagggtacc

SEQ ID NO: 299379 - DNA, 303 bp, Homo sapiens
tgagttggtctcaagtattttggtttcgaatgtgaaagatatgttagattttgaaagtggtttttgtagtaaaattctcagttattttttttcttcgccaagatacagattacctttcctttaagctgatcctaagaagttattttttgtataccttcagagaggggataacatcccaaagatattagtgttcacagaggatggatatttcctacgagcctggaattatacagttgacacacctcatggtatatttgcagccagtactctatatgaacaatccgtctggatcacggatgtagg

SEQ ID NO: 299380 - DNA, 398 bp, Homo sapiens
ggaattatacagttgacacacctcatggtatatttgcagccagtactctatatgaacaatccgtctggatcacggatgtaggaagtggtatgtatagtaatatctattaaattatcttactggaaatcacatctttgcacatgtccttgtttgtattgtttaaaatcagagttgctgaatctaattgtaatttctttaacgattcatgaaatcacatgtttttaacaaactttattttgtacttctgtggaattaagaaatttaacaagggctggacgccgtggctcacgcctgtaatcccagcactttgggaggccgaggcgggcggatcacgaggtcaggagatcgagacgatcctggccaacacggtgaaacccccgtctccactaaaaatacaa

SEQ ID NO: 299381 - DNA, 5660 bp, Homo sapiens
ctgaagttcctggccgtgctgctggccgcgggcatgctggcgttcctcggtgccgtcatctgcatcatcgccagcgtgcccctggcggccagcccggcgcgggcgctgcccggcggcgccgacaatgcttcggtcgcctcgggcgccgccgcgtccccgggcccgcagcggagcctgagcgcgctgcacggcgcgggcggttcagccgggccccccgcgctgcccggggcacccgcggccagcgcgcacccgctgccgcccgggcccctgttcagccgcttcctgtgcacgccgctggctgctgcctgcccgtcgggggcccagcagggggacgcggcgggcgctgcgccgggcgagcgcgaagagctgctgctgctgcagagcacggccgagcagctgcgccagacggcgctgcagcaggaggcgcgcatccgcgccgaccaggacaccatccgtgagctcaccggcaagctgggccgctgcgagagcggcctgccgcgcggcctccagggcgccgggccccgccgcgacaccatggccgacgggccctgggactcgcctgcgctcattctggagctggaggacgccgtgcgcgccctgcgggaccgcatcgaccgcctggagcaggagcttccagcccgtgtgaacctctcagctgccccagccccagtctctgctgtgcccaccggcctacactccaagatggaccagctggaggggcagctgctggcccaggtgctggcactggagaaggagcgtgtggccctcagccacagcagccgccggcagaggcaggaagtggaaaaggagttggacgtcctgcagggtcgtgtggctgagctggagcacgggtcctcagcctacagtcctccagatgccttcaagatcagcatccccatccgtaacaactacatgtacgcccgcgtgcggaaggctctgcccgagctctacgcattcaccgcctgcatgtggctgcggtccaggtccagcggcaccggccagggcacccccttctcctactcagtgcccgggcaggccaacgagattgtactgctagaggcgggccatgagcccatggagctgctgatcaacgacaaggtggcccagctgcccctgagcctgaaggacaatggctggcaccacatctgcatcgcctggaccacaagggatggcctatggtctgcctaccaggacggggagctgcagggctccggtgagaacctggctgcctggcaccccatcaagcctcatgggatccttatcttgggccaggagcaggataccctgggtggccggtttgatgccacccaggcctttgtcggtgacattgcccagtttaacctgtgggaccacgccctgacaccagcccaggtcctgggcattgccaactgcactgcgccactgctgggcaacgtccttccctgggaagacaagttggtggaggcctttgggggtgcaacaaaggctgccttcgatgtctgcaaggggagggccaaggcatgaggggccacctcatccagggcccctcccttgcctgccactttggggacttgaggggggtcatattccctcctcagcctgcccacgcactggccttccctcctgccccactcctggctgtgcctcccatttcccctcacctgtacccacacctccagaatgccctgccctgcgagtgtgtcccctgtccccacctgagtggggaggagcgtctcaagtgaacagtgggagcctgcccacctggcactgcactggagttgtctcttaccccaccctccctgcccatcaactgtatctgatttcactaattttgacagcacccccagtagggtaggattgtgtatgagggggaccccactatctcagtggtgggggtggccgcccgcccccttgtcccccatgcaacaggcccagtggcttccccttcagggccacaacaggctgtagaaggggatgacgaggacatcagaggttagacttaccctcctccctctttccaccagctgccagtcaagggcagtgggatctcgatggagcctccccccccccccacccatgcctccctcttcctcctctttcctcctctctttgtgtgtagcggtttgaatgttggttccatgcctggcccagccccacctcagtctccaggacattcctttcccagctccagcctggagggaaggggacaaagaccccaggaggccaaagggctgcagtcaccccttgtgctcacccatagtgatggccactggtatagtcatcgctctccctccatgccaaggacaggacttggaccgcttcagcctgggctgggagcagccctaaggtagaggcctcatggcccaggagaccccacctctggcagagccacattacctaccctgtgcatggtcctggggcagcaaggaagaagctcagagggtggggagaagcatgaagcagtgagcagagcactgggtgagagggagaagaccttggttcctagccagccctgctaatgtgctgtgtggccttctgtaagtccctgccctctctgggcctggccttcctcattcgtgagctgaggccctcgctttggtcatttgctctccagattgggtgtgagcttctctgtgattccaggtggatatgtggggaaagctctggtgaccctgggcttcgcaggggtagatcccaggactcggcagtggatgggatgcagccagtcatgggttagggtcagcagagactcagagtccagggcaaggttcaaggcagactaacctcatgcatggattgtaaaaaaccagctccctttggatcaacccagcctggcacccttgcctgtctgagagtgtctcaaagggctgatggcttcctggtccccttgagtcatcaccagcttccccaagagagtgtcagaatcttaagagctgagaggccgggcacggtggctcacgcctgtaatcccagcactttgggaggctgagacaggcagatcacttgaggtcaggagttcgaggtcagcctggccaacgtggtgaaaccccatcttcactaaaaatacaaaacttagctggttaggtggtgcatgcctgtagtcccagctactcgggaggccgaggcagaagaatctcttgaactgaggaggtggaggttgcagtgagccgagatcacgccattgcactccagcctgggcaacagagcaagactccatctcaaaaaaataataataatcttaaagatgagaaaagccaccccatctggcaccacagctgcatcttgcttgtgagaaatggggaagagttcagggaggacacgtgacctgcacaggatcacagagcatggggcagagccaggactagagctcagggcatctgactccctcttcagtgttcttccccctccatgttgcctgcccctgaagacctttgagttcagtctacacctaagcaggtagacatccgcgaggtcagatgctttccaacatgacacctgaacatcttcctttatgcaacacccaaacatcttggcatccccaccccaggaagtgcggggaggaggttatgatccctgggcgcttcggcagaatggagagctgaggtgtccctcccctgctagtcacctaccaggtgtctgagcagctgcatgctccctggctcaagtgggcactgtaccttttgcctgcctttttgttccctatctccactccctgaggccacttagcctgagacatgatgcaagagctgcaggccggggggctcagtgccatggaagctactccaagttgcattgcctcccgcgcccagatcctgctttccatttcgagaacataaatagattgcccagcccctccagtacaatcccactggaagaaaaggcaatggcgggcttcagccagacctgctgagacctaggttgccacggtaacagccaaagacatcaacccaagtgctgggtcaagtgtctcatcatactggcactgttgctggggtgacggcagaattcagaacttcaatttcagtgacgccaagcttgatgtgtttctgttattgttttgaagaaggtagctcttgtggaggacttgggagaaggatggggtcttaggaaggaggtgacagcacttgcatggtcacttgagcccacacacacgctcaaccccaagtcctttatgctttgtcacagtgaagatgagacctctgacgtccaagccttgttcctgtgctgcatcacccactcagccttccaaagggaacaggaacaaatttccccagcaccactgtttgggtcccgcttttcctatcttctgctgcccctgagcacatccaagcagacagggaaagaggagtcagacatggcccagtcacatcctgagctgctcctggctgataaccacgatggagcccgtgtttgtcctgccatctggcactgcactgagtgtggcacaggcaccgtcctgttgatctcacaacacagttctaagttaggacgttcttggctccgttagacaggtgaggaaactggggcacagagaggtgatgtcatctgcctggtgtcaatcagctagcaagtgatggagcccagatttcaaaccaaagggggttacgtccaggggctgagttcccactcacctgtgtagagtgccatctgggcaccattgctccagacgtgttccgacccctttcccagcccacagggcttgaagtgaaggaacagaggcagggggtgggccagccccagggccagggtccccttggtgaagccgtgccagggggctcagctgcttcagggaatgtgtccctcccaccatgggccagagcttcagcccttctttagctcagctagagttcacaggagagccaaaaaagaaaaggaagctgagcatctcccgagtcctgggcagggaaggggagggaaattgctgcttctccaactcttgcttggggccaagccctgcaccagttgcttcccagctgttatctgccagatcttcccatcttgtggcatgtggtgcccccaccaacatcccaaggggaccaatccccttgccaccactttgcatcacctgggaccacagatttggacaggaagggctctgagaagaggccaaagccctcattttacagatgaggaagctgaagcccggggaggggagcgaccctcaaggccacccagctggacacgggagacttgagcccagccttctgactgcattcagccctctctaggacgcagcagcctctccccagcactgagtcccccctcctttgtgtgtcccagcacccttggcctgagtaaacttggaaaggggctccctcccagagaagggactactctcttcacccctttattccagctgcctgccaccccagacccccacctcccaccctgacccccgacccctgggtggggaaggggctcacatgggcccaggctgagtgtgagtgagcatgtcaagttgtctgacactgtgacattagtgcaccctactgacaacccctccccagccttgcccctttctcctctccctgttttgtacataaattgacatgagctgcaacatgtgtgcgtgtgtgtgcgtgtgtgtgtgtgtgtatgtgtgtgtgatctgtgtcatggttttgttacctttttgtttttgtaaacttgaatgttcaaaataaacatgctgtttactctga

SEQ ID NO: 299382 - DNA, 4455 bp, Homo sapiens
ctgagccagcctgcctgtcttttctgctccctcactccatgcctctcctttctctgctgctgtcttggcccaggataccctgggtggccggtttgatgccacccaggcctttgtcggtgacattgcccagtttaacctgtgggaccacgccctgacaccagcccaggtcctgggcattgccaactgcactgcgccactgctgggcaacgtccttccctgggaagacaagttggtggaggcctttgggggtgcaacaaaggctgccttcgatgtctgcaaggggagggccaaggcatgaggggccacctcatccagggcccctcccttgcctgccactttggggacttgaggggggtcatattccctcctcagcctgcccacgcactggccttccctcctgccccactcctggctgtgcctcccatttcccctcacctgtacccacacctccagaatgccctgccctgcgagtgtgtcccctgtccccacctgagtggggaggagcgtctcaagtgaacagtgggagcctgcccacctggcactgcactggagttgtctcttaccccaccctccctgcccatcaactgtatctgatttcactaattttgacagcacccccagtagggtaggattgtgtatgagggggaccccactatctcagtggtgggggtggccgcccgcccccttgtcccccatgcaacaggcccagtggcttccccttcagggccacaacaggctgtagaaggggatgacgaggacatcagaggttagacttaccctcctccctctttccaccagctgccagtcaagggcagtgggatctcgatggagcctccccccccccccacccatgcctccctcttcctcctctttcctcctctctttgtgtgtagcggtttgaatgttggttccatgcctggcccagccccacctcagtctccaggacattcctttcccagctccagcctggagggaaggggacaaagaccccaggaggccaaagggctgcagtcaccccttgtgctcacccatagtgatggccactggtatagtcatcgctctccctccatgccaaggacaggacttggaccgcttcagcctgggctgggagcagccctaaggtagaggcctcatggcccaggagaccccacctctggcagagccacattacctaccctgtgcatggtcctggggcagcaaggaagaagctcagagggtggggagaagcatgaagcagtgagcagagcactgggtgagagggagaagaccttggttcctagccagccctgctaatgtgctgtgtggccttctgtaagtccctgccctctctgggcctggccttcctcattcgtgagctgaggccctcgctttggtcatttgctctccagattgggtgtgagcttctctgtgattccaggtggatatgtggggaaagctctggtgaccctgggcttcgcaggggtagatcccaggactcggcagtggatgggatgcagccagtcatgggttagggtcagcagagactcagagtccagggcaaggttcaaggcagactaacctcatgcatggattgtaaaaaaccagctccctttggatcaacccagcctggcacccttgcctgtctgagagtgtctcaaagggctgatggcttcctggtccccttgagtcatcaccagcttccccaagagagtgtcagaatcttaagagctgagaggccgggcacggtggctcacgcctgtaatcccagcactttgggaggctgagacaggcagatcacttgaggtcaggagttcgaggtcagcctggccaacgtggtgaaaccccatcttcactaaaaatacaaaacttagctggttaggtggtgcatgcctgtagtcccagctactcgggaggccgaggcagaagaatctcttgaactgaggaggtggaggttgcagtgagccgagatcacgccattgcactccagcctgggcaacagagcaagactccatctcaaaaaaataataataatcttaaagatgagaaaagccaccccatctggcaccacagctgcatcttgcttgtgagaaatggggaagagttcagggaggacacgtgacctgcacaggatcacagagcatggggcagagccaggactagagctcagggcatctgactccctcttcagtgttcttccccctccatgttgcctgcccctgaagacctttgagttcagtctacacctaagcaggtagacatccgcgaggtcagatgctttccaacatgacacctgaacatcttcctttatgcaacacccaaacatcttggcatccccaccccaggaagtgcggggaggaggttatgatccctgggcgcttcggcagaatggagagctgaggtgtccctcccctgctagtcacctaccaggtgtctgagcagctgcatgctccctggctcaagtgggcactgtaccttttgcctgcctttttgttccctatctccactccctgaggccacttagcctgagacatgatgcaagagctgcaggccggggggctcagtgccatggaagctactccaagttgcattgcctcccgcgcccagatcctgctttccatttcgagaacataaatagattgcccagcccctccagtacaatcccactggaagaaaaggcaatggcgggcttcagccagacctgctgagacctaggttgccacggtaacagccaaagacatcaacccaagtgctgggtcaagtgtctcatcatactggcactgttgctggggtgacggcagaattcagaacttcaatttcagtgacgccaagcttgatgtgtttctgttattgttttgaagaaggtagctcttgtggaggacttgggagaaggatggggtcttaggaaggaggtgacagcacttgcatggtcacttgagcccacacacacgctcaaccccaagtcctttatgctttgtcacagtgaagatgagacctctgacgtccaagccttgttcctgtgctgcatcacccactcagccttccaaagggaacaggaacaaatttccccagcaccactgtttgggtcccgcttttcctatcttctgctgcccctgagcacatccaagcagacagggaaagaggagtcagacatggcccagtcacatcctgagctgctcctggctgataaccacgatggagcccgtgtttgtcctgccatctggcactgcactgagtgtggcacaggcaccgtcctgttgatctcacaacacagttctaagttaggacgttcttggctccgttagacaggtgaggaaactggggcacagagaggtgatgtcatctgcctggtgtcaatcagctagcaagtgatggagcccagatttcaaaccaaagggggttacgtccaggggctgagttcccactcacctgtgtagagtgccatctgggcaccattgctccagacgtgttccgacccctttcccagcccacagggcttgaagtgaaggaacagaggcagggggtgggccagccccagggccagggtccccttggtgaagccgtgccagggggctcagctgcttcagggaatgtgtccctcccaccatgggccagagcttcagcccttctttagctcagctagagttcacaggagagccaaaaaagaaaaggaagctgagcatctcccgagtcctgggcagggaaggggagggaaattgctgcttctccaactcttgcttggggccaagccctgcaccagttgcttcccagctgttatctgccagatcttcccatcttgtggcatgtggtgcccccaccaacatcccaaggggaccaatccccttgccaccactttgcatcacctgggaccacagatttggacaggaagggctctgagaagaggccaaagccctcattttacagatgaggaagctgaagcccggggaggggagcgaccctcaaggccacccagctggacacgggagacttgagcccagccttctgactgcattcagccctctctaggacgcagcagcctctccccagcactgagtcccccctcctttgtgtgtcccagcacccttggcctgagtaaacttggaaaggggctccctcccagagaagggactactctcttcacccctttattccagctgcctgccaccccagacccccacctcccaccctgacccccgacccctgggtggggaaggggctcacatgggcccaggctgagtgtgagtgagcatgtcaagttgtctgacactgtgacattagtgcaccctactgacaacccctccccagccttgcccctttctcctctccctgttttgtacataaattgacatgagctgcaacatgtgtgcgtgtgtgtgcgtgtgtgtgtgtgtgtatgtgtgtgtgatctgtgtcatggttttgttacctttttgtttttgtaaacttgaatgttcaaaataaacatgctgtttactctga

SEQ ID NO: 299383 - DNA, 663 bp, Homo sapiens
gctcaaggccacccagctggacacgggagacttgagcccagccttctgactgcattcagccctctctaggacgcagcagcctctccccagcactgagtcccccctcctttgtgtgtcccagcacccttggcctgagtgctggggagaggccacccagctggacacgggagacttgagcccagccttctgactgcattcagccctctctaggacgcagcagcctctccccagcactgagtcccccctcctttgtgtgtcccagcacccttggcctgagtaaacttggaaaggggctccctcccagagaagggactactctcttcacccctttattccagctgcctgccaccccagacccccacctcccaccctgacccccgacccctgggtggggaaggggctcacatgggcccaggctgagtgtgagtgagcatgtcaagttgtctgacactgtgacattagtgcaccctactgacaacccctccccagccttgcccctttctcctctccctgttttgtacataaattgacatgagctgcaacatgtgtgcgtgtgtgtgcgtgtgtgtgtgtgtgtatgtgtgtgtgatctgtgtcatggttttgttacctttttgtttttgtaaacttgaatgttcaaaataaacatgctgtttactctga

SEQ ID NO: 299384 - DNA, 4992 bp, Homo sapiens
ccagagcccctgcactttaatcacacccctcaacacagaggtggagcagagagagccctgaaggcactgggcatgcagcaggtgcctgggagctgttagccatctttctgaagtgtgccctgtccaccccacccttttcggtgtccaccgacctccaccatgtctgccttgcccaccctcagggtcctcagcctacagtcctccagatgccttcaagatcagcatccccatccgtaacaactacatgtacgcccgcgtgcggaaggctctgcccgagctctacgcattcaccgcctgcatgtggctgcggtccaggtccagcggcaccggccagggcacccccttctcctactcagtgcccgggcaggccaacgagattgtactgctagaggcgggccatgagcccatggagctgctgatcaacgacaaggtggcccagctgcccctgagcctgaaggacaatggctggcaccacatctgcatcgcctggaccacaagggatggcctatggtctgcctaccaggacggggagctgcagggctccggtgagaacctggctgcctggcaccccatcaagcctcatgggatccttatcttgggccaggagcaggataccctgggtggccggtttgatgccacccaggcctttgtcggtgacattgcccagtttaacctgtgggaccacgccctgacaccagcccaggtcctgggcattgccaactgcactgcgccactgctgggcaacgtccttccctgggaagacaagttggtggaggcctttgggggtgcaacaaaggctgccttcgatgtctgcaaggggagggccaaggcatgaggggccacctcatccagggcccctcccttgcctgccactttggggacttgaggggggtcatattccctcctcagcctgcccacgcactggccttccctcctgccccactcctggctgtgcctcccatttcccctcacctgtacccacacctccagaatgccctgccctgcgagtgtgtcccctgtccccacctgagtggggaggagcgtctcaagtgaacagtgggagcctgcccacctggcactgcactggagttgtctcttaccccaccctccctgcccatcaactgtatctgatttcactaattttgacagcacccccagtagggtaggattgtgtatgagggggaccccactatctcagtggtgggggtggccgcccgcccccttgtcccccatgcaacaggcccagtggcttccccttcagggccacaacaggctgtagaaggggatgacgaggacatcagaggttagacttaccctcctccctctttccaccagctgccagtcaagggcagtgggatctcgatggagcctccccccccccccacccatgcctccctcttcctcctctttcctcctctctttgtgtgtagcggtttgaatgttggttccatgcctggcccagccccacctcagtctccaggacattcctttcccagctccagcctggagggaaggggacaaagaccccaggaggccaaagggctgcagtcaccccttgtgctcacccatagtgatggccactggtatagtcatcgctctccctccatgccaaggacaggacttggaccgcttcagcctgggctgggagcagccctaaggtagaggcctcatggcccaggagaccccacctctggcagagccacattacctaccctgtgcatggtcctggggcagcaaggaagaagctcagagggtggggagaagcatgaagcagtgagcagagcactgggtgagagggagaagaccttggttcctagccagccctgctaatgtgctgtgtggccttctgtaagtccctgccctctctgggcctggccttcctcattcgtgagctgaggccctcgctttggtcatttgctctccagattgggtgtgagcttctctgtgattccaggtggatatgtggggaaagctctggtgaccctgggcttcgcaggggtagatcccaggactcggcagtggatgggatgcagccagtcatgggttagggtcagcagagactcagagtccagggcaaggttcaaggcagactaacctcatgcatggattgtaaaaaaccagctccctttggatcaacccagcctggcacccttgcctgtctgagagtgtctcaaagggctgatggcttcctggtccccttgagtcatcaccagcttccccaagagagtgtcagaatcttaagagctgagaggccgggcacggtggctcacgcctgtaatcccagcactttgggaggctgagacaggcagatcacttgaggtcaggagttcgaggtcagcctggccaacgtggtgaaaccccatcttcactaaaaatacaaaacttagctggttaggtggtgcatgcctgtagtcccagctactcgggaggccgaggcagaagaatctcttgaactgaggaggtggaggttgcagtgagccgagatcacgccattgcactccagcctgggcaacagagcaagactccatctcaaaaaaataataataatcttaaagatgagaaaagccaccccatctggcaccacagctgcatcttgcttgtgagaaatggggaagagttcagggaggacacgtgacctgcacaggatcacagagcatggggcagagccaggactagagctcagggcatctgactccctcttcagtgttcttccccctccatgttgcctgcccctgaagacctttgagttcagtctacacctaagcaggtagacatccgcgaggtcagatgctttccaacatgacacctgaacatcttcctttatgcaacacccaaacatcttggcatccccaccccaggaagtgcggggaggaggttatgatccctgggcgcttcggcagaatggagagctgaggtgtccctcccctgctagtcacctaccaggtgtctgagcagctgcatgctccctggctcaagtgggcactgtaccttttgcctgcctttttgttccctatctccactccctgaggccacttagcctgagacatgatgcaagagctgcaggccggggggctcagtgccatggaagctactccaagttgcattgcctcccgcgcccagatcctgctttccatttcgagaacataaatagattgcccagcccctccagtacaatcccactggaagaaaaggcaatggcgggcttcagccagacctgctgagacctaggttgccacggtaacagccaaagacatcaacccaagtgctgggtcaagtgtctcatcatactggcactgttgctggggtgacggcagaattcagaacttcaatttcagtgacgccaagcttgatgtgtttctgttattgttttgaagaaggtagctcttgtggaggacttgggagaaggatggggtcttaggaaggaggtgacagcacttgcatggtcacttgagcccacacacacgctcaaccccaagtcctttatgctttgtcacagtgaagatgagacctctgacgtccaagccttgttcctgtgctgcatcacccactcagccttccaaagggaacaggaacaaatttccccagcaccactgtttgggtcccgcttttcctatcttctgctgcccctgagcacatccaagcagacagggaaagaggagtcagacatggcccagtcacatcctgagctgctcctggctgataaccacgatggagcccgtgtttgtcctgccatctggcactgcactgagtgtggcacaggcaccgtcctgttgatctcacaacacagttctaagttaggacgttcttggctccgttagacaggtgaggaaactggggcacagagaggtgatgtcatctgcctggtgtcaatcagctagcaagtgatggagcccagatttcaaaccaaagggggttacgtccaggggctgagttcccactcacctgtgtagagtgccatctgggcaccattgctccagacgtgttccgacccctttcccagcccacagggcttgaagtgaaggaacagaggcagggggtgggccagccccagggccagggtccccttggtgaagccgtgccagggggctcagctgcttcagggaatgtgtccctcccaccatgggccagagcttcagcccttctttagctcagctagagttcacaggagagccaaaaaagaaaaggaagctgagcatctcccgagtcctgggcagggaaggggagggaaattgctgcttctccaactcttgcttggggccaagccctgcaccagttgcttcccagctgttatctgccagatcttcccatcttgtggcatgtggtgcccccaccaacatcccaaggggaccaatccccttgccaccactttgcatcacctgggaccacagatttggacaggaagggctctgagaagaggccaaagccctcattttacagatgaggaagctgaagcccggggaggggagcgaccctcaaggccacccagctggacacgggagacttgagcccagccttctgactgcattcagccctctctaggacgcagcagcctctccccagcactgagtcccccctcctttgtgtgtcccagcacccttggcctgagtaaacttggaaaggggctccctcccagagaagggactactctcttcacccctttattccagctgcctgccaccccagacccccacctcccaccctgacccccgacccctgggtggggaaggggctcacatgggcccaggctgagtgtgagtgagcatgtcaagttgtctgacactgtgacattagtgcaccctactgacaacccctccccagccttgcccctttctcctctccctgttttgtacataaattgacatgagctgcaacatgtgtgcgtgtgtgtgcgtgtgtgtgtgtgtgtatgtgtgtgtgatctgtgtcatggttttgttacctttttgtttttgtaaacttgaatgttcaaaataaacatgctgtttactctga

SEQ ID NO: 299385 - DNA, 1975 bp, Homo sapiens
ctgaagttcctggccgtgctgctggccgcgggcatgctggcgttcctcggtgccgtcatctgcatcatcgccagcgtgcccctggcggccagcccggcgcgggcgctgcccggcggcgccgacaatgcttcggtcgcctcgggcgccgccgcgtccccgggcccgcagcggagcctgagcgcgctgcacggcgcgggcggttcagccgggccccccgcgctgcccggggcacccgcggccagcgcgcacccgctgccgcccgggcccctgttcagccgcttcctgtgcacgccgctggctgctgcctgcccgtcgggggcccagcagggggacgcggcgggcgctgcgccgggcgagcgcgaagagctgctgctgctgcagagcacggccgagcagctgcgccagacggcgctgcagcaggaggcgcgcatccgcgccgaccaggacaccatccgtgagctcaccggcaagctgggccgctgcgagagcggcctgccgcgcggcctccagggcgccgggccccgccgcgacaccatggccgacgggccctgggactcgcctgcgctcattctggagctggaggacgccgtgcgcgccctgcgggaccgcatcgaccgcctggagcaggagcttccagcccgtgtgaacctctcagctgccccagccccagtctctgctgtgcccaccggcctacactccaagatggaccagctggaggggcagctgctggcccaggtgctggcactggagaaggagcgtgtggccctcagccacagcagccgccggcagaggcaggaagtggaaaaggagttggacgtcctgcagggtcgtgtggctgagctggagcacgggtcctcagcctacagtcctccagatgccttcaagatcagcatccccatccgtaacaactacatgtacgcccgcgtgcggaaggctctgcccgagctctacgcattcaccgcctgcatgtggctgcggtccaggtccagcggcaccggccagggcacccccttctcctactcagtgcccgggcaggccaacgagattgtactgctagaggcgggccatgagcccatggagctgctgatcaacgacaaggtggcccagctgcccctgagcctgaaggacaatggctggcaccacatctgcatcgcctggaccacaagggatggcctatggtctgcctaccaggacggggagctgcagggctccggtgagaacctggctgcctggcaccccatcaagcctcatgggatccttatcttgggccaggagcaggataccctgggtggccggtttgatgccacccaggcctttgtcggtgacattgcccagtttaacctgtgggaccacgccctgacaccagcccaggtcctgggcattgccaactgcactgcgccactgctgggcaacgtccttccctgggaagacaagttggtggaggcctttgggggtgcaacaaaggctgccttcgatgtctgcaaggggagggccaaggcatgaggggccacctcatccagggcccctcccttgcctgccactttggggacttgaggggggtcatattccctcctcagcctgcccacgcactggccttccctcctgccccactcctggctgtgcctcccatttcccctcacctgtacccacacctccagaatgccctgccctgcgagtgtgtcccctgtccccacctgagtggggaggagcgtctcaagtgaacagtgggagcctgcccacctggcactgcactggagttgtctcttaccccaccctccctgcccatcaactgtatctgatttcactaattttgacagcacccccagtagggtaggattgtgtatgagggggacacctttatatgggcggtggcaccctgaaccctaactattgttctgtatgaatggcatcttattgtcctgaaattgaactgcgccctgctctcgaggagacccgttcggattcctacatactt

SEQ ID NO: 299386 - DNA, 743 bp, Homo sapiens
cagagcccctgcactttaatcacacccctcaacacagaggtggagcagagagagccctgaaggcactgggcatgcagcaggtgcctgggagctgttagccatctttctgaagtgtgccctgtccaccccacccttttcggtgtccaccgacctccaccatgtctgccttgcccaccctcagggtcctcagcctacagtcctccagatgccttcaagatcagcatccccatccgtaacaactacatgtacgcccgcgtgcggaaggctctgcccgagctctacgcattcaccgcctgcatgtggctgcggtccaggtccagcggcaccggccagggcacccccttctcctactcagtgcccgggcaggccaacgagattgtactgctagaggcgggccatgagcccatggagctgctgatcaacgacaaggtaggcagggctggcagggagggctggctgggggagggccacccttccagaagcacccactccacactgggctctttcattctcctgctcattctcctgctctgcatattcagcacacattaagtacctaccgtgtgctaggctgggctctgggaatataaagacaagccagacatggagctgccggaagagaggctgtgtccaatagaggctctaagtgttgttccattttacagaggaggcaagtgaagctcttggggatccagtgacttccccagtgacccagctatgggacagggctgaggtgtctgccc

SEQ ID NO: 299387 - DNA, 3606 bp, Homo sapiens
cgcgccctccttgatggacgagagctggtttgttacccctcccgcctgttttacggcagaggggcctggactcggtcccgcccgcctccagagcagtcccctggaggacctcctcatcgagcaccccagcatgtccgtttacgtcaccggcagcaccatagtgctagagcccgggtccccttccccgctcccggacgcggccctgcctgacggcgacctcagcgaaggggaattgacgcccgcccgccgcgagccgcgggccgcgcgccacgccgctcctctcccagcgcgggcggcgctgctggagaaggcgggccaggtgcggcggctgcagcgggcccggcagcgggcagagcgccacgcgctgagcgccaaggcggtgcagcggcagaaccgagcccgcgagagccgtccgcgccggtccaagaaccagagcagcttcatctaccagccgtgccagcgccagttcaactactgagcgtccaccggccgcgccacgaaccccttgccgatcccgatccctgtcgggctcctccgactcctcgggctggacaccgaaacctcccttcttaaagcgtgtgaggttgggtgatagccgttccttccccgacaccctcaatttccccatctctgatcctctaatctgcctctgaacccattcacccttcaccctcactcctggtccccatacccagcatctaatcatccatgccccctactcctggcccctccatcctttcttctctggtccccatccctgtctctccctttcacccttgccctccagtcctctacctctggcctgcccctatttctgaaagcttcttccagtccctgatctggctcattccccaccttcaactcccaccttacatgtctcacactatcccatggttggcattacactcactcctgttcccttattcttcattcccagtaattccctaccaaatggtggggaccctgagcccagctctgaccaggtagagcctgtgcagcctgggctgctgtcattgccctccagtaagggctcagggttttgcttttagtctccccttccttctgccttgggggcggtactctgtggagctgcttaggcctggaaaggtacagtatgtagaagaggactgtgagacgtgagttagagggagaagatggagggaatctagggaacgaggcagcctattggagatgcggacaggacagacacgttgagaagctgcagggagcagggcaccaagggagtgtgcactgtgcttgctcagagaggccaaaccctgctcccaggctgaagcctggagtctgcccccacttcccttttctataatccacccttctgcaggccctgaaatctgaagggcttagttagtaccttgccactctacccccaacacgtcacccgagtagaagctgggcaaggccctaccatcctggccgtctgttcacaagcccaaggtgctagaactagcttaggagacatgcaggccacagggcttctaggcagggaaagggcacacaccctaggtcagcgtgcagagcagtgatgctggaggacacaccatggggtgaagccatcccaaggctgacagctcagtcttcaccttgcctctggccttgtatttcacaccctgctcagtatggctagccagcagtcctgagtaggagtccaggactcccactgtctcaatctgcaaattgttcctatccaggttcagggccttcagggggcctcttttcattttctcccacaggcctctctttctttctaggttgctggggagaaatgggtaccctatgatccccctccccttctcctccagtaaatacctggaagagggaacctgaatccctgggggagacagaaggggcaggggccaccagcctccccttcttgtggtgagactgaattttgggctcagacaccagcaacagcctcttgggatgccctgagttgcttcccatttcctctttctagccgtccttttctagtgtgtgctcactcttcctaggaacttttaagacttcttggtacctatgaacataggtcctcccctcaccccaactctaggtttccaggcctcacagccaagctgaagcttggagaaaactctgcattcccatgagggcaaaggcagctgccctccctgaccctatagccccaggcctcatggggggtatgtggggaagggatggggtatccccatggatgctgggatgaggacagaggaagacctgatggggtctcctattccagggaataagccaaattaacactaaaaacggatcaaagctcccacgccagtccactagggccccagtagttgacagccttgctcctctcccaagttctccttcagaacctagttgcttttattcttccagctaccacttgggcacttcacagccagcctagggtcttcggcacctccaagagctgaatctccctccaacccttcttgcctactcctcactgccagctgggacctaggctcagtcctgtgtggtgcccatgatccttctggtgggggaagagtttaagttatagggcatttggctcaaattttaaaaggccttttgtttacctatatttctggaggctcctgtattctagaacccaatctctcacctgcttggttgcaaggctcatatttttttgtacctttcctatagattctgtagcatttgagtgtggcaatattttaattgtgtatagatttctaagaaccaacactactcagtctcctgctagtctgactcctgaagcatcagcccttgtcatactgtattgactgtgtacgtgcctttcaccttgagcatgcttcaggatttttttttaaaccacagaacttgaatacatgagggaaccagagttcaaagtcctatgcaaccttaggagggggttagagagtctgttttgattgatgttttctgaggccctagaggagtttgtatcaatttgtgagtattaatgtcagtactaccagcactttgccaaaactgtcagagggacccgtttctagagtgagtcccagttacatcaaacagtgacttccagttattccccagtaagtctgagtggttccttcaagctgggtgtctttccagcctttgccagtctagccccagcagggcaccgtgtatgaatgcagtttggtgctgttttagagtatgcctgctccccagccccctgcctggaaccctctgagcaacttgctctgacctataatgtcttaggtgcaacacggaccccaccagagctcttggatacccccctagatccatgtggctttatgtgaggggactgaatgcagacacaccatagcccccttctactactttccctctcgccctgccacctagttccacatggaaccaacaagttgagtgcatccctgttgggtgttttgtgttgagactggctgaaatgaggagactttgaccatgtgacgtgtcaacagactcaaggagacaaccacctcaactgggtcatgtggcatgcctgtgtatgtgtgtaacagaattctgattgttagactgtaatgctattcctctatgggagaaaaaaattaatataaagaaaaacaaataaaaatatatttaaagcac

SEQ ID NO: 299388 - DNA, 3230 bp, Homo sapiens
cgcgccctccttgatggacgagagctggtttgttacccctcccgcctgttttacggcagaggggcctggactcggtcccgcccgcctccagagcagtcccctggaggacctcctcatcgagcaccccagcatgtccgtttacgtcaccggcagcaccatagtgctagagcccgggtccccttccccgctcccggacgcggccctgcctgacggcgacctcagcgaaggggaattgacgcccgcccgccgcgagccgcgggccgcgcgccacgccgctcctctcccagcgcgggcggcgctgctggagaaggcgggccaggtgcggcggctgcagcgggcccggcagcgggcagagcgccacgcgctgagcgccaaggcggtgcagcggcagaaccgagcccgcgagagccgtccgcgccggtccaagaaccagagcagcttcatctaccagccgtgccagcgccagttcaactactgagcgtccaccggccgcgccacgaaccccttgccgatcccgatccctgtcgggctcctccgactcctcgggctggacaccgaaacctcccttcttaaagcgtgtgaggttgggtgatagccgttccttccccgacaccctcaatttccccatctctgatcctctaatctgcctctgaacccattcacccttcaccctcactcctggtccccatacccagcatctaatcatccatgccccctactcctggcccctccatcctttcttctctggtccccatccctgtctctccctttcacccttgccctccagtcctctacctctggcctgcccctatttctgaaagcttcttccagtccctgatctggctcattccccaccttcaactcccaccttacatgtctcacactatcccatggttggcattacactcactcctgttcccttattcttcattcccagtaattccctaccaaatggtggggaccctgagcccagctctgaccaggtagagcctgtgcagcctgggctgctgtcattgccctccagtaagggctcagggttttgcttttagtctccccttccttctgccttgggggcggtactctgtggagctgcttaggcctggaaaggtacagtatgtagaagaggactgtgagacgtgagttagagggagaagatggagggaatctagggaacgaggcagcctattggagatgcggacaggacagacacgttgagaagctgcagggagcagggcaccaagggagtgtgcactgtgcttgctcagagaggccaaaccctgctcccaggctgaagcctggagtctgcccccacttcccttttctataatccaccgttcagggccttcagggggcctcttttcattttctcccacaggcctctctttctttctaggttgctggggagaaatgggtaccctatgatccccctccccttctcctccagtaaatacctggaagagggaacctgaatccctgggggagacagaaggggcaggggccaccagcctccccttcttgtggtgagactgaattttgggctcagacaccagcaacagcctcttgggatgccctgagttgcttcccatttcctctttctagccgtccttttctagtgtgtgctcactcttcctaggaacttttaagacttcttggtacctatgaacataggtcctcccctcaccccaactctaggtttccaggcctcacagccaagctgaagcttggagaaaactctgcattcccatgagggcaaaggcagctgccctccctgaccctatagccccaggcctcatggggggtatgtggggaagggatggggtatccccatggatgctgggatgaggacagaggaagacctgatggggtctcctattccagggaataagccaaattaacactaaaaacggatcaaagctcccacgccagtccactagggccccagtagttgacagccttgctcctctcccaagttctccttcagaacctagttgcttttattcttccagctaccacttgggcacttcacagccagcctagggtcttcggcacctccaagagctgaatctccctccaacccttcttgcctactcctcactgccagctgggacctaggctcagtcctgtgtggtgcccatgatccttctggtgggggaagagtttaagttatagggcatttggctcaaattttaaaaggccttttgtttacctatatttctggaggctcctgtattctagaacccaatctctcacctgcttggttgcaaggctcatatttttttgtacctttcctatagattctgtagcatttgagtgtggcaatattttaattgtgtatagatttctaagaaccaacactactcagtctcctgctagtctgactcctgaagcatcagcccttgtcatactgtattgactgtgtacgtgcctttcaccttgagcatgcttcaggatttttttttaaaccacagaacttgaatacatgagggaaccagagttcaaagtcctatgcaaccttaggagggggttagagagtctgttttgattgatgttttctgaggccctagaggagtttgtatcaatttgtgagtattaatgtcagtactaccagcactttgccaaaactgtcagagggacccgtttctagagtgagtcccagttacatcaaacagtgacttccagttattccccagtaagtctgagtggttccttcaagctgggtgtctttccagcctttgccagtctagccccagcagggcaccgtgtatgaatgcagtttggtgctgttttagagtatgcctgctccccagccccctgcctggaaccctctgagcaacttgctctgacctataatgtcttaggtgcaacacggaccccaccagagctcttggatacccccctagatccatgtggctttatgtgaggggactgaatgcagacacaccatagcccccttctactactttccctctcgccctgccacctagttccacatggaaccaacaagttgagtgcatccctgttgggtgttttgtgttgagactggctgaaatgaggagactttgaccatgtgacgtgtcaacagactcaaggagacaaccacctcaactgggtcatgtggcatgcctgtgtatgtgtgtaacagaattctgattgttagactgtaatgctattcctctatgggagaaaaaaattaatataaagaaaaacaaataaaaatatatttaaagcac

SEQ ID NO: 299389 - DNA, 3549 bp, Homo sapiens
cgcgccctccttgatggacgagagctggtttgttacccctcccgcctgttttacggcagaggggcctggactcggtcccgcccgcctccagagcagtcccctggaggacctcctcatcgagcaccccagcatgtccgtttacgtcaccggcagcaccatagtgctagagcccgggtccccttccccgctcccggacgcggccctgcctgacggcgacctcagcgaaggggaattgacgcccgcccgccgcgagccgcgggccgcgcgccacgccgctcctctcccagcgcgggcggcgctgctggagaaggcgggccaggtgcggcggctgcagcgggcccggcagcgggcagagcgccacgcgctgagcgccaaggcggtgcagcggcagaaccgagcccgcgagagccgtccgcgccggtccaagaaccagagcagcttcatctaccagccgtgccagcgccagttcaactactgagcgtccaccggccgcgccacgaaccccttgccgatcccgatccctgtcgggctcctccgactcctcgggctggacaccgaaacctcccttcttaaagcgtgtgaggttgggtgatagccgttccttccccgacaccctcaatttccccatctctgatcctctaatctgcctctgaacccattcacccttcaccctcactcctggtccccatacccagcatctaatcatccatgccccctactcctggcccctccatcctttcttctctggtccccatccctgtctctccctttcacccttgccctccagtcctctacctctggcctgcccctatttctgaaagcttcttccagtccctgatctggctcattccccaccttcaactcccaccttacatgtctcacactatcccatggttggcattacactcactcctgttcccttattcttcattcccagtaattccctaccaaatggtggggaccctgagcccagctctgaccaggtagagcctgtgcagcctgggctgctgtcattgccctccagtaagggctcagggttttgcttttagtctccccttccttctgccttgggggcggtactctgtggagctgcttaggcctggaaaggtacagtatgtagaagaggactgtgagacgtgagttagagggagaagatggagggaatctagggaacgaggcagcctattggagatgcggacaggacagacacgttgagaagctgcagggagcagggcaccaagggagtgtgcactgtgcttgctcagagaggccaaaccctgctcccaggctgaagcctggagtctgcccccacttcccttttctataatccacccttctgcaggccctgaaatctgaagggcttagttagtaccttgccactctacccccaacacgtcacccgagtagaagctgggcaaggccctaccatcctggccgtctgttcacaagcccaaggtgctagaactagcttaggagacatgcaggccacagggcttctaggcagggaaagggcacacaccctaggtcagcgtgcagagcagtgatgctggaggacacaccatggggtgaagccatcccaaggctgacagctcagtcttcaccttgcctctggccttgtatttcacaccctgctcagtatggctagccagcagtcctgagtaggagtccaggactcccactgtctcaatctgcaaattgttcctatccaggttcagggccttcagggggcctcttttcattttctcccacaggcctctctttctttctaggttgctggggagaaatgggtaccctatgatccccctccccttctcctccagtaaatacctggaagagggaacctgaatccctgggggagacagaaggggcaggggccaccagcctccccttcttgtggtgagactgaattttgggctcagacaccagcaacagcctcttgggatgccctgagttgcttcccatttcctctttctagccgtccttttctagtgtgtgctcactcttcctaggaacttttaagacttcttggtacctatgaacataggtcctcccctcaccccaactctaggtttccaggcctcacagccaagctgaagcttggagaaaactctgcattcccatgagggcaaaggcagctgccctccctgaccctatagccccaggcctcatggggggtatgtggggaagggatggggtatccccatggatgctgggatgaggacagaggaagacctgatggggtctcctattccagggaataagccaaattaacactaaaaacggatcaaagctcccacgccagtccactagggccccagtagttgacagccttgctcctctcccaagttctccttcagaacctagttgcttttattcttccagctaccacttgggcacttcacagccagcctagggtcttcggcacctccaagagctgaatctccctccaacccttcttgcctactcctcactgccagctgggacctaggctcagtcctgtgtggtgcccatgatccttctggtgggggaagagtttaagttatagggcatttggctcccaatctctcacctgcttggttgcaaggctcatatttttttgtacctttcctatagattctgtagcatttgagtgtggcaatattttaattgtgtatagatttctaagaaccaacactactcagtctcctgctagtctgactcctgaagcatcagcccttgtcatactgtattgactgtgtacgtgcctttcaccttgagcatgcttcaggatttttttttaaaccacagaacttgaatacatgagggaaccagagttcaaagtcctatgcaaccttaggagggggttagagagtctgttttgattgatgttttctgaggccctagaggagtttgtatcaatttgtgagtattaatgtcagtactaccagcactttgccaaaactgtcagagggacccgtttctagagtgagtcccagttacatcaaacagtgacttccagttattccccagtaagtctgagtggttccttcaagctgggtgtctttccagcctttgccagtctagccccagcagggcaccgtgtatgaatgcagtttggtgctgttttagagtatgcctgctccccagccccctgcctggaaccctctgagcaacttgctctgacctataatgtcttaggtgcaacacggaccccaccagagctcttggatacccccctagatccatgtggctttatgtgaggggactgaatgcagacacaccatagcccccttctactactttccctctcgccctgccacctagttccacatggaaccaacaagttgagtgcatccctgttgggtgttttgtgttgagactggctgaaatgaggagactttgaccatgtgacgtgtcaacagactcaaggagacaaccacctcaactgggtcatgtggcatgcctgtgtatgtgtgtaacagaattctgattgttagactgtaatgctattcctctatgggagaaaaaaattaatataaagaaaaacaaataaaaatatatttaaagcac

SEQ ID NO: 299390 - DNA, 3865 bp, Homo sapiens
cgcgccctccttgatggacgagagctggtttgttacccctcccgcctgttttacggcagaggggcctggactcggtcccgcccgcctccagagcagtcccctggaggacctcctcatcgagcaccccagcatgtccgtttacgtcaccggcagcaccatagtgctagagcccgggtccccttccccgctcccggacgcggccctgcctgacggcgacctcagcgaaggggaattgacgcccgcccgccgcgagccgcgggccgcgcgccacgccgctcctctcccagcgcgggcggcgctgctggagaaggcgggccaggtgcggcggctgcagcgggcccggcagcgggcagagcgccacgcgctgagcgccaaggcggtgcagcggcagaaccgagcccgcgagagccgtccgcgccggtccaagaaccagagcagcttcatctaccagccgtgccagcgccagttcaactactgagcgtccaccggccgcgccacgaaccccttgccgatcccgatccctgtcgggctcctccgactcctcgggctggacaccgaaacctcccttcttaaagcgtgtgaggttgggtgatagccgttccttccccgacaccctcaatttccccatctctgatcctctaatctgcctctgaacccattcacccttcaccctcactcctggtccccatacccagcatctaatcatccatgccccctactcctggcccctccatcctttcttctctggtccccatccctgtctctccctttcacccttgccctccagtcctctacctctggcctgcccctatttctgaaagcttcttccagtccctgatctggctcattccccaccttcaactcccaccttacatgtctcacactatcccatggttggcattacactcactcctgttcccttattcttcattcccagtaattccctaccaaatggtggggaccctgagcccagctctgaccaggtagagcctgtgcagcctgggctgctgtcattgccctccagtaagggctcagggttttgcttttagtctccccttccttctgccttgggggcggtactctgtggagctgcttaggcctggaaaggtacagtatgtagaagaggactgtgagacgtgagttagagggagaagatggagggaatctagggaacgaggcagcctattggagatgcggacaggacagacacgttgagaagctgcagggagcagggcaccaagggagtgtgcactgtgcttgctcagagaggccaaaccctgctcccaggctgaagcctggagtctgcccccacttcccttttctataatccacccttctgcaggccctgaaatctgaagggcttagttagtaccttgccactctacccccaacacgtcacccgagtagaagctgggcaaggccctaccatcctggccgtctgttcacaagcccaaggtgctagaactagcttaggagacatgcaggccacagggcttctaggcagggaaagggcacacaccctaggtcagcgtgcagagcagtgatgctggaggacacaccatggggtgaagccatcccaaggctgacagctcagtcttcaccttgcctctggccttgtatttcacaccctgctcagtatggctagccagcagtcctgagtaggagtccaggactcccactgtctcaatctgcaaattgttcctatccaggttcagggccttcagggggcctcttttcattttctcccacaggcctctctttctttctaggttgctggggagaaatgggtaccctatgatccccctccccttctcctccagtaaatacctggaagagggaacctgaatccctgggggagacagaaggggcaggggccaccagcctccccttcttgtggtgagactgaattttgggctcagacaccagcaacagcctcttgggatgccctgagttgcttcccatttcctctttctagccgtccttttctagtgtgtgctcactcttcctaggaacttttaagacttcttggtacctatgaacataggtcctcccctcaccccaactctaggtttccaggcctcacagccaagctgaagcttggagaaaactctgcattcccatgagggcaaaggcagctgccctccctgaccctatagccccaggcctcatggggggtatgtggggaagggatggggtatccccatggatgctgggatgaggacagaggaagacctgatggggtctcctattccagggaataagccaaattaacactaaaaacggatcaaagctcccacgccagtccactagggccccagtagttgacagccttgctcctctcccaagttctccttcagaacctagttgcttttattcttccagctaccacttgggcacttcacagccagcctagggtcttcggcacctccaagagctgaatctccctccaacccttcttgcctactcctcactgccagctgggacctaggctcagtcctgtgtggtgcccatgatccttctggtgggggaagagtttaagttatagggcatttggctcaaattttaaaaggccttttgtttacctatatttctggaggctcctgtattctagaacccaatctctcacctgcttggttgcaaggctcatatttttttgtacctttcctatagattctgtagcatttgagtgtggcaatattttaattgtgtatagatttctaagaaccaacactactcagtctcctgctagtctgactcctgaagcatcagcccttgtcatactgtattgactgtgtacgtgcctttcaccttgagcatgcttcaggatttttttttaaaccacagaacttgaatacatgagggaaccagagttcaaagtcctatgcaaccttaggagggggttagagagtctgttttgattgatgttttctgaggccctagaggagtttgtatcaatttgtgagtattaatgtcagtactaccagcactttgccaaaactgtcagagggacccgtttctagagtgagtcccagttacatcaaacagtgacttccagttattccccagtaagtctgagtggttccttcaagctgggtgtctttccagcctttgccagtctagccccagcagggcaccgtgtatgaatgcagtttggtgctgttttagagtatgcctgctccccagccccctgcctggaaccctctgagcaacttgctctgacctataatgtcttaggtgcaacacggaccccaccagagctcttggatacccccctagatccatgtggctttatgtgaggggactgaatgcagacacaccatagcccccttctactactttccctctcgccctgccacctagttccacatggaaccaacaagttgagtgcatccctgttgggtgttttgtgttgagactggctgaaatgaggagactttgaccatgtgacgtgtcaacagactcaaggagacaaccacctcaactgggtcatgtggcatgcctgtgtatgtgtgtaacagaattctgattgttagactgtaatgctattcctctatgggagaaaaaaattaatataaagaaaaacaaataaaaatatatttaaagcactaaacaacacacaccaacaacagcacaaaagcagaagcgcgtcaggccgcccagcggacccccaagagagtctcgccacacacccaacgggcgcagagggccccactgcggcacccggcacaacagggcccacacgtggtcccccggcgacaccccggggcccgaggcacacgccgccgggacctctcgcagagcacaacagaccgggcggagccaaaccagcgacggccccgaaccaacccccactggccccccggga

SEQ ID NO: 299391 - DNA, 3444 bp, Homo sapiens
cgcgccctccttgatggacgagagctggtttgttacccctcccgcctgttttacggcagaggggcctggactcggtcccgcccgcctccagagcagtcccctggaggacctcctcatcgagcaccccagcatgtccgtttacgtcaccggcagcaccatagtgctagagcccgggtccccttccccgctcccggacgcggccctgcctgacggcgacctcagcgaaggggaattgacgcccgcccgccgcgagccgcgggccgcgcgccacgccgctcctctcccagcgcgggcggcgctgctggagaaggcgggccaggtgcggcggctgcagcgggcccggcagcgggcagagcgccacgcgctgagcgccaaggcggtgcagcggcagaaccgagcccgcgagagccgtccgcgccggtccaagaaccagagcagcttcatctaccagccgtgccagcgccagttcaactactgagcgtccaccggccgcgccacgaaccccttgccgatcccgatccctgtcgggctcctccgactcctcgggctggacaccgaaacctcccttcttaaagcgtgtgaggttgggtgatagccgttccttccccgacaccctcaatttccccatctctgatcctctaatctgcctctgaacccattcacccttcaccctcactcctggtccccatacccagcatctaatcatccatgccccctactcctggcccctccatcctttcttctctggtccccatccctgtctctccctttcacccttgccctccagtcctctacctctggcctgcccctatttctgaaagcttcttccagtccctgatctggctcattccccaccttcaactcccaccttacatgtctcacactatcccatggttggcattacactcactcctgttcccttattcttcattcccagtaattccctaccaaatggtggggaccctgagcccagctctgaccaggtagagcctgtgcagcctgggctgctgtcattgccctccagtaagggctcagggttttgcttttagtctccccttccttctgccttgggggcggtactctgtggagctgcttaggcctggaaaggtacagtatgtagaagaggactgtgagacgtgagttagagggagaagatggagggaatctagggaacgaggcagcctattggagatgcggacaggacagacacgttgagaagctgcagggagcagggcaccaagggagtgtgcactgtgcttgctcagagaggccaaaccctgctcccaggctgaagcctggagtctgcccccacttcccttttctataatccacccttctgcaggccctgaaatctgaagggcttagttagtaccttgccactctacccccaacacgtcacccgagtagaagctgggcaaggccctaccatcctggccgtctgttcacaagcccaaggtgctagaactagcttaggagacatgcaggccacagggcttctaggcagggaaagggcacacaccctaggtcagcgtgcagagcagtgatgctggaggacacaccatggggtgaagccatcccaaggctgacagctcagtcttcaccttgcctctggccttgtatttcacaccctgctcagtatggctagccagcagtcctgagtaggagtccaggactcccactgtctcaatctgcaaattgttcctatccaggttcagggccttcagggggcctcttttcattttctcccacaggcctctctttctttctaggttgctggggagaaatgggtaccctatgatccccctccccttctcctccagtaaatacctggaagagggaacctgaatccctgggggagacagaaggggcaggggccaccagcctccccttcttgtggtgagactgaattttgggctcagacaccagcaacagcctcttgggatgccctgagttgcttcccatttcctctttctagccgtccttttctagtgtgtgctcactcttcctaggaacttttaagacttcttggtacctatgaacataggtcctcccctcaccccaactctaggtttccaggcctcacagccaagctgaagcttggagaaaactctgcattcccatgagggcaaaggcagctgccctccctgaccctatagccccaggcctcatggggggtatgtggggaagggatggggtatccccatggatgctgggatgaggacagaggaagacctgatggggtctcctattccagggaataagccaaattaacactaaaaacggatcaaagctcccacgccagtccactagggccccagtagttgacagccttgctcctctcccaagttctccttcagaacctagttgcttttattcttccagctaccacttgggcacttcacagccagcctagggtcttcggcacctccaagagctgaatctccctccaacccttcttgcctactcctcactgccagctgggacctaggctcagtcctgtgtggtgcccatgatccttctggtgggggaagagtttaagttatagggcatttggctcaaattttaaaaggccttttgtttacctatatttctggaggctcctgtattctagaacccaatctctcacctgcttggttgcaaggctcatatttttttgtacctttcctatagattctgtagcatttgagtgtggcaatattttaattgtgtatagatttctaagaaccaacactactcagtctcctgctagtctgactcctgaagcatcagcccttgtcatactgtattgactgtgtacgtgcctttcaccttgagcatgcttcaggatttttttttaaaccacagaacttgaatacatgagggaaccagagttcaaagtcctatgcaaccttaggagggggttagagagtctgttttgattgatgttttctgaggccctagaggagtttgtatcaatttgtgagtattaatgtcagtactaccagcactttgccaaaactgtcagagggacccgtttctagagtgagtcccagttacatcaaacagtgacttccagttattccccagtaagtctgagtggttccttcaagctgggtgtctttccagcctttgccagtctagccccagcagggcaccgtgtatgaatgcagtttggtgctgttttagagtatgcctgctccccagccccctgccacctagttccacatggaaccaacaagttgagtgcatccctgttgggtgttttgtgttgagactggctgaaatgaggagactttgaccatgtgacgtgtcaacagactcaaggagacaaccacctcaactgggtcatgtggcatgcctgtgtatgtgtgtaacagaattctgattgttagactgtaatgctattcctctatgggagaaaaaaattaatataaagaaaaacaaataaaaatatatttaaagcac

SEQ ID NO: 299392 - DNA, 3405 bp, Homo sapiens
cgcgccctccttgatggacgagagctggtttgttacccctcccgcctgttttacggcagaggggcctggactcggtcccgcccgcctccagagcagtcccctggaggacctcctcatcgagcaccccagcatgtccgtttacgtcaccggcagcaccatagtgctagagcccgggtccccttccccgctcccggacgcggccctgcctgacggcgacctcagcgaaggggaattgacgcccgcccgccgcgagccgcgggccgcgcgccacgccgctcctctcccagcgcgggcggcgctgctggagaaggcgggccaggtgcggcggctgcagcgggcccggcagcgggcagagcgccacgcgctgagcgccaaggcggtgcagcggcagaaccgagcccgcgagagccgtccgcgccggtccaagaaccagagcagcttcatctaccagccgtgccagcgccagttcaactactgagcgtccaccggccgcgccacgaaccccttgccgatcccgatccctgtcgggctcctccgactcctcgggctggacaccgaaacctcccttcttaaagcgtgtgaggttgggtgatagccgttccttccccgacaccctcaatttccccatctctgatcctctaatctgcctctgaacccattcacccttcaccctcactcctggtccccatacccagcatctaatcatccatgccccctactcctggcccctccatcctttcttctctggtccccatccctgtctctccctttcacccttgccctccagtcctctacctctggcctgcccctatttctgaaagcttcttccagtccctgatctggctcattccccaccttcaactcccaccttacatgtctcacactatcccatggttggcattacactcactcctgttcccttattcttcattcccagtaattccctaccaaatggtggggaccctgagcccagctctgaccaggtagagcctgtgcagcctgggctgctgtcattgccctccagtaagggctcagggttttgcttttagtctccccttccttctgccttgggggcggtactctgtggagctgcttaggcctggaaaggtacagtatgtagaagaggactgtgagacgtgagttagagggagaagatggagggaatctagggaacgaggcagcctattggagatgcggacaggacagacacgttgagaagctgcagggagcagggcaccaagggagtgtgcactgtgcttgctcagagaggccaaaccctgctcccaggctgaagcctggagtctgcccccacttcccttttctataatccacccttctgcaggccctgaaatctgaagggcttagttagtaccttgccactctacccccaacacgtcacccgagtagaagctgggcaaggccctaccatcctggccgtctgttcacaagcccaaggtgctagaactagcttaggagacatgcaggccacagggcttctaggcagggaaagggcacacaccctaggtcagcgtgcagagcagtgatgctggaggacacaccatggggtgaagccatcccaaggctgacagctcagtcttcaccttgcctctggccttgtatttcacaccctgctcagtatggctagccagcagtcctgagtaggagtccaggactcccactgtctcaatctgcaaattgttcctatccaggttcagggccttcagggggcctcttttcattttctcccacaggcctctctttctttctaggttgctggggagaaatgggtaccctatgatccccctccccttctcctccagtaaatacctggaagagggaacctgaatccctgggggagacagaaggggcaggggccaccagcctccccttcttgtggtgagactgaattttgggctcagacaccagcaacagcctcttgggatgccctgagttgcttcccatttcctctttctagccgtccttttctagtgtgtgctcactcttcctaggaacttttaagacttcttggtacctatgaacataggtcctcccctcaccccaactctaggtttccaggcctcacagccaagctgaagcttggagaaaactctgcattcccatgagggcaaaggcagctgccctccctgaccctatagccccaggcctcatggggggtatgtggggaagggatggggtatccccatggatgctgggatgaggacagaggaagacctgatggggtctcctattccagggaataagccaaattaacactaaaaacggatcaaagctcccacgccagtccactagggccccagtagttgacagccttgctcctctcccaagttctccttcagaacctagttgcttttattcttccagctaccacttgggcacttcacagccagcctagggtcttcggcacctccaagagctgaatctccctccaacccttcttgcctactcctcactgccagctgggacctaggctcagtcctgtgtggtgcccatgatccttctggtgggggaagagtttaagttatagggcatttggctcaaattttaaaaggccttttgtttacctatatttctggaggctcctgtattctagaacccaatctctcacctgcttggttgcaaggctcatatttttttgtacctttcctatagattctgtagcatttgagtgtggcaatattttaattgtgtatagatttctaagaaccaacactactcagtctcctgctagtctgactcctgaagcatcagcccttgtcatactgtattgactgtgtacgtgcctttcaccttgagcatgcttcaggatttttttttaaaccacagaacttgaatacatgagggaaccagagttcaaagtcctatgcaaccttaggagggggttagagagtctgttttgattgatgttttctgaggccctagaggagtttgtatcaatttgtgagtattaatgtcagtactaccagcactttgccaaaactgtcagagggacccgtttctagagtgagtcccagttacatcaaacagtgacttccagttattccccagtaagtctgagtggttccttcaagctgggtgtctttccagcctttgccagtcatagcccccttctactactttccctctcgccctgccacctagttccacatggaaccaacaagttgagtgcatccctgttgggtgttttgtgttgagactggctgaaatgaggagactttgaccatgtgacgtgtcaacagactcaaggagacaaccacctcaactgggtcatgtggcatgcctgtgtatgtgtgtaacagaattctgattgttagactgtaatgctattcctctatgggagaaaaaaattaatataaagaaaaacaaataaaaatatatttaaagcac

SEQ ID NO: 299393 - DNA, 946 bp, Homo sapiens
ttgttaatttatcagaatctatttcagatttataataactttattacagtgagttatttagttactactaaatagctctgaactctcttctccctttttgtgctattattgttatacatattacatctatacatgctgtaagcccaacaatacattgttatatttttcctgtaattgtatgtatattaagcaagcagagacttgagaacaaattatatttatagagtttcttctagtaagcttttaatttaccatttctggttatgttcattttgtcttgtaaatttgagtcaccatctggtgtgatttcttactccagtactactttgttcttatttacctcctttgtgttgtcattgtcaaatatgtcacatttgtatatgttctgggtctaaagcataattacatgatattttatacaattgctctttaagagaaggaagaaatgcatttatactgtctttcataattacataattacatttaccagtgcccttttttttttggaatggattcaaattagtatctggggtcacttcattccaggcagaagtcctttttttaatatatttttatataaggcaaatctgatagggacaaatctttagtttttgtttatatgggctatctttattttaccttctttgagatagttttgctaaatataaaactcctggtgaaaagtttctgtttctgtttttgttttctcagcatctgctgagatgccagctataaagcttaatgaggtttccttctacaagacaaatcgtttttctgtttctgctttcaaaaacaaatggtttcccccctgccccagatttcgtactatgatgtatctgggtgtgagtctgtatttattctgcttggaatttgttgagcttcttgggtatgtagatgaatgattttttttaagaaaaatattaaatttgggatgtttgagccatta

SEQ ID NO: 299394 - DNA, 9764 bp, Homo sapiens
  misc_feature (2424)..(2424): n is a, c, g, or t
  misc_feature (2554)..(2554): n is a, c, g, or t
gcggccgccaggtgctcctggagtgcagcgcctatcgccggggcgtgtgggggccacaccgagcaccagcttctccgacgccgggaagccgctgtcgccgccgctacctctccctgttgccgccgcctcagatctcttcatgccgctgtaagctcggaggccaaggatgcggagtaggcttcccccagcgcttgccgccctgggcgcggccctactcctgtcttccattgaggcagaagttgacccaccttcagacttgaattttaaaattatagatgaaaatactgttcatatgtcatgggcaaaaccagttgatccaattgtgggttacagaataacggtggaccctacaacggatgggcctactaaagaatttaccctttcagctagtaccactgaaactttattgtcagaacttgtacctgaaacagagtatgtggtgacaataacttcatatgatgaagtagaagaaagtgtaccagttataggacaactaacaattcaaacaggtagttcgacaaagccagtggagaagaaacctggaaaaaccgagatacaaaaatgctctgtcagtgcctggactgatttggttttcctcgtggatggctcttggagtgtgggaagaaataatttcaagtacattttagacttcattgctgctcttgtgtctgcttttgacattggggaagagaagacaagagttggagttgttcaatacagctctgacaccaggactgaatttaacttaaatcagtactaccaaagggatgaacttcttgctgcaataaaaaaaattccatataaaggtggcaacacaatgacaggggatgccattgattatttagttaaaaatactttcacggaatctgctggggcaagagttggctttcctaaagtggcaattattattacggatggaaaatcccaggatgaagtggaaattccagcaagagagcttcgtaatgttggagttgaagttttctccttgggcattaaagctgcagatgcaaaagaactcaaacaaattgcctccacaccttcactgaaccatgttttcaatgtggccaactttgatgcaattgtggatattcagaatgagatcatctcccaggtgtgctcaggtgttgatgaacaacttggtgaattggttagtggagaagaagttgttgagcctccttcaaatttgattgccatggaagtctcttcaaaatatgttaagctaaattggaatccatctcctagtccagtgactggctacaaagtcatcctcacaccaatgactgcaggaagccgacagcacgctctgagtgtggggcctcagacaaccacgctcagtgttcgcgacctctcagcagacacagaataccagatcagtgtttccgccatgaagggaatgacatccagtgaacccatttcaataatggagaagactcagccaatgaaagttcaagtggaatgctcacgtggtgtggatataaaagccgatattgtgtttttggttgatggctcctatagcattgggattgcaaactttgttaaagttagagcctttttggaagttcttgtaaaaagttttgaaatttcaccaaatagggtccagattagtcttgtgcaatacagccgggatcctcatactgagttcactttgaaaaaattcaccaaagttgaagatataattgaagcaataaacaccttcccttacagaggaggatctacaaatactggcaaagcaatgacttatgtcagagagaaaatatttgtgcctagcaagggatcaagaagcaatgtgccaaaggtcatgattcttatcacggatgggaaatcatcagatgctttcagagatcctgcgataaaactgaggaattcagatgttgaaatctttgcagttggtgtgaaggatgccgttcgctcagaattggaagctattgcctctcctcctgcagagacccatgtgttcacagtggaagattttgatgcttttcagaggatatcttttgaactcacacagtctatctgccttagaattgagcaagaattggcagctataaagaagaaagcttacgtccctccaaaggatcttagtttttcagaagtgacttcttatggtttcaaaaccaactggtctccagctggagaaaatgttttttcatatcacatcacctacaaggaagcggctggggatgatgaggtcactgtggtggagccagcatcgagcaccagtgttgttctcagcagcctgaagccagagaccttgtatttggtcaatgtgactgcggagtatgaggatggcttcagcattcccttagctggagaggagaccaccgaagaagtaaaaggagcacctcgaaacctaaaggtgacagatgagactacagatagtttcaaaattacttggactcaagctccagggagagttttaagatntcgaattatatatagaccagttgctggtggagagagcagagaagttaccaccccacccaatcagaggaggagaacactggagaacttgattccagacacgaaatatgaagtatctgtaattcctgaatanttctcaggacctggtactccattaactggaaatgcagccactgaagaagttagagggaatccaagagacttaagagtttctgaccctacgacgtctactatgaaattatcttggagtggggcaccaggaaaagtgaaacagtatctcgtcacatataccccagtggcagggggtgaaactcaagaggtcactgtgaggggagatacaaccaatacggtgctgcagggattgaaggaagggacacaatacgccttatctgtgacagcactgtatgcgtctggggctggcgacgccctctttggtgaaggaacaacacttgaagaacgtggttctcctcaagatttagttactaaagacatcactgacacatcaattggggcttattggacatctgctccaggaatggttcgcggttacagggtctcatggaaatcactttatgatgatgttgacactggagagaaaaatctgcctgaagatgcaattcatacgatgatagaaaatctgcagccagagaccaaatacagaatttcagtatttgccacttacagcagtggagaaggagaacctttgactggagatgccacaactgaattatctcaagattccaaaaccctgaaagtagatgaagaaacagaaaacacaatgagagttacatggaaaccagcaccagggaaagtcgtcaactaccgtgttgtctatcgccctcatgggagagggaagcaaatggttgctaaggtgccccccacagtcacttcgacagtgttaaagcgacttcagccacagaccacatatgacatcacagttcttcctatttacaagatgggagaaggaaagcttaggcaaggatcaggaacaacagcttctcggtttaagtctcctagaaacctcaaaacatctgacccaaccatgtcaagcttccgagtgacttgggagcctgcccctggggaagtgaagggttataaagtcacattccaccctacgggggatgacagaagactgggggagttagtggttggaccctatgacaacacagttgttttggaggaacttagggctggtaccacctataaagtaaatgtttttggaatgtttgatggaggagaaagctcaccacttgttggacaagaaatgacaaccctttccgacacaactgttatgccaattttatcttctgggatggagtgtctcaccagagctgaggcagacattgtgttgctggtggatggatcatggagcatcggccgggcaaattttagaaccgtgaggagtttcatttctcgtattgtggaagtctttgacattggccccaaaagagtacaaattgctcttgctcagtatagtggggatcccagaacagagtggcagttaaatgcacacagagacaagaagagcttgttgcaagctgtggcaaacttgccgtacaaaggaggcaatactctcacaggcatggctttgaatttcattcgccaacagaacttcaggacccaagctggcatgagacctcgagctcgaaaaattggtgtgctcattactgatggaaaatcacaagacgatgttgaagcaccttcaaagaaactcaaggatgagggagtggagctgtttgctattggtattaaaaatgctgatgaagtcgaattaaagatgattgcaactgatcctgatgatacccatgactacaatgtggcagattttgagtcactctccaggatagtggatgatctcaccattaatttgtgtaacagtgtcaaaggtccaggtgatttggaagcaccttctaacttagttatttctgagcgaacccatcgttcttttagagtgagctggacaccaccttctgacagtgtggatcgatataaggtggaatactatccagtttctggagggaaacgtcaagaattttatgtgagtcgaatggaaactagcacagtgctgaaagatctgaaacctgaaactgaatatgttgtcaatgtgtattctgtggtagaagatgaatatagtgagcctctgaaggggacagaaaaaaccttgccagtgcctgtagtcagcctgaatatttatgatgttggccctaccaccatgcatgtgcagtggcagcctgtgggaggagctactggctacatcttgtcatacaaacctgttaaggacacagagccaacaagacccaaagaggtgcgtttggggccaacagtgaatgacatgcagctgactgaccttgttcccaacacggagtatgcagtcacagtccaggctgtcctgcacgacctcactagtgaacctgtcactgttcgggaagtcaccttgcctttacccagacctcaggatctgaaactcagagatgtgactcacagcactatgaatgtcttttgggaacctgtgcctggaaaagtgcgtaaatatattgttcgatacaaaacaccagaagaggatgtcaaagaggtagaggtggacagatcagagaccagcacttccctcaaagacctcttctcacagaccttgtacacagtcagcgtttctgcagtacatgacgagggggagtctcctccagtgactgctcaagaaactacccgacccgtgccagccccaacaaacttaaagattactgaagtaacatcagagggtttcagagggacttgggatcatggagcttcagatgtgtctctctacagaataacttggggaccttttggaagctcagataagatggagaccatcttaaatggagatgaaaacactttggtgttcgaaaacctgaaccccaacaccatctatgaagtttccattactgccatctatcctgatgagtcagaaagtgatgacctgattggcagtgagcgcacactgcctatcttaacaacacaagctcccaaaagtgggccacgaaaccttcaagtgtacaatgcaacatctaacagcctgactgttaagtgggatcctgctagtggtcgtgtgcagaaatataggatcacttatcagccttccacaggggaaggcaatgagcaaacgaccacaataggaggacggcagaacagtgtggtcctgcagaaactgaagccagacactccttacactatcaccgtatcctctctgtatcctgatggtgaaggaggtcggatgacgggaagaggcaagaccaaacctctaaacactgtaaggaacctgagagtgtatgacccttctaccagcacctctgaatgtccgctgggaccatgcagagggaaatcctcgtcagtacaagctcttctatgcaccagcagcaggtggtccagaggaactggtaccaatccccgggaataccaattatgccattcttaggaatctgcagccagatacctcatacactgtgactgtagttcccgtttatactgaaggtgatgggggacgcacatcagatactggaaggacattgatgagaggactggcaagaaatgtccaagtatacaatcctacacctaacaggctcggtgttcgctgggaccctgcaccaggacctgtgctgcaatatcgcgttgtgtattctcctgtggatggcacaagaccctcagaatctatagtagtgccaggaaacacgcgcatggtgcatctggagcggctgattccggacacactctattccgtgaaccttgtggctctgtactcggatggagagggaaatcccagccctgcccagggccgaacgctaccacgcagtggaccaaggaacctgagagtctttggtgaaacaaccaatagcctctcggtagcctgggatcatgctgatgggccagttcagcagtacaggatcatctattctcccactgttggtgatccaattgatgaatataccacagtcccaggcagaagaaacaatgtaatactgcagcccctgcaacctgacactccatataaaattactgttattgctgtttatgaagatggagatggtggccatctaacaggaaatggaagaactgtgggactccttcctcctcagaacatacacatctctgacgaatggtatacaagattcagggtgtcctgggatccttcaccttctccagttcttggatataaaatagtatataagccagtgggttccaatgagcccatggaagcctttgttggagaaatgacatcatataccttacacaatctcaatcccagcaccacctacgatgtgaatgtttatgctcaatatgattctggactcagtgtccccttgacagatcaaggcactacattatatttaaatgtaacagatctgaaaacttaccagattgggtgggatacattctgtgtcaaatggtcacctcaccgggcagccacctcctacaggctaaaactaagccctgcagatggaacaaggggacaagaaattacagtgcgtggatcagaaaccagtcactgcttcactggcctttcaccagacactgattatggtgtcactgtttttgtgcagacaccaaatctcgagggaccaggagtctctgttaaagaacataccactgtgaaaccaacagaagcccctacagagccacccacacctcctccccctcccaccattccaccagcccgggatgtatgcaaaggggccaaggcagatattgtgttcttgactgatgcctcctggagcattggggacgataattttaacaaagttgtaaaattcatcttcaatactgtgggaggctttgatgaaatcagtcctgctgggattcaggtttcatttgtgcaatacagcgatgaggtcaagtctgagttcaagctgaacacgtacaatgacaaggccctagcccttggggccctccagaatattaggtacagaggaggaaacacaagaacaggcaaggccctcacgtttatcaaggagaaagtcttgacttgggagagcggcatgaggaagaatgtccctaaggtgttggttgtggtcacggacggtcggtcccaggatgaggtcaagaaggcggctttggtcatccagcagtcagggttcagtgtctttgtagttggtgtggctgatgtcgactacaatgagcttgccaacattgccagcaaaccaagtgaacggcacgtgttcattgtggacgactttgaatcttttgagaagatcgaagacaatcttattacatttgtttgtgaaactgccacttcaagttgtcctctcatttatttggatggctacacctcaccaggttttaaaatgcttgaagcatacaacctgacagaaaagaattttgcttctgtacaaggagtatctttggagtcagggtctttccccagctactcagcatacaggattcagaagaatgcgtttgtgaatcagcctacagcagacctacacccaaatggactccctccttcatacacgattatattattattcagacttctcccagaaactcccagtgacccttttgcaatttggcaaatcacagacagagactacaaaccacaagttggagtgattgcagatccttctagcaagacgttatcattctttaacaaggatacaagaggcgaggtgcaaactgttacatttgacacagaagaagtaaagacattattttatggaagttttcacaaggttcatattgtagtgacctcaaaaagtgttaagatttacattgactgctatgaaattatagaaaaagacatcaaggaagctggaaatataacaactgatggttatgaaattcttggaaaactccttaaaggggaaaggaaatcagccgcattccaaatccagagttttgacattgtctgcagtccagtgtggaccagtagagacagatgctgtgatattccctctaggagagatgagggaaaatgccctgcttttccaaattcttgcacatgtacacaggacagcgttggacctccaggacctccaggccctgcaggaggacctggtgctaaaggtcccagaggtgaaagaggtatcagtggggcaattgggccccctggtcctcgtggagacataggtcctccaggcccccagggtcctccaggccctcagggacccaatggactctctattccgggagagcaaggtcgccaagggatgaaaggtgatgctggagagccaggacttccaggccgaacaggaaccccaggattacctggcccaccaggaccaatgggacctccaggagacagaggcttcactggaaaagacggtgcaatgggacccaggggcccaccagggcggccgggaagcccaggctccccaggagtcacaggaccaagtgggaagccaggaaaacctggagatcatggcagaccaggtccatctgggttgaaaggagaaaaaggtgataggggagacattgcttcccagaacatgatgcgagcagttgcaagacaagtctgtgaacaattgataagtggtcagatgaacagattcaatcagatgctgaatcagattccaaatgattaccagtccagtcgcaaccagccaggcccgccgggtccaccgggacctcctggtagcgcaggagccagaggagaacctgggcctggggggcggccaggcttcccgggcacaccagggatgcagggaccccctggggaacgaggtttgccaggagagaaaggtgaaaggggtactggatcttcaggacctcgggggctgcctgggcccccaggtccacaaggagaatccagaacaggtccaccagggtccacaggttcaagaggtccccctggcccccctggccgtcctggaaactcaggtatccgaggacccccaggtcctcctggatactgtgattcttctcagtgtgccagcatcccatacaacgggcaaagctatccaggttccggctaacacattttctaagtcgccagtgctgcttacagtttgaatacatgaaaatcctgtttctgagatgtttgcgcacgtgcttattaggaaatgagtctgtatggaaatctcaccacagataatggttaacgaaccgggtcgacatcacaaaggagggtggagactctttttactaacttgaatgagacaaaagcagtggtgtcagtttataatcctgatgcatttcagtaataatgtagaaaaacattattttaaaaaagttccaacacacagccatgaggagcctcagttttgaaagaggtgcataataaaactactaaccagaggagtctatgccattttaagaaaaacaattaacctggttaaagagaaatgtcttatgtaaataataaactaattgtggcttgt

SEQ ID NO: 299395 - DNA, 2289 bp, Homo sapiens
  misc_feature (980)..(980): n is a, c, g, or t
  misc_feature (1125)..(1125): n is a, c, g, or t
atgctatataaaattttcttgaaatataattggtgatgacactggcattttcctttgttgtcataatcaggaacaaggggacaagaaattacagtgcgtggatcagaaaccagtcactgcttcactggcctttcaccagacactgattatggtgtcactgtttttgtgcagacaccaaatctcgagggaccaggagtctctgttaaagaacataccagtaagtttttgaggaatctggaaagctttcataaggctttagaatagaatgctctaggtaaggaagacttaagtgaatcctgtgcaggtacctctccgtaggggtagcaataatgatgggatgatggcagattcctgaatgtggagtctaaagctggttcaggacctttttctgtagcaatttgcaagttgtccctgttattgagttggtgctactttgaggaagggctaaaggagggagagatggctctcgctgagaaggtgaattcatattagtgacttttactcatttgaccctatctgaaggccttacattttccctttagatctttattttctgtagctgtagtggatgttgaatgactaccagtgacatcaatttggatggaataaaatccccagcatgtcagtaccgatgacaatggtgtctcattttgtacaacttgatttggtatccaggatttaaattgctcttaaaatttactttctgggatatcaaatgtgcacatggtgtgtttttataattattatttttaaattttagctgtgaaaccaacagaagcccctacagagccacccacacctcctccccctcccaccattccaccagcccgggatggtaagtacagctaaataggcaatacgttcagctgatagggagttacagacttcttatttacgctgcatgtgcatcatttacaattaatatagaacatttctgatctattattgctgctgaagagtttttagattgaaagaaaagntaaccagtaatttgtttctctccatctctgggcacattttggtgtgaataaaatcagtcataaattattccagatcttcagctggaagtctgtttcctcagttttacagatttaggtcttccatggtccatagttacatggtggncatttctttctgctagctgctggcatcagtaagcgctgtgaacccttttggctatatttgcgaccgaagccctgaggctgttggctttaaaattcctggtgtccaacctgagaagttccctggattatacaatgctaaaaaattttccattcaccaaaatttgaaagataattgtaacttgcagtgaactggtgaaacgacatactgatttattaaggttgatctctcagcatttgagggcaattctctagcactttgtcaaattaaatttagttaaataactactgtattattcttttctcatatgctgtttccagcatttaatagaaagcatttcagatatttttattttatcttagaaggatgtcgaacgttacaacttcgttaaacctattatataagtaaaattaaaaattaaaagtgtattattgtggggtaaaataataatggattcctttaaattagatacagaaagaaattcagtaaataatcttggtttaaaaacaagttttttctttttaaataggctttattttctagagtagttttaggttcatagcaacattgcagggatgatgcagagatttttcatctcccagacagactgcccttccccacacatgcccagcctcctccactattaacatcccacatctgagtggtacgtttgttacaaccgatgaacctacattgacacatcatcaccacccaaagtccacagtttgcgttagggttcactcttggtgttatacttctatatgctaagtttttataaactaaaattttgttaattgtttttggaattttttcttagcctctaagtctagatattccaataaaaatcttctcctttcctgcatatgattctagtggcttaatttaaattttacaaaggacttggccaggtgcggtggctcacgcctgtaatcccagcactttgggaggccgggacaggtggatcgagaccatcatggccaacatggttaaacccgtctctgctaaaaatagagaaattagctgggcgtggtggcacatgcctgtagtcccagctactcaggaggctgaggcaggagaatcacttgaacctgggaggtggagtttgcagtgagccaagatcatcacaccactgcactccagcctgaagacagagcaagaccctgtcta

SEQ ID NO: 299396 - DNA, 506 bp, Homo sapiens
gtggaatgaaaggaactagactgatggtctgcttttctgttttggaagtgccagtgcctgtagtcagcctgaatatttatgatgttggccctaccaccatgcatgtgcagtggcagcctgtgggaggagctactggctacatcttgtcatacaaacctgttaaggacacagagccaacaagacccaaagaggtgcgtttggggccaacagtgaatgacatgcagctgactgaccttgttcccaacacggagtatgcagtcacagtccaggctgtcctgcacgacctcactagtgaacctgtcactgttcgggaagtcaccttgcctttacccagacctcaggatctgaaactcagagatgtgactcacagcactatgaatgtcttttgggaacctgtgcctggaaaagtgcgtaaatatattgttcgatacaaaacaccagaagaggatgtcaaagaggtaggttgaagatgatagtagatatgaaaatatttgttttcctagtag

SEQ ID NO: 299397 - DNA, 129 bp, Homo sapiens
gcacgagccaactacttttgataactaagaaattttatattttaactgcagattgtgaatttcactgccttatattatttatttctgaaacaaaagaggcatttttcaataaaactactgaaaatttga

SEQ ID NO: 299398 - DNA, 11581 bp, Homo sapiens
  misc_feature (2424)..(2424): n is a, c, g, or t
  misc_feature (2554)..(2554): n is a, c, g, or t
gcggccgccaggtgctcctggagtgcagcgcctatcgccggggcgtgtgggggccacaccgagcaccagcttctccgacgccgggaagccgctgtcgccgccgctacctctccctgttgccgccgcctcagatctcttcatgccgctgtaagctcggaggccaaggatgcggagtaggcttcccccagcgcttgccgccctgggcgcggccctactcctgtcttccattgaggcagaagttgacccaccttcagacttgaattttaaaattatagatgaaaatactgttcatatgtcatgggcaaaaccagttgatccaattgtgggttacagaataacggtggaccctacaacggatgggcctactaaagaatttaccctttcagctagtaccactgaaactttattgtcagaacttgtacctgaaacagagtatgtggtgacaataacttcatatgatgaagtagaagaaagtgtaccagttataggacaactaacaattcaaacaggtagttcgacaaagccagtggagaagaaacctggaaaaaccgagatacaaaaatgctctgtcagtgcctggactgatttggttttcctcgtggatggctcttggagtgtgggaagaaataatttcaagtacattttagacttcattgctgctcttgtgtctgcttttgacattggggaagagaagacaagagttggagttgttcaatacagctctgacaccaggactgaatttaacttaaatcagtactaccaaagggatgaacttcttgctgcaataaaaaaaattccatataaaggtggcaacacaatgacaggggatgccattgattatttagttaaaaatactttcacggaatctgctggggcaagagttggctttcctaaagtggcaattattattacggatggaaaatcccaggatgaagtggaaattccagcaagagagcttcgtaatgttggagttgaagttttctccttgggcattaaagctgcagatgcaaaagaactcaaacaaattgcctccacaccttcactgaaccatgttttcaatgtggccaactttgatgcaattgtggatattcagaatgagatcatctcccaggtgtgctcaggtgttgatgaacaacttggtgaattggttagtggagaagaagttgttgagcctccttcaaatttgattgccatggaagtctcttcaaaatatgttaagctaaattggaatccatctcctagtccagtgactggctacaaagtcatcctcacaccaatgactgcaggaagccgacagcacgctctgagtgtggggcctcagacaaccacgctcagtgttcgcgacctctcagcagacacagaataccagatcagtgtttccgccatgaagggaatgacatccagtgaacccatttcaataatggagaagactcagccaatgaaagttcaagtggaatgctcacgtggtgtggatataaaagccgatattgtgtttttggttgatggctcctatagcattgggattgcaaactttgttaaagttagagcctttttggaagttcttgtaaaaagttttgaaatttcaccaaatagggtccagattagtcttgtgcaatacagccgggatcctcatactgagttcactttgaaaaaattcaccaaagttgaagatataattgaagcaataaacaccttcccttacagaggaggatctacaaatactggcaaagcaatgacttatgtcagagagaaaatatttgtgcctagcaagggatcaagaagcaatgtgccaaaggtcatgattcttatcacggatgggaaatcatcagatgctttcagagatcctgcgataaaactgaggaattcagatgttgaaatctttgcagttggtgtgaaggatgccgttcgctcagaattggaagctattgcctctcctcctgcagagacccatgtgttcacagtggaagattttgatgcttttcagaggatatcttttgaactcacacagtctatctgccttagaattgagcaagaattggcagctataaagaagaaagcttacgtccctccaaaggatcttagtttttcagaagtgacttcttatggtttcaaaaccaactggtctccagctggagaaaatgttttttcatatcacatcacctacaaggaagcggctggggatgatgaggtcactgtggtggagccagcatcgagcaccagtgttgttctcagcagcctgaagccagagaccttgtatttggtcaatgtgactgcggagtatgaggatggcttcagcattcccttagctggagaggagaccaccgaagaagtaaaaggagcacctcgaaacctaaaggtgacagatgagactacagatagtttcaaaattacttggactcaagctccagggagagttttaagatntcgaattatatatagaccagttgctggtggagagagcagagaagttaccaccccacccaatcagaggaggagaacactggagaacttgattccagacacgaaatatgaagtatctgtaattcctgaatanttctcaggacctggtactccattaactggaaatgcagccactgaagaagttagagggaatccaagagacttaagagtttctgaccctacgacgtctactatgaaattatcttggagtggggcaccaggaaaagtgaaacagtatctcgtcacatataccccagtggcagggggtgaaactcaagaggtcactgtgaggggagatacaaccaatacggtgctgcagggattgaaggaagggacacaatacgccttatctgtgacagcactgtatgcgtctggggctggcgacgccctctttggtgaaggaacaacacttgaagaacgtggttctcctcaagatttagttactaaagacatcactgacacatcaattggggcttattggacatctgctccaggaatggttcgcggttacagggtctcatggaaatcactttatgatgatgttgacactggagagaaaaatctgcctgaagatgcaattcatacgatgatagaaaatctgcagccagagaccaaatacagaatttcagtatttgccacttacagcagtggagaaggagaacctttgactggagatgccacaactgaattatctcaagattccaaaaccctgaaagtagatgaagaaacagaaaacacaatgagagttacatggaaaccagcaccagggaaagtcgtcaactaccgtgttgtctatcgccctcatgggagagggaagcaaatggttgctaaggtgccccccacagtcacttcgacagtgttaaagcgacttcagccacagaccacatatgacatcacagttcttcctatttacaagatgggagaaggaaagcttaggcaaggatcaggaacaacagcttctcggtttaagtctcctagaaacctcaaaacatctgacccaaccatgtcaagcttccgagtgacttgggagcctgcccctggggaagtgaagggttataaagtcacattccaccctacgggggatgacagaagactgggggagttagtggttggaccctatgacaacacagttgttttggaggaacttagggctggtaccacctataaagtaaatgtttttggaatgtttgatggaggagaaagctcaccacttgttggacaagaaatgacaaccctttccgacacaactgttatgccaattttatcttctgggatggagtgtctcaccagagctgaggcagacattgtgttgctggtggatggatcatggagcatcggccgggcaaattttagaaccgtgaggagtttcatttctcgtattgtggaagtctttgacattggccccaaaagagtacaaattgctcttgctcagtatagtggggatcccagaacagagtggcagttaaatgcacacagagacaagaagagcttgttgcaagctgtggcaaacttgccgtacaaaggaggcaatactctcacaggcatggctttgaatttcattcgccaacagaacttcaggacccaagctggcatgagacctcgagctcgaaaaattggtgtgctcattactgatggaaaatcacaagacgatgttgaagcaccttcaaagaaactcaaggatgagggagtggagctgtttgctattggtattaaaaatgctgatgaagtcgaattaaagatgattgcaactgatcctgatgatacccatgactacaatgtggcagattttgagtcactctccaggatagtggatgatctcaccattaatttgtgtaacagtgtcaaaggtccaggtgatttggaagcaccttctaacttagttatttctgagcgaacccatcgttcttttagagtgagctggacaccaccttctgacagtgtggatcgatataaggtggaatactatccagtttctggagggaaacgtcaagaattttatgtgagtcgaatggaaactagcacagtgctgaaagatctgaaacctgaaactgaatatgttgtcaatgtgtattctgtggtagaagatgaatatagtgagcctctgaaggggacagaaaaaaccttgccagtgcctgtagtcagcctgaatatttatgatgttggccctaccaccatgcatgtgcagtggcagcctgtgggaggagctactggctacatcttgtcatacaaacctgttaaggacacagagccaacaagacccaaagaggtgcgtttggggccaacagtgaatgacatgcagctgactgaccttgttcccaacacggagtatgcagtcacagtccaggctgtcctgcacgacctcactagtgaacctgtcactgttcgggaagtcaccttgcctttacccagacctcaggatctgaaactcagagatgtgactcacagcactatgaatgtcttttgggaacctgtgcctggaaaagtgcgtaaatatattgttcgatacaaaacaccagaagaggatgtcaaagaggtagaggtggacagatcagagaccagcacttccctcaaagacctcttctcacagaccttgtacacagtcagcgtttctgcagtacatgacgagggggagtctcctccagtgactgctcaagaaactacccgacccgtgccagccccaacaaacttaaagattactgaagtaacatcagagggtttcagagggacttgggatcatggagcttcagatgtgtctctctacagaataacttggggaccttttggaagctcagataagatggagaccatcttaaatggagatgaaaacactttggtgttcgaaaacctgaaccccaacaccatctatgaagtttccattactgccatctatcctgatgagtcagaaagtgatgacctgattggcagtgagcgcacactgcctatcttaacaacacaagctcccaaaagtgggccacgaaaccttcaagtgtacaatgcaacatctaacagcctgactgttaagtgggatcctgctagtggtcgtgtgcagaaatataggatcacttatcagccttccacaggggaaggcaatgagcaaacgaccacaataggaggacggcagaacagtgtggtcctgcagaaactgaagccagacactccttacactatcaccgtatcctctctgtatcctgatggtgaaggaggtcggatgacgggaagaggcaagaccaaacctctaaacactgtaaggaacctgagagtgtatgacccttctaccagcacctctgaatgtccgctgggaccatgcagagggaaatcctcgtcagtacaagctcttctatgcaccagcagcaggtggtccagaggaactggtaccaatccccgggaataccaattatgccattcttaggaatctgcagccagatacctcatacactgtgactgtagttcccgtttatactgaaggtgatgggggacgcacatcagatactggaaggacattgatgagaggactggcaagaaatgtccaagtatacaatcctacacctaacaggctcggtgttcgctgggaccctgcaccaggacctgtgctgcaatatcgcgttgtgtattctcctgtggatggcacaagaccctcagaatctatagtagtgccaggaaacacgcgcatggtgcatctggagcggctgattccggacacactctattccgtgaaccttgtggctctgtactcggatggagagggaaatcccagccctgcccagggccgaacgctaccacgcagtggaccaaggaacctgagagtctttggtgaaacaaccaatagcctctcggtagcctgggatcatgctgatgggccagttcagcagtacaggatcatctattctcccactgttggtgatccaattgatgaatataccacagtcccaggcagaagaaacaatgtaatactgcagcccctgcaacctgacactccatataaaattactgttattgctgtttatgaagatggagatggtggccatctaacaggaaatggaagaactgtgggactccttcctcctcagaacatacacatctctgacgaatggtatacaagattcagggtgtcctgggatccttcaccttctccagttcttggatataaaatagtatataagccagtgggttccaatgagcccatggaagcctttgttggagaaatgacatcatataccttacacaatctcaatcccagcaccacctacgatgtgaatgtttatgctcaatatgattctggactcagtgtccccttgacagatcaaggcactacattatatttaaatgtaacagatctgaaaacttaccagattgggtgggatacattctgtgtcaaatggtcacctcaccgggcagccacctcctacaggctaaaactaagccctgcagatggaacaaggggacaagaaattacagtgcgtggatcagaaaccagtcactgcttcactggcctttcaccagacactgattatggtgtcactgtttttgtgcagacaccaaatctcgagggaccaggagtctctgttaaagaacataccactgtgaaaccaacagaagcccctacagagccacccacacctcctccccctcccaccattccaccagcccgggatgtatgcaaaggggccaaggcagatattgtgttcttgactgatgcctcctggagcattggggacgataattttaacaaagttgtaaaattcatcttcaatactgtgggaggctttgatgaaatcagtcctgctgggattcaggtttcatttgtgcaatacagcgatgaggtcaagtctgagttcaagctgaacacgtacaatgacaaggccctagcccttggggccctccagaatattaggtacagaggaggaaacacaagaacaggcaaggccctcacgtttatcaaggagaaagtcttgacttgggagagcggcatgaggaagaatgtccctaaggtgttggttgtggtcacggacggtcggtcccaggatgaggtcaagaaggcggctttggtcatccagcagtcagggttcagtgtctttgtagttggtgtggctgatgtcgactacaatgagcttgccaacattgccagcaaaccaagtgaacggcacgtgttcattgtggacgactttgaatcttttgagaagatcgaagacaatcttattacatttgtttgtgaaactgccacttcaagttgtcctctcatttatttggatggctacacctcaccaggttttaaaatgcttgaagcatacaacctgacagaaaagaattttgcttctgtacaaggagtatctttggagtcagggtctttccccagctactcagcatacaggattcagaagaatgcgtttgtgaatcagcctacagcagacctacacccaaatggactccctccttcatacacgattatattattattcagacttctcccagaaactcccagtgacccttttgcaatttggcaaatcacagacagagactacaaaccacaagttggagtgattgcagatccttctagcaagacgttatcattctttaacaaggatacaagaggcgaggtgcaaactgttacatttgacacagaagaagtaaagacattattttatggaagttttcacaaggttcatattgtagtgacctcaaaaagtgttaagatttacattgactgctatgaaattatagaaaaagacatcaaggaagctggaaatataacaactgatggttatgaaattcttggaaaactccttaaaggggaaaggaaatcagccgcattccaaatccagagttttgacattgtctgcagtccagtgtggaccagtagagacagatgctgtgatattccctctaggagagatgagggaaaatgccctgcttttccaaattcttgcacatgtacacaggacagcgttggacctccaggacctccaggccctgcaggaggacctggtgctaaaggtcccagaggtgaaagaggtatcagtggggcaattgggccccctggtcctcgtggagacataggtcctccaggcccccagggtcctccaggccctcagggacccaatggactctctattccgggagagcaaggtcgccaagggatgaaaggtgatgctggagagccaggacttccaggccgaacaggaaccccaggattacctggcccaccaggaccaatgggacctccaggagacagaggcttcactggaaaagacggtgcaatgggacccaggggcccaccagggcggccgggaagcccaggctccccaggagtcacaggaccaagtgggaagccaggaaaacctggagatcatggcagaccaggtccatctgggttgaaaggagaaaaaggtgataggggagacattgcttcccagaacatgatgcgagcagttgcaagacaagtctgtgaacaattgataagtggtcagatgaacagattcaatcagatgctgaatcagattccaaatgattaccagtccagtcgcaaccagccaggcccgccgggtccaccgggacctcctggtagcgcaggagccagaggagaacctgggcctggggggcggccaggcttcccgggcacaccagggatgcagggaccccctggggaacgaggtttgccaggagagaaaggtgaaaggggtactggatcttcaggacctcgggggctgcctgggcccccaggtccacaaggagaatccagaacaggtccaccagggtccacaggttcaagaggtccccctggcccccctggccgtcctggaaactcaggtatccgaggacccccaggtcctcctggatactgtgattcttctcagtgtgccagcatcccatacaacgggcaaagctatccaggttccggctaacacattttctaagtcgccagtgctgcttacagtttgaatacatgaaaatcctgtttctgagatgtttgcgcacgtgcttattaggaaatgagtctgtatggaaatctcaccacagataatggttaacgaaccgggtcgacatcacaaaggagggtggagactctttttactaacttgaatgagacaaaagcagtggtgtcagtttataatcctgatgcatttcagtaataatgtagaaaaacattattttaaaaaagttccaacacacagccatgaggagcctcagttttgaaagaggtgcataataaaactactaaccagaggagtctatgccattttaagaaaaacaattaacctggttaaagagaaatgtcttatgtaaataataaactaattgtggcttgtaaatgatttgtatgtgatcctgtcgactaaaatcacttaacaattctacaataagcttctgcatcaaagcctgccgcttgctctatgccggaataacaccaaatggaatctcctcatctcttgcttgttagcgatgtgtctgattcagggcatctgtctttttgttacttttttgtccgtgtcctctcatttgggttttgtaactgcaattttcaaaccaaagtttaaaatcaccttttcttcctgttttgctgtagtcactggtgttcctcacccaccagctgtaactcagtttgtgtgaggtacagccacagaagatgtcatgtactgtatattacctggtgatagttgcttttcaccccccgagttcagtttctaggagccaatgaaacttcccctcacctcctcatctttccaagttgttctttgaattgaggagtttgaaggcataaacagttacttggggatttgcgaaaatcctacttagttactgcgtttacagttctttggcccagtctctgacccttcccaagtatttgtgcaatgattgtgtttactgctggatttttgaaggtttttttttttaagaaagtgccatttcattatttgattatcaccaaattatctggaaataattgggacattgtaacttatctatttatagttatgagattaagactggagtgccatcaccgcgggtgatgatttagcttttgctgtgtgtgtgtgtgtgtgtgtgccttccaaatcatgccataattgtaatgttgaatcggacagagccttacgtgcccgaggcggggcctacctgcctgagcgcgacccttcatcgtgccggtggagcccgagcggacagcggaatacgaggactacggcgcagacgagcctgcagaggagcctcctgagccccaccggcgctggcggcggccctgccccacggacccgggcagtgaaccagagatcacgcgccgcgccgcgaggcttgggggaggtgttgaaattctcatttacaggtcagatagagcagtgtacgtcttttctgaggtgtttcttccagcgttgctcatccaggagtaccctttctgattgtagagaaccttgtttctgcaggaagcctagctccaagcacgcagtctgtagacatttttgcctttgcccttgaaatgcttgcaaaatactttgttaacaaaagctgcaaagagagaacatgccgtgtgcctttagttagcacagcgggcagcctcagtgaaactcttaggttaagcagttaagtcctggaacccagagctgctgtgtatttcgagcgggcagtttatcttttgctatacttattttcaattcaattacaccacgattcaaataattcccctcctaaaaccaaaaaggagggaaacgtcaactccattgcaattacttatcttcctcttctatctctgttatacgccggggcatagaatgctcgtatacatctctttaacaaccacaaaccttaagccatgtagatgaagttagtgcatcaacgggatacagttccatattgccttaaacctccttgttttagacacactaacatttataccaaattgcagattattctgcagagagggaattgcatgtttgtgttgtatatttagtatgaacttttttcagaatataatatttcttagttatcaaaagtagttggaaaacatttgcaagactatgaacatagaattgctgcttttatattttaactgcagattgtgaatttcactgccttatattatttatttctgaaacaaaagaggcatttttcaataaaactactgaaaatttga

SEQ ID NO: 299399 - DNA, 11549 bp, Homo sapiens
  misc_feature (2424)..(2424): n is a, c, g, or t
  misc_feature (2554)..(2554): n is a, c, g, or t
gcggccgccaggtgctcctggagtgcagcgcctatcgccggggcgtgtgggggccacaccgagcaccagcttctccgacgccgggaagccgctgtcgccgccgctacctctccctgttgccgccgcctcagatctcttcatgccgctgtaagctcggaggccaaggatgcggagtaggcttcccccagcgcttgccgccctgggcgcggccctactcctgtcttccattgaggcagaagttgacccaccttcagacttgaattttaaaattatagatgaaaatactgttcatatgtcatgggcaaaaccagttgatccaattgtgggttacagaataacggtggaccctacaacggatgggcctactaaagaatttaccctttcagctagtaccactgaaactttattgtcagaacttgtacctgaaacagagtatgtggtgacaataacttcatatgatgaagtagaagaaagtgtaccagttataggacaactaacaattcaaacaggtagttcgacaaagccagtggagaagaaacctggaaaaaccgagatacaaaaatgctctgtcagtgcctggactgatttggttttcctcgtggatggctcttggagtgtgggaagaaataatttcaagtacattttagacttcattgctgctcttgtgtctgcttttgacattggggaagagaagacaagagttggagttgttcaatacagctctgacaccaggactgaatttaacttaaatcagtactaccaaagggatgaacttcttgctgcaataaaaaaaattccatataaaggtggcaacacaatgacaggggatgccattgattatttagttaaaaatactttcacggaatctgctggggcaagagttggctttcctaaagtggcaattattattacggatggaaaatcccaggatgaagtggaaattccagcaagagagcttcgtaatgttggagttgaagttttctccttgggcattaaagctgcagatgcaaaagaactcaaacaaattgcctccacaccttcactgaaccatgttttcaatgtggccaactttgatgcaattgtggatattcagaatgagatcatctcccaggtgtgctcaggtgttgatgaacaacttggtgaattggttagtggagaagaagttgttgagcctccttcaaatttgattgccatggaagtctcttcaaaatatgttaagctaaattggaatccatctcctagtccagtgactggctacaaagtcatcctcacaccaatgactgcaggaagccgacagcacgctctgagtgtggggcctcagacaaccacgctcagtgttcgcgacctctcagcagacacagaataccagatcagtgtttccgccatgaagggaatgacatccagtgaacccatttcaataatggagaagactcagccaatgaaagttcaagtggaatgctcacgtggtgtggatataaaagccgatattgtgtttttggttgatggctcctatagcattgggattgcaaactttgttaaagttagagcctttttggaagttcttgtaaaaagttttgaaatttcaccaaatagggtccagattagtcttgtgcaatacagccgggatcctcatactgagttcactttgaaaaaattcaccaaagttgaagatataattgaagcaataaacaccttcccttacagaggaggatctacaaatactggcaaagcaatgacttatgtcagagagaaaatatttgtgcctagcaagggatcaagaagcaatgtgccaaaggtcatgattcttatcacggatgggaaatcatcagatgctttcagagatcctgcgataaaactgaggaattcagatgttgaaatctttgcagttggtgtgaaggatgccgttcgctcagaattggaagctattgcctctcctcctgcagagacccatgtgttcacagtggaagattttgatgcttttcagaggatatcttttgaactcacacagtctatctgccttagaattgagcaagaattggcagctataaagaagaaagcttacgtccctccaaaggatcttagtttttcagaagtgacttcttatggtttcaaaaccaactggtctccagctggagaaaatgttttttcatatcacatcacctacaaggaagcggctggggatgatgaggtcactgtggtggagccagcatcgagcaccagtgttgttctcagcagcctgaagccagagaccttgtatttggtcaatgtgactgcggagtatgaggatggcttcagcattcccttagctggagaggagaccaccgaagaagtaaaaggagcacctcgaaacctaaaggtgacagatgagactacagatagtttcaaaattacttggactcaagctccagggagagttttaagatntcgaattatatatagaccagttgctggtggagagagcagagaagttaccaccccacccaatcagaggaggagaacactggagaacttgattccagacacgaaatatgaagtatctgtaattcctgaatanttctcaggacctggtactccattaactggaaatgcagccactgaagaagttagagggaatccaagagacttaagagtttctgaccctacgacgtctactatgaaattatcttggagtggggcaccaggaaaagtgaaacagtatctcgtcacatataccccagtggcagggggtgaaactcaagaggtcactgtgaggggagatacaaccaatacggtgctgcagggattgaaggaagggacacaatacgccttatctgtgacagcactgtatgcgtctggggctggcgacgccctctttggtgaaggaacaacacttgaagaacgtggttctcctcaagatttagttactaaagacatcactgacacatcaattggggcttattggacatctgctccaggaatggttcgcggttacagggtctcatggaaatcactttatgatgatgttgacactggagagaaaaatctgcctgaagatgcaattcatacgatgatagaaaatctgcagccagagaccaaatacagaatttcagtatttgccacttacagcagtggagaaggagaacctttgactggagatgccacaactgaattatctcaagattccaaaaccctgaaagtagatgaagaaacagaaaacacaatgagagttacatggaaaccagcaccagggaaagtcgtcaactaccgtgttgtctatcgccctcatgggagagggaagcaaatggttgctaaggtgccccccacagtcacttcgacagtgttaaagcgacttcagccacagaccacatatgacatcacagttcttcctatttacaagatgggagaaggaaagcttaggcaaggatcaggaacaacagcttctcggtttaagtctcctagaaacctcaaaacatctgacccaaccatgtcaagcttccgagtgacttgggagcctgcccctggggaagtgaagggttataaagtcacattccaccctacgggggatgacagaagactgggggagttagtggttggaccctatgacaacacagttgttttggaggaacttagggctggtaccacctataaagtaaatgtttttggaatgtttgatggaggagaaagctcaccacttgttggacaagaaatgacaaccctttccgacacaactgttatgccaattttatcttctgggatggagtgtctcaccagagctgaggcagacattgtgttgctggtggatggatcatggagcatcggccgggcaaattttagaaccgtgaggagtttcatttctcgtattgtggaagtctttgacattggccccaaaagagtacaaattgctcttgctcagtatagtggggatcccagaacagagtggcagttaaatgcacacagagacaagaagagcttgttgcaagctgtggcaaacttgccgtacaaaggaggcaatactctcacaggcatggctttgaatttcattcgccaacagaacttcaggacccaagctggcatgagacctcgagctcgaaaaattggtgtgctcattactgatggaaaatcacaagacgatgttgaagcaccttcaaagaaactcaaggatgagggagtggagctgtttgctattggtattaaaaatgctgatgaagtcgaattaaagatgattgcaactgatcctgatgatacccatgactacaatgtggcagattttgagtcactctccaggatagtggatgatctcaccattaatttgtgtaacagtgtcaaaggtccaggtgatttggaagcaccttctaacttagttatttctgagcgaacccatcgttcttttagagtgagctggacaccaccttctgacagtgtggatcgatataaggtggaatactatccagtttctggagggaaacgtcaagaattttatgtgagtcgaatggaaactagcacagtgctgaaagatctgaaacctgaaactgaatatgttgtcaatgtgtattctgtggtagaagatgaatatagtgagcctctgaaggggacagaaaaaaccttgccagtgcctgtagtcagcctgaatatttatgatgttggccctaccaccatgcatgtgcagtggcagcctgtgggaggagctactggctacatcttgtcatacaaacctgttaaggacacagagccaacaagacccaaagaggtgcgtttggggccaacagtgaatgacatgcagctgactgaccttgttcccaacacggagtatgcagtcacagtccaggctgtcctgcacgacctcactagtgaacctgtcactgttcgggaagtcaccttgcctttacccagacctcaggatctgaaactcagagatgtgactcacagcactatgaatgtcttttgggaacctgtgcctggaaaagtgcgtaaatatattgttcgatacaaaacaccagaagaggatgtcaaagaggtagaggtggacagatcagagaccagcacttccctcaaagacctcttctcacagaccttgtacacagtcagcgtttctgcagtacatgacgagggggagtctcctccagtgactgctcaagaaactacccgacccgtgccagccccaacaaacttaaagattactgaagtaacatcagagggtttcagagggacttgggatcatggagcttcagatgtgtctctctacagaataacttggggaccttttggaagctcagataagatggagaccatcttaaatggagatgaaaacactttggtgttcgaaaacctgaaccccaacaccatctatgaagtttccattactgccatctatcctgatgagtcagaaagtgatgacctgattggcagtgagcgcacactgcctatcttaacaacacaagctcccaaaagtgggccacgaaaccttcaagtgtacaatgcaacatctaacagcctgactgttaagtgggatcctgctagtggtcgtgtgcagaaatataggatcacttatcagccttccacaggggaaggcaatgagcaaacgaccacaataggaggacggcagaacagtgtggtcctgcagaaactgaagccagacactccttacactatcaccgtatcctctctgtatcctgatggtgaaggaggtcggatgacgggaagaggcaagaccaaacctctaaacactgtaaggaacctgagagtgtatgacccttctaccagcacctctgaatgtccgctgggaccatgcagagggaaatcctcgtcagtacaagctcttctatgcaccagcagcaggtggtccagaggaactggtaccaatccccgggaataccaattatgccattcttaggaatctgcagccagatacctcatacactgtgactgtagttcccgtttatactgaaggtgatgggggacgcacatcagatactggaaggacattgatgagaggactggcaagaaatgtccaagtatacaatcctacacctaacaggctcggtgttcgctgggaccctgcaccaggacctgtgctgcaatatcgcgttgtgtattctcctgtggatggcacaagaccctcagaatctatagtagtgccaggaaacacgcgcatggtgcatctggagcggctgattccggacacactctattccgtgaaccttgtggctctgtactcggatggagagggaaatcccagccctgcccagggccgaacgctaccacgcagtggaccaaggaacctgagagtctttggtgaaacaaccaatagcctctcggtagcctgggatcatgctgatgggccagttcagcagtacaggatcatctattctcccactgttggtgatccaattgatgaatataccacagtcccaggcagaagaaacaatgtaatactgcagcccctgcaacctgacactccatataaaattactgttattgctgtttatgaagatggagatggtggccatctaacaggaaatggaagaactgtgggactccttcctcctcagaacatacacatctctgacgaatggtatacaagattcagggtgtcctgggatccttcaccttctccagttcttggatataaaatagtatataagccagtgggttccaatgagcccatggaagcctttgttggagaaatgacatcatataccttacacaatctcaatcccagcaccacctacgatgtgaatgtttatgctcaatatgattctggactcagtgtccccttgacagatcaaggcactacattatatttaaatgtaacagatctgaaaacttaccagattgggtgggatacattctgtgtcaaatggtcacctcaccgggcagccacctcctacaggctaaaactaagccctgcagatggaacaaggggacaagaaattacagtgcgtggatcagaaaccagtcactgcttcactggcctttcaccagacactgattatggtgtcactgtttttgtgcagacaccaaatctcgagggaccaggagtctctgttaaagaacataccactgtgaaaccaacagaagcccctacagagccacccacacctcctccccctcccaccattccaccagcccgggatgtatgcaaaggggccaaggcagatattgtgttcttgactgatgcctcctggagcattggggacgataattttaacaaagttgtaaaattcatcttcaatactgtgggaggctttgatgaaatcagtcctgctgggattcaggtttcatttgtgcaatacagcgatgaggtcaagtctgagttcaagctgaacacgtacaatgacaaggccctagcccttggggccctccagaatattaggtacagaggaggaaacacaagaacaggcaaggccctcacgtttatcaaggagaaagtcttgacttgggagagcggcatgaggaagaatgtccctaaggtgttggttgtggtcacggacggtcggtcccaggatgaggtcaagaaggcggctttggtcatccagcagtcagggttcagtgtctttgtagttggtgtggctgatgtcgactacaatgagcttgccaacattgccagcaaaccaagtgaacggcacgtgttcattgtggacgactttgaatcttttgagaagatcgaagacaatcttattacatttgtttgtgaaactgccacttcaagttgtcctctcatttatttggatggctacacctcaccaggttttaaaatgcttgaagcatacaacctgacagaaaagaattttgcttctgtacaaggagtatctttggagtcagggtctttccccagctactcagcatacaggattcagaagaatgcgtttgtgaatcagcctacagcagacctacacccaaatggactccctccttcatacacgattatattattattcagacttctcccagaaactcccagtgacccttttgcaatttggcaaatcacagacagagactacaaaccacaagttggagtgattgcagatccttctagcaagacgttatcattctttaacaaggatacaagaggcgaggtgcaaactgttacatttgacacagaagaagtaaagacattattttatggaagttttcacaaggttcatattgtagtgacctcaaaaagtgttaagatttacattgactgctatgaaattatagaaaaagacatcaaggaagctggaaatataacaactgatggttatgaaattcttggaaaactccttaaaggggaaaggaaatcagccgcattccaaatccagagttttgacattgtctgcagtccagtgtggaccagtagagacagatgctgtgatattccctctaggagagatgagggaaaatgccctgcttttccaaattcttgcacatgtacacaggacagcgttggacctccaggacctccaggccctgcaggaggacctggtgctaaaggtcccagaggtgaaagaggtatcagtggggcaattgggccccctggtcctcgtggagacataggtcctccaggcccccagggtcctccaggccctcagggacccaatggactctctattccgggagagcaaggtcgccaagggatgaaaggtgatgctggagagccaggacttccaggccgaacaggaaccccaggattacctggcccaccaggaccaatgggacctccaggagacagaggcttcactggaaaagacggtgcaatgggacccaggggcccaccagggcggccgggaagcccaggctccccaggagtcacaggaccaagtgggaagccaggaaaacctggagatcatggcagaccaggtccatctgggttgaaaggagaaaaaggtgataggggagacattgcttcccagaacatgatgcgagcagttgcaagacaagtctgtgaacaattgataagtggtcagatgaacagattcaatcagatgctgaatcagattccaaatgattaccagtccagtcgcaaccagccaggcccgccgggtccaccgggacctcctggtagcgcaggagccagaggagaacctgggcctggggggcggccaggcttcccgggcacaccagggatgcagggaccccctggggaacgaggtttgccaggagagaaaggtgaaaggggtactggatcttcaggacctcgggggctgcctgggcccccaggtccacaaggagaatccagaacaggtccaccagggtccacaggttcaagaggtccccctggcccccctggccgtcctggaaactcaggtatccgaggacccccaggtcctcctggatactgtgattcttctcagtgtgccagcatcccatacaacgggcaaagctatccaggttccggctaacacattttctaagtcgccagtgctgcttacagtttgaatacatgaaaatcctgtttctgagatgtttgcgcacgtgcttattaggaaatgagtctgtatggaaatctcaccacagataatggttaacgaaccgggtcgacatcacaaaggagggtggagactctttttactaacttgaatgagacaaaagcagtggtgtcagtttataatcctgatgcatttcagtaataatgtagaaaaacattattttaaaaaagttccaacacacagccatgaggagcctcagttttgaaagaggtgcataataaaactactaaccagaggagtctatgccattttaagaaaaacaattaacctggttaaagagaaatgtcttatgtaaataataaactaattgtggcttgtaaatgatttgtatgtgatcctgtcgactaaaatcacttaacaattctacaataagcttctgcatcaaagcctgccgcttgctctatgccggaataacaccaaatggaatctcctcatctcttgcttgttagcgatgtgtctgattcagggcatctgtctttttgttacttttttgtccgtgtcctctcatttgggttttgtaactgcaattttcaaaccaaagtttaaaatcaccttttcttcctgttttgctgtagtcactggtgttcctcacccaccagctgtaactcagtttgtgtgaggtacagccacagaagatgtcatgtactgtatattacctggtgatagttgcttttcaccccccgagttcagtttctaggagccaatgaaacttcccctcacctcctcatctttccaagttgttctttgaattgaggagtttgaaggcataaacagttacttggggatttgcgaaaatcctacttagttactgcgtttacagttctttggcccagtctctgacccttcccaagtatttgtgcaatgattgtgtttactgctggatttttgaaggtttttttttttaagaaagtgccatttcattatttgattatcaccaaattatctggaaataattgggacattgtaacttatctatttatagttatgagattaagactggagtgccatcaccgcgggtgatgatttagcttttgctgtgtgtgtgtgtgtgtgtgtgccttccaaatcatgccataattgtaatgttgaatcggacagagccttacgtcccttcatcgtgccggtggagcccgagcggacagcggaatacgaggactacggcgcagacgagcctgcagaggagcctcctgagccccaccggcgctggcggcggccctgccccacggacccgggcagtgaaccagagatcacgcgccgcgccgcgaggcttgggggaggtgttgaaattctcatttacaggtcagatagagcagtgtacgtcttttctgaggtgtttcttccagcgttgctcatccaggagtaccctttctgattgtagagaaccttgtttctgcaggaagcctagctccaagcacgcagtctgtagacatttttgcctttgcccttgaaatgcttgcaaaatactttgttaacaaaagctgcaaagagagaacatgccgtgtgcctttagttagcacagcgggcagcctcagtgaaactcttaggttaagcagttaagtcctggaacccagagctgctgtgtatttcgagcgggcagtttatcttttgctatacttattttcaattcaattacaccacgattcaaataattcccctcctaaaaccaaaaaggagggaaacgtcaactccattgcaattacttatcttcctcttctatctctgttatacgccggggcatagaatgctcgtatacatctctttaacaaccacaaaccttaagccatgtagatgaagttagtgcatcaacgggatacagttccatattgccttaaacctccttgttttagacacactaacatttataccaaattgcagattattctgcagagagggaattgcatgtttgtgttgtatatttagtatgaacttttttcagaatataatatttcttagttatcaaaagtagttggaaaacatttgcaagactatgaacatagaattgctgcttttatattttaactgcagattgtgaatttcactgccttatattatttatttctgaaacaaaagaggcatttttcaataaaactactgaaaatttga

SEQ ID NO: 299400 - DNA, 8632 bp, Homo sapiens
gcggccgccaggtgctcctggagtgcagcgcctatcgccggggcgtgtgggggccacaccgagcaccagcttctccgacgccgggaagccgctgtcgccgccgctacctctccctgttgccgccgcctcagatctcttcatgccgctgtaagctcggaggccaaggatgcggagtaggcttcccccagcgcttgccgccctgggcgcggccctactcctgtcttccattgaggcagaagggatggagtgtctcaccagagctgaggcagacattgtgttgctggtggatggatcatggagcatcggccgggcaaattttagaaccgtgaggagtttcatttctcgtattgtggaagtctttgacattggccccaaaagagtacaaattgctcttgctcagtatagtggggatcccagaacagagtggcagttaaatgcacacagagacaagaagagcttgttgcaagctgtggcaaacttgccgtacaaaggaggcaatactctcacaggcatggctttgaatttcattcgccaacagaacttcaggacccaagctggcatgagacctcgagctcgaaaaattggtgtgctcattactgatggaaaatcacaagacgatgttgaagcaccttcaaagaaactcaaggatgagggagtggagctgtttgctattggtattaaaaatgctgatgaagtcgaattaaagatgattgcaactgatcctgatgatacccatgactacaatgtggcagattttgagtcactctccaggatagtggatgatctcaccattaatttgtgtaacagtgtcaaaggtccaggtgatttggaagcaccttctaacttagttatttctgagcgaacccatcgttcttttagagtgagctggacaccaccttctgacagtgtggatcgatataaggtggaatactatccagtttctggagggaaacgtcaagaattttatgtgagtcgaatggaaactagcacagtgctgaaagatctgaaacctgaaactgaatatgttgtcaatgtgtattctgtggtagaagatgaatatagtgagcctctgaaggggacagaaaaaaccttgccagtgcctgtagtcagcctgaatatttatgatgttggccctaccaccatgcatgtgcagtggcagcctgtgggaggagctactggctacatcttgtcatacaaacctgttaaggacacagagccaacaagacccaaagaggtgcgtttggggccaacagtgaatgacatgcagctgactgaccttgttcccaacacggagtatgcagtcacagtccaggctgtcctgcacgacctcactagtgaacctgtcactgttcgggaagtcaccttgcctttacccagacctcaggatctgaaactcagagatgtgactcacagcactatgaatgtcttttgggaacctgtgcctggaaaagtgcgtaaatatattgttcgatacaaaacaccagaagaggatgtcaaagaggtagaggtggacagatcagagaccagcacttccctcaaagacctcttctcacagaccttgtacacagtcagcgtttctgcagtacatgacgagggggagtctcctccagtgactgctcaagaaactacccgacccgtgccagccccaacaaacttaaagattactgaagtaacatcagagggtttcagagggacttgggatcatggagcttcagatgtgtctctctacagaataacttggggaccttttggaagctcagataagatggagaccatcttaaatggagatgaaaacactttggtgttcgaaaacctgaaccccaacaccatctatgaagtttccattactgccatctatcctgatgagtcagaaagtgatgacctgattggcagtgagcgcacactgcctatcttaacaacacaagctcccaaaagtgggccacgaaaccttcaagtgtacaatgcaacatctaacagcctgactgttaagtgggatcctgctagtggtcgtgtgcagaaatataggatcacttatcagccttccacaggggaaggcaatgagcaaacgaccacaataggaggacggcagaacagtgtggtcctgcagaaactgaagccagacactccttacactatcaccgtatcctctctgtatcctgatggtgaaggaggtcggatgacgggaagaggcaagaccaaacctctaaacactgtaaggaacctgagagtgtatgacccttctaccagcacctctgaatgtccgctgggaccatgcagagggaaatcctcgtcagtacaagctcttctatgcaccagcagcaggtggtccagaggaactggtaccaatccccgggaataccaattatgccattcttaggaatctgcagccagatacctcatacactgtgactgtagttcccgtttatactgaaggtgatgggggacgcacatcagatactggaaggacattgatgagaggactggcaagaaatgtccaagtatacaatcctacacctaacaggctcggtgttcgctgggaccctgcaccaggacctgtgctgcaatatcgcgttgtgtattctcctgtggatggcacaagaccctcagaatctatagtagtgccaggaaacacgcgcatggtgcatctggagcggctgattccggacacactctattccgtgaaccttgtggctctgtactcggatggagagggaaatcccagccctgcccagggccgaacgctaccacgcagtggaccaaggaacctgagagtctttggtgaaacaaccaatagcctctcggtagcctgggatcatgctgatgggccagttcagcagtacaggatcatctattctcccactgttggtgatccaattgatgaatataccacagtcccaggcagaagaaacaatgtaatactgcagcccctgcaacctgacactccatataaaattactgttattgctgtttatgaagatggagatggtggccatctaacaggaaatggaagaactgtgggactccttcctcctcagaacatacacatctctgacgaatggtatacaagattcagggtgtcctgggatccttcaccttctccagttcttggatataaaatagtatataagccagtgggttccaatgagcccatggaagcctttgttggagaaatgacatcatataccttacacaatctcaatcccagcaccacctacgatgtgaatgtttatgctcaatatgattctggactcagtgtccccttgacagatcaaggcactacattatatttaaatgtaacagatctgaaaacttaccagattgggtgggatacattctgtgtcaaatggtcacctcaccgggcagccacctcctacaggctaaaactaagccctgcagatggaacaaggggacaagaaattacagtgcgtggatcagaaaccagtcactgcttcactggcctttcaccagacactgattatggtgtcactgtttttgtgcagacaccaaatctcgagggaccaggagtctctgttaaagaacataccagtaagtttttgaggaatctggaaagctttcataaggctttagaatagaatgctctaggtaaggaagacttaagtgaatcctgtgcaggtacctctccgtaggggtagcaataatgatgggatgatggcagattcctgaatgtggagtctaaagctggttcaggacctttttctgtagcaatttgcaagttgtccctgttattgagttggtgctactttgaggaagggctaaaggagggagagatggctctcgctgagaaggtgaattcatattagtgacttttactcatttgaccctatctgaaggccttacattttccctttagatctttattttctgtagctgtagtggatgttgaatgactaccagtgacatcaatttggatggaataaaatccccagcatgtcagtaccgatgacaatggtgtctcattttgtacaacttgatttggtatccaggatttaaattgctcttaaaatttactttctgggatatcaaatgtgcacatggtgtgtttttataattattatttttaaattttagctgtgaaaccaacagaagcccctacagagccacccacacctcctccccctcccaccattccaccagcccgggatgtatgcaaaggggccaaggcagatattgtgttcttgactgatgcctcctggagcattggggacgataattttaacaaagttgtaaaattcatcttcaatactgtgggaggctttgatgaaatcagtcctgctgggattcaggtttcatttgtgcaatacagcgatgaggtcaagtctgagttcaagctgaacacgtacaatgacaaggccctagcccttggggccctccagaatattaggtacagaggaggaaacacaagaacaggcaaggccctcacgtttatcaaggagaaagtcttgacttgggagagcggcatgaggaagaatgtccctaaggtgttggttgtggtcacggacggtcggtcccaggatgaggtcaagaaggcggctttggtcatccagcagtcagggttcagtgtctttgtagttggtgtggctgatgtcgactacaatgagcttgccaacattgccagcaaaccaagtgaacggcacgtgttcattgtggacgactttgaatcttttgagaagatcgaagacaatcttattacatttgtttgtgaaactgccacttcaagttgtcctctcatttatttggatggctacacctcaccaggttttaaaatgcttgaagcatacaacctgacagaaaagaattttgcttctgtacaaggagtatctttggagtcagggtctttccccagctactcagcatacaggattcagaagaatgcgtttgtgaatcagcctacagcagacctacacccaaatggactccctccttcatacacgattatattattattcagacttctcccagaaactcccagtgacccttttgcaatttggcaaatcacagacagagactacaaaccacaagttggagtgattgcagatccttctagcaagacgttatcattctttaacaaggatacaagaggcgaggtgcaaactgttacatttgacacagaagaagtaaagacattattttatggaagttttcacaaggttcatattgtagtgacctcaaaaagtgttaagatttacattgactgctatgaaattatagaaaaagacatcaaggaagctggaaatataacaactgatggttatgaaattcttggaaaactccttaaaggggaaaggaaatcagccgcattccaaatccagagttttgacattgtctgcagtccagtgtggaccagtagagacagatgctgtgatattccctctaggagagatgagggaaaatgccctgcttttccaaattcttgcacatgtacacaggacagcgttggacctccaggacctccaggccctgcaggaggacctggtgctaaaggtcccagaggtgaaagaggtatcagtggggcaattgggccccctggtcctcgtggagacataggtcctccaggcccccagggtcctccaggccctcagggacccaatggactctctattccgggagagcaaggtcgccaagggatgaaaggtgatgctggagagccaggacttccaggccgaacaggaaccccaggattacctggcccaccaggaccaatgggacctccaggagacagaggcttcactggaaaagacggtgcaatgggacccaggggcccaccagggcggccgggaagcccaggctccccaggagtcacaggaccaagtgggaagccaggaaaacctggagatcatggcagaccaggtccatctgggttgaaaggagaaaaaggtgataggggagacattgcttcccagaacatgatgcgagcagttgcaagacaagtctgtgaacaattgataagtggtcagatgaacagattcaatcagatgctgaatcagattccaaatgattaccagtccagtcgcaaccagccaggcccgccgggtccaccgggacctcctggtagcgcaggagccagaggagaacctgggcctggggggcggccaggcttcccgggcacaccagggatgcagggaccccctggggaacgaggtttgccaggagagaaaggtgaaaggggtactggatcttcaggacctcgggggctgcctgggcccccaggtccacaaggagaatccagaacaggtccaccagggtccacaggttcaagaggtccccctggcccccctggccgtcctggaaactcaggtatccgaggacccccaggtcctcctggatactgtgattcttctcagtgtgccagcatcccatacaacgggcaaagctatccaggttccggctaacacattttctaagtcgccagtgctgcttacagtttgaatacatgaaaatcctgtttctgagatgtttgcgcacgtgcttattaggaaatgagtctgtatggaaatctcaccacagataatggttaacgaaccgggtcgacatcacaaaggagggtggagactctttttactaacttgaatgagacaaaagcagtggtgtcagtttataatcctgatgcatttcagtaataatgtagaaaaacattattttaaaaaagttccaacacacagccatgaggagcctcagttttgaaagaggtgcataataaaactactaaccagaggagtctatgccattttaagaaaaacaattaacctggttaaagagaaatgtcttatgtaaataataaactaattgtggcttgtaaatgatttgtatgtgatcctgtcgactaaaatcacttaacaattctacaataagcttctgcatcaaagcctgccgcttgctctatgccggaataacaccaaatggaatctcctcatctcttgcttgttagcgatgtgtctgattcagggcatctgtctttttgttacttttttgtccgtgtcctctcatttgggttttgtaactgcaattttcaaaccaaagtttaaaatcaccttttcttcctgttttgctgtagtcactggtgttcctcacccaccagctgtaactcagtttgtgtgaggtacagccacagaagatgtcatgtactgtatattacctggtgatagttgcttttcaccccccgagttcagtttctaggagccaatgaaacttcccctcacctcctcatctttccaagttgttctttgaattgaggagtttgaaggcataaacagttacttggggatttgcgaaaatcctacttagttactgcgtttacagttctttggcccagtctctgacccttcccaagtatttgtgcaatgattgtgtttactgctggatttttgaaggtttttttttttaagaaagtgccatttcattatttgattatcaccaaattatctggaaataattgggacattgtaacttatctatttatagttatgagattaagactggagtgccatcaccgcgggtgatgatttagcttttgctgtgtgtgtgtgtgtgtgtgtgccttccaaatcatgccataattgtaatgttgaatcggacagagccttacgtgcccgaggcggggcctacctgcctgagcgcgacccttcatcgtgccggtggagcccgagcggacagcggaatacgaggactacggcgcagacgagcctgcagaggagcctcctgagccccaccggcgctggcggcggccctgccccacggacccgggcagtgaaccagagatcacgcgccgcgccgcgaggcttgggggaggtgttgaaattctcatttacaggtcagatagagcagtgtacgtcttttctgaggtgtttcttccagcgttgctcatccaggagtaccctttctgattgtagagaaccttgtttctgcaggaagcctagctccaagcacgcagtctgtagacatttttgcctttgcccttgaaatgcttgcaaaatactttgttaacaaaagctgcaaagagagaacatgccgtgtgcctttagttagcacagcgggcagcctcagtgaaactcttaggttaagcagttaagtcctggaacccagagctgctgtgtatttcgagcgggcagtttatcttttgctatacttattttcaattcaattacaccacgattcaaataattcccctcctaaaaccaaaaaggagggaaacgtcaactccattgcaattacttatcttcctcttctatctctgttatacgccggggcatagaatgctcgtatacatctctttaacaaccacaaaccttaagccatgtagatgaagttagtgcatcaacgggatacagttccatattgccttaaacctccttgttttagacacactaacatttataccaaattgcagattattctgcagagagggaattgcatgtttgtgttgtatatttagtatgaacttttttcagaatataatatttcttagttatcaaaagtagttggaaaacatttgcaagactatgaacatagaattgctgcttttatattttaactgcagattgtgaatttcactgccttatattatttatttctgaaacaaaagaggcatttttcaataaaactactgaaaatttga

SEQ ID NO: 299401 - DNA, 6785 bp, Homo sapiens
ttagtggtctaggaagatgatgttattggttaaattagagtttggaattagtacatcaatttaattggtaggtttttctaagttcctattggggcagttaattaagaactgggtatatcttatttttctctccttttaccttttctattaatcacaaagttattgagtagcaatttgttaaatgaagaagtaatgaatggttgaaactagctgactgaatcagatgagctcaatagctgttgtcagattttacttagaaggcagactcttaaaaaatgtctcttcttcctctctccattacttatgttagaaaactgaaactacttttcctatttcttttctctatcccatgaccctttatggccaatccagttccaccacgtttattagcttgtttttaattgaatacaatgttgcttccttatagacaaaggccatacttgctaactttaactaaatttgggtttggagagttttaatctgcctttgtgtgtaggtaattagaagtataaagaagatagcattttatcctgttacagaatgtaggttctggaaaagtgatacaaaagcttgagatatataaacagacttaaaaaatagatgttggccttcatttcctcagtgatgagaggactggcaagaaatgtccaagtatacaatcctacacctaacaggctcggtgttcgctgggaccctgcaccaggacctgtgctgcaatatcgcgttgtgtattctcctgtggatggcacaagaccctcagaatctatagtagtgccaggaaacacgcgcatggtgcatctggagcggctgattccggacacactctattccgtgaaccttgtggctctgtactcggatggagagggaaatcccagccctgcccagggccgaacgctaccacgcagtggaccaaggaacctgagagtctttggtgaaacaaccaatagcctctcggtagcctgggatcatgctgatgggccagttcagcagtacaggatcatctattctcccactgttggtgatccaattgatgaatataccacagtcccaggcagaagaaacaatgtaatactgcagcccctgcaacctgacactccatataaaattactgttattgctgtttatgaagatggagatggtggccatctaacaggaaatggaagaactgtgggactccttcctcctcagaacatacacatctctgacgaatggtatacaagattcagggtgtcctgggatccttcaccttctccagttcttggatataaaatagtatataagccagtgggttccaatgagcccatggaagcctttgttggagaaatgacatcatataccttacacaatctcaatcccagcaccacctacgatgtgaatgtttatgctcaatatgattctggactcagtgtccccttgacagatcaaggcactacattatatttaaatgtaacagatctgaaaacttaccagattgggtgggatacattctgtgtcaaatggtcacctcaccgggcagccacctcctacaggctaaaactaagccctgcagatggaacaaggggacaagaaattacagtgcgtggatcagaaaccagtcactgcttcactggcctttcaccagacactgattatggtgtcactgtttttgtgcagacaccaaatctcgagggaccaggagtctctgttaaagaacataccagtaagtttttgaggaatctggaaagctttcataaggctttagaatagaatgctctaggtaaggaagacttaagtgaatcctgtgcaggtacctctccgtaggggtagcaataatgatgggatgatggcagattcctgaatgtggagtctaaagctggttcaggacctttttctgtagcaatttgcaagttgtccctgttattgagttggtgctactttgaggaagggctaaaggagggagagatggctctcgctgagaaggtgaattcatattagtgacttttactcatttgaccctatctgaaggccttacattttccctttagatctttattttctgtagctgtagtggatgttgaatgactaccagtgacatcaatttggatggaataaaatccccagcatgtcagtaccgatgacaatggtgtctcattttgtacaacttgatttggtatccaggatttaaattgctcttaaaatttactttctgggatatcaaatgtgcacatggtgtgtttttataattattatttttaaattttagctgtgaaaccaacagaagcccctacagagccacccacacctcctccccctcccaccattccaccagcccgggatgtatgcaaaggggccaaggcagatattgtgttcttgactgatgcctcctggagcattggggacgataattttaacaaagttgtaaaattcatcttcaatactgtgggaggctttgatgaaatcagtcctgctgggattcaggtttcatttgtgcaatacagcgatgaggtcaagtctgagttcaagctgaacacgtacaatgacaaggccctagcccttggggccctccagaatattaggtacagaggaggaaacacaagaacaggcaaggccctcacgtttatcaaggagaaagtcttgacttgggagagcggcatgaggaagaatgtccctaaggtgttggttgtggtcacggacggtcggtcccaggatgaggtcaagaaggcggctttggtcatccagcagtcagggttcagtgtctttgtagttggtgtggctgatgtcgactacaatgagcttgccaacattgccagcaaaccaagtgaacggcacgtgttcattgtggacgactttgaatcttttgagaagatcgaagacaatcttattacatttgtttgtgaaactgccacttcaagttgtcctctcatttatttggatggctacacctcaccaggttttaaaatgcttgaagcatacaacctgacagaaaagaattttgcttctgtacaaggagtatctttggagtcagggtctttccccagctactcagcatacaggattcagaagaatgcgtttgtgaatcagcctacagcagacctacacccaaatggactccctccttcatacacgattatattattattcagacttctcccagaaactcccagtgacccttttgcaatttggcaaatcacagacagagactacaaaccacaagttggagtgattgcagatccttctagcaagacgttatcattctttaacaaggatacaagaggcgaggtgcaaactgttacatttgacacagaagaagtaaagacattattttatggaagttttcacaaggttcatattgtagtgacctcaaaaagtgttaagatttacattgactgctatgaaattatagaaaaagacatcaaggaagctggaaatataacaactgatggttatgaaattcttggaaaactccttaaaggggaaaggaaatcagccgcattccaaatccagagttttgacattgtctgcagtccagtgtggaccagtagagacagatgctgtgatattccctctaggagagatgagggaaaatgccctgcttttccaaattcttgcacatgtacacaggacagcgttggacctccaggacctccaggccctgcaggaggacctggtgctaaaggtcccagaggtgaaagaggtatcagtggggcaattgggccccctggtcctcgtggagacataggtcctccaggcccccagggtcctccaggccctcagggacccaatggactctctattccgggagagcaaggtcgccaagggatgaaaggtgatgctggagagccaggacttccaggccgaacaggaaccccaggattacctggcccaccaggaccaatgggacctccaggagacagaggcttcactggaaaagacggtgcaatgggacccaggggcccaccagggcggccgggaagcccaggctccccaggagtcacaggaccaagtgggaagccaggaaaacctggagatcatggcagaccaggtccatctgggttgaaaggagaaaaaggtgataggggagacattgcttcccagaacatgatgcgagcagttgcaagacaagtctgtgaacaattgataagtggtcagatgaacagattcaatcagatgctgaatcagattccaaatgattaccagtccagtcgcaaccagccaggcccgccgggtccaccgggacctcctggtagcgcaggagccagaggagaacctgggcctggggggcggccaggcttcccgggcacaccagggatgcagggaccccctggggaacgaggtttgccaggagagaaaggtgaaaggggtactggatcttcaggacctcgggggctgcctgggcccccaggtccacaaggagaatccagaacaggtccaccagggtccacaggttcaagaggtccccctggcccccctggccgtcctggaaactcaggtatccgaggacccccaggtcctcctggatactgtgattcttctcagtgtgccagcatcccatacaacgggcaaagctatccaggttccggctaacacattttctaagtcgccagtgctgcttacagtttgaatacatgaaaatcctgtttctgagatgtttgcgcacgtgcttattaggaaatgagtctgtatggaaatctcaccacagataatggttaacgaaccgggtcgacatcacaaaggagggtggagactctttttactaacttgaatgagacaaaagcagtggtgtcagtttataatcctgatgcatttcagtaataatgtagaaaaacattattttaaaaaagttccaacacacagccatgaggagcctcagttttgaaagaggtgcataataaaactactaaccagaggagtctatgccattttaagaaaaacaattaacctggttaaagagaaatgtcttatgtaaataataaactaattgtggcttgtaaatgatttgtatgtgatcctgtcgactaaaatcacttaacaattctacaataagcttctgcatcaaagcctgccgcttgctctatgccggaataacaccaaatggaatctcctcatctcttgcttgttagcgatgtgtctgattcagggcatctgtctttttgttacttttttgtccgtgtcctctcatttgggttttgtaactgcaattttcaaaccaaagtttaaaatcaccttttcttcctgttttgctgtagtcactggtgttcctcacccaccagctgtaactcagtttgtgtgaggtacagccacagaagatgtcatgtactgtatattacctggtgatagttgcttttcaccccccgagttcagtttctaggagccaatgaaacttcccctcacctcctcatctttccaagttgttctttgaattgaggagtttgaaggcataaacagttacttggggatttgcgaaaatcctacttagttactgcgtttacagttctttggcccagtctctgacccttcccaagtatttgtgcaatgattgtgtttactgctggatttttgaaggtttttttttttaagaaagtgccatttcattatttgattatcaccaaattatctggaaataattgggacattgtaacttatctatttatagttatgagattaagactggagtgccatcaccgcgggtgatgatttagcttttgctgtgtgtgtgtgtgtgtgtgtgccttccaaatcatgccataattgtaatgttgaatcggacagagccttacgtgcccgaggcggggcctacctgcctgagcgcgacccttcatcgtgccggtggagcccgagcggacagcggaatacgaggactacggcgcagacgagcctgcagaggagcctcctgagccccaccggcgctggcggcggccctgccccacggacccgggcagtgaaccagagatcacgcgccgcgccgcgaggcttgggggaggtgttgaaattctcatttacaggtcagatagagcagtgtacgtcttttctgaggtgtttcttccagcgttgctcatccaggagtaccctttctgattgtagagaaccttgtttctgcaggaagcctagctccaagcacgcagtctgtagacatttttgcctttgcccttgaaatgcttgcaaaatactttgttaacaaaagctgcaaagagagaacatgccgtgtgcctttagttagcacagcgggcagcctcagtgaaactcttaggttaagcagttaagtcctggaacccagagctgctgtgtatttcgagcgggcagtttatcttttgctatacttattttcaattcaattacaccacgattcaaataattcccctcctaaaaccaaaaaggagggaaacgtcaactccattgcaattacttatcttcctcttctatctctgttatacgccggggcatagaatgctcgtatacatctctttaacaaccacaaaccttaagccatgtagatgaagttagtgcatcaacgggatacagttccatattgccttaaacctccttgttttagacacactaacatttataccaaattgcagattattctgcagagagggaattgcatgtttgtgttgtatatttagtatgaacttttttcagaatataatatttcttagttatcaaaagtagttggaaaacatttgcaagactatgaacatagaattgctgcttttatattttaactgcagattgtgaatttcactgccttatattatttatttctgaaacaaaagaggcatttttcaataaaactactgaaaatttga

SEQ ID NO: 299402 - DNA, 5303 bp, Homo sapiens
atgctatataaaattttcttgaaatataattggtgatgacactggcattttcctttgttgtcataatcaggaacaaggggacaagaaattacagtgcgtggatcagaaaccagtcactgcttcactggcctttcaccagacactgattatggtgtcactgtttttgtgcagacaccaaatctcgagggaccaggagtctctgttaaagaacataccagtaagtttttgaggaatctggaaagctttcataaggctttagaatagaatgctctaggtaaggaagacttaagtgaatcctgtgcaggtacctctccgtaggggtagcaataatgatgggatgatggcagattcctgaatgtggagtctaaagctggttcaggacctttttctgtagcaatttgcaagttgtccctgttattgagttggtgctactttgaggaagggctaaaggagggagagatggctctcgctgagaaggtgaattcatattagtgacttttactcatttgaccctatctgaaggccttacattttccctttagatctttattttctgtagctgtagtggatgttgaatgactaccagtgacatcaatttggatggaataaaatccccagcatgtcagtaccgatgacaatggtgtctcattttgtacaacttgatttggtatccaggatttaaattgctcttaaaatttactttctgggatatcaaatgtgcacatggtgtgtttttataattattatttttaaattttagctgtgaaaccaacagaagcccctacagagccacccacacctcctccccctcccaccattccaccagcccgggatgtatgcaaaggggccaaggcagatattgtgttcttgactgatgcctcctggagcattggggacgataattttaacaaagttgtaaaattcatcttcaatactgtgggaggctttgatgaaatcagtcctgctgggattcaggtttcatttgtgcaatacagcgatgaggtcaagtctgagttcaagctgaacacgtacaatgacaaggccctagcccttggggccctccagaatattaggtacagaggaggaaacacaagaacaggcaaggccctcacgtttatcaaggagaaagtcttgacttgggagagcggcatgaggaagaatgtccctaaggtgttggttgtggtcacggacggtcggtcccaggatgaggtcaagaaggcggctttggtcatccagcagtcagggttcagtgtctttgtagttggtgtggctgatgtcgactacaatgagcttgccaacattgccagcaaaccaagtgaacggcacgtgttcattgtggacgactttgaatcttttgagaagatcgaagacaatcttattacatttgtttgtgaaactgccacttcaagttgtcctctcatttatttggatggctacacctcaccaggttttaaaatgcttgaagcatacaacctgacagaaaagaattttgcttctgtacaaggagtatctttggagtcagggtctttccccagctactcagcatacaggattcagaagaatgcgtttgtgaatcagcctacagcagacctacacccaaatggactccctccttcatacacgattatattattattcagacttctcccagaaactcccagtgacccttttgcaatttggcaaatcacagacagagactacaaaccacaagttggagtgattgcagatccttctagcaagacgttatcattctttaacaaggatacaagaggcgaggtgcaaactgttacatttgacacagaagaagtaaagacattattttatggaagttttcacaaggttcatattgtagtgacctcaaaaagtgttaagatttacattgactgctatgaaattatagaaaaagacatcaaggaagctggaaatataacaactgatggttatgaaattcttggaaaactccttaaaggggaaaggaaatcagccgcattccaaatccagagttttgacattgtctgcagtccagtgtggaccagtagagacagatgctgtgatattccctctaggagagatgagggaaaatgccctgcttttccaaattcttgcacatgtacacaggacagcgttggacctccaggacctccaggccctgcaggaggacctggtgctaaaggtcccagaggtgaaagaggtatcagtggggcaattgggccccctggtcctcgtggagacataggtcctccaggcccccagggtcctccaggccctcagggacccaatggactctctattccgggagagcaaggtcgccaagggatgaaaggtgatgctggagagccaggacttccaggccgaacaggaaccccaggattacctggcccaccaggaccaatgggacctccaggagacagaggcttcactggaaaagacggtgcaatgggacccaggggcccaccagggcggccgggaagcccaggctccccaggagtcacaggaccaagtgggaagccaggaaaacctggagatcatggcagaccaggtccatctgggttgaaaggagaaaaaggtgataggggagacattgcttcccagaacatgatgcgagcagttgcaagacaagtctgtgaacaattgataagtggtcagatgaacagattcaatcagatgctgaatcagattccaaatgattaccagtccagtcgcaaccagccaggcccgccgggtccaccgggacctcctggtagcgcaggagccagaggagaacctgggcctggggggcggccaggcttcccgggcacaccagggatgcagggaccccctggggaacgaggtttgccaggagagaaaggtgaaaggggtactggatcttcaggacctcgggggctgcctgggcccccaggtccacaaggagaatccagaacaggtccaccagggtccacaggttcaagaggtccccctggcccccctggccgtcctggaaactcaggtatccgaggacccccaggtcctcctggatactgtgattcttctcagtgtgccagcatcccatacaacgggcaaagctatccaggttccggctaacacattttctaagtcgccagtgctgcttacagtttgaatacatgaaaatcctgtttctgagatgtttgcgcacgtgcttattaggaaatgagtctgtatggaaatctcaccacagataatggttaacgaaccgggtcgacatcacaaaggagggtggagactctttttactaacttgaatgagacaaaagcagtggtgtcagtttataatcctgatgcatttcagtaataatgtagaaaaacattattttaaaaaagttccaacacacagccatgaggagcctcagttttgaaagaggtgcataataaaactactaaccagaggagtctatgccattttaagaaaaacaattaacctggttaaagagaaatgtcttatgtaaataataaactaattgtggcttgtaaatgatttgtatgtgatcctgtcgactaaaatcacttaacaattctacaataagcttctgcatcaaagcctgccgcttgctctatgccggaataacaccaaatggaatctcctcatctcttgcttgttagcgatgtgtctgattcagggcatctgtctttttgttacttttttgtccgtgtcctctcatttgggttttgtaactgcaattttcaaaccaaagtttaaaatcaccttttcttcctgttttgctgtagtcactggtgttcctcacccaccagctgtaactcagtttgtgtgaggtacagccacagaagatgtcatgtactgtatattacctggtgatagttgcttttcaccccccgagttcagtttctaggagccaatgaaacttcccctcacctcctcatctttccaagttgttctttgaattgaggagtttgaaggcataaacagttacttggggatttgcgaaaatcctacttagttactgcgtttacagttctttggcccagtctctgacccttcccaagtatttgtgcaatgattgtgtttactgctggatttttgaaggtttttttttttaagaaagtgccatttcattatttgattatcaccaaattatctggaaataattgggacattgtaacttatctatttatagttatgagattaagactggagtgccatcaccgcgggtgatgatttagcttttgctgtgtgtgtgtgtgtgtgtgtgccttccaaatcatgccataattgtaatgttgaatcggacagagccttacgtgcccgaggcggggcctacctgcctgagcgcgacccttcatcgtgccggtggagcccgagcggacagcggaatacgaggactacggcgcagacgagcctgcagaggagcctcctgagccccaccggcgctggcggcggccctgccccacggacccgggcagtgaaccagagatcacgcgccgcgccgcgaggcttgggggaggtgttgaaattctcatttacaggtcagatagagcagtgtacgtcttttctgaggtgtttcttccagcgttgctcatccaggagtaccctttctgattgtagagaaccttgtttctgcaggaagcctagctccaagcacgcagtctgtagacatttttgcctttgcccttgaaatgcttgcaaaatactttgttaacaaaagctgcaaagagagaacatgccgtgtgcctttagttagcacagcgggcagcctcagtgaaactcttaggttaagcagttaagtcctggaacccagagctgctgtgtatttcgagcgggcagtttatcttttgctatacttattttcaattcaattacaccacgattcaaataattcccctcctaaaaccaaaaaggagggaaacgtcaactccattgcaattacttatcttcctcttctatctctgttatacgccggggcatagaatgctcgtatacatctctttaacaaccacaaaccttaagccatgtagatgaagttagtgcatcaacgggatacagttccatattgccttaaacctccttgttttagacacactaacatttataccaaattgcagattattctgcagagagggaattgcatgtttgtgttgtatatttagtatgaacttttttcagaatataatatttcttagttatcaaaagtagttggaaaacatttgcaagactatgaacatagaattgctgcttttatattttaactgcagattgtgaatttcactgccttatattatttatttctgaaacaaaagaggcatttttcaataaaactactgaaaatttga

SEQ ID NO: 299403 - DNA, 6695 bp, Homo sapiens
ccgtttatactgaaggtgatgggggacgcacatctaacagcctgactgttaagtgggatcctgctagtggtcgtgtgcagaaatataggatcacttatcagccttccacaggggaaggcaatgagcaaacgaccacaataggaggacggcagaacagtgtggtcctgcagaaactgaagccagacactccttacactatcaccgtatcctctctgtatcctgatggtgaaggaggtcggatgacgggaagaggcaagaccaaacctctaaacactgtaaggaacctgagagtgtatgacccttctaccagcacctctgaatgtccgctgggaccatgcagagggaaatcctcgtcagtacaagctcttctatgcaccagcagcaggtggtccagaggaactggtaccaatccccgggaataccaattatgccattcttaggaatctgcagccagatacctcatacactgtgactgtagttcccgtttatactgaaggtgatgggggacgcacatcagatactggaaggacattgatgagaggactggcaagaaatgtccaagtatacaatcctacacctaacaggctcggtgttcgctgggaccctgcaccaggacctgtgctgcaatatcgcgttgtgtattctcctgtggatggcacaagaccctcagaatctatagtagtgccaggaaacacgcgcatggtgcatctggagcggctgattccggacacactctattccgtgaaccttgtggctctgtactcggatggagagggaaatcccagccctgcccagggccgaacgctaccacgcagtggaccaaggaacctgagagtctttggtgaaacaaccaatagcctctcggtagcctgggatcatgctgatgggccagttcagcagtacaggatcatctattctcccactgttggtgatccaattgatgaatataccacagtcccaggcagaagaaacaatgtaatactgcagcccctgcaacctgacactccatataaaattactgttattgctgtttatgaagatggagatggtggccatctaacaggaaatggaagaactgtgggactccttcctcctcagaacatacacatctctgacgaatggtatacaagattcagggtgtcctgggatccttcaccttctccagttcttggatataaaatagtatataagccagtgggttccaatgagcccatggaagcctttgttggagaaatgacatcatataccttacacaatctcaatcccagcaccacctacgatgtgaatgtttatgctcaatatgattctggactcagtgtccccttgacagatcaaggcactacattatatttaaatgtaacagatctgaaaacttaccagattgggtgggatacattctgtgtcaaatggtcacctcaccgggcagccacctcctacaggctaaaactaagccctgcagatggaacaaggggacaagaaattacagtgcgtggatcagaaaccagtcactgcttcactggcctttcaccagacactgattatggtgtcactgtttttgtgcagacaccaaatctcgagggaccaggagtctctgttaaagaacataccagtaagtttttgaggaatctggaaagctttcataaggctttagaatagaatgctctaggtaaggaagacttaagtgaatcctgtgcaggtacctctccgtaggggtagcaataatgatgggatgatggcagattcctgaatgtggagtctaaagctggttcaggacctttttctgtagcaatttgcaagttgtccctgttattgagttggtgctactttgaggaagggctaaaggagggagagatggctctcgctgagaaggtgaattcatattagtgacttttactcatttgaccctatctgaaggccttacattttccctttagatctttattttctgtagctgtagtggatgttgaatgactaccagtgacatcaatttggatggaataaaatccccagcatgtcagtaccgatgacaatggtgtctcattttgtacaacttgatttggtatccaggatttaaattgctcttaaaatttactttctgggatatcaaatgtgcacatggtgtgtttttataattattatttttaaattttagctgtgaaaccaacagaagcccctacagagccacccacacctcctccccctcccaccattccaccagcccgggatgtatgcaaaggggccaaggcagatattgtgttcttgactgatgcctcctggagcattggggacgataattttaacaaagttgtaaaattcatcttcaatactgtgggaggctttgatgaaatcagtcctgctgggattcaggtttcatttgtgcaatacagcgatgaggtcaagtctgagttcaagctgaacacgtacaatgacaaggccctagcccttggggccctccagaatattaggtacagaggaggaaacacaagaacaggcaaggccctcacgtttatcaaggagaaagtcttgacttgggagagcggcatgaggaagaatgtccctaaggtgttggttgtggtcacggacggtcggtcccaggatgaggtcaagaaggcggctttggtcatccagcagtcagggttcagtgtctttgtagttggtgtggctgatgtcgactacaatgagcttgccaacattgccagcaaaccaagtgaacggcacgtgttcattgtggacgactttgaatcttttgagaagatcgaagacaatcttattacatttgtttgtgaaactgccacttcaagttgtcctctcatttatttggatggctacacctcaccaggttttaaaatgcttgaagcatacaacctgacagaaaagaattttgcttctgtacaaggagtatctttggagtcagggtctttccccagctactcagcatacaggattcagaagaatgcgtttgtgaatcagcctacagcagacctacacccaaatggactccctccttcatacacgattatattattattcagacttctcccagaaactcccagtgacccttttgcaatttggcaaatcacagacagagactacaaaccacaagttggagtgattgcagatccttctagcaagacgttatcattctttaacaaggatacaagaggcgaggtgcaaactgttacatttgacacagaagaagtaaagacattattttatggaagttttcacaaggttcatattgtagtgacctcaaaaagtgttaagatttacattgactgctatgaaattatagaaaaagacatcaaggaagctggaaatataacaactgatggttatgaaattcttggaaaactccttaaaggggaaaggaaatcagccgcattccaaatccagagttttgacattgtctgcagtccagtgtggaccagtagagacagatgctgtgatattccctctaggagagatgagggaaaatgccctgcttttccaaattcttgcacatgtacacaggacagcgttggacctccaggacctccaggccctgcaggaggacctggtgctaaaggtcccagaggtgaaagaggtatcagtggggcaattgggccccctggtcctcgtggagacataggtcctccaggcccccagggtcctccaggccctcagggacccaatggactctctattccgggagagcaaggtcgccaagggatgaaaggtgatgctggagagccaggacttccaggccgaacaggaaccccaggattacctggcccaccaggaccaatgggacctccaggagacagaggcttcactggaaaagacggtgcaatgggacccaggggcccaccagggcggccgggaagcccaggctccccaggagtcacaggaccaagtgggaagccaggaaaacctggagatcatggcagaccaggtccatctgggttgaaaggagaaaaaggtgataggggagacattgcttcccagaacatgatgcgagcagttgcaagacaagtctgtgaacaattgataagtggtcagatgaacagattcaatcagatgctgaatcagattccaaatgattaccagtccagtcgcaaccagccaggcccgccgggtccaccgggacctcctggtagcgcaggagccagaggagaacctgggcctggggggcggccaggcttcccgggcacaccagggatgcagggaccccctggggaacgaggtttgccaggagagaaaggtgaaaggggtactggatcttcaggacctcgggggctgcctgggcccccaggtccacaaggagaatccagaacaggtccaccagggtccacaggttcaagaggtccccctggcccccctggccgtcctggaaactcaggtatccgaggacccccaggtcctcctggatactgtgattcttctcagtgtgccagcatcccatacaacgggcaaagctatccaggttccggctaacacattttctaagtcgccagtgctgcttacagtttgaatacatgaaaatcctgtttctgagatgtttgcgcacgtgcttattaggaaatgagtctgtatggaaatctcaccacagataatggttaacgaaccgggtcgacatcacaaaggagggtggagactctttttactaacttgaatgagacaaaagcagtggtgtcagtttataatcctgatgcatttcagtaataatgtagaaaaacattattttaaaaaagttccaacacacagccatgaggagcctcagttttgaaagaggtgcataataaaactactaaccagaggagtctatgccattttaagaaaaacaattaacctggttaaagagaaatgtcttatgtaaataataaactaattgtggcttgtaaatgatttgtatgtgatcctgtcgactaaaatcacttaacaattctacaataagcttctgcatcaaagcctgccgcttgctctatgccggaataacaccaaatggaatctcctcatctcttgcttgttagcgatgtgtctgattcagggcatctgtctttttgttacttttttgtccgtgtcctctcatttgggttttgtaactgcaattttcaaaccaaagtttaaaatcaccttttcttcctgttttgctgtagtcactggtgttcctcacccaccagctgtaactcagtttgtgtgaggtacagccacagaagatgtcatgtactgtatattacctggtgatagttgcttttcaccccccgagttcagtttctaggagccaatgaaacttcccctcacctcctcatctttccaagttgttctttgaattgaggagtttgaaggcataaacagttacttggggatttgcgaaaatcctacttagttactgcgtttacagttctttggcccagtctctgacccttcccaagtatttgtgcaatgattgtgtttactgctggatttttgaaggtttttttttttaagaaagtgccatttcattatttgattatcaccaaattatctggaaataattgggacattgtaacttatctatttatagttatgagattaagactggagtgccatcaccgcgggtgatgatttagcttttgctgtgtgtgtgtgtgtgtgtgtgccttccaaatcatgccataattgtaatgttgaatcggacagagccttacgtgcccgaggcggggcctacctgcctgagcgcgacccttcatcgtgccggtggagcccgagcggacagcggaatacgaggactacggcgcagacgagcctgcagaggagcctcctgagccccaccggcgctggcggcggccctgccccacggacccgggcagtgaaccagagatcacgcgccgcgccgcgaggcttgggggaggtgttgaaattctcatttacaggtcagatagagcagtgtacgtcttttctgaggtgtttcttccagcgttgctcatccaggagtaccctttctgattgtagagaaccttgtttctgcaggaagcctagctccaagcacgcagtctgtagacatttttgcctttgcccttgaaatgcttgcaaaatactttgttaacaaaagctgcaaagagagaacatgccgtgtgcctttagttagcacagcgggcagcctcagtgaaactcttaggttaagcagttaagtcctggaacccagagctgctgtgtatttcgagcgggcagtttatcttttgctatacttattttcaattcaattacaccacgattcaaataattcccctcctaaaaccaaaaaggagggaaacgtcaactccattgcaattacttatcttcctcttctatctctgttatacgccggggcatagaatgctcgtatacatctctttaacaaccacaaaccttaagccatgtagatgaagttagtgcatcaacgggatacagttccatattgccttaaacctccttgttttagacacactaacatttataccaaattgcagattattctgcagagagggaattgcatgtttgtgttgtatatttagtatgaacttttttcagaatataatatttcttagttatcaaaagtagttggaaaacatttgcaagactatgaacatagaattgctgcttttatattttaactgcagattgtgaatttcactgccttatattatttatttctgaaacaaaagaggcatttttcaataaaactactgaaaatttga

SEQ ID NO: 299404 - DNA, 4250 bp, Homo sapiens
  misc_feature (1)..(1): n is a, c, g, or t
ngcggtagtcgctgacctggatgtgctgcacctggatggcgtgctgggggtagggctgaggatcatggagctggccaacatccacagtggactgctgtgactggtgaggggaagtggccgaggccacttgaaccacttgcagctgtatgtgctgaggtcaagaaggcggctttggtcatccagcagtcagggttcagtgtctttgtagttggtgtggctgatgtcgactacaatgagcttgccaacattgccagcaaaccaagtgaacggcacgtgttcattgtggacgactttgaatcttttgagaagatcgaagacaatcttattacatttgtttgtgaaactgccacttcaagttgtcctctcatttatttggatggctacacctcaccaggttttaaaatgcttgaagcatacaacctgacagaaaagaattttgcttctgtacaaggagtatctttggagtcagggtctttccccagctactcagcatacaggattcagaagaatgcgtttgtgaatcagcctacagcagacctacacccaaatggactccctccttcatacacgattatattattattcagacttctcccagaaactcccagtgacccttttgcaatttggcaaatcacagacagagactacaaaccacaagttggagtgattgcagatccttctagcaagacgttatcattctttaacaaggatacaagaggcgaggtgcaaactgttacatttgacacagaagaagtaaagacattattttatggaagttttcacaaggttcatattgtagtgacctcaaaaagtgttaagatttacattgactgctatgaaattatagaaaaagacatcaaggaagctggaaatataacaactgatggttatgaaattcttggaaaactccttaaaggggaaaggaaatcagccgcattccaaatccagagttttgacattgtctgcagtccagtgtggaccagtagagacagatgctgtgatattccctctaggagagatgagggaaaatgccctgcttttccaaattcttgcacatgtacacaggacagcgttggacctccaggacctccaggccctgcaggaggacctggtgctaaaggtcccagaggtgaaagaggtatcagtggggcaattgggccccctggtcctcgtggagacataggtcctccaggcccccagggtcctccaggccctcagggacccaatggactctctattccgggagagcaaggtcgccaagggatgaaaggtgatgctggagagccaggacttccaggccgaacaggaaccccaggattacctggcccaccaggaccaatgggacctccaggagacagaggcttcactggaaaagacggtgcaatgggacccaggggcccaccagggcggccgggaagcccaggctccccaggagtcacaggaccaagtgggaagccaggaaaacctggagatcatggcagaccaggtccatctgggttgaaaggagaaaaaggtgataggggagacattgcttcccagaacatgatgcgagcagttgcaagacaagtctgtgaacaattgataagtggtcagatgaacagattcaatcagatgctgaatcagattccaaatgattaccagtccagtcgcaaccagccaggcccgccgggtccaccgggacctcctggtagcgcaggagccagaggagaacctgggcctggggggcggccaggcttcccgggcacaccagggatgcagggaccccctggggaacgaggtttgccaggagagaaaggtgaaaggggtactggatcttcaggacctcgggggctgcctgggcccccaggtccacaaggagaatccagaacaggtccaccagggtccacaggttcaagaggtccccctggcccccctggccgtcctggaaactcaggtatccgaggacccccaggtcctcctggatactgtgattcttctcagtgtgccagcatcccatacaacgggcaaagctatccaggttccggctaacacattttctaagtcgccagtgctgcttacagtttgaatacatgaaaatcctgtttctgagatgtttgcgcacgtgcttattaggaaatgagtctgtatggaaatctcaccacagataatggttaacgaaccgggtcgacatcacaaaggagggtggagactctttttactaacttgaatgagacaaaagcagtggtgtcagtttataatcctgatgcatttcagtaataatgtagaaaaacattattttaaaaaagttccaacacacagccatgaggagcctcagttttgaaagaggtgcataataaaactactaaccagaggagtctatgccattttaagaaaaacaattaacctggttaaagagaaatgtcttatgtaaataataaactaattgtggcttgtaaatgatttgtatgtgatcctgtcgactaaaatcacttaacaattctacaataagcttctgcatcaaagcctgccgcttgctctatgccggaataacaccaaatggaatctcctcatctcttgcttgttagcgatgtgtctgattcagggcatctgtctttttgttacttttttgtccgtgtcctctcatttgggttttgtaactgcaattttcaaaccaaagtttaaaatcaccttttcttcctgttttgctgtagtcactggtgttcctcacccaccagctgtaactcagtttgtgtgaggtacagccacagaagatgtcatgtactgtatattacctggtgatagttgcttttcaccccccgagttcagtttctaggagccaatgaaacttcccctcacctcctcatctttccaagttgttctttgaattgaggagtttgaaggcataaacagttacttggggatttgcgaaaatcctacttagttactgcgtttacagttctttggcccagtctctgacccttcccaagtatttgtgcaatgattgtgtttactgctggatttttgaaggtttttttttttaagaaagtgccatttcattatttgattatcaccaaattatctggaaataattgggacattgtaacttatctatttatagttatgagattaagactggagtgccatcaccgcgggtgatgatttagcttttgctgtgtgtgtgtgtgtgtgtgtgccttccaaatcatgccataattgtaatgttgaatcggacagagccttacgtgcccgaggcggggcctacctgcctgagcgcgacccttcatcgtgccggtggagcccgagcggacagcggaatacgaggactacggcgcagacgagcctgcagaggagcctcctgagccccaccggcgctggcggcggccctgccccacggacccgggcagtgaaccagagatcacgcgccgcgccgcgaggcttgggggaggtgttgaaattctcatttacaggtcagatagagcagtgtacgtcttttctgaggtgtttcttccagcgttgctcatccaggagtaccctttctgattgtagagaaccttgtttctgcaggaagcctagctccaagcacgcagtctgtagacatttttgcctttgcccttgaaatgcttgcaaaatactttgttaacaaaagctgcaaagagagaacatgccgtgtgcctttagttagcacagcgggcagcctcagtgaaactcttaggttaagcagttaagtcctggaacccagagctgctgtgtatttcgagcgggcagtttatcttttgctatacttattttcaattcaattacaccacgattcaaataattcccctcctaaaaccaaaaaggagggaaacgtcaactccattgcaattacttatcttcctcttctatctctgttatacgccggggcatagaatgctcgtatacatctctttaacaaccacaaaccttaagccatgtagatgaagttagtgcatcaacgggatacagttccatattgccttaaacctccttgttttagacacactaacatttataccaaattgcagattattctgcagagagggaattgcatgtttgtgttgtatatttagtatgaacttttttcagaatataatatttcttagttatcaaaagtagttggaaaacatttgcaagactatgaacatagaattgctgcttttatattttaactgcagattgtgaatttcactgccttatattatttatttctgaaacaaaagaggcatttttcaataaaactactgaaaatttga

SEQ ID NO: 299405 - DNA, 1939 bp, Homo sapiens
ggtaccccgtttattatttacataagacatttctctttaacccggttaattgtttttcttaaaatggcatagactcctctggttagtagttttatgtaaataataaactaattgtggcttgtaaatgatttgtatgtgatcctgtcgactaaaatcacttaacaattctacaataagcttctgcatcaaagcctgccgcttgctctatgccggaataacaccaaatggaatctcctcatctcttgcttgttagcgatgtgtctgattcagggcatctgtctttttgttacttttttgtccgtgtcctctcatttgggttttgtaactgcaattttcaaaccaaagtttaaaatcaccttttcttcctgttttgctgtagtcactggtgttcctcacccaccagctgtaactcagtttgtgtgaggtacagccacagaagatgtcatgtactgtatattacctggtgatagttgcttttcaccccccgagttcagtttctaggagccaatgaaacttcccctcacctcctcatctttccaagttgttctttgaattgaggagtttgaaggcataaacagttacttggggatttgcgaaaatcctacttagttactgcgtttacagttctttggcccagtctctgacccttcccaagtatttgtgcaatgattgtgtttactgctggatttttgaaggtttttttttttaagaaagtgccatttcattatttgattatcaccaaattatctggaaataattgggacattgtaacttatctatttatagttatgagattaagactggagtgccatcaccgcgggtgatgatttagcttttgctgtgtgtgtgtgtgtgtgtgtgccttccaaatcatgccataattgtaatgttgaatcggacagagccttacgtgcccgaggcggggcctacctgcctgagcgcgacccttcatcgtgccggtggagcccgagcggacagcggaatacgaggactacggcgcagacgagcctgcagaggagcctcctgagccccaccggcgctggcggcggccctgccccacggacccgggcagtgaaccagagatcacgcgccgcgccgcgaggcttgggggaggtgttgaaattctcatttacaggtcagatagagcagtgtacgtcttttctgaggtgtttcttccagcgttgctcatccaggagtaccctttctgattgtagagaaccttgtttctgcaggaagcctagctccaagcacgcagtctgtagacatttttgcctttgcccttgaaatgcttgcaaaatactttgttaacaaaagctgcaaagagagaacatgccgtgtgcctttagttagcacagcgggcagcctcagtgaaactcttaggttaagcagttaagtcctggaacccagagctgctgtgtatttcgagcgggcagtttatcttttgctatacttattttcaattcaattacaccacgattcaaataattcccctcctaaaaccaaaaaggagggaaacgtcaactccattgcaattacttatcttcctcttctatctctgttatacgccggggcatagaatgctcgtatacatctctttaacaaccacaaaccttaagccatgtagatgaagttagtgcatcaacgggatacagttccatattgccttaaacctccttgttttagacacactaacatttataccaaattgcagattattctgcagagagggaattgcatgtttgtgttgtatatttagtatgaacttttttcagaatataatatttcttagttatcaaaagtagttggaaaacatttgcaagactatgaacatagaattgctgcttttatattttaactgcagattgtgaatttcactgccttatattatttatttctgaaacaaaagaggcatttttcaataaaactactgaaaatttga

SEQ ID NO: 299406 - DNA, 1212 bp, Homo sapiens
ccgtttatactgaaggtgatgggggacgcacatctaacagcctgactgttaagtgggatcctgctagtggtcgtgtgcagaaatataggatcacttatcagccttccacaggggaaggcaatgagcaaacgaccacaataggaggacggcagaacagtgtggtcctgcagaaactgaagccagacactccttacactatcaccgtatcctctctgtatcctgatggtgaaggaggtcggatgacgggaagaggcaagaccaaacctctaaacactgtaaggaacctgagagtgtatgacccttctaccagcacctctgaatgtccgctgggaccatgcagagggaaatcctcgtcagtacaagctcttctatgcaccagcagcaggtggtccagaggaactggtaccaatccccgggaataccaattatgccattcttaggaatctgcagccagatactcatccaggagtaccctttctgattgtagagaaccttgtttctgcaggaagcctagctccaagcacgcagtctgtagacatttttgcctttgcccttgaaatgcttgcaaaatactttgttaacaaaagctgcaaagagagaacatgccgtgtgcctttagttagcacagcgggcagcctcagtgaaactcttaggttaagcagttaagtcctggaacccagagctgctgtgtatttcgagcgggcagtttatcttttgctatacttattttcaattcaattacaccacgattcaaataattcccctcctaaaaccaaaaaggagggaaacgtcaactccattgcaattacttatcttcctcttctatctctgttatacgccggggcatagaatgctcgtatacatctctttaacaaccacaaaccttaagccatgtagatgaagttagtgcatcaacgggatacagttccatattgccttaaacctccttgttttagacacactaacatttataccaaattgcagattattctgcagagagggaattgcatgtttgtgttgtatatttagtatgaacttttttcagaatataatatttcttagttatcaaaagtagttggaaaacatttgcaagactatgaacatagaattgctgcttttatattttaactgcagattgtgaatttcactgccttatattatttatttctgaaacaaaagaggcatttttcaataaaactactgaaaatttga

SEQ ID NO: 299407 - DNA, 8847 bp, Homo sapiens
  misc_feature (2424)..(2424): n is a, c, g, or t
  misc_feature (2554)..(2554): n is a, c, g, or t
gcggccgccaggtgctcctggagtgcagcgcctatcgccggggcgtgtgggggccacaccgagcaccagcttctccgacgccgggaagccgctgtcgccgccgctacctctccctgttgccgccgcctcagatctcttcatgccgctgtaagctcggaggccaaggatgcggagtaggcttcccccagcgcttgccgccctgggcgcggccctactcctgtcttccattgaggcagaagttgacccaccttcagacttgaattttaaaattatagatgaaaatactgttcatatgtcatgggcaaaaccagttgatccaattgtgggttacagaataacggtggaccctacaacggatgggcctactaaagaatttaccctttcagctagtaccactgaaactttattgtcagaacttgtacctgaaacagagtatgtggtgacaataacttcatatgatgaagtagaagaaagtgtaccagttataggacaactaacaattcaaacaggtagttcgacaaagccagtggagaagaaacctggaaaaaccgagatacaaaaatgctctgtcagtgcctggactgatttggttttcctcgtggatggctcttggagtgtgggaagaaataatttcaagtacattttagacttcattgctgctcttgtgtctgcttttgacattggggaagagaagacaagagttggagttgttcaatacagctctgacaccaggactgaatttaacttaaatcagtactaccaaagggatgaacttcttgctgcaataaaaaaaattccatataaaggtggcaacacaatgacaggggatgccattgattatttagttaaaaatactttcacggaatctgctggggcaagagttggctttcctaaagtggcaattattattacggatggaaaatcccaggatgaagtggaaattccagcaagagagcttcgtaatgttggagttgaagttttctccttgggcattaaagctgcagatgcaaaagaactcaaacaaattgcctccacaccttcactgaaccatgttttcaatgtggccaactttgatgcaattgtggatattcagaatgagatcatctcccaggtgtgctcaggtgttgatgaacaacttggtgaattggttagtggagaagaagttgttgagcctccttcaaatttgattgccatggaagtctcttcaaaatatgttaagctaaattggaatccatctcctagtccagtgactggctacaaagtcatcctcacaccaatgactgcaggaagccgacagcacgctctgagtgtggggcctcagacaaccacgctcagtgttcgcgacctctcagcagacacagaataccagatcagtgtttccgccatgaagggaatgacatccagtgaacccatttcaataatggagaagactcagccaatgaaagttcaagtggaatgctcacgtggtgtggatataaaagccgatattgtgtttttggttgatggctcctatagcattgggattgcaaactttgttaaagttagagcctttttggaagttcttgtaaaaagttttgaaatttcaccaaatagggtccagattagtcttgtgcaatacagccgggatcctcatactgagttcactttgaaaaaattcaccaaagttgaagatataattgaagcaataaacaccttcccttacagaggaggatctacaaatactggcaaagcaatgacttatgtcagagagaaaatatttgtgcctagcaagggatcaagaagcaatgtgccaaaggtcatgattcttatcacggatgggaaatcatcagatgctttcagagatcctgcgataaaactgaggaattcagatgttgaaatctttgcagttggtgtgaaggatgccgttcgctcagaattggaagctattgcctctcctcctgcagagacccatgtgttcacagtggaagattttgatgcttttcagaggatatcttttgaactcacacagtctatctgccttagaattgagcaagaattggcagctataaagaagaaagcttacgtccctccaaaggatcttagtttttcagaagtgacttcttatggtttcaaaaccaactggtctccagctggagaaaatgttttttcatatcacatcacctacaaggaagcggctggggatgatgaggtcactgtggtggagccagcatcgagcaccagtgttgttctcagcagcctgaagccagagaccttgtatttggtcaatgtgactgcggagtatgaggatggcttcagcattcccttagctggagaggagaccaccgaagaagtaaaaggagcacctcgaaacctaaaggtgacagatgagactacagatagtttcaaaattacttggactcaagctccagggagagttttaagatntcgaattatatatagaccagttgctggtggagagagcagagaagttaccaccccacccaatcagaggaggagaacactggagaacttgattccagacacgaaatatgaagtatctgtaattcctgaatanttctcaggacctggtactccattaactggaaatgcagccactgaagaagttagagggaatccaagagacttaagagtttctgaccctacgacgtctactatgaaattatcttggagtggggcaccaggaaaagtgaaacagtatctcgtcacatataccccagtggcagggggtgaaactcaagaggtcactgtgaggggagatacaaccaatacggtgctgcagggattgaaggaagggacacaatacgccttatctgtgacagcactgtatgcgtctggggctggcgacgccctctttggtgaaggaacaacacttgaagaacgtggttctcctcaagatttagttactaaagacatcactgacacatcaattggggcttattggacatctgctccaggaatggttcgcggttacagggtctcatggaaatcactttatgatgatgttgacactggagagaaaaatctgcctgaagatgcaattcatacgatgatagaaaatctgcagccagagaccaaatacagaatttcagtatttgccacttacagcagtggagaaggagaacctttgactggagatgccacaactgaattatctcaagattccaaaaccctgaaagtagatgaagaaacagaaaacacaatgagagttacatggaaaccagcaccagggaaagtcgtcaactaccgtgttgtctatcgccctcatgggagagggaagcaaatggttgctaaggtgccccccacagtcacttcgacagtgttaaagcgacttcagccacagaccacatatgacatcacagttcttcctatttacaagatgggagaaggaaagcttaggcaaggatcaggaacaacagcttctcggtttaagtctcctagaaacctcaaaacatctgacccaaccatgtcaagcttccgagtgacttgggagcctgcccctggggaagtgaagggttataaagtcacattccaccctacgggggatgacagaagactgggggagttagtggttggaccctatgacaacacagttgttttggaggaacttagggctggtaccacctataaagtaaatgtttttggaatgtttgatggaggagaaagctcaccacttgttggacaagaaatgacaaccctttccgacacaactgttatgccaattttatcttctgggatggagtgtctcaccagagctgaggcagacattgtgttgctggtggatggatcatggagcatcggccgggcaaattttagaaccgtgaggagtttcatttctcgtattgtggaagtctttgacattggccccaaaagagtacaaattgctcttgctcagtatagtggggatcccagaacagagtggcagttaaatgcacacagagacaagaagagcttgttgcaagctgtggcaaacttgccgtacaaaggaggcaatactctcacaggcatggctttgaatttcattcgccaacagaacttcaggacccaagctggcatgagacctcgagctcgaaaaattggtgtgctcattactgatggaaaatcacaagacgatgttgaagcaccttcaaagaaactcaaggatgagggagtggagctgtttgctattggtattaaaaatgctgatgaagtcgaattaaagatgattgcaactgatcctgatgatacccatgactacaatgtggcagattttgagtcactctccaggatagtggatgatctcaccattaatttgtgtaacagtgtcaaaggtccaggtgatttggaagcaccttctaacttagttatttctgagcgaacccatcgttcttttagagtgagctggacaccaccttctgacagtgtggatcgatataaggtggaatactatccagtttctggagggaaacgtcaagaattttatgtgagtcgaatggaaactagcacagtgctgaaagatctgaaacctgaaactgaatatgttgtcaatgtgtattctgtggtagaagatgaatatagtgagcctctgaaggggacagaaaaaaccttgccagtgcctgtagtcagcctgaatatttatgatgttggccctaccaccatgcatgtgcagtggcagcctgtgggaggagctactggctacatcttgtcatacaaacctgttaaggacacagagccaacaagacccaaagaggtgcgtttggggccaacagtgaatgacatgcagctgactgaccttgttcccaacacggagtatgcagtcacagtccaggctgtcctgcacgacctcactagtgaacctgtcactgttcgggaagtcaccttgcctttacccagacctcaggatctgaaactcagagatgtgactcacagcactatgaatgtcttttgggaacctgtgcctggaaaagtgcgtaaatatattgttcgatacaaaacaccagaagaggatgtcaaagaggtagaggtggacagatcagagaccagcacttccctcaaagacctcttctcacagaccttgtacacagtcagcgtttctgcagtacatgacgagggggagtctcctccagtgactgctcaagaaactacccgacccgtgccagccccaacaaacttaaagattactgaagtaacatcagagggtttcagagggacttgggatcatggagcttcagatgtgtctctctacagaataacttggggaccttttggaagctcagataagatggagaccatcttaaatggagatgaaaacactttggtgttcgaaaacctgaaccccaacaccatctatgaagtttccattactgccatctatcctgatgagtcagaaagtgatgacctgattggcagtgagcgcacactgcctatcttaacaacacaagctcccaaaagtgggccacgaaaccttcaagtgtacaatgcaacatctaacagcctgactgttaagtgggatcctgctagtggtcgtgtgcagaaatataggatcacttatcagccttccacaggggaaggcaatgagcaaacgaccacaataggaggacggcagaacagtgtggtcctgcagaaactgaagccagacactccttacactatcaccgtatcctctctgtatcctgatggtgaaggaggtcggatgacgggaagaggcaagaccaaacctctaaacactgtaaggaacctgagagtgtatgacccttctaccagcacctctgaatgtccgctgggaccatgcagagggaaatcctcgtcagtacaagctcttctatgcaccagcagcaggtggtccagaggaactggtaccaatccccgggaataccaattatgccattcttaggaatctgcagccagatacctcatacactgtgactgtagttcccgtttatactgaaggtgatgggggacgcacatcagatactggaaggacattgatgagaggactggcaagaaatgtccaagtatacaatcctacacctaacaggctcggtgttcgctgggaccctgcaccaggacctgtgctgcaatatcgcgttgtgtattctcctgtggatggcacaagaccctcagaatctatagtagtgccaggaaacacgcgcatggtgcatctggagcggctgattccggacacactctattccgtgaaccttgtggctctgtactcggatggagagggaaatcccagccctgcccagggccgaacgctaccacgcagtggaccaaggaacctgagagtctttggtgaaacaaccaatagcctctcggtagcctgggatcatgctgatgggccagttcagcagtacaggatcatctattctcccactgttggtgatccaattgatgaatataccacagtcccaggcagaagaaacaatgtaatactgcagcccctgcaacctgacactccatataaaattactgttattgctgtttatgaagatggagatggtggccatctaacaggaaatggaagaactgtgggactccttcctcctcagaacatacacatctctgacgaatggtatacaagattcagggtgtcctgggatccttcaccttctccagttcttggatataaaatagtatataagccagtgggttccaatgagcccatggaagcctttgttggagaaatgacatcatataccttacacaatctcaatcccagcaccacctacgatgtgaatgtttatgctcaatatgattctggactcagtgtccccttgacagatcaaggcactacattatatttaaatgtaacagatctgaaaacttaccagattgggtgggatacattctgtgtcaaatggtcacctcaccgggcagccacctcctacaggctaaaactaagccctgcagatggaacaaggggacaagaaattacagtgcgtggatcagaaaccagtcactgcttcactggcctttcaccagacactgattatggtgtcactgtttttgtgcagacaccaaatctcgagggaccaggagtctctgttaaagaacataccagtaagtttttgaggaatctggaaagctttcataaggctttagaatagaatgctctaggtaaggaagacttaagtgaatcctgtgcaggtacctctccgtaggggtagcaataatgatgggatgatggcagattcctgaatgtggagtctaaagctggttcaggacctttttctgtagcaatttgcaagttgtccctgttattgagttggtgctactttgaggaagggctaaaggagggagagatggctctcgctgagaaggtgaattcatattagtgacttttactcatttgaccctatctgaaggccttacattttccctttagatctttattttctgtagctgtagtggatgttgaatgactaccagtgacatcaatttggatggaataaaatccccagcatgtcagtaccgatgacaatggtgtctcattttgtacaacttgatttggtatccaggatttaaattgctcttaaaatttactttctgggatatcaaatgtgcacatggtgtgtttttataattattatttttaaattttagctgtgaaaccaacagaagcccctacagagccacccacacctcctccccctcccaccattccaccagcccgggatgtatgcaaaggggccaaggcagatattgtgttcttgactgatgcctcctggagcattggggacgataattttaacaaagttgtaaaattcatcttcaatactgtgggaggctttgatgaaatcagtcctgctgggattcaggtttcatttgtgcaatacagcgatgaggtcaagtctgagttcaagctgaacacgtacaatgacaaggccctagcccttggggccctccagaatattaggtacagaggaggaaacacaagaacaggcaaggccctcacgtttatcaaggagaaagtcttgacttgggagagcggcatgaggaagaatgtccctaaggtgttggttgtggtcacggacggtcggtcccaggatgaggtcaagaaggcggctttggtcatccagcagtcagggttcagtgtctttgtagttggtgtggctgatgtcgactacaatgagcttgccaacattgccagcaaaccaagtgaacggcacgtgttcattgtggacgactttgaatcttttgagaagatcgaagacaatcttattacatttgtttgtgaaactgccacttcaagttgtcctctcatttatttggatggctacacctcaccaggttttaaaatgcttgaagcatacaacctgacagaaaagaattttgcttctgtacaaggagtatctttggagtcagggtctttccccagctactcagcatacaggattcagaagaatgcgtttgtgaatcagcctacagcagacctacacccaaatggactccctccttcatacacgattatattattattcagacttctcccagaaactcccagtgacccttttgcaatttggcaaatcacagacagagactacaaaccacaagttggagtgattgcagatccttctagcaagacgttatcattctttaacaaggatacaagaggcgaggtgcaaactgttacatttgacacagaagaagtaaagacattattttatggaagttttcacaaggtaaaaacataagattatttgagtcttatttctagaaaaaaatataaaacaaatttattatttattaaaatgtcatgttaaattggcagaattataactatgtcttttaaaaataaaatcttgttttagagaatttggttaattcaaataatatttaaaataaaacaatatactaatcaagagataa

SEQ ID NO: 299408 - DNA, 9110 bp, Homo sapiens
  misc_feature (2424)..(2424): n is a, c, g, or t
  misc_feature (2554)..(2554): n is a, c, g, or t
  misc_feature (7801)..(7801): n is a, c, g, or t
  misc_feature (7946)..(7946): n is a, c, g, or t
gcggccgccaggtgctcctggagtgcagcgcctatcgccggggcgtgtgggggccacaccgagcaccagcttctccgacgccgggaagccgctgtcgccgccgctacctctccctgttgccgccgcctcagatctcttcatgccgctgtaagctcggaggccaaggatgcggagtaggcttcccccagcgcttgccgccctgggcgcggccctactcctgtcttccattgaggcagaagttgacccaccttcagacttgaattttaaaattatagatgaaaatactgttcatatgtcatgggcaaaaccagttgatccaattgtgggttacagaataacggtggaccctacaacggatgggcctactaaagaatttaccctttcagctagtaccactgaaactttattgtcagaacttgtacctgaaacagagtatgtggtgacaataacttcatatgatgaagtagaagaaagtgtaccagttataggacaactaacaattcaaacaggtagttcgacaaagccagtggagaagaaacctggaaaaaccgagatacaaaaatgctctgtcagtgcctggactgatttggttttcctcgtggatggctcttggagtgtgggaagaaataatttcaagtacattttagacttcattgctgctcttgtgtctgcttttgacattggggaagagaagacaagagttggagttgttcaatacagctctgacaccaggactgaatttaacttaaatcagtactaccaaagggatgaacttcttgctgcaataaaaaaaattccatataaaggtggcaacacaatgacaggggatgccattgattatttagttaaaaatactttcacggaatctgctggggcaagagttggctttcctaaagtggcaattattattacggatggaaaatcccaggatgaagtggaaattccagcaagagagcttcgtaatgttggagttgaagttttctccttgggcattaaagctgcagatgcaaaagaactcaaacaaattgcctccacaccttcactgaaccatgttttcaatgtggccaactttgatgcaattgtggatattcagaatgagatcatctcccaggtgtgctcaggtgttgatgaacaacttggtgaattggttagtggagaagaagttgttgagcctccttcaaatttgattgccatggaagtctcttcaaaatatgttaagctaaattggaatccatctcctagtccagtgactggctacaaagtcatcctcacaccaatgactgcaggaagccgacagcacgctctgagtgtggggcctcagacaaccacgctcagtgttcgcgacctctcagcagacacagaataccagatcagtgtttccgccatgaagggaatgacatccagtgaacccatttcaataatggagaagactcagccaatgaaagttcaagtggaatgctcacgtggtgtggatataaaagccgatattgtgtttttggttgatggctcctatagcattgggattgcaaactttgttaaagttagagcctttttggaagttcttgtaaaaagttttgaaatttcaccaaatagggtccagattagtcttgtgcaatacagccgggatcctcatactgagttcactttgaaaaaattcaccaaagttgaagatataattgaagcaataaacaccttcccttacagaggaggatctacaaatactggcaaagcaatgacttatgtcagagagaaaatatttgtgcctagcaagggatcaagaagcaatgtgccaaaggtcatgattcttatcacggatgggaaatcatcagatgctttcagagatcctgcgataaaactgaggaattcagatgttgaaatctttgcagttggtgtgaaggatgccgttcgctcagaattggaagctattgcctctcctcctgcagagacccatgtgttcacagtggaagattttgatgcttttcagaggatatcttttgaactcacacagtctatctgccttagaattgagcaagaattggcagctataaagaagaaagcttacgtccctccaaaggatcttagtttttcagaagtgacttcttatggtttcaaaaccaactggtctccagctggagaaaatgttttttcatatcacatcacctacaaggaagcggctggggatgatgaggtcactgtggtggagccagcatcgagcaccagtgttgttctcagcagcctgaagccagagaccttgtatttggtcaatgtgactgcggagtatgaggatggcttcagcattcccttagctggagaggagaccaccgaagaagtaaaaggagcacctcgaaacctaaaggtgacagatgagactacagatagtttcaaaattacttggactcaagctccagggagagttttaagatntcgaattatatatagaccagttgctggtggagagagcagagaagttaccaccccacccaatcagaggaggagaacactggagaacttgattccagacacgaaatatgaagtatctgtaattcctgaatanttctcaggacctggtactccattaactggaaatgcagccactgaagaagttagagggaatccaagagacttaagagtttctgaccctacgacgtctactatgaaattatcttggagtggggcaccaggaaaagtgaaacagtatctcgtcacatataccccagtggcagggggtgaaactcaagaggtcactgtgaggggagatacaaccaatacggtgctgcagggattgaaggaagggacacaatacgccttatctgtgacagcactgtatgcgtctggggctggcgacgccctctttggtgaaggaacaacacttgaagaacgtggttctcctcaagatttagttactaaagacatcactgacacatcaattggggcttattggacatctgctccaggaatggttcgcggttacagggtctcatggaaatcactttatgatgatgttgacactggagagaaaaatctgcctgaagatgcaattcatacgatgatagaaaatctgcagccagagaccaaatacagaatttcagtatttgccacttacagcagtggagaaggagaacctttgactggagatgccacaactgaattatctcaagattccaaaaccctgaaagtagatgaagaaacagaaaacacaatgagagttacatggaaaccagcaccagggaaagtcgtcaactaccgtgttgtctatcgccctcatgggagagggaagcaaatggttgctaaggtgccccccacagtcacttcgacagtgttaaagcgacttcagccacagaccacatatgacatcacagttcttcctatttacaagatgggagaaggaaagcttaggcaaggatcaggaacaacagcttctcggtttaagtctcctagaaacctcaaaacatctgacccaaccatgtcaagcttccgagtgacttgggagcctgcccctggggaagtgaagggttataaagtcacattccaccctacgggggatgacagaagactgggggagttagtggttggaccctatgacaacacagttgttttggaggaacttagggctggtaccacctataaagtaaatgtttttggaatgtttgatggaggagaaagctcaccacttgttggacaagaaatgacaaccctttccgacacaactgttatgccaattttatcttctgggatggagtgtctcaccagagctgaggcagacattgtgttgctggtggatggatcatggagcatcggccgggcaaattttagaaccgtgaggagtttcatttctcgtattgtggaagtctttgacattggccccaaaagagtacaaattgctcttgctcagtatagtggggatcccagaacagagtggcagttaaatgcacacagagacaagaagagcttgttgcaagctgtggcaaacttgccgtacaaaggaggcaatactctcacaggcatggctttgaatttcattcgccaacagaacttcaggacccaagctggcatgagacctcgagctcgaaaaattggtgtgctcattactgatggaaaatcacaagacgatgttgaagcaccttcaaagaaactcaaggatgagggagtggagctgtttgctattggtattaaaaatgctgatgaagtcgaattaaagatgattgcaactgatcctgatgatacccatgactacaatgtggcagattttgagtcactctccaggatagtggatgatctcaccattaatttgtgtaacagtgtcaaaggtccaggtgatttggaagcaccttctaacttagttatttctgagcgaacccatcgttcttttagagtgagctggacaccaccttctgacagtgtggatcgatataaggtggaatactatccagtttctggagggaaacgtcaagaattttatgtgagtcgaatggaaactagcacagtgctgaaagatctgaaacctgaaactgaatatgttgtcaatgtgtattctgtggtagaagatgaatatagtgagcctctgaaggggacagaaaaaaccttgccagtgcctgtagtcagcctgaatatttatgatgttggccctaccaccatgcatgtgcagtggcagcctgtgggaggagctactggctacatcttgtcatacaaacctgttaaggacacagagccaacaagacccaaagaggtgcgtttggggccaacagtgaatgacatgcagctgactgaccttgttcccaacacggagtatgcagtcacagtccaggctgtcctgcacgacctcactagtgaacctgtcactgttcgggaagtcaccttgcctttacccagacctcaggatctgaaactcagagatgtgactcacagcactatgaatgtcttttgggaacctgtgcctggaaaagtgcgtaaatatattgttcgatacaaaacaccagaagaggatgtcaaagaggtagaggtggacagatcagagaccagcacttccctcaaagacctcttctcacagaccttgtacacagtcagcgtttctgcagtacatgacgagggggagtctcctccagtgactgctcaagaaactacccgacccgtgccagccccaacaaacttaaagattactgaagtaacatcagagggtttcagagggacttgggatcatggagcttcagatgtgtctctctacagaataacttggggaccttttggaagctcagataagatggagaccatcttaaatggagatgaaaacactttggtgttcgaaaacctgaaccccaacaccatctatgaagtttccattactgccatctatcctgatgagtcagaaagtgatgacctgattggcagtgagcgcacactgcctatcttaacaacacaagctcccaaaagtgggccacgaaaccttcaagtgtacaatgcaacatctaacagcctgactgttaagtgggatcctgctagtggtcgtgtgcagaaatataggatcacttatcagccttccacaggggaaggcaatgagcaaacgaccacaataggaggacggcagaacagtgtggtcctgcagaaactgaagccagacactccttacactatcaccgtatcctctctgtatcctgatggtgaaggaggtcggatgacgggaagaggcaagaccaaacctctaaacactgtaaggaacctgagagtgtatgacccttctaccagcacctctgaatgtccgctgggaccatgcagagggaaatcctcgtcagtacaagctcttctatgcaccagcagcaggtggtccagaggaactggtaccaatccccgggaataccaattatgccattcttaggaatctgcagccagatacctcatacactgtgactgtagttcccgtttatactgaaggtgatgggggacgcacatcagatactggaaggacattgatgagaggactggcaagaaatgtccaagtatacaatcctacacctaacaggctcggtgttcgctgggaccctgcaccaggacctgtgctgcaatatcgcgttgtgtattctcctgtggatggcacaagaccctcagaatctatagtagtgccaggaaacacgcgcatggtgcatctggagcggctgattccggacacactctattccgtgaaccttgtggctctgtactcggatggagagggaaatcccagccctgcccagggccgaacgctaccacgcagtggaccaaggaacctgagagtctttggtgaaacaaccaatagcctctcggtagcctgggatcatgctgatgggccagttcagcagtacaggatcatctattctcccactgttggtgatccaattgatgaatataccacagtcccaggcagaagaaacaatgtaatactgcagcccctgcaacctgacactccatataaaattactgttattgctgtttatgaagatggagatggtggccatctaacaggaaatggaagaactgtgggactccttcctcctcagaacatacacatctctgacgaatggtatacaagattcagggtgtcctgggatccttcaccttctccagttcttggatataaaatagtatataagccagtgggttccaatgagcccatggaagcctttgttggagaaatgacatcatataccttacacaatctcaatcccagcaccacctacgatgtgaatgtttatgctcaatatgattctggactcagtgtccccttgacagatcaaggcactacattatatttaaatgtaacagatctgaaaacttaccagattgggtgggatacattctgtgtcaaatggtcacctcaccgggcagccacctcctacaggctaaaactaagccctgcagatggaacaaggggacaagaaattacagtgcgtggatcagaaaccagtcactgcttcactggcctttcaccagacactgattatggtgtcactgtttttgtgcagacaccaaatctcgagggaccaggagtctctgttaaagaacataccagtaagtttttgaggaatctggaaagctttcataaggctttagaatagaatgctctaggtaaggaagacttaagtgaatcctgtgcaggtacctctccgtaggggtagcaataatgatgggatgatggcagattcctgaatgtggagtctaaagctggttcaggacctttttctgtagcaatttgcaagttgtccctgttattgagttggtgctactttgaggaagggctaaaggagggagagatggctctcgctgagaaggtgaattcatattagtgacttttactcatttgaccctatctgaaggccttacattttccctttagatctttattttctgtagctgtagtggatgttgaatgactaccagtgacatcaatttggatggaataaaatccccagcatgtcagtaccgatgacaatggtgtctcattttgtacaacttgatttggtatccaggatttaaattgctcttaaaatttactttctgggatatcaaatgtgcacatggtgtgtttttataattattatttttaaattttagctgtgaaaccaacagaagcccctacagagccacccacacctcctccccctcccaccattccaccagcccgggatggtaagtacagctaaataggcaatacgttcagctgatagggagttacagacttcttatttacgctgcatgtgcatcatttacaattaatatagaacatttctgatctattattgctgctgaagagtttttagattgaaagaaaagntaaccagtaatttgtttctctccatctctgggcacattttggtgtgaataaaatcagtcataaattattccagatcttcagctggaagtctgtttcctcagttttacagatttaggtcttccatggtccatagttacatggtggncatttctttctgctagctgctggcatcagtaagcgctgtgaacccttttggctatatttgcgaccgaagccctgaggctgttggctttaaaattcctggtgtccaacctgagaagttccctggattatacaatgctaaaaaattttccattcaccaaaatttgaaagataattgtaacttgcagtgaactggtgaaacgacatactgatttattaaggttgatctctcagcatttgagggcaattctctagcactttgtcaaattaaatttagttaaataactactgtattattcttttctcatatgctgtttccagcatttaatagaaagcatttcagatatttttattttatcttagaaggatgtcgaacgttacaacttcgttaaacctattatataagtaaaattaaaaattaaaagtgtattattgtggggtaaaataataatggattcctttaaattagatacagaaagaaattcagtaaataatcttggtttaaaaacaagttttttctttttaaataggctttattttctagagtagttttaggttcatagcaacattgcagggatgatgcagagatttttcatctcccagacagactgcccttccccacacatgcccagcctcctccactattaacatcccacatctgagtggtacgtttgttacaaccgatgaacctacattgacacatcatcaccacccaaagtccacagtttgcgttagggttcactcttggtgttatacttctatatgctaagtttttataaactaaaattttgttaattgtttttggaattttttcttagcctctaagtctagatattccaataaaaatcttctcctttcctgcatatgattctagtggcttaatttaaattttacaaaggacttggccaggtgcggtggctcacgcctgtaatcccagcactttgggaggccgggacaggtggatcgagaccatcatggccaacatggttaaacccgtctctgctaaaaatagagaaattagctgggcgtggtggcacatgcctgtagtcccagctactcaggaggctgaggcaggagaatcacttgaacctgggaggtggagtttgcagtgagccaagatcatcacaccactgcactccagcctgaagacagagcaagaccctgtcta

SEQ ID NO: 299409 - DNA, 5527 bp, Homo sapiens
  misc_feature (2424)..(2424): n is a, c, g, or t
  misc_feature (2554)..(2554): n is a, c, g, or t
gcggccgccaggtgctcctggagtgcagcgcctatcgccggggcgtgtgggggccacaccgagcaccagcttctccgacgccgggaagccgctgtcgccgccgctacctctccctgttgccgccgcctcagatctcttcatgccgctgtaagctcggaggccaaggatgcggagtaggcttcccccagcgcttgccgccctgggcgcggccctactcctgtcttccattgaggcagaagttgacccaccttcagacttgaattttaaaattatagatgaaaatactgttcatatgtcatgggcaaaaccagttgatccaattgtgggttacagaataacggtggaccctacaacggatgggcctactaaagaatttaccctttcagctagtaccactgaaactttattgtcagaacttgtacctgaaacagagtatgtggtgacaataacttcatatgatgaagtagaagaaagtgtaccagttataggacaactaacaattcaaacaggtagttcgacaaagccagtggagaagaaacctggaaaaaccgagatacaaaaatgctctgtcagtgcctggactgatttggttttcctcgtggatggctcttggagtgtgggaagaaataatttcaagtacattttagacttcattgctgctcttgtgtctgcttttgacattggggaagagaagacaagagttggagttgttcaatacagctctgacaccaggactgaatttaacttaaatcagtactaccaaagggatgaacttcttgctgcaataaaaaaaattccatataaaggtggcaacacaatgacaggggatgccattgattatttagttaaaaatactttcacggaatctgctggggcaagagttggctttcctaaagtggcaattattattacggatggaaaatcccaggatgaagtggaaattccagcaagagagcttcgtaatgttggagttgaagttttctccttgggcattaaagctgcagatgcaaaagaactcaaacaaattgcctccacaccttcactgaaccatgttttcaatgtggccaactttgatgcaattgtggatattcagaatgagatcatctcccaggtgtgctcaggtgttgatgaacaacttggtgaattggttagtggagaagaagttgttgagcctccttcaaatttgattgccatggaagtctcttcaaaatatgttaagctaaattggaatccatctcctagtccagtgactggctacaaagtcatcctcacaccaatgactgcaggaagccgacagcacgctctgagtgtggggcctcagacaaccacgctcagtgttcgcgacctctcagcagacacagaataccagatcagtgtttccgccatgaagggaatgacatccagtgaacccatttcaataatggagaagactcagccaatgaaagttcaagtggaatgctcacgtggtgtggatataaaagccgatattgtgtttttggttgatggctcctatagcattgggattgcaaactttgttaaagttagagcctttttggaagttcttgtaaaaagttttgaaatttcaccaaatagggtccagattagtcttgtgcaatacagccgggatcctcatactgagttcactttgaaaaaattcaccaaagttgaagatataattgaagcaataaacaccttcccttacagaggaggatctacaaatactggcaaagcaatgacttatgtcagagagaaaatatttgtgcctagcaagggatcaagaagcaatgtgccaaaggtcatgattcttatcacggatgggaaatcatcagatgctttcagagatcctgcgataaaactgaggaattcagatgttgaaatctttgcagttggtgtgaaggatgccgttcgctcagaattggaagctattgcctctcctcctgcagagacccatgtgttcacagtggaagattttgatgcttttcagaggatatcttttgaactcacacagtctatctgccttagaattgagcaagaattggcagctataaagaagaaagcttacgtccctccaaaggatcttagtttttcagaagtgacttcttatggtttcaaaaccaactggtctccagctggagaaaatgttttttcatatcacatcacctacaaggaagcggctggggatgatgaggtcactgtggtggagccagcatcgagcaccagtgttgttctcagcagcctgaagccagagaccttgtatttggtcaatgtgactgcggagtatgaggatggcttcagcattcccttagctggagaggagaccaccgaagaagtaaaaggagcacctcgaaacctaaaggtgacagatgagactacagatagtttcaaaattacttggactcaagctccagggagagttttaagatntcgaattatatatagaccagttgctggtggagagagcagagaagttaccaccccacccaatcagaggaggagaacactggagaacttgattccagacacgaaatatgaagtatctgtaattcctgaatanttctcaggacctggtactccattaactggaaatgcagccactgaagaagttagagggaatccaagagacttaagagtttctgaccctacgacgtctactatgaaattatcttggagtggggcaccaggaaaagtgaaacagtatctcgtcacatataccccagtggcagggggtgaaactcaagaggtcactgtgaggggagatacaaccaatacggtgctgcagggattgaaggaagggacacaatacgccttatctgtgacagcactgtatgcgtctggggctggcgacgccctctttggtgaaggaacaacacttgaagaacgtggttctcctcaagatttagttactaaagacatcactgacacatcaattggggcttattggacatctgctccaggaatggttcgcggttacagggtctcatggaaatcactttatgatgatgttgacactggagagaaaaatctgcctgaagatgcaattcatacgatgatagaaaatctgcagccagagaccaaatacagaatttcagtatttgccacttacagcagtggagaaggagaacctttgactggagatgccacaactgaattatctcaagattccaaaaccctgaaagtagatgaagaaacagaaaacacaatgagagttacatggaaaccagcaccagggaaagtcgtcaactaccgtgttgtctatcgccctcatgggagagggaagcaaatggttgctaaggtgccccccacagtcacttcgacagtgttaaagcgacttcagccacagaccacatatgacatcacagttcttcctatttacaagatgggagaaggaaagcttaggcaaggatcaggaacaacagcttctcggtttaagtctcctagaaacctcaaaacatctgacccaaccatgtcaagcttccgagtgacttgggagcctgcccctggggaagtgaagggttataaagtcacattccaccctacgggggatgacagaagactgggggagttagtggttggaccctatgacaacacagttgttttggaggaacttagggctggtaccacctataaagtaaatgtttttggaatgtttgatggaggagaaagctcaccacttgttggacaagaaatgacaaccctttccgacacaactgttatgccaattttatcttctgggatggagtgtctcaccagagctgaggcagacattgtgttgctggtggatggatcatggagcatcggccgggcaaattttagaaccgtgaggagtttcatttctcgtattgtggaagtctttgacattggccccaaaagagtacaaattgctcttgctcagtatagtggggatcccagaacagagtggcagttaaatgcacacagagacaagaagagcttgttgcaagctgtggcaaacttgccgtacaaaggaggcaatactctcacaggcatggctttgaatttcattcgccaacagaacttcaggacccaagctggcatgagacctcgagctcgaaaaattggtgtgctcattactgatggaaaatcacaagacgatgttgaagcaccttcaaagaaactcaaggatgagggagtggagctgtttgctattggtattaaaaatgctgatgaagtcgaattaaagatgattgcaactgatcctgatgatacccatgactacaatgtggcagattttgagtcactctccaggatagtggatgatctcaccattaatttgtgtaacagtgtcaaaggtccaggtgatttggaagcaccttctaacttagttatttctgagcgaacccatcgttcttttagagtgagctggacaccaccttctgacagtgtggatcgatataaggtggaatactatccagtttctggagggaaacgtcaagaattttatgtgagtcgaatggaaactagcacagtgctgaaagatctgaaacctgaaactgaatatgttgtcaatgtgtattctgtggtagaagatgaatatagtgagcctctgaaggggacagaaaaaaccttgccagtgcctgtagtcagcctgaatatttatgatgttggccctaccaccatgcatgtgcagtggcagcctgtgggaggagctactggctacatcttgtcatacaaacctgttaaggacacagagccaacaagacccaaagaggtgcgtttggggccaacagtgaatgacatgcagctgactgaccttgttcccaacacggagtatgcagtcacagtccaggctgtcctgcacgacctcactagtgaacctgtcactgttcgggaagtcaccttgcctttacccagacctcaggatctgaaactcagagatgtgactcacagcactatgaatgtcttttgggaacctgtgcctggaaaagtgcgtaaatatattgttcgatacaaaacaccagaagaggatgtcaaagaggtagaggtggacagatcagagaccagcacttccctcaaagacctcttctcacagaccttgtacacagtcagcgtttctgcagtacatgacgagggggagtctcctccagtgactgctcaagaaactacccgacccgtgccagccccaacaaacttaaagattactgaagtaacatcagagggtttcagagggacttgggatcatggagcttcagatgtgtctctctacagaataacttggggaccttttggaagctcagataagatggagaccatcttaaatggagatgaaaacactttggtgttcgaaaacctgaaccccaacaccatctatgaagtttccattactgccatctatcctgatgagtcagaaagtgatgacctgattggcagtgagcgcacactgcctatcttaacaacacaaggtaagaatttaatttgatgaattgtttgaatgaacaaataatgaatgaatgtataaatgaaaagtaccataagatacataataaataggtcatctgcttttaaatcctaa

SEQ ID NO: 299410 - DNA, 544 bp, Homo sapiens
  misc_feature (525)..(526): n is a, c, g, or t
gcggccgccaggtgctcctggagtgcagcgcctatcgccggggcgtgtgggggccacaccgagcaccagcttctccgacgccgggaagccgctgtcgccgccgctacctctccctgttgccgccgcctcagatctcttcatgccgctgtaagctcggaggccaaggatgcggagtaggcttcccccagcgcttgccgccctgggcgcggccctactcctgtcttccattgaggcagaagttgacccaccttcagacttgaattttaaaattatagatgaaaatactgttcatatgtcatgggcaaaaccagttgatccaattgtgggttacagaataacggtggaccctacaacggatgggcctactaaagaatttaccctttcagctagtaccactgaaactttattgtcagaacttgtacctgaaacagagtatgtggtgacaataacttcatatgatgaagtagaagaaagtgtaccagttataggacaactaacaattcaaacaggtttcttctccactgnntttgtcgaacctcgtgcc

SEQ ID NO: 299411 - DNA, 319 bp, Homo sapiens
cccaggatataactttgatgtagtgcacatgcataagtaaagtaacaaagtgtttttcaagtcatttttttaaataatgggttttgatgatgttgtcattttttaatgaagttagagggaatccaagagacttaagagtttctgaccctacgacgtctactatgaaattatcttggagtggggcaccaggaaaagtgaaacagtatctcgtcacatataccccagtggcagggggtgaaactcaagaggtcactgtgaggggagatacaaccaatacggtgctgcagggattgaaggaagggacacaatacgccttatc

SEQ ID NO: 299412 - DNA, 3767 bp, Homo sapiens
ggggacgcggcacagatagggggaagccggagtaatggttttcgggcaagtggatgttggagagcacacacaggagttggggggcgggggagggcctggggttggggagggctcgaactcggggctgctgggtagtccaggagggcgcggtaaggctggggtgtcctggtgagaactggagaggatctacccgggtccctgcctggccagtggggaaacaccggtcccccaggcaccttcacctaaccagagcggggatttccaccgcccctcatgccgccctttggaggaaagtgaaagtgaaaggaggaagaggaggcttcatggctgaggaggtcgcagcgccatgaagtccctgtctctgctcctcgctgtggctttgggcctggcgaccgccgtctcagcaggacccgcggtgatcgagtgttggttcgtggaggatgcgagcggaaagggcctggccaagagacccggtgcactgctgttgcgccagggaccgggggaaccgccgccccggccggacctcgaccctgagctctatctcagtgtacacgaccccgcgggcgccctccaggctgccttcaggcggtatccccggggcgcccccgcaccacactgcgagatgagccgcttcgtgcctctccccgcctctgcgaaatgggccagcggcctgacccccgcgcagaactgcccgcgggccctggatggggcttggctgatggtcagcatatccagcccagtcctcagcctctccagcctcttgcgaccacagccagagcctcagcaggagcctgttctcatcaccatggcaacagtggtactgactgtcctcacccacacccctgcccctcgagtgagactgggacaagatgctctgctggacttgagctttgcctacatgccccccacctccgaggccgcctcatctctggctccgggtccccctccctttgggctagagtggcgacgccagcacctgggtaagggacatctgctcctggctgcaactcctgggctgaatggccagatgccagcagcccaagaaggggccgtggcatttgctgcttgggatgatgatgagccatggggcccatggaccggaaatgggaccttctggctgcctagagttcaaccctttcaggagggcacctatctggccaccatacacctgccatacctgcaaggacaggtcaccctggagcttgctgtgtacaaaccccccaaagtgtccctgatgccagcaacccttgcacgggccgccccaggggaggcacccccggaattgctctgccttgtgtcccacttctacccttctgggggcctggaggtggagtgggaactccggggtggcccagggggccgctctcagaaggccgaggggcagaggtggctctcggccctgcgccaccattccgatggctctgtcagcctctctgggcacttgcagccgcccccagtcaccactgagcagcatggggcacgctatgcctgtcgaattcaccatcccagcctgcctgcctcggggcgcagcgctgaggtcaccctggaggtagcaggtctttcagggccctcccttgaggacagcgtaggccttttcctgtctgcctttcttctgcttgggctcttcaaggcactgggctgggctgctgtctacctgtccacctgcaaggattcaaagaagaaagcagagtgagggcactcactgccatcctgtggaagccaccatcatctctggcccaagcttctgtagtagctccctaaaataataccctatcatctgctcctaatccctccaatctctctccactgagtggctggaatgcttttttttttttctttcacttatataagggataatttttcttttttttttttttttgagacggagtctcacctcttccgcccaggctgcagtgcagtggcatgatcttggcttactgcaacctccgcctcctgggttcaagcaattctgtggcttcagcctccggagtagctgggattacaggcacatgccaccacacccagtgaatttttgtatttttagtagagacggggtttcaccatgttggccaggctggtcttgaattcctgacctcaggtgatctgcccacctcagcctcccaaagtgctgggattacaggcgtgagccaccacaccaggcccgagaaatgcttttttaaaaaacacacatcttatggcattcaccttcttggagctctaggacagtggttctcaaaatttttttctctcaggacctcttaaaaatcatcaaggaccccaaaaagcttttgggtatgtgggttatagctatcaatatttatggtactagaacttaaaagtgagaaaaatttaaaacacgagaatacataggcacacattctattcatcgtgggaaccatggtgtcaatacatatcatgtagcttctgaaaaactccactgtacacttatagaatgaagaaggcaaaaaactttttttttttttttttggagacggagtctcgctctgtcgcccaggctggagtgcagtggcgcgatctcggctcactgcaagctccgcctctcgggttcacgccattctcctgcctcagcctcccaagtagctcggactacaggcgtcctccaccatgcctggctaatattttgtattttttagtagagacggggtttcaccgtgttagccaggatggtctcgatctcctaacctggtgatccgcccgcctcggcctcccaaagtattgggattacccgcgtgagccaccgcgcccggctgcaaataatctttctttttttctttttttctgagacagagtctcgctctgttgcccaggctggagtgcagtggcacgatctcggctcacggcacgctccgcctcccgggttcacgccattctcctgcctcagcttcccgagtagctgggactacaggggcccgccaccacgcccggctaactttttgtgtttttagtagagacggggtttcaccgtgttagccaggatggtctcgatctcctgaccttgtgatctgcccgcctcggcctcccaaagtgctgggattacaggcgtgagccaccgcgcccggcggcgaaacacgatattgtactaacatcttaattttgttataaaatctcacaaaccccctgacatagtctcagagatctgtagggccgaggttacatttggagaacccgtactctagggccaaatccattcttcttgccctggctcacttgtcccccccaccgccccgcgctggagccactgcctagttcttcagccctagatggtgctcgccagacctcctctcaatgctcatcacacacagggctattcctttcctccaatgaaccaaacgcctcccgcccacctccaggtcccagtcctctgttccctttgcctggtccacccttgccctccctgggtcgcagacgaggtcggcctcgtcattccccgcagaccgccgcgcgtccctcttgtgcggttcaccacagttgtatttaagtgatcgtgtgagtcgtcgttaaatgcctgtctccccgcggatcatgggctcctcgaggacagggaccggcctgtctgtccactgctgtaaccccgcgccggcatagggacctaaggcccactggagggcgctcatcaagtagctgctggatgttgacgaaggaagcggcggcgcagctcagggatctccgagtcaggacggtcggccagacccacggggtaacgggtctaatcgtgtaggaataaagctgtattccagtgctccaaa

SEQ ID NO: 299413 - DNA, 606 bp, Homo sapiens
cgctgtggcctggctcgggacgccccgaggaagcagacccggcggtgcagtccagcacagccagcgctgggcccccgtcctgacctgagcggttaccaccagtccccagcgctctgactggatggctgctagtccaccagagcccctgctcatcacacacagggctattcctttcctccaatgaaccaaacgcctcccgcccacctccaggtcccagtcctctgttccctttgcctggtccacccttgccctccctgggtcgcagacgaggtcggcctcgtcattccccgcagaccgccgcgcgtccctcttgtgcggttcaccacagttgtatttaagtgatcgtgtgagtcgtcgttaaatgcctgtctccccgcggatcatgggctcctcgaggacagggaccggcctgtctgtccactgctgtaaccccgcgccggcatagggacctaaggcccactggagggcgctcatcaagtagctgctggatgttgacgaaggaagcggcggcgcagctcagggatctccgagtcaggacggtcggccagacccacggggtaacgggtctaatcgtgtaggaataaagctgtattccagtgctccaaa

SEQ ID NO: 299414 - DNA, 287 bp, Homo sapiens
gcggccgcctactactactactgctcgaattcaagcttctaacgatgtacggccccgcggatcatgggctcctcgaggacagggaccggcctgtctgtccactgctgtaaccccgcgccggcatagggacctaaggcccactggagggcgctcatcaagtagctgctggatgttgacgaaggaagcggcggcgcagctcagggatctccgagtcaggacggtcggccagacccacggggtaacgggtctaatcgtgtaggaataaagctgtattccagtgctccaaa

SEQ ID NO: 299415 - DNA, 1048 bp, Homo sapiens
gaggtggccccactggagccgatgccagggtgggagtggggcaggtcaccagacatacaaaccgctcctcactcgcgtccctatacgccaggcctggcgaccgccgtctcagcaggacccgcggtgatcgagtgttggttcgtggaggatgcgagcggaaagggcctggccaagagacccggtgcactgctgttgcgccagggaccgggggaaccgccgccccggccggacctcgaccctgagctctatctcagtgtacacgaccccgcgggcgccctccaggctgccttcaggcggtatccccggggcgcccccgcaccacactgcgagatgagccgcttcgtgcctctccccgcctctgcgaaatgggccagcggcctgacccccgcgcagaactgcccgcgggccctggatggggcttggctgatggtcagcatatccagcccagtcctcagcctctccagcctcttgcgaccacagccagagcctcagcaggagcctgttctcatcaccatggcaacaggtagctggggaggggaggtggagaagggtgggtagattctaagggtccagatcagccggtggtctcgctttatggacttgagcaagacatttcgccaatcggggttcagtttcctttttttgttaagagaggtggtttggctagaatgaatcaatctctaccgctccttctagccctcacccagttaaaaaaaaaaaacaaaaaaaaaactgcagcttggcagggggtagggggaaagcagggccgggcaggggggttactttctggtgtttcgaagggcggggctttgaagaggtggggtttcccgacaccagaccttgagagacttgtcaggtgatgcgaggtgggaggggttcagaagcaggagcgttttttctctgctcttcccagatctgtgtcttgctctgcaccctcagctttgcgggtcactctttcaaaacccagcactctatccccacctgcgcccacacccggcgctgcggcaatccgcaaagcaaaggctcttgcactctagcgcgttgacct

SEQ ID NO: 299416 - DNA, 3984 bp, Homo sapiens
ggggacgcggcacagatagggggaagccggagtaatggttttcgggcaagtggatgttggagagcacacacaggagttggggggcgggggagggcctggggttggggagggctcgaactcggggctgctgggtagtccaggagggcgcggtaaggctggggtgtcctggtgagaactggagaggatctacccgggtccctgcctggccagtggggaaacaccggtcccccaggcaccttcacctaaccagagcggggatttccaccgcccctcatgccgccctttggaggaaagtgaaagtgaaaggaggaagaggaggcttcatggctgaggaggtcgcagcgccatgaagtccctgtctctgctcctcgctgtggctttgggcctggcgaccgccgtctcagcaggacccgcggtgatcgagtgttggttcgtggaggatgcgagcggaaagggcctggccaagagacccggtgcactgctgttgcgccagggaccgggggaaccgccgccccggccggacctcgaccctgagctctatctcagtgtacacgaccccgcgggcgccctccaggctgccttcaggcggtatccccggggcgcccccgcaccacactgcgagatgagccgcttcgtgcctctccccgcctctgcgaaatgggccagcggcctgacccccgcgcagaactgcccgcgggccctggatggggcttggctgatggtcagcatatccagcccagtcctcagcctctccagcctcttgcgaccacagccagagcctcagcaggagcctgttctcatcaccatggcaacagtggtactgactgtcctcacccacacccctgcccctcgagtgagactgggacaagatgctctgctggacttgagctttgcctacatgccccccacctccgaggccgcctcatctctggctccgggtccccctccctttgggctagagtggcgacgccagcacctgggtaagggacatctgctcctggctgcaactcctgggctgaatggccagatgccagcagcccaagaaggggccgtggcatttgctgcttgggatgatgatgagccatggggcccatggaccggaaatgggaccttctggctgcctagagttcaaccctttcaggagggcacctatctggccaccatacacctgccatacctgcaaggacaggtcaccctggagcttgctgtgtacaaaccccccaaagtgtccctgatgccagcaacccttgcacgggccgccccaggggaggcacccccggaattgctctgccttgtgtcccacttctacccttctgggggcctggaggtggagtgggaactccggggtggcccagggggccgctctcagaaggccgaggggcagaggtggctctcggccctgcgccaccattccgatggctctgtcagcctctctgggcacttgcagccgcccccagtcaccactgagcagcatggggcacgctatgcctgtcgaattcaccatcccagcctgcctgcctcggggcgcagcgctgaggtcaccctggaggtagcaggtaagagctgggagctctgcggaatctgagccagcacccaggaagacaggagctcactctcaccccttctgcctgccaggtctttcagggccctcccttgaggacagcgtaggccttttcctgtctgcctttcttctgcttgggctcttcaaggcactgggctgggctggtaagtgtcagccctaccctgaccatgacctgaggttggtggactttccccacctactcccaagagcctgacacccatccctctgccctccacctctaccactccagcatcccatcccttctcaatctttccccacagctgtctacctgtccacctgcaaggattcaaagaagaaagcagagtgagggcactcactgccatcctgtggaagccaccatcatctctggcccaagcttctgtagtagctccctaaaataataccctatcatctgctcctaatccctccaatctctctccactgagtggctggaatgcttttttttttttctttcacttatataagggataatttttcttttttttttttttttgagacggagtctcacctcttccgcccaggctgcagtgcagtggcatgatcttggcttactgcaacctccgcctcctgggttcaagcaattctgtggcttcagcctccggagtagctgggattacaggcacatgccaccacacccagtgaatttttgtatttttagtagagacggggtttcaccatgttggccaggctggtcttgaattcctgacctcaggtgatctgcccacctcagcctcccaaagtgctgggattacaggcgtgagccaccacaccaggcccgagaaatgcttttttaaaaaacacacatcttatggcattcaccttcttggagctctaggacagtggttctcaaaatttttttctctcaggacctcttaaaaatcatcaaggaccccaaaaagcttttgggtatgtgggttatagctatcaatatttatggtactagaacttaaaagtgagaaaaatttaaaacacgagaatacataggcacacattctattcatcgtgggaaccatggtgtcaatacatatcatgtagcttctgaaaaactccactgtacacttatagaatgaagaaggcaaaaaactttttttttttttttttggagacggagtctcgctctgtcgcccaggctggagtgcagtggcgcgatctcggctcactgcaagctccgcctctcgggttcacgccattctcctgcctcagcctcccaagtagctcggactacaggcgtcctccaccatgcctggctaatattttgtattttttagtagagacggggtttcaccgtgttagccaggatggtctcgatctcctaacctggtgatccgcccgcctcggcctcccaaagtattgggattacccgcgtgagccaccgcgcccggctgcaaataatctttctttttttctttttttctgagacagagtctcgctctgttgcccaggctggagtgcagtggcacgatctcggctcacggcacgctccgcctcccgggttcacgccattctcctgcctcagcttcccgagtagctgggactacaggggcccgccaccacgcccggctaactttttgtgtttttagtagagacggggtttcaccgtgttagccaggatggtctcgatctcctgaccttgtgatctgcccgcctcggcctcccaaagtgctgggattacaggcgtgagccaccgcgcccggcggcgaaacacgatattgtactaacatcttaattttgttataaaatctcacaaaccccctgacatagtctcagagatctgtagggccgaggttacatttggagaacccgtactctagggccaaatccattcttcttgccctggctcacttgtcccccccaccgccccgcgctggagccactgcctagttcttcagccctagatggtgctcgccagacctcctctcaatgctcatcacacacagggctattcctttcctccaatgaaccaaacgcctcccgcccacctccaggtcccagtcctctgttccctttgcctggtccacccttgccctccctgggtcgcagacgaggtcggcctcgtcattccccgcagaccgccgcgcgtccctcttgtgcggttcaccacagttgtatttaagtgatcgtgtgagtcgtcgttaaatgcctgtctccccgcggatcatgggctcctcgaggacagggaccggcctgtctgtccactgctgtaaccccgcgccggcatagggacctaaggcccactggagggcgctcatcaagtagctgctggatgttgacgaaggaagcggcggcgcagctcagggatctccgagtcaggacggtcggccagacccacggggtaacgggtctaatcgtgtaggaataaagctgtattccagtgctccaaa

SEQ ID NO: 299417 - DNA, 4117 bp, Homo sapiens
ggggacgcggcacagatagggggaagccggagtaatggttttcgggcaagtggatgttggagagcacacacaggagttggggggcgggggagggcctggggttggggagggctcgaactcggggctgctgggtagtccaggagggcgcggtaaggctggggtgtcctggtgagaactggagaggatctacccgggtccctgcctggccagtggggaaacaccggtcccccaggcaccttcacctaaccagagcggggatttccaccgcccctcatgccgccctttggaggaaagtgaaagtgaaaggaggaagaggaggcttcatggctgaggaggtcgcagcgccatgaagtccctgtctctgctcctcgctgtggctttgggcctggcgaccgccgtctcagcaggacccgcggtgatcgagtgttggttcgtggaggatgcgagcggaaagggcctggccaagagacccggtgcactgctgttgcgccagggaccgggggaaccgccgccccggccggacctcgaccctgagctctatctcagtgtacacgaccccgcgggcgccctccaggctgccttcaggcggtatccccggggcgcccccgcaccacactgcgagatgagccgcttcgtgcctctccccgcctctgcgaaatgggccagcggcctgacccccgcgcagaactgcccgcgggccctggatggggcttggctgatggtcagcatatccagcccagtcctcagcctctccagcctcttgcgaccacagccagagcctcagcaggagcctgttctcatcaccatggcaacagtggtactgactgtcctcacccacacccctgcccctcgagtgagactgggacaagatgctctgctggacttgagctttgcctacatgccccccacctccgaggccgcctcatctctggctccgggtccccctccctttgggctagagtggcgacgccagcacctgggtaagggacatctgctcctggctgcaactcctgggctgaatggccagatgccagcagcccaagaaggggccgtggcatttgctgcttgggatgatgatgagccatggggcccatggaccggaaatgggaccttctggctgcctagagttcaaccctttcaggagggcacctatctggccaccatacacctgccatacctgcaaggacaggtcaccctggagcttgctgtgtacagtgagttgggggacagaggtctccaggggtagagggtgggcactggattgtggtgaccgtaatagggggagggatgatggataagagggtgcctgggcaagtaagtagagatagaaagaggttcctgggagttagaggggtaatgggaggctagaagtttcctggaaatttgaggggctttgacatgggtatttctgtgacgcaccaatggagagacagtgggttccctatttcaggagaagaaacctaaccttctttagttctgaggaagccagcaggcaaactgagggtctcttagggaggacagtatggactgatttccctatgctcatttcgtcctctttccccagaaccccccaaagtgtccctgatgccagcaacccttgcacgggccgccccaggggaggcacccccggaattgctctgccttgtgtcccacttctacccttctgggggcctggaggtggagtgggaactccggggtggcccagggggccgctctcagaaggccgaggggcagaggtggctctcggccctgcgccaccattccgatggctctgtcagcctctctgggcacttgcagccgcccccagtcaccactgagcagcatggggcacgctatgcctgtcgaattcaccatcccagcctgcctgcctcggggcgcagcgctgaggtcaccctggaggtagcaggtctttcagggccctcccttgaggacagcgtaggccttttcctgtctgcctttcttctgcttgggctcttcaaggcactgggctgggctgctgtctacctgtccacctgcaaggattcaaagaagaaagcagagtgagggcactcactgccatcctgtggaagccaccatcatctctggcccaagcttctgtagtagctccctaaaataataccctatcatctgctcctaatccctccaatctctctccactgagtggctggaatgcttttttttttttctttcacttatataagggataatttttcttttttttttttttttgagacggagtctcacctcttccgcccaggctgcagtgcagtggcatgatcttggcttactgcaacctccgcctcctgggttcaagcaattctgtggcttcagcctccggagtagctgggattacaggcacatgccaccacacccagtgaatttttgtatttttagtagagacggggtttcaccatgttggccaggctggtcttgaattcctgacctcaggtgatctgcccacctcagcctcccaaagtgctgggattacaggcgtgagccaccacaccaggcccgagaaatgcttttttaaaaaacacacatcttatggcattcaccttcttggagctctaggacagtggttctcaaaatttttttctctcaggacctcttaaaaatcatcaaggaccccaaaaagcttttgggtatgtgggttatagctatcaatatttatggtactagaacttaaaagtgagaaaaatttaaaacacgagaatacataggcacacattctattcatcgtgggaaccatggtgtcaatacatatcatgtagcttctgaaaaactccactgtacacttatagaatgaagaaggcaaaaaactttttttttttttttttggagacggagtctcgctctgtcgcccaggctggagtgcagtggcgcgatctcggctcactgcaagctccgcctctcgggttcacgccattctcctgcctcagcctcccaagtagctcggactacaggcgtcctccaccatgcctggctaatattttgtattttttagtagagacggggtttcaccgtgttagccaggatggtctcgatctcctaacctggtgatccgcccgcctcggcctcccaaagtattgggattacccgcgtgagccaccgcgcccggctgcaaataatctttctttttttctttttttctgagacagagtctcgctctgttgcccaggctggagtgcagtggcacgatctcggctcacggcacgctccgcctcccgggttcacgccattctcctgcctcagcttcccgagtagctgggactacaggggcccgccaccacgcccggctaactttttgtgtttttagtagagacggggtttcaccgtgttagccaggatggtctcgatctcctgaccttgtgatctgcccgcctcggcctcccaaagtgctgggattacaggcgtgagccaccgcgcccggcggcgaaacacgatattgtactaacatcttaattttgttataaaatctcacaaaccccctgacatagtctcagagatctgtagggccgaggttacatttggagaacccgtactctagggccaaatccattcttcttgccctggctcacttgtcccccccaccgccccgcgctggagccactgcctagttcttcagccctagatggtgctcgccagacctcctctcaatgctcatcacacacagggctattcctttcctccaatgaaccaaacgcctcccgcccacctccaggtcccagtcctctgttccctttgcctggtccacccttgccctccctgggtcgcagacgaggtcggcctcgtcattccccgcagaccgccgcgcgtccctcttgtgcggttcaccacagttgtatttaagtgatcgtgtgagtcgtcgttaaatgcctgtctccccgcggatcatgggctcctcgaggacagggaccggcctgtctgtccactgctgtaaccccgcgccggcatagggacctaaggcccactggagggcgctcatcaagtagctgctggatgttgacgaaggaagcggcggcgcagctcagggatctccgagtcaggacggtcggccagacccacggggtaacgggtctaatcgtgtaggaataaagctgtattccagtgctccaaa

SEQ ID NO: 299418 - DNA, 4334 bp, Homo sapiens
ggggacgcggcacagatagggggaagccggagtaatggttttcgggcaagtggatgttggagagcacacacaggagttggggggcgggggagggcctggggttggggagggctcgaactcggggctgctgggtagtccaggagggcgcggtaaggctggggtgtcctggtgagaactggagaggatctacccgggtccctgcctggccagtggggaaacaccggtcccccaggcaccttcacctaaccagagcggggatttccaccgcccctcatgccgccctttggaggaaagtgaaagtgaaaggaggaagaggaggcttcatggctgaggaggtcgcagcgccatgaagtccctgtctctgctcctcgctgtggctttgggcctggcgaccgccgtctcagcaggacccgcggtgatcgagtgttggttcgtggaggatgcgagcggaaagggcctggccaagagacccggtgcactgctgttgcgccagggaccgggggaaccgccgccccggccggacctcgaccctgagctctatctcagtgtacacgaccccgcgggcgccctccaggctgccttcaggcggtatccccggggcgcccccgcaccacactgcgagatgagccgcttcgtgcctctccccgcctctgcgaaatgggccagcggcctgacccccgcgcagaactgcccgcgggccctggatggggcttggctgatggtcagcatatccagcccagtcctcagcctctccagcctcttgcgaccacagccagagcctcagcaggagcctgttctcatcaccatggcaacagtggtactgactgtcctcacccacacccctgcccctcgagtgagactgggacaagatgctctgctggacttgagctttgcctacatgccccccacctccgaggccgcctcatctctggctccgggtccccctccctttgggctagagtggcgacgccagcacctgggtaagggacatctgctcctggctgcaactcctgggctgaatggccagatgccagcagcccaagaaggggccgtggcatttgctgcttgggatgatgatgagccatggggcccatggaccggaaatgggaccttctggctgcctagagttcaaccctttcaggagggcacctatctggccaccatacacctgccatacctgcaaggacaggtcaccctggagcttgctgtgtacagtgagttgggggacagaggtctccaggggtagagggtgggcactggattgtggtgaccgtaatagggggagggatgatggataagagggtgcctgggcaagtaagtagagatagaaagaggttcctgggagttagaggggtaatgggaggctagaagtttcctggaaatttgaggggctttgacatgggtatttctgtgacgcaccaatggagagacagtgggttccctatttcaggagaagaaacctaaccttctttagttctgaggaagccagcaggcaaactgagggtctcttagggaggacagtatggactgatttccctatgctcatttcgtcctctttccccagaaccccccaaagtgtccctgatgccagcaacccttgcacgggccgccccaggggaggcacccccggaattgctctgccttgtgtcccacttctacccttctgggggcctggaggtggagtgggaactccggggtggcccagggggccgctctcagaaggccgaggggcagaggtggctctcggccctgcgccaccattccgatggctctgtcagcctctctgggcacttgcagccgcccccagtcaccactgagcagcatggggcacgctatgcctgtcgaattcaccatcccagcctgcctgcctcggggcgcagcgctgaggtcaccctggaggtagcaggtaagagctgggagctctgcggaatctgagccagcacccaggaagacaggagctcactctcaccccttctgcctgccaggtctttcagggccctcccttgaggacagcgtaggccttttcctgtctgcctttcttctgcttgggctcttcaaggcactgggctgggctggtaagtgtcagccctaccctgaccatgacctgaggttggtggactttccccacctactcccaagagcctgacacccatccctctgccctccacctctaccactccagcatcccatcccttctcaatctttccccacagctgtctacctgtccacctgcaaggattcaaagaagaaagcagagtgagggcactcactgccatcctgtggaagccaccatcatctctggcccaagcttctgtagtagctccctaaaataataccctatcatctgctcctaatccctccaatctctctccactgagtggctggaatgcttttttttttttctttcacttatataagggataatttttcttttttttttttttttgagacggagtctcacctcttccgcccaggctgcagtgcagtggcatgatcttggcttactgcaacctccgcctcctgggttcaagcaattctgtggcttcagcctccggagtagctgggattacaggcacatgccaccacacccagtgaatttttgtatttttagtagagacggggtttcaccatgttggccaggctggtcttgaattcctgacctcaggtgatctgcccacctcagcctcccaaagtgctgggattacaggcgtgagccaccacaccaggcccgagaaatgcttttttaaaaaacacacatcttatggcattcaccttcttggagctctaggacagtggttctcaaaatttttttctctcaggacctcttaaaaatcatcaaggaccccaaaaagcttttgggtatgtgggttatagctatcaatatttatggtactagaacttaaaagtgagaaaaatttaaaacacgagaatacataggcacacattctattcatcgtgggaaccatggtgtcaatacatatcatgtagcttctgaaaaactccactgtacacttatagaatgaagaaggcaaaaaactttttttttttttttttggagacggagtctcgctctgtcgcccaggctggagtgcagtggcgcgatctcggctcactgcaagctccgcctctcgggttcacgccattctcctgcctcagcctcccaagtagctcggactacaggcgtcctccaccatgcctggctaatattttgtattttttagtagagacggggtttcaccgtgttagccaggatggtctcgatctcctaacctggtgatccgcccgcctcggcctcccaaagtattgggattacccgcgtgagccaccgcgcccggctgcaaataatctttctttttttctttttttctgagacagagtctcgctctgttgcccaggctggagtgcagtggcacgatctcggctcacggcacgctccgcctcccgggttcacgccattctcctgcctcagcttcccgagtagctgggactacaggggcccgccaccacgcccggctaactttttgtgtttttagtagagacggggtttcaccgtgttagccaggatggtctcgatctcctgaccttgtgatctgcccgcctcggcctcccaaagtgctgggattacaggcgtgagccaccgcgcccggcggcgaaacacgatattgtactaacatcttaattttgttataaaatctcacaaaccccctgacatagtctcagagatctgtagggccgaggttacatttggagaacccgtactctagggccaaatccattcttcttgccctggctcacttgtcccccccaccgccccgcgctggagccactgcctagttcttcagccctagatggtgctcgccagacctcctctcaatgctcatcacacacagggctattcctttcctccaatgaaccaaacgcctcccgcccacctccaggtcccagtcctctgttccctttgcctggtccacccttgccctccctgggtcgcagacgaggtcggcctcgtcattccccgcagaccgccgcgcgtccctcttgtgcggttcaccacagttgtatttaagtgatcgtgtgagtcgtcgttaaatgcctgtctccccgcggatcatgggctcctcgaggacagggaccggcctgtctgtccactgctgtaaccccgcgccggcatagggacctaaggcccactggagggcgctcatcaagtagctgctggatgttgacgaaggaagcggcggcgcagctcagggatctccgagtcaggacggtcggccagacccacggggtaacgggtctaatcgtgtaggaataaagctgtattccagtgctccaaa

SEQ ID NO: 299419 - DNA, 2288 bp, Homo sapiens
gtttcaagttcaaaaaacagcaggattttgccaacacctgcacaagcacaaggcctacctgacccctaaagtccgtgtccctcagctctgggcatgcccagcctctcacggctccggaatgccatgctatccacaggaaggcagccagctgcccctgagccaggctgctgtctacctgtccacctgcaaggattcaaagaagaaagcagagtgagggcactcactgccatcctgtggaagccaccatcatctctggcccaagcttctgtagtagctccctaaaataataccctatcatctgctcctaatccctccaatctctctccactgagtggctggaatgcttttttttttttctttcacttatataagggataatttttcttttttttttttttttgagacggagtctcacctcttccgcccaggctgcagtgcagtggcatgatcttggcttactgcaacctccgcctcctgggttcaagcaattctgtggcttcagcctccggagtagctgggattacaggcacatgccaccacacccagtgaatttttgtatttttagtagagacggggtttcaccatgttggccaggctggtcttgaattcctgacctcaggtgatctgcccacctcagcctcccaaagtgctgggattacaggcgtgagccaccacaccaggcccgagaaatgcttttttaaaaaacacacatcttatggcattcaccttcttggagctctaggacagtggttctcaaaatttttttctctcaggacctcttaaaaatcatcaaggaccccaaaaagcttttgggtatgtgggttatagctatcaatatttatggtactagaacttaaaagtgagaaaaatttaaaacacgagaatacataggcacacattctattcatcgtgggaaccatggtgtcaatacatatcatgtagcttctgaaaaactccactgtacacttatagaatgaagaaggcaaaaaactttttttttttttttttggagacggagtctcgctctgtcgcccaggctggagtgcagtggcgcgatctcggctcactgcaagctccgcctctcgggttcacgccattctcctgcctcagcctcccaagtagctcggactacaggcgtcctccaccatgcctggctaatattttgtattttttagtagagacggggtttcaccgtgttagccaggatggtctcgatctcctaacctggtgatccgcccgcctcggcctcccaaagtattgggattacccgcgtgagccaccgcgcccggctgcaaataatctttctttttttctttttttctgagacagagtctcgctctgttgcccaggctggagtgcagtggcacgatctcggctcacggcacgctccgcctcccgggttcacgccattctcctgcctcagcttcccgagtagctgggactacaggggcccgccaccacgcccggctaactttttgtgtttttagtagagacggggtttcaccgtgttagccaggatggtctcgatctcctgaccttgtgatctgcccgcctcggcctcccaaagtgctgggattacaggcgtgagccaccgcgcccggcggcgaaacacgatattgtactaacatcttaattttgttataaaatctcacaaaccccctgacatagtctcagagatctgtagggccgaggttacatttggagaacccgtactctagggccaaatccattcttcttgccctggctcacttgtcccccccaccgccccgcgctggagccactgcctagttcttcagccctagatggtgctcgccagacctcctctcaatgctcatcacacacagggctattcctttcctccaatgaaccaaacgcctcccgcccacctccaggtcccagtcctctgttccctttgcctggtccacccttgccctccctgggtcgcagacgaggtcggcctcgtcattccccgcagaccgccgcgcgtccctcttgtgcggttcaccacagttgtatttaagtgatcgtgtgagtcgtcgttaaatgcctgtctccccgcggatcatgggctcctcgaggacagggaccggcctgtctgtccactgctgtaaccccgcgccggcatagggacctaaggcccactggagggcgctcatcaagtagctgctggatgttgacgaaggaagcggcggcgcagctcagggatctccgagtcaggacggtcggccagacccacggggtaacgggtctaatcgtgtaggaataaagctgtattccagtgctccaaa

SEQ ID NO: 299420 - DNA, 2197 bp, Homo sapiens
cccgctccatggaaaagcgggcttgactgcattgccgctgtataaagcatgtggtcttatagtgtttggacagctgctgtctacctgtccacctgcaaggattcaaagaagaaagcagagtgagggcactcactgccatcctgtggaagccaccatcatctctggcccaagcttctgtagtagctccctaaaataataccctatcatctgctcctaatccctccaatctctctccactgagtggctggaatgcttttttttttttctttcacttatataagggataatttttcttttttttttttttttgagacggagtctcacctcttccgcccaggctgcagtgcagtggcatgatcttggcttactgcaacctccgcctcctgggttcaagcaattctgtggcttcagcctccggagtagctgggattacaggcacatgccaccacacccagtgaatttttgtatttttagtagagacggggtttcaccatgttggccaggctggtcttgaattcctgacctcaggtgatctgcccacctcagcctcccaaagtgctgggattacaggcgtgagccaccacaccaggcccgagaaatgcttttttaaaaaacacacatcttatggcattcaccttcttggagctctaggacagtggttctcaaaatttttttctctcaggacctcttaaaaatcatcaaggaccccaaaaagcttttgggtatgtgggttatagctatcaatatttatggtactagaacttaaaagtgagaaaaatttaaaacacgagaatacataggcacacattctattcatcgtgggaaccatggtgtcaatacatatcatgtagcttctgaaaaactccactgtacacttatagaatgaagaaggcaaaaaactttttttttttttttttggagacggagtctcgctctgtcgcccaggctggagtgcagtggcgcgatctcggctcactgcaagctccgcctctcgggttcacgccattctcctgcctcagcctcccaagtagctcggactacaggcgtcctccaccatgcctggctaatattttgtattttttagtagagacggggtttcaccgtgttagccaggatggtctcgatctcctaacctggtgatccgcccgcctcggcctcccaaagtattgggattacccgcgtgagccaccgcgcccggctgcaaataatctttctttttttctttttttctgagacagagtctcgctctgttgcccaggctggagtgcagtggcacgatctcggctcacggcacgctccgcctcccgggttcacgccattctcctgcctcagcttcccgagtagctgggactacaggggcccgccaccacgcccggctaactttttgtgtttttagtagagacggggtttcaccgtgttagccaggatggtctcgatctcctgaccttgtgatctgcccgcctcggcctcccaaagtgctgggattacaggcgtgagccaccgcgcccggcggcgaaacacgatattgtactaacatcttaattttgttataaaatctcacaaaccccctgacatagtctcagagatctgtagggccgaggttacatttggagaacccgtactctagggccaaatccattcttcttgccctggctcacttgtcccccccaccgccccgcgctggagccactgcctagttcttcagccctagatggtgctcgccagacctcctctcaatgctcatcacacacagggctattcctttcctccaatgaaccaaacgcctcccgcccacctccaggtcccagtcctctgttccctttgcctggtccacccttgccctccctgggtcgcagacgaggtcggcctcgtcattccccgcagaccgccgcgcgtccctcttgtgcggttcaccacagttgtatttaagtgatcgtgtgagtcgtcgttaaatgcctgtctccccgcggatcatgggctcctcgaggacagggaccggcctgtctgtccactgctgtaaccccgcgccggcatagggacctaaggcccactggagggcgctcatcaagtagctgctggatgttgacgaaggaagcggcggcgcagctcagggatctccgagtcaggacggtcggccagacccacggggtaacgggtctaatcgtgtaggaataaagctgtattccagtgctccaaa

SEQ ID NO: 299421 - DNA, 2104 bp, Homo sapiens
cagagtccaaacagtgcccagagtccaaacagtgcccagagtccaaacagtgcccagagtccaaacagtgcccagagtccaaacagtgcccagagtccaaacagtgcctatcatctgctcctaatccctccaatctctctccactgagtggctggaatgcttttttttttttctttcacttatataagggataatttttcttttttttttttttttgagacggagtctcacctcttccgcccaggctgcagtgcagtggcatgatcttggcttactgcaacctccgcctcctgggttcaagcaattctgtggcttcagcctccggagtagctgggattacaggcacatgccaccacacccagtgaatttttgtatttttagtagagacggggtttcaccatgttggccaggctggtcttgaattcctgacctcaggtgatctgcccacctcagcctcccaaagtgctgggattacaggcgtgagccaccacaccaggcccgagaaatgcttttttaaaaaacacacatcttatggcattcaccttcttggagctctaggacagtggttctcaaaatttttttctctcaggacctcttaaaaatcatcaaggaccccaaaaagcttttgggtatgtgggttatagctatcaatatttatggtactagaacttaaaagtgagaaaaatttaaaacacgagaatacataggcacacattctattcatcgtgggaaccatggtgtcaatacatatcatgtagcttctgaaaaactccactgtacacttatagaatgaagaaggcaaaaaactttttttttttttttttggagacggagtctcgctctgtcgcccaggctggagtgcagtggcgcgatctcggctcactgcaagctccgcctctcgggttcacgccattctcctgcctcagcctcccaagtagctcggactacaggcgtcctccaccatgcctggctaatattttgtattttttagtagagacggggtttcaccgtgttagccaggatggtctcgatctcctaacctggtgatccgcccgcctcggcctcccaaagtattgggattacccgcgtgagccaccgcgcccggctgcaaataatctttctttttttctttttttctgagacagagtctcgctctgttgcccaggctggagtgcagtggcacgatctcggctcacggcacgctccgcctcccgggttcacgccattctcctgcctcagcttcccgagtagctgggactacaggggcccgccaccacgcccggctaactttttgtgtttttagtagagacggggtttcaccgtgttagccaggatggtctcgatctcctgaccttgtgatctgcccgcctcggcctcccaaagtgctgggattacaggcgtgagccaccgcgcccggcggcgaaacacgatattgtactaacatcttaattttgttataaaatctcacaaaccccctgacatagtctcagagatctgtagggccgaggttacatttggagaacccgtactctagggccaaatccattcttcttgccctggctcacttgtcccccccaccgccccgcgctggagccactgcctagttcttcagccctagatggtgctcgccagacctcctctcaatgctcatcacacacagggctattcctttcctccaatgaaccaaacgcctcccgcccacctccaggtcccagtcctctgttccctttgcctggtccacccttgccctccctgggtcgcagacgaggtcggcctcgtcattccccgcagaccgccgcgcgtccctcttgtgcggttcaccacagttgtatttaagtgatcgtgtgagtcgtcgttaaatgcctgtctccccgcggatcatgggctcctcgaggacagggaccggcctgtctgtccactgctgtaaccccgcgccggcatagggacctaaggcccactggagggcgctcatcaagtagctgctggatgttgacgaaggaagcggcggcgcagctcagggatctccgagtcaggacggtcggccagacccacggggtaacgggtctaatcgtgtaggaataaagctgtattccagtgctccaaa

SEQ ID NO: 299422 - DNA, 3824 bp, Homo sapiens
ggggacgcggcacagatagggggaagccggagtaatggttttcgggcaagtggatgttggagagcacacacaggagttggggggcgggggagggcctggggttggggagggctcgaactcggggctgctgggtagtccaggagggcgcggtaaggctggggtgtcctggtgagaactggagaggatctacccgggtccctgcctggccagtggggaaacaccggtcccccaggcaccttcacctaaccagagcggggatttccaccgcccctcatgccgccctttggaggaaagtgaaagtgaaaggaggaagaggaggcttcatggctgaggaggtcgcagcgccatgaagtccctgtctctgctcctcgctgtggctttgggcctggcgaccgccgtctcagcaggacccgcggtgatcgagtgttggttcgtggaggatgcgagcggaaagggcctggccaagagacccggtgcactgctgttgcgccagggaccgggggaaccgccgccccggccggacctcgaccctgagctctatctcagtgtacacgaccccgcgggcgccctccaggctgccttcaggcggtatccccggggcgcccccgcaccacactgcgagatgagccgcttcgtgcctctccccgcctctgcgaaatgggccagcggcctgacccccgcgcagaactgcccgcgggccctggatggggcttggctgatggtcagcatatccagcccagtcctcagcctctccagcctcttgcgaccacagccagagcctcagcaggagcctgttctcatcaccatggcaacagtggtactgactgtcctcacccacacccctgcccctcgagtgagactgggacaagatgctctgctggacttgagctttgcctacatgccccccacctccgaggccgcctcatctctggctccgggtccccctccctttgggctagagtggcgacgccagcacctgggtaagggacatctgctcctggctgcaactcctgggctgaatggccagatgccagcagcccaagaaggggccgtggcatttgctgcttgggatgatgatgagccatggggcccatggaccggaaatgggaccttctggctgcctagagttcaaccctttcaggagggcacctatctggccaccatacacctgccatacctgcaaggacaggtcaccctggagcttgctgtgtacaaaccccccaaagtgtccctgatgccagcaacccttgcacgggccgccccaggggaggcacccccggaattgctctgccttgtgtcccacttctacccttctgggggcctggaggtggagtgggaactccggggtggcccagggggccgctctcagaaggccgaggggcagaggtggctctcggccctgcgccaccattccgatggctctgtcagcctctctgggcacttgcagccgcccccagtcaccactgagcagcatggggcacgctatgcctgtcgaattcaccatcccagcctgcctgcctcggggcgcagcgctgaggtcaccctggaggtagcaggtctttcagggccctcccttgaggacagcgtaggccttttcctgtctgcctttcttctgcttgggctcttcaaggcactgggctgggctgctgtctacctgtccacctgcaaggattcaaagaagaaagcagagtgagggcactcactgccatcctgtggaagccaccatcatctctggcccaagcttctgtagtagctccctaaaataataccctatcatctgctcctaatccctccaatctctctccactgagtggctggaatgcttttttttttttctttcacttatataagggataatttttcttttttttttttttttgagacggagtctcacctcttccgcccaggctgcagtgcagtggcatgatcttggcttactgcaacctccgcctcctgggttcaagcaattctgtggcttcagcctccggagtagctgggattacaggcacatgccaccacacccagtgaatttttgtatttttagtagagacggggtttcaccatgttggccaggctggtcttgaattcctgacctcaggtgatctgcccacctcagcctcccaaagtgctgggattacaggcgtgagccaccacaccaggcccgagaaatgcttttttaaaaaacacacatcttatggcattcaccttcttggagctctaggacagtggttctcaaaatttttttctctcaggacctcttaaaaatcatcaaggaccccaaaaagcttttgggtatgtgggttatagctatcaatatttatggtactagaacttaaaagtgagaaaaatttaaaacacgagaatacataggcacacattctattcatcgtgggaaccatggtgtcaatacatatcatgtagcttctgaaaaactccactgtacacttatagaatgaagaaggcaaaaaactttttttttttttttttggagacggagtctcgctctgtcgcccaggctggagtgcagtggcgcgatctcggctcactgcaagctccgcctctcgggttcacgccattctcctgcctcagcctcccaagtagctcggactacaggcgtcctccaccatgcctggctaatattttgtattttttagtagagacggggtttcaccgtgttagccaggatggtctcgatctcctaacctggtgatccgcccgcctcggcctcccaaagtattgggattacccgcgtgagccaccgcgcccggctgcaaataatctttctttttttctttttttctgagacagagtctcgctctgttgcccaggctggagtgcagtggcacgatctcggctcacggcacgctccgcctcccgggttcacgccattctcctgcctcagcttcccgagtagctgggactacaggggcccgccaccacgcccggctaactttttgtgtttttagtagagacggggtttcaccgtgttagccaggatggtctcgatctcctgaccttgtgatctgcccgcctcggcctcccaaagtgctgggattacaggcgtgagccaccgcgcccggcggcgaaacacgatattgtactaacatcttaattttgttataaaatctcacaaaccccctgacatagtctcagagatctgtagggccgaggttacatttggagaacccgtactctagggccaaatccattcttcttgccctggctcacttgtcccccccaccgccccgcgctggagccactgcctagttcttcagccctagatggtgctcgccagacctcctctcaatgctcatcacacacagggctattcctttcctccaatgaaccaaacgcctcccgcccacctccaggtcccagtcctctgttccctttgcctggtccacccttgccctccctgggtcgcagacgaggtcggcctcgtcattccccgcagaccgccgcgcgtccctcttgtgcggttcaccacagttgtatttaagtgatcgtgtgagtcgtcgttaaatgcctgtctccccgcggatcatgggctcctcgaggacagggaccggcctgtctgtccactgctgtaaccccgcgccggcatagggacctaaggcccactggagggcgctcatcaagtagctgctggatgttgacgaaggaagcggcggcgcagctcagggatctccgagtcaggacggtcggccagacccacggggtaacgggtctaatcgtgtaggaataaagctgtattccagtgctccaaaaaaaaaaaacacgaacacacaacaacaacccacagaccagacaaaaaaaaaaggggg

SEQ ID NO: 299423 - DNA, 3694 bp, Homo sapiens
ggggacgcggcacagatagggggaagccggagtaatggttttcgggcaagtggatgttggagagcacacacaggagttggggggcgggggagggcctggggttggggagggctcgaactcggggctgctgggtagtccaggagggcgcggtaaggctggggtgtcctggtgagaactggagaggatctacccgggtccctgcctggccagtggggaaacaccggtcccccaggcaccttcacctaaccagagcggggatttccaccgcccctcatgccgccctttggaggaaagtgaaagtgaaaggaggaagaggaggcttcatggctgaggaggtcgcagcgccatgaagtccctgtctctgctcctcgctgtggctttgggcctggcgaccgccgtctcagcaggacccgcggtgatcgagtgttggttcgtggaggatgcgagcggaaagggcctggccaagagacccggtgcactgctgttgcgccagggaccgggggaaccgccgccccggccggacctcgaccctgagctctatctcagtgtacacgaccccgcgggcgccctccaggctgccttcaggcggtatccccggggcgcccccgcaccacactgcgagatgagccgcttcgtgcctctccccgcctctgcgaaatgggccagcggcctgacccccgcgcagaactgcccgcgggccctggatggggcttggctgatggtcagcatatccagcccagtcctcagcctctccagcctcttgcgaccacagccagagcctcagcaggagcctgttctcatcaccatggcaacagtggtactgactgtcctcacccacacccctgcccctcgagtgagactgggacaagatgctctgctggacttgagctttgcctacatgccccccacctccgaggccgcctcatctctggctccgggtccccctccctttgggctagagtggcgacgccagcacctgggtaagggacatctgctcctggctgcaactcctgggctgaatggccagatgccagcagcccaagaaggggccgtggcatttgctgcttgggatgatgatgagccatggggcccatggaccggaaatgggaccttctggctgcctagagttcaaccctttcaggagggcacctatctggccaccatacacctgccatacctgcaaggacaggtcaccctggagcttgctgtgtacaaaccccccaaagtgtccctgatgccagcaacccttgcacgggccgccccaggggaggcacccccggaattgctctgccttgtgtcccacttctacccttctgggggcctggaggtggagtgggaactccggggtggcccagggggccgctctcagaaggccgaggggcagaggtggctctcggccctgcgccaccattccgatggctctgtcagcctctctgggcacttgcagccgcccccagtcaccactgagcagcatggggcacgctatgcctgtcgaattcaccatcccagcctgcctgcctcggggcgcagcgctgaggtcaccctggaggtagcaggtctttcagggccctcccttgaggacagcgtaggccttttcctgtctgcctttcttctgcttgggctcttcaaggcactgggctgggctgctgtctacctgtccacctgcaaggattcaaagaagaaagcagagtgagggcactcactgccatcctgtggaagccaccatcatctctggcccaagcttctgtagtagctccctaaaataataccctatcatctgctcctaatccctccaatctctctccactgagtggctggaatgcttttttttttttctttcacttatataagggataatttttcttttttttttttttttgagacggagtctcacctcttccgcccaggctgcagtgcagtggcatgatcttggcttactgcaacctccgcctcctgggttcaagcaattctgtggcttcagcctccggagtagctgggattacaggcacatgccaccacacccagtgaatttttgtatttttagtagagacggggtttcaccatgttggccaggctggtcttgaattcctgacctcaggtgatctgcccacctcagcctcccaaagtgctgggattacaggcgtgagccaccacaccaggcccgagaaatgcttttttaaaaaacacacatcttatggcattcaccttcttggagctctaggacagtggttctcaaaatttttttctctcaggacctcttaaaaatcatcaaggaccccaaaaagcttttgggtatgtgggttatagctatcaatatttatggtactagaacttaaaagtgagaaaaatttaaaacacgagaatacataggcacacattctattcatcgtgggaaccatggtgtcaatacatatcatgtagcttctgaaaaactccactgtacacttatagaatgaagaaggcaaaaaactttttttttttttttttggagacggagtctcgctctgtcgcccaggctggagtgcagtggcgcgatctcggctcactgcaagctccgcctctcgggttcacgccattctcctgcctcagcctcccaagtagctcggactacaggcgtcctccaccatgcctggctaatattttgtattttttagtagagacggggtttcaccgtgttagccaggatggtctcgatctcctaacctggtgatccgcccgcctcggcctcccaaagtattgggattacccgcgtgagccaccgcgcccggctgcaaataatctttctttttttctttttttctgagacagagtctcgctctgttgcccaggctggagtgcagtggcacgatctcggctcacggcacgctccgcctcccgggttcacgccattctcctgcctcagcttcccgagtagctgggactacaggggcccgccaccacgcccggctaactttttgtgtttttagtagagacggggtttcaccgtgttagccaggatggtctcgatctcctgaccttgtgatctgcccgcctcggcctcccaaagtgctgggattacaggcgtgagccaccgcgcccggcggcgaaacacgatattgtactaacatcttaattttgttataaaatctcacaaaccccctgacatagtctcagagatctgtagggccgaggttacatttggagaacccgtactctagggccaaatccattcttcttgccctggctcacttgtcccccccaccgccccgcgctggagccactgcctagttcttcagccctagatggtgctcgccagacctcctctcaatgctcatcacacacagggctattcctttcctccaatgaaccaaacgcctcccgcccacctccaggtcccagtcctctgttccctttgcctggtccacccttgccctccctgggtcgcagacgaggtcggcctcgtcattccccgcagaccgccgcgcgtccctcttgtgcggttcaccacagttgtatttaagtgatcgtgtgagtcgtcgttaaatgcctgtctccccgcggatcatgggctcctcgaggacagggaccggcctgtctgtccactgctgtaaccccgcgccggcatagggacctaaggcccactggagggcgctgggctgttacggaggcgctgttagaggcgctcgttacgaggcgctcgttacgtatgttagcg

SEQ ID NO: 299424 - DNA, 2160 bp, Homo sapiens
ggggacgcggcacagatagggggaagccggagtaatggttttcgggcaagtggatgttggagagcacacacaggagttggggggcgggggagggcctggggttggggagggctcgaactcggggctgctgggtagtccaggagggcgcggtaaggctggggtgtcctggtgagaactggagaggatctacccgggtccctgcctggccagtggggaaacaccggtcccccaggcaccttcacctaaccagagcggggatttccaccgcccctcatgccgccctttggaggaaagtgaaagtgaaaggaggaagaggaggcttcatggctgaggaggtcgcagcgccatgaagtccctgtctctgctcctcgctgtggctttgggcctggcgaccgccgtctcagcaggacccgcggtgatcgagtgttggttcgtggaggatgcgagcggaaagggcctggccaagagacccggtgcactgctgttgcgccagggaccgggggaaccgccgccccggccggacctcgaccctgagctctatctcagtgtacacgaccccgcgggcgccctccaggctgccttcaggcggtatccccggggcgcccccgcaccacactgcgagatgagccgcttcgtgcctctccccgcctctgcgaaatgggccagcggcctgacccccgcgcagaactgcccgcgggccctggatggggcttggctgatggtcagcatatccagcccagtcctcagcctctccagcctcttgcgaccacagccagagcctcagcaggagcctgttctcatcaccatggcaacagtggtactgactgtcctcacccacacccctgcccctcgagtgagactgggacaagatgctctgctggacttgagctttgcctacatgccccccacctccgaggccgcctcatctctggctccgggtccccctccctttgggctagagtggcgacgccagcacctgggtaagggacatctgctcctggctgcaactcctgggctgaatggccagatgccagcagcccaagaaggggccgtggcatttgctgcttgggatgatgatgagccatggggcccatggaccggaaatgggaccttctggctgcctagagttcaaccctttcaggagggcacctatctggccaccatacacctgccatacctgcaaggacaggtcaccctggagcttgctgtgtacagtgagttgggggacagaggtctccaggggtagagggtgggcactggattgtggtgaccgtaatagggggagggatgatggataagagggtgcctgggcaagtaagtagagatagaaagaggttcctgggagttagaggggtaatgggaggctagaagtttcctggaaatttgaggggctttgacatgggtatttcttgtgatctgcccgcctcggcctcccaaagtgctgggattacaggcgtgagccaccgcgcccggcggcgaaacacgatattgtactaacatcttaattttgttataaaatctcacaaaccccctgacatagtctcagagatctgtagggccgaggttacatttggagaacccgtactctagggccaaatccattcttcttgccctggctcacttgtcccccccaccgccccgcgctggagccactgcctagttcttcagccctagatggtgctcgccagacctcctctcaatgctcatcacacacagggctattcctttcctccaatgaaccaaacgcctcccgcccacctccaggtcccagtcctctgttccctttgcctggtccacccttgccctccctgggtcgcagacgaggtcggcctcgtcattccccgcagaccgccgcgcgtccctcttgtgcggttcaccacagttgtatttaagtgatcgtgtgagtcgtcgttaaatgcctgtctccccgcggatcatgggctcctcgaggacagggaccggcctgtctgtccactgctgtaaccccgcgccggcatagggacctaaggcccactggagggcgctcatcaagtagctgctggatgttgacgaaggaagcggcggcgcagctcagggatctccgagtcaggacggtcggccagacccacggggtaacgggtctaatcgtgtaggaataaagctgtattccagtgctccaaa

SEQ ID NO: 299425 - DNA, 3569 bp, Homo sapiens
ggggacgcggcacagatagggggaagccggagtaatggttttcgggcaagtggatgttggagagcacacacaggagttggggggcgggggagggcctggggttggggagggctcgaactcggggctgctgggtagtccaggagggcgcggtaaggctggggtgtcctggtgagaactggagaggatctacccgggtccctgcctggccagtggggaaacaccggtcccccaggcaccttcacctaaccagagcggggatttccaccgcccctcatgccgccctttggaggaaagtgaaagtgaaaggaggaagaggaggcttcatggctgaggaggtcgcagcgccatgaagtccctgtctctgctcctcgctgtggctttgggcctggcgaccgccgtctcagcaggacccgcggtgatcgagtgttggttcgtggaggatgcgagcggaaagggcctggccaagagacccggtgcactgctgttgcgccagggaccgggggaaccgccgccccggccggacctcgaccctgagctctatctcagtgtacacgaccccgcgggcgccctccaggctgccttcaggcggtatccccggggcgcccccgcaccacactgcgagatgagccgcttcgtgcctctccccgcctctgcgaaatgggccagcggcctgacccccgcgcagaactgcccgcgggccctggatggggcttggctgatggtcagcatatccagcccagtcctcagcctctccagcctcttgcgaccacagccagagcctcagcaggagcctgttctcatcaccatggcaacagtggtactgactgtcctcacccacacccctgcccctcgagtgagactgggacaagatgctctgctggacttgagctttgcctacatgccccccacctccgaggccgcctcatctctggctccgggtccccctccctttgggctagagtggcgacgccagcacctgggtaagggacatctgctcctggctgcaactcctgggctgaatggccagatgccagcagcccaagaaggggccgtggcatttgctgcttgggatgatgatgagccatggggcccatggaccggaaatgggaccttctggctgcctagagttcaaccctttcaggagggcacctatctggccaccatacacctgccatacctgcaaggacaggtcaccctggagcttgctgtgtacaaaccccccaaagtgtccctgatgccagcaacccttgcacgggccgccccaggggaggcacccccggaattgctctgccttgtgtcccacttctacccttctgggggcctggaggtggagtgggaactccggggtggcccagggggccgctctcagaaggccgaggggcagaggtggctctcggccctgcgccaccattccgatggctctgtcagcctctctgggcacttgcagccgcccccagtcaccactgagcagcatggggcacgctatgcctgtcgaattcaccatcccagcctgcctgcctcggggcgcagcgctgaggtcaccctggaggtagcaggtctttcagggccctcccttgaggacagcgtaggccttttcctgtctgcctttcttctgcttgggctcttcaaggcactgggctgggctgctgtctacctgtccacctgcaaggattcaaagaagaaagcagagtgagggcactcactgccatcctgtggaagccaccatcatctctggcccaagcttctgtagtagctccctaaaataataccctatcatctgctcctaatccctccaatctctctccactgagtggctggaatgcttttttttttttctttcacttatataagggataatttttcttttttttttttttttgagacggagtctcacctcttccgcccaggctgcagtgcagtggcatgatcttggcttactgcaacctccgcctcctgggttcaagcaattctgtggcttcagcctccggagtagctgggattacaggcacatgccaccacacccagtgaatttttgtatttttagtagagacggggtttcaccatgttggccaggctggtcttgaattcctgacctcaggtgatctgcccacctcagcctcccaaagtgctgggattacaggcgtgagccaccacaccaggcccgagaaatgcttttttaaaaaacacacatcttatggcattcaccttcttggagctctaggacagtggttctcaaaatttttttctctcaggacctcttaaaaatcatcaaggaccccaaaaagcttttgggtatgtgggttatagctatcaatatttatggtactagaacttaaaagtgagaaaaatttaaaacacgagaatacataggcacacattctattcatcgtgggaaccatggtgtcaatacatatcatgtagcttctgaaaaactccactgtacacttatagaatgaagaaggcaaaaaactttttttttttttttttggagacggagtctcgctctgtcgcccaggctggagtgcagtggcgcgatctcggctcactgcaagctccgcctctcgggttcacgccattctcctgcctcagcctcccaagtagctcggactacaggcgtcctccaccatgcctggctaatattttgtattttttagtagagacggggtttcaccgtgttagccaggatggtctcgatctcctaacctggtgatccgcccgcctcggcctcccaaagtattgggattacccgcgtgagccaccgcgcccggctgcaaataatctttctttttttctttttttctgagacagagtctcgctctgttgcccaggctggagtgcagtggcacgatctcggctcacggcacgctccgcctcccgggttcacgccattctcctgcctcagcttcccgagtagctgggactacaggggcccgccaccacgcccggctaactttttgtgtttttagtagagacggggtttcaccgtgttagccaggatggtctcgatctcctgaccttgtgatctgcccgcctcggcctcccaaagtgctgggattacaggcgtgagccaccgcgcccggcggcgaaacacgatattgtactaacatcttaattttgttataaaatctcacaaaccccctgacatagtctcagagatctgtagggccgaggttacatttggagaacccgtactctagggccaaatccattcttcttgccctggctcacttgtcccccccaccgccccgcgctggagccactgcctagtccctcttgtgcggttcaccacagttgtatttaagtgatcgtgtgagtcgtcgttaaatgcctgtctccccgcggatcatgggctcctcgaggacagggaccggcctgtctgtccactgctgtaaccccgcgccggcatagggacctaaggcccactggagggcgctcatcaagtagctgctggatgttgacgaaggaagcggcggcgcagctcagggatctccgagtcaggacggtcggccagacccacggggtaacgggtctaatcgtgtaggaataaagctgtattccagtgctccaaa

SEQ ID NO: 299426 - DNA, 3501 bp, Homo sapiens
ggggacgcggcacagatagggggaagccggagtaatggttttcgggcaagtggatgttggagagcacacacaggagttggggggcgggggagggcctggggttggggagggctcgaactcggggctgctgggtagtccaggagggcgcggtaaggctggggtgtcctggtgagaactggagaggatctacccgggtccctgcctggccagtggggaaacaccggtcccccaggcaccttcacctaaccagagcggggatttccaccgcccctcatgccgccctttggaggaaagtgaaagtgaaaggaggaagaggaggcttcatggctgaggaggtcgcagcgccatgaagtccctgtctctgctcctcgctgtggctttgggcctggcgaccgccgtctcagcaggacccgcggtgatcgagtgttggttcgtggaggatgcgagcggaaagggcctggccaagagacccggtgcactgctgttgcgccagggaccgggggaaccgccgccccggccggacctcgaccctgagctctatctcagtgtacacgaccccgcgggcgccctccaggctgccttcaggcggtatccccggggcgcccccgcaccacactgcgagatgagccgcttcgtgcctctccccgcctctgcgaaatgggccagcggcctgacccccgcgcagaactgcccgcgggccctggatggggcttggctgatggtcagcatatccagcccagtcctcagcctctccagcctcttgcgaccacagccagagcctcagcaggagcctgttctcatcaccatggcaacagtggtactgactgtcctcacccacacccctgcccctcgagtgagactgggacaagatgctctgctggacttgagctttgcctacatgccccccacctccgaggccgcctcatctctggctccgggtccccctccctttgggctagagtggcgacgccagcacctgggtaagggacatctgctcctggctgcaactcctgggctgaatggccagatgccagcagcccaagaaggggccgtggcatttgctgcttgggatgatgatgagccatggggcccatggaccggaaatgggaccttctggctgcctagagttcaaccctttcaggagggcacctatctggccaccatacacctgccatacctgcaaggacaggtcaccctggagcttgctgtgtacaaaccccccaaagtgtccctgatgccagcaacccttgcacgggccgccccaggggaggcacccccggaattgctctgccttgtgtcccacttctacccttctgggggcctggaggtggagtgggaactccggggtggcccagggggccgctctcagaaggccgaggggcagaggtggctctcggccctgcgccaccattccgatggctctgtcagcctctctgggcacttgcagccgcccccagtcaccactgagcagcatggggcacgctatgcctgtcgaattcaccatcccagcctgcctgcctcggggcgcagcgctgaggtcaccctggaggtagcaggtctttcagggccctcccttgaggacagcgtaggccttttcctgtctgcctttcttctgcttgggctcttcaaggcactgggctgggctgctgtctacctgtccacctgcaaggattcaaagaagaaagcagagtgagggcactcactgccatcctgtggaagccaccatcatctctggcccaagcttctgtagtagctccctaaaataataccctatcatctgctcctaatccctccaatctctctccactgagtggctggaatgcttttttttttttctttcacttatataagggataatttttcttttttttttttttttgagacggagtctcacctcttccgcccaggctgcagtgcagtggcatgatcttggcttactgcaacctccgcctcctgggttcaagcaattctgtggcttcagcctccggagtagctgggattacaggcacatgccaccacacccagtgaatttttgtatttttagtagagacggggtttcaccatgttggccaggctggtcttgaattcctgacctcaggtgatctgcccacctcagcctcccaaagtgctgggattacaggcgtgagccaccacaccaggcccgagaaatgcttttttaaaaaacacacatcttatggcattcaccttcttggagctctaggacagtggttctcaaaatttttttctctcaggacctcttaaaaatcatcaaggaccccaaaaagcttttgggtatgtgggttatagctatcaatatttatggtactagaacttaaaagtgagaaaaatttaaaacacgagaatacataggcacacattctattcatcgtgggaaccatggtgtcaatacatatcatgtagcttctgaaaaactccactgtacacttatagaatgaagaaggcaaaaaactttttttttttttttttggagacggagtctcgctctgtcgcccaggctggagtgcagtggcgcgatctcggctcactgcaagctccgcctctcgggttcacgccattctcctgcctcagcctcccaagtagctcggactacaggcgtcctccaccatgcctggctaatattttgtattttttagtagagacggggtttcaccgtgttagccaggatggtctcgatctcctaacctggtgatccgcccgcctcggcctcccaaagtattgggattacccgcgtgagccaccgcgcccggctgcaaataatctttctttttttctttttttctgagacagagtctcgctctgttgcccaggctggagtgcagtggcacgatctcggctcacggcacgctccgcctcccgggttcacgccattctcctgcctcagcttcccgagtagctgggactacaggggcccgccaccacgcccggctaactttttgtgtttttagtagagacggggtttcaccgtgttagccaggatggtctcgatctcctgaccttgtgatctgcccgcctcggcctcccaaagtgctgggattacaggcgtgagccaccgcgcccggcggcgaaacacgatattgtactaacatcttaattttgttataaaatctcacaaaccccctgacatagtctcagagatctgtagggccgaggttacatttggagaacccgtactctagggccaaatccattcttcttgccctggctcacttgtcccccccaccgccccgcgctggagccactgcctaccccgcggatcatgggctcctcgaggacagggaccggcctgtctgtccactgctgtaaccccgcgccggcatagggacctaaggcccactggagggcgctcatcaagtagctgctggatgttgacgaaggaagcggcggcgcagctcagggatctccgagtcaggacggtcggccagacccacggggtaacgggtctaatcgtgtaggaataaagctgtattccagtgctccaaa

SEQ ID NO: 299427 - DNA, 3996 bp, Homo sapiens
  misc_feature (3337)..(3337): n is a, c, g, or t
  misc_feature (3367)..(3367): n is a, c, g, or t
ggggacgcggcacagatagggggaagccggagtaatggttttcgggcaagtggatgttggagagcacacacaggagttggggggcgggggagggcctggggttggggagggctcgaactcggggctgctgggtagtccaggagggcgcggtaaggctggggtgtcctggtgagaactggagaggatctacccgggtccctgcctggccagtggggaaacaccggtcccccaggcaccttcacctaaccagagcggggatttccaccgcccctcatgccgccctttggaggaaagtgaaagtgaaaggaggaagaggaggcttcatggctgaggaggtcgcagcgccatgaagtccctgtctctgctcctcgctgtggctttgggcctggcgaccgccgtctcagcaggacccgcggtgatcgagtgttggttcgtggaggatgcgagcggaaagggcctggccaagagacccggtgcactgctgttgcgccagggaccgggggaaccgccgccccggccggacctcgaccctgagctctatctcagtgtacacgaccccgcgggcgccctccaggctgccttcaggcggtatccccggggcgcccccgcaccacactgcgagatgagccgcttcgtgcctctccccgcctctgcgaaatgggccagcggcctgacccccgcgcagaactgcccgcgggccctggatggggcttggctgatggtcagcatatccagcccagtcctcagcctctccagcctcttgcgaccacagccagagcctcagcaggagcctgttctcatcaccatggcaacagtggtactgactgtcctcacccacacccctgcccctcgagtgagactgggacaagatgctctgctggacttgagctttgcctacatgccccccacctccgaggccgcctcatctctggctccgggtccccctccctttgggctagagtggcgacgccagcacctgggtaagggacatctgctcctggctgcaactcctgggctgaatggccagatgccagcagcccaagaaggggccgtggcatttgctgcttgggatgatgatgagccatggggcccatggaccggaaatgggaccttctggctgcctagagttcaaccctttcaggagggcacctatctggccaccatacacctgccatacctgcaaggacaggtcaccctggagcttgctgtgtacaaaccccccaaagtgtccctgatgccagcaacccttgcacgggccgccccaggggaggcacccccggaattgctctgccttgtgtcccacttctacccttctgggggcctggaggtggagtgggaactccggggtggcccagggggccgctctcagaaggccgaggggcagaggtggctctcggccctgcgccaccattccgatggctctgtcagcctctctgggcacttgcagccgcccccagtcaccactgagcagcatggggcacgctatgcctgtcgaattcaccatcccagcctgcctgcctcggggcgcagcgctgaggtcaccctggaggtagcaggtctttcagggccctcccttgaggacagcgtaggccttttcctgtctgcctttcttctgcttgggctcttcaaggcactgggctgggctgctgtctacctgtccacctgcaaggattcaaagaagaaagcagagtgagggcactcactgccatcctgtggaagccaccatcatctctggcccaagcttctgtagtagctccctaaaataataccctatcatctgctcctaatccctccaatctctctccactgagtggctggaatgcttttttttttttctttcacttatataagggataatttttcttttttttttttttttgagacggagtctcacctcttccgcccaggctgcagtgcagtggcatgatcttggcttactgcaacctccgcctcctgggttcaagcaattctgtggcttcagcctccggagtagctgggattacaggcacatgccaccacacccagtgaatttttgtatttttagtagagacggggtttcaccatgttggccaggctggtcttgaattcctgacctcaggtgatctgcccacctcagcctcccaaagtgctgggattacaggcgtgagccaccacaccaggcccgagaaatgcttttttaaaaaacacacatcttatggcattcaccttcttggagctctaggacagtggttctcaaaatttttttctctcaggacctcttaaaaatcatcaaggaccccaaaaagcttttgggtatgtgggttatagctatcaatatttatggtactagaacttaaaagtgagaaaaatttaaaacacgagaatacataggcacacattctattcatcgtgggaaccatggtgtcaatacatatcatgtagcttctgaaaaactccactgtacacttatagaatgaagaaggcaaaaaactttttttttttttttttggagacggagtctcgctctgtcgcccaggctggagtgcagtggcgcgatctcggctcactgcaagctccgcctctcgggttcacgccattctcctgcctcagcctcccaagtagctcggactacaggcgtcctccaccatgcctggctaatattttgtattttttagtagagacggggtttcaccgtgttagccaggatggtctcgatctcctaacctggtgatccgcccgcctcggcctcccaaagtattgggattacccgcgtgagccaccgcgcccggctgcaaataatctttctttttttctttttttctgagacagagtctcgctctgttgcccaggctggagtgcagtggcacgatctcggctcacggcacgctccgcctcccgggttcacgccattctcctgcctcagcttcccgagtagctgggactacaggggcccgccaccacgcccggctaactttttgtgtttttagtagagacggggtttcaccgtgttagccaggatggtctcgatctcctgaccttgtgatctgcccgcctcggcctcccaaagtgctgggattacaggcgtgagccaccgcgcccggcggcgaaacacgatattgtactaacatcttaattttgttataaaatctcacaaaccccctgacatagtctcagagatctgtagggccgaggttacatttggagaacccgtactctagggccaaatccattcttcttgccctggctcacttgtcccccccaccgccccgcgctggagccactgcctagttcttcagccctagatggtgctcgccagacctcctctcaatgctcatcacacacagggctattccgttgntcctccagataaactccatgctcccccaangcagcaagaaaaagagaaagaaaaaaaaaacaacacaaaaaaaaaaaaaaaaaaaaaaaaaaaaaaaaaaaaaaaaaaaaaaaaaaaggggggggggcgccccataaagacaactccctcaggggggggccaccagtattacgcacccacgccgcgcatgtttggtgatacaagcgagtggcccccaaaaggagacggaggcgtctaagcggcgcgagacgagcgcgccgcgcgccgctataacacgcgtgtgagcgagcgggacgacaccacacacgcgcctacgcgagcgaaccacttcttggcgacacgccaacacccacactcactgccgggcggcggcgcgacacaaacgtggggggcacccaccacccaccccccgcgactactcgtcaacgaccccactggcggcgcgtccacacatcatccatgctttctgaagggttggtcgtactcaggcggggttgacactactcaccactctcccgcctctatatcgcgcgtgcgcgcgcccgtacagcaacaactagcttgcctactcccgcgcaggatctctcttgctttctctagtagctagataattttattacaccgagacggcatttcacgtttttgtaataaactcggga

SEQ ID NO: 299428 - DNA, 1074 bp, Homo sapiens
tgggacaaacctcaaccctatcccgggacaatcctttaaattaaaaaggaattttgcgaatttggcccattgggtaaaaaaagaacttattttacaaaaaatttcaccgaatttttaccaaaatttaacgccttcaattttccaattgccctttagggtgcgccactttttggaaaggccattggttcgggcctttttcctattaccccaacttgggaaaaggggattttcttcaaagcgatttaatttgggaaccccaaggtttttccaattccgacgtttttaaacggcggccaattaattgttaaaccgccccccataaggccaatttgggtccggggcccccccccaggttttttttttttttttttttttttttttttttttttttttttttttttttttttttttttttttttttttttttttttttttttttttttttttttttttttttttttgatctgtagggccgaggttacatttggagaacccgtactctagggccaaatccattcttcttgccctggctcacttgtcccccccaccgccccgcgctggagccactgcctagttcttcagccctagatggtgctcgccagacctcctctcaatgctcatcacacacagggctattcctttcctccaatgaaccaaacgcctcccgcccacctccaggtcccagtcctctgttccctttgcctggtccacccttgccctccctgggtcgcagacgaggtcggcctcgtcattccccgcagaccgccgcgcgtccctcttgtgcggttcaccacagttgtatttaagtgatcgtgtgagtcgtcgttaaatgcctgtctccccgcggatcatgggctcctcgaggacagggaccggcctgtctgtccactgctgtaaccccgcgccggcatagggacctaaggcccactggagggcgctcatcaagtagctgctggatgttgacgaaggaagcggcggcgcagctcagggatctccgagtcaggacggtcggccagacccacggggtaacgggtctaatcgtgtaggaataaagctgtattccagtgctccaaa

SEQ ID NO: 299429 - DNA, 807 bp, Homo sapiens
aaaaaaaaaaaaaaaaaaagaaagaaaagaaaataaattgcagcccttttctcaccttaagtattcaaacacaggtgtttattttaaatagtcagcacatctcaattcggactagccacatatcaaatgctcaatagcctaatgtgggtggtggctgtcatattggacagcggagcctgagaggacttttaggaggattaaggaagacagtgtatctccttaagaagatgcaggagatacagcactcagcacagtgtctggagggcagaaaatattagcctcatccttctcccatcatctgtgcccatgatagtttatatgtctctaaactgaccatgtacacctcaactgccttttaatatcctgaattcctttcctccaatgaaccaaacgcctcccgcccacctccaggtcccagtcctctgttccctttgcctggtccacccttgccctccctgggtcgcagacgaggtcggcctcgtcattccccgcagaccgccgcgcgtccctcttgtgcggttcaccacagttgtatttaagtgatcgtgtgagtcgtcgttaaatgcctgtctccccgcggatcatgggctcctcgaggacagggaccggcctgtctgtccactgctgtaaccccgcgccggcatagggacctaaggcccactggagggcgctcatcaagtagctgctggatgttgacgaaggaagcggcggcgcagctcagggatctccgagtcaggacggtcggccagacccacggggtaacgggtctaatcgtgtaggaataaagctgtattccagtgctccaaa

SEQ ID NO: 299430 - DNA, 1818 bp, Homo sapiens
  misc_feature (1795)..(1795): n is a, c, g, or t
ggggacgcggcacagatagggggaagccggagtaatggttttcgggcaagtggatgttggagagcacacacaggagttggggggcgggggagggcctggggttggggagggctcgaactcggggctgctgggtagtccaggagggcgcggtaaggctggggtgtcctggtgagaactggagaggatctacccgggtccctgcctggccagtggggaaacaccggtcccccaggcaccttcacctaaccagagcggggatttccaccgcccctcatgccgccctttggaggaaagtgaaagtgaaaggaggaagaggaggcttcatggctgaggaggtcgcagcgccatgaagtccctgtctctgctcctcgctgtggctttgggcctggcgaccgccgtctcagcaggacccgcggtgatcgagtgttggttcgtggaggatgcgagcggaaagggcctggccaagagacccggtgcactgctgttgcgccagggaccgggggaaccgccgccccggccggacctcgaccctgagctctatctcagtgtacacgaccccgcgggcgccctccaggctgccttcaggcggtatccccggggcgcccccgcaccacactgcgagatgagccgcttcgtgcctctccccgcctctgcgaaatgggccagcggcctgacccccgcgcagaactgcccgcgggccctggatggggcttggctgatggtcagcatatccagcccagtcctcagcctctccagcctcttgcgaccacagccagagcctcagcaggagcctgttctcatcaccatggcaacagtggtactgactgtcctcacccacacccctgcccctcgagtgagactgggacaagatgctctgctggacttgagctttgcctacatgccccccacctccgaggccgcctcatctctggctccgggtccccctccctttgggctagagtggcgacgccagcacctgggtaagggacatctgctcctggctgcaactcctgggctgaatggccagatgccagcagcccaagaaggggccgtggcatttgctgcttgggatgatgatgagccatggggcccatggaccggaaatgggaccttctggctgcctagagttcaaccctttcaggagggcacctatctggccaccatacacctgccatacctgcaaggacaggtcaccctggagcttgctgtgtacaaaccccccaaagtgtccctgatgccagcaacccttgcacgggccgccccaggggaggcacccccggaattgctctgccttgtgtcccacttctacccttctgggggcctggaggtggagtgggaactccggggtggcccagggggccgctctcagaaggccgaggggcagaggtggctctcggccctgcgccaccattccgatggctctgtcagcctctctgggcacttgcagccgcccccagtcaccactgagcagcatggggcacgctatgcctgtcgaattcaccatcccagcctgcctgcctcggggcgcagcgctgaggtcaccctggaggtagcaggtctttcagggccctcccttgaggacagcgtaggccttttcctgtctgcctttcttctgcttgggctcttcaaggcactgggctgggctgctgtctacctgtccacctgcaaggattcaaagaagaaagcagagtgagggcactcactgccatcctgtggaagccaccatcatctctggcccaagcttctgtagtagctccctaaaataatacccgtaatgatcatcataataatagcncgatactgtgaggccccatttat

SEQ ID NO: 299431 - DNA, 2673 bp, Homo sapiens
ggggacgcggcacagatagggggaagccggagtaatggttttcgggcaagtggatgttggagagcacacacaggagttggggggcgggggagggcctggggttggggagggctcgaactcggggctgctgggtagtccaggagggcgcggtaaggctggggtgtcctggtgagaactggagaggatctacccgggtccctgcctggccagtggggaaacaccggtcccccaggcaccttcacctaaccagagcggggatttccaccgcccctcatgccgccctttggaggaaagtgaaagtgaaaggaggaagaggaggcttcatggctgaggaggtcgcagcgccatgaagtccctgtctctgctcctcgctgtggctttgggcctggcgaccgccgtctcagcaggacccgcggtgatcgagtgttggttcgtggaggatgcgagcggaaagggcctggccaagagacccggtgcactgctgttgcgccagggaccgggggaaccgccgccccggccggacctcgaccctgagctctatctcagtgtacacgaccccgcgggcgccctccaggctgccttcaggcggtatccccggggcgcccccgcaccacactgcgagatgagccgcttcgtgcctctccccgcctctgcgaaatgggccagcggcctgacccccgcgcagaactgcccgcgggccctggatggggcttggctgatggtcagcatatccagcccagtcctcagcctctccagcctcttgcgaccacagccagagcctcagcaggagcctgttctcatcaccatggcaacagtggtactgactgtcctcacccacacccctgcccctcgagtgagactgggacaagatgctctgctggacttgagctttgcctacatgccccccacctccgaggccgcctcatctctggctccgggtccccctccctttgggctagagtggcgacgccagcacctgggtaagggacatctgctcctggctgcaactcctgggctgaatggccagatgccagcagcccaagaaggggccgtggcatttgctgcttgggatgatgatgagccatggggcccatggaccggaaatgggaccttctggctgcctagagttcaaccctttcaggagggcacctatctggccaccatacacctgccatacctgcaaggacaggtcaccctggagcttgctgtgtacaaaccccccaaagtgtccctgatgccagcaacccttgcacgggccgccccaggggaggcacccccggaattgctctgccttgtgtcccacttctacccttctgggggcctggaggtggagtgggaactccggggtggcccagggggccgctctcagaaggccgaggggcagaggtggctctcggccctgcgccaccattccgatggctctgtcagcctctctgggcacttgcagccgcccccagtcaccactgagcagcatggggcacgctatgcctgtcgaattcaccatcccagcctgcctgcctcggggcgcagcgctgaggtcaccctggaggtagcaggtaagagctgggagctctgcggaatctgagccagcacccaggaagacaggagctcactctcaccccttctgcctgccaggtctttcagggccctcccttgaggacagcgtaggccttttcctgtctgcctttcttctgcttgggctcttcaaggcactgggctgggctggtaagtgtcagccctaccctgaccatgacctgaggttggtggactttccccacctactcccaagagcctgacacccatccctctgccctccacctctaccactccagcatcccatcccttctcaatctttccccacagctgtctacctgtccacctgcaaggattcaaagaaggtacagtgctccacctctctgtatctttcccttgtcactttatctcctcatcctatctcaaaacccatggagggaggctgctggtgtggtaggcagaacctaggcttggaattcacactgatctgggttaaaacctggcactatatcctaactgtaggactctttgagcatgctacttaatctatatgtttccttgggtgtagggattttaaaaagttacttaggcagtgctgtccaatagaaagataatgcaagccacatatgtaaatttaaatactctagtactcacattaaaaaaataagcagaaacaggtaaaattaacttaataatataccttatttaatctaataattctggtcccttatctgaaatgcttgggtcagaagtgtttttggatgttggattttttcagactttggaatatttgcatatatttaatatctttgggatcagacccaaatctaaacacagaaatcatttatgtttcctatacactcacaccattgcactccagcctgggtgacaaaaggaaaacttcgtctcaacaacaaaaaaaaaagaaaaagaaattacagtcttggccaggtgcgttggttcacgcctgtaatcctagcactttgggaggctgaggagggcggatcacctgaggtcaggagttcaagaccagcctggcctcaggtgatcccgcctgcctccgccttcccagagtgctgggattacaggctgagccaccgtacctcgcacatttcgacatctgtaacaacgtcagacatg

SEQ ID NO: 299432 - DNA, 2715 bp, Homo sapiens
ggggacgcggcacagatagggggaagccggagtaatggttttcgggcaagtggatgttggagagcacacacaggagttggggggcgggggagggcctggggttggggagggctcgaactcggggctgctgggtagtccaggagggcgcggtaaggctggggtgtcctggtgagaactggagaggatctacccgggtccctgcctggccagtggggaaacaccggtcccccaggcaccttcacctaaccagagcggggatttccaccgcccctcatgccgccctttggaggaaagtgaaagtgaaaggaggaagaggaggcttcatggctgaggaggtcgcagcgccatgaagtccctgtctctgctcctcgctgtggctttgggcctggcgaccgccgtctcagcaggacccgcggtgatcgagtgttggttcgtggaggatgcgagcggaaagggcctggccaagagacccggtgcactgctgttgcgccagggaccgggggaaccgccgccccggccggacctcgaccctgagctctatctcagtgtacacgaccccgcgggcgccctccaggctgccttcaggcggtatccccggggcgcccccgcaccacactgcgagatgagccgcttcgtgcctctccccgcctctgcgaaatgggccagcggcctgacccccgcgcagaactgcccgcgggccctggatggggcttggctgatggtcagcatatccagcccagtcctcagcctctccagcctcttgcgaccacagccagagcctcagcaggagcctgttctcatcaccatggcaacagtggtactgactgtcctcacccacacccctgcccctcgagtgagactgggacaagatgctctgctggacttgagctttgcctacatgccccccacctccgaggccgcctcatctctggctccgggtccccctccctttgggctagagtggcgacgccagcacctgggtaagggacatctgctcctggctgcaactcctgggctgaatggccagatgccagcagcccaagaaggggccgtggcatttgctgcttgggatgatgatgagccatggggcccatggaccggaaatgggaccttctggctgcctagagttcaaccctttcaggagggcacctatctggccaccatacacctgccatacctgcaaggacaggtcaccctggagcttgctgtgtacaaaccccccaaagtgtccctgatgccagcaacccttgcacgggccgccccaggggaggcacccccggaattgctctgccttgtgtcccacttctacccttctgggggcctggaggtggagtgggaactccggggtggcccagggggccgctctcagaaggccgaggggcagaggtggctctcggccctgcgccaccattccgatggctctgtcagcctctctgggcacttgcagccgcccccagtcaccactgagcagcatggggcacgctatgcctgtcgaattcaccatcccagcctgcctgcctcggggcgcagcgctgaggtcaccctggaggtagcaggtaagagctgggagctctgcggaatctgagccagcacccaggaagacaggagctcactctcaccccttctgcctgccaggtctttcagggccctcccttgaggacagcgtaggccttttcctgtctgcctttcttctgcttgggctcttcaaggcactgggctgggctggtaagtgtcagccctaccctgaccatgacctgaggttggtggactttccccacctactcccaagagcctgacacccatccctctgccctccacctctaccactccagcatcccatcccttctcaatctttccccacagctgtctacctgtccacctgcaaggattcaaagaaggtacagtgctccacctctctgtatctttcccttgtcactttatctcctcatcctatctcaaaacccatggagggaggctgctggtgtggtaggcagaacctaggcttggaattcacactgatctgggttaaaacctggcactatatcctaactgtaggactctttgagcatgctacttaatctatatgtttccttgggtgtagggattttaaaaagttacttaggcagtgctgtccaatagaaagataatgcaagccacatatgtaaatttaaatactctagtactcacattaaaaaaataagcagaaacaggtaaaattaacttaataatataccttatttaatctaataattctggtcccttatctgaaatgcttgggtcagaagtgtttttggatgttggattttttcagactttggaatatttgcatatatttaatatctttgggatcagacccaaatctaaacacagaaatcatttatgtttcctatacaccttatacacatggcctgaagatttttttccttctcttttttttcacaccattgcactccagcctgggtgacaaaaggaaaacttcgtctcaacaacaaaaaaaaaagaaaaagaaattacagtcttggccaggtgcgttggttcacgcctgtaatcctagcactttgggaggctgaggagggcggatcacctgaggtcaggagttcaagaccagcctggcctcaggtgatcccgcctgcctccgccttcccagagtgctgggattacaggctgagccaccgtacctcgcacatttcgacatctgtaacaacgtcagacatg

SEQ ID NO: 299433 - DNA, 2535 bp, Homo sapiens
ggggacgcggcacagatagggggaagccggagtaatggttttcgggcaagtggatgttggagagcacacacaggagttggggggcgggggagggcctggggttggggagggctcgaactcggggctgctgggtagtccaggagggcgcggtaaggctggggtgtcctggtgagaactggagaggatctacccgggtccctgcctggccagtggggaaacaccggtcccccaggcaccttcacctaaccagagcggggatttccaccgcccctcatgccgccctttggaggaaagtgaaagtgaaaggaggaagaggaggcttcatggctgaggaggtcgcagcgccatgaagtccctgtctctgctcctcgctgtggctttgggcctggcgaccgccgtctcagcaggacccgcggtgatcgagtgttggttcgtggaggatgcgagcggaaagggcctggccaagagacccggtgcactgctgttgcgccagggaccgggggaaccgccgccccggccggacctcgaccctgagctctatctcagtgtacacgaccccgcgggcgccctccaggctgccttcaggcggtatccccggggcgcccccgcaccacactgcgagatgagccgcttcgtgcctctccccgcctctgcgaaatgggccagcggcctgacccccgcgcagaactgcccgcgggccctggatggggcttggctgatggtcagcatatccagcccagtcctcagcctctccagcctcttgcgaccacagccagagcctcagcaggagcctgttctcatcaccatggcaacagtggtactgactgtcctcacccacacccctgcccctcgagtgagactgggacaagatgctctgctggacttgagctttgcctacatgccccccacctccgaggccgcctcatctctggctccgggtccccctccctttgggctagagtggcgacgccagcacctgggtaagggacatctgctcctggctgcaactcctgggctgaatggccagatgccagcagcccaagaaggggccgtggcatttgctgcttgggatgatgatgagccatggggcccatggaccggaaatgggaccttctggctgcctagagttcaaccctttcaggagggcacctatctggccaccatacacctgccatacctgcaaggacaggtcaccctggagcttgctgtgtacaaaccccccaaagtgtccctgatgccagcaacccttgcacgggccgccccaggggaggcacccccggaattgctctgccttgtgtcccacttctacccttctgggggcctggaggtggagtgggaactccggggtggcccagggggccgctctcagaaggccgaggggcagaggtggctctcggccctgcgccaccattccgatggctctgtcagcctctctgggcacttgcagccgcccccagtcaccactgagcagcatggggcacgctatgcctgtcgaattcaccatcccagcctgcctgcctcggggcgcagcgctgaggtcaccctggaggtagcaggtaagagctgggagctctgcggaatctgagccagcacccaggaagacaggagctcactctcaccccttctgcctgccaggtctttcagggccctcccttgaggacagcgtaggccttttcctgtctgcctttcttctgcttgggctcttcaaggcactgggctgggctgctgtctacctgtccacctgcaaggattcaaagaaggtacagtgctccacctctctgtatctttcccttgtcactttatctcctcatcctatctcaaaacccatggagggaggctgctggtgtggtaggcagaacctaggcttggaattcacactgatctgggttaaaacctggcactatatcctaactgtaggactctttgagcatgctacttaatctatatgtttccttgggtgtagggattttaaaaagttacttaggcagtgctgtccaatagaaagataatgcaagccacatatgtaaatttaaatactctagtactcacattaaaaaaataagcagaaacaggtaaaattaacttaataatataccttatttaatctaataattctggtcccttatctgaaatgcttgggtcagaagtgtttttggatgttggattttttcagactttggaatatttgcatatatttaatatctttgggatcagacccaaatctaaacacagaaatcatttatgtttcctatacactcacaccattgcactccagcctgggtgacaaaaggaaaacttcgtctcaacaacaaaaaaaaaagaaaaagaaattacagtcttggccaggtgcgttggttcacgcctgtaatcctagcactttgggaggctgaggagggcggatcacctgaggtcaggagttcaagaccagcctggcctcaggtgatcccgcctgcctccgccttcccagagtgctgggattacaggctgagccaccgtacctcgcacatttcgacatctgtaacaacgtcagacatg

SEQ ID NO: 299434 - DNA, 2496 bp, Homo sapiens
ggggacgcggcacagatagggggaagccggagtaatggttttcgggcaagtggatgttggagagcacacacaggagttggggggcgggggagggcctggggttggggagggctcgaactcggggctgctgggtagtccaggagggcgcggtaaggctggggtgtcctggtgagaactggagaggatctacccgggtccctgcctggccagtggggaaacaccggtcccccaggcaccttcacctaaccagagcggggatttccaccgcccctcatgccgccctttggaggaaagtgaaagtgaaaggaggaagaggaggcttcatggctgaggaggtcgcagcgccatgaagtccctgtctctgctcctcgctgtggctttgggcctggcgaccgccgtctcagcaggacccgcggtgatcgagtgttggttcgtggaggatgcgagcggaaagggcctggccaagagacccggtgcactgctgttgcgccagggaccgggggaaccgccgccccggccggacctcgaccctgagctctatctcagtgtacacgaccccgcgggcgccctccaggctgccttcaggcggtatccccggggcgcccccgcaccacactgcgagatgagccgcttcgtgcctctccccgcctctgcgaaatgggccagcggcctgacccccgcgcagaactgcccgcgggccctggatggggcttggctgatggtcagcatatccagcccagtcctcagcctctccagcctcttgcgaccacagccagagcctcagcaggagcctgttctcatcaccatggcaacagtggtactgactgtcctcacccacacccctgcccctcgagtgagactgggacaagatgctctgctggacttgagctttgcctacatgccccccacctccgaggccgcctcatctctggctccgggtccccctccctttgggctagagtggcgacgccagcacctgggtaagggacatctgctcctggctgcaactcctgggctgaatggccagatgccagcagcccaagaaggggccgtggcatttgctgcttgggatgatgatgagccatggggcccatggaccggaaatgggaccttctggctgcctagagttcaaccctttcaggagggcacctatctggccaccatacacctgccatacctgcaaggacaggtcaccctggagcttgctgtgtacaaaccccccaaagtgtccctgatgccagcaacccttgcacgggccgccccaggggaggcacccccggaattgctctgccttgtgtcccacttctacccttctgggggcctggaggtggagtgggaactccggggtggcccagggggccgctctcagaaggccgaggggcagaggtggctctcggccctgcgccaccattccgatggctctgtcagcctctctgggcacttgcagccgcccccagtcaccactgagcagcatggggcacgctatgcctgtcgaattcaccatcccagcctgcctgcctcggggcgcagcgctgaggtcaccctggaggtagcaggtaagagctgggagctctgcggaatctgagccagcacccaggaagacaggagctcactctcaccccttctgcctgccaggtctttcagggccctcccttgaggacagcgtaggccttttcctgtctgcctttcttctgcttgggctcttcaaggcactgggctgggctggtaagtgtcagccctaccctgaccatgacctgaggttggtggactttccccacctactcccaagagcctgacacccatccctctgccctccacctctaccactccagcatcccatcccttctcaatctttccccacagctgtctacctgtccacctgcaaggattcaaagaaggtacagtgctccacctctctgtatctttcccttgtcactttatctcctcatcctatctcaaaacccatggagggaggctgctggtgtggtaggcagaacctaggcttggaattcacactgatctgggttaaaacctggcactatatcctaactgtaggactctttgagcatgctacttaatctatatgtttccttgggtgtagggattttaaaaagttacttaggcagtgctgtccaatagaaagataatgcaagccacatatgtaaatttaaatactctagtactcacattaaaaaaataagcagaaacaggtaaaattaacttaataatataccttatttaatctaataattctggtcccttatctgaaatgcttgggtcagaagtgtttttggatgttggattttttcagactttggaatatttgcatatatttaatatctttgggatcagacccaaatctaaacacagaaatcatttatgtttcctatacaccttatacacatggcctgaagatttttttccttctctttttttttgagacagagtctctgtcgcccaggctggggtgcagtggtgcgatctcggctcactgca

SEQ ID NO: 299435 - DNA, 3023 bp, Homo sapiens
ggggacgcggcacagatagggggaagccggagtaatggttttcgggcaagtggatgttggagagcacacacaggagttggggggcgggggagggcctggggttggggagggctcgaactcggggctgctgggtagtccaggagggcgcggtaaggctggggtgtcctggtgagaactggagaggatctacccgggtccctgcctggccagtggggaaacaccggtcccccaggcaccttcacctaaccagagcggggatttccaccgcccctcatgccgccctttggaggaaagtgaaagtgaaaggaggaagaggaggcttcatggctgaggaggtcgcagcgccatgaagtccctgtctctgctcctcgctgtggctttgggcctggcgaccgccgtctcagcaggacccgcggtgatcgagtgttggttcgtggaggatgcgagcggaaagggcctggccaagagacccggtgcactgctgttgcgccagggaccgggggaaccgccgccccggccggacctcgaccctgagctctatctcagtgtacacgaccccgcgggcgccctccaggctgccttcaggcggtatccccggggcgcccccgcaccacactgcgagatgagccgcttcgtgcctctccccgcctctgcgaaatgggccagcggcctgacccccgcgcagaactgcccgcgggccctggatggggcttggctgatggtcagcatatccagcccagtcctcagcctctccagcctcttgcgaccacagccagagcctcagcaggagcctgttctcatcaccatggcaacagtggtactgactgtcctcacccacacccctgcccctcgagtgagactgggacaagatgctctgctggacttgagctttgcctacatgccccccacctccgaggccgcctcatctctggctccgggtccccctccctttgggctagagtggcgacgccagcacctgggtaagggacatctgctcctggctgcaactcctgggctgaatggccagatgccagcagcccaagaaggggccgtggcatttgctgcttgggatgatgatgagccatggggcccatggaccggaaatgggaccttctggctgcctagagttcaaccctttcaggagggcacctatctggccaccatacacctgccatacctgcaaggacaggtcaccctggagcttgctgtgtacagtgagttgggggacagaggtctccaggggtagagggtgggcactggattgtggtgaccgtaatagggggagggatgatggataagagggtgcctgggcaagtaagtagagatagaaagaggttcctgggagttagaggggtaatgggaggctagaagtttcctggaaatttgaggggctttgacatgggtatttctgtgacgcaccaatggagagacagtgggttccctatttcaggagaagaaacctaaccttctttagttctgaggaagccagcaggcaaactgagggtctcttagggaggacagtatggactgatttccctatgctcatttcgtcctctttccccagaaccccccaaagtgtccctgatgccagcaacccttgcacgggccgccccaggggaggcacccccggaattgctctgccttgtgtcccacttctacccttctgggggcctggaggtggagtgggaactccggggtggcccagggggccgctctcagaaggccgaggggcagaggtggctctcggccctgcgccaccattccgatggctctgtcagcctctctgggcacttgcagccgcccccagtcaccactgagcagcatggggcacgctatgcctgtcgaattcaccatcccagcctgcctgcctcggggcgcagcgctgaggtcaccctggaggtagcaggtaagagctgggagctctgcggaatctgagccagcacccaggaagacaggagctcactctcaccccttctgcctgccaggtctttcagggccctcccttgaggacagcgtaggccttttcctgtctgcctttcttctgcttgggctcttcaaggcactgggctgggctggtaagtgtcagccctaccctgaccatgacctgaggttggtggactttccccacctactcccaagagcctgacacccatccctctgccctccacctctaccactccagcatcccatcccttctcaatctttccccacagctgtctacctgtccacctgcaaggattcaaagaaggtacagtgctccacctctctgtatctttcccttgtcactttatctcctcatcctatctcaaaacccatggagggaggctgctggtgtggtaggcagaacctaggcttggaattcacactgatctgggttaaaacctggcactatatcctaactgtaggactctttgagcatgctacttaatctatatgtttccttgggtgtagggattttaaaaagttacttaggcagtgctgtccaatagaaagataatgcaagccacatatgtaaatttaaatactctagtactcacattaaaaaaataagcagaaacaggtaaaattaacttaataatataccttatttaatctaataattctggtcccttatctgaaatgcttgggtcagaagtgtttttggatgttggattttttcagactttggaatatttgcatatatttaatatctttgggatcagacccaaatctaaacacagaaatcatttatgtttcctatacactcacaccattgcactccagcctgggtgacaaaaggaaaacttcgtctcaacaacaaaaaaaaaagaaaaagaaattacagtcttggccaggtgcgttggttcacgcctgtaatcctagcactttgggaggctgaggagggcggatcacctgaggtcaggagttcaagaccagcctggcctcaggtgatcccgcctgcctccgccttcccagagtgctgggattacaggctgagccaccgtacctcgcacatttcgacatctgtaacaacgtcagacatg

SEQ ID NO: 299436 - DNA, 1340 bp, Homo sapiens
ggggacgcggcacagatagggggaagccggagtaatggttttcgggcaagtggatgttggagagcacacacaggagttggggggcgggggagggcctggggttggggagggctcgaactcggggctgctgggtagtccaggagggcgcggtaaggctggggtgtcctggtgagaactggagaggatctacccgggtccctgcctggccagtggggaaacaccggtcccccaggcaccttcacctaaccagagcggggatttccaccgcccctcatgccgccctttggaggaaagtgaaagtgaaaggaggaagaggaggcttcatggctgaggaggtcgcagcgccatgaagtccctgtctctgctcctcgctgtggctttgggcctggcgaccgccgtctcagcaggacccgcggtgatcgagtgttggttcgtggaggatgcgagcggaaagggcctggccaagagacccggtgcactgctgttgcgccagggaccgggggaaccgccgccccggccggacctcgaccctgagctctatctcagtgtacacgaccccgcgggcgccctccaggctgccttcaggcggtatccccggggcgcccccgcaccacactgcgagatgagccgcttcgtgcctctccccgcctctgcgaaatgggccagcggcctgacccccgcgcagaactgcccgcgggccctggatggggcttggctgatggtcagcatatccagcccagtcctcagcctctccagcctcttgcgaccacagccagagcctcagcaggagcctgttctcatcaccatggcaacaggtagctggggaggggaggtggagaagggtgggtagattctaagggtccagatcagccggtggtctcgctttatggacttgagcaagacatttcgccaatcggggttcagtttcctttttttgttaagagaggtggtttggctagaatgaatcaatctctaccgctccttctagccctcacccagttaaaaaaaaaaaacaaaaaaaaaactgcagcttggcagggggtagggggaaagcagggccgggcaggggggttactttctggtgtttcgaagggcggggctttgaagaggtggggtttcccgacaccagaccttgagagacttgtcaggtgatgcgaggtgggaggggttcagaagcaggagcgttttttctctgctcttcccagatctgtgtcttgctctgcaccctcagctttgcgggtcactctttcaaaacccagcactctatccccacctgcgcccacacccggcgctgcggcaatccgcaaagcaaaggctcttgcactctagcgcgttgacct

SEQ ID NO: 299437 - DNA, 742 bp, Homo sapiens
cgggaggttgaggcaggagaattgcttgaacccgggaggcggaggttgcagtgagccaagatcgcgccattgcattccagcctggcgacagagcaagactccaactcaaaacaaacaaataacaacaacaacaacaaaaaggcattaacaacaacaacaaaaaggcattattaggaaatagttaaataaagatatcagggattgggccatgcacacatctgggggaacatgattcctgcaaagggaatagcaaatgcaatggctcttgtaggggcagagggttggagaaactgcaacagggccagtggggctgaagcacagagagagaggaaaaaaacaaggtaagagaagagacagttaacaaggggcccaagtcataaagcccatttgaagaacagtggctttcgctataagtgacaaggaaaaccactgaagtttttagcagaaagcagatgtcatctgacgtacattttgacaggatcactctacttgccacatagagcctggcatttagaaggtgctcaagaaacgaccagttgaaattgcataaaaattaaccaggccagggccgggcgcaaaggctcacacctataatcctagtactttgggaggctgaggtgggcggatcacgaggtcaggagatcgagaccatcctggctaacacggtgaaacccgtctccactaaaaatacaaaaaattagccgggcctggtggcgggggcctgtagtcccagctactcggg

SEQ ID NO: 299438 - DNA, 2372 bp, Homo sapiens
aaatgctctcagctgcactataccaaggcacgaggagctgagatgaataatgaacttaattttccataaagacattctgtttggcattccagctaataaggttccacaagatgaatggacagggtacaccccacgaggtaaagatgatgaaattccatgccgaagaatgcggagtggcagttatatcaaggccatgggggatgaagacagtggagactcagacacgagtcctaagccttctccaaaagttgctgcgcggagagaaagctatctcaaggctactcagccatcccttacagaactcaccacactcaaaatctccaatgaacactcacccaaactccagatccggagtcatagttacctgagggcagtgagtgaagtctccatcaaccggagcctggacagcctggaccctgcaggcttgctcacatcaccaaagttccgctccaggaatgagagctacatgcgagccatgagcaccatcagccaggtgagcgagatggaagtgaacgggcagttcgagtccgtgtgcgagtccgtgttcagcgagctggagtcgcaggccgtggaagcgctggacctgcccatgcccggctgcttccgcatgcggagccacagctatgtgcgggccattgagaaaggctgctcccaggacgacgagtgcgtgtccctgaggtcgtcctcgccgccgcgcaccaccaccaccgttaggaccatccagagcagcacggtgtcatcttgcattacaacatataagaagacaccacctccagtcccacccagaactaccacgaaacctttcatttctatcacagcccagagtagcacagagtcagcccaggatgcctacatggacggacagggccagcgaggagatattatcagccagtctggactcagcaactccaccgagagcctggacagtatgaaggctctgacagccgccatcgaagctgcaaacgcccagatccatggccctgccagtcaacacatgggcaataacactgccaccgtcaccaccacgactaccatagccaccgtcaccacggaggacaggaagaaggaccactttaagaaaaatcgatgcctgtctatcgggatacaggtggatgatgctgaagaacctgacaaaacaggggagaataaagcacccagtaagttccagtccgtgggagtgcaagtagaagaagagaagtgcttccgcaggttcactcgatccaacagtgtgacgacagcagtacaggccgacctggacttccatgataatctggaaaattctctggaatctatagaggacaattcgtgtcctggccccatggccagacagttctcccgcgatgccagcacctccacagtcagcattcagggctcaggaaaccattaccatgcctgtgccgccgatgatgactttgacacggattttgacccctctattctgcctcctccggacccctggattgactctatcactgaagaccctctggaggccgtgcaaaggtcagtgtgccaccgggatggccactggttcctgaagcttctccaggcagagcgagaccgcatggaggggtggtgtcaacagatggagcgggaagaacgggaaaacaacctgcccgaagacattctaggaaaaatccgaaccgcagtgggcagtgcccaacttctcatggcccagaaattctaccagttcagagaactgtgtgaagaaaacctgaatcctaatgctcatccaagacccacctcccaggatttggcggggttttgggacatgctgcagttgtccatagaaaatattagtatgaaatttgatgaacttcatcagttaaaggccaataattggaaacagatggatcctcttgacaagaaggtagaacaatgtagattttgtatggttcatttaaaaacctgcacaaacactggacagtctaaataggcttctgcattcagtcctgctgtttacaatgtgaaatggagctgatatcatattaatttcattgtaatgacaatgtttacatagtaatcatttgggatattatctgtaatatgtttcaggcatatttttaaagaaaaacctgtctttgtgaattggaaaatgggaatgtggctttttttgttaattaaactttaagttaaaccattttagtcactggaaggaactgcctccattttgctttttaaactaaaataaatgacatcttcagtgcatgaatccatagaacaagagttcaacttccttacacccctaggatgtgttttcaagaaaaataggatgccctgaaaaataactgactttgataatcatttcataaatatagtaataaagaaattactgttgttcaagtctaaaaatatataccataaagtttcacagt

SEQ ID NO: 299439 - DNA, 3445 bp, Homo sapiens
tgcccaagacgggtctggagcctgacttccgggtgtccatgaccctggcggctgcttccggtccgccatgaaagggctatcaggcagccgcagccatcaccacggggtcacctgcgactcggcctgtgactcgctgtcgcaccactccgaccgcaagccctacctgctgagcccagtggagcaccaccccgcagaccacccatactacacccagcggaactccttccaggctgagtgcgtgggccccttcagcgacccgctggccagcagcaccttcccccgcaggcactacacctcgcagcaagagctgaaggacgagtgtgccctggtgccccgcaccctggccaccaaggcgaaccgcatccccgccaacctgctggaccagttcgagcggcagctgccactcagccgcgatggctatcacaccctgcagtacaagcgcacggccgtggagcaccgcagcgacagccccggccgcatccgccacctggtgcactcggtccagaagctcttcaccaagtcgcactccctggaggggccgtccaagggcagcgtcaacgggggcaaggccagccctgacgaggcgcaggcggcgcgctatggcaaacgcagcaagagcaaggagcggcgcgcggagcccaaggcccggcccagcacctccccgggctggtggagctcggacgacaacctggatggtgacatgtgcatctaccacgccccctcgggcgtgatgaccatgggcaggtgccccgaccgctcggcctcacagtacttcctggaggcctacaacaccatcagcgagcaggcggtgaaggcctcccggagcaacaacgacgtcaagtgctccacctgcgccaacctgccggtcagcctggacaccccgctgctgaagaagagcgcctggtcctccacgctcaccgtgagccgggcccgggaggtttaccagaaggcctcggtgaacatggaccaggccatggtgaagtccgagtcgtgtcagcaagaacgctcctgccagtacctgcaggttccacaagatgaatggacagggtacaccccacgaggtaaagatgatgaaattccatgccgaagaatgcggagtggcagttatatcaaggccatgggggatgaagacagtggagactcagacacgagtcctaagccttctccaaaagttgctgcgcggagagaaagctatctcaaggctactcagccatcccttacagaactcaccacactcaaaatctccaatgaacactcacccaaactccagatccggagtcatagttacctgagggcagtgagtgaagtctccatcaaccggagcctggacagcctggaccctgcaggcttgctcacatcaccaaagttccgctccaggaatgagagctacatgcgagccatgagcaccatcagccaggtgagcgagatggaagtgaacgggcagttcgagtccgtgtgcgagtccgtgttcagcgagctggagtcgcaggccgtggaagcgctggacctgcccatgcccggctgcttccgcatgcggagccacagctatgtgcgggccattgagaaaggctgctcccaggacgacgagtgcgtgtccctgaggtcgtcctcgccgccgcgcaccaccaccaccgttaggaccatccagagcagcacggtgtcatcttgcattacaacatataagaagacaccacctccagtcccacccagaactaccacgaaacctttcatttctatcacagcccagagtagcacagagtcagcccaggatgcctacatggacggacagggccagcgaggagatattatcagccagtctggactcagcaactccaccgagagcctggacagtatgaaggctctgacagccgccatcgaagctgcaaacgcccagatccatggccctgccagtcaacacatgggcaataacactgccaccgtcaccaccacgactaccatagccaccgtcaccacggaggacaggaagaaggaccactttaagaaaaatcgatgcctgtctatcgggatacaggtggatgatgctgaagaacctgacaaaacaggggagaataaagcacccagtaagttccagtccgtgggagtgcaagtagaagaagagaagtgcttccgcaggttcactcgatccaacagtgtgacgacagcagtacaggccgacctggacttccatgataatctggaaaattctctggaatctatagaggacaattcgtgtcctggccccatggccagacagttctcccgcgatgccagcacctccacagtcagcattcagggctcaggaaaccattaccatgcctgtgccgccgatgatgactttgacacggattttgacccctctattctgcctcctccggacccctggattgactctatcactgaagaccctctggaggccgtgcaaaggtcagtgtgccaccgggatggccactggttcctgaagcttctccaggcagagcgagaccgcatggaggggtggtgtcaacagatggagcgggaagaacgggaaaacaacctgcccgaagacattctaggaaaaatccgaaccgcagtgggcagtgcccaacttctcatggcccagaaattctaccagttcagagaactgtgtgaagaaaacctgaatcctaatgctcatccaagacccacctcccaggatttggcggggttttgggacatgctgcagttgtccatagaaaatattagtatgaaatttgatgaacttcatcagttaaaggccaataattggaaacagatggatcctcttgacaagaaggagagaagggcccctcctccagtgccaaagaagccggcgaagggccccgcgccgctgatccgggagcgctcgctggagagctcgcagcgccaggaggcccgcaagcgcctgatggccgccaagcgcgccgcgtccgtccgccagaactcggccaccgagagcgccgagagcatcgagatctacatccccgaggcgcagacccggctctgagcgccccgcagcccggccgccgccgccaagcatctgtcccctcctcccccggccgctcctctgccggctgcctctccccctccgagcccgtccgctcccgagctcggtgacttccactgtcgcggtgtagttgtccacctcgcaggagccgccccccgggcccccctcagccccccacttcccgtacccgtttgcccatctccttcttcaccgagcttcgccccctgtcctgatgccgtcgccctgcctcatactgagatccaaccctttattttctgggcaaagccaaacccacctgtgtagaagtgatgcctttaggtcacccgccgtcctcagttctctcgagctagtctgttcagcaatataaaaccatagggtatttcagaaatccagtatcacagggtgatcctttgggacttaccgtcttccacgtgaaagaaacta

SEQ ID NO: 299440 - DNA, 2521 bp, Homo sapiens
aaatgctctcagctgcactataccaaggcacgaggagctgagatgaataatgaacttaattttccataaagacattctgtttggcattccagctaataaggttccacaagatgaatggacagggtacaccccacgaggtaaagatgatgaaattccatgccgaagaatgcggagtggcagttatatcaaggccatgggggatgaagacagtggagactcagacacgagtcctaagccttctccaaaagttgctgcgcggagagaaagctatctcaaggctactcagccatcccttacagaactcaccacactcaaaatctccaatgaacactcacccaaactccagatccggagtcatagttacctgagggcagtgagtgaagtctccatcaaccggagcctggacagcctggaccctgcaggcttgctcacatcaccaaagttccgctccaggaatgagagctacatgcgagccatgagcaccatcagccaggtgagcgagatggaagtgaacgggcagttcgagtccgtgtgcgagtccgtgttcagcgagctggagtcgcaggccgtggaagcgctggacctgcccatgcccggctgcttccgcatgcggagccacagctatgtgcgggccattgagaaaggctgctcccaggacgacgagtgcgtgtccctgaggtcgtcctcgccgccgcgcaccaccaccaccgttaggaccatccagagcagcacggtgtcatcttgcattacaacatataagaagacaccacctccagtcccacccagaactaccacgaaacctttcatttctatcacagcccagagtagcacagagtcagcccaggatgcctacatggacggacagggccagcgaggagatattatcagccagtctggactcagcaactccaccgagagcctggacagtatgaaggctctgacagccgccatcgaagctgcaaacgcccagatccatggccctgccagtcaacacatgggcaataacactgccaccgtcaccaccacgactaccatagccaccgtcaccacggaggacaggaagaaggaccactttaagaaaaatcgatgcctgtctatcgggatacaggtggatgatgctgaagaacctgacaaaacaggggagaataaagcacccagtaagttccagtccgtgggagtgcaagtagaagaagagaagtgcttccgcaggttcactcgatccaacagtgtgacgacagcagtacaggccgacctggacttccatgataatctggaaaattctctggaatctatagaggacaattcgtgtcctggccccatggccagacagttctcccgcgatgccagcacctccacagtcagcattcagggctcaggaaaccattaccatgcctgtgccgccgatgatgactttgacacggattttgacccctctattctgcctcctccggacccctggattgactctatcactgaagaccctctggaggccgtgcaaaggtcagtgtgccaccgggatggccactggttcctgaagcttctccaggcagagcgagaccgcatggaggggtggtgtcaacagatggagcgggaagaacgggaaaacaacctgcccgaagacattctaggaaaaatccgaaccgcagtgggcagtgcccaacttctcatggcccagaaattctaccagttcagagaactgtgtgaagaaaacctgaatcctaatgctcatccaagacccacctcccaggatttggcggggttttgggacatgctgcagttgtccatagaaaatattagtatgaaatttgatgaacttcatcagttaaaggccaataattggaaacagatggatcctcttgacaagaaggagagaagggcccctcctccagtgccaaagaagccggcgaagggccccgcgccgctgatccgggagcgctcgctggagagctcgcagcgccaggaggcccgcaagcgcctgatggccgccaagcgcgccgcgtccgtccgccagaactcggccaccgagagcgccgagagcatcgagatctacatccccgaggcgcagacccggctctgagcgccccgcagcccggccgccgccgccaagcatctgtcccctcctcccccggccgctcctctgccggctgcctctccccctccgagcccgtccgctcccgagctcggtgacttccactgtcgcggtgtagttgtccacctcgcaggagccgccccccgggcccccctcagccccccacttcccgtacccgtttgcccatctccttcttcaccgagcttcgccccctgtcctgatgccgtcgccctgcctcatactgagatccaaccctttattttctgggcaaagccaaacccacctgtgtagaagtgatgcctttaggtcacccgccgtcctcagttctctcgagctagtctgttcagcaatataaaaccatagggtatttcagaaatccagtatcacagggtgatcctttgggacttaccgtcttccacgtgaaagaaacta

SEQ ID NO: 299441 - DNA, 778 bp, Homo sapiens
aaatgctctcagctgcactataccaaggcacgaggagctgagatgaataatgaacttaattttccataaagacattctgtttggcattccagctaataaggttccacaagatgaatggacagggtacaccccacgaggtaaagatgatgaaattccatgccgaagaatgcggagtggcagttatatcaaggccatgggggatgaagacagtggagactcagacacgagtcctaagccttctccaaaagttgctgcgcggagagaaagctatctcaaggctactcagccatcccttacagaactcaccacactcaataaaaccgtatttttaagaagttaggccaaataaccgaatggaacgactgggcccaccaccactatcccccactagcccgtttcataagagacatcatctccaggagcgagaggcaaagcagcggtgagcaagccagcccttccagcaggacgaatatgtcacctttccatgacacagctcctgccatctgaaacagaacccctcagacatcccagacacagtctctcctaaatgggctaagaaaaggcatcactagtattccatccatctatcatgtcctatatgatactcacaccataacgacttctcagcacccctgcctctaagactccacagttaccacaagtcctgccgtcactgaccattacacattcttcctcttgaattaccttgtcactaacgagaaaaggctttgggtacctggcagacccaggttgaacttgaccaggcttttgctaagtc

SEQ ID NO: 299442 - DNA, 2477 bp, Homo sapiens
cgtcgacacggctgcgagagacgacagaaggggggtagaagtggagagagagagacagagggagcgagagagagagcaagacagaccgagaaggaaagcactcccagagatgaaattttaggaaagcaaaatgatcgacctttttaaggctgagtgggtttcttcagtttgtgtgcaagtttcaagaaatggaaggactgaccaggttccacaagatgaatggacagggtacaccccacgaggtaaagatgatgaaattccatgccgaagaatgcggagtggcagttatatcaaggccatgggggatgaagacagtggagactcagacacgagtcctaagccttctccaaaagttgctgcgcggagagaaagctatctcaaggctactcagccatcccttacagaactcaccacactcaaaatctccaatgaacactcacccaaactccagatccggagtcatagttacctgagggcagtgagtgaagtctccatcaaccggagcctggacagcctggaccctgcaggcttgctcacatcaccaaagttccgctccaggaatgagagctacatgcgagccatgagcaccatcagccaggtgagcgagatggaagtgaacgggcagttcgagtccgtgtgcgagtccgtgttcagcgagctggagtcgcaggccgtggaagcgctggacctgcccatgcccggctgcttccgcatgcggagccacagctatgtgcgggccattgagaaaggctgctcccaggacgacgagtgcgtgtccctgaggtcgtcctcgccgccgcgcaccaccaccaccgttaggaccatccagagcagcacggtgtcatcttgcattacaacatataagaagacaccacctccagtcccacccagaactaccacgaaacctttcatttctatcacagcccagagtagcacagagtcagcccaggatgcctacatggacggacagggccagcgaggagatattatcagccagtctggactcagcaactccaccgagagcctggacagtatgaaggctctgacagccgccatcgaagctgcaaacgcccagatccatggccctgccagtcaacacatgggcaataacactgccaccgtcaccaccacgactaccatagccaccgtcaccacggaggacaggaagaaggaccactttaagaaaaatcgatgcctgtctatcgggatacaggtggatgatgctgaagaacctgacaaaacaggggagaataaagcacccagtaagttccagtccgtgggagtgcaagtagaagaagagaagtgcttccgcaggttcactcgatccaacagtgtgacgacagcagtacaggccgacctggacttccatgataatctggaaaattctctggaatctatagaggacaattcgtgtcctggccccatggccagacagttctcccgcgatgccagcacctccacagtcagcattcagggctcaggaaaccattaccatgcctgtgccgccgatgatgactttgacacggattttgacccctctattctgcctcctccggacccctggattgactctatcactgaagaccctctggaggccgtgcaaaggtcagtgtgccaccgggatggccactggttcctgaagcttctccaggcagagcgagaccgcatggaggggtggtgtcaacagatggagcgggaagaacgggaaaacaacctgcccgaagacattctaggaaaaatccgaaccgcagtgggcagtgcccaacttctcatggcccagaaattctaccagttcagagaactgtgtgaagaaaacctgaatcctaatgctcatccaagacccacctcccaggatttggcggggttttgggacatgctgcagttgtccatagaaaatattagtatgaaatttgatgaacttcatcagttaaaggccaataattggaaacagatggatcctcttgacaagaaggtagaacaatgtagattttgtatggttcatttaaaaacctgcacaaacactggacagtctaaataggcttctgcattcagtcctgctgtttacaatgtgaaatggagctgatatcatattaatttcattgtaatgacaatgtttacatagtaatcatttgggatattatctgtaatatgtttcaggcatatttttaaagaaaaacctgtctttgtgaattggaaaatgggaatgtggctttttttgttaattaaactttaagttaaaccattttagtcactggaaggaactgcctccattttgctttttaaactaaaataaatgacatcttcagtgcatgaatccatagaacaagagttcaacttccttacacccctaggatgtgttttcaagaaaaataggatgccctgaaaaataactgactttgataatcatttcataaatatagtaataaagaaattactgttgttcaagtctaaaaatatataccataaagtttcacagt

SEQ ID NO: 299443 - DNA, 2379 bp, Homo sapiens
cgtcgacacggctgcgagagacgacagaaggggggtagaagtggagagagagagacagagggagcgagagagagagcaagacagaccgagaaggaaagcactcccagagatgaaattttaggaaagcaaaatgatcgacctttttaaggctgagtgggtttcttcagtttgtgtgcaagtttcaagaaatggaaggactgaccaggttccacaagatgaatggacagggtacaccccacgaggtaaagatgatgaaattccatgccgaagaatgcggagtggcagttatatcaaggccatgggggatgaagacagtggagactcagacacgagtcctaagccttctccaaaagttgctgcgcggagagaaagctatctcaaggctactcagccatcccttacagaactcaccacactcaaaatctccaatgaacactcacccaaactccagatccggagtcatagttacctgagggcagtgagtgaagtctccatcaaccggagcctggacagcctggaccctgcaggcttgctcacatcaccaaagttccgctccaggaatgagagctacatgcgagccatgagcaccatcagccaggtgagcgagatggaagtgaacgggcagttcgagtccgtgtgcgagtccgtgttcagcgagctggagtcgcaggccgtggaagcgctggacctgcccatgcccggctgcttccgcatgcggagccacagctatgtgcgggccattgagaaaggctgctcccaggacgacgagtgcgtgtccctgaggtcgtcctcgccgccgcgcaccaccaccaccgttaggaccatccagagcagcacggtgtcatcttgcattacaacatataagaagacaccacctccagtcccacccagaactaccacgaaacctttcatttctatcacagcccagagtagcacagagtcagcccaggatgcctacatggacggacagggccagcgaggagatattatcagccagtctggactcagcaactccaccgagagcctggacagtatgaaggctctgacagccgccatcgaagctgcaaacgcccagatccatggccctgccagtcaacacatgggcaataacactgccaccgtcaccaccacgactaccatagccaccgtcaccacggaggacaggaagaaggaccactttaagaaaaatcgatgcctgtctatcgggatacaggtggatgatgctgaagaacctgacaaaacaggggagaataaagcacccagtaagttccagtccgtgggagtgcaagtagaagaagagaagtgcttccgcaggttcactcgatccaacagtgtgacgacagcagtacaggccgacctggacttccatgataatctggaaaattctctggaatctatagaggacaattcgtgtcctggccccatggccagacagttctcccgcgatgccagcacctccacagtcagcattcagggctcaggaaaccattaccatgcctgtgccgccgatgatgactttgacacggattttgacccctctattctgcctcctccggacccctggattgactctatcactgaagaccctctggaggccgtgcaaaggtcagtgtgccaccgggatggccactggttcctgaagcttctccaggcagagcgagaccgcatggaggggtggtgtcaacagatggagcgggaagaacgggaaaacaacctgcccgaagacattctaggaaaaatccgaaccgcagtgggcagtgcccaacttctcatggcccagaaattctaccagttcagagaactgtgtgaagaaaacctgaatcctaatgctcatccaagacccacctcccaggatttggcggggttttgggacatgctgcagttgtccatagaaaatattagtatgaaatttgatgaacttcatcagttaaaggccaataattggaaacagatggatcctcttgacaagaaggtagaacaatgtagattttgtatggttcatttaaaaacctgcacaaacactggacagtctaaataggcttctgcattcagtcctgctgtttacaatgtgaaatggagctgatatcatattaatttcattgtaatgacaatgtttacatagtaatcatttgggatattatctgtaatatgtttcaggcatatttttaaagaaaaacctgtctttgtgaattggaaaatgggaatgtggctttttttgttaattaaactttaagttaaaccattttagtcactggaaggaactgcctccattttgctttttaaactaaaataaatgacatcttcagtgcatgaatgcttaataaaaacaaatacaaaagcagaccatgcaatacaaccaaaaggctcccttggcctcat

SEQ ID NO: 299444 - DNA, 1655 bp, Homo sapiens
cgtcgacacggctgcgagagacgacagaaggggggtagaagtggagagagagagacagagggagcgagagagagagcaagacagaccgagaaggaaagcactcccagagatgaaattttaggaaagcaaaatgatcgacctttttaaggctgagtgggtttcttcagtttgtgtgcaagtttcaagaaatggaaggactgaccaggttccacaagatgaatggacagggtacaccccacgaggtaaagatgatgaaattccatgccgaagaatgcggagtggcagttatatcaaggccatgggggatgaagacagtggagactcagacacgagtcctaagccttctccaaaagttgctgcgcggagagaaagctatctcaaggctactcagccatcccttacagaactcaccacactcaaaatctccaatgaacactcacccaaactccagatccggagtcatagttacctgagggcagtgagtgaagtctccatcaaccggagcctggacagcctggaccctgcaggcttgctcacatcaccaaagttccgctccaggaatgagagctacatgcgagccatgagcaccatcagccaggtgagcgagatggaagtgaacgggcagttcgagtccgtgtgcgagtccgtgttcagcgagctggagtcgcaggccgtggaagcgctggacctgcccatgcccggctgcttccgcatgcggagccacagctatgtgcgggccattgagaaaggctgctcccaggacgacgagtgcgtgtccctgaggtcgtcctcgccgccgcgcaccaccaccaccgttaggaccatccagagcagcacggtggaactggagacatcgcgtacttccacccttgcaggctcagacgaaagaaaaaagagcaagatttatgacacaacctactccttttgtgaggcaacttatccttgtctgctgttacattgaaggaaactgacagtgatgatttgcaggagacttttggttataacttctcctttcttctgtggggcactcgaggtaggattcctctataatattaggaagtcataaaaatgcaaaagtcctatcaggcacagagcaagatttaaaatctgaagaataccatgtgcttccatctcctgcagttgttttgaagtacataaatcacctcttgggaacggagtgccaaccttgaggggctatgcctcacagacagccaacaagcaagtccacctttgcccacattcggggttattgcatggcaaacagtgaaggggcttccagggttttctggcacactggccttaaaggctgttgtaaggttcacatgagatcattcacaaggaagcattatgcaaattacaaattagaatgccctactttggctttgattttaaatctctcaatgtggcttagtttaataataatgataatagctaacctttaagcacttattatttgacaagcatacaaacagctgcatacattgtctaatgtaaccgtaatgaatactctatgacttgcacatgatattatcatttaaatcaaacagagaaaaaaaaatgtaagacttagagaggttacacaacttgaccaggccacacagctagtaagtgaaattctctctgtaatcaccaataaatgccttggaaactaaata

SEQ ID NO: 299445 - DNA, 1208 bp, Homo sapiens
cgtcgacacggctgcgagagacgacagaaggggggtagaagtggagagagagagacagagggagcgagagagagagcaagacagaccgagaaggaaagcactcccagagatgaaattttaggaaagcaaaatgatcgacctttttaaggctgagtgggtttcttcagtttgtgtgcaagtttcaagaaatggaaggactgaccaggttccacaagatgaatggacagggtacaccccacgaggtaaagatgatgaaattccatgccgaagaatgcggagtggcagttatatcaaggccatgggggatgaagacagtggagactcagacacgagtcctaagccttctccaaaagttgctgcgcggagagaaagctatctcaaggctactcagccatcccttacagaactcaccacactcaaaatctccaatgaacactcacccaaactccagatccggagtcatagttacctgagggcagtgagtgaagtctccatcaaccggagcctggacagcctggaccctgcaggcttgctcacatcaccaaagttccgctccaggaatgagagctacatgcgagccatgagcaccatcagccaggtgagcgagatggaagtgaacgggcagttcgagtccgtgtgcgagtccgtgttcagcgagctggagtcgcaggccgtggaagcgctggacctgcccatgcccggctgcttccgcatgcggagccacagctatgtgcgggccattgagaaaggctgctcccaggacgacgagtgcgtgtccctgaggtcgtcctcgccgccgcgcaccaccaccaccgttaggaccatccagagcagcacgggtcccaaccataacagagatgacagatggagatgtccagccaggctgtcctgtcacctactggcctatcaccattttgccaaccgttagagagaggagggccacacagattctacaacctcgaccaagacccctggtgaagaatggccatgctattctcttgagaaatggttcacatttcatgctattctcgtgggaaatagctccaccacctagtaagaaacccatggctgggcatggtggctcacgtctgtaatcccaacactttgggaggctgaagtgggaagaccatttgagtccaggagttcaagaccagcctgaacaacatagcaagaacccatctctatttaaaaaaaaaaaagaaagaaag

SEQ ID NO: 299446 - DNA, 994 bp, Homo sapiens
cgtcgacacggctgcgagagacgacagaaggggggtagaagtggagagagagagacagagggagcgagagagagagcaagacagaccgagaaggaaagcactcccagagatgaaattttaggaaagcaaaatgatcgacctttttaaggctgagtgggtttcttcagtttgtgtgcaagtttcaagaaatggaaggactgaccaggttccacaagatgaatggacagggtacaccccacgaggtaaagatgatgaaattccatgccgaagaatgcggagtggcagttatatcaaggccatgggggatgaagacagtggagactcagacacgagtcctaagccttctccaaaagttgctgcgcggagagaaagctatctcaaggctactcagccatcccttacagaactcaccacactcaaaatctccaatgaacactcacccaaactccagatccggagtcatagttacctgagggcagtgagtgaagtctccatcaaccggagcctggacagcctggaccctgcaggcttgctcacatcaccaaagttccgctccaggaatgagagctacatgcgagccatgagcaccatcagccaggtgagcgagatggaagtgaacgggcagttcgagtccgtgtgcgagtccgtgttcagcgagctggagtcgcaggccgtggaagcgctggacctgcccatgcccggctgcttccgcatgcggagccacagctatgtgcgggccattgagaaaggctgctcccaggacgacgagtgcgtgtccctgaggtcgtcctcgccgccgcgcaccaccaccaccgttaggaccatccagagcagcacggggagccttgacaagaagctggaatcctgggcgctagggtaggaagacatgactcctccacccctgataccactcaggcaaaatgggtaaagatcaccccatatgaacttcaacttggtgaattcacagctctcacaataaaaaacattttgtttt

SEQ ID NO: 299447 - DNA, 1072 bp, Homo sapiens
cgtcgacacggctgcgagagacgacagaaggggggtagaagtggagagagagagacagagggagcgagagagagagcaagacagaccgagaaggaaagcactcccagagatgaaattttaggaaagcaaaatgatcgacctttttaaggctgagtgggtttcttcagtttgtgtgcaagtttcaagaaatggaaggactgaccaggttccacaagatgaatggacagggtacaccccacgaggtaaagatgatgaaattccatgccgaagaatgcggagtggcagttatatcaaggccatgggggatgaagacagtggagactcagacacgagtcctaagccttctccaaaagttgctgcgcggagagaaagctatctcaaggctactcagccatcccttacagaactcaccacactcaaaatctccaatgaacactcacccaaactccagatccggagtcatagttacctgagggcagtgagtgaagtctccatcaaccggagcctggacagcctggaccctgcaggcttgctcacatcaccaaagttccgctccaggaatgagagctacatgcgagccatgagcaccatcagccaggtgagcgagatggaagtgaacgggcagttcgagtccgtgtgcgagtccgtgttcagcgagctggagtcgcaggccgtggaagcgctggacctgcccatgcccggctgcttccgcatgcggagccacagctatgtgcgggccattgagaaaggctgctcccaggacgacgagtgcgtgtccctgaggtcgtcctcgccgccgcgcaccaccaccaccgttaggaccatccagagcagcacggactgaaatctcagtgttaggagaagagatgcttccagaccttgcgttggccaagcagctcagcagggagcccagcagctcagaccctggctggctacctccagaccagagatggtagatgtccgtatattcttgctcactaggaaattctctctccaagaacaaccacaggttaataaattaaatgagagttatttatgaagagaaaaatatatatatttttgaaaaatcaac

SEQ ID NO: 299448 - DNA, 628 bp, Homo sapiens
ggaggtgatctagaggtcccttcgattggcgggccacttagttatcaatttttttttctatcagctattctgttgtatttctaaaacattttttagatgactttttaaagtatatttagcagtaaccttatgaggttcaaattggtaaatctcttgtaatttagccttcatcgaataataggtaccagtgtattaaaaatgtgtattttttgcagccccttgaaccagagtaggttcagagaaactcccaaagtttgtactttagacacatcatgcttgattggtaacttccctccttttttggggaacatgtttgtgtcctattaacttaattggatagatttttaaatatttcttatttttggcacacggaaagggtagttcgagtacagaactttgatttttggtgtagatgcagagggaatgatgggtaaatttcctaggtttatgtgaatttagggggtgtatgcattttgaaacaatctactaacagatggtgctgaaatctattacctacatgttttctagttgttcagcattatgttaatgaagcctccatataaggagtgtttctctggcacagttggtaagttgcccgccaatcgaaggggatcctctagagcacaac

SEQ ID NO: 299449 - DNA, 1563 bp, Homo sapiens
  misc_feature (1375)..(1375): n is a, c, g, or t
  misc_feature (1378)..(1378): n is a, c, g, or t
cttcatgttcagtttttacttcactctttattcttttctttgattatggtatgcttatttggaaagtcagtgaaactgtcaaaatgttatctcaataagatacttatatgagaactacaatcaccgaatctactgtattcaatattagcagatctaatttgataaacaacatggcttgtgtgaaaactgagcaggtgtttgtttacccatagtgttctgtgtagttattgcttagtctgcagaaaataatgacttagatgagatgtctgacttgctttcacttattaaacatgttcaccatgggatgatgtctgtaacatcagatattgttcaactagactaggatttaataaaaattgtgaaagcttactggcctaacattttattttataatattgggtatgaattatatgtagccagagatgtcattaagctttactgttatagtaggtaatatggttagtttgtagggaaaagagcatatgagcacatgcttgtgtattttggcctttgccccagtagaacagaccaatggcattctagacttgatgatactaagttttagcagacactagtaagtggtttgtatttaaccatactgatgaagcagacagattgaggcacagattttagtggctttgtggcaataaatagggcatggtgtgccttaggaaaagaatgtttataaagggaattataactgaaattaaaggaggcggcagtgaagaggaaataattctcttctatctaaatgatatacatatgatattttgagatttttataacagcagtggaacacaattctaggtagagtagaaaaaggaaagttttaaagacatataaaagattcttgttgacaaattatttttggtagcaaatctcaaatggttacctgctattaaggtctgccatattagagttttgcactattttgctaccaagtttgattcatacatctaaaacattttgtagttacttgtcaaggacttaatttgaaaatcatttgccaggccacttagttatcaatttttttttctatcagctattctgttgtatttctaaaacattttttagatgactttttaaagtatatttagcagtaaccttatgaggttcaaattggtaaatctcttgtaatttagccttcatcgaataataggtaccagtgtattaaaaatgtgtattttttgcagccccttgaaccagagtaggttcagagaaactcccaaagtttgtactttagacacatcatgcttgattggtaacttccctccttttttggggaacatgtttgtgtcctattaacttaattggatagatttttaaatatttcttatttttggcacacggaaagggtagttcgagtacagaaccnttngatcttggcgggtacatcccacacgcaagcagggcaaaatccccaggggcctgttgagatacggcaggagcacactgcgaacacaccacacacaacggcagagactacacgcaaccgtccacgccccataataataaaacgccagaaacgagggtctagcgcacaagaagaccagacagacacac

SEQ ID NO: 299450 - DNA, 1288 bp, Homo sapiens
cttcatgttcagtttttacttcactctttattcttttctttgattatggtatgcttatttggaaagtcagtgaaactgtcaaaatgttatctcaataagatacttatatgagaactacaatcaccgaatctactgtattcaatattagcagatctaatttgataaacaacatggcttgtgtgaaaactgagcaggtgtttgtttacccatagtgttctgtgtagttattgcttagtctgcagaaaataatgacttagatgagatgtctgacttgctttcacttattaaacatgttcaccatgggatgatgtctgtaacatcagatattgttcaactagactaggatttaataaaaattgtgaaagcttactggcctaacattttattttataatattgggtatgaattatatgtagccagagatgtcattaagctttactgttatagtaggtaatatggttagtttgtagggaaaagagcatatgagcacatgcttgtgtattttggcctttgccccagtagaacagaccaatggcattctagacttgatgatactaagttttagcagacactagtaagtggtttgtatttaaccatactgatgaagcagacagattgaggcacagattttagtggctttgtggcaataaatagggcatggtgtgccttaggaaaagaatgtttataaagggaattataactgaaattaaaggaggcggcagtgaagaggaaataattctcttctatctaaatgatatacatatgatattttgagatttttataacagcagtggaacacaattctaggtagagtagaaaaaggaaagttttaaagacatataaaagattcttgttgacaaattatttttggtagcaaatctcaaatggttacctgctattaaggtctgccatattagagttttgcactattttgctaccaagtttgattcatacatctaaaacattttgtagttacttgtcaaggacttaatttgaaaatcatttgccaggccacttagttatcaatttttttttctatcagctattctgttgtatttctaaaacattttttagatgactttttaaagtatatttagcagtaaccttatgaggttcaaattggtaaatctcttgtaatttaaagtttgtagaattatgggtgactgtgatgaggatcaacgtgtatgcaactgtagacaccacgttcttgagataggcgtcggaggagggacaacattgtataccaacactatttggattgtttcgggtaatcctgtagtttattatt

SEQ ID NO: 299451 - DNA, 3022 bp, Homo sapiens
  misc_feature (2501)..(2501): n is a, c, g, or t
cttcatgttcagtttttacttcactctttattcttttctttgattatggtatgcttatttggaaagtcagtgaaactgtcaaaatgttatctcaataagatacttatatgagaactacaatcaccgaatctactgtattcaatattagcagatctaatttgataaacaacatggcttgtgtgaaaactgagcaggtgtttgtttacccatagtgttctgtgtagttattgcttagtctgcagaaaataatgacttagatgagatgtctgacttgctttcacttattaaacatgttcaccatgggatgatgtctgtaacatcagatattgttcaactagactaggatttaataaaaattgtgaaagcttactggcctaacattttattttataatattgggtatgaattatatgtagccagagatgtcattaagctttactgttatagtaggtaatatggttagtttgtagggaaaagagcatatgagcacatgcttgtgtattttggcctttgccccagtagaacagaccaatggcattctagacttgatgatactaagttttagcagacactagtaagtggtttgtatttaaccatactgatgaagcagacagattgaggcacagattttagtggctttgtggcaataaatagggcatggtgtgccttaggaaaagaatgtttataaagggaattataactgaaattaaaggaggcggcagtgaagaggaaataattctcttctatctaaatgatatacatatgatattttgagatttttataacagcagtggaacacaattctaggtagagtagaaaaaggaaagttttaaagacatataaaagattcttgttgacaaattatttttggtagcaaatctcaaatggttacctgctattaaggtctgccatattagagttttgcactattttgctaccaagtttgattcatacatctaaaacattttgtagttacttgtcaaggacttaatttgaaaatcatttgccaggccacttagttatcaatttttttttctatcagctattctgttgtatttctaaaacattttttagatgactttttaaagtatatttagcagtaaccttatgaggttcaaattggtaaatctcttgtaatttagccttcatcgaataataggtaccagtgtattaaaaatgtgtattttttgcagccccttgaaccagagtaggttcagagaaactcccaaagtttgtactttagacacatcatgcttgattggtaacttccctccttttttggggaacatgtttgtgtcctattaacttaattggatagatttttaaatatttcttatttttggcacacggaaagggtagttcgagtacagaactttgatttttggtgtagatgcagagggaatgatgggtaaatttcctaggtttatgtgaatttagggggtgtatgcattttgaaacaatctactaacagatggtgctgaaatctattacctacatgttttctagttgttcagcattatgttaatgaagcctccatataaggagtgtttctctggcacagttggtaagttgactgctaacttcatttaaatgtgttactggatatgcagtatactgaaattattaatcagtttgtgtataggaaaagagaactgggttaaaagcaaattaacttgttctgaaaagaaagtatagattaattttgttttctgtttaaattttatctccttggtaaagatttttttttcctgggcagaaaacttggcatttttaggcgtagataccttaccttacaatgccaaaatgaatttaattccagtactcaggtttttccctttaacagactctatgtgtatcagggctttctaatgggtttttcctcttcgtttttaaaatgtgagtagcatttgaccaatttccagtgctcttagcattttacttaaagaacaaccactacaaaagaaaatctttgtaatttgattgtcttttgctttgcttcattaatgcctaagaacttaagaatactcctacctcattagctactcaagatgctgtgacgatcaaatctattctacataatgcgtttagaaacaaagacttgggtgaaaaatgaaataagtatattctgacttggctattgaggggaaaattcagtattaagtgttcctcacaggagatatgttagcagaatactataaaagtttgaaatttttaaaaagtaaaagtacttaaatttaggtatctctcctgaaattctttgcagttcattttttatggcagttaatccagtgaaacactcaaaagtttttttttttttaaaagtgtttttccagataaactgtagggtgaacattcacataatcacaaatatgtaattctgtaattgtggaatgcttgtatgctttgttttcgtacatcttccatggagatgtctgaatataatactccatctgtgaatattttaaatgttgaaataaaagtaagaaatgtgaaaaacaaanaaaccaaaaaaaaaaaaaaaaaaaaatcgcacaccccagacaaacaacagaaaacagactaacaaaggcaagaccgacacagcaaacaatcccacgcacgagacagaaaaccaaccaaccaacacggcacacacctaccaccgcacaacataccgaacgcacatcctgacccaccacactgaccctacgacacaccccacaccaaaaaaccagcggcaacgccgcacccacccaacaccatgtggagacagaagacaggagggaaagaaaaaagagcaagcggagagaagaagaggaacaacaaaaaaacagggaaggaagaaaaaaaaacaagcaataatagagctagaagagaacagaacgcgtgcaacaattacgaaccgagcgacagacgaaggagcgggagcgagtgcagacacaagactagcgaaagctgaaagacacgtaccagcagaacggacaagcaggagaggcagggagagcagaccacaaagagcaaaacgcgaaaaccagaaaaggaa

SEQ ID NO: 299452 - DNA, 2967 bp, Homo sapiens
  misc_feature (2446)..(2446): n is a, c, g, or t
cttcatgttcagtttttacttcactctttattcttttctttgattatggtatgcttatttggaaagtcagtgaaactgtcaaaatgttatctcaataagatacttatatgagaactacaatcaccgaatctactgtattcaatattagcagatctaatttgataaacaacatggcttgtgtgaaaactgagcaggtgtttgtttacccatagtgttctgtgtagttattgcttagtctgcagaaaataatgacttagatgagatgtctgacttgctttcacttattaaacatgttcaccatgggatgatgtctgtaacatcagatattgttcaactagactaggatttaataaaaattgtgaaagcttactggcctaacattttattttataatattgggtatgaattatatgtagccagagatgtcattaagctttactgttatagtaggtaatatggttagtttgtagggaaaagagcatatgagcacatgcttgtgtattttggcctttgccccagtagaacagaccaatggcattctagacttgatgatactaagttttagcagacactagtaagtggtttgtatttaaccatactgatgaagcagacagattgaggcacagattttagtggctttgtggcaataaatagggcatggtgtgccttaggaaaagaatgtttataaagggaattataactgaaattaaaggaggcggcagtgaagaggaaataattctcttctatctaaatgatatacatatgatattttgagatttttataacagcagtggaacacaattctaggtagagtagaaaaaggaaagttttaaagacatataaaagattcttgttgacaaattatttttggtagcaaatctcaaatggttacctgctattaaggtctgccatattagagttttgcactattttgctaccaagtttgattcatacatctaaaacattttgtagttacttgtcaaggacttaatttgaaaatcatttgccaggccacttagttatcaatttttttttctatcagctattctgttgtatttctaaaacattttttagatgactttttaaagtatatttagcagtaaccttatgaggttcaaattggtaaatctcttgtaatttagccttcatcgaataataggtaccagtgtattaaaatttgtactttagacacatcatgcttgattggtaacttccctccttttttggggaacatgtttgtgtcctattaacttaattggatagatttttaaatatttcttatttttggcacacggaaagggtagttcgagtacagaactttgatttttggtgtagatgcagagggaatgatgggtaaatttcctaggtttatgtgaatttagggggtgtatgcattttgaaacaatctactaacagatggtgctgaaatctattacctacatgttttctagttgttcagcattatgttaatgaagcctccatataaggagtgtttctctggcacagttggtaagttgactgctaacttcatttaaatgtgttactggatatgcagtatactgaaattattaatcagtttgtgtataggaaaagagaactgggttaaaagcaaattaacttgttctgaaaagaaagtatagattaattttgttttctgtttaaattttatctccttggtaaagatttttttttcctgggcagaaaacttggcatttttaggcgtagataccttaccttacaatgccaaaatgaatttaattccagtactcaggtttttccctttaacagactctatgtgtatcagggctttctaatgggtttttcctcttcgtttttaaaatgtgagtagcatttgaccaatttccagtgctcttagcattttacttaaagaacaaccactacaaaagaaaatctttgtaatttgattgtcttttgctttgcttcattaatgcctaagaacttaagaatactcctacctcattagctactcaagatgctgtgacgatcaaatctattctacataatgcgtttagaaacaaagacttgggtgaaaaatgaaataagtatattctgacttggctattgaggggaaaattcagtattaagtgttcctcacaggagatatgttagcagaatactataaaagtttgaaatttttaaaaagtaaaagtacttaaatttaggtatctctcctgaaattctttgcagttcattttttatggcagttaatccagtgaaacactcaaaagtttttttttttttaaaagtgtttttccagataaactgtagggtgaacattcacataatcacaaatatgtaattctgtaattgtggaatgcttgtatgctttgttttcgtacatcttccatggagatgtctgaatataatactccatctgtgaatattttaaatgttgaaataaaagtaagaaatgtgaaaaacaaanaaaccaaaaaaaaaaaaaaaaaaaaatcgcacaccccagacaaacaacagaaaacagactaacaaaggcaagaccgacacagcaaacaatcccacgcacgagacagaaaaccaaccaaccaacacggcacacacctaccaccgcacaacataccgaacgcacatcctgacccaccacactgaccctacgacacaccccacaccaaaaaaccagcggcaacgccgcacccacccaacaccatgtggagacagaagacaggagggaaagaaaaaagagcaagcggagagaagaagaggaacaacaaaaaaacagggaaggaagaaaaaaaaacaagcaataatagagctagaagagaacagaacgcgtgcaacaattacgaaccgagcgacagacgaaggagcgggagcgagtgcagacacaagactagcgaaagctgaaagacacgtaccagcagaacggacaagcaggagaggcagggagagcagaccacaaagagcaaaacgcgaaaaccagaaaaggaa

SEQ ID NO: 299453 - DNA, 2491 bp, Homo sapiens
cttcatgttcagtttttacttcactctttattcttttctttgattatggtatgcttatttggaaagtcagtgaaactgtcaaaatgttatctcaataagatacttatatgagaactacaatcaccgaatctactgtattcaatattagcagatctaatttgataaacaacatggcttgtgtgaaaactgagcaggtgtttgtttacccatagtgttctgtgtagttattgcttagtctgcagaaaataatgacttagatgagatgtctgacttgctttcacttattaaacatgttcaccatgggatgatgtctgtaacatcagatattgttcaactagactaggatttaataaaaattgtgaaagcttactggcctaacattttattttataatattgggtatgaattatatgtagccagagatgtcattaagctttactgttatagtaggtaatatggttagtttgtagggaaaagagcatatgagcacatgcttgtgtattttggcctttgccccagtagaacagaccaatggcattctagacttgatgatactaagttttagcagacactagtaagtggtttgtatttaaccatactgatgaagcagacagattgaggcacagattttagtggctttgtggcaataaatagggcatggtgtgccttaggaaaagaatgtttataaagggaattataactgaaattaaaggaggcggcagtgaagaggaaataattctcttctatctaaatgatatacatatgatattttgagatttttataacagcagtggaacacaattctaggtagagtagaaaaaggaaagttttaaagacatataaaagattcttgttgacaaattatttttggtagcaaatctcaaatggttacctgctattaaggtctgccatattagagttttgcactattttgctaccaagtttgattcatacatctaaaacattttgtagttacttgtcaaggacttaatttgaaaatcatttgccaggccacttagttatcaatttttttttctatcagctattctgttgtatttctaaaacattttttagatgactttttaaagtatatttagcagtaaccttatgaggttcaaattggtaaatctcttgtaatttagccttcatcgaataataggtaccagtgtattaaaaatgtgtattttttgcagccccttgaaccagagtaggttcagagaaactcccaaagtttgtactttagacacatcatgcttgattggtaacttccctccttttttggggaacatgtttgtgtcctattaacttaattggatagatttttaaatatttcttatttttggcacacggaaagggtagttcgagtacagaactttgatttttggtgtagatgcagagggaatgatgggtaaatttcctaggtttatgtgaatttagggggtgtatgcattttgaaacaatctactaacagatggtgctgaaatctattacctacatgttttctagttgttcagcattatgttaatgaagcctccatataaggagtgtttctctggcacagttggtaagttgactgctaacttcatttaaatgtgttactggatatgcagtatactgaaattattaatcagtttgtgtataggaaaagagaactgggttaaaagcaaattaacttgttctgaaaagaaagtatagattaattttgttttctgtttaaattttatctccttggtaaagatttttttttcctgggcagaaaacttggcatttttaggcgtagataccttaccttacaatgccaaaatgaatttaattccagtactcaggtttttccctttaacagactctatgtgtatcagggctttctaatgggtttttcctcttcgtttttaaaatgtgagtagcatttgaccaatttccagtgctcttagcattttacttaaagaacaaccactacaaaagaaaatctttgtaatttgattgtcttttgctttgcttcattaatgcctaagaacttaagaatactcctacctcattagctactcaagatgctgtgacgatcaaatctattctacataatgcgtttagaaacaaagacttgggtgaaaaatgaaataagtatattctgacttggctattgaggggaaaattcagtattaagtgttcctcacaggagatatgttagcagaatactataaaagtttgaaatttttaaaaagtaaaagtacttaaatttaggtatctctcctgaaattctttgcagttcattttttatggcagttaatccagtgaaacactcaaaagtttttttttttttaaaagtgtttttccagataaactgtagggtgaacattcacataatcacaaatatgtaattctgtaattgtggaatgcttgtatgctttgttttcgtacatcttccatggagatgtctgaatataatactccatctgtgaatattttaaatgttgaaataaaagtaagaaatgtg

SEQ ID NO: 299454 - DNA, 2044 bp, Homo sapiens
  misc_feature (1523)..(1523): n is a, c, g, or t
tagcgattctacaggagcttatcgattggcgggccacttagttatcaatttttttttctatcagctattctgttgtatttctaaaacattttttagatgactttttaaagtatatttagcagtaaccttatgaggttcaaattggtaaatctcttgtaatttagccttcatcgaataataggtaccagtgtattaaaaatgtgtattttttgcagccccttgaaccagagtaggttcagagaaactcccaaagtttgtactttagacacatcatgcttgattggtaacttccctccttttttggggaacatgtttgtgtcctattaacttaattggatagatttttaaatatttcttatttttggcacacggaaagggtagttcgagtacagaactttgatttttggtgtagatgcagagggaatgatgggtaaatttcctaggtttatgtgaatttagggggtgtatgcattttgaaacaatctactaacagatggtgctgaaatctattacctacatgttttctagttgttcagcattatgttaatgaagcctccatataaggagtgtttctctggcacagttggtaagttgactgctaacttcatttaaatgtgttactggatatgcagtatactgaaattattaatcagtttgtgtataggaaaagagaactgggttaaaagcaaattaacttgttctgaaaagaaagtatagattaattttgttttctgtttaaattttatctccttggtaaagatttttttttcctgggcagaaaacttggcatttttaggcgtagataccttaccttacaatgccaaaatgaatttaattccagtactcaggtttttccctttaacagactctatgtgtatcagggctttctaatgggtttttcctcttcgtttttaaaatgtgagtagcatttgaccaatttccagtgctcttagcattttacttaaagaacaaccactacaaaagaaaatctttgtaatttgattgtcttttgctttgcttcattaatgcctaagaacttaagaatactcctacctcattagctactcaagatgctgtgacgatcaaatctattctacataatgcgtttagaaacaaagacttgggtgaaaaatgaaataagtatattctgacttggctattgaggggaaaattcagtattaagtgttcctcacaggagatatgttagcagaatactataaaagtttgaaatttttaaaaagtaaaagtacttaaatttaggtatctctcctgaaattctttgcagttcattttttatggcagttaatccagtgaaacactcaaaagtttttttttttttaaaagtgtttttccagataaactgtagggtgaacattcacataatcacaaatatgtaattctgtaattgtggaatgcttgtatgctttgttttcgtacatcttccatggagatgtctgaatataatactccatctgtgaatattttaaatgttgaaataaaagtaagaaatgtgaaaaacaaanaaaccaaaaaaaaaaaaaaaaaaaaatcgcacaccccagacaaacaacagaaaacagactaacaaaggcaagaccgacacagcaaacaatcccacgcacgagacagaaaaccaaccaaccaacacggcacacacctaccaccgcacaacataccgaacgcacatcctgacccaccacactgaccctacgacacaccccacaccaaaaaaccagcggcaacgccgcacccacccaacaccatgtggagacagaagacaggagggaaagaaaaaagagcaagcggagagaagaagaggaacaacaaaaaaacagggaaggaagaaaaaaaaacaagcaataatagagctagaagagaacagaacgcgtgcaacaattacgaaccgagcgacagacgaaggagcgggagcgagtgcagacacaagactagcgaaagctgaaagacacgtaccagcagaacggacaagcaggagaggcagggagagcagaccacaaagagcaaaacgcgaaaaccagaaaaggaa

SEQ ID NO: 299455 - DNA, 2044 bp, Homo sapiens
  misc_feature (1523)..(1523): n is a, c, g, or t
ggaggtgatctagaggtcccttcgattggcgggccacttagttatcaatttttttttctatcagctattctgttgtatttctaaaacattttttagatgactttttaaagtatatttagcagtaaccttatgaggttcaaattggtaaatctcttgtaatttagccttcatcgaataataggtaccagtgtattaaaaatgtgtattttttgcagccccttgaaccagagtaggttcagagaaactcccaaagtttgtactttagacacatcatgcttgattggtaacttccctccttttttggggaacatgtttgtgtcctattaacttaattggatagatttttaaatatttcttatttttggcacacggaaagggtagttcgagtacagaactttgatttttggtgtagatgcagagggaatgatgggtaaatttcctaggtttatgtgaatttagggggtgtatgcattttgaaacaatctactaacagatggtgctgaaatctattacctacatgttttctagttgttcagcattatgttaatgaagcctccatataaggagtgtttctctggcacagttggtaagttgactgctaacttcatttaaatgtgttactggatatgcagtatactgaaattattaatcagtttgtgtataggaaaagagaactgggttaaaagcaaattaacttgttctgaaaagaaagtatagattaattttgttttctgtttaaattttatctccttggtaaagatttttttttcctgggcagaaaacttggcatttttaggcgtagataccttaccttacaatgccaaaatgaatttaattccagtactcaggtttttccctttaacagactctatgtgtatcagggctttctaatgggtttttcctcttcgtttttaaaatgtgagtagcatttgaccaatttccagtgctcttagcattttacttaaagaacaaccactacaaaagaaaatctttgtaatttgattgtcttttgctttgcttcattaatgcctaagaacttaagaatactcctacctcattagctactcaagatgctgtgacgatcaaatctattctacataatgcgtttagaaacaaagacttgggtgaaaaatgaaataagtatattctgacttggctattgaggggaaaattcagtattaagtgttcctcacaggagatatgttagcagaatactataaaagtttgaaatttttaaaaagtaaaagtacttaaatttaggtatctctcctgaaattctttgcagttcattttttatggcagttaatccagtgaaacactcaaaagtttttttttttttaaaagtgtttttccagataaactgtagggtgaacattcacataatcacaaatatgtaattctgtaattgtggaatgcttgtatgctttgttttcgtacatcttccatggagatgtctgaatataatactccatctgtgaatattttaaatgttgaaataaaagtaagaaatgtgaaaaacaaanaaaccaaaaaaaaaaaaaaaaaaaaatcgcacaccccagacaaacaacagaaaacagactaacaaaggcaagaccgacacagcaaacaatcccacgcacgagacagaaaaccaaccaaccaacacggcacacacctaccaccgcacaacataccgaacgcacatcctgacccaccacactgaccctacgacacaccccacaccaaaaaaccagcggcaacgccgcacccacccaacaccatgtggagacagaagacaggagggaaagaaaaaagagcaagcggagagaagaagaggaacaacaaaaaaacagggaaggaagaaaaaaaaacaagcaataatagagctagaagagaacagaacgcgtgcaacaattacgaaccgagcgacagacgaaggagcgggagcgagtgcagacacaagactagcgaaagctgaaagacacgtaccagcagaacggacaagcaggagaggcagggagagcagaccacaaagagcaaaacgcgaaaaccagaaaaggaa

SEQ ID NO: 299456 - DNA, 1606 bp, Homo sapiens
cttcatgttcagtttttacttcactctttattcttttctttgattatggtatgcttatttggaaagtcagtgaaactgtcaaaatgttatctcaataagatacttatatgagaactacaatcaccgaatctactgtattcaatattagcagatctaatttgataaacaacatggcttgtgtgaaaactgagcaggtgtttgtttacccatagtgttctgtgtagttattgcttagtctgcagaaaataatgacttagatgagatgtctgacttgctttcacttattaaacatgttcaccatgggatgatgtctgtaacatcagatattgttcaactagactaggatttaataaaaattgtgaaagcttactggcctaacattttattttataatattgggtatgaattatatgtagccagagatgtcattaagctttactgttatagtaggtaatatggttagtttgtagggaaaagagcatatgagcacatgcttgtgtattttggcctttgccccagtagaacagaccaatggcattctagacttgatgatactaagttttagcagacactagtaagtggtttgtatttaaccatactgatgaagcagacagattgaggcacagattttagtggctttgtggcaataaatagggcatggtgtgccttaggaaaagaatgtttataaagggaattataactgaaattaaaggaggcggcagtgaagaggaaataattctcttctatctaaatgatatacatatgatattttgagatttttataacagcagtggaacacaattctaggtagagtagaaaaaggaaagttttaaagacatataaaagattcttgttgacaaattatttttggtagcaaatctcaaatggttacctgctattaaggtctgccatattagagttttgcactattttgctaccaagtttgattcatacatctaaaacattttgtagttacttgtcaaggacttaatttgaaaatcatttgccaggccacttagttatcaatttttttttctatcagctattctgttgtatttctaaaacattttttagatgactttttaaagtatatttagcagtaaccttatgaggttcaaattggtaaatctcttgtaatttagccttcatcgaataataggtaccagtgtattaaaaatgtgtattttttgcagccccttgaaccagagtaggttcagagaaactcccaaagtttgtactttagacacatcatgcttgattggtaacttccctccttttttggggaacatgtttgtgtcctattaacttaattggatagatttttaaatatttcttatttttggcacacggaaagggtagttcgagtacagaactttgatttttggtgtagatgcagagggaatgatgggtaaatttcctaggtttatgtgaatttagggggtgtatgcattttgaaacaatctactaacagatggtgctgaaatctattacctacatgttttctagttgttcagcattatgttaatgaagcctccatataaggagtgtttctctggcacagttggtaagttgcccgccaatcgaaggggatcctctagagcacaac

SEQ ID NO: 299457 - DNA, 205 bp, Homo sapiens
aaaagtgtttttccagataaactgtagggtgaacattcacataatcacaaatatgtaattctgtaattgtggaatgcttgtatgctttgttttcgtacatcttccatggagatgtctgaatataatactccatctgtgaatattttaaatgttgaaataaaagtaagaaatgtgccctttgtgttatcccggtttcacaaacctg

SEQ ID NO: 299458 - DNA, 3389 bp, Homo sapiens
ggctcctcccccaccggccttcaccttttgttccctatcctgggccagttctctcgcaggtcccagatgtccagttccagatgcctggacccagagtgtgggggaaatatctctggagaagccctcactccaaaggctgtccaggcgcaatgtggtggctgcttctctggggagtcctccaggcttgcccaacccggggctccgtcctcttggcccaagagctaccccagcagctgacatcccccgggtacccagagccgtatggcaaaggccaagagagcagcacggacatcaaggctccagagggctttgctgtgaggctcgtcttccaggacttcgacctggagccgtcccaggactgtgcaggggactctgtcacaatctcattcgtcggttcggatccaagccagttctgtggtcagcaaggctcccctctgggcaggccccctggtcagagggagtttgtatcctcagggaggagtttgcggctgaccttccgcacacagccttcctcggagaacaagactgcccacctccacaagggcttcctggccctctaccaaaccgtggctgtgaactatagtcagcccatcagcgaggccagcaggggctctgaggccatcaacgcacctggagacaaccctgccaaggtccagaaccactgccaggagccctattatcaggccgcggcagcaggggcactcacctgtgcaaccccagggacctggaaagacagacaggatggggaggaggttcttcagtgtatgcctgtctgcggacggccagtcacccccattgcccagaatcagacgaccctcggttcttccagagccaagctgggcaacttcccctggcaagccttcaccagtatccacggccgtgggggcggggccctgctgggggacagatggatcctcactgctgcccacaccgtctaccccaaggacagtgtttctctcaggaagaaccagagtgtgaatgtgttcttgggccacacagccatagatgagatgctgaaactggggaaccaccctgtccaccgtgtcgttgtgcaccccgactaccgtcagaatgagtcccataactttagcggggacatcgccctcctggagctgcagcacagcatccccctgggccccaacgtcctcccggtctgtctgcccgataatgagaccctctaccgcagcggcttgttgggctacgtcagtgggtttggcatggagatgggctggctaactactgagctgaagtactcgaggctgcctgtagctcccagggaggcctgcaacgcctggctccaaaagagacagagacccgaggtgttttctgacaatatgttctgtgttggggatgagacgcaaaggcacagtgtctgccagggggacagtggcagcgtctatgtggtatgggacaatcatgcccatcactgggtggccacgggcattgtgtcctggggcatagggtgtggcgaagggtatgacttctacaccaaggtgctcagctatgtggactggatcaagggagtgatgaatggcaagaattgaccctgggggcttgaacagggactgaccagcacagtggaggccccaggcaacagagggcctggagtgaggactgaacactggggtaggggttgggggtggggggttgggggaggcagggaaatcctattcacatcactgttgcaccaagccactgcaagagaaacccccacccggcaagcccgccccatcccagacaggaagcagagtcccacagaccgctcctcctcaccctctacctccctgtgctcatgcactaggccccgggaagcctgtacatctcaacaactttcgccttgaatgtccttagaaccaccttcccctacttcatctgttgacacagcttttatactcacctgtggaagagtcagctactcacccgctattagagtatggaggaaggggttttcattgcattgcatttctgaaacattcctaagaccctttagttgaccttcaaatattcaagctattctgcagctccaagatgcaattatagaaacagctccttttttattttatgtcctctatatgccaggtgcttcacctgttatttcacttaatcctcataccatatttgcaaaggatgtgttattatctatgtgtgacaaatgaggaaactgaggctcaggggataaagggacttgcccaagtcccacagctggtgtgtgactgcagagactgtgctcttcccagtgtgctgcaatacttctcaaccctcctctaacctgctgtgtcacccgctttccctcccagcccccacatccttaccattttccctccctgggaattcctgcttctgcgaaaatggtatcctctagctcacactttcctaatggccccatctcctgcagaagccaggtgagcccagcactggactgaagttcttgcagacaccccacctgtgcccctatcatcaggggaactgctccacctgagaggaccaactctttaatttttagtaaaacctggaggtgatgggccgggcgcagtggctcacgcctgtaatcccaacaccttaggagtccgaggtgggtggatcacgaggtcaggagatccagcccatcctggccaacatggtgaaaccccatctctactaaaaatacaaaaattagccgggcgtggtgacacgtgcctgtagtcccagctactcgggaggctgaggcaggagaatcacttgaacctgggaggcggaggttgcagtgagctaagatcacgccactgcactccagcctgcggacagaccaagacttcatcccccccaaaaaaaaaagattggaggtgatttacagtgaaagacacaaataaaatacaactgttcaatggaaatagaaaataaacaccataaaagagagaagagaggtaatttgttagcatcaagagtcaagttgctatatggtcaaaggttaaatttatctctaaaaaatggcaggattcaaagttgtacatacatgtgattacttctgttttttacacccacatacagtacaaaagattattaaaaatattcccaaaaggcaggtgcaatgatgcacacttatacccccagccactcaggaggctgatgcaagaggatcgcttgagcccaggagttgaagtccagcctaagcaacatagtgaaaccccatctccaaaaatataataataattctctcaaaatactaaacagaggtggttttattgataagattttggctgtttggttttccactattctctattggctaaaatttgtttaatgagcatgaaatgtttttattttattttgcttatttttatgattgcaaaaaatgatatgagtttctccctgccaaggcaaaaaatatatatatatacctataaaaatat

SEQ ID NO: 299459 - DNA, 287 bp, Homo sapiens
ctatttcttgcctattatgaatgatgctgctatgagcatttgtgtacaagtttttatatcaacgtacgtttctaaatctcctgggtatatacctagcagtagacttgctggattgtataataattctgtttaactttttgaggaaccaccaaactgtcttcaacagcagcagcaccaagttacatctcaccggcaatacatgagggttcaagcccaccatttttgagatccacgcttttgaatgaaagcattgccttctaaagttttgtttgtttgtttgttttgag

SEQ ID NO: 299460 - DNA, 2794 bp, Homo sapiens
  misc_feature (66)..(66): n is a, c, g, or t
  misc_feature (86)..(86): n is a, c, g, or t
  misc_feature (102)..(102): n is a, c, g, or t
  misc_feature (118)..(118): n is a, c, g, or t
ggggggggggggtcccccccccccctctcccccggggtggttcccaaaaagaacccaaaaaggggnggggggggggggcccaaaanctttttccaacccccnttgggtggccaaaaancccccagggacctggaaagacagacaggatggggaggaggttcttcagtgtatgcctgtctgcggacggccagtcacccccattgcccagaatcagacgaccctcggttcttccagagccaagctgggcaacttcccctggcaagccttcaccagtatccacggccgtgggggcggggccctgctgggggacagatggatcctcactgctgcccacaccgtctaccccaaggacagtgtttctctcaggaagaaccagagtgtgaatgtgttcttgggccacacagccatagatgagatgctgaaactggggaaccaccctgtccaccgtgtcgttgtgcaccccgactaccgtcagaatgagtcccataactttagcggggacatcgccctcctggagctgcagcacagcatccccctgggccccaacgtcctcccggtctgtctgcccgataatgagaccctctaccgcagcggcttgttgggctacgtcagtgggtttggcatggagatgggctggctaactactgagctgaagtactcgaggctgcctgtagctcccagggaggcctgcaacgcctggctccaaaagagacagagacccgaggtgttttctgacaatatgttctgtgttggggatgagacgcaaaggcacagtgtctgccagggggacagtggcagcgtctatgtggtatgggacaatcatgcccatcactgggtggccacgggcattgtgtcctggggcatagggtgtggcgaagggtatgacttctacaccaaggtgctcagctatgtggactggatcaagggagtgatgaatggcaagaattgaccctgggggcttgaacagggactgaccagcacagtggaggccccaggcaacagagggcctggagtgaggactgaacactggggtaggggttgggggtggggggttgggggaggcagggaaatcctattcacatcactgttgcaccaagccactgcaagagaaacccccacccggcaagcccgccccatcccagacaggaagcagagtcccacagaccgctcctcctcaccctctacctccctgtgctcatgcactaggccccgggaagcctgtacatctcaacaactttcgccttgaatgtccttagaaccaccttcccctacttcatctgttgacacagcttttatactcacctgtggaagagtcagctactcacccgctattagagtatggaggaaggggttttcattgcattgcatttctgaaacattcctaagaccctttagttgaccttcaaatattcaagctattctgcagctccaagatgcaattatagaaacagctccttttttattttatgtcctctatatgccaggtgcttcacctgttatttcacttaatcctcataccatatttgcaaaggatgtgttattatctatgtgtgacaaatgaggaaactgaggctcaggggataaagggacttgcccaagtcccacagctggtgtgtgactgcagagactgtgctcttcccagtgtgctgcaatacttctcaaccctcctctaacctgctgtgtcacccgctttccctcccagcccccacatccttaccattttccctccctgggaattcctgcttctgcgaaaatggtatcctctagctcacactttcctaatggccccatctcctgcagaagccaggtgagcccagcactggactgaagttcttgcagacaccccacctgtgcccctatcatcaggggaactgctccacctgagaggaccaactctttaatttttagtaaaacctggaggtgatgggccgggcgcagtggctcacgcctgtaatcccaacaccttaggagtccgaggtgggtggatcacgaggtcaggagatccagcccatcctggccaacatggtgaaaccccatctctactaaaaatacaaaaattagccgggcgtggtgacacgtgcctgtagtcccagctactcgggaggctgaggcaggagaatcacttgaacctgggaggcggaggttgcagtgagctaagatcacgccactgcactccagcctgcggacagaccaagacttcatcccccccaaaaaaaaaagattggaggtgatttacagtgaaagacacaaataaaatacaactgttcaatggaaatagaaaataaacaccataaaagagagaagagaggtaatttgttagcatcaagagtcaagttgctatatggtcaaaggttaaatttatctctaaaaaatggcaggattcaaagttgtacatacatgtgattacttctgttttttacacccacatacagtacaaaagattattaaaaatattcccaaaaggcaggtgcaatgatgcacacttatacccccagccactcaggaggctgatgcaagaggatcgcttgagcccaggagttgaagtccagcctaagcaacatagtgaaaccccatctccaaaaatataataataattctctcaaaatactaaacagaggtggttttattgataagattttggctgtttggttttccactattctctattggctaaaatttgtttaatgagcatgaaatgtttttattttattttgcttatttttatgattgcaaaaaatgatatgagtttctccctgccaaggcaaaaaatatatatatatacctataaaaatat

SEQ ID NO: 299461 - DNA, 2037 bp, Homo sapiens
ggctcctcccccaccggccttcaccttttgttccctatcctgggccagttctctcgcaggtcccagatgtccagttccagatgcctggacccagagtgtgggggaaatatctctggagaagccctcactccaaaggctgtccaggcgcaatgtggtggctgcttctctggggagtcctccaggcttgcccaacccggggctccgtcctcttggcccaagagctaccccagcagctgacatcccccgggtacccagagccgtatggcaaaggccaagagagcagcacggacatcaaggctccagagggctttgctgtgaggctcgtcttccaggacttcgacctggagccgtcccaggactgtgcaggggactctgtcacaatctcattcgtcggttcggatccaagccagttctgtggtcagcaaggctcccctctgggcaggccccctggtcagagggagtttgtatcctcagggaggagtttgcggctgaccttccgcacacagccttcctcggagaacaagactgcccacctccacaagggcttcctggccctctaccaaaccgtggctgtgaactatagtcagcccatcagcgaggccagcaggggctctgaggccatcaacgcacctggagacaaccctgccaaggtccagaaccactgccaggagccctattatcaggccgcggcagcaggggcactcacctgtgcaaccccagggacctggaaagacagacaggatggggaggaggttcttcagtgtatgcctgtctgcggacggccagtcacccccattgcccagaatcagacgaccctcggttcttccagagccaagctgggcaacttcccctggcaagccttcaccagtatccacggccgtgggggcggggccctgctgggggacagatggatcctcactgctgcccacaccgtctaccccaaggacagtgtttctctcaggaagaaccagagtgtgaatgtgttcttgggccacacagccatagatgagatgctgaaactggggaaccaccctgtccaccgtgtcgttgtgcaccccgactaccgtcagaatgagtcccataactttagcggggacatcgccctcctggagctgcagcacagcatccccctgggccccaacgtcctcccggtctgtctgcccgataatgagaccctctaccgcagcggcttgttgggctacgtcagtgggtttggcatggagatgggctggctaactactgagctgaagtactcgaggctgcctgtagctcccagggaggcctgcaacgcctggctccaaaagagacagagacccgaggtgttttctgacaatatgttctgtgttggggatgagaggagaatcacttgaacctgggaggcggaggttgcagtgagctaagatcacgccactgcactccagcctgcggacagaccaagacttcatcccccccaaaaaaaaaagattggaggtgatttacagtgaaagacacaaataaaatacaactgttcaatggaaatagaaaataaacaccataaaagagagaagagaggtaatttgttagcatcaagagtcaagttgctatatggtcaaaggttaaatttatctctaaaaaatggcaggattcaaagttgtacatacatgtgattacttctgttttttacacccacatacagtacaaaagattattaaaaatattcccaaaaggcaggtgcaatgatgcacacttatacccccagccactcaggaggctgatgcaagaggatcgcttgagcccaggagttgaagtccagcctaagcaacatagtgaaaccccatctccaaaaatataataataattctctcaaaatactaaacagaggtggttttattgataagattttggctgtttggttttccactattctctattggctaaaatttgtttaatgagcatgaaatgtttttattttattttgcttatttttatgattgcaaaaaatgatatgagtttctccctgccaaggcaaaaaatatatatatatacctataaaaatat

SEQ ID NO: 299462 - DNA, 1764 bp, Homo sapiens
gtgatctagcaggatcttcaaagacagacagtcggggaaatcctattcacatcactgttgcaccaagccactgcaagagaaacccccacccggcaagcccgccccatcccagacaggaagcagagtcccacagaccgctcctcctcaccctctacctccctgtgctcatgcactaggccccgggaagcctgtacatctcaacaactttcgccttgaatgtccttagaaccaccttcccctacttcatctgttgacacagcttttatactcacctgtggaagagtcagctactcacccgctattagagtatggaggaaggggttttcattgcattgcatttctgaaacattcctaagaccctttagttgaccttcaaatattcaagctattctgcagctccaagatgcaattatagaaacagctccttttttattttatgtcctctatatgccaggtgcttcacctgttatttcacttaatcctcataccatatttgcaaaggatgtgttattatctatgtgtgacaaatgaggaaactgaggctcaggggataaagggacttgcccaagtcccacagctggtgtgtgactgcagagactgtgctcttcccagtgtgctgcaatacttctcaaccctcctctaacctgctgtgtcacccgctttccctcccagcccccacatccttaccattttccctccctgggaattcctgcttctgcgaaaatggtatcctctagctcacactttcctaatggccccatctcctgcagaagccaggtgagcccagcactggactgaagttcttgcagacaccccacctgtgcccctatcatcaggggaactgctccacctgagaggaccaactctttaatttttagtaaaacctggaggtgatgggccgggcgcagtggctcacgcctgtaatcccaacaccttaggagtccgaggtgggtggatcacgaggtcaggagatccagcccatcctggccaacatggtgaaaccccatctctactaaaaatacaaaaattagccgggcgtggtgacacgtgcctgtagtcccagctactcgggaggctgaggcaggagaatcacttgaacctgggaggcggaggttgcagtgagctaagatcacgccactgcactccagcctgcggacagaccaagacttcatcccccccaaaaaaaaaagattggaggtgatttacagtgaaagacacaaataaaatacaactgttcaatggaaatagaaaataaacaccataaaagagagaagagaggtaatttgttagcatcaagagtcaagttgctatatggtcaaaggttaaatttatctctaaaaaatggcaggattcaaagttgtacatacatgtgattacttctgttttttacacccacatacagtacaaaagattattaaaaatattcccaaaaggcaggtgcaatgatgcacacttatacccccagccactcaggaggctgatgcaagaggatcgcttgagcccaggagttgaagtccagcctaagcaacatagtgaaaccccatctccaaaaatataataataattctctcaaaatactaaacagaggtggttttattgataagattttggctgtttggttttccactattctctattggctaaaatttgtttaatgagcatgaaatgtttttattttattttgcttatttttatgattgcaaaaaatgatatgagtttctccctgccaaggcaaaaaatatatatatatacctataaaaatat

SEQ ID NO: 299463 - DNA, 886 bp, Homo sapiens
  misc_feature (179)..(179): n is a, c, g, or t
  misc_feature (215)..(215): n is a, c, g, or t
  misc_feature (224)..(224): n is a, c, g, or t
  misc_feature (235)..(235): n is a, c, g, or t
agtaatggctctgcttaattttagctgttctttttagagagccatgacagttattaccaagtttgtcattagaaaataatattaggttggagcaaaagtaattgcagtttttgccattgctttcaatggtaaaaggcaccattacttttgcagccacgtaatattataaatttgttccntaaagtgtatttttgataagaaagcccttttgtttntctttctgntaattttttgnttttttcttggtagagacagagttttgcactccagcctgcggacagaccaagacttcatcccccccaaaaaaaaaagattggaggtgatttacagtgaaagacacaaataaaatacaactgttcaatggaaatagaaaataaacaccataaaagagagaagagaggtaatttgttagcatcaagagtcaagttgctatatggtcaaaggttaaatttatctctaaaaaatggcaggattcaaagttgtacatacatgtgattacttctgttttttacacccacatacagtacaaaagattattaaaaatattcccaaaaggcaggtgcaatgatgcacacttatacccccagccactcaggaggctgatgcaagaggatcgcttgagcccaggagttgaagtccagcctaagcaacatagtgaaaccccatctccaaaaatataataataattctctcaaaatactaaacagaggtggttttattgataagattttggctgtttggttttccactattctctattggctaaaatttgtttaatgagcatgaaatgtttttattttattttgcttatttttatgattgcaaaaaatgatatgagtttctccctgccaaggcaaaaaatatatatatatacctataaaaatat

SEQ ID NO: 299464 - DNA, 714 bp, Homo sapiens
gcgtcccctaccacagcacttcagagaagcagaggagaatcacttgaacctgggaggcggaggttgcagtgagctaagatcacgccactgcactccagcctgcggacagaccaagacttcatcccccccaaaaaaaaaagattggaggtgatttacagtgaaagacacaaataaaatacaactgttcaatggaaatagaaaataaacaccataaaagagagaagagaggtaatttgttagcatcaagagtcaagttgctatatggtcaaaggttaaatttatctctaaaaaatggcaggattcaaagttgtacatacatgtgattacttctgttttttacacccacatacagtacaaaagattattaaaaatattcccaaaaggcaggtgcaatgatgcacacttatacccccagccactcaggaggctgatgcaagaggatcgcttgagcccaggagttgaagtccagcctaagcaacatagtgaaaccccatctccaaaaatataataataattctctcaaaatactaaacagaggtggttttattgataagattttggctgtttggttttccactattctctattggctaaaatttgtttaatgagcatgaaatgtttttattttattttgcttatttttatgattgcaaaaaatgatatgagtttctccctgccaaggcaaaaaatatatatatatacctataaaaatat

SEQ ID NO: 299465 - DNA, 916 bp, Homo sapiens
ggctcctcccccaccggccttcaccttttgttccctatcctgggccagttctctcgcaggtcccagatgtccagttccagatgcctggacccagagtgtgggggaaatatctctggagaagccctcactccaaaggctgtccaggcgcaatgtggtggctgcttctctggggagtcctccaggcttgcccaacccggggctccgtcctcttggcccaagagctaccccagcagctgacatcccccgggtacccagagccgtatggcaaaggccaagagagcagcacggacatcaaggctccagagggctttgctgtgaggctcgtcttccaggacttcgacctggagccgtcccaggactgtgcaggggactctgtcacaatctcattcgtcggttcggatccaagccagttctgtggtcagcaaggctcccctctgggcaggccccctggtcagagggagtttgtatcctcagggaggagtttgcggctgaccttccgcacacagccttcctcggagaacaagactgcccacctccacaagggcttcctggccctctaccaaaccgtggctgtgaactatagtcagcccatcagcgaggccagcaggggctctgaggccatcaacgcacctggagacaaccctgccaaggtccagaaccactgccaggagccctattatcaggccgcggcagcaggggcactcacctgtgcaaccccagggacctggaaagacagacaggatggggaggaggttcttcagtgtatgcctggaaccaccaaactgtcttcaacagcagcagcaccaagttacatctcaccggcaatacatgagggttcaagcccaccatttttgagatccacgcttttgaatgaaagcattgccttctaaagttttgtttgtttgtttgttttgag

SEQ ID NO: 299466 - DNA, 892 bp, Homo sapiens
ggctcctcccccaccggccttcaccttttgttccctatcctgggccagttctctcgcaggtcccagatgtccagttccagatgcctggacccagagtgtgggggaaatatctctggagaagccctcactccaaaggctgtccaggcgcaatgtggtggctgcttctctggggagtcctccaggcttgcccaacccggggctccgtcctcttggcccaagagctaccccagcagctgacatcccccgggtacccagagccgtatggcaaaggccaagagagcagcacggacatcaaggctccagagggctttgctgtgaggctcgtcttccaggacttcgacctggagccgtcccaggactgtgcaggggactctgtcacaatctcattcgtcggttcggatccaagccagttctgtggtcagcaaggctcccctctgggcaggccccctggtcagagggagtttgtatcctcagggaggagtttgcggctgaccttccgcacacagccttcctcggagaacaagactgcccacctccacaagggcttcctggccctctaccaaaccgtggctgtgaactatagtcagcccatcagcgaggccagcaggggctctgaggccatcaacgcacctggagacaaccctgccaaggtccagaaccactgccaggagccctattatcaggccgcggcagcaggggcactcacctgtgcaaccccagggacctggaaagacagacaggatggggaggaggttcttcagtgtatgcctgcagcagcaccaagttacatctcaccggcaatacatgagggttcaagcccaccatttttgagatccacgcttttgaatgaaagcattgccttctaaagttttgtttgtttgtttgttttgag

SEQ ID NO: 299467 - DNA, 778 bp, Homo sapiens
ggctcctcccccaccggccttcaccttttgttccctatcctgggccagttctctcgcaggtcccagatgtccagttccagatgcctggacccagagtgtgggggaaatatctctggagaagccctcactccaaaggctgtccaggcgcaatgtggtggctgcttctctggggagtcctccaggcttgcccaacccggggctccgtcctcttggcccaagagctaccccagcagctgacatcccccgggtacccagagccgtatggcaaaggccaagagagcagcacggacatcaaggctccagagggctttgctgtgaggctcgtcttccaggacttcgacctggagccgtcccaggactgtgcaggggactctgtcacagtgagctggggatggggggggtcccgccaggactgtggccagggagattcccggggttgtgggaagtggcggtgccctgaatcccccatctggaggagggatgaattttccatgtaggggcagtcgggcttggcttaccggggagcagtggtggaccccaggacacagcctcccaccagcgcctccggggctgccatctgggccccacagagcaaagagggcagcaagcaggccctgcgtttggaaggcttatgaatggacacacaaatcttgcaaatctatggagccaggggcagggacgcacatattggttgttaaaaatatgtcatcatgtatttgttgagtgcctgctctatcaggtgaggaagctggacacaaataataacaaaagattaagt

SEQ ID NO: 299468 - DNA, 788 bp, Homo sapiens
ggctcctcccccaccggccttcaccttttgttccctatcctgggccagttctctcgcaggtcccagatgtccagttccagatgcctggacccagagtgtgggggaaatatctctggagaagccctcactccaaaggctgtccaggcgcaatgtggtggctgcttctctggggagtcctccaggcttgcccaacccggggctccgtcctcttggcccaagagctaccccagcagctgacatcccccgggtacccagagccgtatggcaaaggccaagagagcagcacggacatcaaggctccagagggctttgctgtgaggctcgtcttccaggacttcgacctggagccgtcccaggactgtgcaggggactctgtcacagtgagctggggatggggggggtcccgccaggactgtggccagggagattcccggggttgtgggaagtggcggtgccctgaatcccccatctggaggagggatgaattttccatgtaggggcagtcgggcttggcttaccggggagcagtggtggaccccagccatgaccctggtatcttcaagccttaagtggaagcttgagtgacagctgaggctggggactcagggacacctgggctggatcccagccctgcccctgctggcaagcaaccctattaagagacagccgtagctgagcccccagcggttgtttccatgcagatttacaggcccagtgtttgcagatcatctcatttttaaagagatgccaaaaatccagatttttaagtaaaattataaattttcaaa

SEQ ID NO: 299469 - DNA, 614 bp, Homo sapiens
tatcttcaaactctttgagtgttgtcaatctgatcggtgaaaacgaactcaaatgttttaaaaaaactaaaaataaaaaataaaacactgtgcaagtcaaaccaagtatagccatgggccagaatcagcccctgggttgccagttggcaagtctgtgctaggtgctgttttcctatagctgtgaactatagtcagcccatcagcgaggccagcaggggctctgaggccatcaacgcacctggagacaaccctgccaaggtccagaaccactgccaggagccctattatcaggccgcggcagcaggtgagtccccacctgccgaggggtggcttccatccacctcattcccacccaaatgcctgacaccctctgagcacctgcttcgttaaccaacagcttcaactccgagcctatttctttgcctctcctcatttacgccacaggggcactcacctgtgcaaccccagggacctggaaagacagacaggatggggaggaggttcttcagtgtatgcctggtgagtagccacctgctagcaccattcccccaacaagcctcagctgcaactgggacctacaggacacaggggttaaaggaaagccttagaataga

SEQ ID NO: 299470 - DNA, 325 bp, Homo sapiens
cagcacttcagagaagcaggtctttaatcagtgtgtctagatgcagctgctgactgtcacccctaccccgcctctctcccagtctgcggacggccagtcacccccattgcccagaatcagacgaccctcggttcttccagagccaagctgggcaacttcccctggcaagccttcaccagtatccacggccgtgggggcggggccctgctgggggacagatggatcctcactgctgcccacaccgtctaccccaaggacagtgtttctctcaggaagaaccagagtgtgaatgtgttcttgggccacacagccatagatgagatgc

SEQ ID NO: 299471 - DNA, 3608 bp, Homo sapiens
gaattcttcgtaggaattatcttttccctcctctcacccgacagcctgcctatttccaaaggaaaaaaaaaaagcgtgttgagtacgttctggattactcataagaccttttttttttccttccgggcgcaaaaccgtgagctggatttataatcgccctataaagctccagaggcggtcaggcacctgcagaggagccccgccgctccgccgactagctgcccccgcgagcaacggcctcgtgatttccccgccgatccggtccccgcctccccactctgcccccgcctaccccggagccgtgcagccgcctctccgaatctctctcttctcctggcgctcgcgtgcgagagggaactagcgagaacgaggaagcagctggaggtgacgccgggcagattacgcctgtcagggccgagccgagcggatcgctgggcgctgtgcagaggaaaggcgggagtgcccggctcgctgtcgcagagccgagcctgtttctgcgccggaccagtcgaggactctggacagtagaggccccgggacgaccgagctgatggcgtcttcgaccccatcttcgtccgcaacctcctcgaacgcgggagcggaccccaataccactaacctgcgccccacaacgtacgatacctggtgcggcgtggcccatggatgcaccagaaaactggggctcaagatctgcggcttcttgcaaaggaccaacagcctggaagagaagagtcgccttgtgagtgccttcaaggagaggcaatcctccaagaacctgctttcctgtgaaaacagcgaccgggatgcccgcttccggcgcacagagactgacttctctaatctgtttgctagagatctgcttccggctaagaacggtgaggagcaaaccgtgcaattcctcctggaagtggtggacatactcctcaactatgtccgcaagacatttgatcgctccaccaaggtgctggactttcatcacccacaccagttgctggaaggcatggagggcttcaacttggagctctctgaccaccccgagtccctggagcagatcctggttgactgcagagacaccttgaagtatggggttcgcacaggtcatcctcgatttttcaaccagctctccactggattggatattattggcctagctggagaatggctgacatcaacggccaataccaacatgtttacatatgaaattgcaccagtgtttgtcctcatggaacaaataacacttaagaagatgagagagatagttggatggtcaagtaaagatggtgatgggatattttctcctgggggcgccatatccaacatgtacagcatcatggctgctcgctacaagtacttcccggaagttaagacaaagggcatggcggctgtgcctaaactggtcctcttcacctcagaacagagtcactattccataaagaaagctggggctgcacttggctttggaactgacaatgtgattttgataaagtgcaatgaaagggggaaaataattccagctgattttgaggcaaaaattcttgaagccaaacagaagggatatgttcccttttatgtcaatgcaactgctggcacgactgtttatggagcttttgatccgatacaagagattgcagatatatgtgagaaatataacctttggttgcatgtcgatgctgcctggggaggtgggctgctcatgtccaggaagcaccgccataaactcaacggcatagaaagggccaactcagtcacctggaaccctcacaagatgatgggcgtgctgttgcagtgctctgccattctcgtcaaggaaaagggtatactccaaggatgcaaccagatgtgtgcaggatacctcttccagccagacaagcagtatgatgtctcctacgacaccggggacaaggcaattcagtgtggccgccacgtggatatcttcaagttctggctgatgtggaaagcaaagggcacagtgggatttgaaaaccagatcaacaaatgcctggaactggctgaatacctctatgccaagattaaaaacagagaagaatttgagatggttttcaatggcgagcctgagcacacaaacgtctgtttttggtatattccacaaagcctcaggggtgtgccagacagccctcaacgacgggaaaagctacacaaggtggctccaaaaatcaaagccctgatgatggagtcaggtacgaccatggttggctaccagccccaaggggacaaggccaacttcttccggatggtcatctccaacccagccgctacccagtctgacattgacttcctcattgaggagatagaaagactgggccaggatctgtaatcatccttcgcagaacatgagtttatgggaatgccttttccctctggcactccagaacaaacctctatatgttgctgaaacacacaggccatttcattgagggaaaacataatatcttgaagaatattgttaaaaccttacttaaagcttgtttgttctagttagcaggaaatagtgttctttttaaaaagttgcacattaggaacagagtatatatgtacagttatacatacctctctctatatatacatgtatagtgagtgtggcttagtaatagatcacggcatgtttcccgctccaagagaattcactttaccttcagcagttaccgaggagctaaacatgctgccaaccagcttgtccaacaactccaggaaaactgtttttcaaaacgccatgtcctaggggccaagggaaatgctgttggtgagaatcgacctcactgtcagcgtttctccacctgaagtgatgatggatgagaaaaaacaccaccaaatgacaagtcacaccctccccattagtatcctgttaggggaaaatagtagcagagtcattgttacaggtgtactatggctgtatttttagagattaatttgtgtagattgtgtaaattcctgttgtctgaccttggtggtgggagggggagactatgtgtcatgatttcaatgattgtttaattgtaggtcaatgaaatatttgcttatttatattcagagatgtaccatgttaaagaggcgtcttgtattttcttcccatttgtaatgtatcttatttatatatgaagtaagttctgaaaactgtttatggtattttcgtgcatttgtgagccaaagagaaaagattaaaattagtgagatttgtatttatattagagtgcccttaaaataatgatttaagcattttactgtctgtaagagaattctaagattgtacataaagtcatatatatggaaatcctgttacttaaatagcatctgctcttctcttacgctctctgtctggctgtacgtctggtgttctcaatgcttttctagcaactgttggataataactagatctcctgtaattttgtagtagttgatgaccaatctctgtgactcgcttagctgaaacctaaggcaacatttccgaagaccttctgaagatctcagataaagtgaccaggctcacaactgtttttgaagaagggaaattcacactgtgcgttttagagtatgcaagaagaatataaataaataaaaatattctccatggagattgacaaaaaaaaaaa

SEQ ID NO: 299472 - DNA, 1385 bp, Homo sapiens
gaattcttcgtaggaattatcttttccctcctctcacccgacagcctgcctatttccaaaggaaaaaaaaaaagcgtgttgagtacgttctggattactcataagaccttttttttttccttccgggcgcaaaaccgtgagctggatttataatcgccctataaagctccagaggcggtcaggcacctgcagaggagccccgccgctccgccgactagctgcccccgcgagcaacggcctcgtgatttccccgccgatccggtccccgcctccccactctgcccccgcctaccccggagccgtgcagccgcctctccgaatctctctcttctcctggcgctcgcgtgcgagagggaactagcgagaacgaggaagcagctggaggtgacgccgggcagattacgcctgtcagggccgagccgagcggatcgctgggcgctgtgcagaggaaaggcgggagtgcccggctcgctgtcgcagagccgagcctgtttctgcgccggaccagtcgaggactctggacagtagaggccccgggacgaccgagctgatggcgtcttcgaccccatcttcgtccgcaacctcctcgaacgcgggagcggaccccaataccactaacctgcgccccacaacgtacgatacctggtgcggcgtggcccatggatgcaccagaaaactggggctcaagatctgcggcttcttgcaaaggaccaacagcctggaagagaagagtcgccttgtgagtgccttcaaggagaggcaatcctccaagaacctgctttcctgtgaaaacagcgaccgggatgcccgcttccggcgcacagagactgacttctctaatctgtttgctagagatctgcttccggctaagaacggtgaggagcaaaccgtgcaattcctcctggaagtggtggacatactcctcaactatgtccgcaagacatttgatcgctccaccaaggtgctggactttcatcacccacaccagttgctggaaggcatggagggcttcaacttggagctctctgaccaccccgagtccctggagcagatcctggttgactgcagagacaccttgaagtatggggttcgcacaggtcatcctcgatttttcaaccagctctccactggattggatattattggcctagctggagaatggctgacatcaacggccaataccaacatgccatcagacatgagggagtgttggttgctacggtgatggggctcagagcagaaccaaagcatgattgtgacctccagaggtgatggtaactgcacacatggtttccaagggtcttcctcctaaatttccaggggcctcccaaggaaaatggacatattctttttggaaataaaatacttctaccaacataaaaaaa

SEQ ID NO: 299473 - DNA, 3553 bp, Homo sapiens
gaattcttcgtaggaattatcttttccctcctctcacccgacagcctgcctatttccaaaggaaaaaaaaaaagcgtgttgagtacgttctggattactcataagaccttttttttttccttccgggcgcaaaaccgtgagctggatttataatcgccctataaagctccagaggcggtcaggcacctgcagaggagccccgccgctccgccgactagctgcccccgcgagcaacggcctcgtgatttccccgccgatccggtccccgcctccccactctgcccccgcctaccccggagccgtgcagccgcctctccgaatctctctcttctcctggcgctcgcgtgcgagagggaactagcgagaacgaggaagcagctggaggtgacgccgggcagattacgcctgtcagggccgagccgagcggatcgctgggcgctgtgcagaggaaaggcgggagtgcccggctcgctgtcgcagagccgagcctgtttctgcgccggaccagtcgaggactctggacagtagaggccccgggacgaccgagctgatggcgtcttcgaccccatcttcgtccgcaacctcctcgaacgcgggagcggaccccaataccactaacctgcgccccacaacgtacgatacctggtgcggcgtggcccatggatgcaccagaaaactggggctcaagatctgcggcttcttgcaaaggaccaacagcctggaagagaagagtcgccttgtgagtgccttcaaggagaggcaatcctccaagaacctgctttcctgtgaaaacagcgaccgggatgcccgcttccggcgcacagagactgacttctctaatctgtttgctagagatctgcttccggctaagaacggtgaggagcaaaccgtgcaattcctcctggaagtggtggacatactcctcaactatgtccgcaagacatttgatcgctccaccaaggtgctggactttcatcacccacaccagttgctggaaggcatggagggcttcaacttggagctctctgaccaccccgagtccctggagcagatcctggttgactgcagagacaccttgaagtatggggttcgcacaggtcatcctcgatttttcaaccagctctccactggattggatattattggcctagctggagaatggctgacatcaacggccaataccaacatgtttacatatgaaattgcaccagtgtttgtcctcatggaacaaataacacttaagaagatgagagagatagttggatggtcaagtaaagatggtgatgggatattttctcctgggggcgccatatccaacatgtacagcatcatggctgctcgctacaagtacttcccggaagttaagacaaagggcatggcggctgtgcctaaactggtcctcttcacctcagaacagagtcactattccataaagaaagctggggctgcacttggctttggaactgacaatgtgattttgataaagtgcaatgaaagggggaaaataattccagctgattttgaggcaaaaattcttgaagccaaacagaagggatatgttcccttttatgtcaatgcaactgctggcacgactgtttatggagcttttgatccgatacaagagattgcagatatatgtgagaaatataacctttggttgcatgtcgatgctgcctggggaggtgggctgctcatgtccaggaagcaccgccataaactcaacggcatagaaagggccaactcagtcacctggaaccctcacaagatgatgggcgtgctgttgcagtgctctgccattctcgtcaaggaaaagggtatactccaaggatgcaaccagatgtgtgcaggatacctcttccagccagacaagcagtatgatgtctcctacgacaccggggacaaggcaattcagtgtggccgccacgtggatatcttcaagttctggctgatgtggaaagcaaagggcacagtgggatttgaaaaccagatcaacaaatgcctggaactggctgaatacctctatgccaagattaaaaacagagaagaatttgagatggttttcaatggcgagcctgagcacacaaacgtctgtttttggtatattccacaaagcctcaggggtgtgccagacagccctcaacgacgggaaaagctacacaaggtggctccaaaaatcaaagccctgatgatggagtcaggtacgaccatggttggctaccagccccaaggggacaaggccaacttcttccggatggtcatctccaacccagccgctacccagtctgacattgacttcctcattgaggagatagaaagactgggccaggatctgtaatcatccttcgcagaacatgagtttatgggaatgccttttccctctggcactccagaacaaacctctatatgttgctgaaacacacaggccatttcattgagggaaaacataatatcttgaagaatattgttaaaaccttacttaaagcttgtttgttctagttagcaggaaatagtgttctttttaaaaagttgcacattaggaacagagtatatatgtacagttatacatacctctctctatatatacatgtatagtgagtgtggcttagtaatagatcacggcatgtttcccgctccaagagaattcactttaccttcagcagttaccgaggagctaaacatgctgccaaccagcttgtccaacaactccaggaaaactgtttttcaaaacgccatgtcctaggggccaagggaaatgctgttggtgagaatcgacctcactgtcagcgtttctccacctgaagtgatgatggatgagaaaaaacaccaccaaatgacaagtcacaccctccccattagtatcctgttaggggaaaatagtagcagagtcattgttacaggtgtactatggctgtatttttagagattaatttgtgtagattgtgtaaattcctgttgtctgaccttggtggtgggagggggagactatgtgtcatgatttcaatgattgtttaattgtaggtcaatgaaatatttgcttatttatattcagagatgtaccatgttaaagaggcgtcttgtattttcttcccatttgtaatgtatcttatttatatatgaagtaagttctgaaaactgtttatggtattttcgtgcatttgtgagccaaagagaaaagattaaaattagtgagatttgtatttatattagagtgccataaagtcatatatatggaaatcctgttacttaaatagcatctgctcttctcttacgctctctgtctggctgtacgtctggtgttctcaatgcttttctagcaactgttggataataactagatctcctgtaattttgtagtagttgatgaccaatctctgtgactcgcttagctgaaacctaaggcaacatttccgaagaccttctgaagatctcagataaagtgaccaggctcacaactgtttttgaagaagggaaattcacactgtgcgttttagagtatgcaagaagaatataaataaataaaaatattctccatggagattgacaaaaaaaaaaa

SEQ ID NO: 299474 - DNA, 2039 bp, Homo sapiens
agcggactccgagagccgcagcggcagcggcgcgtcctgcctgcagagagccaggccggagaagccgagcggcgcagaggacgccagggcgcgcgccgcagccacccaccctccggaccgcggcagctgctgacccgccatcgccatggcccgcgggaaagccaaggccaactcagtcacctggaaccctcacaagatgatgggcgtgctgttgcagtgctctgccattctcgtcaaggaaaagggtatactccaaggatgcaaccagatgtgtgcaggatacctcttccagccagacaagcagtatgatgtctcctacgacaccggggacaaggcaattcagtgtggccgccacgtggatatcttcaagttctggctgatgtggaaagcaaagggcacagtgggatttgaaaaccagatcaacaaatgcctggaactggctgaatacctctatgccaagattaaaaacagagaagaatttgagatggttttcaatggcgagcctgagcacacaaacgtctgtttttggtatattccacaaagcctcaggggtgtgccagacagccctcaacgacgggaaaagctacacaaggtggctccaaaaatcaaagccctgatgatggagtcaggtacgaccatggttggctaccagccccaaggggacaaggccaacttcttccggatggtcatctccaacccagccgctacccagtctgacattgacttcctcattgaggagatagaaagactgggccaggatctgtaatcatccttcgcagaacatgagtttatgggaatgccttttccctctggcactccagaacaaacctctatatgttgctgaaacacacaggccatttcattgagggaaaacataatatcttgaagaatattgttaaaaccttacttaaagcttgtttgttctagttagcaggaaatagtgttctttttaaaaagttgcacattaggaacagagtatatatgtacagttatacatacctctctctatatatacatgtatagtgagtgtggcttagtaatagatcacggcatgtttcccgctccaagagaattcactttaccttcagcagttaccgaggagctaaacatgctgccaaccagcttgtccaacaactccaggaaaactgtttttcaaaacgccatgtcctaggggccaagggaaatgctgttggtgagaatcgacctcactgtcagcgtttctccacctgaagtgatgatggatgagaaaaaacaccaccaaatgacaagtcacaccctccccattagtatcctgttaggggaaaatagtagcagagtcattgttacaggtgtactatggctgtatttttagagattaatttgtgtagattgtgtaaattcctgttgtctgaccttggtggtgggagggggagactatgtgtcatgatttcaatgattgtttaattgtaggtcaatgaaatatttgcttatttatattcagagatgtaccatgttaaagaggcgtcttgtattttcttcccatttgtaatgtatcttatttatatatgaagtaagttctgaaaactgtttatggtattttcgtgcatttgtgagccaaagagaaaagattaaaattagtgagatttgtatttatattagagtgcccttaaaataatgatttaagcattttactgtctgtaagagaattctaagattgtacataaagtcatatatatggaaatcctgttacttaaatagcatctgctcttctcttacgctctctgtctggctgtacgtctggtgttctcaatgcttttctagcaactgttggataataactagatctcctgtaattttgtagtagttgatgaccaatctctgtgactcgcttagctgaaacctaaggcaacatttccgaagaccttctgaagatctcagataaagtgaccaggctcacaactgtttttgaagaagggaaattcacactgtgcgttttagagtatgcaagaagaatataaataaataaaaatattctccatggagattgacaaaaaaaaaaa

SEQ ID NO: 299475 - DNA, 499 bp, Homo sapiens
atataactcacctatccctttgcagccctgatgcagctacctcttatatttctgtctagacttcaggtggaaagcgcactgaagtacacgaatcacctccagccaaattgcctagatagctttggtaataagtgtgactacttgtattcccagggtaaagggtccagtgggaagccccagcaatagggaagccagcaaaacctatcaggatattatcctttcgcttcctgacctcccttgtctcttgagacaccagctcagcgttcgtttttagaaacaataatcaaagagccccaacacctcccaatatgtccgcttgctgacagggggcgccatatccaacatgtacagcatcatggctgctcgctacaagtacttcccggaagttaagacaaagggcatggcggctgtgcctaaactggtcctcttcacctcagaacaggtgagtcggggatgctttctcatggatagtggtgttttttaggggactttccaactt

SEQ ID NO: 299476 - DNA, 505 bp, Homo sapiens
tataactcacctatccctttgcagccctgatgcagctacctcttatatttctgtctagacttcaggtggaaagcgcactgaagtacacgaatcacctccagccaaattgcctagatagctttggtaataagtgtgactacttgtattcccagggtaaagggtccagtgggaagccccagcaatagggaagccagcaaaacctatcaggatattatcctttcgcttcctgacctcccttgtctcttgagacaccagctcagcgttcgtttttagaaacaataatcaaagagccccaacacctcccaatatgtccgcttgctgacagggggcgccatatccaacatgtacagcatcatggctgctcgctacaagtacttcccggaagttaagacaaagggcatggcggctgtgcctaaactggtcctcttcacctcagaacaggtgagtcggggatgctttctcatggatagtggtgttttttaggggactttccaacttctaacct

SEQ ID NO: 299477 - DNA, 791 bp, Homo sapiens
cgtgtgtttgtgtgtgtgtatgtgtgctggtgaatgtgagtacagggaagcagcggccgccatttcagggagcttgtcgacgctgtcgcaggggtggatcctgagctgccgaagccgccgtcctgctctcccgcgtgggcttctctaattccattgttttttttagattctctcgggcctagccgtccttggaacccgatattcgggctgggcggttccgcggcctgggcctaggggcttaacagtagcaacagaagcggcggcggcggcagcagcagcagcagcagcagcaatctcttcccgaacacgagcaccacaggcgcccgaaggccggaacaggcgtttagagaaaatggcagacgatattgatattgaagcaatgcttgaggctccttacaagaagacttgcctaacgatatctcacctctactcccatgaattcacctttgattccagtgtgaactgtcaatcataaggtagtaattgagtgacttatcgctgtaccgtggtcccctaggtaaaatgactcaactaagaattaccacctccagtttggtatagcaaaaaggtgaatgtagtggtttgggaaaaagcaggggtccaagaataacaaagcatgaccagtctgtggcaagttaaatcttctaatagtcttataagaagaaatgggtgagattttaaaatttatgtatctatgtaagactggtgatagtaaatcttaaaacagtccagtggcaatctgctgctcagttaataattactaaaattcttggatccctgaatagaaatta

SEQ ID NO: 299478 - DNA, 1102 bp, Homo sapiens
tgtgtgtgtttttttttttttaattctcaagactgtatatatatatgtagcttacaaagatatctaaagtctgaaaatgggtgtgtgcattttcagaatctaaaaattttgaggctgtaacctttggtcttggcacctctcagtggtccaggatggataaatacaagggcagcttgcctgggaataaagttaagagacaagtatttttgtttcctcttcataactgaggtggaaaagcagtagcctaaacaatgttagtcttgctggagagcgcatgaatgcgatcttagcaagaccctaaacctgtaactagtgtaattttgtgtttcctttttagctccggaccaaaatttaacagtgccatccgaggaaagattgggttgcctcatagcatcaaattaaggtttttaaacatacttctgaattgtttaaattgtttttcaaggaactaacatgctgtacttgtttggataacttctgaaactttttaactttgcagcagacgacgttcccgaagcaaaagtccattcagaaaagacaagagccctgtgaggtagtttacttctttaaagcctttagctcttaaaaagcttttgcagcttatggtactgttaaatttgatgatatttagtaatttggaccatattaaatcttgcttttgctttcttttgcacttccagtactttaaggtcaagtgaatttctactgagttttcagtagttttcactttaatttcatataattaaagcaacagttatatatttatttatttatttatttattttgagacggagtctcactcagtcacccaggatggagtgcagtagtgcagtcttggcttactgcaacctccgcctcctgggttcaagcagttcttctacctcagccctccaagtagctgggattacaggcatgcaccaccatgcctcgctatttttttattttagtagcgatgggatttcaccatgttggctagcctagtgttgagctccggacctcagatggtccacccaccttggcctctcaaagtggtaggattgcaggtgtgagccaacacacccggccacaaaagttatttatttatgagatggagtctcgctct

SEQ ID NO: 299479 - DNA, 306 bp, Homo sapiens
tagccgccgtgacggcggaatcgtcgggtggtccggaatcgtcgtcgtcgtgcggaattcgtcgtcgtggctgttttcagctgaaatgtcaggccagttgtgaatttgttgtgtatgctcattgataaagatccttttttgggctcatctgtatttaaggtttgttaataataataaaaggtattccaaactaaaagtgttttgaagattagatcactagaaatttggatgtggatatttaaagttggaaacaaatatattatggttattaaataactatattaaccacctacaattctaaggatt

SEQ ID NO: 299480 - DNA, 834 bp, Homo sapiens
gtactcttgaagctgtaactccctaatttcctgcaggcccttggtaaaatgttatctacctcctctttctgaattttgcatattctagatgcctcctattaagttgatatgtagtatctgacttacgtagggtagtatttttatcactctaaactttaacattagttgttatgcaaatggaaggtgtatgtctttaaactgctgtgtgttatctctgtgtgacgtgtattttgtcttctaggcagaaaaaaacagagctgcagcaatggcaaacaatttacaaaagggaagtgctggacctatgaggctttatgtgggctcattacacttcaacataactgaagatatgcttcgtgggatctttgagccttttggaagagtaagtccaggttcttcaatgaatcttcagtaggttgttgatctgagtataactacataatttctgtatgtcttgctttgttatctttctgtgagttaatattaagaggataagggctggttttataaaaatttctgtgacaacatagattaaaataggtcacttgatagattcttaaaagaatgttactgttattcataatgccatgtgaaatgcataatgggtattagagttaataaaaagtccacattggctgggcatggtggctcatgcctgtaatcccagctacttggggtgctgaggcaggaggatgacattagcccaggatttcaaggttgcagtgagccatgattatgccacttcactccaccttgggtaacagtgtgatcctgtgtcaaaagaaggaaaattgttaaatcatacgaagactattattttttagtaggatttttttt

SEQ ID NO: 299481 - DNA, 502 bp, Homo sapiens
ctattttatccttcatctgtttggattgatgtgtattgagattttgtctaattgaactgattttgataacacataaagtttaatttccctgttaaaataggactcccaaatttctgaatgtctgtttcaagtattaggttacctcagttttctggcacctaaaagctactgataacatacattagtagcaatattaaataaggtaaaataactccagtgacatcctagttacatgcttggggtgggtttttggtttcgttttaaagtatttatgagggatactttcatgcattttccatgaaactaatttttctctttctttttttagcttcagctttagctgcagctgcctctgttcagccacttgcaacacaatgtttccaactctctaacatgtttaaccctcaaacagaagaagaagttggatgggataccgagattaaggatagagagattaaggatagagagattaacggagggactcctctagacctcaccctct

SEQ ID NO: 299482 - DNA, 491 bp, Homo sapiens
ataaaattctagtatacctattagccagtggaaccattatggtaaaccagtttgtggttatagagcactaagtttctacaggcaacttgaataaacataacttgggtccattttgcatacagcaacatctttaccttttttttcattttttctgtagggcaatgtgtatgtgaagtgcccatcaattgctgcagctattgctgctgtcaatgcattgcatggcaggtggtttgctggtaaaatgataacagcagcatatgtacctcttccaacttaccacaacctgtttcctgattctatgacagcaacacagctactggttccaagtagacgatgaaggaagatatagtcccttatgtatatagctttttttctttcttgagaattcatcttgagttatcttttatttagataaaaataaagaggcaaggatctactgtcatttgtatgcaatttcctgttaccttgaaaaaataaaaatgttaacagga

SEQ ID NO: 299483 - DNA, 2809 bp, Homo sapiens
  misc_feature (27)..(27): n is a, c, g, or t
  misc_feature (34)..(34): n is a, c, g, or t
  misc_feature (47)..(47): n is a, c, g, or t
  misc_feature (56)..(56): n is a, c, g, or t
cagtcgacttactgcgcctacacctanattgaanacaccgctttgcntcagtatanaaaacggcaagtgtacgtcgatacggagcttgtcgacgctgtcgcaggggtggatcctgagctgccgaagccgccgtcctgctctcccgcgtgggcttctctaattccattgttttttttagattctctcgggcctagccgtccttggaacccgatattcgggctgggcggttccgcggcctgggcctaggggcttaacagtagcaacagaagcggcggcggcggcagcagcagcagcagcagcagcaatctcttcccgaacacgagcaccacaggcgcccgaaggccggaacaggcgtttagagaaaatggcagacgatattgatattgaagcaatgcttgaggctccttacaagaaggatgagaacaagttgagcagtgccaacggccatgaagaacgtagcaaaaagaggaaaaaaagcaagagcagaagtcgtagtcatgaacgaaagagaagcaaaagtaaggaacggaagcgaagtagagacagagaaaggaaaaagagcaaaagccgtgaaagaaagcgaagtagaagcaaagagaggcgacggagccgctcaagaagtcgagatcgaagatttagaggccgctacagaagtccttactccggaccaaaatttaacagtgccatccgaggaaagattgggttgcctcatagcatcaaattaagcagacgacgttcccgaagcaaaagtccattcagaaaagacaagagccctgtgagagaacctattgataatttaactcctgaggaaagagatgcaaggacagtcttctgtatgcagctggcggcaagaattcgaccaagggatttggaagagtttttctctacagtaggaaaggttcgagatgtgaggatgatttctgacagaaattcaagacgttccaaaggaattgcttatgtggagttcgtcgatgttagctcagtgcctctagcaataggattaactggccaacgagttttaggcgtgccaatcatagtacaggcatcacaggcagaaaaaaacagagctgcagcaatggcaaacaatttacaaaagggaagtgctggacctatgaggctttatgtgggctcattacacttcaacataactgaagatatgcttcgtgggatctttgagccttttggaagaattgaaagtatccagctgatgatggacagtgaaactggtcgatccaagggatatggatttattacattttctgactcagaatgtgccaaaaaggctttggaacaacttaatggatttgaactagcaggaagaccaatgaaagttggtcatgttactgaacgtactgatgcttcgagtgctagttcatttttggacagtgatgaactggaaaggactggaattgatttgggaacaactggtcgtcttcagttaatggcaagacttgcagagggtacaggtttgcagattccgccagcagcacagcaagctctacagatgagtggctctttggcatttggtgctgtggcagatttgcaaacaagactttcccagcagactgaagcttcagctttagctgcagctgcctctgttcagccacttgcaacacaatgtttccaactctctaacatgtttaaccctcaaacagaagaagaagttggatgggataccgagattaaggatgatgtgattgaagaatgtaataaacatggaggagttattcatatttatgttgacaaaaattcagctcagggcaatgtgtatgtgaagtgcccatcaattgctgcagctattgctgctgtcaatgcattgcatggcaggtggtttgctggtaaaatgataacagcagcatatgtacctcttccaacttaccacaacctgtttcctgattctatgacagcaacacagctactggttccaagtagacgatgaaggaagatatagtcccttatgtatatagctttttttctttcttgagaattcatcttgagttatcttttatttagataaaaataaagaggcaaggatctactgtcatttgtatgcaatttcctgttaccttgaaaaaataaaaatgttaacaggaatgcagtgtgctcattctccctaaatagtaaatcccactgtatacaaaactgttctcttgttctgccttttaaaatgttcatgtagaaaattaatgaactataggaatagctctaggagaacaaatgtgctttctgtaaaaaggcagaccagggatgtaatgtttttaatgtttcagaagcctaactttttacacagtggttacatttcacatttcactaatgttgatatttggctgatggttgagcagtttctgaaatacacatttagtgtatggaaatacaagacagctaaagggctgtttggttagcatctcatcttgcattctgatcaattggcaagaaagggagatttcaaaattatatttcttgatggtatcttttcaattaatgtatctgtaaaagtttctttgtaaatactatgtgttctggtgtgtcttaaaattccaaacaaaatgatccctgcatttcctgaagatgtttaaacgtgagagtctggtaggcaaagcagtctgagaaagaaataggaaatgcagaaataggttttgtctggttgcatataatctttgctctttttaagctctgtgagctctgaaatatatttttgggttacttcagtgtgtttgacaagacagcttgatatttctatcaaacaaatgactttcatattgcaacaatctttgtaagaaccactcaaataaaagtctcttaaaaaggc

SEQ ID NO: 299484 - DNA, 2827 bp, Homo sapiens
  misc_feature (27)..(27): n is a, c, g, or t
  misc_feature (34)..(34): n is a, c, g, or t
  misc_feature (47)..(47): n is a, c, g, or t
  misc_feature (56)..(56): n is a, c, g, or t
cagtcgacttactgcgcctacacctanattgaanacaccgctttgcntcagtatanaaaacggcaagtgtacgtcgatacggagcttgtcgacgctgtcgcaggggtggatcctgagctgccgaagccgccgtcctgctctcccgcgtgggcttctctaattccattgttttttttagattctctcgggcctagccgtccttggaacccgatattcgggctgggcggttccgcggcctgggcctaggggcttaacagtagcaacagaagcggcggcggcggcagcagcagcagcagcagcagcaatctcttcccgaacacgagcaccacaggcgcccgaaggccggaacaggcgtttagagaaaatggcagacgatattgatattgaagcaatgcttgaggctccttacaagaaggatgagaacaagttgagcagtgccaacggccatgaagaacgtagcaaaaagaggaaaaaaagcaagagcagaagtcgtagtcatgaacgaaagagaagcaaaagtaaggaacggaagcgaagtagagacagagaaaggaaaaagagcaaaagccgtgaaagaaagcgaagtagaagcaaagagaggcgacggagccgctcaagaagtcgagatcgaagatttagaggccgctacagaagtccttactccggaccaaaatttaacagtgccatccgaggaaagattgggttgcctcatagcatcaaattaagcagacgacgttcccgaagcaaaagtccattcagaaaagacaagagccctgtgagagaacctattgataatttaactcctgaggaaagagatgcaaggacagtcttctgtatgcagctggcggcaagaattcgaccaagggatttggaagagtttttctctacagtaggaaaggttcgagatgtgaggatgatttctgacagaaattcaagacgttccaaaggaattgcttatgtggagttcgtcgatgttagctcagtgcctctagcaataggattaactggccaacgagttttaggcgtgccaatcatagtacaggcatcacaggcagaaaaaaacagagctgcagcaatggcaaacaatttacaaaagggaagtgctggacctatgaggctttatgtgggctcattacacttcaacataactgaagatatgcttcgtgggatctttgagccttttggaagaattgaaagtatccagctgatgatggacagtgaaactggtcgatccaagggatatggatttattacattttctgactcagaatgtgccaaaaaggctttggaacaacttaatggatttgaactagcaggaagaccaatgaaagttggtcatgttactgaacgtactgatgcttcgagtgctagttcatttttggacagtgatgaactggaaaggactggaattgatttgggaacaactggtcgtcttcagttaatggcaagacttgcagagggtacaggtttgcagattccgccagcagcacagcaagctctacagatgagtggctctttggcatttggtgctgtggcagaattctcttttgttatagatttgcaaacaagactttcccagcagactgaagcttcagctttagctgcagctgcctctgttcagccacttgcaacacaatgtttccaactctctaacatgtttaaccctcaaacagaagaagaagttggatgggataccgagattaaggatgatgtgattgaagaatgtaataaacatggaggagttattcatatttatgttgacaaaaattcagctcagggcaatgtgtatgtgaagtgcccatcaattgctgcagctattgctgctgtcaatgcattgcatggcaggtggtttgctggtaaaatgataacagcagcatatgtacctcttccaacttaccacaacctgtttcctgattctatgacagcaacacagctactggttccaagtagacgatgaaggaagatatagtcccttatgtatatagctttttttctttcttgagaattcatcttgagttatcttttatttagataaaaataaagaggcaaggatctactgtcatttgtatgcaatttcctgttaccttgaaaaaataaaaatgttaacaggaatgcagtgtgctcattctccctaaatagtaaatcccactgtatacaaaactgttctcttgttctgccttttaaaatgttcatgtagaaaattaatgaactataggaatagctctaggagaacaaatgtgctttctgtaaaaaggcagaccagggatgtaatgtttttaatgtttcagaagcctaactttttacacagtggttacatttcacatttcactaatgttgatatttggctgatggttgagcagtttctgaaatacacatttagtgtatggaaatacaagacagctaaagggctgtttggttagcatctcatcttgcattctgatcaattggcaagaaagggagatttcaaaattatatttcttgatggtatcttttcaattaatgtatctgtaaaagtttctttgtaaatactatgtgttctggtgtgtcttaaaattccaaacaaaatgatccctgcatttcctgaagatgtttaaacgtgagagtctggtaggcaaagcagtctgagaaagaaataggaaatgcagaaataggttttgtctggttgcatataatctttgctctttttaagctctgtgagctctgaaatatatttttgggttacttcagtgtgtttgacaagacagcttgatatttctatcaaacaaatgactttcatattgcaacaatctttgtaagaaccactcaaataaaagtctcttaaaaaggc

SEQ ID NO: 299485 - DNA, 4348 bp, Homo sapiens
  misc_feature (27)..(27): n is a, c, g, or t
  misc_feature (34)..(34): n is a, c, g, or t
  misc_feature (47)..(47): n is a, c, g, or t
  misc_feature (56)..(56): n is a, c, g, or t
cagtcgacttactgcgcctacacctanattgaanacaccgctttgcntcagtatanaaaacggcaagtgtacgtcgatacggagcttgtcgacgctgtcgcaggggtggatcctgagctgccgaagccgccgtcctgctctcccgcgtgggcttctctaattccattgttttttttagattctctcgggcctagccgtccttggaacccgatattcgggctgggcggttccgcggcctgggcctaggggcttaacagtagcaacagaagcggcggcggcggcagcagcagcagcagcagcagcaatctcttcccgaacacgagcaccacaggcgcccgaaggccggaacaggcgtttagagaaaatggcagacgatattgatattgaagcaatgcttgaggctccttacaagaagacttgcctaacgatatctcacctctactcccatgaattcacctttgattccagtgtgaactgtcaatcataaggtagtaattgagtgacttatcgctgtaccgtggtcccctaggtaaaatgactcaactaagaattaccacctccagtttggtatagcaaaaaggtgaatgtagtggtttgggaaaaagcaggggtccaagaataacaaagcatgaccagtctgtggcaagttaaatcttctaatagtcttataagaagaaatgggtgagattttaaaatttatgtatctatgtaagactggtgatagtaaatcttaaaacagtccagtggcaatctgctgctcagttaataattactaaaattcttggatccctgaatagaaattaaaaaaaaaaatacaagaggcagtagagtcaatacaagcttaatacaagcttagagtaaatacaagcttagagtcacttgatgactgttttactgttctccatattgtttttatttttaattaggccctaccatagtatttcacactaaaaacaaaggaattatattggctaatatagtctttgactcatttcggtatctcagtaaaagtaaactgtcttttcattgtttcaccagttggtggtgaaaatagcagtatgcatgcattatcactggtgtcacaaactgtaagctttgtaagttagcactttactcctatagctgatgtaatcaaacttttaaacatttcactaaaccttttaatgaattcttgatagatttaaatagtgtatgtaattttgtaatgcttagactcttgaagagctactttctgttttaatgttaagattcttgtgtcttagttttttttaacatggatgtaattccatgtaaacaggtatggaagtaggaaatgtttaggctggacttggtggattattaattgactttcttgggttcttgggagtcaacattactaaagcagtgtgaatccctgtttgcttcagggcgagatgtgtgacagaggtggcatcaagctcttacagtcccaaccctccaacggaaatgggcgaagatctcaggaatggcatcggtcacaggaaatcgatagtggctggctgctagcatggccacttggggcttaggcagaaatagagccatggtactgaccaaagggaccatagcacatggaataaaactcaaaacaggacttcatgttttatggaaattatatttaaccacttcaacattgtaaatctggataacttttaatatctaaactatataagaaagtaaaatttaacatgttaatatggaaaatttttttatttttgtatcttgatgacttaaatgtaagcaacaaagtggttaaacacatacccatctaaatttttttatagccttccatgttaaactataagtaaataattagttttaaaattgttttgtattttcttattcctgttccctttaccctttgacaacttgaaatgttaccacttcgtcctcatgatgttcttctatcaaccctgcttaggatgagaacaagttgagcagtgccaacggccatgaagaacgtagcaaaaagaggaaaaaaagcaagagcagaagtcgtagtcatgaacgaaagagaagcaaaagtaaggaacggaagcgaagtagagacagagaaaggaaaaagagcaaaagccgtgaaagaaagcgaagtagaagcaaagagaggcgacggagccgctcaagaagtcgagatcgaagatttagaggccgctacagaagtccttactccggaccaaaatttaacagtgccatccgaggaaagattgggttgcctcatagcatcaaattaagcagacgacgttcccgaagcaaaagtccattcagaaaagacaagagccctgtgagagaacctattgataatttaactcctgaggaaagagatgcaaggacagtcttctgtatgcagctggcggcaagaattcgaccaagggatttggaagagtttttctctacagtaggaaaggttcgagatgtgaggatgatttctgacagaaattcaagacgttccaaaggaattgcttatgtggagttcgtcgatgttagctcagtgcctctagcaataggattaactggccaacgagttttaggcgtgccaatcatagtacaggcatcacaggcagaaaaaaacagagctgcagcaatggcaaacaatttacaaaagggaagtgctggacctatgaggctttatgtgggctcattacacttcaacataactgaagatatgcttcgtgggatctttgagccttttggaagaattgaaagtatccagctgatgatggacagtgaaactggtcgatccaagggatatggatttattacattttctgactcagaatgtgccaaaaaggctttggaacaacttaatggatttgaactagcaggaagaccaatgaaagttggtcatgttactgaacgtactgatgcttcgagtgctagttcatttttggacagtgatgaactggaaaggactggaattgatttgggaacaactggtcgtcttcagttaatggcaagacttgcagagggtacaggtttgcagattccgccagcagcacagcaagctctacagatgagtggctctttggcatttggtgctgtggcagaattctcttttgttatagatttgcaaacaagactttcccagcagactgaagcttcagctttagctgcagctgcctctgttcagccacttgcaacacaatgtttccaactctctaacatgtttaaccctcaaacagaagaagaagttggatgggataccgagattaaggatgatgtgattgaagaatgtaataaacatggaggagttattcatatttatgttgacaaaaattcagctcagggcaatgtgtatgtgaagtgcccatcaattgctgcagctattgctgctgtcaatgcattgcatggcaggtggtttgctggtaaaatgataacagcagcatatgtacctcttccaacttaccacaacctgtttcctgattctatgacagcaacacagctactggttccaagtagacgatgaaggaagatatagtcccttatgtatatagctttttttctttcttgagaattcatcttgagttatcttttatttagataaaaataaagaggcaaggatctactgtcatttgtatgcaatttcctgttaccttgaaaaaataaaaatgttaacaggaatgcagtgtgctcattctccctaaatagtaaatcccactgtatacaaaactgttctcttgttctgccttttaaaatgttcatgtagaaaattaatgaactataggaatagctctaggagaacaaatgtgctttctgtaaaaaggcagaccagggatgtaatgtttttaatgtttcagaagcctaactttttacacagtggttacatttcacatttcactaatgttgatatttggctgatggttgagcagtttctgaaatacacatttagtgtatggaaatacaagacagctaaagggctgtttggttagcatctcatcttgcattctgatcaattggcaagaaagggagatttcaaaattatatttcttgatggtatcttttcaattaatgtatctgtaaaagtttctttgtaaatactatgtgttctggtgtgtcttaaaattccaaacaaaatgatccctgcatttcctgaagatgtttaaacgtgagagtctggtaggcaaagcagtctgagaaagaaataggaaatgcagaaataggttttgtctggttgcatataatctttgctctttttaagctctgtgagctctgaaatatatttttgggttacttcagtgtgtttgacaagacagcttgatatttctatcaaacaaatgactttcatattgcaacaatctttgtaagaaccactcaaataaaagtctcttaaaaaggc

SEQ ID NO: 299486 - DNA, 4402 bp, Homo sapiens
  misc_feature (27)..(27): n is a, c, g, or t
  misc_feature (34)..(34): n is a, c, g, or t
  misc_feature (47)..(47): n is a, c, g, or t
  misc_feature (56)..(56): n is a, c, g, or t
cagtcgacttactgcgcctacacctanattgaanacaccgctttgcntcagtatanaaaacggcaagtgtacgtcgatacggagcttgtcgacgctgtcgcaggggtggatcctgagctgccgaagccgccgtcctgctctcccgcgtgggcttctctaattccattgttttttttagattctctcgggcctagccgtccttggaacccgatattcgggctgggcggttccgcggcctgggcctaggggcttaacagtagcaacagaagcggcggcggcggcagcagcagcagcagcagcagcaatctcttcccgaacacgagcaccacaggcgcccgaaggccggaacaggcgtttagagaaaatggcagacgatattgatattgaagcaatgcttgaggctccttacaagaagacttgcctaacgatatctcacctctactcccatgaattcacctttgattccagtgtgaactgtcaatcataaggtagtaattgagtgacttatcgctgtaccgtggtcccctaggtaaaatgactcaactaagaattaccacctccagtttggtatagcaaaaaggtgaatgtagtggtttgggaaaaagcaggggtccaagaataacaaagcatgaccagtctgtggcaagttaaatcttctaatagtcttataagaagaaatgggtgagattttaaaatttatgtatctatgtaagactggtgatagtaaatcttaaaacagtccagtggcaatctgctgctcagttaataattactaaaattcttggatccctgaatagaaattaaaaaaaaaaatacaagaggcagtagagtcaatacaagcttaatacaagcttagagtaaatacaagcttagagtcacttgatgactgttttactgttctccatattgtttttatttttaattaggccctaccatagtatttcacactaaaaacaaaggaattatattggctaatatagtctttgactcatttcggtatctcagtaaaagtaaactgtcttttcattgtttcaccagttggtggtgaaaatagcagtatgcatgcattatcactggtgtcacaaactgtaagctttgtaagttagcactttactcctatagctgatgtaatcaaacttttaaacatttcactaaaccttttaaaaataatacatttgttttggattgtatagcacgaccatgtggtaccaatttggatgaattcttgatagatttaaatagtgtatgtaattttgtaatgcttagactcttgaagagctactttctgttttaatgttaagattcttgtgtcttagttttttttaacatggatgtaattccatgtaaacaggtatggaagtaggaaatgtttaggctggacttggtggattattaattgactttcttgggttcttgggagtcaacattactaaagcagtgtgaatccctgtttgcttcagggcgagatgtgtgacagaggtggcatcaagctcttacagtcccaaccctccaacggaaatgggcgaagatctcaggaatggcatcggtcacaggaaatcgatagtggctggctgctagcatggccacttggggcttaggcagaaatagagccatggtactgaccaaagggaccatagcacatggaataaaactcaaaacaggacttcatgttttatggaaattatatttaaccacttcaacattgtaaatctggataacttttaatatctaaactatataagaaagtaaaatttaacatgttaatatggaaaatttttttatttttgtatcttgatgacttaaatgtaagcaacaaagtggttaaacacatacccatctaaatttttttatagccttccatgttaaactataagtaaataattagttttaaaattgttttgtattttcttattcctgttccctttaccctttgacaacttgaaatgttaccacttcgtcctcatgatgttcttctatcaaccctgcttaggatgagaacaagttgagcagtgccaacggccatgaagaacgtagcaaaaagaggaaaaaaagcaagagcagaagtcgtagtcatgaacgaaagagaagcaaaagtaaggaacggaagcgaagtagagacagagaaaggaaaaagagcaaaagccgtgaaagaaagcgaagtagaagcaaagagaggcgacggagccgctcaagaagtcgagatcgaagatttagaggccgctacagaagtccttactccggaccaaaatttaacagtgccatccgaggaaagattgggttgcctcatagcatcaaattaagcagacgacgttcccgaagcaaaagtccattcagaaaagacaagagccctgtgagagaacctattgataatttaactcctgaggaaagagatgcaaggacagtcttctgtatgcagctggcggcaagaattcgaccaagggatttggaagagtttttctctacagtaggaaaggttcgagatgtgaggatgatttctgacagaaattcaagacgttccaaaggaattgcttatgtggagttcgtcgatgttagctcagtgcctctagcaataggattaactggccaacgagttttaggcgtgccaatcatagtacaggcatcacaggcagaaaaaaacagagctgcagcaatggcaaacaatttacaaaagggaagtgctggacctatgaggctttatgtgggctcattacacttcaacataactgaagatatgcttcgtgggatctttgagccttttggaagaattgaaagtatccagctgatgatggacagtgaaactggtcgatccaagggatatggatttattacattttctgactcagaatgtgccaaaaaggctttggaacaacttaatggatttgaactagcaggaagaccaatgaaagttggtcatgttactgaacgtactgatgcttcgagtgctagttcatttttggacagtgatgaactggaaaggactggaattgatttgggaacaactggtcgtcttcagttaatggcaagacttgcagagggtacaggtttgcagattccgccagcagcacagcaagctctacagatgagtggctctttggcatttggtgctgtggcagaattctcttttgttatagatttgcaaacaagactttcccagcagactgaagcttcagctttagctgcagctgcctctgttcagccacttgcaacacaatgtttccaactctctaacatgtttaaccctcaaacagaagaagaagttggatgggataccgagattaaggatgatgtgattgaagaatgtaataaacatggaggagttattcatatttatgttgacaaaaattcagctcagggcaatgtgtatgtgaagtgcccatcaattgctgcagctattgctgctgtcaatgcattgcatggcaggtggtttgctggtaaaatgataacagcagcatatgtacctcttccaacttaccacaacctgtttcctgattctatgacagcaacacagctactggttccaagtagacgatgaaggaagatatagtcccttatgtatatagctttttttctttcttgagaattcatcttgagttatcttttatttagataaaaataaagaggcaaggatctactgtcatttgtatgcaatttcctgttaccttgaaaaaataaaaatgttaacaggaatgcagtgtgctcattctccctaaatagtaaatcccactgtatacaaaactgttctcttgttctgccttttaaaatgttcatgtagaaaattaatgaactataggaatagctctaggagaacaaatgtgctttctgtaaaaaggcagaccagggatgtaatgtttttaatgtttcagaagcctaactttttacacagtggttacatttcacatttcactaatgttgatatttggctgatggttgagcagtttctgaaatacacatttagtgtatggaaatacaagacagctaaagggctgtttggttagcatctcatcttgcattctgatcaattggcaagaaagggagatttcaaaattatatttcttgatggtatcttttcaattaatgtatctgtaaaagtttctttgtaaatactatgtgttctggtgtgtcttaaaattccaaacaaaatgatccctgcatttcctgaagatgtttaaacgtgagagtctggtaggcaaagcagtctgagaaagaaataggaaatgcagaaataggttttgtctggttgcatataatctttgctctttttaagctctgtgagctctgaaatatatttttgggttacttcagtgtgtttgacaagacagcttgatatttctatcaaacaaatgactttcatattgcaacaatctttgtaagaaccactcaaataaaagtctcttaaaaaggc

SEQ ID NO: 299487 - DNA, 4572 bp, Homo sapiens
  misc_feature (27)..(27): n is a, c, g, or t
  misc_feature (34)..(34): n is a, c, g, or t
  misc_feature (47)..(47): n is a, c, g, or t
  misc_feature (56)..(56): n is a, c, g, or t
cagtcgacttactgcgcctacacctanattgaanacaccgctttgcntcagtatanaaaacggcaagtgtacgtcgatacggagcttgtcgacgctgtcgcaggggtggatcctgagctgccgaagccgccgtcctgctctcccgcgtgggcttctctaattccattgttttttttagattctctcgggcctagccgtccttggaacccgatattcgggctgggcggttccgcggcctgggcctaggggcttaacagtagcaacagaagcggcggcggcggcagcagcagcagcagcagcagcaatctcttcccgaacacgagcaccacaggcgcccgaaggccggaacaggcgtttagagaaaatggcagacgatattgatattgaagcaatgcttgaggctccttacaagaaggtgagaaaaaacatgtcggtgaggtttatatatttcttaatttagcattattcacgaaactactgctgaaatgtaaactaacctccccggagccctcttgatttatcttatcagagatgcattacgtgtaacttacaaaagtaaatatatgctattgatgtaataatattgtgcagtagtttcacttcagcgtgatgaataaatgcccatctatctctctttgtacttgcctaacgatatctcacctctactcccatgaattcacctttgattccagtgtgaactgtcaatcataaggtagtaattgagtgacttatcgctgtaccgtggtcccctaggtaaaatgactcaactaagaattaccacctccagtttggtatagcaaaaaggtgaatgtagtggtttgggaaaaagcaggggtccaagaataacaaagcatgaccagtctgtggcaagttaaatcttctaatagtcttataagaagaaatgggtgagattttaaaatttatgtatctatgtaagactggtgatagtaaatcttaaaacagtccagtggcaatctgctgctcagttaataattactaaaattcttggatccctgaatagaaattaaaaaaaaaaatacaagaggcagtagagtcaatacaagcttaatacaagcttagagtaaatacaagcttagagtcacttgatgactgttttactgttctccatattgtttttatttttaattaggccctaccatagtatttcacactaaaaacaaaggaattatattggctaatatagtctttgactcatttcggtatctcagtaaaagtaaactgtcttttcattgtttcaccagttggtggtgaaaatagcagtatgcatgcattatcactggtgtcacaaactgtaagctttgtaagttagcactttactcctatagctgatgtaatcaaacttttaaacatttcactaaaccttttaatgaattcttgatagatttaaatagtgtatgtaattttgtaatgcttagactcttgaagagctactttctgttttaatgttaagattcttgtgtcttagttttttttaacatggatgtaattccatgtaaacaggtatggaagtaggaaatgtttaggctggacttggtggattattaattgactttcttgggttcttgggagtcaacattactaaagcagtgtgaatccctgtttgcttcagggcgagatgtgtgacagaggtggcatcaagctcttacagtcccaaccctccaacggaaatgggcgaagatctcaggaatggcatcggtcacaggaaatcgatagtggctggctgctagcatggccacttggggcttaggcagaaatagagccatggtactgaccaaagggaccatagcacatggaataaaactcaaaacaggacttcatgttttatggaaattatatttaaccacttcaacattgtaaatctggataacttttaatatctaaactatataagaaagtaaaatttaacatgttaatatggaaaatttttttatttttgtatcttgatgacttaaatgtaagcaacaaagtggttaaacacatacccatctaaatttttttatagccttccatgttaaactataagtaaataattagttttaaaattgttttgtattttcttattcctgttccctttaccctttgacaacttgaaatgttaccacttcgtcctcatgatgttcttctatcaaccctgcttaggatgagaacaagttgagcagtgccaacggccatgaagaacgtagcaaaaagaggaaaaaaagcaagagcagaagtcgtagtcatgaacgaaagagaagcaaaagtaaggaacggaagcgaagtagagacagagaaaggaaaaagagcaaaagccgtgaaagaaagcgaagtagaagcaaagagaggcgacggagccgctcaagaagtcgagatcgaagatttagaggccgctacagaagtccttactccggaccaaaatttaacagtgccatccgaggaaagattgggttgcctcatagcatcaaattaagcagacgacgttcccgaagcaaaagtccattcagaaaagacaagagccctgtgagagaacctattgataatttaactcctgaggaaagagatgcaaggacagtcttctgtatgcagctggcggcaagaattcgaccaagggatttggaagagtttttctctacagtaggaaaggttcgagatgtgaggatgatttctgacagaaattcaagacgttccaaaggaattgcttatgtggagttcgtcgatgttagctcagtgcctctagcaataggattaactggccaacgagttttaggcgtgccaatcatagtacaggcatcacaggcagaaaaaaacagagctgcagcaatggcaaacaatttacaaaagggaagtgctggacctatgaggctttatgtgggctcattacacttcaacataactgaagatatgcttcgtgggatctttgagccttttggaagaattgaaagtatccagctgatgatggacagtgaaactggtcgatccaagggatatggatttattacattttctgactcagaatgtgccaaaaaggctttggaacaacttaatggatttgaactagcaggaagaccaatgaaagttggtcatgttactgaacgtactgatgcttcgagtgctagttcatttttggacagtgatgaactggaaaggactggaattgatttgggaacaactggtcgtcttcagttaatggcaagacttgcagagggtacaggtttgcagattccgccagcagcacagcaagctctacagatgagtggctctttggcatttggtgctgtggcagaattctcttttgttatagatttgcaaacaagactttcccagcagactgaagcttcagctttagctgcagctgcctctgttcagccacttgcaacacaatgtttccaactctctaacatgtttaaccctcaaacagaagaagaagttggatgggataccgagattaaggatgatgtgattgaagaatgtaataaacatggaggagttattcatatttatgttgacaaaaattcagctcagggcaatgtgtatgtgaagtgcccatcaattgctgcagctattgctgctgtcaatgcattgcatggcaggtggtttgctggtaaaatgataacagcagcatatgtacctcttccaacttaccacaacctgtttcctgattctatgacagcaacacagctactggttccaagtagacgatgaaggaagatatagtcccttatgtatatagctttttttctttcttgagaattcatcttgagttatcttttatttagataaaaataaagaggcaaggatctactgtcatttgtatgcaatttcctgttaccttgaaaaaataaaaatgttaacaggaatgcagtgtgctcattctccctaaatagtaaatcccactgtatacaaaactgttctcttgttctgccttttaaaatgttcatgtagaaaattaatgaactataggaatagctctaggagaacaaatgtgctttctgtaaaaaggcagaccagggatgtaatgtttttaatgtttcagaagcctaactttttacacagtggttacatttcacatttcactaatgttgatatttggctgatggttgagcagtttctgaaatacacatttagtgtatggaaatacaagacagctaaagggctgtttggttagcatctcatcttgcattctgatcaattggcaagaaagggagatttcaaaattatatttcttgatggtatcttttcaattaatgtatctgtaaaagtttctttgtaaatactatgtgttctggtgtgtcttaaaattccaaacaaaatgatccctgcatttcctgaagatgtttaaacgtgagagtctggtaggcaaagcagtctgagaaagaaataggaaatgcagaaataggttttgtctggttgcatataatctttgctctttttaagctctgtgagctctgaaatatatttttgggttacttcagtgtgtttgacaagacagcttgatatttctatcaaacaaatgactttcatattgcaacaatctttgtaagaaccactcaaataaaagtctcttaaaaaggc

SEQ ID NO: 299488 - DNA, 4284 bp, Homo sapiens
  misc_feature (27)..(27): n is a, c, g, or t
  misc_feature (34)..(34): n is a, c, g, or t
  misc_feature (47)..(47): n is a, c, g, or t
  misc_feature (56)..(56): n is a, c, g, or t
cagtcgacttactgcgcctacacctanattgaanacaccgctttgcntcagtatanaaaacggcaagtgtacgtcgatacggagcttgtcgacgctgtcgcaggggtggatcctgagctgccgaagccgccgtcctgctctcccgcgtgggcttctctaattccattgttttttttagattctctcgggcctagccgtccttggaacccgatattcgggctgggcggttccgcggcctgggcctaggggcttaacagtagcaacagaagcggcggcggcggcagcagcagcagcagcagcagcaatctcttcccgaacacgagcaccacaggcgcccgaaggccggaacagacttgcctaacgatatctcacctctactcccatgaattcacctttgattccagtgtgaactgtcaatcataaggtagtaattgagtgacttatcgctgtaccgtggtcccctaggtaaaatgactcaactaagaattaccacctccagtttggtatagcaaaaaggtgaatgtagtggtttgggaaaaagcaggggtccaagaataacaaagcatgaccagtctgtggcaagttaaatcttctaatagtcttataagaagaaatgggtgagattttaaaatttatgtatctatgtaagactggtgatagtaaatcttaaaacagtccagtggcaatctgctgctcagttaataattactaaaattcttggatccctgaatagaaattaaaaaaaaaaatacaagaggcagtagagtcaatacaagcttaatacaagcttagagtaaatacaagcttagagtcacttgatgactgttttactgttctccatattgtttttatttttaattaggccctaccatagtatttcacactaaaaacaaaggaattatattggctaatatagtctttgactcatttcggtatctcagtaaaagtaaactgtcttttcattgtttcaccagttggtggtgaaaatagcagtatgcatgcattatcactggtgtcacaaactgtaagctttgtaagttagcactttactcctatagctgatgtaatcaaacttttaaacatttcactaaaccttttaatgaattcttgatagatttaaatagtgtatgtaattttgtaatgcttagactcttgaagagctactttctgttttaatgttaagattcttgtgtcttagttttttttaacatggatgtaattccatgtaaacaggtatggaagtaggaaatgtttaggctggacttggtggattattaattgactttcttgggttcttgggagtcaacattactaaagcagtgtgaatccctgtttgcttcagggcgagatgtgtgacagaggtggcatcaagctcttacagtcccaaccctccaacggaaatgggcgaagatctcaggaatggcatcggtcacaggaaatcgatagtggctggctgctagcatggccacttggggcttaggcagaaatagagccatggtactgaccaaagggaccatagcacatggaataaaactcaaaacaggacttcatgttttatggaaattatatttaaccacttcaacattgtaaatctggataacttttaatatctaaactatataagaaagtaaaatttaacatgttaatatggaaaatttttttatttttgtatcttgatgacttaaatgtaagcaacaaagtggttaaacacatacccatctaaatttttttatagccttccatgttaaactataagtaaataattagttttaaaattgttttgtattttcttattcctgttccctttaccctttgacaacttgaaatgttaccacttcgtcctcatgatgttcttctatcaaccctgcttaggatgagaacaagttgagcagtgccaacggccatgaagaacgtagcaaaaagaggaaaaaaagcaagagcagaagtcgtagtcatgaacgaaagagaagcaaaagtaaggaacggaagcgaagtagagacagagaaaggaaaaagagcaaaagccgtgaaagaaagcgaagtagaagcaaagagaggcgacggagccgctcaagaagtcgagatcgaagatttagaggccgctacagaagtccttactccggaccaaaatttaacagtgccatccgaggaaagattgggttgcctcatagcatcaaattaagcagacgacgttcccgaagcaaaagtccattcagaaaagacaagagccctgtgagagaacctattgataatttaactcctgaggaaagagatgcaaggacagtcttctgtatgcagctggcggcaagaattcgaccaagggatttggaagagtttttctctacagtaggaaaggttcgagatgtgaggatgatttctgacagaaattcaagacgttccaaaggaattgcttatgtggagttcgtcgatgttagctcagtgcctctagcaataggattaactggccaacgagttttaggcgtgccaatcatagtacaggcatcacaggcagaaaaaaacagagctgcagcaatggcaaacaatttacaaaagggaagtgctggacctatgaggctttatgtgggctcattacacttcaacataactgaagatatgcttcgtgggatctttgagccttttggaagaattgaaagtatccagctgatgatggacagtgaaactggtcgatccaagggatatggatttattacattttctgactcagaatgtgccaaaaaggctttggaacaacttaatggatttgaactagcaggaagaccaatgaaagttggtcatgttactgaacgtactgatgcttcgagtgctagttcatttttggacagtgatgaactggaaaggactggaattgatttgggaacaactggtcgtcttcagttaatggcaagacttgcagagggtacaggtttgcagattccgccagcagcacagcaagctctacagatgagtggctctttggcatttggtgctgtggcagaattctcttttgttatagatttgcaaacaagactttcccagcagactgaagcttcagctttagctgcagctgcctctgttcagccacttgcaacacaatgtttccaactctctaacatgtttaaccctcaaacagaagaagaagttggatgggataccgagattaaggatgatgtgattgaagaatgtaataaacatggaggagttattcatatttatgttgacaaaaattcagctcagggcaatgtgtatgtgaagtgcccatcaattgctgcagctattgctgctgtcaatgcattgcatggcaggtggtttgctggtaaaatgataacagcagcatatgtacctcttccaacttaccacaacctgtttcctgattctatgacagcaacacagctactggttccaagtagacgatgaaggaagatatagtcccttatgtatatagctttttttctttcttgagaattcatcttgagttatcttttatttagataaaaataaagaggcaaggatctactgtcatttgtatgcaatttcctgttaccttgaaaaaataaaaatgttaacaggaatgcagtgtgctcattctccctaaatagtaaatcccactgtatacaaaactgttctcttgttctgccttttaaaatgttcatgtagaaaattaatgaactataggaatagctctaggagaacaaatgtgctttctgtaaaaaggcagaccagggatgtaatgtttttaatgtttcagaagcctaactttttacacagtggttacatttcacatttcactaatgttgatatttggctgatggttgagcagtttctgaaatacacatttagtgtatggaaatacaagacagctaaagggctgtttggttagcatctcatcttgcattctgatcaattggcaagaaagggagatttcaaaattatatttcttgatggtatcttttcaattaatgtatctgtaaaagtttctttgtaaatactatgtgttctggtgtgtcttaaaattccaaacaaaatgatccctgcatttcctgaagatgtttaaacgtgagagtctggtaggcaaagcagtctgagaaagaaataggaaatgcagaaataggttttgtctggttgcatataatctttgctctttttaagctctgtgagctctgaaatatatttttgggttacttcagtgtgtttgacaagacagcttgatatttctatcaaacaaatgactttcatattgcaacaatctttgtaagaaccactcaaataaaagtctcttaaaaaggc

SEQ ID NO: 299489 - DNA, 3430 bp, Homo sapiens
  misc_feature (27)..(27): n is a, c, g, or t
  misc_feature (34)..(34): n is a, c, g, or t
  misc_feature (47)..(47): n is a, c, g, or t
  misc_feature (56)..(56): n is a, c, g, or t
cagtcgacttactgcgcctacacctanattgaanacaccgctttgcntcagtatanaaaacggcaagtgtacgtcgatacggagcttgtcgacgctgtcgcaggggtggatcctgagctgccgaagccgccgtcctgctctcccgcgtgggcttctctaattccattgttttttttagattctctcgggcctagccgtccttggaacccgatattcgggctgggcggttccgcggcctgggcctaggggcttaacagtagcaacagaagcggcggcggcggcagcagcagcagcagcagcagcaatctcttcccgaacacgagcaccacaggcgcccgaaggccggaacaggcgtttagagaaaatggcagacgatattgatattgaagcaatgcttgaggctccttacaagaagacttgcctaacgatatctcacctctactcccatgaattcacctttgattccagtgtgaactgtcaatcataagggcgagatgtgtgacagaggtggcatcaagctcttacagtcccaaccctccaacggaaatgggcgaagatctcaggaatggcatcggtcacaggaaatcgatagtggctggctgctagcatggccacttggggcttaggcagaaatagagccatggtactgaccaaagggaccatagcacatggaataaaactcaaaacaggacttcatgttttatggaaattatatttaaccacttcaacattgtaaatctggataacttttaatatctaaactatataagaaagtaaaatttaacatgttaatatggaaaatttttttatttttgtatcttgatgacttaaatgtaagcaacaaagtggttaaacacatacccatctaaatttttttatagccttccatgttaaactataagtaaataattagttttaaaattgttttgtattttcttattcctgttccctttaccctttgacaacttgaaatgttaccacttcgtcctcatgatgttcttctatcaaccctgcttaggatgagaacaagttgagcagtgccaacggccatgaagaacgtagcaaaaagaggaaaaaaagcaagagcagaagtcgtagtcatgaacgaaagagaagcaaaagtaaggaacggaagcgaagtagagacagagaaaggaaaaagagcaaaagccgtgaaagaaagcgaagtagaagcaaagagaggcgacggagccgctcaagaagtcgagatcgaagatttagaggccgctacagaagtccttactccggaccaaaatttaacagtgccatccgaggaaagattgggttgcctcatagcatcaaattaagcagacgacgttcccgaagcaaaagtccattcagaaaagacaagagccctgtgagagaacctattgataatttaactcctgaggaaagagatgcaaggacagtcttctgtatgcagctggcggcaagaattcgaccaagggatttggaagagtttttctctacagtaggaaaggttcgagatgtgaggatgatttctgacagaaattcaagacgttccaaaggaattgcttatgtggagttcgtcgatgttagctcagtgcctctagcaataggattaactggccaacgagttttaggcgtgccaatcatagtacaggcatcacaggcagaaaaaaacagagctgcagcaatggcaaacaatttacaaaagggaagtgctggacctatgaggctttatgtgggctcattacacttcaacataactgaagatatgcttcgtgggatctttgagccttttggaagaattgaaagtatccagctgatgatggacagtgaaactggtcgatccaagggatatggatttattacattttctgactcagaatgtgccaaaaaggctttggaacaacttaatggatttgaactagcaggaagaccaatgaaagttggtcatgttactgaacgtactgatgcttcgagtgctagttcatttttggacagtgatgaactggaaaggactggaattgatttgggaacaactggtcgtcttcagttaatggcaagacttgcagagggtacaggtttgcagattccgccagcagcacagcaagctctacagatgagtggctctttggcatttggtgctgtggcagaattctcttttgttatagatttgcaaacaagactttcccagcagactgaagcttcagctttagctgcagctgcctctgttcagccacttgcaacacaatgtttccaactctctaacatgtttaaccctcaaacagaagaagaagttggatgggataccgagattaaggatgatgtgattgaagaatgtaataaacatggaggagttattcatatttatgttgacaaaaattcagctcagggcaatgtgtatgtgaagtgcccatcaattgctgcagctattgctgctgtcaatgcattgcatggcaggtggtttgctggtaaaatgataacagcagcatatgtacctcttccaacttaccacaacctgtttcctgattctatgacagcaacacagctactggttccaagtagacgatgaaggaagatatagtcccttatgtatatagctttttttctttcttgagaattcatcttgagttatcttttatttagataaaaataaagaggcaaggatctactgtcatttgtatgcaatttcctgttaccttgaaaaaataaaaatgttaacaggaatgcagtgtgctcattctccctaaatagtaaatcccactgtatacaaaactgttctcttgttctgccttttaaaatgttcatgtagaaaattaatgaactataggaatagctctaggagaacaaatgtgctttctgtaaaaaggcagaccagggatgtaatgtttttaatgtttcagaagcctaactttttacacagtggttacatttcacatttcactaatgttgatatttggctgatggttgagcagtttctgaaatacacatttagtgtatggaaatacaagacagctaaagggctgtttggttagcatctcatcttgcattctgatcaattggcaagaaagggagatttcaaaattatatttcttgatggtatcttttcaattaatgtatctgtaaaagtttctttgtaaatactatgtgttctggtgtgtcttaaaattccaaacaaaatgatccctgcatttcctgaagatgtttaaacgtgagagtctggtaggcaaagcagtctgagaaagaaataggaaatgcagaaataggttttgtctggttgcatataatctttgctctttttaagctctgtgagctctgaaatatatttttgggttacttcagtgtgtttgacaagacagcttgatatttctatcaaacaaatgactttcatattgcaacaatctttgtaagaaccactcaaataaaagtctcttaaaaaggc

SEQ ID NO: 299490 - DNA, 5244 bp, Homo sapiens
  misc_feature (27)..(27): n is a, c, g, or t
  misc_feature (34)..(34): n is a, c, g, or t
  misc_feature (47)..(47): n is a, c, g, or t
  misc_feature (56)..(56): n is a, c, g, or t
cagtcgacttactgcgcctacacctanattgaanacaccgctttgcntcagtatanaaaacggcaagtgtacgtcgatacggagcttgtcgacgctgtcgcaggggtggatcctgagctgccgaagccgccgtcctgctctcccgcgtgggcttctctaattccattgttttttttagattctctcgggcctagccgtccttggaacccgatattcgggctgggcggttccgcggcctgggcctaggggcttaacagtagcaacagaagcggcggcggcggcagcagcagcagcagcagcagcaatctcttcccgaacacgagcaccacaggcgcccgaaggccggaacaggcgtttagagaaaatggcagacgatattgatattgaagcaatgcttgaggctccttacaagaagacttgcctaacgatatctcacctctactcccatgaattcacctttgattccagtgtgaactgtcaatcataaggtagtaattgagtgacttatcgctgtaccgtggtcccctaggtaaaatgactcaactaagaattaccacctccagtttggtatagcaaaaaggtgaatgtagtggtttgggaaaaagcaggggtccaagaataacaaagcatgaccagtctgtggcaagttaaatcttctaatagtcttataagaagaaatgggtgagattttaaaatttatgtatctatgtaagactggtgatagtaaatcttaaaacagtccagtggcaatctgctgctcagttaataattactaaaattcttggatccctgaatagaaattaaaaaaaaaaatacaagaggcagtagagtcaatacaagcttaatacaagcttagagtaaatacaagcttagagtcacttgatgactgttttactgttctccatattgtttttatttttaattaggccctaccatagtatttcacactaaaaacaaaggaattatattggctaatatagtctttgactcatttcggtatctcagtaaaagtaaactgtcttttcattgtttcaccagttggtggtgaaaatagcagtatgcatgcattatcactggtgtcacaaactgtaagctttgtaagttagcactttactcctatagctgatgtaatcaaacttttaaacatttcactaaaccttttaatgaattcttgatagatttaaatagtgtatgtaattttgtaatgcttagactcttgaagagctactttctgttttaatgttaagattcttgtgtcttagttttttttaacatggatgtaattccatgtaaacaggtatggaagtaggaaatgtttaggctggacttggtggattattaattgactttcttgggttcttgggagtcaacattactaaagcagtgtgaatccctgtttgcttcagggcgagatgtgtgacagaggtggcatcaagctcttacagtcccaaccctccaacggaaatgggcgaagatctcaggaatggcatcggtcacaggaaatcgatagtggctggctgctagcatggccacttggggcttaggcagaaatagagccatggtactgaccaaagggaccatagcacatggaataaaactcaaaacaggacttcatgttttatggaaattatatttaaccacttcaacattgtaaatctggataacttttaatatctaaactatataagaaagtaaaatttaacatgttaatatggaaaatttttttatttttgtatcttgatgacttaaatgtaagcaacaaagtggttaaacacatacccatctaaatttttttatagccttccatgttaaactataagtaaataattagttttaaaattgttttgtattttcttattcctgttccctttaccctttgacaacttgaaatgttaccacttcgtcctcatgatgttcttctatcaaccctgcttaggatgagaacaagttgagcagtgccaacggccatgaagaacgtagcaaaaaaatactttgcattaaaaatttagatcttcttacatggaagaggtcaaatccagttatagcaaaacacctttactgcagaggccatataaccaaaaagtccaaaggcccagcccagtggaccatttacttcagtgatgttcagtacaaaatttcactgccattaaagactttggaaagtcccttttaagttgtaacaggatttgactattagtgtggatttcgataacccttctttagttaatgtaataaatgctctttgaagctggaaatatactggtttcttgcacccttgtagttttctctgggcttttatgcaaaagattgtattttctgaatgtcttagtatgttgctgtctttttacctgcctggggttgccttcagatgtgggtgaggacttgtttacaaaaagtcctagaagaccttaagttaaaattagctctccaattttcaagtgttttcttttggcagaataagttttgggtcctatgagaggtaaataggttggttgcctctcttgctatagcccatctagagcagaacaaaaactttgtttttgagggggatggagttactttttaccttgttccctaattgaatatatttaggacttttggttttagaaatctcagagttctatagttggaatagtgtcacagagatagtgttaggtttcttaggcaacaaaattggagtgttacctattgcccatctgggcatggctttgatgagttctatataaataatgagtgtagcctaattttctgtcatgtgctacctagcatatacatttctgacagtcaggtggattatcttgaaattttagacaaactttctgcctccttggaaagctctacatctccttgtgattggagtgtgggtttcaagattccagaaggaggaaaaaaagcaagagcagaagtcgtagtcatgaacgaaagagaagcaaaagtaaggaacggaagcgaagtagagacagagaaaggaaaaagagcaaaagccgtgaaagaaagcgaagtagaagcaaagagaggcgacggagccgctcaagaagtcgagatcgaagatttagaggccgctacagaagtccttactccggaccaaaatttaacagtgccatccgaggaaagattgggttgcctcatagcatcaaattaagcagacgacgttcccgaagcaaaagtccattcagaaaagacaagagccctgtgagagaacctattgataatttaactcctgaggaaagagatgcaaggacagtcttctgtatgcagctggcggcaagaattcgaccaagggatttggaagagtttttctctacagtaggaaaggttcgagatgtgaggatgatttctgacagaaattcaagacgttccaaaggaattgcttatgtggagttcgtcgatgttagctcagtgcctctagcaataggattaactggccaacgagttttaggcgtgccaatcatagtacaggcatcacaggcagaaaaaaacagagctgcagcaatggcaaacaatttacaaaagggaagtgctggacctatgaggctttatgtgggctcattacacttcaacataactgaagatatgcttcgtgggatctttgagccttttggaagaattgaaagtatccagctgatgatggacagtgaaactggtcgatccaagggatatggatttattacattttctgactcagaatgtgccaaaaaggctttggaacaacttaatggatttgaactagcaggaagaccaatgaaagttggtcatgttactgaacgtactgatgcttcgagtgctagttcatttttggacagtgatgaactggaaaggactggaattgatttgggaacaactggtcgtcttcagttaatggcaagacttgcagagggtacaggtttgcagattccgccagcagcacagcaagctctacagatgagtggctctttggcatttggtgctgtggcagaattctcttttgttatagatttgcaaacaagactttcccagcagactgaagcttcagctttagctgcagctgcctctgttcagccacttgcaacacaatgtttccaactctctaacatgtttaaccctcaaacagaagaagaagttggatgggataccgagattaaggatgatgtgattgaagaatgtaataaacatggaggagttattcatatttatgttgacaaaaattcagctcagggcaatgtgtatgtgaagtgcccatcaattgctgcagctattgctgctgtcaatgcattgcatggcaggtggtttgctggtaaaatgataacagcagcatatgtacctcttccaacttaccacaacctgtttcctgattctatgacagcaacacagctactggttccaagtagacgatgaaggaagatatagtcccttatgtatatagctttttttctttcttgagaattcatcttgagttatcttttatttagataaaaataaagaggcaaggatctactgtcatttgtatgcaatttcctgttaccttgaaaaaataaaaatgttaacaggaatgcagtgtgctcattctccctaaatagtaaatcccactgtatacaaaactgttctcttgttctgccttttaaaatgttcatgtagaaaattaatgaactataggaatagctctaggagaacaaatgtgctttctgtaaaaaggcagaccagggatgtaatgtttttaatgtttcagaagcctaactttttacacagtggttacatttcacatttcactaatgttgatatttggctgatggttgagcagtttctgaaatacacatttagtgtatggaaatacaagacagctaaagggctgtttggttagcatctcatcttgcattctgatcaattggcaagaaagggagatttcaaaattatatttcttgatggtatcttttcaattaatgtatctgtaaaagtttctttgtaaatactatgtgttctggtgtgtcttaaaattccaaacaaaatgatccctgcatttcctgaagatgtttaaacgtgagagtctggtaggcaaagcagtctgagaaagaaataggaaatgcagaaataggttttgtctggttgcatataatctttgctctttttaagctctgtgagctctgaaatatatttttgggttacttcagtgtgtttgacaagacagcttgatatttctatcaaacaaatgactttcatattgcaacaatctttgtaagaaccactcaaataaaagtctcttaaaaaggc

SEQ ID NO: 299491 - DNA, 4420 bp, Homo sapiens
  misc_feature (27)..(27): n is a, c, g, or t
  misc_feature (34)..(34): n is a, c, g, or t
  misc_feature (47)..(47): n is a, c, g, or t
  misc_feature (56)..(56): n is a, c, g, or t
cagtcgacttactgcgcctacacctanattgaanacaccgctttgcntcagtatanaaaacggcaagtgtacgtcgatacggagcttgtcgacgctgtcgcaggggtggatcctgagctgccgaagccgccgtcctgctctcccgcgtgggcttctctaattccattgttttttttagattctctcgggcctagccgtccttggaacccgatattcgggctgggcggttccgcggcctgggcctaggggcttaacagtagcaacagaagcggcggcggcggcagcagcagcagcagcagcagcaatctcttcccgaacacgagcaccacaggcgcccgaaggccggaacaggcgtttagagaaaatggcagacgatattgatattgaagcaatgcttgaggctccttacaagaagacttgcctaacgatatctcacctctactcccatgaattcacctttgattccagtgtgaactgtcaatcataaggtagtaattgagtgacttatcgctgtaccgtggtcccctaggtaaaatgactcaactaagaattaccacctccagtttggtatagcaaaaaggtgaatgtagtggtttgggaaaaagcaggggtccaagaataacaaagcatgaccagtctgtggcaagttaaatcttctaatagtcttataagaagaaatgggtgagattttaaaatttatgtatctatgtaagactggtgatagtaaatcttaaaacagtccagtggcaatctgctgctcagttaataattactaaaattcttggatccctgaatagaaattaaaaaaaaaaatacaagaggcagtagagtcaatacaagcttaatacaagcttagagtaaatacaagcttagagtcacttgatgactgttttactgttctccatattgtttttatttttaattaggccctaccatagtatttcacactaaaaacaaaggaattatattggctaatatagtctttgactcatttcggtatctcagtaaaagtaaactgtcttttcattgtttcaccagttggtggtgaaaatagcagtatgcatgcattatcactggtgtcacaaactgtaagctttgtaagttagcactttactcctatagctgatgtaatcaaacttttaaacatttcactaaaccttttaatgaattcttgatagatttaaatagtgtatgtaattttgtaatgcttagactcttgaagagctactttctgttttaatgttaagattcttgtgtcttagttttttttaacatggatgtaattccatgtaaacaggtatggaagtaggaaatgtttaggctggacttggtggattattaattgactttcttgggttcttgggagtcaacattactaaagcagtgtgaatccctgtttgcttcagggcgagatgtgtgacagaggtggcatcaagctcttacagtcccaaccctccaacggaaatgggcgaagatctcaggaatggcatcggtcacaggaaatcgatagtggctggctgctagcatggccacttggggcttaggcagaaatagagccatggtactgaccaaagggaccatagcacatggaataaaactcaaaacaggacttcatgttttatggaaattatatttaaccacttcaacattgtaaatctggataacttttaatatctaaactatataagaaagtaaaatttaacatgttaatatggaaaatttttttatttttgtatcttgatgacttaaatgtaagcaacaaagtggttaaacacatacccatctaaatttttttatagccttccatgttaaactataagtaaataattagttttaaaattgttttgtattttcttattcctgttccctttaccctttgacaacttgaaatgttaccacttcgtcctcatgatgttcttctatcaaccctgcttaggatgagaacaagttgagcagtgccaacggccatgaagaacgtagcaaaaaacaaactttctgcctccttggaaagctctacatctccttgtgattggagtgtgggtttcaagattccagaaggaggaaaaaaagcaagagcagaagtcgtagtcatgaacgaaagagaagcaaaagtaaggaacggaagcgaagtagagacagagaaaggaaaaagagcaaaagccgtgaaagaaagcgaagtagaagcaaagagaggcgacggagccgctcaagaagtcgagatcgaagatttagaggccgctacagaagtccttactccggaccaaaatttaacagtgccatccgaggaaagattgggttgcctcatagcatcaaattaagcagacgacgttcccgaagcaaaagtccattcagaaaagacaagagccctgtgagagaacctattgataatttaactcctgaggaaagagatgcaaggacagtcttctgtatgcagctggcggcaagaattcgaccaagggatttggaagagtttttctctacagtaggaaaggttcgagatgtgaggatgatttctgacagaaattcaagacgttccaaaggaattgcttatgtggagttcgtcgatgttagctcagtgcctctagcaataggattaactggccaacgagttttaggcgtgccaatcatagtacaggcatcacaggcagaaaaaaacagagctgcagcaatggcaaacaatttacaaaagggaagtgctggacctatgaggctttatgtgggctcattacacttcaacataactgaagatatgcttcgtgggatctttgagccttttggaagaattgaaagtatccagctgatgatggacagtgaaactggtcgatccaagggatatggatttattacattttctgactcagaatgtgccaaaaaggctttggaacaacttaatggatttgaactagcaggaagaccaatgaaagttggtcatgttactgaacgtactgatgcttcgagtgctagttcatttttggacagtgatgaactggaaaggactggaattgatttgggaacaactggtcgtcttcagttaatggcaagacttgcagagggtacaggtttgcagattccgccagcagcacagcaagctctacagatgagtggctctttggcatttggtgctgtggcagaattctcttttgttatagatttgcaaacaagactttcccagcagactgaagcttcagctttagctgcagctgcctctgttcagccacttgcaacacaatgtttccaactctctaacatgtttaaccctcaaacagaagaagaagttggatgggataccgagattaaggatgatgtgattgaagaatgtaataaacatggaggagttattcatatttatgttgacaaaaattcagctcagggcaatgtgtatgtgaagtgcccatcaattgctgcagctattgctgctgtcaatgcattgcatggcaggtggtttgctggtaaaatgataacagcagcatatgtacctcttccaacttaccacaacctgtttcctgattctatgacagcaacacagctactggttccaagtagacgatgaaggaagatatagtcccttatgtatatagctttttttctttcttgagaattcatcttgagttatcttttatttagataaaaataaagaggcaaggatctactgtcatttgtatgcaatttcctgttaccttgaaaaaataaaaatgttaacaggaatgcagtgtgctcattctccctaaatagtaaatcccactgtatacaaaactgttctcttgttctgccttttaaaatgttcatgtagaaaattaatgaactataggaatagctctaggagaacaaatgtgctttctgtaaaaaggcagaccagggatgtaatgtttttaatgtttcagaagcctaactttttacacagtggttacatttcacatttcactaatgttgatatttggctgatggttgagcagtttctgaaatacacatttagtgtatggaaatacaagacagctaaagggctgtttggttagcatctcatcttgcattctgatcaattggcaagaaagggagatttcaaaattatatttcttgatggtatcttttcaattaatgtatctgtaaaagtttctttgtaaatactatgtgttctggtgtgtcttaaaattccaaacaaaatgatccctgcatttcctgaagatgtttaaacgtgagagtctggtaggcaaagcagtctgagaaagaaataggaaatgcagaaataggttttgtctggttgcatataatctttgctctttttaagctctgtgagctctgaaatatatttttgggttacttcagtgtgtttgacaagacagcttgatatttctatcaaacaaatgactttcatattgcaacaatctttgtaagaaccactcaaataaaagtctcttaaaaaggc

SEQ ID NO: 299492 - DNA, 2900 bp, Homo sapiens
  misc_feature (27)..(27): n is a, c, g, or t
  misc_feature (34)..(34): n is a, c, g, or t
  misc_feature (47)..(47): n is a, c, g, or t
  misc_feature (56)..(56): n is a, c, g, or t
cagtcgacttactgcgcctacacctanattgaanacaccgctttgcntcagtatanaaaacggcaagtgtacgtcgatacggagcttgtcgacgctgtcgcaggggtggatcctgagctgccgaagccgccgtcctgctctcccgcgtgggcttctctaattccattgttttttttagattctctcgggcctagccgtccttggaacccgatattcgggctgggcggttccgcggcctgggcctaggggcttaacagtagcaacagaagcggcggcggcggcagcagcagcagcagcagcagcaatctcttcccgaacacgagcaccacaggcgcccgaaggccggaacaggcgtttagagaaaatggcagacgatattgatattgaagcaatgcttgaggctccttacaagaagacttgcctaacgatatctcacctctactcccatgaattcacctttgattccagtgtgaactgtcaatcataaggatgagaacaagttgagcagtgccaacggccatgaagaacgtagcaaaaagaggaaaaaaagcaagagcagaagtcgtagtcatgaacgaaagagaagcaaaagtaaggaacggaagcgaagtagagacagagaaaggaaaaagagcaaaagccgtgaaagaaagcgaagtagaagcaaagagaggcgacggagccgctcaagaagtcgagatcgaagatttagaggccgctacagaagtccttactccggaccaaaatttaacagtgccatccgaggaaagattgggttgcctcatagcatcaaattaagcagacgacgttcccgaagcaaaagtccattcagaaaagacaagagccctgtgagagaacctattgataatttaactcctgaggaaagagatgcaaggacagtcttctgtatgcagctggcggcaagaattcgaccaagggatttggaagagtttttctctacagtaggaaaggttcgagatgtgaggatgatttctgacagaaattcaagacgttccaaaggaattgcttatgtggagttcgtcgatgttagctcagtgcctctagcaataggattaactggccaacgagttttaggcgtgccaatcatagtacaggcatcacaggcagaaaaaaacagagctgcagcaatggcaaacaatttacaaaagggaagtgctggacctatgaggctttatgtgggctcattacacttcaacataactgaagatatgcttcgtgggatctttgagccttttggaagaattgaaagtatccagctgatgatggacagtgaaactggtcgatccaagggatatggatttattacattttctgactcagaatgtgccaaaaaggctttggaacaacttaatggatttgaactagcaggaagaccaatgaaagttggtcatgttactgaacgtactgatgcttcgagtgctagttcatttttggacagtgatgaactggaaaggactggaattgatttgggaacaactggtcgtcttcagttaatggcaagacttgcagagggtacaggtttgcagattccgccagcagcacagcaagctctacagatgagtggctctttggcatttggtgctgtggcagaattctcttttgttatagatttgcaaacaagactttcccagcagactgaagcttcagctttagctgcagctgcctctgttcagccacttgcaacacaatgtttccaactctctaacatgtttaaccctcaaacagaagaagaagttggatgggataccgagattaaggatgatgtgattgaagaatgtaataaacatggaggagttattcatatttatgttgacaaaaattcagctcagggcaatgtgtatgtgaagtgcccatcaattgctgcagctattgctgctgtcaatgcattgcatggcaggtggtttgctggtaaaatgataacagcagcatatgtacctcttccaacttaccacaacctgtttcctgattctatgacagcaacacagctactggttccaagtagacgatgaaggaagatatagtcccttatgtatatagctttttttctttcttgagaattcatcttgagttatcttttatttagataaaaataaagaggcaaggatctactgtcatttgtatgcaatttcctgttaccttgaaaaaataaaaatgttaacaggaatgcagtgtgctcattctccctaaatagtaaatcccactgtatacaaaactgttctcttgttctgccttttaaaatgttcatgtagaaaattaatgaactataggaatagctctaggagaacaaatgtgctttctgtaaaaaggcagaccagggatgtaatgtttttaatgtttcagaagcctaactttttacacagtggttacatttcacatttcactaatgttgatatttggctgatggttgagcagtttctgaaatacacatttagtgtatggaaatacaagacagctaaagggctgtttggttagcatctcatcttgcattctgatcaattggcaagaaagggagatttcaaaattatatttcttgatggtatcttttcaattaatgtatctgtaaaagtttctttgtaaatactatgtgttctggtgtgtcttaaaattccaaacaaaatgatccctgcatttcctgaagatgtttaaacgtgagagtctggtaggcaaagcagtctgagaaagaaataggaaatgcagaaataggttttgtctggttgcatataatctttgctctttttaagctctgtgagctctgaaatatatttttgggttacttcagtgtgtttgacaagacagcttgatatttctatcaaacaaatgactttcatattgcaacaatctttgtaagaaccactcaaataaaagtctcttaaaaaggc

SEQ ID NO: 299493 - DNA, 3796 bp, Homo sapiens
  misc_feature (27)..(27): n is a, c, g, or t
  misc_feature (34)..(34): n is a, c, g, or t
  misc_feature (47)..(47): n is a, c, g, or t
  misc_feature (56)..(56): n is a, c, g, or t
cagtcgacttactgcgcctacacctanattgaanacaccgctttgcntcagtatanaaaacggcaagtgtacgtcgatacggagcttgtcgacgctgtcgcaggggtggatcctgagctgccgaagccgccgtcctgctctcccgcgtgggcttctctaattccattgttttttttagattctctcgggcctagccgtccttggaacccgatattcgggctgggcggttccgcggcctgggcctaggggcttaacagtagcaacagaagcggcggcggcggcagcagcagcagcagcagcagcaatctcttcccgaacacgagcaccacaggcgcccgaaggccggaacaggcgtttagagaaaatggcagacgatattgatattgaagcaatgcttgaggctccttacaagaagacttgcctaacgatatctcacctctactcccatgaattcacctttgattccagtgtgaactgtcaatcataaggatgagaacaagttgagcagtgccaacggccatgaagaacgtagcaaaaaaatactttgcattaaaaatttagatcttcttacatggaagaggtcaaatccagttatagcaaaacacctttactgcagaggccatataaccaaaaagtccaaaggcccagcccagtggaccatttacttcagtgatgttcagtacaaaatttcactgccattaaagactttggaaagtcccttttaagttgtaacaggatttgactattagtgtggatttcgataacccttctttagttaatgtaataaatgctctttgaagctggaaatatactggtttcttgcacccttgtagttttctctgggcttttatgcaaaagattgtattttctgaatgtcttagtatgttgctgtctttttacctgcctggggttgccttcagatgtgggtgaggacttgtttacaaaaagtcctagaagaccttaagttaaaattagctctccaattttcaagtgttttcttttggcagaataagttttgggtcctatgagaggtaaataggttggttgcctctcttgctatagcccatctagagcagaacaaaaactttgtttttgagggggatggagttactttttaccttgttccctaattgaatatatttaggacttttggttttagaaatctcagagttctatagttggaatagtgtcacagagatagtgttaggtttcttaggcaacaaaattggagtgttacctattgcccatctgggcatggctttgatgagttctatataaataatgagtgtagcctaattttctgtcatgtgctacctagcatatacatttctgacagtcaggtggattatcttgaaattttagacaaactttctgcctccttggaaagctctacatctccttgtgattggagtgtgggtttcaagattccagaaggaggaaaaaaagcaagagcagaagtcgtagtcatgaacgaaagagaagcaaaagtaaggaacggaagcgaagtagagacagagaaaggaaaaagagcaaaagccgtgaaagaaagcgaagtagaagcaaagagaggcgacggagccgctcaagaagtcgagatcgaagatttagaggccgctacagaagtccttactccggaccaaaatttaacagtgccatccgaggaaagattgggttgcctcatagcatcaaattaagcagacgacgttcccgaagcaaaagtccattcagaaaagacaagagccctgtgagagaacctattgataatttaactcctgaggaaagagatgcaaggacagtcttctgtatgcagctggcggcaagaattcgaccaagggatttggaagagtttttctctacagtaggaaaggttcgagatgtgaggatgatttctgacagaaattcaagacgttccaaaggaattgcttatgtggagttcgtcgatgttagctcagtgcctctagcaataggattaactggccaacgagttttaggcgtgccaatcatagtacaggcatcacaggcagaaaaaaacagagctgcagcaatggcaaacaatttacaaaagggaagtgctggacctatgaggctttatgtgggctcattacacttcaacataactgaagatatgcttcgtgggatctttgagccttttggaagaattgaaagtatccagctgatgatggacagtgaaactggtcgatccaagggatatggatttattacattttctgactcagaatgtgccaaaaaggctttggaacaacttaatggatttgaactagcaggaagaccaatgaaagttggtcatgttactgaacgtactgatgcttcgagtgctagttcatttttggacagtgatgaactggaaaggactggaattgatttgggaacaactggtcgtcttcagttaatggcaagacttgcagagggtacaggtttgcagattccgccagcagcacagcaagctctacagatgagtggctctttggcatttggtgctgtggcagaattctcttttgttatagatttgcaaacaagactttcccagcagactgaagcttcagctttagctgcagctgcctctgttcagccacttgcaacacaatgtttccaactctctaacatgtttaaccctcaaacagaagaagaagttggatgggataccgagattaaggatgatgtgattgaagaatgtaataaacatggaggagttattcatatttatgttgacaaaaattcagctcagggcaatgtgtatgtgaagtgcccatcaattgctgcagctattgctgctgtcaatgcattgcatggcaggtggtttgctggtaaaatgataacagcagcatatgtacctcttccaacttaccacaacctgtttcctgattctatgacagcaacacagctactggttccaagtagacgatgaaggaagatatagtcccttatgtatatagctttttttctttcttgagaattcatcttgagttatcttttatttagataaaaataaagaggcaaggatctactgtcatttgtatgcaatttcctgttaccttgaaaaaataaaaatgttaacaggaatgcagtgtgctcattctccctaaatagtaaatcccactgtatacaaaactgttctcttgttctgccttttaaaatgttcatgtagaaaattaatgaactataggaatagctctaggagaacaaatgtgctttctgtaaaaaggcagaccagggatgtaatgtttttaatgtttcagaagcctaactttttacacagtggttacatttcacatttcactaatgttgatatttggctgatggttgagcagtttctgaaatacacatttagtgtatggaaatacaagacagctaaagggctgtttggttagcatctcatcttgcattctgatcaattggcaagaaagggagatttcaaaattatatttcttgatggtatcttttcaattaatgtatctgtaaaagtttctttgtaaatactatgtgttctggtgtgtcttaaaattccaaacaaaatgatccctgcatttcctgaagatgtttaaacgtgagagtctggtaggcaaagcagtctgagaaagaaataggaaatgcagaaataggttttgtctggttgcatataatctttgctctttttaagctctgtgagctctgaaatatatttttgggttacttcagtgtgtttgacaagacagcttgatatttctatcaaacaaatgactttcatattgcaacaatctttgtaagaaccactcaaataaaagtctcttaaaaaggc

SEQ ID NO: 299494 - DNA, 3723 bp, Homo sapiens
  misc_feature (27)..(27): n is a, c, g, or t
  misc_feature (34)..(34): n is a, c, g, or t
  misc_feature (47)..(47): n is a, c, g, or t
  misc_feature (56)..(56): n is a, c, g, or t
cagtcgacttactgcgcctacacctanattgaanacaccgctttgcntcagtatanaaaacggcaagtgtacgtcgatacggagcttgtcgacgctgtcgcaggggtggatcctgagctgccgaagccgccgtcctgctctcccgcgtgggcttctctaattccattgttttttttagattctctcgggcctagccgtccttggaacccgatattcgggctgggcggttccgcggcctgggcctaggggcttaacagtagcaacagaagcggcggcggcggcagcagcagcagcagcagcagcaatctcttcccgaacacgagcaccacaggcgcccgaaggccggaacaggcgtttagagaaaatggcagacgatattgatattgaagcaatgcttgaggctccttacaagaaggatgagaacaagttgagcagtgccaacggccatgaagaacgtagcaaaaaaatactttgcattaaaaatttagatcttcttacatggaagaggtcaaatccagttatagcaaaacacctttactgcagaggccatataaccaaaaagtccaaaggcccagcccagtggaccatttacttcagtgatgttcagtacaaaatttcactgccattaaagactttggaaagtcccttttaagttgtaacaggatttgactattagtgtggatttcgataacccttctttagttaatgtaataaatgctctttgaagctggaaatatactggtttcttgcacccttgtagttttctctgggcttttatgcaaaagattgtattttctgaatgtcttagtatgttgctgtctttttacctgcctggggttgccttcagatgtgggtgaggacttgtttacaaaaagtcctagaagaccttaagttaaaattagctctccaattttcaagtgttttcttttggcagaataagttttgggtcctatgagaggtaaataggttggttgcctctcttgctatagcccatctagagcagaacaaaaactttgtttttgagggggatggagttactttttaccttgttccctaattgaatatatttaggacttttggttttagaaatctcagagttctatagttggaatagtgtcacagagatagtgttaggtttcttaggcaacaaaattggagtgttacctattgcccatctgggcatggctttgatgagttctatataaataatgagtgtagcctaattttctgtcatgtgctacctagcatatacatttctgacagtcaggtggattatcttgaaattttagacaaactttctgcctccttggaaagctctacatctccttgtgattggagtgtgggtttcaagattccagaaggaggaaaaaaagcaagagcagaagtcgtagtcatgaacgaaagagaagcaaaagtaaggaacggaagcgaagtagagacagagaaaggaaaaagagcaaaagccgtgaaagaaagcgaagtagaagcaaagagaggcgacggagccgctcaagaagtcgagatcgaagatttagaggccgctacagaagtccttactccggaccaaaatttaacagtgccatccgaggaaagattgggttgcctcatagcatcaaattaagcagacgacgttcccgaagcaaaagtccattcagaaaagacaagagccctgtgagagaacctattgataatttaactcctgaggaaagagatgcaaggacagtcttctgtatgcagctggcggcaagaattcgaccaagggatttggaagagtttttctctacagtaggaaaggttcgagatgtgaggatgatttctgacagaaattcaagacgttccaaaggaattgcttatgtggagttcgtcgatgttagctcagtgcctctagcaataggattaactggccaacgagttttaggcgtgccaatcatagtacaggcatcacaggcagaaaaaaacagagctgcagcaatggcaaacaatttacaaaagggaagtgctggacctatgaggctttatgtgggctcattacacttcaacataactgaagatatgcttcgtgggatctttgagccttttggaagaattgaaagtatccagctgatgatggacagtgaaactggtcgatccaagggatatggatttattacattttctgactcagaatgtgccaaaaaggctttggaacaacttaatggatttgaactagcaggaagaccaatgaaagttggtcatgttactgaacgtactgatgcttcgagtgctagttcatttttggacagtgatgaactggaaaggactggaattgatttgggaacaactggtcgtcttcagttaatggcaagacttgcagagggtacaggtttgcagattccgccagcagcacagcaagctctacagatgagtggctctttggcatttggtgctgtggcagaattctcttttgttatagatttgcaaacaagactttcccagcagactgaagcttcagctttagctgcagctgcctctgttcagccacttgcaacacaatgtttccaactctctaacatgtttaaccctcaaacagaagaagaagttggatgggataccgagattaaggatgatgtgattgaagaatgtaataaacatggaggagttattcatatttatgttgacaaaaattcagctcagggcaatgtgtatgtgaagtgcccatcaattgctgcagctattgctgctgtcaatgcattgcatggcaggtggtttgctggtaaaatgataacagcagcatatgtacctcttccaacttaccacaacctgtttcctgattctatgacagcaacacagctactggttccaagtagacgatgaaggaagatatagtcccttatgtatatagctttttttctttcttgagaattcatcttgagttatcttttatttagataaaaataaagaggcaaggatctactgtcatttgtatgcaatttcctgttaccttgaaaaaataaaaatgttaacaggaatgcagtgtgctcattctccctaaatagtaaatcccactgtatacaaaactgttctcttgttctgccttttaaaatgttcatgtagaaaattaatgaactataggaatagctctaggagaacaaatgtgctttctgtaaaaaggcagaccagggatgtaatgtttttaatgtttcagaagcctaactttttacacagtggttacatttcacatttcactaatgttgatatttggctgatggttgagcagtttctgaaatacacatttagtgtatggaaatacaagacagctaaagggctgtttggttagcatctcatcttgcattctgatcaattggcaagaaagggagatttcaaaattatatttcttgatggtatcttttcaattaatgtatctgtaaaagtttctttgtaaatactatgtgttctggtgtgtcttaaaattccaaacaaaatgatccctgcatttcctgaagatgtttaaacgtgagagtctggtaggcaaagcagtctgagaaagaaataggaaatgcagaaataggttttgtctggttgcatataatctttgctctttttaagctctgtgagctctgaaatatatttttgggttacttcagtgtgtttgacaagacagcttgatatttctatcaaacaaatgactttcatattgcaacaatctttgtaagaaccactcaaataaaagtctcttaaaaaggc

SEQ ID NO: 299495 - DNA, 4294 bp, Homo sapiens
  misc_feature (27)..(27): n is a, c, g, or t
  misc_feature (34)..(34): n is a, c, g, or t
  misc_feature (47)..(47): n is a, c, g, or t
  misc_feature (56)..(56): n is a, c, g, or t
cagtcgacttactgcgcctacacctanattgaanacaccgctttgcntcagtatanaaaacggcaagtgtacgtcgatacggagcttgtcgacgctgtcgcaggggtggatcctgagctgccgaagccgccgtcctgctctcccgcgtgggcttctctaattccattgttttttttagattctctcgggcctagccgtccttggaacccgatattcgggctgggcggttccgcggcctgggcctaggggcttaacagtagcaacagaagcggcggcggcggcagcagcagcagcagcagcagcaatctcttcccgaacacgagcaccacaggcgcccgaaggccggaacaggcgtttagagaaaatggcagacgatattgatattgaagcaatgcttgaggctccttacaagaagacttgcctaacgatatctcacctctactcccatgaattcacctttgattccagtgtgaactgtcaatcataaggtagtaattgagtgacttatcgctgtaccgtggtcccctaggtaaaatgactcaactaagaattaccacctccagtttggtatagcaaaaaggtgaatgtagtggtttgggaaaaagcaggggtccaagaataacaaagcatgaccagtctgtggcaagttaaatcttctaatagtcttataagaagaaatgggtgagattttaaaatttatgtatctatgtaagactggtgatagtaaatcttaaaacagtccagtggcaatctgctgctcagttaataattactaaaattcttggatccctgaatagaaattaaaaaaaaaaatacaagaggcagtagagtcaatacaagcttaatacaagcttagagtaaatacaagcttagagtcacttgatgactgttttactgttctccatattgtttttatttttaattaggccctaccatagtatttcacactaaaaacaaaggaattatattggctaatatagtctttgactcatttcggtatctcagtaaaagtaaactgtcttttcattgtttcaccagttggtggtgaaaatagcagtatgcatgcattatcactggtgtcacaaactgtaagctttgtaagttagcactttactcctatagctgatgtaatcaaacttttaaacatttcactaaaccttttaatgaattcttgatagatttaaatagtgtatgtaattttgtaatgcttagactcttgaagagctactttctgttttaatgttaagattcttgtgtcttagttttttttaacatggatgtaattccatgtaaacaggtatggaagtaggaaatgtttaggctggacttggtggattattaattgactttcttgggttcttgggagtcaacattactaaagcagtgtgaatccctgtttgcttcagggcgagatgtgtgacagaggtggcatcaagctcttacagtcccaaccctccaacggaaatgggcgaagatctcaggaatggcatcggtcacaggaaatcgatagtggctggctgctagcatggccacttggggcttaggcagaaatagagccatggtactgaccaaagggaccatagcacatggaataaaactcaaaacaggacttcatgttttatggaaattatatttaaccacttcaacattgtaaatctggataacttttaatatctaaactatataagaaagtaaaatttaacatgttaatatggaaaatttttttatttttgtatcttgatgacttaaatgtaagcaacaaagtggttaaacacatacccatctaaatttttttatagccttccatgttaaactataagtaaataattagttttaaaattgttttgtattttcttattcctgttccctttaccctttgacaacttgaaatgttaccacttcgtcctcatgatgttcttctatcaaccctgcttaggatgagaacaagttgagcagtgccaacggccatgaagaacgtagcaaaaagaggaaaaaaagcaagagcagaagtcgtagtcatgaacgaaagagaagcaaaagtaaggaacggaagcgaagtagagacagagaaaggaaaaagagcaaaagccgtgaaagaaagcgaagtagaagcaaagagaggcgacggagccgctcaagaagtcgagatcgaagatttagaggccgctacagaagtccttactccggaccaaaatttaacagtgccatccgaggaaagattgggttgcctcatagcatcaaattaagcagacgacgttcccgaagcaaaagtccattcagaaaagacaagagccctgtgagagaacctattgataatttaactcctgaggaaagagatgcaaggacagtcttctgtatgcagctggcggcaagaattcgaccaagggatttggaagagtttttctctacagtaggaaaggttcgagatgtgaggatgatttctgacagaaattcaagacgttccaaaggaattgcttatgtggagttcgtcgatgttagctcagtgcctctagcaataggattaactggccaacgagttttaggcgtgccaatcatagtacaggcatcacaggcagaaaaaaacagagctgcagcaatggcaaacaatttacaaaagggaagtgctggacctatgaggctttatgtgggctcattacacttcaacataactgaagatatgcttcgtgggatctttgagccttttggaagaattgaaagtatccagctgatgatggacagtgaaactggtcgatccaagggatatggatttattacattttctgactcagaatgtgccaaaaaggctttggaacaacttaatggatttgaactagcaggaagaccaatgaaagttggtcatgttactgaacgtactgatgcttcgagtgctagttcatttttggacagtgatgaactggaaaggactggaattgatttgggaacaactggtcgtcttcagttaatggcaagacttgcagagggtacaggtttgcagattccgccagcagcacagcaagctctacagatgagtggctctttggcatttggtgctgtggcagaattctcttttgttatagatttgcaaacaagactttcccagcagactgaagcttcagctttagctgcagctgcctctgttcagccacttgcaacacaatgtttccaactctctaacatgtttaaccctcaaacagaagaagaagttggatgggataccgagattaaggatgatgtgattgaagaatgtaataaacatggaggagttattcatatttatgttgacaaaaattcagctcagggcaatgtgtatgtgaagtgcccatcaattgctgcagctattgctgctgtcaatgcattgcatggcaggtggtttgctggtaaaatgataacagcagcatatgtacctcttccaacttaccacaacctgtttcctgattctatgacagcaacacagctactggttccaagtagacgatgaaggaagatatagtcccttatgtatatagctttttttctttcttgagaattcatcttgagttatcttttatttagataaaaataaagaggcaaggatctactgtcatttgtatgcaatttcctgttaccttgaaaaaataaaaatgttaacaggaatgcagtgtgctcattctccctaaatagtaaatcccactgtatacaaaactgttctcttgttctgccttttaaaatgttcatgtagaaaattaatgaactataggaatagctctaggagaacaaatgtgctttctttacacagtggttacatttcacatttcactaatgttgatatttggctgatggttgagcagtttctgaaatacacatttagtgtatggaaatacaagacagctaaagggctgtttggttagcatctcatcttgcattctgatcaattggcaagaaagggagatttcaaaattatatttcttgatggtatcttttcaattaatgtatctgtaaaagtttctttgtaaatactatgtgttctggtgtgtcttaaaattccaaacaaaatgatccctgcatttcctgaagatgtttaaacgtgagagtctggtaggcaaagcagtctgagaaagaaataggaaatgcagaaataggttttgtctggttgcatataatctttgctctttttaagctctgtgagctctgaaatatatttttgggttacttcagtgtgtttgacaagacagcttgatatttctatcaaacaaatgactttcatattgcaacaatctttgtaagaaccactcaaataaaagtctcttaaaaaggc

SEQ ID NO: 299496 - DNA, 2834 bp, Homo sapiens
  misc_feature (27)..(27): n is a, c, g, or t
  misc_feature (34)..(34): n is a, c, g, or t
  misc_feature (47)..(47): n is a, c, g, or t
  misc_feature (56)..(56): n is a, c, g, or t
cagtcgacttactgcgcctacacctanattgaanacaccgctttgcntcagtatanaaaacggcaagtgtacgtcgatacggagcttgtcgacgctgtcgcaggggtggatcctgagctgccgaagccgccgtcctgctctcccgcgtgggcttctctaattccattgttttttttagattctctcgggcctagccgtccttggaacccgatattcgggctgggcggttccgcggcctgggcctaggggcttaacagtagcaacagaagcggcggcggcggcagcagcagcagcagcagcagcaatctcttcccgaacacgagcaccacaggcgcccgaaggccggaacaggcgtttagagaaaatggcagacgatattgatattgaagcaatgcttgaggctccttacaagaagacttgcctaacgatatctcacctctactcccatgaattcacctttgattccagtgtgaactgtcaatcataaggatgagaacaagttgagcagtgccaacggccatgaagaacgtagcaaaaagaggaaaaaaagcaagagcagaagtcgtagtcatgaacgaaagagaagcaaaagtaaggaacggaagcgaagtagagacagagaaaggaaaaagagcaaaagccgtgaaagaaagcgaagtagaagcaaagagaggcgacggagccgctcaagaagtcgagatcgaagatttagaggccgctacagaagtccttacagacgacgttcccgaagcaaaagtccattcagaaaagacaagagccctgtgagagaacctattgataatttaactcctgaggaaagagatgcaaggacagtcttctgtatgcagctggcggcaagaattcgaccaagggatttggaagagtttttctctacagtaggaaaggttcgagatgtgaggatgatttctgacagaaattcaagacgttccaaaggaattgcttatgtggagttcgtcgatgttagctcagtgcctctagcaataggattaactggccaacgagttttaggcgtgccaatcatagtacaggcatcacaggcagaaaaaaacagagctgcagcaatggcaaacaatttacaaaagggaagtgctggacctatgaggctttatgtgggctcattacacttcaacataactgaagatatgcttcgtgggatctttgagccttttggaagaattgaaagtatccagctgatgatggacagtgaaactggtcgatccaagggatatggatttattacattttctgactcagaatgtgccaaaaaggctttggaacaacttaatggatttgaactagcaggaagaccaatgaaagttggtcatgttactgaacgtactgatgcttcgagtgctagttcatttttggacagtgatgaactggaaaggactggaattgatttgggaacaactggtcgtcttcagttaatggcaagacttgcagagggtacaggtttgcagattccgccagcagcacagcaagctctacagatgagtggctctttggcatttggtgctgtggcagaattctcttttgttatagatttgcaaacaagactttcccagcagactgaagcttcagctttagctgcagctgcctctgttcagccacttgcaacacaatgtttccaactctctaacatgtttaaccctcaaacagaagaagaagttggatgggataccgagattaaggatgatgtgattgaagaatgtaataaacatggaggagttattcatatttatgttgacaaaaattcagctcagggcaatgtgtatgtgaagtgcccatcaattgctgcagctattgctgctgtcaatgcattgcatggcaggtggtttgctggtaaaatgataacagcagcatatgtacctcttccaacttaccacaacctgtttcctgattctatgacagcaacacagctactggttccaagtagacgatgaaggaagatatagtcccttatgtatatagctttttttctttcttgagaattcatcttgagttatcttttatttagataaaaataaagaggcaaggatctactgtcatttgtatgcaatttcctgttaccttgaaaaaataaaaatgttaacaggaatgcagtgtgctcattctccctaaatagtaaatcccactgtatacaaaactgttctcttgttctgccttttaaaatgttcatgtagaaaattaatgaactataggaatagctctaggagaacaaatgtgctttctgtaaaaaggcagaccagggatgtaatgtttttaatgtttcagaagcctaactttttacacagtggttacatttcacatttcactaatgttgatatttggctgatggttgagcagtttctgaaatacacatttagtgtatggaaatacaagacagctaaagggctgtttggttagcatctcatcttgcattctgatcaattggcaagaaagggagatttcaaaattatatttcttgatggtatcttttcaattaatgtatctgtaaaagtttctttgtaaatactatgtgttctggtgtgtcttaaaattccaaacaaaatgatccctgcatttcctgaagatgtttaaacgtgagagtctggtaggcaaagcagtctgagaaagaaataggaaatgcagaaataggttttgtctggttgcatataatctttgctctttttaagctctgtgagctctgaaatatatttttgggttacttcagtgtgtttgacaagacagcttgatatttctatcaaacaaatgactttcatattgcaacaatctttgtaagaaccactcaaataaaagtctcttaaaaaggc

SEQ ID NO: 299497 - DNA, 2773 bp, Homo sapiens
  misc_feature (27)..(27): n is a, c, g, or t
  misc_feature (34)..(34): n is a, c, g, or t
  misc_feature (47)..(47): n is a, c, g, or t
  misc_feature (56)..(56): n is a, c, g, or t
cagtcgacttactgcgcctacacctanattgaanacaccgctttgcntcagtatanaaaacggcaagtgtacgtcgatacggagcttgtcgacgctgtcgcaggggtggatcctgagctgccgaagccgccgtcctgctctcccgcgtgggcttctctaattccattgttttttttagattctctcgggcctagccgtccttggaacccgatattcgggctgggcggttccgcggcctgggcctaggggcttaacagtagcaacagaagcggcggcggcggcagcagcagcagcagcagcagcaatctcttcccgaacacgagcaccacaggcgcccgaaggccggaacaggcgtttagagaaaatggcagacgatattgatattgaagcaatgcttgaggctccttacaagaaggatgagaacaagttgagcagtgccaacggccatgaagaacgtagcaaaaataaggaacggaagcgaagtagagacagagaaaggaaaaagagcaaaagccgtgaaagaaagcgaagtagaagcaaagagaggcgacggagccgctcaagaagtcgagatcgaagatttagaggccgctacagaagtccttactccggaccaaaatttaacagtgccatccgaggaaagattgggttgcctcatagcatcaaattaagcagacgacgttcccgaagcaaaagtccattcagaaaagacaagagccctgtgagagaacctattgataatttaactcctgaggaaagagatgcaaggacagtcttctgtatgcagctggcggcaagaattcgaccaagggatttggaagagtttttctctacagtaggaaaggttcgagatgtgaggatgatttctgacagaaattcaagacgttccaaaggaattgcttatgtggagttcgtcgatgttagctcagtgcctctagcaataggattaactggccaacgagttttaggcgtgccaatcatagtacaggcatcacaggcagaaaaaaacagagctgcagcaatggcaaacaatttacaaaagggaagtgctggacctatgaggctttatgtgggctcattacacttcaacataactgaagatatgcttcgtgggatctttgagccttttggaagaattgaaagtatccagctgatgatggacagtgaaactggtcgatccaagggatatggatttattacattttctgactcagaatgtgccaaaaaggctttggaacaacttaatggatttgaactagcaggaagaccaatgaaagttggtcatgttactgaacgtactgatgcttcgagtgctagttcatttttggacagtgatgaactggaaaggactggaattgatttgggaacaactggtcgtcttcagttaatggcaagacttgcagagggtacaggtttgcagattccgccagcagcacagcaagctctacagatgagtggctctttggcatttggtgctgtggcagaattctcttttgttatagatttgcaaacaagactttcccagcagactgaagcttcagctttagctgcagctgcctctgttcagccacttgcaacacaatgtttccaactctctaacatgtttaaccctcaaacagaagaagaagttggatgggataccgagattaaggatgatgtgattgaagaatgtaataaacatggaggagttattcatatttatgttgacaaaaattcagctcagggcaatgtgtatgtgaagtgcccatcaattgctgcagctattgctgctgtcaatgcattgcatggcaggtggtttgctggtaaaatgataacagcagcatatgtacctcttccaacttaccacaacctgtttcctgattctatgacagcaacacagctactggttccaagtagacgatgaaggaagatatagtcccttatgtatatagctttttttctttcttgagaattcatcttgagttatcttttatttagataaaaataaagaggcaaggatctactgtcatttgtatgcaatttcctgttaccttgaaaaaataaaaatgttaacaggaatgcagtgtgctcattctccctaaatagtaaatcccactgtatacaaaactgttctcttgttctgccttttaaaatgttcatgtagaaaattaatgaactataggaatagctctaggagaacaaatgtgctttctgtaaaaaggcagaccagggatgtaatgtttttaatgtttcagaagcctaactttttacacagtggttacatttcacatttcactaatgttgatatttggctgatggttgagcagtttctgaaatacacatttagtgtatggaaatacaagacagctaaagggctgtttggttagcatctcatcttgcattctgatcaattggcaagaaagggagatttcaaaattatatttcttgatggtatcttttcaattaatgtatctgtaaaagtttctttgtaaatactatgtgttctggtgtgtcttaaaattccaaacaaaatgatccctgcatttcctgaagatgtttaaacgtgagagtctggtaggcaaagcagtctgagaaagaaataggaaatgcagaaataggttttgtctggttgcatataatctttgctctttttaagctctgtgagctctgaaatatatttttgggttacttcagtgtgtttgacaagacagcttgatatttctatcaaacaaatgactttcatattgcaacaatctttgtaagaaccactcaaataaaagtctcttaaaaaggc

SEQ ID NO: 299498 - DNA, 4445 bp, Homo sapiens
  misc_feature (27)..(27): n is a, c, g, or t
  misc_feature (34)..(34): n is a, c, g, or t
  misc_feature (47)..(47): n is a, c, g, or t
  misc_feature (56)..(56): n is a, c, g, or t
cagtcgacttactgcgcctacacctanattgaanacaccgctttgcntcagtatanaaaacggcaagtgtacgtcgatacggagcttgtcgacgctgtcgcaggggtggatcctgagctgccgaagccgccgtcctgctctcccgcgtgggcttctctaattccattgttttttttagattctctcgggcctagccgtccttggaacccgatattcgggctgggcggttccgcggcctgggcctaggggcttaacagtagcaacagaagcggcggcggcggcagcagcagcagcagcagcagcaatctcttcccgaacacgagcaccacaggcgcccgaaggccggaacaggcgtttagagaaaatggcagacgatattgatattgaagcaatgcttgaggctccttacaagaagacttgcctaacgatatctcacctctactcccatgaattcacctttgattccagtgtgaactgtcaatcataaggtagtaattgagtgacttatcgctgtaccgtggtcccctaggtaaaatgactcaactaagaattaccacctccagtttggtatagcaaaaaggtgaatgtagtggtttgggaaaaagcaggggtccaagaataacaaagcatgaccagtctgtggcaagttaaatcttctaatagtcttataagaagaaatgggtgagattttaaaatttatgtatctatgtaagactggtgatagtaaatcttaaaacagtccagtggcaatctgctgctcagttaataattactaaaattcttggatccctgaatagaaattaaaaaaaaaaatacaagaggcagtagagtcaatacaagcttaatacaagcttagagtaaatacaagcttagagtcacttgatgactgttttactgttctccatattgtttttatttttaattaggccctaccatagtatttcacactaaaaacaaaggaattatattggctaatatagtctttgactcatttcggtatctcagtaaaagtaaactgtcttttcattgtttcaccagttggtggtgaaaatagcagtatgcatgcattatcactggtgtcacaaactgtaagctttgtaagttagcactttactcctatagctgatgtaatcaaacttttaaacatttcactaaaccttttaatgaattcttgatagatttaaatagtgtatgtaattttgtaatgcttagactcttgaagagctactttctgttttaatgttaagattcttgtgtcttagttttttttaacatggatgtaattccatgtaaacaggtatggaagtaggaaatgtttaggctggacttggtggattattaattgactttcttgggttcttgggagtcaacattactaaagcagtgtgaatccctgtttgcttcagggcgagatgtgtgacagaggtggcatcaagctcttacagtcccaaccctccaacggaaatgggcgaagatctcaggaatggcatcggtcacaggaaatcgatagtggctggctgctagcatggccacttggggcttaggcagaaatagagccatggtactgaccaaagggaccatagcacatggaataaaactcaaaacaggacttcatgttttatggaaattatatttaaccacttcaacattgtaaatctggataacttttaatatctaaactatataagaaagtaaaatttaacatgttaatatggaaaatttttttatttttgtatcttgatgacttaaatgtaagcaacaaagtggttaaacacatacccatctaaatttttttatagccttccatgttaaactataagtaaataattagttttaaaattgttttgtattttcttattcctgttccctttaccctttgacaacttgaaatgttaccacttcgtcctcatgatgttcttctatcaaccctgcttaggatgagaacaagttgagcagtgccaacggccatgaagaacgtagcaaaaagaggaaaaaaagcaagagcagaagtcgtagtcatgaacgaaagagaagcaaaagtaaggaacggaagcgaagtagagacagagaaaggaaaaagagcaaaagccgtgaaagaaagcgaagtagaagcaaagagaggcgacggagccgctcaagaagtcgagatcgaagatttagaggccgctacagaagtccttactccggaccaaaatttaacagtgccatccgaggaaagattgggttgcctcatagcatcaaattaagcagacgacgttcccgaagcaaaagtccattcagaaaagacaagagccctgtgagagaacctattgataatttaactcctgaggaaagagatgcaaggacagtcttctgtatgcagctggcggcaagaattcgaccaagggatttggaagagtttttctctacagtaggaaaggttcgagatgtgaggatgatttctgacagaaattcaagacgttccaaaggaattgcttatgtggagttcgtcgatgttagctcagtgcctctagcaataggattaactggccaacgagttttaggcgtgccaatcatagtacaggcatcacaggcagaaaaaaacagagctgcagcaatggcaaacaatttacaaaagggaagtgctggacctatgaggctttatgtgggctcattacacttcaacataactgaagatatgcttcgtgggatctttgagccttttggaagaattgaaagtatccagctgatgatggacagtgaaactggtcgatccaagggatatggatttattacattttctgactcagaatgtgccaaaaaggctttggaacaacttaatggatttgaactagcaggaagaccaatgaaagttggtcatgttactgaacgtactgatgcttcgagtgctagttcatttttggacagtgatgaactggaaaggactggaattgatttgggaacaactggtcgtcttcagttaatggcaagacttgcagagggtacaggtttgcagattccgccagcagcacagcaagctctacagatgagtggctctttggcatttggtgctgtggcagaattctcttttgttatagatttgcaaacaagactttcccagcagactgaagcttcagctttagctgcagctgcctctgttcagccacttgcaacacaatgtttccaactctctaacatgtttaaccctcaaacagaagaagaagttggatgggataccgagattaaggatgatgtgattgaagaatgtaataaacatggaggagttattcatatttatgttgacaaaaattcagctcagggcaatgtgtatgtgaagtgcccatcaattgctgcagctattgctgctgtcaatgcattgcatggcaggtggtttgctggtaaaatgataacagcagcatatgtacctcttccaacttaccacaacctgtttcctgattctatgacagcaacacagctactggttccaagtagacgatgaaggaagatatagtcccttatgtatatagctttttttctttcttgagaattcatcttgagttatcttttatttagataaaaataaagaggcaaggatctactgtcatttgtatgcaatttcctgttaccttgaaaaaataaaaatgttaacaggaatgcagtgtgctcattctccctaaatagtaaatcccactgtatacaaaactgttctcttgttctgccttttaaaatgttcatgtagaaaattaatgaactataggaatagctctaggagaacaaatgtgctttctgtaaaaaggcagaccagggatgtaatgtttttaatgtttcagaagcctaactttttacacagtggttacatttcacatttcactaatgttgatatttggctgatggttgagcagtttctgaaatacacatttagtgtatggaaatacaagacagctaaagggctgtttggttagcatctcatcttgcattctgatcaattggcaagaaagggagatttcaaaattatatttcttgatggtatcttttcaattaatgtatctgtaaaagtttctttgtaaatactatgtgttctggtgtgtcttaaaattccaaacaaaatgatccctgcatttcctgaagatgtttaaacgtgagagtctggtaggcaaagcagtctgagaaagaaataggaaatgcagaaataggttttgtctggttgcatataatctttgctctttttaagctctgtgagctctgaaatatatttttgggttacttcagtgtgtttgacaagacagcttgatatttctatcaaacaaatgactttcatattgcaacaatctttgtaagaaccactcaaataaaagtctcttaaaaaggcaaagattatatgcaaccagacaaaacctatttctgcatttcctatttctttctcagactgtttgcctaccagactctcacgtttaaacatcttcagg

SEQ ID NO: 299499 - DNA, 4294 bp, Homo sapiens
  misc_feature (27)..(27): n is a, c, g, or t
  misc_feature (34)..(34): n is a, c, g, or t
  misc_feature (47)..(47): n is a, c, g, or t
  misc_feature (56)..(56): n is a, c, g, or t
cagtcgacttactgcgcctacacctanattgaanacaccgctttgcntcagtatanaaaacggcaagtgtacgtcgatacggagcttgtcgacgctgtcgcaggggtggatcctgagctgccgaagccgccgtcctgctctcccgcgtgggcttctctaattccattgttttttttagattctctcgggcctagccgtccttggaacccgatattcgggctgggcggttccgcggcctgggcctaggggcttaacagtagcaacagaagcggcggcggcggcagcagcagcagcagcagcagcaatctcttcccgaacacgagcaccacaggcgcccgaaggccggaacaggcgtttagagaaaatggcagacgatattgatattgaagcaatgcttgaggctccttacaagaagacttgcctaacgatatctcacctctactcccatgaattcacctttgattccagtgtgaactgtcaatcataaggtagtaattgagtgacttatcgctgtaccgtggtcccctaggtaaaatgactcaactaagaattaccacctccagtttggtatagcaaaaaggtgaatgtagtggtttgggaaaaagcaggggtccaagaataacaaagcatgaccagtctgtggcaagttaaatcttctaatagtcttataagaagaaatgggtgagattttaaaatttatgtatctatgtaagactggtgatagtaaatcttaaaacagtccagtggcaatctgctgctcagttaataattactaaaattcttggatccctgaatagaaattaaaaaaaaaaatacaagaggcagtagagtcaatacaagcttaatacaagcttagagtaaatacaagcttagagtcacttgatgactgttttactgttctccatattgtttttatttttaattaggccctaccatagtatttcacactaaaaacaaaggaattatattggctaatatagtctttgactcatttcggtatctcagtaaaagtaaactgtcttttcattgtttcaccagttggtggtgaaaatagcagtatgcatgcattatcactggtgtcacaaactgtaagctttgtaagttagcactttactcctatagctgatgtaatcaaacttttaaacatttcactaaaccttttaatgaattcttgatagatttaaatagtgtatgtaattttgtaatgcttagactcttgaagagctactttctgttttaatgttaagattcttgtgtcttagttttttttaacatggatgtaattccatgtaaacaggtatggaagtaggaaatgtttaggctggacttggtggattattaattgactttcttgggttcttgggagtcaacattactaaagcagtgtgaatccctgtttgcttcagggcgagatgtgtgacagaggtggcatcaagctcttacagtcccaaccctccaacggaaatgggcgaagatctcaggaatggcatcggtcacaggaaatcgatagtggctggctgctagcatggccacttggggcttaggcagaaatagagccatggtactgaccaaagggaccatagcacatggaataaaactcaaaacaggacttcatgttttatggaaattatatttaaccacttcaacattgtaaatctggataacttttaatatctaaactatataagaaagtaaaatttaacatgttaatatggaaaatttttttatttttgtatcttgatgacttaaatgtaagcaacaaagtggttaaacacatacccatctaaatttttttatagccttccatgttaaactataagtaaataattagttttaaaattgttttgtattttcttattcctgttccctttaccctttgacaacttgaaatgttaccacttcgtcctcatgatgttcttctatcaaccctgcttaggatgagaacaagttgagcagtgccaacggccatgaagaacgtagcaaaaagaggaaaaaaagcaagagcagaagtcgtagtcatgaacgaaagagaagcaaaagtaaggaacggaagcgaagtagagacagagaaaggaaaaagagcaaaagccgtgaaagaaagcgaagtagaagcaaagagaggcgacggagccgctcaagaagtcgagatcgaagatttagaggccgctacagaagtccttactccggaccaaaatttaacagtgccatccgaggaaagattgggttgcctcatagcatcaaattaagcagacgacgttcccgaagcaaaagtccattcagaaaagacaagagccctgtgagagaacctattgataatttaactcctgaggaaagagatgcaaggacagtcttctgtatgcagctggcggcaagaattcgaccaagggatttggaagagtttttctctacagtaggaaaggttcgagatgtgaggatgatttctgacagaaattcaagacgttccaaaggaattgcttatgtggagttcgtcgatgttagctcagtgcctctagcaataggattaactggccaacgagttttaggcgtgccaatcatagtacaggcatcacaggcagaaaaaaacagagctgcagcaatggcaaacaatttacaaaagggaagtgctggacctatgaggctttatgtgggctcattacacttcaacataactgaagatatgcttcgtgggatctttgagccttttggaagaattgaaagtatccagctgatgatggacagtgaaactggtcgatccaagggatatggatttattacattttctgactcagaatgtgccaaaaaggctttggaacaacttaatggatttgaactagcaggaagaccaatgaaagttggtcatgttactgaacgtactgatgcttcgagtgctagttcatttttggacagtgatgaactggaaaggactggaattgatttgggaacaactggtcgtcttcagttaatggcaagacttgcagagggtacaggtttgcagattccgccagcagcacagcaagctctacagatgagtggctctttggcatttggtgctgtggcagaattctcttttgttatagatttgcaaacaagactttcccagcagactgaagcttcagctttagctgcagctgcctctgttcagccacttgcaacacaatgtttccaactctctaacatgtttaaccctcaaacagaagaagaagttggatgggataccgagattaaggatgatgtgattgaagaatgtaataaacatggaggagttattcatatttatgttgacaaaaattcagctcagggcaatgtgtatgtgaagtgcccatcaattgctgcagctattgctgctgtcaatgcattgcatggcaggtggtttgctggtaaaatgataacagcagcatatgtacctcttccaacttaccacaacctgtttcctgattctatgacagcaacacagctactggttccaagtagacgatgaaggaagatatagtcccttatgtatatagctttttttctttcttgagaattcatcttgagttatcttttatttagataaaaataaagaggcaaggatctactgtcatttgtatgcaatttcctgttaccttgaaaaaataaaaatgttaacaggaatgcagtgtgctcattctccctaaatagtaaatcccactgtatacaaaactgttctcttgttctgccttttaaaatgttcatgtagaaaattaatgaactataggaatagctctaggagaacaaatgtgctttctgtaaaaaggcagaccagggatgtaatgtttttaatgtttcagaagcctaactttttacacagtggttacatttcacatttcactaatgttgatatttggctgatggttgagcagtttctgcatctcatcttgcattctgatcaattggcaagaaagggagatttcaaaattatatttcttgatggtatcttttcaattaatgtatctgtaaaagtttctttgtaaatactatgtgttctggtgtgtcttaaaattccaaacaaaatgatccctgcatttcctgaagatgtttaaacgtgagagtctggtaggcaaagcagtctgagaaagaaataggaaatgcagaaataggttttgtctggttgcatataatctttgctctttttaagctctgtgagctctgaaatatatttttgggttacttcagtgtgtttgacaagacagcttgatatttctatcaaacaaatgactttcatattgcaacaatctttgtaagaaccactcaaataaaagtctcttaaaaaggc

SEQ ID NO: 299500 - DNA, 4061 bp, Homo sapiens
  misc_feature (27)..(27): n is a, c, g, or t
  misc_feature (34)..(34): n is a, c, g, or t
  misc_feature (47)..(47): n is a, c, g, or t
  misc_feature (56)..(56): n is a, c, g, or t
cagtcgacttactgcgcctacacctanattgaanacaccgctttgcntcagtatanaaaacggcaagtgtacgtcgatacggagcttgtcgacgctgtcgcaggggtggatcctgagctgccgaagccgccgtcctgctctcccgcgtgggcttctctaattccattgttttttttagattctctcgggcctagccgtccttggaacccgatattcgggctgggcggttccgcggcctgggcctaggggcttaacagtagcaacagaagcggcggcggcggcagcagcagcagcagcagcagcaatctcttcccgaacacgagcaccacaggcgcccgaaggccggaacaggcgtttagagaaaatggcagacgatattgatattgaagcaatgcttgaggctccttacaagaagacttgcctaacgatatctcacctctactcccatgaattcacctttgattccagtgtgaactgtcaatcataaggtagtaattgagtgacttatcgctgtaccgtggtcccctaggtaaaatgactcaactaagaattaccacctccagtttggtatagcaaaaaggtgaatgtagtggtttgggaaaaagcaggggtccaagaataacaaagcatgaccagtctgtggcaagttaaatcttctaatagtcttataagaagaaatgggtgagattttaaaatttatgtatctatgtaagactggtgatagtaaatcttaaaacagtccagtggcaatctgctgctcagttaataattactaaaattcttggatccctgaatagaaattaaaaaaaaaaatacaagaggcagtagagtcaatacaagcttaatacaagcttagagtaaatacaagcttagagtcacttgatgactgttttactgttctccatattgtttttatttttaattaggccctaccatagtatttcacactaaaaacaaaggaattatattggctaatatagtctttgactcatttcggtatctcagtaaaagtaaactgtcttttcattgtttcaccagttggtggtgaaaatagcagtatgcatgcattatcactggtgtcacaaactgtaagctttgtaagttagcactttactcctatagctgatgtaatcaaacttttaaacatttcactaaaccttttaatgaattcttgatagatttaaatagtgtatgtaattttgtaatgcttagactcttgaagagctactttctgttttaatgttaagattcttgtgtcttagttttttttaacatggatgtaattccatgtaaacaggtatggaagtaggaaatgtttaggctggacttggtggattattaattgactttcttgggttcttgggagtcaacattactaaagcagtgtgaatccctgtttgcttcagggcgagatgtgtgacagaggtggcatcaagctcttacagtcccaaccctccaacggaaatgggcgaagatctcaggaatggcatcggtcacaggaaatcgatagtggctggctgctagcatggccacttggggcttaggcagaaatagagccatggtactgaccaaagggaccatagcacatggaataaaactcaaaacaggacttcatgttttatggaaattatatttaaccacttcaacattgtaaatctggataacttttaatatctaaactatataagaaagtaaaatttaacatgttaatatggaaaatttttttatttttgtatcttgatgacttaaatgtaagcaacaaagtggttaaacacatacccatctaaatttttttatagccttccatgttaaactataagtaaataattagttttaaaattgttttgtattttcttattcctgttccctttaccctttgacaacttgaaatgttaccacttcgtcctcatgatgttcttctatcaaccctgcttaggatgagaacaagttgagcagtgccaacggccatgaagaacgtagcaaaaagaggaaaaaaagcaagagcagaagtcgtagtcatgaacgaaagagaagcaaaagtaaggaacggaagcgaagtagagacagagaaaggaaaaagagcaaaagccgtgaaagaaagcgaagtagaagcaaagagaggcgacggagccgctcaagaagtcgagatcgaagatttagaggccgctacagaagtccttactccggaccaaaatttaacagtgccatccgaggaaagattgggttgcctcatagcatcaaattaagcagacgacgttcccgaagcaaaagtccattcagaaaagacaagagccctgtgagagaacctattgataatttaactcctgaggaaagagatgcaaggacagtcttctgtatgcagctggcggcaagaattcgaccaagggatttggaagagtttttctctacagtaggaaaggttcgagatgtgaggatgatttctgacagaaattcaagacgttccaaaggaattgcttatgtggagttcgtcgatgttagctcagtgcctctagcaataggattaactggccaacgagttttaggcgtgccaatcatagtacaggcatcacaggcagaaaaaaacagagctgcagcaatggcaaacaatttacaaaagggaagtgctggacctatgaggctttatgtgggctcattacacttcaacataactgaagatatgcttcgtgggatctttgagccttttggaagaattgaaagtatccagctgatgatggacagtgaaactggtcgatccaagggatatggatttattacattttctgactcagaatgtgccaaaaaggctttggaacaacttaatggatttgaactagcaggaagaccaatgaaagttggtcatgttactgaacgtactgatgcttcgagtgctagttcatttttggacagtgatgaactggaaaggactggaattgatttgggaacaactggtcgtcttcagttaatggcaagacttgcagagggtacaggtttgcagattccgccagcagcacagcaagctctacagatgagtggctctttggcatttggtgctgtggcagaattctcttttgttatagatttgcaaacaagactttcccagcagactgaagcttcagctttagctgcagctgcctctgttcagccacttgcaacacaatgtttccaactctctaacatgtttaaccctcaaacagaagaagaagttggatgggataccgagattaaggatgatgtgattgaagaatgtaataaacatggaggagttattcatatttatgttgacaaaaattcagctcagggcaatgtgtatgtgaagtgcccatcaattgctgcagctattgctgctgtcaatgcattgcatggcaggtggtttgctggtaaaatgataacagcagcatatgtacctcttccaacttaccacaacctgtttcctgattctatgacagcaacacagctactggttccaagtagacgatgaaggaagatatagtcccttatgtatatagctttttttctttcttgagaattcatcttgagttatcttttatttagataaaaataaagaggcaaggatctactgtcatttgtatgcaatttcctgttaccttgaaaaaataaaaatgttaacaggaatgcagtgtgctcattctccctaaatagtaaatcccactgtatacaaaactgttctcttgttctgccttttaaaatgttcatgtagaaaattaatgaactataggaatagctctaggagaacaaatgtgctttctgtaaaaaggcagaccagggatgtaatgtttttaatgtttcagaagcctaactttttacacagtggttacatttcacatttcactaatgttgatatttggctgatggttgagcagtttctgaaatacacatttagtgtatggaaatacaagacagctaaagggctgtttggttagcatctcatcttgcattctgatcaattggcaagaaagggagatttcaaaattatattaattgaaaagataccatcaagaaatatacctttgaaatctccctttcttgccaattggtcgacc

SEQ ID NO: 299501 - DNA, 3632 bp, Homo sapiens
  misc_feature (27)..(27): n is a, c, g, or t
  misc_feature (34)..(34): n is a, c, g, or t
  misc_feature (47)..(47): n is a, c, g, or t
  misc_feature (56)..(56): n is a, c, g, or t
cagtcgacttactgcgcctacacctanattgaanacaccgctttgcntcagtatanaaaacggcaagtgtacgtcgatacggagcttgtcgacgctgtcgcaggggtggatcctgagctgccgaagccgccgtcctgctctcccgcgtgggcttctctaattccattgttttttttagattctctcgggcctagccgtccttggaacccgatattcgggctgggcggttccgcggcctgggcctaggggcttaacagtagcaacagaagcggcggcggcggcagcagcagcagcagcagcagcaatctcttcccgaacacgagcaccacaggcgcccgaaggccggaacaggcgtttagagaaaatggcagacgatattgatattgaagcaatgcttgaggctccttacaagaagacttgcctaacgatatctcacctctactcccatgaattcacctttgattccagtgtgaactgtcaatcataaggtagtaattgagtgacttatcgctgtaccgtggtcccctaggtaaaatgactcaactaagaattaccacctccagtttggtatagcaaaaaggtgaatgtagtggtttgggaaaaagcaggggtccaagaataacaaagcatgaccagtctgtggcaagttaaatcttctaatagtcttataagaagaaatgggtgagattttaaaatttatgtatctatgtaagactggtgatagtaaatcttaaaacagtccagtggcaatctgctgctcagttaataattactaaaattcttggatccctgaatagaaattaaaaaaaaaaatacaagaggcagtagagtcaatacaagcttaatacaagcttagagtaaatacaagcttagagtcacttgatgactgttttactgttctccatattgtttttatttttaattaggccctaccatagtatttcacactaaaaacaaaggaattatattggctaatatagtctttgactcatttcggtatctcagtaaaagtaaactgtcttttcattgtttcaccagttggtggtgaaaatagcagtatgcatgcattatcactggtgtcacaaactgtaagctttgtaagttagcactttactcctatagctgatgtaatcaaacttttaaacatttcactaaaccttttaatgaattcttgatagatttaaatagtgtatgtaattttgtaatgcttagactcttgaagagctactttctgttttaatgttaagattcttgtgtcttagttttttttaacatggatgtaattccatgtaaacaggtatggaagtaggaaatgtttaggctggacttggtggattattaattgactttcttgggttcttgggagtcaacattactaaagcagtgtgaatccctgtttgcttcagggcgagatgtgtgacagaggtggcatcaagctcttacagtcccaaccctccaacggaaatgggcgaagatctcaggaatggcatcggtcacaggaaatcgatagtggctggctgctagcatggccacttggggcttaggcagaaatagagccatggtactgaccaaagggaccatagcacatggaataaaactcaaaacaggacttcatgttttatggaaattatatttaaccacttcaacattgtaaatctggataacttttaatatctaaactatataagaaagtaaaatttaacatgttaatatggaaaatttttttatttttgtatcttgatgacttaaatgtaagcaacaaagtggttaaacacatacccatctaaatttttttatagccttccatgttaaactataagtaaataattagttttaaaattgttttgtattttcttattcctgttccctttaccctttgacaacttgaaatgttaccacttcgtcctcatgatgttcttctatcaaccctgcttaggatgagaacaagttgagcagtgccaacggccatgaagaacgtagcaaaaagaggaaaaaaagcaagagcagaagtcgtagtcatgaacgaaagagaagcaaaagtaaggaacggaagcgaagtagagacagagaaaggaaaaagagcaaaagccgtgaaagaaagcgaagtagaagcaaagagaggcgacggagccgctcaagaagtcgagatcgaagatttagaggccgctacagaagtccttactccggaccaaaatttaacagtgccatccgaggaaagattgggttgcctcatagcatcaaattaagcagacgacgttcccgaagcaaaagtccattcagaaaagacaagagccctgtgagagaacctattgataatttaactcctgaggaaagagatgcaaggacagtcttctgtatgcagctggcggcaagaattcgaccaagggatttggaagagtttttctctacagtaggaaaggttcgagatgtgaggatgatttctgacagaaattcaagacgttccaaaggaattgcttatgtggagttcgtcgatgttagctcagtgcctctagcaataggattaactggccaacgagttttaggcgtgccaatcatagtacaggcatcacaggcagaaaaaaacagagctgcagcaatggcaaacaatttacaaaagggaagtgctggacctatgaggctttatgtgggctcattacacttcaacataactgaagatatgcttcgtgggatctttgagccttttggaagaattgaaagtatccagctgatgatggacagtgaaactggtcgatccaagggatatggatttattacattttctgactcagaatgtgccaaaaaggctttggaacaacttaatggatttgaactagcaggaagaccaatgaaagttggtcatgttactgaacgtactgatgcttcgagtgctagttcatttttggacagtgatgaactggaaaggactggaattgatttgggaacaactggtcgtcttcagttaatggcaagacttgcagagggtacaggtttgcagattccgccagcagcacagcaagctctacagatgagtggctctttggcatttggtgctgtggcagaattctcttttgttatagatttgcaaacaagactttcccagcagactgaagcttcagctttagctgcagctgcctctgttcagccacttgcaacacaatgtttccaactctctaacatgtttaaccctcaaacagaagaagaagttggatgggataccgagattaaggatgatgtgattgaagaatgtaataaacatggaggagttattcatatttatgttgacaaaaattcagctcagggcaatgtgtatgtgaagtgcccatcaattgctgcagctattgctgctgtcaatgcattgcatggcaggtggtttgctggtaaaatgataacagcagcatatgtacctcttccaacttaccacaacctgtttcctgattctatgacagcaacacagctactggttccaagtagacgatgaaggaagatatagtcccttatgtatatagctttttttctttcttgagaattcatcttgagttatcttttatttagataaaaataaagaggcaaggatctactgtcatttgtatgcaatttcctgttaccttgaaaaaataaaaatgttaacagga

SEQ ID NO: 299502 - DNA, 3614 bp, Homo sapiens
  misc_feature (27)..(27): n is a, c, g, or t
  misc_feature (34)..(34): n is a, c, g, or t
  misc_feature (47)..(47): n is a, c, g, or t
  misc_feature (56)..(56): n is a, c, g, or t
cagtcgacttactgcgcctacacctanattgaanacaccgctttgcntcagtatanaaaacggcaagtgtacgtcgatacggagcttgtcgacgctgtcgcaggggtggatcctgagctgccgaagccgccgtcctgctctcccgcgtgggcttctctaattccattgttttttttagattctctcgggcctagccgtccttggaacccgatattcgggctgggcggttccgcggcctgggcctaggggcttaacagtagcaacagaagcggcggcggcggcagcagcagcagcagcagcagcaatctcttcccgaacacgagcaccacaggcgcccgaaggccggaacaggcgtttagagaaaatggcagacgatattgatattgaagcaatgcttgaggctccttacaagaagacttgcctaacgatatctcacctctactcccatgaattcacctttgattccagtgtgaactgtcaatcataaggtagtaattgagtgacttatcgctgtaccgtggtcccctaggtaaaatgactcaactaagaattaccacctccagtttggtatagcaaaaaggtgaatgtagtggtttgggaaaaagcaggggtccaagaataacaaagcatgaccagtctgtggcaagttaaatcttctaatagtcttataagaagaaatgggtgagattttaaaatttatgtatctatgtaagactggtgatagtaaatcttaaaacagtccagtggcaatctgctgctcagttaataattactaaaattcttggatccctgaatagaaattaaaaaaaaaaatacaagaggcagtagagtcaatacaagcttaatacaagcttagagtaaatacaagcttagagtcacttgatgactgttttactgttctccatattgtttttatttttaattaggccctaccatagtatttcacactaaaaacaaaggaattatattggctaatatagtctttgactcatttcggtatctcagtaaaagtaaactgtcttttcattgtttcaccagttggtggtgaaaatagcagtatgcatgcattatcactggtgtcacaaactgtaagctttgtaagttagcactttactcctatagctgatgtaatcaaacttttaaacatttcactaaaccttttaatgaattcttgatagatttaaatagtgtatgtaattttgtaatgcttagactcttgaagagctactttctgttttaatgttaagattcttgtgtcttagttttttttaacatggatgtaattccatgtaaacaggtatggaagtaggaaatgtttaggctggacttggtggattattaattgactttcttgggttcttgggagtcaacattactaaagcagtgtgaatccctgtttgcttcagggcgagatgtgtgacagaggtggcatcaagctcttacagtcccaaccctccaacggaaatgggcgaagatctcaggaatggcatcggtcacaggaaatcgatagtggctggctgctagcatggccacttggggcttaggcagaaatagagccatggtactgaccaaagggaccatagcacatggaataaaactcaaaacaggacttcatgttttatggaaattatatttaaccacttcaacattgtaaatctggataacttttaatatctaaactatataagaaagtaaaatttaacatgttaatatggaaaatttttttatttttgtatcttgatgacttaaatgtaagcaacaaagtggttaaacacatacccatctaaatttttttatagccttccatgttaaactataagtaaataattagttttaaaattgttttgtattttcttattcctgttccctttaccctttgacaacttgaaatgttaccacttcgtcctcatgatgttcttctatcaaccctgcttaggatgagaacaagttgagcagtgccaacggccatgaagaacgtagcaaaaagaggaaaaaaagcaagagcagaagtcgtagtcatgaacgaaagagaagcaaaagtaaggaacggaagcgaagtagagacagagaaaggaaaaagagcaaaagccgtgaaagaaagcgaagtagaagcaaagagaggcgacggagccgctcaagaagtcgagatcgaagatttagaggccgctacagaagtccttactccggaccaaaatttaacagtgccatccgaggaaagattgggttgcctcatagcatcaaattaagcagacgacgttcccgaagcaaaagtccattcagaaaagacaagagccctgtgagagaacctattgataatttaactcctgaggaaagagatgcaaggacagtcttctgtatgcagctggcggcaagaattcgaccaagggatttggaagagtttttctctacagtaggaaaggttcgagatgtgaggatgatttctgacagaaattcaagacgttccaaaggaattgcttatgtggagttcgtcgatgttagctcagtgcctctagcaataggattaactggccaacgagttttaggcgtgccaatcatagtacaggcatcacaggcagaaaaaaacagagctgcagcaatggcaaacaatttacaaaagggaagtgctggacctatgaggctttatgtgggctcattacacttcaacataactgaagatatgcttcgtgggatctttgagccttttggaagaattgaaagtatccagctgatgatggacagtgaaactggtcgatccaagggatatggatttattacattttctgactcagaatgtgccaaaaaggctttggaacaacttaatggatttgaactagcaggaagaccaatgaaagttggtcatgttactgaacgtactgatgcttcgagtgctagttcatttttggacagtgatgaactggaaaggactggaattgatttgggaacaactggtcgtcttcagttaatggcaagacttgcagagggtacaggtttgcagattccgccagcagcacagcaagctctacagatgagtggctctttggcatttggtgctgtggcagatttgcaaacaagactttcccagcagactgaagcttcagctttagctgcagctgcctctgttcagccacttgcaacacaatgtttccaactctctaacatgtttaaccctcaaacagaagaagaagttggatgggataccgagattaaggatgatgtgattgaagaatgtaataaacatggaggagttattcatatttatgttgacaaaaattcagctcagggcaatgtgtatgtgaagtgcccatcaattgctgcagctattgctgctgtcaatgcattgcatggcaggtggtttgctggtaaaatgataacagcagcatatgtacctcttccaacttaccacaacctgtttcctgattctatgacagcaacacagctactggttccaagtagacgatgaaggaagatatagtcccttatgtatatagctttttttctttcttgagaattcatcttgagttatcttttatttagataaaaataaagaggcaaggatctactgtcatttgtatgcaatttcctgttaccttgaaaaaataaaaatgttaacagga

SEQ ID NO: 299503 - DNA, 3667 bp, Homo sapiens
  misc_feature (27)..(27): n is a, c, g, or t
  misc_feature (34)..(34): n is a, c, g, or t
  misc_feature (47)..(47): n is a, c, g, or t
  misc_feature (56)..(56): n is a, c, g, or t
cagtcgacttactgcgcctacacctanattgaanacaccgctttgcntcagtatanaaaacggcaagtgtacgtcgatacggagcttgtcgacgctgtcgcaggggtggatcctgagctgccgaagccgccgtcctgctctcccgcgtgggcttctctaattccattgttttttttagattctctcgggcctagccgtccttggaacccgatattcgggctgggcggttccgcggcctgggcctaggggcttaacagtagcaacagaagcggcggcggcggcagcagcagcagcagcagcagcaatctcttcccgaacacgagcaccacaggcgcccgaaggccggaacaggcgtttagagaaaatggcagacgatattgatattgaagcaatgcttgaggctccttacaagaagacttgcctaacgatatctcacctctactcccatgaattcacctttgattccagtgtgaactgtcaatcataaggtagtaattgagtgacttatcgctgtaccgtggtcccctaggtaaaatgactcaactaagaattaccacctccagtttggtatagcaaaaaggtgaatgtagtggtttgggaaaaagcaggggtccaagaataacaaagcatgaccagtctgtggcaagttaaatcttctaatagtcttataagaagaaatgggtgagattttaaaatttatgtatctatgtaagactggtgatagtaaatcttaaaacagtccagtggcaatctgctgctcagttaataattactaaaattcttggatccctgaatagaaattaaaaaaaaaaatacaagaggcagtagagtcaatacaagcttaatacaagcttagagtaaatacaagcttagagtcacttgatgactgttttactgttctccatattgtttttatttttaattaggccctaccatagtatttcacactaaaaacaaaggaattatattggctaatatagtctttgactcatttcggtatctcagtaaaagtaaactgtcttttcattgtttcaccagttggtggtgaaaatagcagtatgcatgcattatcactggtgtcacaaactgtaagctttgtaagttagcactttactcctatagctgatgtaatcaaacttttaaacatttcactaaaccttttaatgaattcttgatagatttaaatagtgtatgtaattttgtaatgcttagactcttgaagagctactttctgttttaatgttaagattcttgtgtcttagttttttttaacatggatgtaattccatgtaaacaggtatggaagtaggaaatgtttaggctggacttggtggattattaattgactttcttgggttcttgggagtcaacattactaaagcagtgtgaatccctgtttgcttcagggcgagatgtgtgacagaggtggcatcaagctcttacagtcccaaccctccaacggaaatgggcgaagatctcaggaatggcatcggtcacaggaaatcgatagtggctggctgctagcatggccacttggggcttaggcagaaatagagccatggtactgaccaaagggaccatagcacatggaataaaactcaaaacaggacttcatgttttatggaaattatatttaaccacttcaacattgtaaatctggataacttttaatatctaaactatataagaaagtaaaatttaacatgttaatatggaaaatttttttatttttgtatcttgatgacttaaatgtaagcaacaaagtggttaaacacatacccatctaaatttttttatagccttccatgttaaactataagtaaataattagttttaaaattgttttgtattttcttattcctgttccctttaccctttgacaacttgaaatgttaccacttcgtcctcatgatgttcttctatcaaccctgcttaggatgagaacaagttgagcagtgccaacggccatgaagaacgtagcaaaaagaggaaaaaaagcaagagcagaagtcgtagtcatgaacgaaagagaagcaaaagtaaggaacggaagcgaagtagagacagagaaaggaaaaagagcaaaagccgtgaaagaaagcgaagtagaagcaaagagaggcgacggagccgctcaagaagtcgagatcgaagatttagaggccgctacagaagtccttactccggaccaaaatttaacagtgccatccgaggaaagattgggttgcctcatagcatcaaattaagcagacgacgttcccgaagcaaaagtccattcagaaaagacaagagccctgtgagagaacctattgataatttaactcctgaggaaagagatgcaaggacagtcttctgtatgcagctggcggcaagaattcgaccaagggatttggaagagtttttctctacagtaggaaaggttcgagatgtgaggatgatttctgacagaaattcaagacgttccaaaggaattgcttatgtggagttcgtcgatgttagctcagtgcctctagcaataggattaactggccaacgagttttaggcgtgccaatcatagtacaggcatcacaggcagaaaaaaacagagctgcagcaatggcaaacaatttacaaaagggaagtgctggacctatgaggctttatgtgggctcattacacttcaacataactgaagatatgcttcgtgggatctttgagccttttggaagaattgaaagtatccagctgatgatggacagtgaaactggtcgatccaagggatatggatttattacattttctgactcagaatgtgccaaaaaggctttggaacaacttaatggatttgaactagcaggaagaccaatgaaagttggtcatgttactgaacgtactgatgcttcgagtgctagttcatttttggacagtgatgaactggaaaggactggaattgatttgggaacaactggtcgtcttcagttaatggcaagacttgcagagggtacaggtttgcagattccgccagcagcacagcaagctctacagatgagtggctctttggcatttggtgctgtggcagttgaggctcttcattgttcctgcactgagctgtagaattctcttttgttatagatttgcaaacaagactttcccagcagactgaagcttcagctttagctgcagctgcctctgttcagccacttgcaacacaatgtttccaactctctaacatgtttaaccctcaaacagaagaagaagttggatgggataccgagattaaggatgatgtgattgaagaatgtaataaacatggaggagttattcatatttatgttgacaaaaattcagctcagggcaatgtgtatgtgaagtgcccatcaattgctgcagctattgctgctgtcaatgcattgcatggcaggtggtttgctggtaaaatgataacagcagcatatgtacctcttccaacttaccacaacctgtttcctgattctatgacagcaacacagctactggttccaagtagacgatgaaggaagatatagtcccttatgtatatagctttttttctttcttgagaattcatcttgagttatcttttatttagataaaaataaagaggcaaggatctactgtcatttgtatgcaatttcctgttaccttgaaaaaataaaaatgttaacagga

SEQ ID NO: 299504 - DNA, 3458 bp, Homo sapiens
  misc_feature (27)..(27): n is a, c, g, or t
  misc_feature (34)..(34): n is a, c, g, or t
  misc_feature (47)..(47): n is a, c, g, or t
  misc_feature (56)..(56): n is a, c, g, or t
cagtcgacttactgcgcctacacctanattgaanacaccgctttgcntcagtatanaaaacggcaagtgtacgtcgatacggagcttgtcgacgctgtcgcaggggtggatcctgagctgccgaagccgccgtcctgctctcccgcgtgggcttctctaattccattgttttttttagattctctcgggcctagccgtccttggaacccgatattcgggctgggcggttccgcggcctgggcctaggggcttaacagtagcaacagaagcggcggcggcggcagcagcagcagcagcagcagcaatctcttcccgaacacgagcaccacaggcgcccgaaggccggaacaggcgtttagagaaaatggcagacgatattgatattgaagcaatgcttgaggctccttacaagaagacttgcctaacgatatctcacctctactcccatgaattcacctttgattccagtgtgaactgtcaatcataaggtagtaattgagtgacttatcgctgtaccgtggtcccctaggtaaaatgactcaactaagaattaccacctccagtttggtatagcaaaaaggtgaatgtagtggtttgggaaaaagcaggggtccaagaataacaaagcatgaccagtctgtggcaagttaaatcttctaatagtcttataagaagaaatgggtgagattttaaaatttatgtatctatgtaagactggtgatagtaaatcttaaaacagtccagtggcaatctgctgctcagttaataattactaaaattcttggatccctgaatagaaattaaaaaaaaaaatacaagaggcagtagagtcaatacaagcttaatacaagcttagagtaaatacaagcttagagtcacttgatgactgttttactgttctccatattgtttttatttttaattaggccctaccatagtatttcacactaaaaacaaaggaattatattggctaatatagtctttgactcatttcggtatctcagtaaaagtaaactgtcttttcattgtttcaccagttggtggtgaaaatagcagtatgcatgcattatcactggtgtcacaaactgtaagctttgtaagttagcactttactcctatagctgatgtaatcaaacttttaaacatttcactaaaccttttaatgaattcttgatagatttaaatagtgtatgtaattttgtaatgcttagactcttgaagagctactttctgttttaatgttaagattcttgtgtcttagttttttttaacatggatgtaattccatgtaaacaggtatggaagtaggaaatgtttaggctggacttggtggattattaattgactttcttgggttcttgggagtcaacattactaaagcagtgtgaatccctgtttgcttcagggcgagatgtgtgacagaggtggcatcaagctcttacagtcccaaccctccaacggaaatgggcgaagatctcaggaatggcatcggtcacaggaaatcgatagtggctggctgctagcatggccacttggggcttaggcagaaatagagccatggtactgaccaaagggaccatagcacatggaataaaactcaaaacaggacttcatgttttatggaaattatatttaaccacttcaacattgtaaatctggataacttttaatatctaaactatataagaaagtaaaatttaacatgttaatatggaaaatttttttatttttgtatcttgatgacttaaatgtaagcaacaaagtggttaaacacatacccatctaaatttttttatagccttccatgttaaactataagtaaataattagttttaaaattgttttgtattttcttattcctgttccctttaccctttgacaacttgaaatgttaccacttcgtcctcatgatgttcttctatcaaccctgcttaggatgagaacaagttgagcagtgccaacggccatgaagaacgtagcaaaaagaggaaaaaaagcaagagcagaagtcgtagtcatgaacgaaagagaagcaaaagtaaggaacggaagcgaagtagagacagagaaaggaaaaagagcaaaagccgtgaaagaaagcgaagtagaagcaaagagaggcgacggagccgctcaagaagtcgagatcgaagatttagaggccgctacagaagtccttactccggaccaaaatttaacagtgccatccgaggaaagattgggttgcctcatagcatcaaattaagcagacgacgttcccgaagcaaaagtccattcagaaaagacaagagccctgtgagagaacctattgataatttaactcctgaggaaagagatgcaaggacagtcttctgtatgcagctggcggcaagaattcgaccaagggatttggaagagtttttctctacagtaggaaaggttcgagatgtgaggatgatttctgacagaaattcaagacgttccaaaggaattgcttatgtggagttcgtcgatgttagctcagtgcctctagcaataggattaactggccaacgagttttaggcgtgccaatcatagtacaggcatcacaggcagaaaaaaacagagctgcagcaatggcaaacaatttacaaaagggaagtgctggacctatgaggctttatgtgggctcattacacttcaacataactgaagatatgcttcgtgggatctttgagccttttggaagaattgaaagtatccagctgatgatggacagtgaaactggtcgatccaagggatatggatttattacattttctgactcagaatgtgccaaaaaggctttggaacaacttaatggatttgaactagcaggaagaccaatgaaagttggtcatgttactgaacgtactgatgcttcgagtgctagttcatttttggacagtgatgaactggaaaggactggaattgatttgggaacaactggtcgtcttcagttaatggcaagacttgcagagggtacaggtttgcagattccgccagcagcacagcaagctctacagatgagtggctctttggcatttggtgctgtggcagaattctcttttgttatagatttgcaaacaagactttcccagcagactgaagcttcagctttagctgcagctgcctctgttcagccacttgcaacacaatgtttccaactctctaacatgtttaaccctcaaacagaagaagaagttggatgggataccgagattaaggatgatgtgattgaagaatgtaataaacatggaggagttattcatatttatgttgacaaaaattcagctcaggtattttcatctttttttataaatgatgttaggttgttcgtctctaccttaatcttcgcacattatgtggtgcatgttatggttaaccgtcttccattatagtttttgtgtgtgtgtgcctgaaagtagctttaatatagtggctaaataaaccctccaa

SEQ ID NO: 299505 - DNA, 3623 bp, Homo sapiens
  misc_feature (27)..(27): n is a, c, g, or t
  misc_feature (34)..(34): n is a, c, g, or t
  misc_feature (47)..(47): n is a, c, g, or t
  misc_feature (56)..(56): n is a, c, g, or t
cagtcgacttactgcgcctacacctanattgaanacaccgctttgcntcagtatanaaaacggcaagtgtacgtcgatacggagcttgtcgacgctgtcgcaggggtggatcctgagctgccgaagccgccgtcctgctctcccgcgtgggcttctctaattccattgttttttttagattctctcgggcctagccgtccttggaacccgatattcgggctgggcggttccgcggcctgggcctaggggcttaacagtagcaacagaagcggcggcggcggcagcagcagcagcagcagcagcaatctcttcccgaacacgagcaccacaggcgcccgaaggccggaacaggcgtttagagaaaatggcagacgatattgatattgaagcaatgcttgaggctccttacaagaagacttgcctaacgatatctcacctctactcccatgaattcacctttgattccagtgtgaactgtcaatcataaggtagtaattgagtgacttatcgctgtaccgtggtcccctaggtaaaatgactcaactaagaattaccacctccagtttggtatagcaaaaaggtgaatgtagtggtttgggaaaaagcaggggtccaagaataacaaagcatgaccagtctgtggcaagttaaatcttctaatagtcttataagaagaaatgggtgagattttaaaatttatgtatctatgtaagactggtgatagtaaatcttaaaacagtccagtggcaatctgctgctcagttaataattactaaaattcttggatccctgaatagaaattaaaaaaaaaaatacaagaggcagtagagtcaatacaagcttaatacaagcttagagtaaatacaagcttagagtcacttgatgactgttttactgttctccatattgtttttatttttaattaggccctaccatagtatttcacactaaaaacaaaggaattatattggctaatatagtctttgactcatttcggtatctcagtaaaagtaaactgtcttttcattgtttcaccagttggtggtgaaaatagcagtatgcatgcattatcactggtgtcacaaactgtaagctttgtaagttagcactttactcctatagctgatgtaatcaaacttttaaacatttcactaaaccttttaatgaattcttgatagatttaaatagtgtatgtaattttgtaatgcttagactcttgaagagctactttctgttttaatgttaagattcttgtgtcttagttttttttaacatggatgtaattccatgtaaacaggtatggaagtaggaaatgtttaggctggacttggtggattattaattgactttcttgggttcttgggagtcaacattactaaagcagtgtgaatccctgtttgcttcagggcgagatgtgtgacagaggtggcatcaagctcttacagtcccaaccctccaacggaaatgggcgaagatctcaggaatggcatcggtcacaggaaatcgatagtggctggctgctagcatggccacttggggcttaggcagaaatagagccatggtactgaccaaagggaccatagcacatggaataaaactcaaaacaggacttcatgttttatggaaattatatttaaccacttcaacattgtaaatctggataacttttaatatctaaactatataagaaagtaaaatttaacatgttaatatggaaaatttttttatttttgtatcttgatgacttaaatgtaagcaacaaagtggttaaacacatacccatctaaatttttttatagccttccatgttaaactataagtaaataattagttttaaaattgttttgtattttcttattcctgttccctttaccctttgacaacttgaaatgttaccacttcgtcctcatgatgttcttctatcaaccctgcttaggatgagaacaagttgagcagtgccaacggccatgaagaacgtagcaaaaagaggaaaaaaagcaagagcagaagtcgtagtcatgaacgaaagagaagcaaaagtaaggaacggaagcgaagtagagacagagaaaggaaaaagagcaaaagccgtgaaagaaagcgaagtagaagcaaagagaggcgacggagccgctcaagaagtcgagatcgaagatttagaggccgctacagaagtccttactccggaccaaaatttaacagtgccatccgaggaaagattgggttgcctcatagcatcaaattaagcagacgacgttcccgaagcaaaagtccattcagaaaagacaagagccctgtgagagaacctattgataatttaactcctgaggaaagagatgcaaggacagtcttctgtatgcagctggcggcaagaattcgaccaagggatttggaagagtttttctctacagtaggaaaggttcgagatgtgaggatgatttctgacagaaattcaagacgttccaaaggaattgcttatgtggagttcgtcgatgttagctcagtgcctctagcaataggattaactggccaacgagttttaggcgtgccaatcatagtacaggcatcacaggcagaaaaaaacagagctgcagcaatggcaaacaatttacaaaagggaagtgctggacctatgaggctttatgtgggctcattacacttcaacataactgaagatatgcttcgtgggatctttgagccttttggaagaattgaaagtatccagctgatgatggacagtgaaactggtcgatccaagggatatggatttattacattttctgactcagaatgtgccaaaaaggctttggaacaacttaatggatttgaactagcaggaagaccaatgaaagttggtcatgttactgaacgtactgatgcttcgagtgctagttcatttttggacagtgatgaactggaaaggactggaattgatttgggaacaactggtcgtcttcagttaatggcaagacttgcagagggtacaggtttgcagattccgccagcagcacagcaagctctacagatgagtggctctttggcatttggtgctgtggcagatttgcaaacaagactttcccagcagactgaagcttcagctttagctgcagctgcctctgttcagccacttgcaacacaatgtttccaactctctaacatgtttaaccctcaaacagaagaagaagttggatgggataccgagattaaggatgatgtgattgaagaatgtaataaacatggaggagttattcatatttatgttgacaaaaattcagctcagggcaatgtgtatgtgaagtgcccatcaattgctgcagctattgctgctgtcaatgcattgcatggcaggtggtttgctggtaaaatgataacagcagcatatgtacctcttccaacttaccacaacctgtttcctgattctatgacagcaacacagctactggttccaagtagacgatgaaggaagatatagtcccttatgtatatagctttttttctttcttgagaattcatcttgagttatcttttaggttacaggaaaattgcagacgcaatggactcgtacgatgttcatgctccgtatgcattcagtgtaactgaaatacagaggaatccactgatct

SEQ ID NO: 299506 - DNA, 3231 bp, Homo sapiens
  misc_feature (27)..(27): n is a, c, g, or t
  misc_feature (34)..(34): n is a, c, g, or t
  misc_feature (47)..(47): n is a, c, g, or t
  misc_feature (56)..(56): n is a, c, g, or t
  misc_feature (3193)..(3193): n is a, c, g, or t
cagtcgacttactgcgcctacacctanattgaanacaccgctttgcntcagtatanaaaacggcaagtgtacgtcgatacggagcttgtcgacgctgtcgcaggggtggatcctgagctgccgaagccgccgtcctgctctcccgcgtgggcttctctaattccattgttttttttagattctctcgggcctagccgtccttggaacccgatattcgggctgggcggttccgcggcctgggcctaggggcttaacagtagcaacagaagcggcggcggcggcagcagcagcagcagcagcagcaatctcttcccgaacacgagcaccacaggcgcccgaaggccggaacaggcgtttagagaaaatggcagacgatattgatattgaagcaatgcttgaggctccttacaagaagacttgcctaacgatatctcacctctactcccatgaattcacctttgattccagtgtgaactgtcaatcataaggtagtaattgagtgacttatcgctgtaccgtggtcccctaggtaaaatgactcaactaagaattaccacctccagtttggtatagcaaaaaggtgaatgtagtggtttgggaaaaagcaggggtccaagaataacaaagcatgaccagtctgtggcaagttaaatcttctaatagtcttataagaagaaatgggtgagattttaaaatttatgtatctatgtaagactggtgatagtaaatcttaaaacagtccagtggcaatctgctgctcagttaataattactaaaattcttggatccctgaatagaaattaaaaaaaaaaatacaagaggcagtagagtcaatacaagcttaatacaagcttagagtaaatacaagcttagagtcacttgatgactgttttactgttctccatattgtttttatttttaattaggccctaccatagtatttcacactaaaaacaaaggaattatattggctaatatagtctttgactcatttcggtatctcagtaaaagtaaactgtcttttcattgtttcaccagttggtggtgaaaatagcagtatgcatgcattatcactggtgtcacaaactgtaagctttgtaagttagcactttactcctatagctgatgtaatcaaacttttaaacatttcactaaaccttttaatgaattcttgatagatttaaatagtgtatgtaattttgtaatgcttagactcttgaagagctactttctgttttaatgttaagattcttgtgtcttagttttttttaacatggatgtaattccatgtaaacaggtatggaagtaggaaatgtttaggctggacttggtggattattaattgactttcttgggttcttgggagtcaacattactaaagcagtgtgaatccctgtttgcttcagggcgagatgtgtgacagaggtggcatcaagctcttacagtcccaaccctccaacggaaatgggcgaagatctcaggaatggcatcggtcacaggaaatcgatagtggctggctgctagcatggccacttggggcttaggcagaaatagagccatggtactgaccaaagggaccatagcacatggaataaaactcaaaacaggacttcatgttttatggaaattatatttaaccacttcaacattgtaaatctggataacttttaatatctaaactatataagaaagtaaaatttaacatgttaatatggaaaatttttttatttttgtatcttgatgacttaaatgtaagcaacaaagtggttaaacacatacccatctaaatttttttatagccttccatgttaaactataagtaaataattagttttaaaattgttttgtattttcttattcctgttccctttaccctttgacaacttgaaatgttaccacttcgtcctcatgatgttcttctatcaaccctgcttaggatgagaacaagttgagcagtgccaacggccatgaagaacgtagcaaaaagaggaaaaaaagcaagagcagaagtcgtagtcatgaacgaaagagaagcaaaagtaaggaacggaagcgaagtagagacagagaaaggaaaaagagcaaaagccgtgaaagaaagcgaagtagaagcaaagagaggcgacggagccgctcaagaagtcgagatcgaagatttagaggccgctacagaagtccttactccggaccaaaatttaacagtgccatccgaggaaagattgggttgcctcatagcatcaaattaagcagacgacgttcccgaagcaaaagtccattcagaaaagacaagagccctgtgagagaacctattgataatttaactcctgaggaaagagatgcaaggacagtcttctgtatgcagctggcggcaagaattcgaccaagggatttggaagagtttttctctacagtaggaaaggttcgagatgtgaggatgatttctgacagaaattcaagacgttccaaaggaattgcttatgtggagttcgtcgatgttagctcagtgcctctagcaataggattaactggccaacgagttttaggcgtgccaatcatagtacaggcatcacaggcagaaaaaaacagagctgcagcaatggcaaacaatttacaaaagggaagtgctggacctatgaggctttatgtgggctcattacacttcaacataactgaagatatgcttcgtgggatctttgagccttttggaagaattgaaagtatccagctgatgatggacagtgaaactggtcgatccaagggatatggatttattacattttctgactcagaatgtgccaaaaaggctttggaacaacttaatggatttgaactagcaggaagaccaatgaaagttggtcatgttactgaacgtactgatgcttcgagtgctagttcatttttggacagtgatgaactggaaaggactggaattgatttgggaacaactggtcgtcttcagttaatggcaagacttgcagagggtacaggtttgcagattccgccagcagcacagcaagctctacagatgagtggctctttggcatttggtgctgtggcagatttgcaaacaagactttcccagcagactgaagcttcagctttagctgcagctgcctctgttcagccacttgcaacacaatgtttccaactctctaacatgtttaaccctcaaacaaaaaaaaaaagttggatngggatccccaatttaaggttgggattgtttattggggg

SEQ ID NO: 299507 - DNA, 3283 bp, Homo sapiens
  misc_feature (27)..(27): n is a, c, g, or t
  misc_feature (34)..(34): n is a, c, g, or t
  misc_feature (47)..(47): n is a, c, g, or t
  misc_feature (56)..(56): n is a, c, g, or t
cagtcgacttactgcgcctacacctanattgaanacaccgctttgcntcagtatanaaaacggcaagtgtacgtcgatacggagcttgtcgacgctgtcgcaggggtggatcctgagctgccgaagccgccgtcctgctctcccgcgtgggcttctctaattccattgttttttttagattctctcgggcctagccgtccttggaacccgatattcgggctgggcggttccgcggcctgggcctaggggcttaacagtagcaacagaagcggcggcggcggcagcagcagcagcagcagcagcaatctcttcccgaacacgagcaccacaggcgcccgaaggccggaacaggcgtttagagaaaatggcagacgatattgatattgaagcaatgcttgaggctccttacaagaagacttgcctaacgatatctcacctctactcccatgaattcacctttgattccagtgtgaactgtcaatcataaggtagtaattgagtgacttatcgctgtaccgtggtcccctaggtaaaatgactcaactaagaattaccacctccagtttggtatagcaaaaaggtgaatgtagtggtttgggaaaaagcaggggtccaagaataacaaagcatgaccagtctgtggcaagttaaatcttctaatagtcttataagaagaaatgggtgagattttaaaatttatgtatctatgtaagactggtgatagtaaatcttaaaacagtccagtggcaatctgctgctcagttaataattactaaaattcttggatccctgaatagaaattaaaaaaaaaaatacaagaggcagtagagtcaatacaagcttaatacaagcttagagtaaatacaagcttagagtcacttgatgactgttttactgttctccatattgtttttatttttaattaggccctaccatagtatttcacactaaaaacaaaggaattatattggctaatatagtctttgactcatttcggtatctcagtaaaagtaaactgtcttttcattgtttcaccagttggtggtgaaaatagcagtatgcatgcattatcactggtgtcacaaactgtaagctttgtaagttagcactttactcctatagctgatgtaatcaaacttttaaacatttcactaaaccttttaatgaattcttgatagatttaaatagtgtatgtaattttgtaatgcttagactcttgaagagctactttctgttttaatgttaagattcttgtgtcttagttttttttaacatggatgtaattccatgtaaacaggtatggaagtaggaaatgtttaggctggacttggtggattattaattgactttcttgggttcttgggagtcaacattactaaagcagtgtgaatccctgtttgcttcagggcgagatgtgtgacagaggtggcatcaagctcttacagtcccaaccctccaacggaaatgggcgaagatctcaggaatggcatcggtcacaggaaatcgatagtggctggctgctagcatggccacttggggcttaggcagaaatagagccatggtactgaccaaagggaccatagcacatggaataaaactcaaaacaggacttcatgttttatggaaattatatttaaccacttcaacattgtaaatctggataacttttaatatctaaactatataagaaagtaaaatttaacatgttaatatggaaaatttttttatttttgtatcttgatgacttaaatgtaagcaacaaagtggttaaacacatacccatctaaatttttttatagccttccatgttaaactataagtaaataattagttttaaaattgttttgtattttcttattcctgttccctttaccctttgacaacttgaaatgttaccacttcgtcctcatgatgttcttctatcaaccctgcttaggatgagaacaagttgagcagtgccaacggccatgaagaacgtagcaaaaagaggaaaaaaagcaagagcagaagtcgtagtcatgaacgaaagagaagcaaaagtaaggaacggaagcgaagtagagacagagaaaggaaaaagagcaaaagccgtgaaagaaagcgaagtagaagcaaagagaggcgacggagccgctcaagaagtcgagatcgaagatttagaggccgctacagaagtccttactccggaccaaaatttaacagtgccatccgaggaaagattgggttgcctcatagcatcaaattaagcagacgacgttcccgaagcaaaagtccattcagaaaagacaagagccctgtgagagaacctattgataatttaactcctgaggaaagagatgcaaggacagtcttctgtatgcagctggcggcaagaattcgaccaagggatttggaagagtttttctctacagtaggaaaggttcgagatgtgaggatgatttctgacagaaattcaagacgttccaaaggaattgcttatgtggagttcgtcgatgttagctcagtgcctctagcaataggattaactggccaacgagttttaggcgtgccaatcatagtacaggcatcacaggcagaaaaaaacagagctgcagcaatggcaaacaatttacaaaagggaagtgctggacctatgaggctttatgtgggctcattacacttcaacataactgaagatatgcttcgtgggatctttgagccttttggaagaattgaaagtatccagctgatgatggacagtgaaactggtcgatccaagggatatggatttattacattttctgactcagaatgtgccaaaaaggctttggaacaacttaatggatttgaactagcaggaagaccaatgaaagttggtcatgttactgaacgtactgatgcttcgagtgctagttcatttttggacagtgatgaactggaaaggactggaattgatttgggaacaactggtcgtcttcagttaatggcaagacttgcagagggtacaggtttgcagattccgccagcagcacagcaagctctacagatgagtggctctttggcatttggtgctgtggcagatttgcaaacaagactttcccagcagactgaaggtgagttgaagtgttcatattttttatttttgtctttgaaatagaattaaatgtagtaagacagttttctatatttattgtcatatttttataccagtaatttggaccaaattttgacacagtgacacatagtggtatattcatagtaatctgtctgtatttcagaagacctaacccaaattaatggactt

SEQ ID NO: 299508 - DNA, 3301 bp, Homo sapiens
  misc_feature (27)..(27): n is a, c, g, or t
  misc_feature (34)..(34): n is a, c, g, or t
  misc_feature (47)..(47): n is a, c, g, or t
  misc_feature (56)..(56): n is a, c, g, or t
cagtcgacttactgcgcctacacctanattgaanacaccgctttgcntcagtatanaaaacggcaagtgtacgtcgatacggagcttgtcgacgctgtcgcaggggtggatcctgagctgccgaagccgccgtcctgctctcccgcgtgggcttctctaattccattgttttttttagattctctcgggcctagccgtccttggaacccgatattcgggctgggcggttccgcggcctgggcctaggggcttaacagtagcaacagaagcggcggcggcggcagcagcagcagcagcagcagcaatctcttcccgaacacgagcaccacaggcgcccgaaggccggaacaggcgtttagagaaaatggcagacgatattgatattgaagcaatgcttgaggctccttacaagaagacttgcctaacgatatctcacctctactcccatgaattcacctttgattccagtgtgaactgtcaatcataaggtagtaattgagtgacttatcgctgtaccgtggtcccctaggtaaaatgactcaactaagaattaccacctccagtttggtatagcaaaaaggtgaatgtagtggtttgggaaaaagcaggggtccaagaataacaaagcatgaccagtctgtggcaagttaaatcttctaatagtcttataagaagaaatgggtgagattttaaaatttatgtatctatgtaagactggtgatagtaaatcttaaaacagtccagtggcaatctgctgctcagttaataattactaaaattcttggatccctgaatagaaattaaaaaaaaaaatacaagaggcagtagagtcaatacaagcttaatacaagcttagagtaaatacaagcttagagtcacttgatgactgttttactgttctccatattgtttttatttttaattaggccctaccatagtatttcacactaaaaacaaaggaattatattggctaatatagtctttgactcatttcggtatctcagtaaaagtaaactgtcttttcattgtttcaccagttggtggtgaaaatagcagtatgcatgcattatcactggtgtcacaaactgtaagctttgtaagttagcactttactcctatagctgatgtaatcaaacttttaaacatttcactaaaccttttaatgaattcttgatagatttaaatagtgtatgtaattttgtaatgcttagactcttgaagagctactttctgttttaatgttaagattcttgtgtcttagttttttttaacatggatgtaattccatgtaaacaggtatggaagtaggaaatgtttaggctggacttggtggattattaattgactttcttgggttcttgggagtcaacattactaaagcagtgtgaatccctgtttgcttcagggcgagatgtgtgacagaggtggcatcaagctcttacagtcccaaccctccaacggaaatgggcgaagatctcaggaatggcatcggtcacaggaaatcgatagtggctggctgctagcatggccacttggggcttaggcagaaatagagccatggtactgaccaaagggaccatagcacatggaataaaactcaaaacaggacttcatgttttatggaaattatatttaaccacttcaacattgtaaatctggataacttttaatatctaaactatataagaaagtaaaatttaacatgttaatatggaaaatttttttatttttgtatcttgatgacttaaatgtaagcaacaaagtggttaaacacatacccatctaaatttttttatagccttccatgttaaactataagtaaataattagttttaaaattgttttgtattttcttattcctgttccctttaccctttgacaacttgaaatgttaccacttcgtcctcatgatgttcttctatcaaccctgcttaggatgagaacaagttgagcagtgccaacggccatgaagaacgtagcaaaaagaggaaaaaaagcaagagcagaagtcgtagtcatgaacgaaagagaagcaaaagtaaggaacggaagcgaagtagagacagagaaaggaaaaagagcaaaagccgtgaaagaaagcgaagtagaagcaaagagaggcgacggagccgctcaagaagtcgagatcgaagatttagaggccgctacagaagtccttactccggaccaaaatttaacagtgccatccgaggaaagattgggttgcctcatagcatcaaattaagcagacgacgttcccgaagcaaaagtccattcagaaaagacaagagccctgtgagagaacctattgataatttaactcctgaggaaagagatgcaaggacagtcttctgtatgcagctggcggcaagaattcgaccaagggatttggaagagtttttctctacagtaggaaaggttcgagatgtgaggatgatttctgacagaaattcaagacgttccaaaggaattgcttatgtggagttcgtcgatgttagctcagtgcctctagcaataggattaactggccaacgagttttaggcgtgccaatcatagtacaggcatcacaggcagaaaaaaacagagctgcagcaatggcaaacaatttacaaaagggaagtgctggacctatgaggctttatgtgggctcattacacttcaacataactgaagatatgcttcgtgggatctttgagccttttggaagaattgaaagtatccagctgatgatggacagtgaaactggtcgatccaagggatatggatttattacattttctgactcagaatgtgccaaaaaggctttggaacaacttaatggatttgaactagcaggaagaccaatgaaagttggtcatgttactgaacgtactgatgcttcgagtgctagttcatttttggacagtgatgaactggaaaggactggaattgatttgggaacaactggtcgtcttcagttaatggcaagacttgcagagggtacaggtttgcagattccgccagcagcacagcaagctctacagatgagtggctctttggcatttggtgctgtggcagaattctcttttgttatagatttgcaaacaagactttcccagcagactgaaggtgagttgaagtgttcatattttttatttttgtctttgaaatagaattaaatgtagtaagacagttttctatatttattgtcatatttttataccagtaatttggaccaaattttgacacagtgacacatagtggtatattcatagtaatctgtctgtatttcagaagacctaacccaaattaatggactt

SEQ ID NO: 299509 - DNA, 2869 bp, Homo sapiens
  misc_feature (27)..(27): n is a, c, g, or t
  misc_feature (34)..(34): n is a, c, g, or t
  misc_feature (47)..(47): n is a, c, g, or t
  misc_feature (56)..(56): n is a, c, g, or t
  misc_feature (2824)..(2824): n is a, c, g, or t
  misc_feature (2862)..(2863): n is a, c, g, or t
cagtcgacttactgcgcctacacctanattgaanacaccgctttgcntcagtatanaaaacggcaagtgtacgtcgatacggagcttgtcgacgctgtcgcaggggtggatcctgagctgccgaagccgccgtcctgctctcccgcgtgggcttctctaattccattgttttttttagattctctcgggcctagccgtccttggaacccgatattcgggctgggcggttccgcggcctgggcctaggggcttaacagtagcaacagaagcggcggcggcggcagcagcagcagcagcagcagcaatctcttcccgaacacgagcaccacaggcgcccgaaggccggaacaggcgtttagagaaaatggcagacgatattgatattgaagcaatgcttgaggctccttacaagaagacttgcctaacgatatctcacctctactcccatgaattcacctttgattccagtgtgaactgtcaatcataaggtagtaattgagtgacttatcgctgtaccgtggtcccctaggtaaaatgactcaactaagaattaccacctccagtttggtatagcaaaaaggtgaatgtagtggtttgggaaaaagcaggggtccaagaataacaaagcatgaccagtctgtggcaagttaaatcttctaatagtcttataagaagaaatgggtgagattttaaaatttatgtatctatgtaagactggtgatagtaaatcttaaaacagtccagtggcaatctgctgctcagttaataattactaaaattcttggatccctgaatagaaattaaaaaaaaaaatacaagaggcagtagagtcaatacaagcttaatacaagcttagagtaaatacaagcttagagtcacttgatgactgttttactgttctccatattgtttttatttttaattaggccctaccatagtatttcacactaaaaacaaaggaattatattggctaatatagtctttgactcatttcggtatctcagtaaaagtaaactgtcttttcattgtttcaccagttggtggtgaaaatagcagtatgcatgcattatcactggtgtcacaaactgtaagctttgtaagttagcactttactcctatagctgatgtaatcaaacttttaaacatttcactaaaccttttaatgaattcttgatagatttaaatagtgtatgtaattttgtaatgcttagactcttgaagagctactttctgttttaatgttaagattcttgtgtcttagttttttttaacatggatgtaattccatgtaaacaggtatggaagtaggaaatgtttaggctggacttggtggattattaattgactttcttgggttcttgggagtcaacattactaaagcagtgtgaatccctgtttgcttcagggcgagatgtgtgacagaggtggcatcaagctcttacagtcccaaccctccaacggaaatgggcgaagatctcaggaatggcatcggtcacaggaaatcgatagtggctggctgctagcatggccacttggggcttaggcagaaatagagccatggtactgaccaaagggaccatagcacatggaataaaactcaaaacaggacttcatgttttatggaaattatatttaaccacttcaacattgtaaatctggataacttttaatatctaaactatataagaaagtaaaatttaacatgttaatatggaaaatttttttatttttgtatcttgatgacttaaatgtaagcaacaaagtggttaaacacatacccatctaaatttttttatagccttccatgttaaactataagtaaataattagttttaaaattgttttgtattttcttattcctgttccctttaccctttgacaacttgaaatgttaccacttcgtcctcatgatgttcttctatcaaccctgcttaggatgagaacaagttgagcagtgccaacggccatgaagaacgtagcaaaaagaggaaaaaaagcaagagcagaagtcgtagtcatgaacgaaagagaagcaaaagtaaggaacggaagcgaagtagagacagagaaaggaaaaagagcaaaagccgtgaaagaaagcgaagtagaagcaaagagaggcgacggagccgctcaagaagtcgagatcgaagatttagaggccgctacagaagtccttactccggaccaaaatttaacagtgccatccgaggaaagattgggttgcctcatagcatcaaattaagcagacgacgttcccgaagcaaaagtccattcagaaaagacaagagccctgtgagagaacctattgataatttaactcctgaggaaagagatgcaaggacagtcttctgtatgcagctggcggcaagaattcgaccaagggatttggaagagtttttctctacagtaggaaaggttcgagatgtgaggatgatttctgacagaaattcaagacgttccaaaggaattgcttatgtggagttcgtcgatgttagctcagtgcctctagcaataggattaactggccaacgagttttaggcgtgccaatcatagtacaggcatcacaggcagaaaaaaacagagctgcagcaatggcaaacaatttacaaaagggaagtgctggacctatgaggctttatgtgggctcattacacttcaacataactgaagatatgcttcgtgggatctttgagccttttggaagaattgaaagtatccagctgatgatggacagtgaaactggtcgatccaagggatatggatttattacatttctgctcaaatggccaaaaggcttggaccacttatggttgacttcnggaaaccatgaagtggcatgtctgacgctgagctcagnntattat

SEQ ID NO: 299510 - DNA, 2732 bp, Homo sapiens
  misc_feature (27)..(27): n is a, c, g, or t
  misc_feature (34)..(34): n is a, c, g, or t
  misc_feature (47)..(47): n is a, c, g, or t
  misc_feature (56)..(56): n is a, c, g, or t
cagtcgacttactgcgcctacacctanattgaanacaccgctttgcntcagtatanaaaacggcaagtgtacgtcgatacggagcttgtcgacgctgtcgcaggggtggatcctgagctgccgaagccgccgtcctgctctcccgcgtgggcttctctaattccattgttttttttagattctctcgggcctagccgtccttggaacccgatattcgggctgggcggttccgcggcctgggcctaggggcttaacagtagcaacagaagcggcggcggcggcagcagcagcagcagcagcagcaatctcttcccgaacacgagcaccacaggcgcccgaaggccggaacaggcgtttagagaaaatggcagacgatattgatattgaagcaatgcttgaggctccttacaagaagacttgcctaacgatatctcacctctactcccatgaattcacctttgattccagtgtgaactgtcaatcataaggtagtaattgagtgacttatcgctgtaccgtggtcccctaggtaaaatgactcaactaagaattaccacctccagtttggtatagcaaaaaggtgaatgtagtggtttgggaaaaagcaggggtccaagaataacaaagcatgaccagtctgtggcaagttaaatcttctaatagtcttataagaagaaatgggtgagattttaaaatttatgtatctatgtaagactggtgatagtaaatcttaaaacagtccagtggcaatctgctgctcagttaataattactaaaattcttggatccctgaatagaaattaaaaaaaaaaatacaagaggcagtagagtcaatacaagcttaatacaagcttagagtaaatacaagcttagagtcacttgatgactgttttactgttctccatattgtttttatttttaattaggccctaccatagtatttcacactaaaaacaaaggaattatattggctaatatagtctttgactcatttcggtatctcagtaaaagtaaactgtcttttcattgtttcaccagttggtggtgaaaatagcagtatgcatgcattatcactggtgtcacaaactgtaagctttgtaagttagcactttactcctatagctgatgtaatcaaacttttaaacatttcactaaaccttttaatgaattcttgatagatttaaatagtgtatgtaattttgtaatgcttagactcttgaagagctactttctgttttaatgttaagattcttgtgtcttagttttttttaacatggatgtaattccatgtaaacaggtatggaagtaggaaatgtttaggctggacttggtggattattaattgactttcttgggttcttgggagtcaacattactaaagcagtgtgaatccctgtttgcttcagggcgagatgtgtgacagaggtggcatcaagctcttacagtcccaaccctccaacggaaatgggcgaagatctcaggaatggcatcggtcacaggaaatcgatagtggctggctgctagcatggccacttggggcttaggcagaaatagagccatggtactgaccaaagggaccatagcacatggaataaaactcaaaacaggacttcatgttttatggaaattatatttaaccacttcaacattgtaaatctggataacttttaatatctaaactatataagaaagtaaaatttaacatgttaatatggaaaatttttttatttttgtatcttgatgacttaaatgtaagcaacaaagtggttaaacacatacccatctaaatttttttatagccttccatgttaaactataagtaaataattagttttaaaattgttttgtattttcttattcctgttccctttaccctttgacaacttgaaatgttaccacttcgtcctcatgatgttcttctatcaaccctgcttaggatgagaacaagttgagcagtgccaacggccatgaagaacgtagcaaaaagaggaaaaaaagcaagagcagaagtcgtagtcatgaacgaaagagaagcaaaagtaaggaacggaagcgaagtagagacagagaaaggaaaaagagcaaaagccgtgaaagaaagcgaagtagaagcaaagagaggcgacggagccgctcaagaagtcgagatcgaagatttagaggccgctacagaagtccttactccggaccaaaatttaacagtgccatccgaggaaagattgggttgcctcatagcatcaaattaagcagacgacgttcccgaagcaaaagtccattcagaaaagacaagagccctgtgagagaacctattgataatttaactcctgaggaaagagatgcaaggacagtcttctgtatgcagctggcggcaagaattcgaccaagggatttggaagagtttttctctacagtaggaaaggttcgagatgtgaggatgatttctgacagaaattcaagacgttccaaaggaattgcttatgtggagccgctcaagaagtcgagatcgaagatttagaggccgctacagaagtccttactccggaccaaaatttaacagtgccatccgaggaaagattgggttgcctcatagcatcaaattaagcagacgacgttcccgaagcaaaagtccattcagaaaaagagcaaaagccgtgaaagaaagcgaaagagaagcaaaagtaaggaacggaagcgaagtagagacagagaaaggaaaaagagcaaaagccgtg

SEQ ID NO: 299511 - DNA, 2450 bp, Homo sapiens
  misc_feature (27)..(27): n is a, c, g, or t
  misc_feature (34)..(34): n is a, c, g, or t
  misc_feature (47)..(47): n is a, c, g, or t
  misc_feature (56)..(56): n is a, c, g, or t
cagtcgacttactgcgcctacacctanattgaanacaccgctttgcntcagtatanaaaacggcaagtgtacgtcgatacggagcttgtcgacgctgtcgcaggggtggatcctgagctgccgaagccgccgtcctgctctcccgcgtgggcttctctaattccattgttttttttagattctctcgggcctagccgtccttggaacccgatattcgggctgggcggttccgcggcctgggcctaggggcttaacagtagcaacagaagcggcggcggcggcagcagcagcagcagcagcagcaatctcttcccgaacacgagcaccacaggcgcccgaaggccggaacaggcgtttagagaaaatggcagacgatattgatattgaagcaatgcttgaggctccttacaagaagacttgcctaacgatatctcacctctactcccatgaattcacctttgattccagtgtgaactgtcaatcataaggtagtaattgagtgacttatcgctgtaccgtggtcccctaggtaaaatgactcaactaagaattaccacctccagtttggtatagcaaaaaggtgaatgtagtggtttgggaaaaagcaggggtccaagaataacaaagcatgaccagtctgtggcaagttaaatcttctaatagtcttataagaagaaatgggtgagattttaaaatttatgtatctatgtaagactggtgatagtaaatcttaaaacagtccagtggcaatctgctgctcagttaataattactaaaattcttggatccctgaatagaaattaaaaaaaaaaatacaagaggcagtagagtcaatacaagcttaatacaagcttagagtaaatacaagcttagagtcacttgatgactgttttactgttctccatattgtttttatttttaattaggccctaccatagtatttcacactaaaaacaaaggaattatattggctaatatagtctttgactcatttcggtatctcagtaaaagtaaactgtcttttcattgtttcaccagttggtggtgaaaatagcagtatgcatgcattatcactggtgtcacaaactgtaagctttgtaagttagcactttactcctatagctgatgtaatcaaacttttaaacatttcactaaaccttttaatgaattcttgatagatttaaatagtgtatgtaattttgtaatgcttagactcttgaagagctactttctgttttaatgttaagattcttgtgtcttagttttttttaacatggatgtaattccatgtaaacaggtatggaagtaggaaatgtttaggctggacttggtggattattaattgactttcttgggttcttgggagtcaacattactaaagcagtgtgaatccctgtttgcttcagggcgagatgtgtgacagaggtggcatcaagctcttacagtcccaaccctccaacggaaatgggcgaagatctcaggaatggcatcggtcacaggaaatcgatagtggctggctgctagcatggccacttggggcttaggcagaaatagagccatggtactgaccaaagggaccatagcacatggaataaaactcaaaacaggacttcatgttttatggaaattatatttaaccacttcaacattgtaaatctggataacttttaatatctaaactatataagaaagtaaaatttaacatgttaatatggaaaatttttttatttttgtatcttgatgacttaaatgtaagcaacaaagtggttaaacacatacccatctaaatttttttatagccttccatgttaaactataagtaaataattagttttaaaattgttttgtattttcttattcctgttccctttaccctttgacaacttgaaatgttaccacttcgtcctcatgatgttcttctatcaaccctgcttaggatgagaacaagttgagcagtgccaacggccatgaagaacgtagcaaaaagaggaaaaaaagcaagagcagaagtcgtagtcatgaacgaaagagaagcaaaagtaaggaacggaagcgaagtagagacagagaaaggaaaaagagcaaaagccgtgaaagaaagcgaagtagaagcaaagagaggcgacggagccgctcaagaagtcgagatcgaagatttagaggccgctacagaagtccttactccggaccaaaatttaacagtgccatccgaggaaagattgggttgcctcatagcatcaaattaagcagacgacgttcccgaagcaaaagtccattcagaaaagacaagagccctgtgagagaacctattgataatttaactcctgaggaaagagatgcaaggacagtcttctgtatgcagctggcggcaagaattcgaccaagggatttggaagagagtgcctataaatgtgattccctgaacttacagctttagtaccactcagctt

SEQ ID NO: 299512 - DNA, 2850 bp, Homo sapiens
  misc_feature (27)..(27): n is a, c, g, or t
  misc_feature (34)..(34): n is a, c, g, or t
  misc_feature (47)..(47): n is a, c, g, or t
  misc_feature (56)..(56): n is a, c, g, or t
cagtcgacttactgcgcctacacctanattgaanacaccgctttgcntcagtatanaaaacggcaagtgtacgtcgatacggagcttgtcgacgctgtcgcaggggtggatcctgagctgccgaagccgccgtcctgctctcccgcgtgggcttctctaattccattgttttttttagattctctcgggcctagccgtccttggaacccgatattcgggctgggcggttccgcggcctgggcctaggggcttaacagtagcaacagaagcggcggcggcggcagcagcagcagcagcagcagcaatctcttcccgaacacgagcaccacaggcgcccgaaggccggaacaggcgtttagagaaaatggcagacgatattgatattgaagcaatgcttgaggctccttacaagaagacttgcctaacgatatctcacctctactcccatgaattcacctttgattccagtgtgaactgtcaatcataaggtagtaattgagtgacttatcgctgtaccgtggtcccctaggtaaaatgactcaactaagaattaccacctccagtttggtatagcaaaaaggtgaatgtagtggtttgggaaaaagcaggggtccaagaataacaaagcatgaccagtctgtggcaagttaaatcttctaatagtcttataagaagaaatgggtgagattttaaaatttatgtatctatgtaagactggtgatagtaaatcttaaaacagtccagtggcaatctgctgctcagttaataattactaaaattcttggatccctgaatagaaattaaaaaaaaaaatacaagaggcagtagagtcaatacaagcttaatacaagcttagagtaaatacaagcttagagtcacttgatgactgttttactgttctccatattgtttttatttttaattaggccctaccatagtatttcacactaaaaacaaaggaattatattggctaatatagtctttgactcatttcggtatctcagtaaaagtaaactgtcttttcattgtttcaccagttggtggtgaaaatagcagtatgcatgcattatcactggtgtcacaaactgtaagctttgtaagttagcactttactcctatagctgatgtaatcaaacttttaaacatttcactaaaccttttaatgaattcttgatagatttaaatagtgtatgtaattttgtaatgcttagactcttgaagagctactttctgttttaatgttaagattcttgtgtcttagttttttttaacatggatgtaattccatgtaaacaggtatggaagtaggaaatgtttaggctggacttggtggattattaattgactttcttgggttcttgggagtcaacattactaaagcagtgtgaatccctgtttgcttcagggcgagatgtgtgacagaggtggcatcaagctcttacagtcccaaccctccaacggaaatgggcgaagatctcaggaatggcatcggtcacaggaaatcgatagtggctggctgctagcatggccacttggggcttaggcagaaatagagccatggtactgaccaaagggaccatagcacatggaataaaactcaaaacaggacttcatgttttatggaaattatatttaaccacttcaacattgtaaatctggataacttttaatatctaaactatataagaaagtaaaatttaacatgttaatatggaaaatttttttatttttgtatcttgatgacttaaatgtaagcaacaaagtggttaaacacatacccatctaaatttttttatagccttccatgttaaactataagtaaataattagttttaaaattgttttgtattttcttattcctgttccctttaccctttgacaacttgaaatgttaccacttcgtcctcatgatgttcttctatcaaccctgcttaggatgagaacaagttgagcagtgccaacggccatgaagaacgtagcaaaaagaggaaaaaaagcaagagcagaagtcgtagtcatgaacgaaagagaagcaaaagtaaggaacggaagcgaagtagagacagagaaaggaaaaagagcaaaagccgtgaaagaaagcgaagtagaagcaaagagaggcgacggagccgctcaagaagtcgagatcgaagatttagaggccgctacagaagtccttactccggaccaaaatttaacagtgccatccgaggaaagattgggttgcctcatagcatcaaattaagcagacgacgttcccgaagcaaaagtccattcagaaaagacaagagccctgtgaggtagtttacttctttaaagcctttagctcttaaaaagcttttgcagcttatggtactgttaaatttgatgatatttagtaatttggaccatattaaatcttgcttttgctttcttttgcacttccagtactttaaggtcaagtgaatttctactgagttttcagtagttttcactttaatttcatataattaaagcaacagttatatatttatttatttatttatttattttgagacggagtctcactcagtcacccaggatggagtgcagtagtgcagtcttggcttactgcaacctccgcctcctgggttcaagcagttcttctacctcagccctccaagtagctgggattacaggcatgcaccaccatgcctcgctatttttttattttagtagcgatgggatttcaccatgttggctagcctagtgttgagctccggacctcagatggtccacccaccttggcctctcaaagtggtaggattgcaggtgtgagccaacacacccggccacaaaagttatttatttatgagatggagtctcgctct

SEQ ID NO: 299513 - DNA, 2377 bp, Homo sapiens
  misc_feature (27)..(27): n is a, c, g, or t
  misc_feature (34)..(34): n is a, c, g, or t
  misc_feature (47)..(47): n is a, c, g, or t
  misc_feature (56)..(56): n is a, c, g, or t
  misc_feature (2320)..(2320): n is a, c, g, or t
  misc_feature (2341)..(2341): n is a, c, g, or t
  misc_feature (2352)..(2352): n is a, c, g, or t
  misc_feature (2374)..(2374): n is a, c, g, or t
cagtcgacttactgcgcctacacctanattgaanacaccgctttgcntcagtatanaaaacggcaagtgtacgtcgatacggagcttgtcgacgctgtcgcaggggtggatcctgagctgccgaagccgccgtcctgctctcccgcgtgggcttctctaattccattgttttttttagattctctcgggcctagccgtccttggaacccgatattcgggctgggcggttccgcggcctgggcctaggggcttaacagtagcaacagaagcggcggcggcggcagcagcagcagcagcagcagcaatctcttcccgaacacgagcaccacaggcgcccgaaggccggaacaggcgtttagagaaaatggcagacgatattgatattgaagcaatgcttgaggctccttacaagaagacttgcctaacgatatctcacctctactcccatgaattcacctttgattccagtgtgaactgtcaatcataaggtagtaattgagtgacttatcgctgtaccgtggtcccctaggtaaaatgactcaactaagaattaccacctccagtttggtatagcaaaaaggtgaatgtagtggtttgggaaaaagcaggggtccaagaataacaaagcatgaccagtctgtggcaagttaaatcttctaatagtcttataagaagaaatgggtgagattttaaaatttatgtatctatgtaagactggtgatagtaaatcttaaaacagtccagtggcaatctgctgctcagttaataattactaaaattcttggatccctgaatagaaattaaaaaaaaaaatacaagaggcagtagagtcaatacaagcttaatacaagcttagagtaaatacaagcttagagtcacttgatgactgttttactgttctccatattgtttttatttttaattaggccctaccatagtatttcacactaaaaacaaaggaattatattggctaatatagtctttgactcatttcggtatctcagtaaaagtaaactgtcttttcattgtttcaccagttggtggtgaaaatagcagtatgcatgcattatcactggtgtcacaaactgtaagctttgtaagttagcactttactcctatagctgatgtaatcaaacttttaaacatttcactaaaccttttaatgaattcttgatagatttaaatagtgtatgtaattttgtaatgcttagactcttgaagagctactttctgttttaatgttaagattcttgtgtcttagttttttttaacatggatgtaattccatgtaaacaggtatggaagtaggaaatgtttaggctggacttggtggattattaattgactttcttgggttcttgggagtcaacattactaaagcagtgtgaatccctgtttgcttcagggcgagatgtgtgacagaggtggcatcaagctcttacagtcccaaccctccaacggaaatgggcgaagatctcaggaatggcatcggtcacaggaaatcgatagtggctggctgctagcatggccacttggggcttaggcagaaatagagccatggtactgaccaaagggaccatagcacatggaataaaactcaaaacaggacttcatgttttatggaaattatatttaaccacttcaacattgtaaatctggataacttttaatatctaaactatataagaaagtaaaatttaacatgttaatatggaaaatttttttatttttgtatcttgatgacttaaatgtaagcaacaaagtggttaaacacatacccatctaaatttttttatagccttccatgttaaactataagtaaataattagttttaaaattgttttgtattttcttattcctgttccctttaccctttgacaacttgaaatgttaccacttcgtcctcatgatgttcttctatcaaccctgcttaggatgagaacaagttgagcagtgccaacggccatgaagaacgtagcaaaaagaggaaaaaaagcaagagcagaagtcgtagtcatgaacgaaagagaagcaaaagtaaggaacggaagcgaagtagagacagagaaaggaaaaagagcaaaagccgtgaaagaaagcgaagtagaagcaaagagaggcgacggagccgctcaagaagtcgagatcgaagatttagaggccgctacagaagtccttactccggaccaaaatttaacagtgccatccgaggaaagattgggttgcctcatagcatcaaattaagcagacgacgttcccgaagcaaaagtccattcagaaaagacaagagccctgtgagagaacctattgattatttnactccttagaaatagattgtngaagggggatntctgagcgaatgggcatcaaancaa

SEQ ID NO: 299514 - DNA, 2946 bp, Homo sapiens
  misc_feature (27)..(27): n is a, c, g, or t
  misc_feature (34)..(34): n is a, c, g, or t
  misc_feature (47)..(47): n is a, c, g, or t
  misc_feature (56)..(56): n is a, c, g, or t
cagtcgacttactgcgcctacacctanattgaanacaccgctttgcntcagtatanaaaacggcaagtgtacgtcgatacggagcttgtcgacgctgtcgcaggggtggatcctgagctgccgaagccgccgtcctgctctcccgcgtgggcttctctaattccattgttttttttagattctctcgggcctagccgtccttggaacccgatattcgggctgggcggttccgcggcctgggcctaggggcttaacagtagcaacagaagcggcggcggcggcagcagcagcagcagcagcagcaatctcttcccgaacacgagcaccacaggcgcccgaaggccggaacaggcgtttagagaaaatggcagacgatattgatattgaagcaatgcttgaggctccttacaagaagacttgcctaacgatatctcacctctactcccatgaattcacctttgattccagtgtgaactgtcaatcataaggtagtaattgagtgacttatcgctgtaccgtggtcccctaggtaaaatgactcaactaagaattaccacctccagtttggtatagcaaaaaggtgaatgtagtggtttgggaaaaagcaggggtccaagaataacaaagcatgaccagtctgtggcaagttaaatcttctaatagtcttataagaagaaatgggtgagattttaaaatttatgtatctatgtaagactggtgatagtaaatcttaaaacagtccagtggcaatctgctgctcagttaataattactaaaattcttggatccctgaatagaaattaaaaaaaaaaatacaagaggcagtagagtcaatacaagcttaatacaagcttagagtaaatacaagcttagagtcacttgatgactgttttactgttctccatattgtttttatttttaattaggccctaccatagtatttcacactaaaaacaaaggaattatattggctaatatagtctttgactcatttcggtatctcagtaaaagtaaactgtcttttcattgtttcaccagttggtggtgaaaatagcagtatgcatgcattatcactggtgtcacaaactgtaagctttgtaagttagcactttactcctatagctgatgtaatcaaacttttaaacatttcactaaaccttttaatgaattcttgatagatttaaatagtgtatgtaattttgtaatgcttagactcttgaagagctactttctgttttaatgttaagattcttgtgtcttagttttttttaacatggatgtaattccatgtaaacaggtatggaagtaggaaatgtttaggctggacttggtggattattaattgactttcttgggttcttgggagtcaacattactaaagcagtgtgaatccctgtttgcttcagggcgagatgtgtgacagaggtggcatcaagctcttacagtcccaaccctccaacggaaatgggcgaagatctcaggaatggcatcggtcacaggaaatcgatagtggctggctgctagcatggccacttggggcttaggcagaaatagagccatggtactgaccaaagggaccatagcacatggaataaaactcaaaacaggacttcatgttttatggaaattatatttaaccacttcaacattgtaaatctggataacttttaatatctaaactatataagaaagtaaaatttaacatgttaatatggaaaatttttttatttttgtatcttgatgacttaaatgtaagcaacaaagtggttaaacacatacccatctaaatttttttatagccttccatgttaaactataagtaaataattagttttaaaattgttttgtattttcttattcctgttccctttaccctttgacaacttgaaatgttaccacttcgtcctcatgatgttcttctatcaaccctgcttaggatgagaacaagttgagcagtgccaacggccatgaagaacgtagcaaaaagaggaaaaaaagcaagagcagaagtcgtagtcatgaacgaaagagaagcaaaagtaaggaacggaagcgaagtagagacagagaaaggaaaaagagcaaaagccgtgaaagaaagcgaagtagaagcaaagagaggcgacggagccgctcaagaagtcgagatcgaagatttagaggccgctacagaagtccttactccggaccaaaatttaacagtgccatccgaggaaagattgggttgcctcatagcatcaaattaaggtttttaaacatacttctgaattgtttaaattgtttttcaaggaactaacatgctgtacttgtttggataacttctgaaactttttaactttgcagcagacgacgttcccgaagcaaaagtccattcagaaaagacaagagccctgtgaggtagtttacttctttaaagcctttagctcttaaaaagcttttgcagcttatggtactgttaaatttgatgatatttagtaatttggaccatattaaatcttgcttttgctttcttttgcacttccagtactttaaggtcaagtgaatttctactgagttttcagtagttttcactttaatttcatataattaaagcaacagttatatatttatttatttatttatttattttgagacggagtctcactcagtcacccaggatggagtgcagtagtgcagtcttggcttactgcaacctccgcctcctgggttcaagcagttcttctacctcagccctccaagtagctgggattacaggcatgcaccaccatgcctcgctatttttttattttagtagcgatgggatttcaccatgttggctagcctagtgttgagctccggacctcagatggtccacccaccttggcctctcaaagtggtaggattgcaggtgtgagccaacacacccggccacaaaagttatttatttatgagatggagtctcgctct

SEQ ID NO: 299515 - DNA, 2761 bp, Homo sapiens
  misc_feature (27)..(27): n is a, c, g, or t
  misc_feature (34)..(34): n is a, c, g, or t
  misc_feature (47)..(47): n is a, c, g, or t
  misc_feature (56)..(56): n is a, c, g, or t
cagtcgacttactgcgcctacacctanattgaanacaccgctttgcntcagtatanaaaacggcaagtgtacgtcgatacggagcttgtcgacgctgtcgcaggggtggatcctgagctgccgaagccgccgtcctgctctcccgcgtgggcttctctaattccattgttttttttagattctctcgggcctagccgtccttggaacccgatattcgggctgggcggttccgcggcctgggcctaggggcttaacagtagcaacagaagcggcggcggcggcagcagcagcagcagcagcagcaatctcttcccgaacacgagcaccacaggcgcccgaaggccggaacaggcgtttagagaaaatggcagacgatattgatattgaagcaatgcttgaggctccttacaagaagacttgcctaacgatatctcacctctactcccatgaattcacctttgattccagtgtgaactgtcaatcataaggtagtaattgagtgacttatcgctgtaccgtggtcccctaggtaaaatgactcaactaagaattaccacctccagtttggtatagcaaaaaggtgaatgtagtggtttgggaaaaagcaggggtccaagaataacaaagcatgaccagtctgtggcaagttaaatcttctaatagtcttataagaagaaatgggtgagattttaaaatttatgtatctatgtaagactggtgatagtaaatcttaaaacagtccagtggcaatctgctgctcagttaataattactaaaattcttggatccctgaatagaaattaaaaaaaaaaatacaagaggcagtagagtcaatacaagcttaatacaagcttagagtaaatacaagcttagagtcacttgatgactgttttactgttctccatattgtttttatttttaattaggccctaccatagtatttcacactaaaaacaaaggaattatattggctaatatagtctttgactcatttcggtatctcagtaaaagtaaactgtcttttcattgtttcaccagttggtggtgaaaatagcagtatgcatgcattatcactggtgtcacaaactgtaagctttgtaagttagcactttactcctatagctgatgtaatcaaacttttaaacatttcactaaaccttttaatgaattcttgatagatttaaatagtgtatgtaattttgtaatgcttagactcttgaagagctactttctgttttaatgttaagattcttgtgtcttagttttttttaacatggatgtaattccatgtaaacaggtatggaagtaggaaatgtttaggctggacttggtggattattaattgactttcttgggttcttgggagtcaacattactaaagcagtgtgaatccctgtttgcttcagggcgagatgtgtgacagaggtggcatcaagctcttacagtcccaaccctccaacggaaatgggcgaagatctcaggaatggcatcggtcacaggaaatcgatagtggctggctgctagcatggccacttggggcttaggcagaaatagagccatggtactgaccaaagggaccatagcacatggaataaaactcaaaacaggacttcatgttttatggaaattatatttaaccacttcaacattgtaaatctggataacttttaatatctaaactatataagaaagtaaaatttaacatgttaatatggaaaatttttttatttttgtatcttgatgacttaaatgtaagcaacaaagtggttaaacacatacccatctaaatttttttatagccttccatgttaaactataagtaaataattagttttaaaattgttttgtattttcttattcctgttccctttaccctttgacaacttgaaatgttaccacttcgtcctcatgatgttcttctatcaaccctgcttaggatgagaacaagttgagcagtgccaacggccatgaagaacgtagcaaaaagaggaaaaaaagcaagagcagaagtcgtagtcatgaacgaaagagaagcaaaagtaaggaacggaagcgaagtagagacagagaaaggaaaaagagcaaaagccgtgaaagaaagcgaagtagaagcaaagagaggcgacggagccgctcaagaagtcgagatcgaagatttagaggccgctacagaagtccttagtatgtaactatagttatgattttggtttgagggttattctctgggtattcagatggcagtttaacttgagtgatttgaattgtgaatttttatttttttaatgattggttaaaaagtattgaattaaggatattggcattgaatactagtaaagtgaaaatacagtgcatagacaaataagtaaaaatttgcttttactaggcatactgactattttctgttaaactatcagagtttctaaattgtatgccagtcaacgcaaactggatgaaagcactagagtgcttgaaaaagatgacattgtagtgcccaaatacctaagaaagcttaacaagtgtctgggctgttacagtatttgctaaatacatatttacttaaaattgtaaagttctgatgaatactaagttacacatgtataattagttaacagtaaataaaaagtctttgtcaccgtggctgttttcagctgaaatgtcaggccagttgtgaatttgttgtgtatgctcattgataaagatccttttttgggctcatctgtatttaaggtttgttaataataataaaaggtattccaaacta

SEQ ID NO: 299516 - DNA, 2874 bp, Homo sapiens
  misc_feature (27)..(27): n is a, c, g, or t
  misc_feature (34)..(34): n is a, c, g, or t
  misc_feature (47)..(47): n is a, c, g, or t
  misc_feature (56)..(56): n is a, c, g, or t
cagtcgacttactgcgcctacacctanattgaanacaccgctttgcntcagtatanaaaacggcaagtgtacgtcgatacggagcttgtcgacgctgtcgcaggggtggatcctgagctgccgaagccgccgtcctgctctcccgcgtgggcttctctaattccattgttttttttagattctctcgggcctagccgtccttggaacccgatattcgggctgggcggttccgcggcctgggcctaggggcttaacagtagcaacagaagcggcggcggcggcagcagcagcagcagcagcagcaatctcttcccgaacacgagcaccacaggcgcccgaaggccggaacaggcgtttagagaaaatggcagacgatattgatattgaagcaatgcttgaggctccttacaagaagacttgcctaacgatatctcacctctactcccatgaattcacctttgattccagtgtgaactgtcaatcataaggtagtaattgagtgacttatcgctgtaccgtggtcccctaggtaaaatgactcaactaagaattaccacctccagtttggtatagcaaaaaggtgaatgtagtggtttgggaaaaagcaggggtccaagaataacaaagcatgaccagtctgtggcaagttaaatcttctaatagtcttataagaagaaatgggtgagattttaaaatttatgtatctatgtaagactggtgatagtaaatcttaaaacagtccagtggcaatctgctgctcagttaataattactaaaattcttggatccctgaatagaaattaaaaaaaaaaatacaagaggcagtagagtcaatacaagcttaatacaagcttagagtaaatacaagcttagagtcacttgatgactgttttactgttctccatattgtttttatttttaattaggccctaccatagtatttcacactaaaaacaaaggaattatattggctaatatagtctttgactcatttcggtatctcagtaaaagtaaactgtcttttcattgtttcaccagttggtggtgaaaatagcagtatgcatgcattatcactggtgtcacaaactgtaagctttgtaagttagcactttactcctatagctgatgtaatcaaacttttaaacatttcactaaaccttttaatgaattcttgatagatttaaatagtgtatgtaattttgtaatgcttagactcttgaagagctactttctgttttaatgttaagattcttgtgtcttagttttttttaacatggatgtaattccatgtaaacaggtatggaagtaggaaatgtttaggctggacttggtggattattaattgactttcttgggttcttgggagtcaacattactaaagcagtgtgaatccctgtttgcttcagggcgagatgtgtgacagaggtggcatcaagctcttacagtcccaaccctccaacggaaatgggcgaagatctcaggaatggcatcggtcacaggaaatcgatagtggctggctgctagcatggccacttggggcttaggcagaaatagagccatggtactgaccaaagggaccatagcacatggaataaaactcaaaacaggacttcatgttttatggaaattatatttaaccacttcaacattgtaaatctggataacttttaatatctaaactatataagaaagtaaaatttaacatgttaatatggaaaatttttttatttttgtatcttgatgacttaaatgtaagcaacaaagtggttaaacacatacccatctaaatttttttatagccttccatgttaaactataagtaaataattagttttaaaattgttttgtattttcttattcctgttccctttaccctttgacaacttgaaatgttaccacttcgtcctcatgatgttcttctatcaaccctgcttaggatgagaacaagttgagcagtgccaacggccatgaagaacgtagcaaaaagaggaaaaaaagcaagagcagaagtcgtagtcatgaacgaaagagaagcaaaagtaaggaacggaagcgaagtagagacagagaaaggaaaaagagcaaaagccgtgaaagaaagcgaagtagaagcaaagagaggcgacggagccgctcaagaagtcgagatcgaagatttagaggccgctacagaagtccttagtatgtaactatagttatgattttggtttgagggttattctctgggtattcagatggcagtttaacttgagtgatttgaattgtgaatttttatttttttaatgattggttaaaaagtattgaattaaggatattggcattgaatactagtaaagtgaaaatacagtgcatagacaaataagtaaaaatttgcttttactaggcatactgactattttctgttaaactatcagagtttctaaattgtatgccagtcaacgcaaactggatgaaagcactagagtgcttgaaaaagatgacattgtagtgcccaaatacctaagaaagcttaacaagtgtctgggctgttacagtatttgctaaatacatatttacttaaaattgtaaagttctgatgaatactaagttacacatgtataattagttaacagtaaataaaaagtctttgtcaccgtggctgttttcagctgaaatgtcaggccagttgtgaatttgttgtgtatgctcattgataaagatccttttttgggctcatctgtatttaaggtttgttaataataataaaaggtattccaaactaaaagtgttttgaagattagatcactagaaatttggatgtggatatttaaagttggaaacaaatatattatggttattaaataactatattaaccacctacaattctaaggatt

SEQ ID NO: 299517 - DNA, 2641 bp, Homo sapiens
  misc_feature (27)..(27): n is a, c, g, or t
  misc_feature (34)..(34): n is a, c, g, or t
  misc_feature (47)..(47): n is a, c, g, or t
  misc_feature (56)..(56): n is a, c, g, or t
cagtcgacttactgcgcctacacctanattgaanacaccgctttgcntcagtatanaaaacggcaagtgtacgtcgatacggagcttgtcgacgctgtcgcaggggtggatcctgagctgccgaagccgccgtcctgctctcccgcgtgggcttctctaattccattgttttttttagattctctcgggcctagccgtccttggaacccgatattcgggctgggcggttccgcggcctgggcctaggggcttaacagtagcaacagaagcggcggcggcggcagcagcagcagcagcagcagcaatctcttcccgaacacgagcaccacaggcgcccgaaggccggaacaggcgtttagagaaaatggcagacgatattgatattgaagcaatgcttgaggctccttacaagaagacttgcctaacgatatctcacctctactcccatgaattcacctttgattccagtgtgaactgtcaatcataaggtagtaattgagtgacttatcgctgtaccgtggtcccctaggtaaaatgactcaactaagaattaccacctccagtttggtatagcaaaaaggtgaatgtagtggtttgggaaaaagcaggggtccaagaataacaaagcatgaccagtctgtggcaagttaaatcttctaatagtcttataagaagaaatgggtgagattttaaaatttatgtatctatgtaagactggtgatagtaaatcttaaaacagtccagtggcaatctgctgctcagttaataattactaaaattcttggatccctgaatagaaattaaaaaaaaaaatacaagaggcagtagagtcaatacaagcttaatacaagcttagagtaaatacaagcttagagtcacttgatgactgttttactgttctccatattgtttttatttttaattaggccctaccatagtatttcacactaaaaacaaaggaattatattggctaatatagtctttgactcatttcggtatctcagtaaaagtaaactgtcttttcattgtttcaccagttggtggtgaaaatagcagtatgcatgcattatcactggtgtcacaaactgtaagctttgtaagttagcactttactcctatagctgatgtaatcaaacttttaaacatttcactaaaccttttaatgaattcttgatagatttaaatagtgtatgtaattttgtaatgcttagactcttgaagagctactttctgttttaatgttaagattcttgtgtcttagttttttttaacatggatgtaattccatgtaaacaggtatggaagtaggaaatgtttaggctggacttggtggattattaattgactttcttgggttcttgggagtcaacattactaaagcagtgtgaatccctgtttgcttcagggcgagatgtgtgacagaggtggcatcaagctcttacagtcccaaccctccaacggaaatgggcgaagatctcaggaatggcatcggtcacaggaaatcgatagtggctggctgctagcatggccacttggggcttaggcagaaatagagccatggtactgaccaaagggaccatagcacatggaataaaactcaaaacaggacttcatgttttatggaaattatatttaaccacttcaacattgtaaatctggataacttttaatatctaaactatataagaaagtaaaatttaacatgttaatatggaaaatttttttatttttgtatcttgatgacttaaatgtaagcaacaaagtggttaaacacatacccatctaaatttttttatagccttccatgttaaactataagtaaataattagttttaaaattgttttgtattttcttattcctgttccctttaccctttgacaacttgaaatgttaccacttcgtcctcatgatgttcttctatcaaccctgcttaggatgagaacaagttgagcagtgccaacggccatgaagaacgtagcaaaaagtgagttttaagaaggggcttgggggagggtggtgagcttttttgtggttttagaccttaagttgtgttcctgtggctaaagtatacaaaattctcttctgaagcttttctttgctgcttttagaaaattggttctttgccttttgagacaaactcttggaggaactgtggatttttttgcttagatttcagaatatagtttcagataccttcccctccaagtccatcatgacaatctggtgacaagttctgtattagaggttgtcttgttttaaatttgttaactttggtttgatatttggttatcttactgataaaactgttatatatccattgatcttaaaaggtagaaagagttaaattaggtgataactaggccatggaaagtattgtttgccctaaagtgccgaaggagtcaaagctgtgaattatttctgcaacttgctgctcagaggcccttttggaagtgatggaacaggtacttaagtacttctaaaggtggctttcattatcttaggccttttaaactctagacttaacagggtggggattttggaaattatgaatatatctgtacactttatttgggtaagatgagtgactcaatagaactctgctatagactagtacagaaaacagtgtacgaaaagtctta

SEQ ID NO: 299518 - DNA, 3201 bp, Homo sapiens
  misc_feature (27)..(27): n is a, c, g, or t
  misc_feature (34)..(34): n is a, c, g, or t
  misc_feature (47)..(47): n is a, c, g, or t
  misc_feature (56)..(56): n is a, c, g, or t
cagtcgacttactgcgcctacacctanattgaanacaccgctttgcntcagtatanaaaacggcaagtgtacgtcgatacggagcttgtcgacgctgtcgcaggggtggatcctgagctgccgaagccgccgtcctgctctcccgcgtgggcttctctaattccattgttttttttagattctctcgggcctagccgtccttggaacccgatattcgggctgggcggttccgcggcctgggcctaggggcttaacagtagcaacagaagcggcggcggcggcagcagcagcagcagcagcagcaatctcttcccgaacacgagcaccacaggcgcccgaaggccggaacaggcgtttagagaaaatggcagacgatattgatattgaagcaatgcttgaggctccttacaagaagacttgcctaacgatatctcacctctactcccatgaattcacctttgattccagtgtgaactgtcaatcataaggtagtaattgagtgacttatcgctgtaccgtggtcccctaggtaaaatgactcaactaagaattaccacctccagtttggtatagcaaaaaggtgaatgtagtggtttgggaaaaagcaggggtccaagaataacaaagcatgaccagtctgtggcaagttaaatcttctaatagtcttataagaagaaatgggtgagattttaaaatttatgtatctatgtaagactggtgatagtaaatcttaaaacagtccagtggcaatctgctgctcagttaataattactaaaattcttggatccctgaatagaaattaaaaaaaaaaatacaagaggcagtagagtcaatacaagcttaatacaagcttagagtaaatacaagcttagagtcacttgatgactgttttactgttctccatattgtttttatttttaattaggccctaccatagtatttcacactaaaaacaaaggaattatattggctaatatagtctttgactcatttcggtatctcagtaaaagtaaactgtcttttcattgtttcaccagttggtggtgaaaatagcagtatgcatgcattatcactggtgtcacaaactgtaagctttgtaagttagcactttactcctatagctgatgtaatcaaacttttaaacatttcactaaaccttttaatgaattcttgatagatttaaatagtgtatgtaattttgtaatgcttagactcttgaagagctactttctgttttaatgttaagattcttgtgtcttagttttttttaacatggatgtaattccatgtaaacaggtatggaagtaggaaatgtttaggctggacttggtggattattaattgactttcttgggttcttgggagtcaacattactaaagcagtgtgaatccctgtttgcttcagggcgagatgtgtgacagaggtggcatcaagctcttacagtcccaaccctccaacggaaatgggcgaagatctcaggaatggcatcggtcacaggaaatcgatagtggctggctgctagcatggccacttggggcttaggcagaaatagagccatggtactgaccaaagggaccatagcacatggaataaaactcaaaacaggacttcatgttttatggaaattatatttaaccacttcaacattgtaaatctggataacttttaatatctaaactatataagaaagtaaaatttaacatgttaatatggaaaatttttttatttttgtatcttgatgacttaaatgtaagcaacaaagtggttaaacacatacccatctaaatttttttatagccttccatgttaaactataagtaaataattagttttaaaattgttttgtattttcttattcctgttccctttaccctttgacaacttgaaatgttaccacttcgtcctcatgatgttcttctatcaaccctgcttaggatgagaacaagttgagcagtgccaacggccatgaagaacgtagcaaaaaaatactttgcattaaaaatttagatcttcttacatggaagaggtcaaatccagttatagcaaaacacctttactgcagaggccatataaccaaaaagtccaaaggcccagcccagtggaccatttacttcagtgatgttcagtacaaaatttcactgccattaaagactttggaaagtcccttttaagttgtaacaggatttgactattagtgtggatttcgataacccttctttagttaatgtaataaatgctctttgaagctggaaatatactggtttcttgcacccttgtagttttctctgggcttttatgcaaaagattgtattttctgaatgtcttagtatgttgctgtctttttacctgcctggggttgccttcagatgtgggtgaggacttgtttacaaaaagtcctagaagaccttaagttaaaattagctctccaattttcaagtgttttcttttggcagaataagttttgggtcctatgagaggtaaataggttggttgcctctcttgctatagcccatctagagcagaacaaaaactttgtttttgagggggatggagttactttttaccttgttccctaattgaatatatttaggacttttggttttagaaatctcagagttctatagttggaatagtgtcacagagatagtgttaggtttcttaggcaacaaaattggagtgttacctattgcccatctgggcatggctttgatgagttctatataaataatgagtgtagcctaattttctgtcatgtgctacctagcatatacatttctgacagtcaggtggattatcttgaaattttagacaaactttctgcctccttggaaagctctacatctccttgtgattggagtgtgggtttcaagattccagaaggtgggtgtcttcattttctattttcaatgcactctaaagatgacctgcttacaggttctctgaggcagacctcagttgctcttgtgatatgtaactttgctttgataaggaataaacaattacatatccagataatgatacagaattgtcaaaatgtttaatcattaagccactacaaatagacattttcgtggaataaactgattttgaaatgtctttcaatttatattgaaatatctgaaggcacctctaaaatttgggtgatgacacagaggtatagattataagatttaattatgaatgggtggtatactgtgaa

SEQ ID NO: 299519 - DNA, 1331 bp, Homo sapiens
  misc_feature (27)..(27): n is a, c, g, or t
  misc_feature (34)..(34): n is a, c, g, or t
  misc_feature (47)..(47): n is a, c, g, or t
  misc_feature (56)..(56): n is a, c, g, or t
  misc_feature (1312)..(1312): n is a, c, g, or t
cagtcgacttactgcgcctacacctanattgaanacaccgctttgcntcagtatanaaaacggcaagtgtacgtcgatacggagcttgtcgacgctgtcgcaggggtggatcctgagctgccgaagccgccgtcctgctctcccgcgtgggcttctctaattccattgttttttttagattctctcgggcctagccgtccttggaacccgatattcgggctgggcggttccgcggcctgggcctaggggcttaacagtagcaacagaagcggcggcggcggcagcagcagcagcagcagcagcaatctcttcccgaacacgagcaccacaggcgcccgaaggccggaacaggcgtttagagaaaatggcagacgatattgatattgaagcaatgcttgaggctccttacaagaagacttgcctaacgatatctcacctctactcccatgaattcacctttgattccagtgtgaactgtcaatcataaggtagtaattgagtgacttatcgctgtaccgtggtcccctaggtaaaatgactcaactaagaattaccacctccagtttggtatagcaaaaaggtgaatgtagtggtttgggaaaaagcaggggtccaagaataacaaagcatgaccagtctgtggcaagttaaatcttctaatagtcttataagaagaaatgggtgagattttaaaatttatgtatctatgtaagactggtgatagtaaatcttaaaacagtccagtggcaatctgctgctcagttaataattactaaaattcttggatccctgaatagaaattaaaaaaaaaaatacaagaggcagtagagtcaatacaagcttaatacaagcttagagtaaatacaagcttagagtcacttgatgactgttttactgttctccatattgtttttatttttaattaggccctaccatagtatttcacactaaaaacaaaggaattatattggctaatatagtctttgactcatttcggtatctcagtaaaagtaaactgtcttttcattgtttcaccagttggtggtgaaaatagcagtatgcatgcattatcactggtgtcacaaactgtaagctttgtaagttagcactttactcctatagctgatgtaatcaaacttttaaacatttcactaaaccttttaatgaattcttgatagatttaaatagtgtatgtaattttgtaatgcttagactcttgaagagctactttctgttttaatgttaagattcttgtgtcttagttttttttaacatggatgtaattccatgtaaacaggtatggaagtggtgnttggccccctccccccccc

SEQ ID NO: 299520 - DNA, 1332 bp, Homo sapiens
  misc_feature (27)..(27): n is a, c, g, or t
  misc_feature (34)..(34): n is a, c, g, or t
  misc_feature (47)..(47): n is a, c, g, or t
  misc_feature (56)..(56): n is a, c, g, or t
cagtcgacttactgcgcctacacctanattgaanacaccgctttgcntcagtatanaaaacggcaagtgtacgtcgatacggagcttgtcgacgctgtcgcaggggtggatcctgagctgccgaagccgccgtcctgctctcccgcgtgggcttctctaattccattgttttttttagattctctcgggcctagccgtccttggaacccgatattcgggctgggcggttccgcggcctgggcctaggggcttaacagtagcaacagaagcggcggcggcggcagcagcagcagcagcagcagcaatctcttcccgaacacgagcaccacaggcgcccgaaggccggaacaggcgtttagagaaaatggcagacgatattgatattgaagcaatgcttgaggctccttacaagaagacttgcctaacgatatctcacctctactcccatgaattcacctttgattccagtgtgaactgtcaatcataaggtagtaattgagtgacttatcgctgtaccgtggtcccctaggtaaaatgactcaactaagaattaccacctccagtttggtatagcaaaaaggtgaatgtagtggtttgggaaaaagcaggggtccaagaataacaaagcatgaccagtctgtggcaagttaaatcttctaatagtcttataagaagaaatgggtgagattttaaaatttatgtatctatgtaagactggtgatagtaaatcttaaaacagtccagtggcaatctgctgctcagttaataattactaaaattcttggatccctgaatagaaattaaaaaaaaaaatacaagaggcagtagagtcaatacaagcttaatacaagcttagagtaaatacaagcttagagtcacttgatgactgttttactgttctccatattgtttttatttttaattaggccctaccatagtatttcacactaaaaacaaaggaattatattggctaatatagtctttgactcatttcggtatctcagtaaaagtaaactgtcttttcattgtttcaccagttggtggtgaaaatagcagtatgcatgcattatcactggtgtcacaaactgtaagctttgtaagttagcactttactcctatagctgatgtaatcaaacttttaaacatttcactaaaccttttaatgaattcttgatagatttaaatagtgtatgtaattttgtaatgcttagactcttgaagagctactttctgcctcaatgcccattctctctcgccccacctcttctccccaccctcgcctctctcccctctccccccccccccctcctcctcccccctcctccccctcc

SEQ ID NO: 299521 - DNA, 803 bp, Homo sapiens
  misc_feature (27)..(27): n is a, c, g, or t
  misc_feature (34)..(34): n is a, c, g, or t
  misc_feature (47)..(47): n is a, c, g, or t
  misc_feature (56)..(56): n is a, c, g, or t
cagtcgacttactgcgcctacacctanattgaanacaccgctttgcntcagtatanaaaacggcaagtgtacgtcgatacggagcttgtcgacgctgtcgcaggggtggatcctgagctgccgaagccgccgtcctgctctcccgcgtgggcttctctaattccattgttttttttagattctctcgggcctagccgtccttggaacccgatattcgggctgggcggttccgcggcctgggcctaggggcttaacagtagcaacagaagcggcggcggcggcagcagcagcagcagcagcagcaatctcttcccgaacacgagcaccacaggcgcccgaaggccggaacaggcgtttagagaaaatggcagacgatattgatattgaagcaatgcttgaggctccttacaagaagacttgcctaacgatatctcacctctactcccatgaattcacctttgattccagtgtgaactgtcaatcataaggtagtaattgagtgacttatcgctgtaccgtggtcccctaggtaaaatgactcaactaagaattaccacctccagtttggtatagcaaaaaggtgaatgtagtggtttgggaaaaagcaggggtccaagaataacaaagcatgaccagtctgtggcaagttaaatcttctaatagtcttataagaagaaatgggtgagattttaaaatttatgtatctatgtaagactggtgatagtaaatcttaaaacagtccagtggcaatctgctgctcagttaataattactaaaattcttggatccctgaatagaaatta

SEQ ID NO: 299522 - DNA, 1027 bp, Homo sapiens
  misc_feature (27)..(27): n is a, c, g, or t
  misc_feature (34)..(34): n is a, c, g, or t
  misc_feature (47)..(47): n is a, c, g, or t
  misc_feature (56)..(56): n is a, c, g, or t
cagtcgacttactgcgcctacacctanattgaanacaccgctttgcntcagtatanaaaacggcaagtgtacgtcgatacggagcttgtcgacgctgtcgcaggggtggatcctgagctgccgaagccgccgtcctgctctcccgcgtgggcttctctaattccattgttttttttagattctctcgggcctagccgtccttggaacccgatattcgggctgggcggttccgcggcctgggcctaggggcttaacagtagcaacagaagcggcggcggcggcagcagcagcagcagcagcagcaatctcttcccgaacacgagcaccacaggcgcccgaaggccggaacaggcgtttagagaaaatggcagacgatattgatattgaagcaatgcttgaggctccttacaagaaggtgagaaaaaacatgtcggtgaggtttatatatttcttaatttagcattattcacgaaactactgctgaaatgtaaactaacctccccggagccctcttgatttatcttatcagagatgcattacgtgtaacttacaaaagtaaatatatgctattgatgtaataatattgtgcagtagtttcacttcagcgtgatgaataaatgcccatctatctctctttgtacttgcctaacgatatctcacctctactcccatgaattcacctttgattccagtgtgaactgtcaatcataaggtagtaattgagtgacttatcgctgtaccgtggtcccctaggtaaaatgactcaactaagaattaccacctccagtttggtatagcaaaaaggtgaatgtagtggtttgggaaaaagcaggggtccaagaataacaaagcatgaccagtctgtggcaagttaaatcttctaatagtcttataagaagaaatgggtgagattttaaaatttatgtatctatgtaagactggtgatagtaaatcttaaaacagtccagtggcaatctgctgctcagttaataattactaaaattcttggatccctgaatagaaatta

SEQ ID NO: 299523 - DNA, 1036 bp, Homo sapiens
agtttcgcgctaaatgccggcgccgttactgcccccgtgtttattttttcgcccccaattgtgtccccgcgtaaaacaaaggggcgaccatattttcaacggccaggcccgaagccacagctagaaagcagctattattacagctggctcttcagaagactctacgatttccctcactcctgatccttgaatcagggaacgtcaatcataggatgagaacaagttgagcagtgccaacggccatgaagaacgtagcaaaaagaggaaaaaaagcaagagcagaagtcgtagtcatgaacgaaagagaagcaaaagtaaggaacggaagcgaagtagagacagagaaaggaaaaagagcaaaagccgtgaaagaaagcgaagtagaagcaaagagaggcgacggagccgctcaagaagtcgagatcgaagatttagaggccgctacagaagtccttagtatgtaactatagttatgattttggtttgagggttattctctgggtattcagatggcagtttaacttgagtgatttgaattgtgaatttttatttttttaatgattggttaaaaagtattgaattaaggatattggcattgaatactagtaaagtgaaaatacagtgcatagacaaataagtaaaaatttgcttttactaggcatactgactattttctgttaaactatcagagtttctaaattgtatgccagtcaacgcaaactggatgaaagcactagagtgcttgaaaaagatgacattgtagtgcccaaatacctaagaaagcttaacaagtgtctgggctgttacagtatttgctaaatacatatttacttaaaattgtaaagttctgatgaatactaagttacacatgtataattagttaacagtaaataaaaagtctttgtcaccgtggctgttttcagctgaaatgtcaggccagttgtgaatttgttgtgtatgctcattgataaagatccttttttgggctcatctgtatttaaggtttgttaataataataaaaggtattccaaacta

SEQ ID NO: 299524 - DNA, 324 bp, Homo sapiens
taaacataacttgggtccattttgcatacagcaacatctttaccttttttttcattttttctgtagggcaatgtgtatgtgaagtgcccatcaattgctgcagctattgctgctgtcaatgcattgcatggcaggtggtttgctggtgagtttgaatttattttttgactgattgttattaaggctctataatgaagatgctaaacccaacatgtctgtttcttttaataggtaaaatgataacagcagcatatgtacctcttccaacttaccacaacctgtttcctgattctatgacagcaacacagctactggttccaagta

SEQ ID NO: 299525 - DNA, 3599 bp, Homo sapiens
aacgctttttgaattgaattttttaaaatgcatgtattccttttcaaactaaaatgatttttaagcacacaaaagagaatcaaaggctgagaaacaatgatttcacacactatgtttgcaagaacaagttattcccaaagcaattcctacaggttctgcacctgtgttgcttttataaagcaagcacagcgtaatgtgtaagcactattgtcctgaatgctttatccatgaaggtacgtgttaaggatccataactggtagaagggcgtttaaaacgcttttttttcttttaaagagacagggtctcactatgttgcccaggctgctctcttaactacgaggctcggagtcaggaatggagagaagggtaatggttttacctcttattgtggaaacctgttgagatcacagagaatatactgacggcataaaagggcagaaccatagcagggtgcgcgctgctgtagttgccttccatggatctataggagagcaagtcctccaggagaagaagtcctcaccagtgaacggagacctctctgaactaaggataccatggccacgtcagccccactacggagcctggaagaggaggtgacctgctccatctgtcttgattacctgcgggaccctgtgaccattgactgtggccacgtcttctgccgcagctgcaccacagacgtccgccccatctcagggagccgccccgtctgcccactctgcaagaagccttttaagaaggagaacatccgacccgtgtggcaactggccagcctggtggagaacattgagcggctgaaggtggacaagggcaggcagccgggagaggtgacccgggagcagcaggatgcaaagttgtgcgagcgacaccgagagaagctgcactactactgtgaggacgacgggaagctgctgtgcgtgatgtgccgggagtcccgggagcacaggccccacacggccgtcctcatggagaaggccgcccagccccacagggaaaaaatcctgaaccacctgagtaccctaaggagggacagagacaaaattcagggcttccaggcaaagggagaagctgatatcctggccgcgctgaagaagctccaggaccagaggcagtacattgtggctgagtttgagcagggtcatcagttcctgagggagcgggaggaacacctgctggaacagctggcgaagctggagcaggagctcacggagggcagggagaagttcaagagccggggcgtcggggagcttgcccggctggccctggtcatctccgaactggagggcaaggcgcagcagccagctgcagagctcatgcaggacacgagagacttcctaaacaggtatccacggaagaagttctgggttgggaaacccattgctcgagtggttaaaaaaaagaccggagaattctcagataaactcctctctctgcaacgaggcctgagggaattccaggggaagctgctgagagacttggaatataagacagtgagcgtcaccctggacccacagtcggccagtgggtacctgcagctgtcagaggactggaagtgcgtgacctacaccagcctgtacaagagtgcctacctgcacccccagcagtttgactgtgagcctggggtgctaggcagcaagggcttcacctggggcaaggtctactgggaagtggaagtggagagggagggctggtctgaggatgaagaagagggggatgaggaggaagagggagaagaggaggaggaggaagaggaggccggctatggggatggatatgacgactgggaaacggacgaagatgaggaatcgttgggcgatgaagaggaagaagaggaggaggaagaggaggaagttctggaaagctgcatggtgggggtggctagagactctgtgaagaggaagggagacctctccctgcggccagaggatggcgtgtgggcgctgcgcctctcctcctccggcatctgggccaacaccagccccgaggctgagcttttcccagcactgcggccccggagagtgggcatcgccctggattatgaagggggcaccgtgactttcaccaacgcagagtcacaggaactcatctacaccttcactgccaccttcacccggcgcctggtccccttcctgtggctcaagtggccaggaacacgcctcctgctaagaccctgagccctgacatctgcccccagccccaaccctcagatgcttcacttctttggaattccaggactctcaatggggggacgggatgcctggcctaagcacctggagcaggggaccccatatccactggtagccacctccccattgctgtggccccctgaaatctcactcagtgctgttgctccatctactgccctaatggggctcttttcccacctcctgctggtttcccgagggaacttctgaccctggagtccatgagggctcctttcctttttgaccacgaccttggccccagctctgcactctctggaataagggcccgatgcagcattttcttgcccagtgtggcaagacctcagaaaaaccagtcaattacgcctaagatcattttgctgtccttaaaccccccaggttccttcttgcacaaatccactctgctgcccaccttccctggcattttaaacagacctaccccaccccaactcagagttaagcatacatggcaatgctgaaaataaacaaaatccactgaggcttcccaggccatttaaagcctggagtaccagcgcatatcatctcatggggtccagagtggagtccaggcttctctgaaaccagggctgagcatatttccatagccaaggaggtgggactccctggagctatctgtggtcttagggaaggatccagacatacacggctttggggtacaagctgtgatcactgatcaataaattatctctagattggtccttgtgaggggagttttaagaatccagaacatcttgctcttgatcagcacatccaaaaacaccaagacaaacatccagtggagcagaacctctcctgcctcgggagttctgaccgggttccccagcagggtgttaagcctctgtctctggccctaccagcatccaggttccactttcctaggagagagtggagatgggaagacagggaaaggaaggcagcaggaggccacaagcccaccaggtcttcatgtcaagagagggagtaacatgtcttctcattgcccacggacccaacctctgtccaggtgcccctcatcatcacagtttaacacaagctcccctgctccagccaaattgatctcccagtcttgtccttacccattccaagtgctctgccagcccctgttcatccaagttttaagtcctccaccctgttctaagagactgttccaacggctctgggcctcagtggtcacttgaccaccattgtctcagagctgcccactttgtgtgtgtcacatgctgcctgagtcacatgtacatcttatttctgcctctagttttgtaagctcctggagggcggataacatcttatactactcttgtattctcatggcacctagtgcagtgctgggcacagagtaggtgctcaataaagacttgttgaatgaacag

SEQ ID NO: 299526 - DNA, 917 bp, Homo sapiens
aggaggaccgtgcatgtagggattcgcggccggagctcgggaccggagtcaggaatggagagaagggtaatggttttacctcttattgtggaaacctgttgagatcacagagaatatactgacggcataaaagggcagaaccatagcagggtgcggttgcttcattccagcctcgcagtcacctctgtgccctgctggttgtcttcccagcgctgctgtagttgccttccatggatctataggagagcaagtcctccaggagctggtggtgtctgtcgattgactgagtgctggagctggcagccctgtgcaggctgccacctttgcccctttactgtgcttgctcctgactctatgtcgcgtctccaaggagaagaagtcctcaccagtgaacggagacctctctgaactaaggataccatggccacgtcagccccactacggagcctggaagaggaggtgacctgctccatctgtcttgattacctgcgggaccctgtgaccattgactgtggccacgtcttctgccgcagctgcaccacagacgtccgccccatctcagggagccgccccgtctgcccactctgcaagaagccttttaagaaggagaacatccgacccgtgtggcaactggccagcctggtggagaacattgagcggctgaaggtggacaagggcaggcagccgggagaggtgacccgggagcagcaggatgcaaagttgtgcgagcgacaccgagagaagctgcactactactgtgaggacgacgggaagctgctgtgcgtgatgtgccgggagtcccgggagcacaggccccacacggccgtcctcatggagaaggccgcccagccccacaggaacatctgacacctgatactcatggggacaagacaacacggctcccgcaagagaccacc

SEQ ID NO: 299527 - DNA, 522 bp, Homo sapiens
gcaggagcgggacccggaacagaccgccgtgagagaggaggggtgccggccgggattcgcggcccggagctcgggaccggagtcaggaatggagagaagggtaatggttttacctcttattgtggaaacctgttgagatcacagagaatatactgacggcataaaagggcagaaccatagcagggtgcggttgcttcattccagcctcgcagtcacctctgtgccctgctggttgtcttcccagcgctgctgtagttgccttccatggatctataggagagcaagtcctccaggttccaacggctctgggcctcagtggtcacttgaccaccattgtctcagagctgcccactttgtgtgtgtcacatgctgcctgagtcacatgtacatcttatttctgcctctagttttgtaagctcctggagggcggataacatcttatactactcttgtattctcatggcacctagtgcagtgctgggcacagagtaggtgctcaataaagacttgttgaatgaacag

SEQ ID NO: 299528 - DNA, 3387 bp, Homo sapiens
gcaggagcgggacccggaacagaccgccgtgagagaggaggggtgccggccgggattcgcggcccggagctcgggaccggagtcaggaatggagagaagggtaatggttttacctcttattgtggaaacctgttgagatcacagagaatatactgacggcataaaagggcagaaccatagcagggtgcggttgcttcattccagcctcgcagtcacctctgtgccctgctggttgtcttcccagcgctgctgtagttgccttccatggatctataggagagcaagtcctccaggagaagaagtcctcaccagtgaacggagacctctctgaactaaggataccatggccacgtcagccccactacggagcctggaagaggaggtgacctgctccatctgtcttgattacctgcgggaccctgtgaccattgactgtggccacgtcttctgccgcagctgcaccacagacgtccgccccatctcagggagccgccccgtctgcccactctgcaagaagccttttaagaaggagaacatccgacccgtgtggcaactggccagcctggtggagaacattgagcggctgaaggtggacaagggcaggcagccgggagaggtgacccgggagcagcaggatgcaaagttgtgcgagcgacaccgagagaagctgcactactactgtgaggacgacgggaagctgctgtgcgtgatgtgccgggagtcccgggagcacaggccccacacggccgtcctcatggagaaggccgcccagccccacagggaaaaaatcctgaaccacctgagtaccctaaggagggacagagacaaaattcagggcttccaggcaaagggagaagctgatatcctggccgcgctgaagaagctccaggaccagaggcagtacattgtggctgagtttgagcagggtcatcagttcctgagggagcgggaggaacacctgctggaacagctggcgaagctggagcaggagctcacggagggcagggagaagttcaagagccggggcgtcggggagcttgcccggctggccctggtcatctccgaactggagggcaaggcgcagcagccagctgcagagctcatgcaggacacgagagacttcctaaacaggtatccacggaagaagttctgggttgggaaacccattgctcgagtggttaaaaaaaagaccggagaattctcagataaactcctctctctgcaacgaggcctgagggaattccaggggaagctgctgagagacttggaatataagacagtgagcgtcaccctggacccacagtcggccagtgggtacctgcagctgtcagaggactggaagtgcgtgacctacaccagcctgtacaagagtgcctacctgcacccccagcagtttgactgtgagcctggggtgctaggcagcaagggcttcacctggggcaaggtctactgggaagtggaagtggagagggagggctggtctgaggatgaagaagagggggatgaggaggaagagggagaagaggaggaggaggaagaggaggccggctatggggatggatatgacgactgggaaacggacgaagatgaggaatcgttgggcgatgaagaggaagaagaggaggaggaagaggaggaagttctggaaagctgcatggtgggggtggctagagactctgtgaagaggaagggagacctctccctgcggccagaggatggcgtgtgggcgctgcgcctctcctcctccggcatctgggccaacaccagccccgaggctgagcttttcccagcactgcggccccggagagtgggcatcgccctggattatgaagggggcaccgtgactttcaccaacgcagagtcacaggaactcatctacaccttcactgccaccttcacccggcgcctggtccccttcctgtggctcaagtggccaggaacacgcctcctgctaagaccctgagccctgacatctgcccccagccccaaccctcagatgcttcacttctttggaattccaggactctcaatggggggacgggatgcctggcctaagcacctggagcaggggaccccatatccactggtagccacctccccattgctgtggccccctgaaatctcactcagtgctgttgctccatctactgccctaatggggctcttttcccacctcctgctggtttcccgagggaacttctgaccctggagtccatgagggctcctttcctttttgaccacgaccttggccccagctctgcactctctggaataagggcccgatgcagcattttcttgcccagtgtggcaagacctcagaaaaaccagtcaattacgcctaagatcattttgctgtccttaaaccccccaggttccttcttgcacaaatccactctgctgcccaccttccctggcattttaaacagacctaccccaccccaactcagagttaagcatacatggcaatgctgaaaataaacaaaatccactgaggcttcccaggccatttaaagcctggagtaccagcgcatatcatctcatggggtccagagtggagtccaggcttctctgaaaccagggctgagcatatttccatagccaaggaggtgggactccctggagctatctgtggtcttagggaaggatccagacatacacggctttggggtacaagctgtgatcactgatcaataaattatctctagattggtccttgtgaggggagttttaagaatccagaacatcttgctcttgatcagcacatccaaaaacaccaagacaaacatccagtggagcagaacctctcctgcctcgggagttctgaccgggttccccagcagggtgttaagcctctgtctctggccctaccagcatccaggttccactttcctaggagagagtggagatgggaagacagggaaaggaaggcagcaggaggccacaagcccaccaggtcttcatgtcaagagagggagtaacatgtcttctcattgcccacggacccaacctctgtccaggtgcccctcatcatcacagtttaacacaagctcccctgctccagccaaattgatctcccagtcttgtccttacccattccaagtgctctgccagcccctgttcatccaagttttaagtcctccaccctgttctaagagactgttccaacggctctgggcctcagtggtcacttgaccaccattgtctcagagctgcccactttgtgtgtgtcacatgctgcctgagtcacatgtacatcttatttctgcctctagttttgtaagctcctggagggcggataacatcttatactactcttgtattctcatggcacctagtgcagtgctgggcacagagtaggtgctcaataaagacttgttgaatgaacag

SEQ ID NO: 299529 - DNA, 3139 bp, Homo sapiens
gcccggaagctcggggaccgggaagaaagaaagtcctccaaccaagtgaaaacggaaggaccctctctgaaaccttaaagcggaattaacccaatgtgcccacgtcagccccactacggagcctggaagaggaggtgacctgctccatctgtcttgattacctgcgggaccctgtgaccattgactgtggccacgtcttctgccgcagctgcaccacagacgtccgccccatctcagggagccgccccgtctgcccactctgcaagaagccttttaagaaggagaacatccgacccgtgtggcaactggccagcctggtggagaacattgagcggctgaaggtggacaagggcaggcagccgggagaggtgacccgggagcagcaggatgcaaagttgtgcgagcgacaccgagagaagctgcactactactgtgaggacgacgggaagctgctgtgcgtgatgtgccgggagtcccgggagcacaggccccacacggccgtcctcatggagaaggccgcccagccccacagggaaaaaatcctgaaccacctgagtaccctaaggagggacagagacaaaattcagggcttccaggcaaagggagaagctgatatcctggccgcgctgaagaagctccaggaccagaggcagtacattgtggctgagtttgagcagggtcatcagttcctgagggagcgggaggaacacctgctggaacagctggcgaagctggagcaggagctcacggagggcagggagaagttcaagagccggggcgtcggggagcttgcccggctggccctggtcatctccgaactggagggcaaggcgcagcagccagctgcagagctcatgcaggacacgagagacttcctaaacaggtatccacggaagaagttctgggttgggaaacccattgctcgagtggttaaaaaaaagaccggagaattctcagataaactcctctctctgcaacgaggcctgagggaattccaggggaagctgctgagagacttggaatataagacagtgagcgtcaccctggacccacagtcggccagtgggtacctgcagctgtcagaggactggaagtgcgtgacctacaccagcctgtacaagagtgcctacctgcacccccagcagtttgactgtgagcctggggtgctaggcagcaagggcttcacctggggcaaggtctactgggaagtggaagtggagagggagggctggtctgaggatgaagaagagggggatgaggaggaagagggagaagaggaggaggaggaagaggaggccggctatggggatggatatgacgactgggaaacggacgaagatgaggaatcgttgggcgatgaagaggaagaagaggaggaggaagaggaggaagttctggaaagctgcatggtgggggtggctagagactctgtgaagaggaagggagacctctccctgcggccagaggatggcgtgtgggcgctgcgcctctcctcctccggcatctgggccaacaccagccccgaggctgagcttttcccagcactgcggccccggagagtgggcatcgccctggattatgaagggggcaccgtgactttcaccaacgcagagtcacaggaactcatctacaccttcactgccaccttcacccggcgcctggtccccttcctgtggctcaagtggccaggaacacgcctcctgctaagaccctgagccctgacatctgcccccagccccaaccctcagatgcttcacttctttggaattccaggactctcaatggggggacgggatgcctggcctaagcacctggagcaggggaccccatatccactggtagccacctccccattgctgtggccccctgaaatctcactcagtgctgttgctccatctactgccctaatggggctcttttcccacctcctgctggtttcccgagggaacttctgaccctggagtccatgagggctcctttcctttttgaccacgaccttggccccagctctgcactctctggaataagggcccgatgcagcattttcttgcccagtgtggcaagacctcagaaaaaccagtcaattacgcctaagatcattttgctgtccttaaaccccccaggttccttcttgcacaaatccactctgctgcccaccttccctggcattttaaacagacctaccccaccccaactcagagttaagcatacatggcaatgctgaaaataaacaaaatccactgaggcttcccaggccatttaaagcctggagtaccagcgcatatcatctcatggggtccagagtggagtccaggcttctctgaaaccagggctgagcatatttccatagccaaggaggtgggactccctggagctatctgtggtcttagggaaggatccagacatacacggctttggggtacaagctgtgatcactgatcaataaattatctctagattggtccttgtgaggggagttttaagaatccagaacatcttgctcttgatcagcacatccaaaaacaccaagacaaacatccagtggagcagaacctctcctgcctcgggagttctgaccgggttccccagcagggtgttaagcctctgtctctggccctaccagcatccaggttccactttcctaggagagagtggagatgggaagacagggaaaggaaggcagcaggaggccacaagcccaccaggtcttcatgtcaagagagggagtaacatgtcttctcattgcccacggacccaacctctgtccaggtgcccctcatcatcacagtttaacacaagctcccctgctccagccaaattgatctcccagtcttgtccttacccattccaagtgctctgccagcccctgttcatccaagttttaagtcctccaccctgttctaagagactgttccaacggctctgggcctcagtggtcacttgaccaccattgtctcagagctgcccactttgtgtgtgtcacatgctgcctgagtcacatgtacatcttatttctgcctctagttttgtaagctcctggagggcggataacatcttatactactcttgtattctcatggcacctagtgcagtgctgggcacagagtaggtgctcaataaagacttgttgaatgaacag

SEQ ID NO: 299530 - DNA, 3464 bp, Homo sapiens
aggaggaccgtgcatgtagggattcgcggccggagctcgggaccggagtcaggaatggagagaagggtaatggttttacctcttattgtggaaacctgttgagatcacagagaatatactgacggcataaaagggcagaaccatagcagggtgcggttgcttcattccagcctcgcagtcacctctgtgccctgctggttgtcttcccagcgctgctgtagttgccttccatggatctataggagagcaagtcctccaggagctggtggtgtctgtcgattgactgagtgctggagctggcagccctgtgcaggctgccacctttgcccctttactgtgcttgctcctgactctatgtcgcgtctccaaggagaagaagtcctcaccagtgaacggagacctctctgaactaaggataccatggccacgtcagccccactacggagcctggaagaggaggtgacctgctccatctgtcttgattacctgcgggaccctgtgaccattgactgtggccacgtcttctgccgcagctgcaccacagacgtccgccccatctcagggagccgccccgtctgcccactctgcaagaagccttttaagaaggagaacatccgacccgtgtggcaactggccagcctggtggagaacattgagcggctgaaggtggacaagggcaggcagccgggagaggtgacccgggagcagcaggatgcaaagttgtgcgagcgacaccgagagaagctgcactactactgtgaggacgacgggaagctgctgtgcgtgatgtgccgggagtcccgggagcacaggccccacacggccgtcctcatggagaaggccgcccagccccacagggaaaaaatcctgaaccacctgagtaccctaaggagggacagagacaaaattcagggcttccaggcaaagggagaagctgatatcctggccgcgctgaagaagctccaggaccagaggcagtacattgtggctgagtttgagcagggtcatcagttcctgagggagcgggaggaacacctgctggaacagctggcgaagctggagcaggagctcacggagggcagggagaagttcaagagccggggcgtcggggagcttgcccggctggccctggtcatctccgaactggagggcaaggcgcagcagccagctgcagagctcatgcaggacacgagagacttcctaaacaggtatccacggaagaagttctgggttgggaaacccattgctcgagtggttaaaaaaaagaccggagaattctcagataaactcctctctctgcaacgaggcctgagggaattccaggggaagctgctgagagacttggaatataagacagtgagcgtcaccctggacccacagtcggccagtgggtacctgcagctgtcagaggactggaagtgcgtgacctacaccagcctgtacaagagtgcctacctgcacccccagcagtttgactgtgagcctggggtgctaggcagcaagggcttcacctggggcaaggtctactgggaagtggaagtggagagggagggctggtctgaggatgaagaagagggggatgaggaggaagagggagaagaggaggaggaggaagaggaggccggctatggggatggatatgacgactgggaaacggacgaagatgaggaatcgttgggcgatgaagaggaagaagaggaggaggaagaggaggaagttctggaaagctgcatggtgggggtggctagagactctgtgaagaggaagggagacctctccctgcggccagaggatggcgtgtgggcgctgcgcctctcctcctccggcatctgggccaacaccagccccgaggctgagcttttcccagcactgcggccccggagagtgggcatcgccctggattatgaagggggcaccgtgactttcaccaacgcagagtcacaggaactcatctacaccttcactgccaccttcacccggcgcctggtccccttcctgtggctcaagtggccaggaacacgcctcctgctaagaccctgagccctgacatctgcccccagccccaaccctcagatgcttcacttctttggaattccaggactctcaatggggggacgggatgcctggcctaagcacctggagcaggggaccccatatccactggtagccacctccccattgctgtggccccctgaaatctcactcagtgctgttgctccatctactgccctaatggggctcttttcccacctcctgctggtttcccgagggaacttctgaccctggagtccatgagggctcctttcctttttgaccacgaccttggccccagctctgcactctctggaataagggcccgatgcagcattttcttgcccagtgtggcaagacctcagaaaaaccagtcaattacgcctaagatcattttgctgtccttaaaccccccaggttccttcttgcacaaatccactctgctgcccaccttccctggcattttaaacagacctaccccaccccaactcagagttaagcatacatggcaatgctgaaaataaacaaaatccactgaggcttcccaggccatttaaagcctggagtaccagcgcatatcatctcatggggtccagagtggagtccaggcttctctgaaaccagggctgagcatatttccatagccaaggaggtgggactccctggagctatctgtggtcttagggaaggatccagacatacacggctttggggtacaagctgtgatcactgatcaataaattatctctagattggtccttgtgaggggagttttaagaatccagaacatcttgctcttgatcagcacatccaaaaacaccaagacaaacatccagtggagcagaacctctcctgcctcgggagttctgaccgggttccccagcagggtgttaagcctctgtctctggccctaccagcatccaggttccactttcctaggagagagtggagatgggaagacagggaaaggaaggcagcaggaggccacaagcccaccaggtcttcatgtcaagagagggagtaacatgtcttctcattgcccacggacccaacctctgtccaggtgcccctcatcatcacagtttaacacaagctcccctgctccagccaaattgatctcccagtcttgtccttacccattccaagtgctctgccagcccctgttcatccaagttttaagtcctccaccctgttctaagagactgttccaacggctctgggcctcagtggtcacttgaccaccattgtctcagagctgcccactttgtgtgtgtcacatgctgcctgagtcacatgtacatcttatttctgcctctagttttgtaagctcctggagggcggataacatcttatactactcttgtattctcatggcacctagtgcagtgctgggcacagagtaggtgctcaataaagacttgttgaatgaacag

SEQ ID NO: 299531 - DNA, 2572 bp, Homo sapiens
ctatgtcatggcgggtgcctcctgagaggttgcatgataatctccgaagtatcttccatctcaagaagctccaggaccagaggcagtacattgtggctgagtttgagcagggtcatcagttcctgagggagcgggaggaacacctgctggaacagctggcgaagctggagcaggagctcacggagggcagggagaagttcaagagccggggcgtcggggagcttgcccggctggccctggtcatctccgaactggagggcaaggcgcagcagccagctgcagagctcatgcaggacacgagagacttcctaaacaggtatccacggaagaagttctgggttgggaaacccattgctcgagtggttaaaaaaaagaccggagaattctcagataaactcctctctctgcaacgaggcctgagggaattccaggggaagctgctgagagacttggaatataagacagtgagcgtcaccctggacccacagtcggccagtgggtacctgcagctgtcagaggactggaagtgcgtgacctacaccagcctgtacaagagtgcctacctgcacccccagcagtttgactgtgagcctggggtgctaggcagcaagggcttcacctggggcaaggtctactgggaagtggaagtggagagggagggctggtctgaggatgaagaagagggggatgaggaggaagagggagaagaggaggaggaggaagaggaggccggctatggggatggatatgacgactgggaaacggacgaagatgaggaatcgttgggcgatgaagaggaagaagaggaggaggaagaggaggaagttctggaaagctgcatggtgggggtggctagagactctgtgaagaggaagggagacctctccctgcggccagaggatggcgtgtgggcgctgcgcctctcctcctccggcatctgggccaacaccagccccgaggctgagcttttcccagcactgcggccccggagagtgggcatcgccctggattatgaagggggcaccgtgactttcaccaacgcagagtcacaggaactcatctacaccttcactgccaccttcacccggcgcctggtccccttcctgtggctcaagtggccaggaacacgcctcctgctaagaccctgagccctgacatctgcccccagccccaaccctcagatgcttcacttctttggaattccaggactctcaatggggggacgggatgcctggcctaagcacctggagcaggggaccccatatccactggtagccacctccccattgctgtggccccctgaaatctcactcagtgctgttgctccatctactgccctaatggggctcttttcccacctcctgctggtttcccgagggaacttctgaccctggagtccatgagggctcctttcctttttgaccacgaccttggccccagctctgcactctctggaataagggcccgatgcagcattttcttgcccagtgtggcaagacctcagaaaaaccagtcaattacgcctaagatcattttgctgtccttaaaccccccaggttccttcttgcacaaatccactctgctgcccaccttccctggcattttaaacagacctaccccaccccaactcagagttaagcatacatggcaatgctgaaaataaacaaaatccactgaggcttcccaggccatttaaagcctggagtaccagcgcatatcatctcatggggtccagagtggagtccaggcttctctgaaaccagggctgagcatatttccatagccaaggaggtgggactccctggagctatctgtggtcttagggaaggatccagacatacacggctttggggtacaagctgtgatcactgatcaataaattatctctagattggtccttgtgaggggagttttaagaatccagaacatcttgctcttgatcagcacatccaaaaacaccaagacaaacatccagtggagcagaacctctcctgcctcgggagttctgaccgggttccccagcagggtgttaagcctctgtctctggccctaccagcatccaggttccactttcctaggagagagtggagatgggaagacagggaaaggaaggcagcaggaggccacaagcccaccaggtcttcatgtcaagagagggagtaacatgtcttctcattgcccacggacccaacctctgtccaggtgcccctcatcatcacagtttaacacaagctcccctgctccagccaaattgatctcccagtcttgtccttacccattccaagtgctctgccagcccctgttcatccaagttttaagtcctccaccctgttctaagagactgttccaacggctctgggcctcagtggtcacttgaccaccattgtctcagagctgcccactttgtgtgtgtcacatgctgcctgagtcacatgtacatcttatttctgcctctagttttgtaagctcctggagggcggataacatcttatactactcttgtattctcatggcacctagtgcagtgctgggcacagagtaggtgctcaataaagacttgttgaatgaacag

SEQ ID NO: 299532 - DNA, 2334 bp, Homo sapiens
attgaagtcttatttgattcatattgatacttgtgcttttttctttcccttctaggacacgagagacttcctaaacaggtatccacggaagaagttctgggttgggaaacccattgctcgagtggttaaaaaaaagaccggagaattctcagataaactcctctctctgcaacgaggcctgagggaattccaggggaagctgctgagagacttggaatataagacagtgagcgtcaccctggacccacagtcggccagtgggtacctgcagctgtcagaggactggaagtgcgtgacctacaccagcctgtacaagagtgcctacctgcacccccagcagtttgactgtgagcctggggtgctaggcagcaagggcttcacctggggcaaggtctactgggaagtggaagtggagagggagggctggtctgaggatgaagaagagggggatgaggaggaagagggagaagaggaggaggaggaagaggaggccggctatggggatggatatgacgactgggaaacggacgaagatgaggaatcgttgggcgatgaagaggaagaagaggaggaggaagaggaggaagttctggaaagctgcatggtgggggtggctagagactctgtgaagaggaagggagacctctccctgcggccagaggatggcgtgtgggcgctgcgcctctcctcctccggcatctgggccaacaccagccccgaggctgagcttttcccagcactgcggccccggagagtgggcatcgccctggattatgaagggggcaccgtgactttcaccaacgcagagtcacaggaactcatctacaccttcactgccaccttcacccggcgcctggtccccttcctgtggctcaagtggccaggaacacgcctcctgctaagaccctgagccctgacatctgcccccagccccaaccctcagatgcttcacttctttggaattccaggactctcaatggggggacgggatgcctggcctaagcacctggagcaggggaccccatatccactggtagccacctccccattgctgtggccccctgaaatctcactcagtgctgttgctccatctactgccctaatggggctcttttcccacctcctgctggtttcccgagggaacttctgaccctggagtccatgagggctcctttcctttttgaccacgaccttggccccagctctgcactctctggaataagggcccgatgcagcattttcttgcccagtgtggcaagacctcagaaaaaccagtcaattacgcctaagatcattttgctgtccttaaaccccccaggttccttcttgcacaaatccactctgctgcccaccttccctggcattttaaacagacctaccccaccccaactcagagttaagcatacatggcaatgctgaaaataaacaaaatccactgaggcttcccaggccatttaaagcctggagtaccagcgcatatcatctcatggggtccagagtggagtccaggcttctctgaaaccagggctgagcatatttccatagccaaggaggtgggactccctggagctatctgtggtcttagggaaggatccagacatacacggctttggggtacaagctgtgatcactgatcaataaattatctctagattggtccttgtgaggggagttttaagaatccagaacatcttgctcttgatcagcacatccaaaaacaccaagacaaacatccagtggagcagaacctctcctgcctcgggagttctgaccgggttccccagcagggtgttaagcctctgtctctggccctaccagcatccaggttccactttcctaggagagagtggagatgggaagacagggaaaggaaggcagcaggaggccacaagcccaccaggtcttcatgtcaagagagggagtaacatgtcttctcattgcccacggacccaacctctgtccaggtgcccctcatcatcacagtttaacacaagctcccctgctccagccaaattgatctcccagtcttgtccttacccattccaagtgctctgccagcccctgttcatccaagttttaagtcctccaccctgttctaagagactgttccaacggctctgggcctcagtggtcacttgaccaccattgtctcagagctgcccactttgtgtgtgtcacatgctgcctgagtcacatgtacatcttatttctgcctctagttttgtaagctcctggagggcggataacatcttatactactcttgtattctcatggcacctagtgcagtgctgggcacagagtaggtgctcaataaagacttgttgaatgaacag

SEQ ID NO: 299533 - DNA, 2009 bp, Homo sapiens
gggacgggatgcctggcctaagcacctggagcaggggaccccatatccactggtagccacctccccattgctgtggccccctgaaatctcactcagggctggtctgaggatgaagaagagggggatgaggaggaagagggagaagaggaggaggaggaagaggaggccggctatggggatggatatgacgactgggaaacggacgaagatgaggaatcgttgggcgatgaagaggaagaagaggaggaggaagaggaggaagttctggaaagctgcatggtgggggtggctagagactctgtgaagaggaagggagacctctccctgcggccagaggatggcgtgtgggcgctgcgcctctcctcctccggcatctgggccaacaccagccccgaggctgagcttttcccagcactgcggccccggagagtgggcatcgccctggattatgaagggggcaccgtgactttcaccaacgcagagtcacaggaactcatctacaccttcactgccaccttcacccggcgcctggtccccttcctgtggctcaagtggccaggaacacgcctcctgctaagaccctgagccctgacatctgcccccagccccaaccctcagatgcttcacttctttggaattccaggactctcaatggggggacgggatgcctggcctaagcacctggagcaggggaccccatatccactggtagccacctccccattgctgtggccccctgaaatctcactcagtgctgttgctccatctactgccctaatggggctcttttcccacctcctgctggtttcccgagggaacttctgaccctggagtccatgagggctcctttcctttttgaccacgaccttggccccagctctgcactctctggaataagggcccgatgcagcattttcttgcccagtgtggcaagacctcagaaaaaccagtcaattacgcctaagatcattttgctgtccttaaaccccccaggttccttcttgcacaaatccactctgctgcccaccttccctggcattttaaacagacctaccccaccccaactcagagttaagcatacatggcaatgctgaaaataaacaaaatccactgaggcttcccaggccatttaaagcctggagtaccagcgcatatcatctcatggggtccagagtggagtccaggcttctctgaaaccagggctgagcatatttccatagccaaggaggtgggactccctggagctatctgtggtcttagggaaggatccagacatacacggctttggggtacaagctgtgatcactgatcaataaattatctctagattggtccttgtgaggggagttttaagaatccagaacatcttgctcttgatcagcacatccaaaaacaccaagacaaacatccagtggagcagaacctctcctgcctcgggagttctgaccgggttccccagcagggtgttaagcctctgtctctggccctaccagcatccaggttccactttcctaggagagagtggagatgggaagacagggaaaggaaggcagcaggaggccacaagcccaccaggtcttcatgtcaagagagggagtaacatgtcttctcattgcccacggacccaacctctgtccaggtgcccctcatcatcacagtttaacacaagctcccctgctccagccaaattgatctcccagtcttgtccttacccattccaagtgctctgccagcccctgttcatccaagttttaagtcctccaccctgttctaagagactgttccaacggctctgggcctcagtggtcacttgaccaccattgtctcagagctgcccactttgtgtgtgtcacatgctgcctgagtcacatgtacatcttatttctgcctctagttttgtaagctcctggagggcggataacatcttatactactcttgtattctcatggcacctagtgcagtgctgggcacagagtaggtgctcaataaagacttgttgaatgaacag

SEQ ID NO: 299534 - DNA, 2123 bp, Homo sapiens
aacgctttttgaattgaattttttaaaatgcatgtattccttttcaaactaaaatgatttttaagcacacaaaagagaatcaaaggctgagaaacaatgatttcacacactatgtttgcaagaacaagttattcccaaagcaattcctacaggttctgcacctgtgttgcttttataaagcaagcacagcgtaatgtgtaagcactattgtcctgaatgctttatccatgaaggtacgtgttaaggatccataactggtagaagggcgtttaaaacgcttttttttcttttaaagagacagggtctcactatgttgcccaggctgctctcttaactacgaggctcggagtcaggaatggagagaagggtaatggttttacctcttattgtggaaacctgttgagatcacagagaatatactgacggcataaaagggcagaaccatagcagggtgcggttgcttcattccagcctcgcagtcacctctgtgccctgctggttgtcttcccagcgctgctgtagttgccttccatggatctataggagagcaagtcctccaggagaagaagtcctcaccagtgaacggagacctctctgaactaaggataccatggccacgtcagccccactacggagcctggaagaggaggtgacctgctccatctgtcttgattacctgcgggaccctgtgaccattgactgtggccacgtcttctgccgcagctgcaccacagacgtccgccccatctcagggagccgccccgtctgcccactctgcaagaagccttttaagaaggagaacatccgacccgtgtggcaatggtagccacctccccattgctgtggccccctgaaatctcactcagtgctgttgctccatctactgccctaatggggctcttttcccacctcctgctggtttcccgagggaacttctgaccctggagtccatgagggctcctttcctttttgaccacgaccttggccccagctctgcactctctggaataagggcccgatgcagcattttcttgcccagtgtggcaagacctcagaaaaaccagtcaattacgcctaagatcattttgctgtccttaaaccccccaggttccttcttgcacaaatccactctgctgcccaccttccctggcattttaaacagacctaccccaccccaactcagagttaagcatacatggcaatgctgaaaataaacaaaatccactgaggcttcccaggccatttaaagcctggagtaccagcgcatatcatctcatggggtccagagtggagtccaggcttctctgaaaccagggctgagcatatttccatagccaaggaggtgggactccctggagctatctgtggtcttagggaaggatccagacatacacggctttggggtacaagctgtgatcactgatcaataaattatctctagattggtccttgtgaggggagttttaagaatccagaacatcttgctcttgatcagcacatccaaaaacaccaagacaaacatccagtggagcagaacctctcctgcctcgggagttctgaccgggttccccagcagggtgttaagcctctgtctctggccctaccagcatccaggttccactttcctaggagagagtggagatgggaagacagggaaaggaaggcagcaggaggccacaagcccaccaggtcttcatgtcaagagagggagtaacatgtcttctcattgcccacggacccaacctctgtccaggtgcccctcatcatcacagtttaacacaagctcccctgctccagccaaattgatctcccagtcttgtccttacccattccaagtgctctgccagcccctgttcatccaagttttaagtcctccaccctgttctaagagactgttccaacggctctgggcctcagtggtcacttgaccaccattgtctcagagctgcccactttgtgtgtgtcacatgctgcctgagtcacatgtacatcttatttctgcctctagttttgtaagctcctggagggcggataacatcttatactactcttgtattctcatggcacctagtgcagtgctgggcacagagtaggtgctcaataaagacttgttgaatgaacag

SEQ ID NO: 299535 - DNA, 2680 bp, Homo sapiens
gcaggagcgggacccggaacagaccgccgtgagagaggaggggtgccggccgggattcgcggcccggagctcgggaccggagtcaggaatggagagaagggtaatggttttacctcttattgtggaaacctgttgagatcacagagaatatactgacggcataaaagggcagaaccatagcagggtgcggttgcttcattccagcctcgcagtcacctctgtgccctgctggttgtcttcccagcgctgctgtagttgccttccatggatctataggagagcaagtcctccaggagaagaagtcctcaccagtgaacggagacctctctgaactaaggataccatggccacgtcagccccactacggagcctggaagaggaggtgacctgctccatctgtcttgattacctgcgggaccctgtgaccattgactgtggccacgtcttctgccgcagctgcaccacagacgtccgccccatctcagggagccgccccgtctgcccactctgcaagaagccttttaagaaggagaacatccgacccgtgtggcaactggccagcctggtggagaacattgagcggctgaaggtggacaagggcaggcagccgggagaggtgacccgggagcagcaggatgcaaagttgtgcgagcgacaccgagagaagctgcactactactgtgaggacgacgggaagctgctgtgcgtgatgtgccgggagtcccgggagcacaggccccacacggccgtcctcatggagaaggccgcccagccccacagggaaaaaatcctgaaccacctgagtaccctaaggagggacagagacaaaattcagggcttccaggcaaagggagaagctgatatcctggccgcgctgaagaagctccaggaccagaggcagtacattgtggctgagtttgagcagggtcatcagttcctgagggagcgggaggaacacctgctggaacagctggcgaagctggagcaggagctcacggagggcagggagaagttcaagagccggggcgtcggggagcttgcccggctggccctggtcatctccgaactggagggcaaggcgcagcagccagctgcagagctcatgcaggacacgagagacttcctaaacaggtatccacggaagaagttctgggttgggaaacccattgctcgagtggttaaaaaaaagaccggagaattctcagataaactcctctctctgcaacgaggcctgagggaattccaggggaagctgctgagagacttggaatataagacagtgagcgtcaccctggacccacagtcggccagtgggtacctgcagctgtcagaggactggaagtgcgtgacctacaccagcctgtacaagagtgcctacctgcacccccagcagtttgactgtgagcctggggtgctaggcagcaagggcttcacctggggcaaggtctactgggaagtggaagtggagagggagggctggtctgaggatgaagaagagggggatgaggaggaagagggagaagaggaggaggaggaagaggaggccggctatggggatggatatgacgactgggaaacggacgaagatgaggaatcgttgggcgatgaagaggaagaagaggaggaggaagaggaggaagttctggaaagctgcatggtgggggtggctagagactctgtgaagaggaagggagacctctccctgcggccagaggatggcgtgtgggcgctgcgcctctcctcctccggcatctgggccaacaccagccccgaggctgagcttttcccagcactgcggccccggagagtgggcatcgccctggattatgaagggggcaccgtgactttcaccaacgcagagtcacaggaactcatctacaccttcactgccaccttcacccggcgcctggtccccttcctgtggctcaagtggccaggaacacgcctcctgctaagaccctgagccctgacatctgcccccagccccaaccctcagatgcttcacttctttggaattccaggactctcaatggggggacgggatgcctggcctaagcacctggagcaggggaccccatatccactggtagccacctccccattgctgtggccccctgaaatctcactcagtgctgttgctccatctactgccctaatggggctcttttcccacctcctgctggtttcccgagggaacttctgaccctggagtccatgagggctcctttcctttttgaccacgaccttggccccagctctgcactctctggaataagggcccgatgcagcattttcttgcccagtgtggcaagacctcagaaaaaccagtcaattacgcctaagatcattttgctgtccttaaaccccccagtcttgtccttacccattccaagtgctctgccagcccctgttcatccaagttttaagtcctccaccctgttctaagagactgttccaacggctctgggcctcagtggtcacttgaccaccattgtctcagagctgcccactttgtgtgtgtcacatgctgcctgagtcacatgtacatcttatttctgcctctagttttgtaagctcctggagggcggataacatcttatactactcttgtattctcatggcacctagtgcagtgctgggcacagagtaggtgctcaataaagacttgttgaatgaacag

SEQ ID NO: 299536 - DNA, 2625 bp, Homo sapiens
  misc_feature (2393)..(2393): n is a, c, g, or t
  misc_feature (2409)..(2409): n is a, c, g, or t
  misc_feature (2442)..(2442): n is a, c, g, or t
  misc_feature (2466)..(2467): n is a, c, g, or t
  misc_feature (2599)..(2599): n is a, c, g, or t
  misc_feature (2604)..(2604): n is a, c, g, or t
gcaggagcgggacccggaacagaccgccgtgagagaggaggggtgccggccgggattcgcggcccggagctcgggaccggagtcaggaatggagagaagggtaatggttttacctcttattgtggaaacctgttgagatcacagagaatatactgacggcataaaagggcagaaccatagcagggtgcggttgcttcattccagcctcgcagtcacctctgtgccctgctggttgtcttcccagcgctgctgtagttgccttccatggatctataggagagcaagtcctccaggagaagaagtcctcaccagtgaacggagacctctctgaactaaggataccatggccacgtcagccccactacggagcctggaagaggaggtgacctgctccatctgtcttgattacctgcgggaccctgtgaccattgactgtggccacgtcttctgccgcagctgcaccacagacgtccgccccatctcagggagccgccccgtctgcccactctgcaagaagccttttaagaaggagaacatccgacccgtgtggcaactggccagcctggtggagaacattgagcggctgaaggtggacaagggcaggcagccgggagaggtgacccgggagcagcaggatgcaaagttgtgcgagcgacaccgagagaagctgcactactactgtgaggacgacgggaagctgctgtgcgtgatgtgccgggagtcccgggagcacaggccccacacggccgtcctcatggagaaggccgcccagccccacagggaaaaaatcctgaaccacctgagtaccctaaggagggacagagacaaaattcagggcttccaggcaaagggagaagctgatatcctggccgcgctgaagaagctccaggaccagaggcagtacattgtggctgagtttgagcagggtcatcagttcctgagggagcgggaggaacacctgctggaacagctggcgaagctggagcaggagctcacggagggcagggagaagttcaagagccggggcgtcggggagcttgcccggctggccctggtcatctccgaactggagggcaaggcgcagcagccagctgcagagctcatgcaggacacgagagacttcctaaacaggtatccacggaagaagttctgggttgggaaacccattgctcgagtggttaaaaaaaagaccggagaattctcagataaactcctctctctgcaacgaggcctgagggaattccaggggaagctgctgagagacttggaatataagacagtgagcgtcaccctggacccacagtcggccagtgggtacctgcagctgtcagaggactggaagtgcgtgacctacaccagcctgtacaagagtgcctacctgcacccccagcagtttgactgtgagcctggggtgctaggcagcaagggcttcacctggggcaaggtctactgggaagtggaagtggagagggagggctggtctgaggatgaagaagagggggatgaggaggaagagggagaagaggaggaggaggaagaggaggccggctatggggatggatatgacgactgggaaacggacgaagatgaggaatcgttgggcgatgaagaggaagaagaggaggaggaagaggaggaagttctggaaagctgcatggtgggggtggctagagactctgtgaagaggaagggagacctctccctgcggccagaggatggcgtgtgggcgctgcgcctctcctcctccggcatctgggccaacaccagccccgaggctgagcttttcccagcactgcggccccggagagtgggcatcgccctggattatgaagggggcaccgtgactttcaccaacgcagagtcacaggaactcatctacaccttcactgccaccttcacccggcgcctggtccccttcctgtggctcaagtggccaggaacacgcctcctgctaagaccctgagccctgacatctgcccccagccccaaccctcagatgcttcacttctttggaattccaggactctcaatggggggacgggatgcctggcctaagcacctggagcaggggaccccatatccactggtagccacctccccattgctgtggccccctgaaatctcactcagtgctgttgctccatctactgccctaatggggctcttttcccacctcctgctggtttcccgagggaacttctgaccctggagtccatgagggctcctttcctttttgaccacgaccttggccccagctctgcactctctggaataagggcccgatgcagcattttcttgcccagtgtggcaagacctcagaaaaaccagtcaattacgcctaagatcattttgctgtccttaaaccccccagagagagcgtcgacgctctctcngtggggccaaaggctnggggcggtgctacacccgtgtcgtctccttccnggagccttaggagcagacaggtgnnccctgccatcgagaaggtgcaggccaagtttgaacgcacatgctgctcccccaagtatggttctcccaagctgcagaggaagcccctccccaaagccgaccagccaaataacaggacgtcaccagggatggnccagnaagggtacagtgagtcagcct

SEQ ID NO: 299537 - DNA, 2376 bp, Homo sapiens
gcaggagcgggacccggaacagaccgccgtgagagaggaggggtgccggccgggattcgcggcccggagctcgggaccggagtcaggaatggagagaagggtaatggttttacctcttattgtggaaacctgttgagatcacagagaatatactgacggcataaaagggcagaaccatagcagggtgcggttgcttcattccagcctcgcagtcacctctgtgccctgctggttgtcttcccagcgctgctgtagttgccttccatggatctataggagagcaagtcctccaggagaagaagtcctcaccagtgaacggagacctctctgaactaaggataccatggccacgtcagccccactacggagcctggaagaggaggtgacctgctccatctgtcttgattacctgcgggaccctgtgaccattgactgtggccacgtcttctgccgcagctgcaccacagacgtccgccccatctcagggagccgccccgtctgcccactctgcaagaagccttttaagaaggagaacatccgacccgtgtggcaactggccagcctggtggagaacattgagcggctgaaggtggacaagggcaggcagccgggagaggtgacccgggagcagcaggatgcaaagttgtgcgagcgacaccgagagaagctgcactactactgtgaggacgacgggaagctgctgtgcgtgatgtgccgggagtcccgggagcacaggccccacacggccgtcctcatggagaaggccgcccagccccacagggaaaaaatcctgaaccacctgagtaccctaaggagggacagagacaaaattcagggcttccaggcaaagggagaagctgatatcctggccgcgctgaagaagctccaggaccagaggcagtacattgtggctgagtttgagcagggtcatcagttcctgagggagcgggaggaacacctgctggaacagctggcgaagctggagcaggagctcacggagggcagggagaagttcaagagccggggcgtcggggagcttgcccggctggccctggtcatctccgaactggagggcaaggcgcagcagccagctgcagagctcatgcaggacacgagagacttcctaaacaggtatccacggaagaagttctgggttgggaaacccattgctcgagtggttaaaaaaaagaccggagaattctcagataaactcctctctctgcaacgaggcctgagggaattccaggggaagctgctgagagacttggaatataagacagtgagcgtcaccctggacccacagtcggccagtgggtacctgcagctgtcagaggactggaagtgcgtgacctacaccagcctgtacaagagtgcctacctgcacccccagcagtttgactgtgagcctggggtgctaggcagcaagggcttcacctggggcaaggtctactgggaagtggaagtggagagggagggctggtctgaggatgaagaagagggggatgaggaggaagagggagaagaggaggaggaggaagaggaggccggctatggggatggatatgacgactgggaaacggacgaagatgaggaatcgttgggcgatgaagaggaagaagaggaggaggaagaggaggaagttctggaaagctgcatggtgggggtggctagagactctgtgaagaggaagggagacctctccctgcggccagaggatggcgtgtgggcgctgcgcctctcctcctccggcatctgggccaacaccagccccgaggctgagcttttcccagcactgcggccccggagagtgggcatcgccctggattatgaagggggcaccgtgactttcaccaacgcagagtcacaggaactcatctacaccttcactgccaccttcacccggcgcctggtccccttcctgtggctcaagtggccaggaacacgcctcctgctaagaccctgagccctgacatctgcccccagccccaaccctcagatgcttcacttctttggaattccaggactctcaatggggggacgggatgcccagccaaattgatctcccagtcttgtccttacccattccaagtgctctgccagcccctgttcatccaagttttaagtcctccaccctgttctaagagactgttccaacggctctgggcctcagtggtcacttgaccaccattgtctcagagctgcccactttgtgtgtgtcacatgctgcctgagtcacatgtacatcttatttctgcctctagttttgtaagctcctggagggcggataacatcttatactactcttgtattctcatggcacctagtgcagtgctgggcacagagtaggtgctcaataaagacttgttgaatgaacag

SEQ ID NO: 299538 - DNA, 2258 bp, Homo sapiens
gcaggagcgggacccggaacagaccgccgtgagagaggaggggtgccggccgggattcgcggcccggagctcgggaccggagtcaggaatggagagaagggtaatggttttacctcttattgtggaaacctgttgagatcacagagaatatactgacggcataaaagggcagaaccatagcagggtgcggttgcttcattccagcctcgcagtcacctctgtgccctgctggttgtcttcccagcgctgctgtagttgccttccatggatctataggagagcaagtcctccaggagaagaagtcctcaccagtgaacggagacctctctgaactaaggataccatggccacgtcagccccactacggagcctggaagaggaggtgacctgctccatctgtcttgattacctgcgggaccctgtgaccattgactgtggccacgtcttctgccgcagctgcaccacagacgtccgccccatctcagggagccgccccgtctgcccactctgcaagaagccttttaagaaggagaacatccgacccgtgtggcaactggccagcctggtggagaacattgagcggctgaaggtggacaagggcaggcagccgggagaggtgacccgggagcagcaggatgcaaagttgtgcgagcgacaccgagagaagctgcactactactgtgaggacgacgggaagctgctgtgcgtgatgtgccgggagtcccgggagcacaggccccacacggccgtcctcatggagaaggccgcccagccccacagggaaaaaatcctgaaccacctgagtaccctaaggagggacagagacaaaattcagggcttccaggcaaagggagaagctgatatcctggccgcgctgaagaagctccaggaccagaggcagtacattgtggctgagtttgagcagggtcatcagttcctgagggagcgggaggaacacctgctggaacagctggcgaagctggagcaggagctcacggagggcagggagaagttcaagagccggggcgtcggggagcttgcccggctggccctggtcatctccgaactggagggcaaggcgcagcagccagctgcagagctcatgcaggacacgagagacttcctaaacaggtatccacggaagaagttctgggttgggaaacccattgctcgagtggttaaaaaaaagaccggagaattctcagataaactcctctctctgcaacgaggcctgagggaattccaggggaagctgctgagagacttggaatataagacagtgagcgtcaccctggacccacagtcggccagtgggtacctgcagctgtcagaggactggaagtgcgtgacctacaccagcctgtacaagagtgcctacctgcacccccagcagtttgactgtgagcctggggtgctaggcagcaagggcttcacctggggcaaggtctactgggaagtggaagtggagagggagggctggtctgaggatgaagaagagggggatgaggaggaagagggagaagaggaggaggaggaagaggaggccggctatggggatggatatgacgactgggaaacggacgaagatgaggaatcgttgggcgatgaagaggaagaagaggaggaggaagaggaggaagttctggaaagctgcatggtgggggtggctagagactctgtgaagaggaagggagacctctccctgcggccagaggatggcgtgtgggcgctgcgcctctcctcctccggcatctgggccaacaccagccccgaggctgagcttttcccagcactgcggccccggagagtgggcatcgccctggattatgaagggggcaccgtgactttcaccaacgcagagtcacaggaactcatctacaccttcactgccaccttcacccggcgcctggtccccttcctgtggctcaagtggccaggaacacgcctcctgctaagaccctgagccctgacatctgcccccacccctgttcatccaagttttaagtcctccaccctgttctaagagactgttccaacggctctgggcctcagtggtcacttgaccaccattgtctcagagctgcccactttgtgtgtgtcacatgctgcctgagtcacatgtacatcttatttctgcctctagttttgtaagctcctggagggcggataacatcttatactactcttgtattctcatggcacctagtgcagtgctgggcacagagtaggtgctcaataaagacttgttgaatgaacag

SEQ ID NO: 299539 - DNA, 1303 bp, Homo sapiens
aacgctttttgaattgaattttttaaaatgcatgtattccttttcaaactaaaatgatttttaagcacacaaaagagaatcaaaggctgagaaacaatgatttcacacactatgtttgcaagaacaagttattcccaaagcaattcctacaggttctgcacctgtgttgcttttataaagcaagcacagcgtaatgtgtaagcactattgtcctgaatgctttatccatgaaggtacgtgttaaggatccataactggtagaagggcgtttaaaacgcttttttttcttttaaagagacagggtctcactatgttgcccaggctgctctcttaactacgaggctcggagtcaggaatggagagaagggtaatggttttacctcttattgtggaaacctgttgagatcacagagaatatactgacggcataaaagggcagaaccatagcagggtgcggtaagttggggaagagtttttggagagggtgaattttgcattggacctgacagaattgtgtatggggaaggggagcggttattctggtctgctcacatctctcatactcaacctcatttctcctaattctgaaatcttgagatcctctatcactaagaaggaaaactactgtccaacagggacactttattgctcaccccatatgtgaaagtttgtcatagctaaggctagggtgcttttggtcagtatcagcagaatatatgccccctttcttttgtcagcattactccgcttacaaagcccttccatgtagatgacctcatctgagcttcctaacaaaggagctggtattagaccccattttacagtgtgcctgggtagggaagagagtgtagtggattgagcagaggccttggcaccagacactgcttcctagccatgtgctcttgggcaagttgcttaaccctgctgagcctcagtttcctcaagaaggagtctgtataagcaaggggaagggattggtcatagaagtggtactgtgtttcatttatctagttatggcagactctcaaaaacaaatggttctatacaactaacattgtctgcaattcccctgaatccattcacttgttcagtaaatgtgtattgagcttctacaaggtgtcaagcaccatgatctctgtatcagtgatttaaccatttttgatggttactacagacctctttaagaatgtgatagaaaactgtagctccctccccagaaaacttttctagctttttattttgctttgcagtgagccaagatagttccactgcactcgggggacagagtaagaccctgtctcaa

SEQ ID NO: 299540 - DNA, 1106 bp, Homo sapiens
gcaggagcgggacccggaacagaccgccgtgagagaggaggggtgccggccgggattcgcggcccggagctcgggaccggagtcaggaatggagagaagggtaatggttttacctcttattgtggaaacctgttgagatcacagagaatatactgacggcataaaagggcagaaccatagcagggtgcggttgcttcattccagcctcgcagtcacctctgtgccctgctggttgtcttcccagcgctgctgtagttgccttccatggatctataggagagcaagtcctccaggagaagaagtcctcaccagtgaacggagacctctctgaactaaggataccatggccacgtcagccccactacggagcctggaagaggaggtgacctgctccatctgtcttgattacctgcgggaccctgtgaccattgactgtggccacgtcttctgccgcagctgcaccacagacgtccgccccatctcagggagccgccccgtctgcccactctgcaagaagccttttaagaaggagaacatccgacccgtgtggcaactggccagcctggtggagaacattgagcggctgaaggtggacaagggcaggcagccgggagaggtgacccgggagcagcaggatgcaaagttgtgcgagcgacaccgagagaagctgcactactactgtgaggacgacgggaagctgctgtgcgtgatgtgccgggagtcccgggagcacaggccccacacggccgtcctcatggagaaggccgcccagccccacagggaaaaaatcctgaaccacctgagtaccctaaggagggacagagacaaaattcagggcttccaggcaaagggagaagctgatatcctggccgcgctggttccaacggctctgggcctcagtggtcacttgaccaccattgtctcagagctgcccactttgtgtgtgtcacatgctgcctgagtcacatgtacatcttatttctgcctctagttttgtaagctcctggagggcggataacatcttatactactcttgtattctcatggcacctagtgcagtgctgggcacagagtaggtgctcaataaagacttgttgaatgaacag

SEQ ID NO: 299541 - DNA, 1541 bp, Homo sapiens
gcaggagcgggacccggaacagaccgccgtgagagaggaggggtgccggccgggattcgcggcccggagctcgggaccggagtcaggaatggagagaagggtaatggttttacctcttattgtggaaacctgttgagatcacagagaatatactgacggcataaaagggcagaaccatagcagggtgcggttgcttcattccagcctcgcagtcacctctgtgccctgctggttgtcttcccagcgctgctgtagttgccttccatggatctataggagagcaagtcctccaggagaagaagtcctcaccagtgaacggagacctctctgaactaaggataccatggccacgtcagccccactacggagcctggaagaggaggtgacctgctccatctgtcttgattacctgcgggaccctgtgaccattgactgtggccacgtcttctgccgcagctgcaccacagacgtccgccccatctcagggagccgccccgtctgcccactctgcaagaagccttttaagaaggagaacatccgacccgtgtggcaactggccagcctggtggagaacattgagcggctgaaggtggacaagggcaggcagccgggagaggtgacccgggagcagcaggatgcaaagttgtgcgagcgacaccgagagaagctgcactactactgtgaggacgacgggaagctgctgtgcgtgatgtgccgggagtcccgggagcacaggccccacacggccgtcctcatggagaaggccgcccagccccacagggaaaaaatcctgaaccacctgagtaccctaaggagggacagagacaaaattcagggcttccaggcaaagggagaagctgatatcctggccgcgctgaagaagctccaggaccagaggcagtacattgtggctgagtttgagcagggtcatcagttcctgagggagcgggaggaacacctgctggaacagctggcgaagctggagcaggagctcacggagggcagggagaagttcaagagccggggcgtcggggagcttgcccggctggccctggtcatctccgaactggagggcaaggcgcagcagccagctgcagagctcatgcagacacgagagacttcctaaacaggtatccacggaagaagttcttattgtggaaacctgttgagatcacagagaatatactgacggcataaaagggcagaaccatagcagggtgcggttgcttcattccagcctcgcagtcacctctgtgccctgctggttgtcttcccagcgctgctgtagttgccttccatggatctataggaggttccaacggctctgggcctcagtggtcacttgaccaccattgtctcagagctgcccactttgtgtgtgtcacatgctgcctgagtcacatgtacatcttatttctgcctctagttttgtaagctcctggagggcggataacatcttatactactcttgtattctcatggcacctagtgcagtgctgggcacagagtaggtgctcaataaagacttgttgaatgaacag

SEQ ID NO: 299542 - DNA, 996 bp, Homo sapiens
gcaggagcgggacccggaacagaccgccgtgagagaggaggggtgccggccgggattcgcggcccggagctcgggaccggttgcttcattccagcctcgcagtcacctctgtgccctgctggttgtcttcccagcgctgctgtagttgccttccatggatctataggagagcaagtcctccaggagaagaagtcctcaccagtgaacggagacctctctgaactaaggataccatggccacgtcagccccactacggagcctggaagaggaggtgacctgctccatctgtcttgattacctgcgggaccctgtgaccattgactgtggccacgtcttctgccgcagctgcaccacagacgtccgccccatctcagggagccgccccgtctgcccactctgcaagaagccttttaagaaggagaacatccgacccgtgtggcaactggccagcctggtggagaacattgagcggctgaaggtggacaagggcaggcagccgggagaggtgacccgggagcagcaggatgcaaagttgtgcgagcgacaccgagagaagctgcactactactgtgaggacgacgggaagctgctgtgcgtgatgtgccgggagtcccgggagcacaggccccacacggccgtcctcatggagaaggccgcccagccccacagggaaaaaatcctgaaccacctgagtaccctaaggagggacagagacaaaattcagggcttccaggcaaagggagaagctgatatcctggccgcgctggttccaacggctctgggcctcagtggtcacttgaccaccattgtctcagagctgcccactttgtgtgtgtcacatgctgcctgagtcacatgtacatcttatttctgcctctagttttgtaagctcctggagggcggataacatcttatactactcttgtattctcatggcacctagtgcagtgctgggcacagagtaggtgctcaataaagacttgttgaatgaacag

SEQ ID NO: 299543 - DNA, 657 bp, Homo sapiens
aacgctttttgaattgaattttttaaaatgcatgtattccttttcaaactaaaatgatttttaagcacacaaaagagaatcaaaggctgagaaacaatgatttcacacactatgtttgcaagaacaagttattcccaaagcaattcctacaggttctgcacctgtgttgcttttataaagcaagcacagcgtaatgtgtaagcactattgtcctgaatgctttatccatgaaggtacgtgttaaggatccataactggtagaagggcgtttaaaacgcttttttttcttttaaagagacagggtctcactatgttgcccaggctgctctcttaactacgaggctcggagtcaggaatggagagaagggtaatggttttacctcttattgtggaaacctgttgagatcacagagaatatactgacggcataaaagggcagaaccatagcagggtgcggttgcttcattccagcctcgcagtcacctctgtgccctgctggttgtcttcccagcgctgctgtagttgccttccatggatctataggagagcaagtcctccagggcggataacatcttatactactcttgtattctcatggcacctagtgcagtgctgggcacagagtaggtgctcaataaagacttgttgaatgaacag

SEQ ID NO: 299544 - DNA, 2395 bp, Homo sapiens
cggagcccgtcaggtgtctgacagcccatcgatccctttgtctatcccccgaccatggcgaagctgattgcgctcaccctcttggggatgggactggcactcttcaggaaccaccagtcttcttaccaaacacgacttaatgctctccgagaggtacaacccgtagaacttcctaactgtaatttagttaaaggaatcgaaactggctctgaagacttggagatactgcctaatggactggctttcattagctctggattaaagtatcctggaataaagagcttcaaccccaacagtcctggaaaaatacttctgatggacctgaatgaagaagatccaacagtgttggaattggggatcactggaagtaaatttgatgtatcttcatttaaccctcatgggattagcacattcacagatgaagataatgccatgtacctcctggtggtgaaccatccagatgccaagtccacagtggagttgtttaaatttcaagaagaagaaaaatcgcttttgcatctaaaaaccatcagacataaacttctgcctaatttgaatgatattgttgctgtgggacctgagcacttttatggcacaaatgatcactattttcttgacccctacttacaatcctgggagatgtatttgggtttagcgtggtcgtatgttgtctactatagtccaagtgaagttcgagtggtggcagaaggatttgattttgctaatggaatcaacatttcacccgatggcaagtatgtctatatagctgagttgctggctcataagattcatgtgtatgaaaagcatgctaattggactttaactccattgaagtcccttgactttaataccctcgtggataacatatctgtggatcctgagacaggagacctttgggttggatgccatcccaatggcatgaaaatcttcttctatgactcagagaatcctcctgcatcagaggtgcttcgaatccagaacattctaacagaagaacctaaagtgacacaggtttatgcagaaaatggcacagtgttgcaaggcagtacagttgcctctgtgtacaaagggaaactgctgattggcacagtgtttcacaaagctctttactgtgagctctaacagaccgatttgcacccatgccatagaaactgaggccattatttcaaccgcttgccatattccgaggacccagtgttcttagctgaacaatgaatgctgaccctaaatgtggacatcatgaagcatcaaagcactgtttaactgggagtgatatgatgtgtagggcttttttttgagaatacactatcaaatcagtcttggaatacttgaaaacctcatttaccataaaaatccttctcactaaaatggataaatcagttatgtcaattgtcagatattaaataacagtgtgtgaccccaaaagtacttaccctaaaacatgtgttgcctgaaagcacatgtgtgtatcgctgccttgccatgtcttgttcagaagacacaggggagcagggttagctcacgtgtctttagaactccagtactcacccagggactccagttcacaggccagaaaacatatgcattatgaagttcccctctactccatgcacatagtaagtctgactatggcagtcagacttacttactcccattttcccttcgatatatgactttttctcagtaaatattaacctgaactattccaactccccttgtactcttgctttttcaattctcctgttgcaatgacacataggaaaatcttaaaattcttgggagtgttgtcacacacctgaaaattatgagtctctatgatcttggcacaaattgtacatttgagtgtctttgacttggttaaaaggaagtttgttcacttcgatgactggatacagaatgaatcccataattgacatgggcgacagtaaaagtgtccccaaagactacactgttgttgaggtggtggtagtgctggtgggtttttgtttaatatttaaacttcttgttgtggaggctgaaaagaaaaaaaataatagaaaggtaaacaaacaaataaatagaaaagatcaacaacccctttggctatctactgagacatgactaggaagaaaacatgactttatcattttgttatagaagctgatatataaggttacacattttcatttatttgtttttctgatttgaaggtataaccttcatgatgaattacttcttcagggtgttaaggcagtgactttagaaacaaatttttttcttgcttttgttttgtttttgagaccgaatctcactctgttgcccaggctggagtgcagtggtgcgatcttggctcactgcaacttctacctccgaggttcaagagattcttgtgcctcagcctcccggatagctgccg

SEQ ID NO: 299545 - DNA, 2315 bp, Homo sapiens
ctcgtgccgaatcggcacgagcttcaggaaccaccagtcttcttaccaaacacgacttaatgctctccgagaggtacaacccgtagaacttcctaactgtaatttagttaaaggaatcgaaactggctctgaagacttggagatactgcctaatggactggctttcattagctctggattaaagtatcctggaataaagagcttcaaccccaacagtcctggaaaaatacttctgatggacctgaatgaagaagatccaacagtgttggaattggggatcactggaagtaaatttgatgtatcttcatttaaccctcatgggattagcacattcacagatgaagataatgccatgtacctcctggtggtgaaccatccagatgccaagtccacagtggagttgtttaaatttcaagaagaagaaaaatcgcttttgcatctaaaaaccatcagacataaacttctgcctaatttgaatgatattgttgctgtgggacctgagcacttttatggcacaaatgatcactattttcttgacccctacttacaatcctgggagatgtatttgggtttagcgtggtcgtatgttgtctactatagtccaagtgaagttcgagtggtggcagaaggatttgattttgctaatggaatcaacatttcacccgatggcaagtatgtctatatagctgagttgctggctcataagattcatgtgtatgaaaagcatgctaattggactttaactccattgaagtcccttgactttaataccctcgtggataacatatctgtggatcctgagacaggagacctttgggttggatgccatcccaatggcatgaaaatcttcttctatgactcagagaatcctcctgcatcagaggtgcttcgaatccagaacattctaacagaagaacctaaagtgacacaggtttatgcagaaaatggcacagtgttgcaaggcagtacagttgcctctgtgtacaaagggaaactgctgattggcacagtgtttcacaaagctctttactgtgagctctaacagaccgatttgcacccatgccatagaaactgaggccattatttcaaccgcttgccatattccgaggacccagtgttcttagctgaacaatgaatgctgaccctaaatgtggacatcatgaagcatcaaagcactgtttaactgggagtgatatgatgtgtagggcttttttttgagaatacactatcaaatcagtcttggaatacttgaaaacctcatttaccataaaaatccttctcactaaaatggataaatcagttatgtcaattgtcagatattaaataacagtgtgtgaccccaaaagtacttaccctaaaacatgtgttgcctgaaagcacatgtgtgtatcgctgccttgccatgtcttgttcagaagacacaggggagcagggttagctcacgtgtctttagaactccagtactcacccagggactccagttcacaggccagaaaacatatgcattatgaagttcccctctactccatgcacatagtaagtctgactatggcagtcagacttacttactcccattttcccttcgatatatgactttttctcagtaaatattaacctgaactattccaactccccttgtactcttgctttttcaattctcctgttgcaatgacacataggaaaatcttaaaattcttgggagtgttgtcacacacctgaaaattatgagtctctatgatcttggcacaaattgtacatttgagtgtctttgacttggttaaaaggaagtttgttcacttcgatgactggatacagaatgaatcccataattgacatgggcgacagtaaaagtgtccccaaagactacactgttgttgaggtggtggtagtgctggtgggtttttgtttaatatttaaacttcttgttgtggaggctgaaaagaaaaaaaataatagaaaggtaaacaaacaaataaatagaaaagatcaacaacccctttggctatctactgagacatgactaggaagaaaacatgactttatcattttgttatagaagctgatatataaggttacacattttcatttatttgtttttctgatttgaaggtataaccttcatgatgaattacttcttcagggtgttaaggcagtgactttagaaacaaatttttttcttgcttttgttttgtttttgagaccgaatctcactctgttgcccaggctggagtgcagtggtgcgatcttggctcactgcaacttctacctccgaggttcaagagattcttgtgcctcagcctcccggatagctgccg

SEQ ID NO: 299546 - DNA, 2600 bp, Homo sapiens
taggaggctgcccatctgtcagcaactctaaaacatcaatggaataaactggaaccatgttgccatttacccggactttccacctaggagtccttacacactgatgaaattgctcctgttcctgccaaagtacacagagccctagagaggatattatgtatctcttatgtgtacctatccacctctgctaaataaaaactaaatattgtacccagagttccccacttgtcttgccctggccttgcctggaaaaattgcaggaatgcctacctttgcaacttattataatttctgaatagttttgtgtgtgttttatttctttctcccccacagaacacgacttaatgctctccgagaggtacaacccgtagaacttcctaactgtaatttagttaaaggaatcgaaactggctctgaagacttggagatactgcctaatggactggctttcattagctctggattaaagtatcctggaataaagagcttcaaccccaacagtcctggaaaaatacttctgatggacctgaatgaagaagatccaacagtgttggaattggggatcactggaagtaaatttgatgtatcttcatttaaccctcatgggattagcacattcacagatgaagataatgccatgtacctcctggtggtgaaccatccagatgccaagtccacagtggagttgtttaaatttcaagaagaagaaaaatcgcttttgcatctaaaaaccatcagacataaacttctgcctaatttgaatgatattgttgctgtgggacctgagcacttttatggcacaaatgatcactattttcttgacccctacttacaatcctgggagatgtatttgggtttagcgtggtcgtatgttgtctactatagtccaagtgaagttcgagtggtggcagaaggatttgattttgctaatggaatcaacatttcacccgatggcaagtatgtctatatagctgagttgctggctcataagattcatgtgtatgaaaagcatgctaattggactttaactccattgaagtcccttgactttaataccctcgtggataacatatctgtggatcctgagacaggagacctttgggttggatgccatcccaatggcatgaaaatcttcttctatgactcagagaatcctcctgcatcagaggtgcttcgaatccagaacattctaacagaagaacctaaagtgacacaggtttatgcagaaaatggcacagtgttgcaaggcagtacagttgcctctgtgtacaaagggaaactgctgattggcacagtgtttcacaaagctctttactgtgagctctaacagaccgatttgcacccatgccatagaaactgaggccattatttcaaccgcttgccatattccgaggacccagtgttcttagctgaacaatgaatgctgaccctaaatgtggacatcatgaagcatcaaagcactgtttaactgggagtgatatgatgtgtagggcttttttttgagaatacactatcaaatcagtcttggaatacttgaaaacctcatttaccataaaaatccttctcactaaaatggataaatcagttatgtcaattgtcagatattaaataacagtgtgtgaccccaaaagtacttaccctaaaacatgtgttgcctgaaagcacatgtgtgtatcgctgccttgccatgtcttgttcagaagacacaggggagcagggttagctcacgtgtctttagaactccagtactcacccagggactccagttcacaggccagaaaacatatgcattatgaagttcccctctactccatgcacatagtaagtctgactatggcagtcagacttacttactcccattttcccttcgatatatgactttttctcagtaaatattaacctgaactattccaactccccttgtactcttgctttttcaattctcctgttgcaatgacacataggaaaatcttaaaattcttgggagtgttgtcacacacctgaaaattatgagtctctatgatcttggcacaaattgtacatttgagtgtctttgacttggttaaaaggaagtttgttcacttcgatgactggatacagaatgaatcccataattgacatgggcgacagtaaaagtgtccccaaagactacactgttgttgaggtggtggtagtgctggtgggtttttgtttaatatttaaacttcttgttgtggaggctgaaaagaaaaaaaataatagaaaggtaaacaaacaaataaatagaaaagatcaacaacccctttggctatctactgagacatgactaggaagaaaacatgactttatcattttgttatagaagctgatatataaggttacacattttcatttatttgtttttctgatttgaaggtataaccttcatgatgaattacttcttcagggtgttaaggcagtgactttagaaacaaatttttttcttgcttttgttttgtttttgagaccgaatctcactctgttgcccaggctggagtgcagtggtgcgatcttggctcactgcaacttctacctccgaggttcaagagattcttgtgcctcagcctcccggatagctgccg

SEQ ID NO: 299547 - DNA, 2261 bp, Homo sapiens
ctcgtgccgaatcggcacgagcttcaggaaccaccagtcttcttaccaaacacgacttaatgctctccgagaggtacaacccgtagaacttcctaactgtaatttagttaaaggaatcgaaactggctctgaagacttggagatactgcctaatggactggctttcattagctctggattaaagtatcctggaataaagagcttcaaccccaacagtcctggaatcactggaagtaaatttgatgtatcttcatttaaccctcatgggattagcacattcacagatgaagataatgccatgtacctcctggtggtgaaccatccagatgccaagtccacagtggagttgtttaaatttcaagaagaagaaaaatcgcttttgcatctaaaaaccatcagacataaacttctgcctaatttgaatgatattgttgctgtgggacctgagcacttttatggcacaaatgatcactattttcttgacccctacttacaatcctgggagatgtatttgggtttagcgtggtcgtatgttgtctactatagtccaagtgaagttcgagtggtggcagaaggatttgattttgctaatggaatcaacatttcacccgatggcaagtatgtctatatagctgagttgctggctcataagattcatgtgtatgaaaagcatgctaattggactttaactccattgaagtcccttgactttaataccctcgtggataacatatctgtggatcctgagacaggagacctttgggttggatgccatcccaatggcatgaaaatcttcttctatgactcagagaatcctcctgcatcagaggtgcttcgaatccagaacattctaacagaagaacctaaagtgacacaggtttatgcagaaaatggcacagtgttgcaaggcagtacagttgcctctgtgtacaaagggaaactgctgattggcacagtgtttcacaaagctctttactgtgagctctaacagaccgatttgcacccatgccatagaaactgaggccattatttcaaccgcttgccatattccgaggacccagtgttcttagctgaacaatgaatgctgaccctaaatgtggacatcatgaagcatcaaagcactgtttaactgggagtgatatgatgtgtagggcttttttttgagaatacactatcaaatcagtcttggaatacttgaaaacctcatttaccataaaaatccttctcactaaaatggataaatcagttatgtcaattgtcagatattaaataacagtgtgtgaccccaaaagtacttaccctaaaacatgtgttgcctgaaagcacatgtgtgtatcgctgccttgccatgtcttgttcagaagacacaggggagcagggttagctcacgtgtctttagaactccagtactcacccagggactccagttcacaggccagaaaacatatgcattatgaagttcccctctactccatgcacatagtaagtctgactatggcagtcagacttacttactcccattttcccttcgatatatgactttttctcagtaaatattaacctgaactattccaactccccttgtactcttgctttttcaattctcctgttgcaatgacacataggaaaatcttaaaattcttgggagtgttgtcacacacctgaaaattatgagtctctatgatcttggcacaaattgtacatttgagtgtctttgacttggttaaaaggaagtttgttcacttcgatgactggatacagaatgaatcccataattgacatgggcgacagtaaaagtgtccccaaagactacactgttgttgaggtggtggtagtgctggtgggtttttgtttaatatttaaacttcttgttgtggaggctgaaaagaaaaaaaataatagaaaggtaaacaaacaaataaatagaaaagatcaacaacccctttggctatctactgagacatgactaggaagaaaacatgactttatcattttgttatagaagctgatatataaggttacacattttcatttatttgtttttctgatttgaaggtataaccttcatgatgaattacttcttcagggtgttaaggcagtgactttagaaacaaatttttttcttgcttttgttttgtttttgagaccgaatctcactctgttgcccaggctggagtgcagtggtgcgatcttggctcactgcaacttctacctccgaggttcaagagattcttgtgcctcagcctcccggatagctgccg

SEQ ID NO: 299548 - DNA, 2341 bp, Homo sapiens
cggagcccgtcaggtgtctgacagcccatcgatccctttgtctatcccccgaccatggcgaagctgattgcgctcaccctcttggggatgggactggcactcttcaggaaccaccagtcttcttaccaaacacgacttaatgctctccgagaggtacaacccgtagaacttcctaactgtaatttagttaaaggaatcgaaactggctctgaagacttggagatactgcctaatggactggctttcattagctctggattaaagtatcctggaataaagagcttcaaccccaacagtcctggaatcactggaagtaaatttgatgtatcttcatttaaccctcatgggattagcacattcacagatgaagataatgccatgtacctcctggtggtgaaccatccagatgccaagtccacagtggagttgtttaaatttcaagaagaagaaaaatcgcttttgcatctaaaaaccatcagacataaacttctgcctaatttgaatgatattgttgctgtgggacctgagcacttttatggcacaaatgatcactattttcttgacccctacttacaatcctgggagatgtatttgggtttagcgtggtcgtatgttgtctactatagtccaagtgaagttcgagtggtggcagaaggatttgattttgctaatggaatcaacatttcacccgatggcaagtatgtctatatagctgagttgctggctcataagattcatgtgtatgaaaagcatgctaattggactttaactccattgaagtcccttgactttaataccctcgtggataacatatctgtggatcctgagacaggagacctttgggttggatgccatcccaatggcatgaaaatcttcttctatgactcagagaatcctcctgcatcagaggtgcttcgaatccagaacattctaacagaagaacctaaagtgacacaggtttatgcagaaaatggcacagtgttgcaaggcagtacagttgcctctgtgtacaaagggaaactgctgattggcacagtgtttcacaaagctctttactgtgagctctaacagaccgatttgcacccatgccatagaaactgaggccattatttcaaccgcttgccatattccgaggacccagtgttcttagctgaacaatgaatgctgaccctaaatgtggacatcatgaagcatcaaagcactgtttaactgggagtgatatgatgtgtagggcttttttttgagaatacactatcaaatcagtcttggaatacttgaaaacctcatttaccataaaaatccttctcactaaaatggataaatcagttatgtcaattgtcagatattaaataacagtgtgtgaccccaaaagtacttaccctaaaacatgtgttgcctgaaagcacatgtgtgtatcgctgccttgccatgtcttgttcagaagacacaggggagcagggttagctcacgtgtctttagaactccagtactcacccagggactccagttcacaggccagaaaacatatgcattatgaagttcccctctactccatgcacatagtaagtctgactatggcagtcagacttacttactcccattttcccttcgatatatgactttttctcagtaaatattaacctgaactattccaactccccttgtactcttgctttttcaattctcctgttgcaatgacacataggaaaatcttaaaattcttgggagtgttgtcacacacctgaaaattatgagtctctatgatcttggcacaaattgtacatttgagtgtctttgacttggttaaaaggaagtttgttcacttcgatgactggatacagaatgaatcccataattgacatgggcgacagtaaaagtgtccccaaagactacactgttgttgaggtggtggtagtgctggtgggtttttgtttaatatttaaacttcttgttgtggaggctgaaaagaaaaaaaataatagaaaggtaaacaaacaaataaatagaaaagatcaacaacccctttggctatctactgagacatgactaggaagaaaacatgactttatcattttgttatagaagctgatatataaggttacacattttcatttatttgtttttctgatttgaaggtataaccttcatgatgaattacttcttcagggtgttaaggcagtgactttagaaacaaatttttttcttgcttttgttttgtttttgagaccgaatctcactctgttgcccaggctggagtgcagtggtgcgatcttggctcactgcaacttctacctccgaggttcaagagattcttgtgcctcagcctcccggatagctgccg

SEQ ID NO: 299549 - DNA, 2346 bp, Homo sapiens
cggagcccgtcaggtgtctgacagcccatcgatccctttgtctatcccccgaccatggcgaagctgattgcgctcaccctcttggggatgggactggcactcttcaggaaccaccagtcttcttaccaaacacgacttaatgctctccgagaggtacaacccgtagaacttcctaactgtaatttagttaaaggaatcgaaactggctctgaagacttggagatactgcctaatggactggctttcattagctctggattaaagtatcctggaataaagagcttcaaccccaacagtcctggaaaaatacttctgatggacctgaatgaagaagatccaacagtgttggaattggggatcactggaagtaaatttgatgtatcttcatttaaccctcatgggattagcacattcacagatgaagataatgccatgtacctcctggtggtgaaccatccagatgccaagtccacagtggagttgtttaaatttcaagaagaagtttgaatgatattgttgctgtgggacctgagcacttttatggcacaaatgatcactattttcttgacccctacttacaatcctgggagatgtatttgggtttagcgtggtcgtatgttgtctactatagtccaagtgaagttcgagtggtggcagaaggatttgattttgctaatggaatcaacatttcacccgatggcaagtatgtctatatagctgagttgctggctcataagattcatgtgtatgaaaagcatgctaattggactttaactccattgaagtcccttgactttaataccctcgtggataacatatctgtggatcctgagacaggagacctttgggttggatgccatcccaatggcatgaaaatcttcttctatgactcagagaatcctcctgcatcagaggtgcttcgaatccagaacattctaacagaagaacctaaagtgacacaggtttatgcagaaaatggcacagtgttgcaaggcagtacagttgcctctgtgtacaaagggaaactgctgattggcacagtgtttcacaaagctctttactgtgagctctaacagaccgatttgcacccatgccatagaaactgaggccattatttcaaccgcttgccatattccgaggacccagtgttcttagctgaacaatgaatgctgaccctaaatgtggacatcatgaagcatcaaagcactgtttaactgggagtgatatgatgtgtagggcttttttttgagaatacactatcaaatcagtcttggaatacttgaaaacctcatttaccataaaaatccttctcactaaaatggataaatcagttatgtcaattgtcagatattaaataacagtgtgtgaccccaaaagtacttaccctaaaacatgtgttgcctgaaagcacatgtgtgtatcgctgccttgccatgtcttgttcagaagacacaggggagcagggttagctcacgtgtctttagaactccagtactcacccagggactccagttcacaggccagaaaacatatgcattatgaagttcccctctactccatgcacatagtaagtctgactatggcagtcagacttacttactcccattttcccttcgatatatgactttttctcagtaaatattaacctgaactattccaactccccttgtactcttgctttttcaattctcctgttgcaatgacacataggaaaatcttaaaattcttgggagtgttgtcacacacctgaaaattatgagtctctatgatcttggcacaaattgtacatttgagtgtctttgacttggttaaaaggaagtttgttcacttcgatgactggatacagaatgaatcccataattgacatgggcgacagtaaaagtgtccccaaagactacactgttgttgaggtggtggtagtgctggtgggtttttgtttaatatttaaacttcttgttgtggaggctgaaaagaaaaaaaataatagaaaggtaaacaaacaaataaatagaaaagatcaacaacccctttggctatctactgagacatgactaggaagaaaacatgactttatcattttgttatagaagctgatatataaggttacacattttcatttatttgtttttctgatttgaaggtataaccttcatgatgaattacttcttcagggtgttaaggcagtgactttagaaacaaatttttttcttgcttttgttttgtttttgagaccgaatctcactctgttgcccaggctggagtgcagtggtgcgatcttggctcactgcaacttctacctccgaggttcaagagattcttgtgcctcagcctcccggatagctgccg

SEQ ID NO: 299550 - DNA, 2357 bp, Homo sapiens
cggagcccgtcaggtgtctgacagcccatcgatccctttgtctatcccccgaccatggcgaagctgattgcgctcaccctcttggggatgggactggcactcttcaggaaccaccagtcttcttaccaaacacgacttaatgctctccgagaggtacaacccgtagaacttcctaactgtaatttagttaaaggaatcgaaactggctctgaagacttggagatactgcctaatggactggctttcattagctctggattaaagtatcctggaataaagagcttcaaccccaacagtcctggaaaaatacttctgatggacctgaatgaagaagatccaacagtgttggaattggggatcactggaagtaaatttgatgtatcttcatttaaccctcatgggattagcacattcacagatgaagataatgccatgtacctcctggtggtgaaccatccagatgccaagtccacagtggagttgtttaaatttcaagaagaagaaaaatcgcttttgcatctaaaaaccatcagacataaacttctgcctaaatggcacaaatgatcactattttcttgacccctacttacaatcctgggagatgtatttgggtttagcgtggtcgtatgttgtctactatagtccaagtgaagttcgagtggtggcagaaggatttgattttgctaatggaatcaacatttcacccgatggcaagtatgtctatatagctgagttgctggctcataagattcatgtgtatgaaaagcatgctaattggactttaactccattgaagtcccttgactttaataccctcgtggataacatatctgtggatcctgagacaggagacctttgggttggatgccatcccaatggcatgaaaatcttcttctatgactcagagaatcctcctgcatcagaggtgcttcgaatccagaacattctaacagaagaacctaaagtgacacaggtttatgcagaaaatggcacagtgttgcaaggcagtacagttgcctctgtgtacaaagggaaactgctgattggcacagtgtttcacaaagctctttactgtgagctctaacagaccgatttgcacccatgccatagaaactgaggccattatttcaaccgcttgccatattccgaggacccagtgttcttagctgaacaatgaatgctgaccctaaatgtggacatcatgaagcatcaaagcactgtttaactgggagtgatatgatgtgtagggcttttttttgagaatacactatcaaatcagtcttggaatacttgaaaacctcatttaccataaaaatccttctcactaaaatggataaatcagttatgtcaattgtcagatattaaataacagtgtgtgaccccaaaagtacttaccctaaaacatgtgttgcctgaaagcacatgtgtgtatcgctgccttgccatgtcttgttcagaagacacaggggagcagggttagctcacgtgtctttagaactccagtactcacccagggactccagttcacaggccagaaaacatatgcattatgaagttcccctctactccatgcacatagtaagtctgactatggcagtcagacttacttactcccattttcccttcgatatatgactttttctcagtaaatattaacctgaactattccaactccccttgtactcttgctttttcaattctcctgttgcaatgacacataggaaaatcttaaaattcttgggagtgttgtcacacacctgaaaattatgagtctctatgatcttggcacaaattgtacatttgagtgtctttgacttggttaaaaggaagtttgttcacttcgatgactggatacagaatgaatcccataattgacatgggcgacagtaaaagtgtccccaaagactacactgttgttgaggtggtggtagtgctggtgggtttttgtttaatatttaaacttcttgttgtggaggctgaaaagaaaaaaaataatagaaaggtaaacaaacaaataaatagaaaagatcaacaacccctttggctatctactgagacatgactaggaagaaaacatgactttatcattttgttatagaagctgatatataaggttacacattttcatttatttgtttttctgatttgaaggtataaccttcatgatgaattacttcttcagggtgttaaggcagtgactttagaaacaaatttttttcttgcttttgttttgtttttgagaccgaatctcactctgttgcccaggctggagtgcagtggtgcgatcttggctcactgcaacttctacctccgaggttcaagagattcttgtgcctcagcctcccggatagctgccg

SEQ ID NO: 299551 - DNA, 993 bp, Homo sapiens
ctcgtgccgaatcggcacgagcttcaggaaccaccagtcttcttaccaaacacgacttaatgctctccgagaggtacaacccgtagaacttcctaactgtaatttagttaaaggaatcgaaactggctctgaagacttggagatactgcctaatggactggctttcattagctctggattaaagtatcctggaataaagagcttcaaccccaacagtcctggaatcactggaagtaaatttgatgtatcttcatttaaccctcatgggattagcacattcacagatgaagataatgccatgtacctcctggtggtgaaccatccagatgccaagtccacagtggagttgtttaaatttcaagaagaagaaaaatcgcttttgcatctaaaaaccatcagacataaacttctgcctaactgcctaagtactgagatatatcacatttctattttcctttagctgtagcggatagttaatccacttttagtttttccttttggccagagtaggtatggctgttcaactctcatttctaatgatcacaaactcctccacatgctcttctgaagaaccttctgaggactcaagcccctcagagacggcccattcttttcctctcttgtttctcgagctgattggatgctggctcctggcctcaggatctccattcaagttattaccaggaaaaaaatcctcttcttcagaaccagacttagtatttcaaacccaaaccggcttcatagataaatttgacatcatgagcttatttatttatattaaaaagtagactcttagatgtttccatgaattagaaacacagacccaagaggagaccctgaatcaagtgcatctaagacctccttatactgcctccgctgctgtttgattgcacaaaatttatgcaatagcagatctgtggtaacactcaattccccctaggcaccttgttcatgtaacatatggtgaaataaaacactcaagaatctccaatc

SEQ ID NO: 299552 - DNA, 2571 bp, Homo sapiens
agaaaagaagtgccattatgtgaactaatgaaacccttgggctttagcaggtgtacggtcgaatccttgatgaggaggccgcggcgcgggacgcatagagctgcggctcgggcggcgcctccctgcggcggcccggcccggctccggcccccgctggggcaatgctccccggggccgcgggatgagccagcgatcctgaactgtgttcctgcccacagtgactcggccggtccgggcatggcagacccagtggcgggcatcgcgggctcggcggccaagagcgtgcggccatttcgctccagtgaggcctacgtggaggccatgaaggaggacctggccgagtggctcaatgccttgtacggcctgggtctcccgggtggtggcgatggcttcctgacagggctggccacgggcacgaccctgtgccaacatgccaacgccgtgaccgaggctgcccgtgcattggcagccgcccgcccggcccgaggtgtggccttccaggcgcacagtgtagtgcctggctccttcatggcgcgcgacaacgtggccaccttcatcggctggtgccgcgtggagctgggtgtgccggaggtgctcatgtttgagactgaggacctggtgctgcgcaagaacgagaagagcgtggtgctgtgcctgctggaggtggcgcggcgtggggcacgcctgggcctgctggccccacgcctcgtgcagtttgagcaggagattgagcgggagctgcgtgctgcacccccagcccccaacgcccctgccgctggggaggacaccactgaaaccgcccccgcaccagggactcctgcccgcggcccccgcatgacacccagcgacctgcgcaacctcgacgagctggtgagggagattctgggccgctgcacctgccctgaccagtttcccatgatcaaggtctcagaggggaagtaccgtgtgggggactcgagcctgctcatctttgtgcgggtgctgaggagccacgtgatggtgcgagtgggtggtggctgggacacgctggagcattacctggacaagcacgacccgtgccgctgctcctccactgctcatcgcccaccccagccgagggtctgcaccttttctccacagagggtgtcgcccaccaccagtccccgccctgctagcccagtccctgggagtgagcgccggggctcccggcctgagatgactcccgttagcttacgaagcacaaaggaggggcccgagaccccacccaggccccgggatcagctgcccccccatccccgctcccgccgctactccggggacagtgactcctcagcctcctccgcccagagcggcccccttggtacccgcagtgatgacacaggcactggcccccggagggagcgacccagccggcggctgaccacaggcaccccggcctctccgagacggcctcctgccctgcgcagccagtcccgagaccggctggatcgcggccggccccggggggccccaggaggcaggggagcccagctgtcggtccccagccctgcccggcgggcccggagccagagccgcgaggagcaggctgtgctgcttgtgcgcagggatcgagacgggcagcactcatgggtgccaaggggcaggggcagtgggggctcgggcaggagcaccccccagactccccgtgcccgcagccctgcagcaccccggctttcccgggtctccagccccagtccagagttgggcaccacaccggccagcatcttccgcacacccctgcagctcgacccgcagcaggagcagcagctgttccggcgcctggaagaggagttcctggccaatgcccgggcccttgaggctgttgctagcgtgacccccactggaccagcccctgacccagctcgggcccccgaccctccagctcctgactctgcctattgttcctccagttcctcctcttcgtccctcagcgtcctgggtggcaaatgtggccaacctggggactctggccggacggccaatgggctgcctgggccccgaagccaagccctttccagctcctccgatgaaggcagcccctgccctggcatgggggggccactagatgcacctgggagccccctggcttgcactgaaccctcgaggacctgggcacggggtcggatggacacacagccagaccgtaaaccctcacgtatccccacgcctcggggcccccgccgcccctccggacccgcagagctggggacatggcatgccctgcactcagtcaccccgagggctgagccagattcctggatgtgatggaccagctcagctgtccccagaccccatcccttctccttttcctttgtggccttaacccttctgcatcagggagccccctctgcctcttgagtaccagacctcatgggaccagaccccttgggaccacatggcacaatgggacctctgttgtacattccggttgggggatgagcgttgctatttaattactaatattattgaatgccttagaggaggccgggcgagcccggtgttctgaagacctgtggcccagcagagcctctgacagtaaagttttgctccagc

SEQ ID NO: 299553 - DNA, 3388 bp, Homo sapiens
cgcggcggtgccgtttatctggccaggggaggtccacccgggaggaggtgactttgcagcctccagccgctatcgcttcctgacttcatcttgggaacaggccgtgctgtgcgccagcccggggagcccaccgtctggggaggggggcgattaaaaggtcccaacctcctccccaggagaccaaagaggttggacggggccccgggtactaggctgggtgggggttgggcgcctgggccggtcgcagttgtctgggggccctggggctctctgcgtcgagagcgctcgaagacccgggattcctggcccgatcgcgggcggggggagaccccagctccaccccagctcccgccggctcggggaaggggcggcccctttaagagcgcgcggccccgcccgccccctccgggcaggatccgaattccagggaggcggggcggagacggcggcgaggaggaggccgcggcgcgggacgcatagagctgcggctcgggcggcgcctccctgcggcggcccggcccggctccggcccccgctggggcaatgctccccggggccgcgggatgagccagtgactcggccggtccgggcatggcagacccagtggcgggcatcgcgggctcggcggccaagagcgtgcggccatttcgctccagtgaggcctacgtggaggccatgaaggaggacctggccgagtggctcaatgccttgtacggcctgggtctcccgggtggtggcgatggcttcctgacagggctggccacgggcacgaccctgtgccaacatgccaacgccgtgaccgaggctgcccgtgcattggcagccgcccgcccggcccgaggtgtggccttccaggcgcacagtgtagtgcctggctccttcatggcgcgcgacaacgtggccaccttcatcggctggtgccgcgtggagctgggtgtgccggaggtgctcatgtttgagactgaggacctggtgctgcgcaagaacgagaagagcgtggtgctgtgcctgctggaggtggcgcggcgtggggcacgcctgggcctgctggccccacgcctcgtgcagtttgagcaggagattgagcgggagctgcgtgctgcacccccagcccccaacgcccctgccgctggggaggacaccactgaaaccgcccccgcaccagggactcctgcccgcggcccccgcatgacacccagcgacctgcgcaacctcgacgagctggtgagggagattctgggccgctgcacctgccctgaccagtttcccatgatcaaggtctcagaggggaagtaccgtgtgggggactcgagcctgctcatctttgtgcgggtgctgaggagccacgtgatggtgcgagtgggtggtggctgggacacgctggagcattacctggacaagcacgacccgtgccgctgctcctccactgctcatcgcccaccccagccgagggtctgcaccttttctccacagagggtgtcgcccaccaccagtccccgccctgctagcccagtccctgggagtgagcgccggggctcccggcctgagatgactcccgttagcttacgaagcacaaaggaggggcccgagaccccacccaggtgagatgcaggaggacgaggagtgaggggtccagagggtgggggggcgtcagccctggcctgcatgatgggttgcctgtgcgccagagtgactcacaccctgggaaaagttcccgtgggtgggggcgggcctggcttcccatctccatggcaacccaaccaaaccaacaacacagctggggcgggccctgtggctgggcggcagccagtccagctcttgcttcctctggcccgtcctgggaaggggggtgtctagagcccaggaaacttcttcttccgtggcttttggggccctgggccgctggaggaagctgctcacttctccctggaagtccccaggacagaccgatgcccctgacagccccgtccaccagccacataccctgctgttcctctccctgcctgttctgcatgccagtccttccgtggtaccccatctgtctctattgtccccctgccccaggccccgggatcagctgcccccccatccccgctcccgccgctactccggggacagtgactcctcagcctcctccgcccagagcggcccccttggtacccgcagtgatgacacaggcactggcccccggagggagcgacccagccggcggctgaccacaggcaccccggcctctccgagacggcctcctgccctgcgcagccagtcccgagaccggctggatcgcggccggccccggggggccccaggaggcaggggagcccagctgtcggtccccagccctgcccggcgggcccggagccagagccgcgaggagcaggctgtgctgcttgtgcgcagggatcgagacgggcagcactcatgggtgccaaggggcaggggcagtgggggctcgggcaggagcaccccccagactccccgtgcccgcagccctgcagcaccccggctttcccgggtctccagccccagtccagagttgggcaccacaccggccagcatcttccgcacacccctgcagctcgacccgcagcaggagcagcagctgttccggcgcctggaagaggagttcctggccaatgcccgggcccttgaggctgttgctagcgtgacccccactggaccagcccctgacccagctcgggcccccgaccctccagctcctgactctgcctattgttcctccagttcctcctcttcgtccctcagcgtcctgggtggcaaatgtggccaacctggggactctggccggacggccaatgggctgcctgggccccgaagccaagccctttccagctcctccgatgaaggcagcccctgccctggcatgggggggccactagatgcacctgggagccccctggcttgcactgaaccctcgaggacctgggcacggggtcggatggacacacagccagaccgtaaaccctcacgtatccccacgcctcggggcccccgccgcccctccggacccgcagagctggggacatggcatgccctgcactcagtcaccccgagggctgagccagattcctggatgtgatggaccagctcagctgtccccagaccccatcccttctccttttcctttgtggccttaacccttctgcatcagggagccccctctgcctcttgagtaccagacctcatgggaccagaccccttgggaccacatggcacaatgggacctctgttgtacattccggttgggggatgagcgttgctatttaattactaatattattgaatgccttagaggaggccgggcgagcccggtgttctgaagacctgtggcccagcagagcctctgacagtaaagttttgctccagc

SEQ ID NO: 299554 - DNA, 3643 bp, Homo sapiens
cgcggcggtgccgtttatctggccaggggaggtccacccgggaggaggtgactttgcagcctccagccgctatcgcttcctgacttcatcttgggaacaggccgtgctgtgcgccagcccggggagcccaccgtctggggaggggggcgattaaaaggtcccaacctcctccccaggagaccaaagaggttggacggggccccgggtactaggctgggtgggggttgggcgcctgggccggtcgcagttgtctgggggccctggggctctctgcgtcgagagcgctcgaagacccgggattcctggcccgatcgcgggcggggggagaccccagctccaccccagctcccgccggctcggggaaggggcggcccctttaagagcgcgcggccccgcccgccccctccgggcaggatccgaattccagggaggcggggcggagacggcggcgaggaggaggccgcggcgcgggacgcatagagctgcggctcgggcggcgcctccctgcggcggcccggcccggctccggcccccgctggggcaatgctccccggggccgcgggatgagccagtgactcggccggtccgggcatggcagacccagtggcgggcatcgcgggctcggcggccaagagcgtgcggccatttcgctccagtgaggcctacgtggaggccatgaaggaggacctggccgagtggctcaatgccttgtacggcctgggtctcccgggtggtggcgatggcttcctgacagggctggccacgggcacgaccctgtgccaacatgccaacgccgtgaccgaggctgcccgtgcattggcagccgcccgcccggcccgaggtgtggccttccaggcgcacagtgtagtgcctggctccttcatggcgcgcgacaacgtggccaccttcatcggctggtgccgcgtggagctgggtgtgccggaggtgctcatgtttgagactgaggacctggtgctgcgcaagaacgagaagagcgtggtgctgtgcctgctggaggtggcgcggcgtggggcacgcctgggcctgctggccccacgcctcgtgcagtttgagcaggagattgagcgggagctgcgtgctgcacccccagcccccaacgcccctgccgctggggaggacaccactgaaaccgcccccgcaccagggactcctgcccgcggcccccgcatgacacccagcgacctgcgcaacctcgacgagctggtgagggagattctgggccgctgcacctgccctgaccagtttcccatgatcaaggtctcagaggggaagtaccgtgtgggggactcgagcctgctcatctttgtgcgggtgctgaggagccacgtgatggtgcgagtgggtggtggctgggacacgctggagcattacctggacaagcacgacccgtgccgctgctcctccactgctcatcgcccaccccagccgagggtctgcaccttttctccacagagggtgtcgcccaccaccagtccccgccctgctagcccagtccctgggagtgagcgccggggctcccggcctgagatgactcccgttagcttacgaagcacaaaggaggggcccgagaccccacccaggtgagatgcaggaggacgaggagtgaggggtccagagggtgggggggcgtcagccctggcctgcatgatgggttgcctgtgcgccagagtgactcacaccctgggaaaagttcccgtgggtgggggcgggcctggcttcccatctccatggcaacccaaccaaaccaacaacacagctggggcgggccctgtggctgggcggcagccagtccagctcttgcttcctctggcccgtcctgggaaggggggtgtctagagcccaggaaacttcttcttccgtggcttttggggccctgggccgctggaggaagctgctcacttctccctggaagtccccaggacagaccgatgcccctgacagccccgtccaccagccacataccctgctgttcctctccctgcctgttctgcatgccagtccttccgtggtaccccatctgtctctattgtccccctgccccaggccccgggatcagctgcccccccatccccgctcccgccgctactccggggacagtgactcctcagcctcctccgcccagagcggcccccttggtacccgcagtgatgacacaggcactggcccccggagggagcgacccagccggcggctgaccacaggcaccccggcctctccgagacggcctcctgccctgcgcagccagtcccgagaccggctggatcgcggccggccccggggggccccaggaggcaggggagcccagctgtcggtccccagccctgcccggcgggcccggagccagagccgcgaggagcaggctgtgctgcttgtgcgcagggatcgagacgggcagcactcatgggtgccaaggggcaggggcagtgggggctcgggcaggagcaccccccagactccccgtgcccgcagccctgcagcaccccggctttcccgggtctccagccccagtccagagttgggcaccacaccggccagcatcttccgcacacccctgcagctcgacccgcagcaggagcagcagctgttccggcgcctggaagaggagttcctggccaatgcccgggcccttgaggctgttgctagcgtgacccccactggaccagcccctgacccagctcgggcccccgaccctccagctcctgactctgcctattgttcctccagttcctcctcttcgtccctcagcgtcctgggtggcaaatgtggccaacctggggactctggccggacggccaatgggctgcctgggccccgaagccaagccctttccagctcctccgatgaaggcagcccctgccctggcatgggggggccactagatgcacctgggagccccctggcttgcactgaaccctcgaggacctgggcacggggtcggatggacacacagccagaccgtaaaccctcacgtatccccacgcctcggggcccccgccgcccctccggacccgcagagctggggacatggcatgccctgcactcagtcaccccgagggctgagccagattcctggatgtgatggaccagctcagctgtccccagaccccatcccttctccttttcctttgtggccttaacccttctgcatcagggagccccctctgcctcttgagtaccagacctcatgggaccagaccccttgggaccacatggcacaatgggacctctgttgtacattccggttgggggatgagcgttgctatttaattactaatattattgaatgccttagaggaggccgggcgagcccggtgttctgaagacctgtggcccagcagagcctctgacagtaaagttttgctccagcaaaaaaaaaaaaaaaaaaaaaaaaaaaaacctcgtgccgaattcggcacgaggtgggcacccacaagttctccagtgccattggcctggtgctgctgatggaggcggtggccgtgctcgtcgggcccccttcgggaggcaaactcctggatgcgacccacgtctacatgtacgtgttcatcctggcgggggccgaggtgctcacctcctccctgattttgctgctgggcaacttcttctgcattaggaagaagcc

SEQ ID NO: 299555 - DNA, 2753 bp, Homo sapiens
cgcggcggtgccgtttatctggccaggggaggtccacccgggaggaggtgactttgcagcctccagccgctatcgcttcctgacttcatcttgggaacaggccgtgctgtgcgccagcccggggagcccaccgtctggggaggggggcgattaaaaggtcccaacctcctccccaggagaccaaagaggttggacggggccccgggtactaggctgggtgggggttgggcgcctgggccggtcgcagttgtctgggggccctggggctctctgcgtcgagagcgctcgaagacccgggattcctggcccgatcgcgggcggggggagaccccagctccaccccagctcccgccggctcggggaaggggcggcccctttaagagcgcgcggccccgcccgccccctccgggcaggatccgaattccagggaggcggggcggagacggcggcgaggaggaggccgcggcgcgggacgcatagagctgcggctcgggcggcgcctccctgcggcggcccggcccggctccggcccccgctggggcaatgctccccggggccgcgggatgagccagtgactcggccggtccgggcatggcagacccagtggcgggcatcgcgggctcggcggccaagagcgtgcggccatttcgctccagtgaggcctacgtggaggccatgaaggaggacctggccgagtggctcaatgccttgtacggcctgggtctcccgggtggtggcgatggcttcctgacagggctggccacgggcacgaccctgtgccaacatgccaacgccgtgaccgaggctgcccgtgcattggcagccgcccgcccggcccgaggtgtggccttccaggcgcacagtgtagtgcctggctccttcatggcgcgcgacaacgtggccaccttcatcggctggtgccgcgtggagctgggtgtgccggaggtgctcatgtttgagactgaggacctggtgctgcgcaagaacgagaagagcgtggtgctgtgcctgctggaggtggcgcggcgtggggcacgcctgggcctgctggccccacgcctcgtgcagtttgagcaggagattgagcgggagctgcgtgctgcacccccagcccccaacgcccctgccgctggggaggacaccactgaaaccgcccccgcaccagggactcctgcccgcggcccccgcatgacacccagcgacctgcgcaacctcgacgagctggtgagggagattctgggccgctgcacctgccctgaccagtttcccatgatcaaggtctcagaggggaagtaccgtgtgggggactcgagcctgctcatctttgtgcgggtgctgaggagccacgtgatggtgcgagtgggtggtggctgggacacgctggagcattacctggacaagcacgacccgtgccgctgctcctccactggccccgggatcagctgcccccccatccccgctcccgccgctactccggggacagtgactcctcagcctcctccgcccagagcggcccccttggtacccgcagtgatgacacaggcactggcccccggagggagcgacccagccggcggctgaccacaggcaccccggcctctccgagacggcctcctgccctgcgcagccagtcccgagaccggctggatcgcggccggccccggggggccccaggaggcaggggagcccagctgtcggtccccagccctgcccggcgggcccggagccagagccgcgaggagcaggctgtgctgcttgtgcgcagggatcgagacgggcagcactcatgggtgccaaggggcaggggcagtgggggctcgggcaggagcaccccccagactccccgtgcccgcagccctgcagcaccccggctttcccgggtctccagccccagtccagagttgggcaccacaccggccagcatcttccgcacacccctgcagctcgacccgcagcaggagcagcagctgttccggcgcctggaagaggagttcctggccaatgcccgggcccttgaggctgttgctagcgtgacccccactggaccagcccctgacccagctcgggcccccgaccctccagctcctgactctgcctattgttcctccagttcctcctcttcgtccctcagcgtcctgggtggcaaatgtggccaacctggggactctggccggacggccaatgggctgcctgggccccgaagccaagccctttccagctcctccgatgaaggcagcccctgccctggcatgggggggccactagatgcacctgggagccccctggcttgcactgaaccctcgaggacctgggcacggggtcggatggacacacagccagaccgtaaaccctcacgtatccccacgcctcggggcccccgccgcccctccggacccgcagagctggggacatggcatgccctgcactcagtcaccccgagggctgagccagattcctggatgtgatggaccagctcagctgtccccagaccccatcccttctccttttcctttgtggccttaacccttctgcatcagggagccccctctgcctcttgagtaccagacctcatgggaccagaccccttgggaccacatggcacaatgggacctctgttgtacattccggttgggggatgagcgttgctatttaattactaatattattgaatgccttagaggaggccgggcgagcccggtgttctgaagacctgtggcccagcagagcctctgacagtaaagttttgctccagc

SEQ ID NO: 299556 - DNA, 3006 bp, Homo sapiens
agaaaagaagtgccattatgtgaactaatgaaacccttgggctttagcaggtgtacggtcgaatccttgatgaggaggccgcggcgcgggacgcatagagctgcggctcgggcggcgcctccctgcggcggcccggcccggctccggcccccgctggggcaatgctccccggggccgcgggatgagccagtgactcggccggtccgggcatggcagacccagtggcgggcatcgcgggctcggcggccaagagcgtgcggccatttcgctccagtgaggcctacgtggaggccatgaaggaggacctggccgagtggctcaatgccttgtacggcctgggtctcccgggtggtggcgatggcttcctgacagggctggccacgggcacgaccctgtgccaacatgccaacgccgtgaccgaggctgcccgtgcattggcagccgcccgcccggcccgaggtgtggccttccaggcgcacagtgtagtgcctggctccttcatggcgcgcgacaacgtggccaccttcatcggctggtgccgcgtggagctgggtgtgccggaggtgctcatgtttgagactgaggacctggtgctgcgcaagaacgagaagagcgtggtgctgtgcctgctggaggtggcgcggcgtggggcacgcctgggcctgctggccccacgcctcgtgcagtttgagcaggagattgagcgggagctgcgtgctgcacccccagcccccaacgcccctgccgctggggaggacaccactgaaaccgcccccgcaccagggactcctgcccgcggcccccgcatgacacccagcgacctgcgcaacctcgacgagctggtgagggagattctgggccgctgcacctgccctgaccagtttcccatgatcaaggtctcagaggggaagtaccgtgtgggggactcgagcctgctcatctttgtgcgggtgctgaggagccacgtgatggtgcgagtgggtggtggctgggacacgctggagcattacctggacaagcacgacccgtgccgctgctcctccactgctcatcgcccaccccagccgagggtctgcaccttttctccacagagggtgtcgcccaccaccagtccccgccctgctagcccagtccctgggagtgagcgccggggctcccggcctgagatgactcccgttagcttacgaagcacaaaggaggggcccgagaccccacccaggtgagatgcaggaggacgaggagtgaggggtccagagggtgggggggcgtcagccctggcctgcatgatgggttgcctgtgcgccagagtgactcacaccctgggaaaagttcccgtgggtgggggcgggcctggcttcccatctccatggcaacccaaccaaaccaacaacacagctggggcgggccctgtggctgggcggcagccagtccagctcttgcttcctctggcccgtcctgggaaggggggtgtctagagcccaggaaacttcttcttccgtggcttttggggccctgggccgctggaggaagctgctcacttctccctggaagtccccaggacagaccgatgcccctgacagccccgtccaccagccacataccctgctgttcctctccctgcctgttctgcatgccagtccttccgtggtaccccatctgtctctattgtccccctgccccaggccccgggatcagctgcccccccatccccgctcccgccgctactccggggacagtgactcctcagcctcctccgcccagagcggcccccttggtacccgcagtgatgacacaggcactggcccccggagggagcgacccagccggcggctgaccacaggcaccccggcctctccgagacggcctcctgccctgcgcagccagtcccgagaccggctggatcgcggccggccccggggggccccaggaggcaggggagcccagctgtcggtccccagccctgcccggcgggcccggagccagagccgcgaggagcaggctgtgctgcttgtgcgcagggatcgagacgggcagcactcatgggtgccaaggggcaggggcagtgggggctcgggcaggagcaccccccagactccccgtgcccgcagccctgcagcaccccggctttcccgggtctccagccccagtccagagttgggcaccacaccggccagcatcttccgcacacccctgcagctcgacccgcagcaggagcagcagctgttccggcgcctggaagaggagttcctggccaatgcccgggcccttgaggctgttgctagcgtgacccccactggaccagcccctgacccagctcgggcccccgaccctccagctcctgactctgcctattgttcctccagttcctcctcttcgtccctcagcgtcctgggtggcaaatgtggccaacctggggactctggccggacggccaatgggctgcctgggccccgaagccaagccctttccagctcctccgatgaaggcagcccctgccctggcatgggggggccactagatgcacctgggagccccctggcttgcactgaaccctcgaggacctgggcacggggtcggatggacacacagccagaccgtaaaccctcacgtatccccacgcctcggggcccccgccgcccctccggacccgcagagctggggacatggcatgccctgcactcagtcaccccgagggctgagccagattcctggatgtgatggaccagctcagctgtccccagaccccatcccttctccttttcctttgtggccttaacccttctgcatcagggagccccctctgcctcttgagtaccagacctcatgggaccagaccccttgggaccacatggcacaatgggacctctgttgtacattccggttgggggatgagcgttgctatttaattactaatattattgaatgccttagaggaggccgggcgagcccggtgttctgaagacctgtggcccagcagagcctctgacagtaaagttttgctccagc

SEQ ID NO: 299557 - DNA, 2726 bp, Homo sapiens
gctttcgtgtccactgggggccttagccgttgtcttcacttctctaggtcccagcccttcacaatgggcgcgcctccctgcctgagagggaggccccagccaagccccagtttccaccgcaaaaagccacacagcaaacacttaatggaccctaaatttataaaaattatcccatagagtcctatgaggcagggaatgttactgtacccatttcgcagatgaggaaacttggggcaccgacatttcccagagccaacatgtaaaccaggcatttggcctgagtgacagactggtgcaggtggccagcagcttaatttgtactgagcgcttactgggtccccacagcgatcctgaactgtgttcctgcccacagtgactcggccggtccgggcatggcagacccagtggcgggcatcgcgggctcggcggccaagagcgtgcggccatttcgctccagtgaggcctacgtggaggccatgaaggaggacctggccgagtggctcaatgccttgtacggcctgggtctcccgggtggtggcgatggcttcctgacagggctggccacgggcacgaccctgtgccaacatgccaacgccgtgaccgaggctgcccgtgcattggcagccgcccgcccggcccgaggtgtggccttccaggcgcacagtgtagtgcctggctccttcatggcgcgcgacaacgtggccaccttcatcggctggtgccgcgtggagctgggtgtgccggaggtgctcatgtttgagactgaggacctggtgctgcgcaagaacgagaagagcgtggtgctgtgcctgctggaggtggcgcggcgtggggcacgcctgggcctgctggccccacgcctcgtgcagtttgagcaggagattgagcgggagctgcgtgctgcacccccagcccccaacgcccctgccgctggggaggacaccactgaaaccgcccccgcaccagggactcctgcccgcggcccccgcatgacacccagcgacctgcgcaacctcgacgagctggtgagggagattctgggccgctgcacctgccctgaccagtttcccatgatcaaggtctcagaggggaagtaccgtgtgggggactcgagcctgctcatctttgtgcgggtgctgaggagccacgtgatggtgcgagtgggtggtggctgggacacgctggagcattacctggacaagcacgacccgtgccgctgctcctccactgctcatcgcccaccccagccgagggtctgcaccttttctccacagagggtgtcgcccaccaccagtccccgccctgctagcccagtccctgggagtgagcgccggggctcccggcctgagatgactcccgttagcttacgaagcacaaaggaggggcccgagaccccacccaggccccgggatcagctgcccccccatccccgctcccgccgctactccggggacagtgactcctcagcctcctccgcccagagcggcccccttggtacccgcagtgatgacacaggcactggcccccggagggagcgacccagccggcggctgaccacaggcaccccggcctctccgagacggcctcctgccctgcgcagccagtcccgagaccggctggatcgcggccggccccggggggccccaggaggcaggggagcccagctgtcggtccccagccctgcccggcgggcccggagccagagccgcgaggagcaggctgtgctgcttgtgcgcagggatcgagacgggcagcactcatgggtgccaaggggcaggggcagtgggggctcgggcaggagcaccccccagactccccgtgcccgcagccctgcagcaccccggctttcccgggtctccagccccagtccagagttgggcaccacaccggccagcatcttccgcacacccctgcagctcgacccgcagcaggagcagcagctgttccggcgcctggaagaggagttcctggccaatgcccgggcccttgaggctgttgctagcgtgacccccactggaccagcccctgacccagctcgggcccccgaccctccagctcctgactctgcctattgttcctccagttcctcctcttcgtccctcagcgtcctgggtggcaaatgtggccaacctggggactctggccggacggccaatgggctgcctgggccccgaagccaagccctttccagctcctccgatgaaggcagcccctgccctggcatgggggggccactagatgcacctgggagccccctggcttgcactgaaccctcgaggacctgggcacggggtcggatggacacacagccagaccgtaaaccctcacgtatccccacgcctcggggcccccgccgcccctccggacccgcagagctggggacatggcatgccctgcactcagtcaccccgagggctgagccagattcctggatgtgatggaccagctcagctgtccccagaccccatcccttctccttttcctttgtggccttaacccttctgcatcagggagccccctctgcctcttgagtaccagacctcatgggaccagaccccttgggaccacatggcacaatgggacctctgttgtacattccggttgggggatgagcgttgctatttaattactaatattattgaatgccttagaggaggccgggcgagcccggtgttctgaagacctgtggcccagcagagcctctgacagtaaagttttgctccagc

SEQ ID NO: 299558 - DNA, 2435 bp, Homo sapiens
tctaaggtaactaatcatatgttaactgtatcatgtctagactagcttgatatgtggctgctggagagtagtgataactgagtattatgtatgaccaatatattacacaggagctagtgagaatcgcgggctcggcggccaagagcgtgcggccatttcgctccagtgaggcctacgtggaggccatgaaggaggacctggccgagtggctcaatgccttgtacggcctgggtctcccgggtggtggcgatggcttcctgacagggctggccacgggcacgaccctgtgccaacatgccaacgccgtgaccgaggctgcccgtgcattggcagccgcccgcccggcccgaggtgtggccttccaggcgcacagtgtagtgcctggctccttcatggcgcgcgacaacgtggccaccttcatcggctggtgccgcgtggagctgggtgtgccggaggtgctcatgtttgagactgaggacctggtgctgcgcaagaacgagaagagcgtggtgctgtgcctgctggaggtggcgcggcgtggggcacgcctgggcctgctggccccacgcctcgtgcagtttgagcaggagattgagcgggagctgcgtgctgcacccccagcccccaacgcccctgccgctggggaggacaccactgaaaccgcccccgcaccagggactcctgcccgcggcccccgcatgacacccagcgacctgcgcaacctcgacgagctggtgagggagattctgggccgctgcacctgccctgaccagtttcccatgatcaaggtctcagaggggaagtaccgtgtgggggactcgagcctgctcatctttgtgcgggtgctgaggagccacgtgatggtgcgagtgggtggtggctgggacacgctggagcattacctggacaagcacgacccgtgccgctgctcctccactgctcatcgcccaccccagccgagggtctgcaccttttctccacagagggtgtcgcccaccaccagtccccgccctgctagcccagtccctgggagtgagcgccggggctcccggcctgagatgactcccgttagcttacgaagcacaaaggaggggcccgagaccccacccaggccccgggatcagctgcccccccatccccgctcccgccgctactccggggacagtgactcctcagcctcctccgcccagagcggcccccttggtacccgcagtgatgacacaggcactggcccccggagggagcgacccagccggcggctgaccacaggcaccccggcctctccgagacggcctcctgccctgcgcagccagtcccgagaccggctggatcgcggccggccccggggggccccaggaggcaggggagcccagctgtcggtccccagccctgcccggcgggcccggagccagagccgcgaggagcaggctgtgctgcttgtgcgcagggatcgagacgggcagcactcatgggtgccaaggggcaggggcagtgggggctcgggcaggagcaccccccagactccccgtgcccgcagccctgcagcaccccggctttcccgggtctccagccccagtccagagttgggcaccacaccggccagcatcttccgcacacccctgcagctcgacccgcagcaggagcagcagctgttccggcgcctggaagaggagttcctggccaatgcccgggcccttgaggctgttgctagcgtgacccccactggaccagcccctgacccagctcgggcccccgaccctccagctcctgactctgcctattgttcctccagttcctcctcttcgtccctcagcgtcctgggtggcaaatgtggccaacctggggactctggccggacggccaatgggctgcctgggccccgaagccaagccctttccagctcctccgatgaaggcagcccctgccctggcatgggggggccactagatgcacctgggagccccctggcttgcactgaaccctcgaggacctgggcacggggtcggatggacacacagccagaccgtaaaccctcacgtatccccacgcctcggggcccccgccgcccctccggacccgcagagctggggacatggcatgccctgcactcagtcaccccgagggctgagccagattcctggatgtgatggaccagctcagctgtccccagaccccatcccttctccttttcctttgtggccttaacccttctgcatcagggagccccctctgcctcttgagtaccagacctcatgggaccagaccccttgggaccacatggcacaatgggacctctgttgtacattccggttgggggatgagcgttgctatttaattactaatattattgaatgccttagaggaggccgggcgagcccggtgttctgaagacctgtggcccagcagagcctctgacagtaaagttttgctccagc

SEQ ID NO: 299559 - DNA, 2324 bp, Homo sapiens
aaagaaaggtcacgtgtggaagctgtaccccatccggggcaacactgcctccatccacttacccggaaagcctgacttcctcctgaccctggaatggctgacattaagccccaggaggaggacttgacctctgacccctaccctctctctctggcctcaggtgagggagattctgggccgctgcacctgccctgaccagtttcccatgatcaaggtctcagaggggaagtaccgtgtgggggactcgagcctgctcatctttgtgcgggtgctgaggagccacgtgatggtgcgagtgggtggtggctgggacacgctggagcattacctggacaagcacgacccgtgccgctgctcctccactgctcatcgcccaccccagccgagggtctgcaccttttctccacagagggtgtcgcccaccaccagtccccgccctgctagcccagtccctgggagtgagcgccggggctcccggcctgagatgactcccgttagcttacgaagcacaaaggaggggcccgagaccccacccaggtgagatgcaggaggacgaggagtgaggggtccagagggtgggggggcgtcagccctggcctgcatgatgggttgcctgtgcgccagagtgactcacaccctgggaaaagttcccgtgggtgggggcgggcctggcttcccatctccatggcaacccaaccaaaccaacaacacagctggggcgggccctgtggctgggcggcagccagtccagctcttgcttcctctggcccgtcctgggaaggggggtgtctagagcccaggaaacttcttcttccgtggcttttggggccctgggccgctggaggaagctgctcacttctccctggaagtccccaggacagaccgatgcccctgacagccccgtccaccagccacataccctgctgttcctctccctgcctgttctgcatgccagtccttccgtggtaccccatctgtctctattgtccccctgccccaggccccgggatcagctgcccccccatccccgctcccgccgctactccggggacagtgactcctcagcctcctccgcccagagcggcccccttggtacccgcagtgatgacacaggcactggcccccggagggagcgacccagccggcggctgaccacaggcaccccggcctctccgagacggcctcctgccctgcgcagccagtcccgagaccggctggatcgcggccggccccggggggccccaggaggcaggggagcccagctgtcggtccccagccctgcccggcgggcccggagccagagccgcgaggagcaggctgtgctgcttgtgcgcagggatcgagacgggcagcactcatgggtgccaaggggcaggggcagtgggggctcgggcaggagcaccccccagactccccgtgcccgcagccctgcagcaccccggctttcccgggtctccagccccagtccagagttgggcaccacaccggccagcatcttccgcacacccctgcagctcgacccgcagcaggagcagcagctgttccggcgcctggaagaggagttcctggccaatgcccgggcccttgaggctgttgctagcgtgacccccactggaccagcccctgacccagctcgggcccccgaccctccagctcctgactctgcctattgttcctccagttcctcctcttcgtccctcagcgtcctgggtggcaaatgtggccaacctggggactctggccggacggccaatgggctgcctgggccccgaagccaagccctttccagctcctccgatgaaggcagcccctgccctggcatgggggggccactagatgcacctgggagccccctggcttgcactgaaccctcgaggacctgggcacggggtcggatggacacacagccagaccgtaaaccctcacgtatccccacgcctcggggcccccgccgcccctccggacccgcagagctggggacatggcatgccctgcactcagtcaccccgagggctgagccagattcctggatgtgatggaccagctcagctgtccccagaccccatcccttctccttttcctttgtggccttaacccttctgcatcagggagccccctctgcctcttgagtaccagacctcatgggaccagaccccttgggaccacatggcacaatgggacctctgttgtacattccggttgggggatgagcgttgctatttaattactaatattattgaatgccttagaggaggccgggcgagcccggtgttctgaagacctgtggcccagcagagcctctgacagtaaagttttgctccagc

SEQ ID NO: 299560 - DNA, 1758 bp, Homo sapiens
cgcggcggtgccgtttatctggccaggggaggtccacccgggaggaggtgactttgcagcctccagccgctatcgcttcctgacttcatcttgggaacaggccgtgctgtgcgccagcccggggagcccaccgtctggggaggggggcgattaaaaggtcccaacctcctccccaggagaccaaagaggttggacggggccccgggtactaggctgggtgggggttgggcgcctgggccggtcgcagttgtctgggggccctggggctctctgcgtcgagagcgctcgaagacccgggattcctggcccgatcgcgggcggggggagaccccagctccaccccagctcccgccggctcggggaaggggcggcccctttaagagcgcgcggccccgcccgccccctccgggcaggatccgaattccagggaggcggggcggagacggcggcgaggaggaggccgcggcgcgggacgcatagagctgcggctcgggcggcgcctccctgcggcggcccggcccggctccggcccccgctggggcaatgctccccggggccgcgggatgagccagtgactcggccggtccgggcatggcagacccagtggcgggcatcgcgggctcggcggccaagagcgtgcggccatttcgctccagtgaggcctacgtggaggccatgaaggaggacctggccgagtggctcaatgccttgtacggcctgggtctcccgggtggtggcgatggcttcctgacagggctggccacgggcacgaccctgtgccaacatgccaacgccgtgaccgaggctgcccgtgcattggcagccgcccgcccggcccgaggtgtggccttccaggcgcacagtgtagtgcctggctccttcatggcgcgcgacaacgtggccaccttcatcggctggtgccgcgtggagctgggtgtgccggaggtgctcatgtttgagactgaggacctggtgctgcgcaagaacgagaagagcgtggtgctgtgcctgctggaggtggcgcggcgtggggcacgcctgggcctgctggccccacgcctcgtgcagtttgagcaggagattgagcgggagctgcgtgctgcacccccagcccccaacgcccctgccgctggggaggacaccactgaaaccgcccccgcaccagggactcctgcccgcggcccccgcatgacacccagcgacctgcgcaacctcgacgagctggtgagggagattctgggccgctgcacctgccctgaccagtttcccatgatcaaggtctcagaggggaagtaccgtgtgggggactcgagcctgctcatctttgtgcgggtgctgaggagccacgtgatggtgcgagtgggtggtggctgggacacgctggagcattacctggacaccgcagagctggggacatggcatgccctgcactcagtcaccccgagggctgagccagattcctggatgtgatggaccagctcagctgtccccagaccccatcccttctccttttcctttgtggccttaacccttctgcatcagggagccccctctgcctcttgagtaccagacctcatgggaccagaccccttgggaccacatggcacaatgggacctctgttgtacattccggttgggggatgagcgttgctatttaattactaatattattgaatgccttagaggaggccgggcgagcccggtgttctgaagacctgtggcccagcagagcctctgacagtaaagttttgctccagc

SEQ ID NO: 299561 - DNA, 574 bp, Homo sapiens
ctggcatcccgagaagccaggaagcagtgagcccaggagtcctcggccagccctgcctgcccaccaggaggatgaaggtctccgtggctgccctctcctgcctcatgcttgttactgcccttggatcccaggcccgggtcacaaaagatgcagagacagagttcatgatgtcaaagcttccattggaaaatccagtacttctggacagattccatgctactagtgctgactgctgcatctcctacaccccacgaagcatcccgtgttcactcctggagagttactttgaaacgaacagcgagtgctccaagccgggtgtcatcttcctcaccaagaaggggcgacgtttctgtgccaaccccagtgataagcaagttcaggtttgcatgagaatgctgaagctggacacacggatcaagaccaggaagaattgaacttgtcaaggtgaagggacacaagttgccagccaccaactttcttgcctcaactaccttcctgaattatttttttaagaagcatttattcttgtgttctggatttagagcaattcatctaataaacagtttctcacttt

SEQ ID NO: 299562 - DNA, 625 bp, Homo sapiens
ctggcatcccgagaagccaggaagcagtgagcccaggagtcctcggccagccctgcctgcccaccaggaggatgaaggtctccgtggctgccctctcctgcctcatgcttgttactgcccttggatcccaggcccgggtcacaaaagatgcagagacagagttcatgatgtcaaagcttccattggaaaatccagtacttctggacatgctctggaggagaaagattggtcctcagatgaccctttctcatgctgcaggattccatgctactagtgctgactgctgcatctcctacaccccacgaagcatcccgtgttcactcctggagagttactttgaaacgaacagcgagtgctccaagccgggtgtcatcttcctcaccaagaaggggcgacgtttctgtgccaaccccagtgataagcaagttcaggtttgcatgagaatgctgaagctggacacacggatcaagaccaggaagaattgaacttgtcaaggtgaagggacacaagttgccagccaccaactttcttgcctcaactaccttcctgaattatttttttaagaagcatttattcttgtgttctggatttagagcaattcatctaataaacagtttctcacttt

SEQ ID NO: 299563 - DNA, 674 bp, Homo sapiens
  misc_feature (541)..(541): n is a, c, g, or t
ctggcatcccgagaagccaggaagcagtgagcccaggagtcctcggccagccctgcctgcccaccaggaggatgaaggtctccgtggctgccctctcctgcctcatgcttgttactgcccttggatcccaggcccgggtcacaaaagatgcagagacagggggtcagggggggggaggtttccatttgaaaaatcaggacttttggacatgcttctggagggaaaaagatggggccctaaaaataccccttttttaatgcctgagggaatcccaagcctattaaggcctgacctggtgaatttcccaaccccccacaaaacatcccccgggttcccttccgtgaaaatttttttttaaaaaaaaaaagagagggctctcaaaccggggtggtatttttttcccaccaaaaaaaaggggaaaatttctttttggccccccccccccattaaaaaaaaactctacattttttctttaaaaaaatttgtgaggtggccccacccctttttaaaacccaaaataatatttcttcttttgtggggngagaggaacacatttggtcgcccacaccacaattttttttcacacaacccacctctctccaaatatttttataaaaaaaaaattttcattttgttcgcgggggtgggggggagttcttataaaaaaaactcct

SEQ ID NO: 299564 - DNA, 3290 bp, Homo sapiens
tgcatggtttatggtgctgctctaatattttctctttaaaactgtgtcatttttggagaatgaatttttcaaccttttcattgtggaggatttttcccacaaggtagtaatgggcagtggatcaaaatcctatcataaatgattgaattttcaatgtcatagtgtgtggaaatactactccctttcctccatgtctatcttcttagatgttctgtctttgtcatcatctgctccagcacatactttggactcctttacaggtgaccttcccccctccctcctcaataggtgtcctcagtgttttctaagcatttaaaactgaatttgacaagtggctaaaaacttagtctgagacttgtacttagtatatggttaattatagaaacaacaactattttaaacagttactctgttgactgctctttatgactacacttgtatgccaggaggcagcagcaccaccaggacgactctttacaagcaaccaacgaaccaattgcagtggttgcagttgtcacagtagtcttgcccaggctccagtctggctagagagcatccagcccattccttgcctcagtgccacctttttctgggcaagtagccaagaagtgactttatatgcagtgagtacttcagataaacttacagctacagctgccgaagagtggagaaggttgaccaccatttatttaattctctagtgtaaaaacaattgagagcagtgtgcgtgagcccacagacacctgtgtttctgggagctctggcagtggcggattcataggcacttgggctgcactttgaatgacacacttggctttattagattcactagtttttaaaaaattgttgttcgtttcttttcattaaaggtttaatcagacagatcagacagcataattttgtatttaatgacagaaacgttggtacatttcttcatgaatgagcttgcattctgaagcaagagcctacaaaaggcacttgttataaatgaaagttctggctctagaggccagtactctggagtttcagagcagccagtgattgttccagtcagtgatgcctagttatatagaggaggagtacactgtgcactcttctaggtgtaagggtatgcaactttggatcttaaaattctgtacacatacacactttatatatatgtatgtatgtatgaaaacatgaaattagtttgtcaaatatgtgtgtgtttagtattttagcttagtgcaactatttccacattatttattaaattgatctaagacactttcttgttgacaccttgaatattaatgttcaagggtgcaatgtgtattcctttagattgttaaagcttaattactatgatttgtagtaaattaacttttaaaatgtatttgagcccttctgtagtgtcgtagggctcttacagggtgggaaagattttaattttccagttgctaattgaacagtatggcctcattatatattttgatttataggagtttgtgtctgggtcccaggaacatctactggggatgactgttaggcagcttgtgatgatgttttttaaaaaacctaagtaacttggggagacagagcatttcaaacccatatagacacctatcatacctgtatatcccctaatacatggaacataaatttcatttcagctttatgcattaatgtattgaagaggcaggctttttttccagtaataatactgtacatctaaggttgctattcagtaaaactaatagaagagataattattgaataccttggaatatgtagtgagaagaggccaaatttttcatgtttgtgagcatgtctttcagatactcgctaatggagaaattcactttagacctctagaccccaaaaccaagttagcaagtgacaaaaagtaaattattaatagtctgtaaagtggatgctggtcttacaaagctcctattcacatgaaccctatggttaattagaaagaacttgctgtctccagaaaagggaatggaaataataactatgtatcttcttttcatgtaatttggtcacagaataaggtattcaagttaagtctaatccaagtcttagagatctttaagtatcctaaaatagcagcctaagtagtcatcatgtaaagaagttgactttcaggaatgtcagcattgacctctccttgccactgttactcagctaaacataacttgccattcttaaaaataaaaaagctcccacccagaaactctagtgatactcagttttgacctcttactgcttccatgtgggacttcttttcagcttttaaccattggaattttctacctgctatgttcctctctggaaaatatcaatttggaaatgctgcctttcaaatcaatgccatgatcatccatattgttgagtttgttgttggtgttccagaagtgtccccattttacaactttatgcacacacctggcaaatcattaacatgagcattcaacagtactgggatgggtggggtgggggtagggggctcaccaacagaactggccagttgacattgcctgaaaaggcaccacctttaagggccagttgtggggttggtaagcacagttatgaaaatttctatctagcctccgttttgaatggttttaagaaattttgtatatggaggatggaaatgcttatatatttattgaaaatccttttatttgaaattaaaattatttggtatataattgtttgatatttggggagggttttggaggggagataatgtcactgataaattaaaagcctgttgattttgcagaaaggtactgttagtgactgataaggatgcctttgttttgtacatgaaccaaatctttgttttacatttcttttatccaaaatatttaggcatctgacattttcaaccagaatttcaattatatactgtgatttttatttgttgcaatacattacaatttcagaggtactttggggctcaaaagctaggatttctaagtcagtatgtgcatttcacacgataaagctgttaatggtgagcaaagtattatatactaactagatttttccacatctgtatagtatattatatgtattttgtggtattgagagtatagaaagtttagagtgtcaaacatgcgtttaatgtgtatttttaaacaaatttatggcaattaaaatatttggagacaagggtatcacatttcaatttgtaaagatctttttaactctactgtgtcattaagatgctttgtacaatgccaaaccatagttggagaaactaagtttaataaatatcaaatagattttctgta

SEQ ID NO: 299565 - DNA, 3353 bp, Homo sapiens
tgcatggtttatggtgctgctctaatattttctctttaaaactgtgtcatttttggagaatgaatttttcaaccttttcattgtggaggatttttcccacaaggtagtaatgggcagtggatcaaaatcctatcataaatgattgaattttcaatgtcatagtgtgtggaaatactactccctttcctccatgtctatcttcttagatgttctgtctttgtcatcatctgctccagcacatactttggactcctttacaggtgaccttcccccctccctcctcaataggtgtcctcagtgttttctaagcatttaaaactgaatttgacaagtggctaaaaacttagtctgagacttgtacttagtatatggttaattatagaaacaacaactattttaaacagttactctgttgactgctctttatgactacacttgtatgccaggaggcagcagcaccaccaggacgactctttacaagcaaccaacgaaccaattgcagtggttgcagttgtcacagtagtcttgcctgggccagactgggctgggctgtgggaagcattccccttcaggggagtttccacagctcagcccaggctccagtctggctagagagcatccagcccattccttgcctcagtgccacctttttctgggcaagtagccaagaagtgactttatatgcagtgagtacttcagataaacttacagctacagctgccgaagagtggagaaggttgaccaccatttatttaattctctagtgtaaaaacaattgagagcagtgtgcgtgagcccacagacacctgtgtttctgggagctctggcagtggcggattcataggcacttgggctgcactttgaatgacacacttggctttattagattcactagtttttaaaaaattgttgttcgtttcttttcattaaaggtttaatcagacagatcagacagcataattttgtatttaatgacagaaacgttggtacatttcttcatgaatgagcttgcattctgaagcaagagcctacaaaaggcacttgttataaatgaaagttctggctctagaggccagtactctggagtttcagagcagccagtgattgttccagtcagtgatgcctagttatatagaggaggagtacactgtgcactcttctaggtgtaagggtatgcaactttggatcttaaaattctgtacacatacacactttatatatatgtatgtatgtatgaaaacatgaaattagtttgtcaaatatgtgtgtgtttagtattttagcttagtgcaactatttccacattatttattaaattgatctaagacactttcttgttgacaccttgaatattaatgttcaagggtgcaatgtgtattcctttagattgttaaagcttaattactatgatttgtagtaaattaacttttaaaatgtatttgagcccttctgtagtgtcgtagggctcttacagggtgggaaagattttaattttccagttgctaattgaacagtatggcctcattatatattttgatttataggagtttgtgtctgggtcccaggaacatctactggggatgactgttaggcagcttgtgatgatgttttttaaaaaacctaagtaacttggggagacagagcatttcaaacccatatagacacctatcatacctgtatatcccctaatacatggaacataaatttcatttcagctttatgcattaatgtattgaagaggcaggctttttttccagtaataatactgtacatctaaggttgctattcagtaaaactaatagaagagataattattgaataccttggaatatgtagtgagaagaggccaaatttttcatgtttgtgagcatgtctttcagatactcgctaatggagaaattcactttagacctctagaccccaaaaccaagttagcaagtgacaaaaagtaaattattaatagtctgtaaagtggatgctggtcttacaaagctcctattcacatgaaccctatggttaattagaaagaacttgctgtctccagaaaagggaatggaaataataactatgtatcttcttttcatgtaatttggtcacagaataaggtattcaagttaagtctaatccaagtcttagagatctttaagtatcctaaaatagcagcctaagtagtcatcatgtaaagaagttgactttcaggaatgtcagcattgacctctccttgccactgttactcagctaaacataacttgccattcttaaaaataaaaaagctcccacccagaaactctagtgatactcagttttgacctcttactgcttccatgtgggacttcttttcagcttttaaccattggaattttctacctgctatgttcctctctggaaaatatcaatttggaaatgctgcctttcaaatcaatgccatgatcatccatattgttgagtttgttgttggtgttccagaagtgtccccattttacaactttatgcacacacctggcaaatcattaacatgagcattcaacagtactgggatgggtggggtgggggtagggggctcaccaacagaactggccagttgacattgcctgaaaaggcaccacctttaagggccagttgtggggttggtaagcacagttatgaaaatttctatctagcctccgttttgaatggttttaagaaattttgtatatggaggatggaaatgcttatatatttattgaaaatccttttatttgaaattaaaattatttggtatataattgtttgatatttggggagggttttggaggggagataatgtcactgataaattaaaagcctgttgattttgcagaaaggtactgttagtgactgataaggatgcctttgttttgtacatgaaccaaatctttgttttacatttcttttatccaaaatatttaggcatctgacattttcaaccagaatttcaattatatactgtgatttttatttgttgcaatacattacaatttcagaggtactttggggctcaaaagctaggatttctaagtcagtatgtgcatttcacacgataaagctgttaatggtgagcaaagtattatatactaactagatttttccacatctgtatagtatattatatgtattttgtggtattgagagtatagaaagtttagagtgtcaaacatgcgtttaatgtgtatttttaaacaaatttatggcaattaaaatatttggagacaagggtatcacatttcaatttgtaaagatctttttaactctactgtgtcattaagatgctttgtacaatgccaaaccatagttggagaaactaagtttaataaatatcaaatagattttctgta

SEQ ID NO: 299566 - DNA, 3382 bp, Homo sapiens
gggtgaggcttcaacacaggaattttggggggacacatcagcattcactccatcacaggtggttagccctttaatccacgggaattttgtttggggttgtgtgagatacgggtctaatattttctctttaaaactgtgtcatttttggagaatgaatttttcaaccttttcattgtggaggatttttcccacaaggtagtaatgggcagtggatcaaaatcctatcataaatgattgaattttcaatgtcatagtgtgtggaaatactactccctttcctccatgtctatcttcttagatgttctgtctttgtcatcatctgctccagcacatactttggactcctttacaggtgaccttcccccctccctcctcaataggtgtcctcagtgttttctaagcatttaaaactgaatttgacaagtggctaaaaacttagtctgagacttgtacttagtatatggttaattatagaaacaacaactattttaaacagttactctgttgactgctctttatgactacacttgtatgccaggaggcagcagcaccaccaggacgactctttacaagcaaccaacgaaccaattgcagtggttgcagttgtcacagtagtcttgcccaggctccagtctggctagagagcatccagcccattccttgcctcagtgccacctttttctgggcaagtagccaagaagtgactttatatgcagtgagtacttcagataaacttacagctacagctgccgaagagtggagaaggttgaccaccatttatttaattctctagtgtaaaaacaattgagagcagtgtgcgtgagcccacagacacctgtgtttctgggagctctggcagtggcggattcataggcacttgggctgcactttgaatgacacacttggctttattagattcactagtttttaaaaaattgttgttcgtttcttttcattaaaggtttaatcagacagatcagacagcataattttgtatttaatgacagaaacgttggtacatttcttcatgaatgagcttgcattctgaagcaagagcctacaaaaggcacttgttataaatgaaagttctggctctagaggccagtactctggagtttcagagcagccagtgattgttccagtcagtgatgcctagttatatagaggaggagtacactgtgcactcttctaggtgtaagggtatgcaactttggatcttaaaattctgtacacatacacactttatatatatgtatgtatgtatgaaaacatgaaattagtttgtcaaatatgtgtgtgtttagtattttagcttagtgcaactatttccacattatttattaaattgatctaagacactttcttgttgacaccttgaatattaatgttcaagggtgcaatgtgtattcctttagattgttaaagcttaattactatgatttgtagtaaattaacttttaaaatgtatttgagcccttctgtagtgtcgtagggctcttacagggtgggaaagattttaattttccagttgctaattgaacagtatggcctcattatatattttgatttataggagtttgtgtctgggtcccaggaacatctactggggatgactgttaggcagcttgtgatgatgttttttaaaaaacctaagtaacttggggagacagagcatttcaaacccatatagacacctatcatacctgtatatcccctaatacatggaacataaatttcatttcagctttatgcattaatgtattgaagaggcaggctttttttccagtaataatactgtacatctaaggttgctattcagtaaaactaatagaagagataattattgaataccttggaatatgtagtgagaagaggccaaatttttcatgtttgtgagcatgtctttcagatactcgctaatggagaaattcactttagacctctagaccccaaaaccaagttagcaagtgacaaaaagtaaattattaatagtctgtaaagtggatgctggtcttacaaagctcctattcacatgaaccctatggttaattagaaagaacttgctgtctccagaaaagggaatggaaataataactatgtatcttcttttcatgtaatttggtcacagaataaggtattcaagttaagtctaatccaagtcttagagatctttaagtatcctaaaatagcagcctaagtagtcatcatgtaaagaagttgactttcaggaatgtcagcattgacctctccttgccactgttactcagctaaacataacttgccattcttaaaaataaaaaagctcccacccagaaactctagtgatactcagttttgacctcttactgcttccatgtgggacttcttttcagcttttaaccattggaattttctacctgctatgttcctctctggaaaatatcaatttggaaatgctgcctttcaaatcaatgccatgatcatccatattgttgagtttgttgttggtgttccagaagtgtccccattttacaactttatgcacacacctggcaaatcattaacatgagcattcaacagtactgggatgggtggggtgggggtagggggctcaccaacagaactggccagttgacattgcctgaaaaggcaccacctttaagggccagttgtggggttggtaagcacagttatgaaaatttctatctagcctccgttttgaatggttttaagaaattttgtatatggaggatggaaatgcttatatatttattgaaaatccttttatttgaaattaaaattatttggtatataattgtttgatatttggggagggttttggaggggagataatgtcactgataaattaaaagcctgttgattttgcagaaaggtactgttagtgactgataaggatgcctttgttttgtacatgaaccaaatctttgttttacatttcttttatccaaaatatttaggcatctgacattttcaaccagaatttcaattatatactgtgatttttatttgttgcaatacattacaatttcagaggtactttggggctcaaaagctaggatttctaagtcagtatgtgcatttcacacgataaagctgttaatggtgagcaaagtattatatactaactagatttttccacatctgtatagtatattatatgtattttgtggtattgagagtatagaaagtttagagtgtcaaacatgcgtttaatgtgtatttttaaacaaatttatggcaattaaaatatttggagacaagggtatcacatttcaatttgtaaagatctttttaactctactgtgtcattaagatgctttgtacaatgccaaaccatagttggagaaactaagtttaataaatatcaaatagattttctgta

SEQ ID NO: 299567 - DNA, 3347 bp, Homo sapiens
tgcatggtttatggtgctgctctaatattttctctttaaaactgtgtcatttttggagaatgaatttttcaaccttttcattgtggaggatttttcccacaaggtagtaatgggcagtggatcaaaatcctatcataaatgattgaattttcaatgtcatagtgtgtggaaatactactccctttcctccatgtctatcttcttagatgttctgtctttgtcatcatctgctccagcacatactttggactcctttacaggtgaccttcccccctccctcctcaataggtgtcctcagtgttttctaagcatttaaaactgaatttgacaagtggctaaaaacttagtctgagacttgtacttagtatatggttaattatagaaacaacaactattttaaacagttactctgttgactgctctttatgactacacttgtatgccaggaggcagcagcaccaccaggacgactctttacaagcaaccaacgaaccaattgcagtggttgcagttgtcacagtagtcttgcccaggctccagtctggctagagagcatccagcccattccttgcctcagtgccacctttttctgggcaagtagccaagaagtgactttatatgcagtgagtacttcagataaacttacagctacagctgccgaagagtggagaaggttgaccaccatttatttaattctctagtgtaaaaacaattgagagcagtgtgcgtgagcccacagacacctgtgtttctgggagctctggcagtggcggattcataggcacttgggctgcactttgaatgacacacttggctttattagattcactagtttttaaaaaattgttgttcgtttcttttcattaaaggtttaatcagacagatcagacagcataattttgtatttaatgacagaaacgttggtacatttcttcatgaatgagcttgcattctgaagcaagagcctacaaaaggcacttgttataaatgaaagttctggctctagaggccagtactctggagtttcagagcagccagtgattgttccagtcagtgatgcctagttatatagaggaggagtacactgtgcactcttctaggtgtaagggtatgcaactttggatcttaaaattctgtacacatacacactttatatatatgtatgtatgtatgaaaacatgaaattagtttgtcaaatatgtgtgtgtttagtattttagcttagtgcaactatttccacattatttattaaattgatctaagacactttcttgttgacaccttgaatattaatgttcaagggtgcaatgtgtattcctttagattgttaaagcttaattactatgatttgtagtaaattaacttttaaaatgtatttgagcccttctgtagtgtcgtagggctcttacagggtgggaaagattttaattttccagttgctaattgaacagtatggcctcattatatattttgatttataggagtttgtgtctgggtcccaggaacatctactggggatgactgttaggcagcttgtgatgatgttttttaaaaaacctaagtaacttggggagacagagcatttcaaacccatatagacacctatcatacctgtatatcccctaatacatggaacataaatttcatttcagctttatgcattaatgtattgaagaggcaggctttttttccagtaataatactgtacatctaaggttgctattcagtaaaactaatagaagagataattattgaataccttggaatatgtagtgagaagaggccaaatttttcatgtttgtgagcatgtctttcagatactcgctaatggagaaattcactttagacctctagaccccaaaaccaagttagcaagtgacaaaaagtaaattattaatagtctgtaaagtggatgctggtcttacaaagctcctattcacatgaaccctatggttaattagaaagaacttgctgtctccagaaaagggaatggaaataataactatgtatcttcttttcatgtaatttggtcacagaataaggtattcaagttaagtctaatccaagtcttagagatctttaagtatcctaaaatagcagcctaagtagtcatcatgtaaagaagttgactttcaggaatgtcagcattgacctctccttgccactgttactcagctaaacataacttgccattcttaaaaataaaaaagctcccacccagaaactctagtgatactcagttttgacctcttactgcttccatgtgggacttcttttcagcttttaaccattggaattttctacctgctatgttcctctctggaaaatatcaatttggaaatgctgcctttcaaatcaatgccatgatcatccatattgttgagtttgttgttggtgttccagaagtgtccccattttacaactttatgcacacacctggcaaatcattaacatgagcattcaacagtactgggatgggtggggtgggggtagggggctcaccaacagaactggccagttgacattgcctgaaaaggcaccacctttaagggccagttgtggggttggtaagcacagttatgaaaatttctatctagcctccgttttgaatggttttaagaaattttgtatatggaggatggaaatgcttatatatttattgaaaatccttttatttgaaattaaaattatttggtatataattgtttgatatttggggagggttttggaggggagataatgtcactgataaattaaaagcctgttgattttgcagaaaggtactgttagtgactgataaggatgcctttgttttgtacatgaaccaaatctttgttttacatttcttttatccaaaatatttaggcatctgacattttcaaccagaatttcaattatatactgtgatttttatttgttgcaatacattacaatttcagaggtactttggggctcaaaagctaggatttctaagtcagtatgtgcatttcacacgataaagctgttaatggtgagcaaagtattatatactaactagatttttccacatctgtatagtatattatatgtattttgtggtattgagagtatagaaagtttagagtgtcaaacatgcgtttaatgtgtatttttaaacaaatttatggcaattaaaatatttggagacaagggtatcacatttcaatttgtaaagatctttttaactctactgtgtcattaagatgctttgtacaatgccaaaccatagttggagaaactaagtttaataaatatcaaatagattttctgtattaaagttactgaacactgtactctttatatttcttcaactctgagcccttttcatg

SEQ ID NO: 299568 - DNA, 4553 bp, Homo sapiens
ggaagcgaattcgctcacgttttaggacaaggaagagagagaggcacgggagaagagcccagcaagatttggattgaaaccgagacaccctccggaggctcggagcagaggaaggaggaggagggcggcgaacggaagccagtttgcaattcaagttttgatagcgctggtagaagggggtttaaatcagatttttttttttttaaaggagagagactttttccgctctctcgctccctgttaaagccgggtctagcacagctgcagacgccaccagcgagaaagagggagaggaagacagatagggggcgggggaagaagaaaaagaaaggtaaaaagtcttctaggagaacctttcacatttgcaacaaaagacctaggggctggagagagattcctgggacgcagggctggagtgtctatttcgagctcagcggcagggctcgggcgcgagtcgagaccctgctcgctcctctcgcttctgaaaccgacgttcaggagcggctttttaaaaacgcaaggcacaaggacggtcacccgcgcgactatgtttgctgatttttcgccttgccctctttaaaagcggcctcccattctccaaaagacacttcccctcctccctttgaagtgcattagttgtgatttctgcctccttttcttttttctttcttttttgttttgctttttccccccttttgaattatgtgctgctgttaaaacaacaacaaaaaaacaacaaaacacagcagctgcggacttgtccccggctggagcccagcgccccgcctggagtggatgagcctctccatgagagatccggtcattcctgggacaagcatggcctaccatccgttcctacctcaccgggcgccggacttcgccatgagcgcggtgctgggtcaccagccgccgttcttccccgcgctgacgctgcctcccaacggcgcggcggcgctctcgctgccgggcgccctggccaagccgatcatggatcaattggtgggggcggccgagaccggcatcccgttctcctccctggggccccaggcgcatctgaggcctttgaagaccatggagcccgaagaagaggtggaggacgaccccaaggtgcacctggaggctaaagaactttgggatcagtttcacaagcggggcaccgagatggtcattaccaagtcgggaaggcgaatgtttcctccatttaaagtgagatgttctgggctggataaaaaagccaaatacattttattgatggacattatagctgctgatgactgtcgttataaatttcacaattctcggtggatggtggctggtaaggccgaccccgaaatgccaaagaggatgtacattcacccggacagccccgctactggggaacagtggatgtccaaagtcgtcactttccacaaactgaaactcaccaacaacatttcagacaaacatggatttactatattgaactccatgcacaaataccagccccggttccacattgtaagagccaatgacatcttgaaactcccttatagtacatttcggacatacttgttccccgaaactgaattcatcgctgtgactgcataccagaatgataagataacccagttaaaaatagacaacaacccttttgcaaaaggtttccgggacactggaaatggccgaagagaaaaaagaaaacagctcaccctgcagtccatgagggtgtttgatgaaagacacaaaaaggagaatgggacctctgatgagtcctccagtgaacaagcagctttcaactgcttcgcccaggcttcttctccagccgcctccactgtagggacatcgaacctcaaagatttatgtcccagcgagggtgagagcgacgccgaggccgagagcaaagaggagcatggccccgaggcctgcgacgcggccaagatctccaccaccacgtcggaggagccctgccgtgacaagggcagccccgcggtcaaggctcaccttttcgctgctgagcggccccgggacagcgggcggctggacaaagcgtcgcccgactcacgccatagccccgccaccatctcgtccagcactcgcggcctgggcgcggaggagcgcaggagcccggttcgcgagggcacagcgccggccaaggtggaagaggcgcgcgcgctcccgggcaaggaggccttcgcgccgctcacggtgcagacggacgcggccgccgcgcacctggcccagggccccctgcctggcctcggcttcgccccgggcctggcgggccaacagttcttcaacgggcacccgctcttcctgcaccccagccagtttgccatggggggcgccttctccagcatggcggccgctggcatgggtcccctcctggccacggtttctggggcctccaccggtgtctcgggcctggattccacggccatggcctctgccgctgcggcgcagggactgtccggggcgtccgcggccaccctgcccttccacctccagcagcacgtcctggcctctcagggcctggccatgtcccctttcggaagcctgttcccttacccctacacgtacatggccgcagcggcggccgcctcctctgcggcagcctccagctcggtgcaccgccaccccttcctcaatctgaacaccatgcgcccgcggctgcgctacagcccctactccatcccggtgccggtcccggacggcagcagtctgctcaccaccgccctgccctccatggcggcggccgcggggcccctggacggcaaagtcgccgccctggccgccagcccggcctcggtggcagtggactcgggctctgaactcaacagccgctcctccacgctctcctccagctccatgtccttgtcgcccaaactctgcgcggagaaagaggcggccaccagcgaactgcagagcatccagcggttggttagcggcttggaagccaagccggacaggtcccgcagcgcgtccccgtagacccgtcccagacacgtcttttcattccagtccagttcaggctgccgtgcactttgtcggatataaaataaaccacgggcccgccatggcgttagcccttccttttgcagttgcgtctgggaaggggccccggactccctcgagagaatgtgctagagacagcccctgtcttcttggcgtggtttatatgtccgggatctggatcagattctgggggctcagaaacgtcggttgcattgagctactgggggtaggagttccaacatttatgtccagagcaacttccagcaaggctggtctgggtctctgcccaccaggcggggaggtgttcaaagacatctccctcagtgcggatttatatatatatttttccttcactgtgtcaagtggaaacaaaaacaaaatctttcaaaaaaaaaatcgggacaagtgaacacattaacatgattctgtttgtgcagattaaaaactttatagggacttgcattatcggttctcaataaattactgagcagctttgtttggggagggaagtccctaccatccttgtttagtctatattaagaaaatctgtgtctttttaatattcttgtgatgttttcagagccgctgtaggtctcttcttgcatgtccacagtaatgtatttgtggtttttattttgaacgcttgcttttagagagaaaacaatatagccccctacccttttcccaatcctttgccctcaaatcagtgacccaagggagggggggatttaaagggaaggagtgggcaaaacacataaaatgaatttattatatctaagctctgtagcaggattcatgtcgttctttgacagttctttctctttcctgtatatgcaataacaaggttttaaaaaaataataaagaagtgagactattagacaaagtatttatgtaattatttgataactcttgtaaataggtggaatatgaatgcttggaaaattaaactttaatttattgacattgtacatagctctgtgtaaatagaattgcaactgtcaggttttgtgttcttgttttcctttagttgggtttatttccaggtcacagaattgctgttaacactagaaaacacacttcctgcaccaacaccaataccctttcaaaagagttgtctgcaacatttttgttttcttttttaatgtccaaaagtgggggaaagtgctatttcctattttcaccaaaattggggaaggagtgccactttccagctccacttcaaattccttaaaatataactgagattgctgtggggagggaggagggcagaggctgcggtttgactttttaatttttcttttgttatttgtatttgctagtctctgatttcctcaaaacgaagtggaatttactactgttgtcagtatcggtgttttgaattggtgcctgcctatagagatatattcacagttcaaaagtcaggtgctgagagatggtttaaagacaaattcatgaaggtatattttgtgttatagttgttgatgagttctttggttttctgtatttttccccctctctttaaaacatcactgaaatttcaataaatttttattgaaatgtc

SEQ ID NO: 299569 - DNA, 4253 bp, Homo sapiens
taaggctagtagaggctggggttgaatcggccgaggaagtcttctaggagaacctttcacatttgcaacaaaagacctaggggctggagagagattcctgggacgcagggctggagtgtctatttcgagctcagcggcagggctcgggcgcgagtcgagaccctgctcgctcctctcgcttctgaaaccgacgttcaggagcggctttttaaaaacgcaaggcacaaggacggtcacccgcgcgactatgtttgctgatttttcgccttgccctctttaaaagcggcctcccattctccaaaagacacttcccctcctccctttgaagtgcattagttgtgatttctgcctccttttcttttttctttcttttttgttttgctttttccccccttttgaattatgtgctgctgttaaaacaacaacaaaaaaacaacaaaacacagcagctgcggacttgtccccggctggagcccagcgccccgcctggagtggatgagcctctccatgagagatccggtcattcctgggacaagcatggcctaccatccgttcctacctcaccgggcgccggacttcgccatgagcgcggtgctgggtcaccagccgccgttcttccccgcgctgacgctgcctcccaacggcgcggcggcgctctcgctgccgggcgccctggccaagccgatcatggatcaattggtgggggcggccgagaccggcatcccgttctcctccctggggccccaggcgcatctgaggcctttgaagaccatggagcccgaagaagaggtggaggacgaccccaaggtgcacctggaggctaaagaactttgggatcagtttcacaagcggggcaccgagatggtcattaccaagtcgggaaggcgaatgtttcctccatttaaagtgagatgttctgggctggataaaaaagccaaatacattttattgatggacattatagctgctgatgactgtcgttataaatttcacaattctcggtggatggtggctggtaaggccgaccccgaaatgccaaagaggatgtacattcacccggacagccccgctactggggaacagtggatgtccaaagtcgtcactttccacaaactgaaactcaccaacaacatttcagacaaacatggatttactatattgaactccatgcacaaataccagccccggttccacattgtaagagccaatgacatcttgaaactcccttatagtacatttcggacatacttgttccccgaaactgaattcatcgctgtgactgcataccagaatgataagataacccagttaaaaatagacaacaacccttttgcaaaaggtttccgggacactggaaatggccgaagagaaaaaagaaaacagctcaccctgcagtccatgagggtgtttgatgaaagacacaaaaaggagaatgggacctctgatgagtcctccagtgaacaagcagctttcaactgcttcgcccaggcttcttctccagccgcctccactgtagggacatcgaacctcaaagatttatgtcccagcgagggtgagagcgacgccgaggccgagagcaaagaggagcatggccccgaggcctgcgacgcggccaagatctccaccaccacgtcggaggagccctgccgtgacaagggcagccccgcggtcaaggctcaccttttcgctgctgagcggccccgggacagcgggcggctggacaaagcgtcgcccgactcacgccatagccccgccaccatctcgtccagcactcgcggcctgggcgcggaggagcgcaggagcccggttcgcgagggcacagcgccggccaaggtggaagaggcgcgcgcgctcccgggcaaggaggccttcgcgccgctcacggtgcagacggacgcggccgccgcgcacctggcccagggccccctgcctggcctcggcttcgccccgggcctggcgggccaacagttcttcaacgggcacccgctcttcctgcaccccagccagtttgccatggggggcgccttctccagcatggcggccgctggcatgggtcccctcctggccacggtttctggggcctccaccggtgtctcgggcctggattccacggccatggcctctgccgctgcggcgcagggactgtccggggcgtccgcggccaccctgcccttccacctccagcagcacgtcctggcctctcagggcctggccatgtcccctttcggaagcctgttcccttacccctacacgtacatggccgcagcggcggccgcctcctctgcggcagcctccagctcggtgcaccgccaccccttcctcaatctgaacaccatgcgcccgcggctgcgctacagcccctactccatcccggtgccggtcccggacggcagcagtctgctcaccaccgccctgccctccatggcggcggccgcggggcccctggacggcaaagtcgccgccctggccgccagcccggcctcggtggcagtggactcgggctctgaactcaacagccgctcctccacgctctcctccagctccatgtccttgtcgcccaaactctgcgcggagaaagaggcggccaccagcgaactgcagagcatccagcggttggttagcggcttggaagccaagccggacaggtcccgcagcgcgtccccgtagacccgtcccagacacgtcttttcattccagtccagttcaggctgccgtgcactttgtcggatataaaataaaccacgggcccgccatggcgttagcccttccttttgcagttgcgtctgggaaggggccccggactccctcgagagaatgtgctagagacagcccctgtcttcttggcgtggtttatatgtccgggatctggatcagattctgggggctcagaaacgtcggttgcattgagctactgggggtaggagttccaacatttatgtccagagcaacttccagcaaggctggtctgggtctctgcccaccaggcggggaggtgttcaaagacatctccctcagtgcggatttatatatatatttttccttcactgtgtcaagtggaaacaaaaacaaaatctttcaaaaaaaaaatcgggacaagtgaacacattaacatgattctgtttgtgcagattaaaaactttatagggacttgcattatcggttctcaataaattactgagcagctttgtttggggagggaagtccctaccatccttgtttagtctatattaagaaaatctgtgtctttttaatattcttgtgatgttttcagagccgctgtaggtctcttcttgcatgtccacagtaatgtatttgtggtttttattttgaacgcttgcttttagagagaaaacaatatagccccctacccttttcccaatcctttgccctcaaatcagtgacccaagggagggggggatttaaagggaaggagtgggcaaaacacataaaatgaatttattatatctaagctctgtagcaggattcatgtcgttctttgacagttctttctctttcctgtatatgcaataacaaggttttaaaaaaataataaagaagtgagactattagacaaagtatttatgtaattatttgataactcttgtaaataggtggaatatgaatgcttggaaaattaaactttaatttattgacattgtacatagctctgtgtaaatagaattgcaactgtcaggttttgtgttcttgttttcctttagttgggtttatttccaggtcacagaattgctgttaacactagaaaacacacttcctgcaccaacaccaataccctttcaaaagagttgtctgcaacatttttgttttcttttttaatgtccaaaagtgggggaaagtgctatttcctattttcaccaaaattggggaaggagtgccactttccagctccacttcaaattccttaaaatataactgagattgctgtggggagggaggagggcagaggctgcggtttgactttttaatttttcttttgttatttgtatttgctagtctctgatttcctcaaaacgaagtggaatttactactgttgtcagtatcggtgttttgaattggtgcctgcctatagagatatattcacagttcaaaagtcaggtgctgagagatggtttaaagacaaattcatgaaggtatattttgtgttatagttgttgatgagttctttggttttctgtatttttccccctctctttaaaacatcactgaaatttcaataaatttttattgaaatgtc

SEQ ID NO: 299570 - DNA, 4651 bp, Homo sapiens
  misc_feature (4567)..(4567): n is a, c, g, or t
  misc_feature (4570)..(4570): n is a, c, g, or t
ggaagcgaattcgctcacgttttaggacaaggaagagagagaggcacgggagaagagcccagcaagatttggattgaaaccgagacaccctccggaggctcggagcagaggaaggaggaggagggcggcgaacggaagccagtttgcaattcaagttttgatagcgctggtagaagggggtttaaatcagatttttttttttttaaaggagagagactttttccgctctctcgctccctgttaaagccgggtctagcacagctgcagacgccaccagcgagaaagagggagaggaagacagatagggggcgggggaagaagaaaaagaaaggtaaaaagtcttctaggagaacctttcacatttgcaacaaaagacctaggggctggagagagattcctgggacgcagggctggagtgtctatttcgagctcagcggcagggctcgggcgcgagtcgagaccctgctcgctcctctcgcttctgaaaccgacgttcaggagcggctttttaaaaacgcaaggcacaaggacggtcacccgcgcgactatgtttgctgatttttcgccttgccctctttaaaagcggcctcccattctccaaaagacacttcccctcctccctttgaagtgcattagttgtgatttctgcctccttttcttttttctttcttttttgttttgctttttccccccttttgaattatgtgctgctgttaaaacaacaacaaaaaaacaacaaaacacagcagctgcggacttgtccccggctggagcccagcgccccgcctggagtggatgagcctctccatgagagatccggtcattcctgggacaagcatggcctaccatccgttcctacctcaccgggcgccggacttcgccatgagcgcggtgctgggtcaccagccgccgttcttccccgcgctgacgctgcctcccaacggcgcggcggcgctctcgctgccgggcgccctggccaagccgatcatggatcaattggtgggggcggccgagaccggcatcccgttctcctccctggggccccaggcgcatctgaggcctttgaagaccatggagcccgaagaagaggtggaggacgaccccaaggtgcacctggaggctaaagaactttgggatcagtttcacaagcggggcaccgagatggtcattaccaagtcgggaaggcgaatgtttcctccatttaaagtgagatgttctgggctggataaaaaagccaaatacattttattgatggacattatagctgctgatgactgtcgttataaatttcacaattctcggtggatggtggctggtaaggccgaccccgaaatgccaaagaggatgtacattcacccggacagccccgctactggggaacagtggatgtccaaagtcgtcactttccacaaactgaaactcaccaacaacatttcagacaaacatggatttactatattgaactccatgcacaaataccagccccggttccacattgtaagagccaatgacatcttgaaactcccttatagtacatttcggacatacttgttccccgaaactgaattcatcgctgtgactgcataccagaatgataagataacccagttaaaaatagacaacaacccttttgcaaaaggtttccgggacactggaaatggccgaagagaaaaaagaaaacagctcaccctgcagtccatgagggtgtttgatgaaagacacaaaaaggagaatgggacctctgatgagtcctccagtgaacaagcagctttcaactgcttcgcccaggcttcttctccagccgcctccactgtagggacatcgaacctcaaagatttatgtcccagcgagggtgagagcgacgccgaggccgagagcaaagaggagcatggccccgaggcctgcgacgcggccaagatctccaccaccacgtcggaggagccctgccgtgacaagggcagccccgcggtcaaggctcaccttttcgctgctgagcggccccgggacagcgggcggctggacaaagcgtcgcccgactcacgccatagccccgccaccatctcgtccagcactcgcggcctgggcgcggaggagcgcaggagcccggttcgcgagggcacagcgccggccaaggtggaagaggcgcgcgcgctcccgggcaaggaggccttcgcgccgctcacggtgcagacggacgcggccgccgcgcacctggcccagggccccctgcctggcctcggcttcgccccgggcctggcgggccaacagttcttcaacgggcacccgctcttcctgcaccccagccagtttgccatggggggcgccttctccagcatggcggccgctggcatgggtcccctcctggccacggtttctggggcctccaccggtgtctcgggcctggattccacggccatggcctctgccgctgcggcgcagggactgtccggggcgtccgcggccaccctgcccttccacctccagcagcacgtcctggcctctcagggcctggccatgtcccctttcggaagcctgttcccttacccctacacgtacatggccgcagcggcggccgcctcctctgcggcagcctccagctcggtgcaccgccaccccttcctcaatctgaacaccatgcgcccgcggctgcgctacagcccctactccatcccggtgccggtcccggacggcagcagtctgctcaccaccgccctgccctccatggcggcggccgcggggcccctggacggcaaagtcgccgccctggccgccagcccggcctcggtggcagtggactcgggctctgaactcaacagccgctcctccacgctctcctccagctccatgtccttgtcgcccaaactctgcgcggagaaagaggcggccaccagcgaactgcagagcatccagcggttggttagcggcttggaagccaagccggacaggtcccgcagcgcgtccccgtagacccgtcccagacacgtcttttcattccagtccagttcaggctgccgtgcactttgtcggatataaaataaaccacgggcccgccatggcgttagcccttccttttgcagttgcgtctgggaaggggccccggactccctcgagagaatgtgctagagacagcccctgtcttcttggcgtggtttatatgtccgggatctggatcagattctgggggctcagaaacgtcggttgcattgagctactgggggtaggagttccaacatttatgtccagagcaacttccagcaaggctggtctgggtctctgcccaccaggcggggaggtgttcaaagacatctccctcagtgcggatttatatatatatttttccttcactgtgtcaagtggaaacaaaaacaaaatctttcaaaaaaaaaatcgggacaagtgaacacattaacatgattctgtttgtgcagattaaaaactttatagggacttgcattatcggttctcaataaattactgagcagctttgtttggggagggaagtccctaccatccttgtttagtctatattaagaaaatctgtgtctttttaatattcttgtgatgttttcagagccgctgtaggtctcttcttgcatgtccacagtaatgtatttgtggtttttattttgaacgcttgcttttagagagaaaacaatatagccccctacccttttcccaatcctttgccctcaaatcagtgacccaagggagggggggatttaaagggaaggagtgggcaaaacacataaaatgaatttattatatctaagctctgtagcaggattcatgtcgttctttgacagttctttctctttcctgtatatgcaataacaaggttttaaaaaaataataaagaagtgagactattagacaaagtatttatgtaattatttgataactcttgtaaataggtggaatatgaatgcttggaaaattaaactttaatttattgacattgtacatagctctgtgtaaatagaattgcaactgtcaggttttgtgttcttgttttcctttagttgggtttatttccaggtcacagaattgctgttaacactagaaaacacacttcctgcaccaacaccaataccctttcaaaagagttgtctgcaacatttttgttttcttttttaatgtccaaaagtgggggaaagtgctatttcctattttcaccaaaattggggaaggagtgccactttccagctccacttcaaattccttaaaatataactgagattgctgtggggagggaggagggcagaggctgcggtttgactttttaatttttcttttgttatttgtatttgctagtctctgatttcctcaaaacgaagtggaatttactactgttgtcagtatcggtgttttgaattggtgcctgcctatagagatatattcacagttcaaaagtcaggtgctgagagatggtttaaagacaaattcatgaaggtatattttgtgttatagttgttgatgagttctttggttttctgtatttttccccctctctttaaaacatcactgaaatttcaataaatttttattgaaatgtcaaaaaaaaaaaaanaanaaaaactttgggggggcccgttcccattatcctttggtgggcggttccaattactggtcggctttaccaccctggacctgg

SEQ ID NO: 299571 - DNA, 4596 bp, Homo sapiens
  misc_feature (4512)..(4512): n is a, c, g, or t
  misc_feature (4515)..(4515): n is a, c, g, or t
ggaagcgaattcgctcacgttttaggacaaggaagagagagaggcacgggagaagagcccagcaagatttggattgaaaccgagacaccctccggaggctcggagcagaggaaggaggaggagggcggcgaacggaagccagtttgcaattcaagttttgatagcgctggtagaagggggtttaaatcagatttttttttttttaaaggagagagactttttccgctctctcgctccctgttaaagccgggtctagcacagctgcagacgccaccagcgagaaagagggagaggaagacagatagggggcgggggaagaagaaaaagaaaggtaaaaagtcttctaggagaacctttcacatttgcaacaaaagacctaggggctggagagagattcctgggacgcagggctggagtgtctatttcgagctcagcggcagggctcgggcgcgagtcgagaccctgctcgctcctctcgcttctgaaaccgacgttcaggagcggctttttaaaaacgcaaggcacaaggacggtcacccgcgcgactatgtttgctgatttttcgccttgccctctttaaaagcggcctcccattctccaaaagacacttcccctcctccctttgaagtgcattagttgtgatttctgcctccttttcttttttctttcttttttgttttgctttttccccccttttgaattatgtgctgctgttaaaacaacaacaaaaaaacaacaaaacacagcagctgcggacttgtccccggctggagcccagcgccccgcctggagtggatgagcctctccatgagagatccggtcattcctgggacaagcatggcctaccatccgttcctacctcaccgggcgccggacttcgccatgagcgcggtgctgggtcaccagccgccgttcttccccgcgctgacgctgcctcccaacggcgcggcggcgctctcgctgccgggcgccctggccaagccgatcatggatcaattggtgggggcggccgagaccggcatcccgttctcctccctggggccccaggcgcatctgaggcctttgaagaccatggagcccgaagaagaggtggaggacgaccccaaggtgcacctggaggctaaagaactttgggatcagtttcacaagcggggcaccgagatggtcattaccaagtcgggaaggcgaatgtttcctccatttaaagtgagatgttctgggctggataaaaaagccaaatacattttattgatggacattatagctgctgatgactgtcgttataaatttcacaattctcggtggatggtggctggtaaggccgaccccgaaatgccaaagaggatgtacattcacccggacagccccgctactggggaacagtggatgtccaaagtcgtcactttccacaaactgaaactcaccaacaacatttcagacaaacatggatttactatattgaactccatgcacaaataccagccccggttccacattgtaagagccaatgacatcttgaaactcccttatagtacatttcggacatacttgttccccgaaactgaattcatcgctgtgactgcataccagaatgataagataacccagttaaaaatagacaacaacccttttgcaaaaggtttccgggacactggaaatggccgaagagaaaaaagaaaacagctcaccctgcagtccatgagggtgtttgatgaaagacacaaaaaggagaatgggacctctgatgagtcctccagtgaacaagcagctttcaactgcttcgcccaggcttcttctccagccgcctccactgtagggacatcgaacctcaaagatttatgtcccagcgagggtgagagcgacgccgaggccgagagcaaagaggagcatggccccgaggcctgcgacgcggccaagatctccaccaccacgtcggaggagccctgccgtgacaagggcagccccgcggtcaaggctcaccttttcgctgctgagcggccccgggacagcgggcggctggacaaagcgtcgcccgactcacgccatagccccgccaccatctcgtccagcactcgcggcctgggcgcggaggagcgcaggagcccggttcgcgagggcacagcgccggccaaggtggaagaggcgcgcgcgctcccgggcaaggaggccttcgcgccgctcacggtgcagacggacgcggccgccgcgcacctggcccagggccccctgcctggcctcggcttcgccccgggcctggcgggccaacagttcttcaacgggcacccgctcttcctgcaccccagccagtttgccatggggggcgccttctccagcatggcggccgctggcatgggtcccctcctggccacggtttctggggcctccaccggtgtctcgggcctggattccacggccatggcctctgccgctgcggcgcagggactgtccggggcgtccgcggccaccctgcccttccacctccagcagcacgtcctggcctctcagggcctggccatgtcccctttcggaagcctgttcccttacccctacacgtacatggccgcagcggcggccgcctcctctgcggcagcctccagctcggtgcaccgccaccccttcctcaatctgaacaccatgcgcccgcggctgcgctacagcccctactccatcccggtgccggtcccggacggcagcagtctgctcaccaccgccctgccctccatggcggcggccgcggggcccctggacggcaaagtcgccgccctggccgccagcccggcctcggtggcagtggactcgggctctgaactcaacagccgctcctccacgctctcctccagctccatgtccttgtcgcccaaactctgcgcggagaaagaggcggccaccagcgaactgcagagcatccagcggttggttagcggcttggaagccaagccggacaggtcccgcagcgcgtccccgtagacccgtcccagacacgtcttttcattccagtccagttcaggctgccgtgcactttgtcggatataaaataaaccacgggcccgccatggcgttagcccttccttttgcagttgcgtctgggaaggggccccggactccctcgagagaatgtgctagagacagcccctgtcttcttggcgtggtttatatgtccgggatctggatcagattctgggggctcagaaacgtcggttgcattgagctactgggggtaggagttccaacatttatgtccagagcaacttccagcaaggctggtctgggtctctgcccaccaggcggggaggtgttcaaagacatctccctcagtgcggatttatatatatatttttccttcactgtgtcaagtggaaacaaaaacaaaatctttcaaaaaaaaaatcgggacaagtgaacacattaacatgattctgtttgtgcagattaaaaactttatagggacttgcattatcggttctcaataaattactgagcagctttgtttggggagggaagtccctaccatccttgtttagtctatattaagaaaatctgtgtctttttaatattcttgtgatgttttcagagccgctgtaggtctcttcttgcatgtccacagtaatgtatttgtggtttttattttgaacgcttgcttttagagagaaaacaatatagccccctacccttttcccaatcctttgccctcaaatcagtgacccaagggagggggggatttaaagggaaggagtgggcaaaacacataaaatgaatttattatatctaagctctgtagcaggattcatgtcgttctttgacagttctttctctttcctgtatatgcaataacaaggttttaaaaaaataataaagaagtgagactattagacaaagtatttatgtaattatttgataactcttgtaaataggtggaatatgaataattgcaactgtcaggttttgtgttcttgttttcctttagttgggtttatttccaggtcacagaattgctgttaacactagaaaacacacttcctgcaccaacaccaataccctttcaaaagagttgtctgcaacatttttgttttcttttttaatgtccaaaagtgggggaaagtgctatttcctattttcaccaaaattggggaaggagtgccactttccagctccacttcaaattccttaaaatataactgagattgctgtggggagggaggagggcagaggctgcggtttgactttttaatttttcttttgttatttgtatttgctagtctctgatttcctcaaaacgaagtggaatttactactgttgtcagtatcggtgttttgaattggtgcctgcctatagagatatattcacagttcaaaagtcaggtgctgagagatggtttaaagacaaattcatgaaggtatattttgtgttatagttgttgatgagttctttggttttctgtatttttccccctctctttaaaacatcactgaaatttcaataaatttttattgaaatgtcaaaaaaaaaaaaanaanaaaaactttgggggggcccgttcccattatcctttggtgggcggttccaattactggtcggctttaccaccctggacctgg

SEQ ID NO: 299572 - DNA, 4596 bp, Homo sapiens
  misc_feature (4512)..(4512): n is a, c, g, or t
  misc_feature (4515)..(4515): n is a, c, g, or t
ggaagcgaattcgctcacgttttaggacaaggaagagagagaggcacgggagaagagcccagcaagatttggattgaaaccgagacaccctccggaggctcggagcagaggaaggaggaggagggcggcgaacggaagccagtttgcaattcaagttttgatagcgctggtagaagggggtttaaatcagatttttttttttttaaaggagagagactttttccgctctctcgctccctgttaaagccgggtctagcacagctgcagacgccaccagcgagaaagagggagaggaagacagatagggggcgggggaagaagaaaaagaaaggtaaaaagtcttctaggagaacctttcacatttgcaacaaaagacctaggggctggagagagattcctgggacgcagggctggagtgtctatttcgagctcagcggcagggctcgggcgcgagtcgagaccctgctcgctcctctcgcttctgaaaccgacgttcaggagcggctttttaaaaacgcaaggcacaaggacggtcacccgcgcgactatgtttgctgatttttcgccttgccctctttaaaagcggcctcccattctccaaaagacacttcccctcctccctttgaagtgcattagttgtgatttctgcctccttttcttttttctttcttttttgttttgctttttccccccttttgaattatgtgctgctgttaaaacaacaacaaaaaaacaacaaaacacagcagctgcggacttgtccccggctggagcccagcgccccgcctggagtggatgagcctctccatgagagatccggtcattcctgggacaagcatggcctaccatccgttcctacctcaccgggcgccggacttcgccatgagcgcggtgctgggtcaccagccgccgttcttccccgcgctgacgctgcctcccaacggcgcggcggcgctctcgctgccgggcgccctggccaagccgatcatggatcaattggtgggggcggccgagaccggcatcccgttctcctccctggggccccaggcgcatctgaggcctttgaagaccatggagcccgaagaagaggtggaggacgaccccaaggtgcacctggaggctaaagaactttgggatcagtttcacaagcggggcaccgagatggtcattaccaagtcgggaaggcgaatgtttcctccatttaaagtgagatgttctgggctggataaaaaagccaaatacattttattgatggacattatagctgctgatgactgtcgttataaatttcacaattctcggtggatggtggctggtaaggccgaccccgaaatgccaaagaggatgtacattcacccggacagccccgctactggggaacagtggatgtccaaagtcgtcactttccacaaactgaaactcaccaacaacatttcagacaaacatggatttactatattgaactccatgcacaaataccagccccggttccacattgtaagagccaatgacatcttgaaactcccttatagtacatttcggacatacttgttccccgaaactgaattcatcgctgtgactgcataccagaatgataagataacccagttaaaaatagacaacaacccttttgcaaaaggtttccgggacactggaaatggccgaagagaaaaaagaaaacagctcaccctgcagtccatgagggtgtttgatgaaagacacaaaaaggagaatgggacctctgatgagtcctccagtgaacaagcagctttcaactgcttcgcccaggcttcttctccagccgcctccactgtagggacatcgaacctcaaagatttatgtcccagcgagggtgagagcgacgccgaggccgagagcaaagaggagcatggccccgaggcctgcgacgcggccaagatctccaccaccacgtcggaggagccctgccgtgacaagggcagccccgcggtcaaggctcaccttttcgctgctgagcggccccgggacagcgggcggctggacaaagcgtcgcccgactcacgccatagccccgccaccatctcgtccagcactcgcggcctgggcgcggaggagcgcaggagcccggttcgcgagggcacagcgccggccaaggtggaagaggcgcgcgcgctcccgggcaaggaggccttcgcgccgctcacggtgcagacggacgcggccgccgcgcacctggcccagggccccctgcctggcctcggcttcgccccgggcctggcgggccaacagttcttcaacgggcacccgctcttcctgcaccccagccagtttgccatggggggcgccttctccagcatggcggccgctggcatgggtcccctcctggccacggtttctggggcctccaccggtgtctcgggcctggattccacggccatggcctctgccgctgcggcgcagggactgtccggggcgtccgcggccaccctgcccttccacctccagcagcacgtcctggcctctcagggcctggccatgtcccctttcggaagcctgttcccttacccctacacgtacatggccgcagcggcggccgcctcctctgcggcagcctccagctcggtgcaccgccaccccttcctcaatctgaacaccatgcgcccgcggctgcgctacagcccctactccatcccggtgccggtcccggacggcagcagtctgctcaccaccgccctgccctccatggcggcggccgcggggcccctggacggcaaagtcgccgccctggccgccagcccggcctcggtggcagtggactcgggctctgaactcaacagccgctcctccacgctctcctccagctccatgtccttgtcgcccaaactctgcgcggagaaagaggcggccaccagcgaactgcagagcatccagcggttggttagcggcttggaagccaagccggacaggtcccgcagcgcgtccccgtagacccgtcccagacacgtcttttcattccagtccagttcaggctgccgtgcactttgtcggatataaaataaaccacgggcccgccatggcgttagcccttccttttgcagttgcgtctgggaaggggccccggactccctcgagagaatgtgctagagacagcccctgtcttcttggcgtggtttatatgtccgggatctggatcagattctgggggctcagaaacgtcggttgcattgagctactgggggtaggagttccaacatttatgtccagagcaacttccagcaaggctggtctgggtctctgcccaccaggcggggaggtgttcaaagacatctccctcagtgcggatttatatatatatttttccttcactgtgtcaagtggaaacaaaaacaaaatctttcaaaaaaaaaatcgggacaagtgaacacattaacatgattctgtttgtgcagattatttggggagggaagtccctaccatccttgtttagtctatattaagaaaatctgtgtctttttaatattcttgtgatgttttcagagccgctgtaggtctcttcttgcatgtccacagtaatgtatttgtggtttttattttgaacgcttgcttttagagagaaaacaatatagccccctacccttttcccaatcctttgccctcaaatcagtgacccaagggagggggggatttaaagggaaggagtgggcaaaacacataaaatgaatttattatatctaagctctgtagcaggattcatgtcgttctttgacagttctttctctttcctgtatatgcaataacaaggttttaaaaaaataataaagaagtgagactattagacaaagtatttatgtaattatttgataactcttgtaaataggtggaatatgaatgcttggaaaattaaactttaatttattgacattgtacatagctctgtgtaaatagaattgcaactgtcaggttttgtgttcttgttttcctttagttgggtttatttccaggtcacagaattgctgttaacactagaaaacacacttcctgcaccaacaccaataccctttcaaaagagttgtctgcaacatttttgttttcttttttaatgtccaaaagtgggggaaagtgctatttcctattttcaccaaaattggggaaggagtgccactttccagctccacttcaaattccttaaaatataactgagattgctgtggggagggaggagggcagaggctgcggtttgactttttaatttttcttttgttatttgtatttgctagtctctgatttcctcaaaacgaagtggaatttactactgttgtcagtatcggtgttttgaattggtgcctgcctatagagatatattcacagttcaaaagtcaggtgctgagagatggtttaaagacaaattcatgaaggtatattttgtgttatagttgttgatgagttctttggttttctgtatttttccccctctctttaaaacatcactgaaatttcaataaatttttattgaaatgtcaaaaaaaaaaaaanaanaaaaactttgggggggcccgttcccattatcctttggtgggcggttccaattactggtcggctttaccaccctggacctgg

SEQ ID NO: 299573 - DNA, 4269 bp, Homo sapiens
  misc_feature (4185)..(4185): n is a, c, g, or t
  misc_feature (4188)..(4188): n is a, c, g, or t
ggaagcgaattcgctcacgttttaggacaaggaagagagagaggcacgggagaagagcccagcaagatttggattgaaaccgagacaccctccggaggctcggagcagaggaaggaggaggagggcggcgaacggaagccagtttgcaattcaagttttgatagcgctggtagaagggggtttaaatcagatttttttttttttaaaggagagagactttttccgctctctcgctccctgttaaagccgggtctagcacagctgcagacgccaccagcgagaaagagggagaggaagacagatagggggcgggggaagaagaaaaagaaaggtaaaaagtcttctaggagaacctttcacatttgcaacaaaagacctaggggctggagagagattcctgggacgcagggctggagtgtctatttcgagctcagcggcagggctcgggcgcgagtcgagaccctgctcgctcctctcgcttctgaaaccgacgttcaggagcggctttttaaaaacgcaaggcacaaggacggtcacccgcgcgactatgtttgctgatttttcgccttgccctctttaaaagcggcctcccattctccaaaagacacttcccctcctccctttgaagtgcattagttgtgatttctgcctccttttcttttttctttcttttttgttttgctttttccccccttttgaattatgtgctgctgttaaaacaacaacaaaaaaacaacaaaacacagcagctgcggacttgtccccggctggagcccagcgccccgcctggagtggatgagcctctccatgagagatccggtcattcctgggacaagcatggcctaccatccgttcctacctcaccgggcgccggacttcgccatgagcgcggtgctgggtcaccagccgccgttcttccccgcgctgacgctgcctcccaacggcgcggcggcgctctcgctgccgggcgccctggccaagccgatcatggatcaattggtgggggcggccgagaccggcatcccgttctcctccctggggccccaggcgcatctgaggcctttgaagaccatggagcccgaagaagaggtggaggacgaccccaaggtgcacctggaggctaaagaactttgggatcagtttcacaagcggggcaccgagatggtcattaccaagtcgggaaggcgaatgtttcctccatttaaagtgagatgttctgggctggataaaaaagccaaatacattttattgatggacattatagctgctgatgactgtcgttataaatttcacaattctcggtggatggtggctggtaaggccgaccccgaaatgccaaagaggatgtacattcacccggacagccccgctactggggaacagtggatgtccaaagtcgtcactttccacaaactgaaactcaccaacaacatttcagacaaacatggatttactttggccttcccaagtgatcacgctacgtggcaggggaattatagttttggtactcagactatattgaactccatgcacaaataccagccccggttccacattgtaagagccaatgacatcttgaaactcccttatagtacatttcggacatacttgttccccgaaactgaattcatcgctgtgactgcataccagaatgataagataacccagttaaaaatagacaacaacccttttgcaaaaggtttccgggacactggaaatggccgaagagaaaaaagaaaacagctcaccctgcagtccatgagggtgtttgatgaaagacacaaaaaggagaatgggacctctgatgagtcctccagtgaacaagcagctttcaactgcttcgcccaggcttcttctccagccgcctccactgtagggacatcgaacctcaaagatttatgtcccagcgagggtgagagcgacgccgaggccgagagcaaagaggagcatggccccgaggcctgcgacgcggccaagatctccaccaccacgtcggaggagccctgccgtgacaagggcagccccgcggtcaaggctcaccttttcgctgctgagcggccccgggacagcgggcggctggacaaagcgtcgcccgactcacgccatagccccgccaccatctcgtccagcactcgcggcctgggcgcggaggagcgcaggagcccggttcgcgagggcacagcgccggccaaggtggaagaggcgcgcgcgctcccgggcaaggaggccttcgcgccgctcacggtgcagacggacgcgcctccagctcggtgcaccgccaccccttcctcaatctgaacaccatgcgcccgcggctgcgctacagcccctactccatcccggtgccggtcccggacggcagcagtctgctcaccaccgccctggccgccagcccggcctcggtggcagtggactcgggctctgaactcaacagccgctcctccacgctctcctccagctccatgtccttgtcgcccaaactctgcgcggagaaagaggcggccaccagcgaactgcagagcatccagcggttggttagcggcttggaagccaagccggacaggtcccgcagcgcgtccccgtagacccgtcccagacacgtcttttcattccagtccagttcaggctgccgtgcactttgtcggatataaaataaaccacgggcccgccatggcgttagcccttccttttgcagttgcgtctgggaaggggccccggactccctcgagagaatgtgctagagacagcccctgtcttcttggcgtggtttatatgtccgggatctggatcagattctgggggctcagaaacgtcggttgcattgagctactgggggtaggagttccaacatttatgtccagagcaacttccagcaaggctggtctgggtctctgcccaccaggcggggaggtgttcaaagacatctccctcagtgcggatttatatatatatttttccttcactgtgtcaagtggaaacaaaaacaaaatctttcaaaaaaaaaatcgggacaagtgaacacattaacatgattctgtttgtgcagattaaaaactttatagggacttgcattatcggttctcaataaattactgagcagctttgtttggggagggaagtccctaccatccttgtttagtctatattaagaaaatctgtgtctttttaatattcttgtgatgttttcagagccgctgtaggtctcttcttgcatgtccacagtaatgtatttgtggtttttattttgaacgcttgcttttagagagaaaacaatatagccccctacccttttcccaatcctttgccctcaaatcagtgacccaagggagggggggatttaaagggaaggagtgggcaaaacacataaaatgaatttattatatctaagctctgtagcaggattcatgtcgttctttgacagttctttctctttcctgtatatgcaataacaaggttttaaaaaaataataaagaagtgagactattagacaaagtatttatgtaattatttgataactcttgtaaataggtggaatatgaatgcttggaaaattaaactttaatttattgacattgtacatagctctgtgtaaatagaattgcaactgtcaggttttgtgttcttgttttcctttagttgggtttatttccaggtcacagaattgctgttaacactagaaaacacacttcctgcaccaacaccaataccctttcaaaagagttgtctgcaacatttttgttttcttttttaatgtccaaaagtgggggaaagtgctatttcctattttcaccaaaattggggaaggagtgccactttccagctccacttcaaattccttaaaatataactgagattgctgtggggagggaggagggcagaggctgcggtttgactttttaatttttcttttgttatttgtatttgctagtctctgatttcctcaaaacgaagtggaatttactactgttgtcagtatcggtgttttgaattggtgcctgcctatagagatatattcacagttcaaaagtcaggtgctgagagatggtttaaagacaaattcatgaaggtatattttgtgttatagttgttgatgagttctttggttttctgtatttttccccctctctttaaaacatcactgaaatttcaataaatttttattgaaatgtcaaaaaaaaaaaaanaanaaaaactttgggggggcccgttcccattatcctttggtgggcggttccaattactggtcggctttaccaccctggacctgg

SEQ ID NO: 299574 - DNA, 4874 bp, Homo sapiens
ggaagcgaattcgctcacgttttaggacaaggaagagagagaggcacgggagaagagcccagcaagatttggattgaaaccgagacaccctccggaggctcggagcagaggaaggaggaggagggcggcgaacggaagccagtttgcaattcaagttttgatagcgctggtagaagggggtttaaatcagatttttttttttttaaaggagagagactttttccgctctctcgctccctgttaaagccgggtctagcacagctgcagacgccaccagcgagaaagagggagaggaagacagatagggggcgggggaagaagaaaaagaaaggtaaaaagtcttctaggagaacctttcacatttgcaacaaaagacctaggggctggagagagattcctgggacgcagggctggagtgtctatttcgagctcagcggcagggctcgggcgcgagtcgagaccctgctcgctcctctcgcttctgaaaccgacgttcaggagcggctttttaaaaacgcaaggcacaaggacggtcacccgcgcgactatgtttgctgatttttcgccttgccctctttaaaagcggcctcccattctccaaaagacacttcccctcctccctttgaagtgcattagttgtgatttctgcctccttttcttttttctttcttttttgttttgctttttccccccttttgaattatgtgctgctgttaaaacaacaacaaaaaaacaacaaaacacagcagctgcggacttgtccccggctggagcccagcgccccgcctggagtggatgagcctctccatgagagatccggtcattcctgggacaagcatggcctaccatccgttcctacctcaccgggcgccggacttcgccatgagcgcggtgctgggtcaccagccgccgttcttccccgcgctgacgctgcctcccaacggcgcggcggcgctctcgctgccgggcgccctggccaagccgatcatggatcaattggtgggggcggccgagaccggcatcccgttctcctccctggggccccaggcgcatctgaggcctttgaagaccatggagcccgaagaagaggtggaggacgaccccaaggtgcacctggaggctaaagaactttgggatcagtttcacaagcggggcaccgagatggtcattaccaagtcgggaaggcgaatgtttcctccatttaaagtgagatgttctgggctggataaaaaagccaaatacattttattgatggacattatagctgctgatgactgtcgttataaatttcacaattctcggtggatggtggctggtaaggccgaccccgaaatgccaaagaggatgtacattcacccggacagccccgctactggggaacagtggatgtccaaagtcgtcactttccacaaactgaaactcaccaacaacatttcagacaaacatggatttactttggccttcccaagtgatcacgctacgtggcaggggaattatagttttggtactcaggtaggctagggttcaaggtatgaatgatccttagatggtgagggtggggggggccctttggcaactgaggagcaatttggattctccagaagataacatctgtggagcgaaacgtacccagggggtactccaaggaggtgggctcggtacaagcgtggtaccctgcggtggggaagatttcagcctggcaggggtcctaagatcccgtttgttctgctaaatccttgttttatgtatgtctcctcttccctgcccctgcagactatattgaactccatgcacaaataccagccccggttccacattgtaagagccaatgacatcttgaaactcccttatagtacatttcggacatacttgttccccgaaactgaattcatcgctgtgactgcataccagaatgataagataacccagttaaaaatagacaacaacccttttgcaaaaggtttccgggacactggaaatggccgaagagaaaaaagaaaacagctcaccctgcagtccatgagggtgtttgatgaaagacacaaaaaggagaatgggacctctgatgagtcctccagtgaacaagcagctttcaactgcttcgcccaggcttcttctccagccgcctccactgtagggacatcgaacctcaaagatttatgtcccagcgagggtgagagcgacgccgaggccgagagcaaagaggagcatggccccgaggcctgcgacgcggccaagatctccaccaccacgtcggaggagccctgccgtgacaagggcagccccgcggtcaaggctcaccttttcgctgctgagcggccccgggacagcgggcggctggacaaagcgtcgcccgactcacgccatagccccgccaccatctcgtccagcactcgcggcctgggcgcggaggagcgcaggagcccggttcgcgagggcacagcgccggccaaggtggaagaggcgcgcgcgctcccgggcaaggaggccttcgcgccgctcacggtgcagacggacgcggccgccgcgcacctggcccagggccccctgcctggcctcggcttcgccccgggcctggcgggccaacagttcttcaacgggcacccgctcttcctgcaccccagccagtttgccatggggggcgccttctccagcatggcggccgctggcatgggtcccctcctggccacggtttctggggcctccaccggtgtctcgggcctggattccacggccatggcctctgccgctgcggcgcagggactgtccggggcgtccgcggccaccctgcccttccacctccagcagcacgtcctggcctctcagggcctggccatgtcccctttcggaagcctgttcccttacccctacacgtacatggccgcagcggcggccgcctcctctgcggcagcctccagctcggtgcaccgccaccccttcctcaatctgaacaccatgcgcccgcggctgcgctacagcccctactccatcccggtgccggtcccggacggcagcagtctgctcaccaccgccctgccctccatggcggcggccgcggggcccctggacggcaaagtcgccgccctggccgccagcccggcctcggtggcagtggactcgggctctgaactcaacagccgctcctccacgctctcctccagctccatgtccttgtcgcccaaactctgcgcggagaaagaggcggccaccagcgaactgcagagcatccagcggttggttagcggcttggaagccaagccggacaggtcccgcagcgcgtccccgtagacccgtcccagacacgtcttttcattccagtccagttcaggctgccgtgcactttgtcggatataaaataaaccacgggcccgccatggcgttagcccttccttttgcagttgcgtctgggaaggggccccggactccctcgagagaatgtgctagagacagcccctgtcttcttggcgtggtttatatgtccgggatctggatcagattctgggggctcagaaacgtcggttgcattgagctactgggggtaggagttccaacatttatgtccagagcaacttccagcaaggctggtctgggtctctgcccaccaggcggggaggtgttcaaagacatctccctcagtgcggatttatatatatatttttccttcactgtgtcaagtggaaacaaaaacaaaatctttcaaaaaaaaaatcgggacaagtgaacacattaacatgattctgtttgtgcagattaaaaactttatagggacttgcattatcggttctcaataaattactgagcagctttgtttggggagggaagtccctaccatccttgtttagtctatattaagaaaatctgtgtctttttaatattcttgtgatgttttcagagccgctgtaggtctcttcttgcatgtccacagtaatgtatttgtggtttttattttgaacgcttgcttttagagagaaaacaatatagccccctacccttttcccaatcctttgccctcaaatcagtgacccaagggagggggggatttaaagggaaggagtgggcaaaacacataaaatgaatttattatatctaagctctgtagcaggattcatgtcgttctttgacagttctttctctttcctgtatatgcaataacaaggttttaaaaaaataataaagaagtgagactattagacaaagtatttatgtaattatttgataactcttgtaaataggtggaatatgaatgcttggaaaattaaactttaatttattgacattgtacatagctctgtgtaaatagaattgcaactgtcaggttttgtgttcttgttttcctttagttgggtttatttccaggtcacagaattgctgttaacactagaaaacacacttcctgcaccaacaccaataccctttcaaaagagttgtctgcaacatttttgttttcttttttaatgtccaaaagtgggggaaagtgctatttcctattttcaccaaaattggggaaggagtgccactttccagctccacttcaaattccttaaaatataactgagattgctgtggggagggaggagggcagaggctgcggtttgactttttaatttttcttttgttatttgtatttgctagtctctgatttcctcaaaacgaagtggaatttactactgttgtcagtatcggtgttttgaattggtgcctgcctatagagatatattcacagttcaaaagtcaggtgctgagagatggtttaaagacaaattcatgaaggtatattttgtgttatagttgttgatgagttctttggttttctgtatttttccccctctctttaaaacatcactgaaatttcaataaatttttattgaaatgtc

SEQ ID NO: 299575 - DNA, 4600 bp, Homo sapiens
  misc_feature (4516)..(4516): n is a, c, g, or t
  misc_feature (4519)..(4519): n is a, c, g, or t
ggaagcgaattcgctcacgttttaggacaaggaagagagagaggcacgggagaagagcccagcaagatttggattgaaaccgagacaccctccggaggctcggagcagaggaaggaggaggagggcggcgaacggaagccagtttgcaattcaagttttgatagcgctggtagaagggggtttaaatcagatttttttttttttaaaggagagagactttttccgctctctcgctccctgttaaagccgggtctagcacagctgcagacgccaccagcgagaaagagggagaggaagacagatagggggcgggggaagaagaaaaagaaaggtaaaaagtcttctaggagaacctttcacatttgcaacaaaagacctaggggctggagagagattcctgggacgcagggctggagtgtctatttcgagctcagcggcagggctcgggcgcgagtcgagaccctgctcgctcctctcgcttctgaaaccgacgttcaggagcggctttttaaaaacgcaaggcacaaggacggtcacccgcgcgactatgtttgctgatttttcgccttgccctctttaaaagcggcctcccattctccaaaagacacttcccctcctccctttgaagtgcattagttgtgatttctgcctccttttcttttttctttcttttttgttttgctttttccccccttttgaattatgtgctgctgttaaaacaacaacaaaaaaacaacaaaacacagcagctgcggacttgtccccggctggagcccagcgccccgcctggagtggatgagcctctccatgagagatccggtcattcctgggacaagcatggcctaccatccgttcctacctcaccgggcgccggacttcgccatgagcgcggtgctgggtcaccagccgccgttcttccccgcgctgacgctgcctcccaacggcgcggcggcgctctcgctgccgggcgccctggccaagccgatcatggatcaattggtgggggcggccgagaccggcatcccgttctcctccctggggccccaggcgcatctgaggcctttgaagaccatggagcccgaagaagaggtggaggacgaccccaaggtgcacctggaggctaaagaactttgggatcagtttcacaagcggggcaccgagatggtcattaccaagtcgggaaggcgaatgtttcctccatttaaagtgagatgttctgggctggataaaaaagccaaatacattttattgatggacattatagctgctgatgactgtcgttataaatttcacaattctcggtggatggtggctggtaaggccgaccccgaaatgccaaagaggatgtacattcacccggacagccccgctactggggaacagtggatgtccaaagtcgtcactttccacaaactgaaactcaccaacaacatttcagacaaacatggatttactatattgaactccatgcacaaataccagccccggttccacattgtaagagccaatgacatcttgaaactcccttatagtacatttcggacatacttgttccccgaaactgaattcatcgctgtgactgcataccagaatgataagataacccagttaaaaatagacaacaacccttttgcaaaaggtttccgggacactggaaatggccgaagagaaaaaagaaaacagctcaccctgcagtccatgagggtgtttgatgaaagacacaaaaaggagaatgggacctctgatgagtcctccagtgaacaagcagctttcaactgcttcgcccaggcttcttctccagccgcctccactgtagggacatcgaacctcaaagatttatgtcccagcgagggtgagagcgacgccgaggccgagagcaaagaggagcatggccccgaggcctgcgacgcggccaagatctccaccaccacgtcggaggagccctgccgtgacaagggcagccccgcggtcaaggctcaccttttcgctgctgagcggccccgggacagcgggcggctggacaaagcgtcgcccgactcacgccatagccccgccaccatctcgtccagcactcgcggcctgggcgcggaggagcgcaggagcccggttcgcgagggcacagcgccggccaaggtggaagaggcgcgcgcgctcccgggcaaggaggccttcgcgccgctcacggtgcagacggacgcggccgccgcgcacctggcccagggccccctgcctggcctcggcttcgccccgggcctggcgggccaacagttcttcaacgggcacccgctcttcctgcaccccagccagtttgccatggggggcgccttctccagcatggcggccgctggcatgggtcccctcctggccacggtttctggggcctccaccggtgtctcgggcctggattccacggccatggcctctgccgctgcggcgcagggactgtccggggcgtccgcggccaccctgcccttccacctccagcagcacgtcctggcctctcagggcctggccatgtcccctttcggaagcctgttcccttacccctacacgtacatggccgcagcggcggccgcctcctctgcggcagcctccagctcggtgcaccgccaccccttcctcaatctgaacaccatgcgcccgcggctgcgctacagcccctactccatcccggtgccggtcccggacggcagcagtctgctcaccaccgccctggccgccagcccggcctcggtggcagtggactcgggctctgaactcaacagccgctcctccacgctctcctccagctccatgtccttgtcgcccaaactctgcgcggagaaagaggcggccaccagcgaactgcagagcatccagcggttggttagcggcttggaagccaagccggacaggtcccgcagcgcgtccccgtagacccgtcccagacacgtcttttcattccagtccagttcaggctgccgtgcactttgtcggatataaaataaaccacgggcccgccatggcgttagcccttccttttgcagttgcgtctgggaaggggccccggactccctcgagagaatgtgctagagacagcccctgtcttcttggcgtggtttatatgtccgggatctggatcagattctgggggctcagaaacgtcggttgcattgagctactgggggtaggagttccaacatttatgtccagagcaacttccagcaaggctggtctgggtctctgcccaccaggcggggaggtgttcaaagacatctccctcagtgcggatttatatatatatttttccttcactgtgtcaagtggaaacaaaaacaaaatctttcaaaaaaaaaatcgggacaagtgaacacattaacatgattctgtttgtgcagattaaaaactttatagggacttgcattatcggttctcaataaattactgagcagctttgtttggggagggaagtccctaccatccttgtttagtctatattaagaaaatctgtgtctttttaatattcttgtgatgttttcagagccgctgtaggtctcttcttgcatgtccacagtaatgtatttgtggtttttattttgaacgcttgcttttagagagaaaacaatatagccccctacccttttcccaatcctttgccctcaaatcagtgacccaagggagggggggatttaaagggaaggagtgggcaaaacacataaaatgaatttattatatctaagctctgtagcaggattcatgtcgttctttgacagttctttctctttcctgtatatgcaataacaaggttttaaaaaaataataaagaagtgagactattagacaaagtatttatgtaattatttgataactcttgtaaataggtggaatatgaatgcttggaaaattaaactttaatttattgacattgtacatagctctgtgtaaatagaattgcaactgtcaggttttgtgttcttgttttcctttagttgggtttatttccaggtcacagaattgctgttaacactagaaaacacacttcctgcaccaacaccaataccctttcaaaagagttgtctgcaacatttttgttttcttttttaatgtccaaaagtgggggaaagtgctatttcctattttcaccaaaattggggaaggagtgccactttccagctccacttcaaattccttaaaatataactgagattgctgtggggagggaggagggcagaggctgcggtttgactttttaatttttcttttgttatttgtatttgctagtctctgatttcctcaaaacgaagtggaatttactactgttgtcagtatcggtgttttgaattggtgcctgcctatagagatatattcacagttcaaaagtcaggtgctgagagatggtttaaagacaaattcatgaaggtatattttgtgttatagttgttgatgagttctttggttttctgtatttttccccctctctttaaaacatcactgaaatttcaataaatttttattgaaatgtcaaaaaaaaaaaaanaanaaaaactttgggggggcccgttcccattatcctttggtgggcggttccaattactggtcggctttaccaccctggacctgg

SEQ ID NO: 299576 - DNA, 2920 bp, Homo sapiens
attttccagcaatgttgttgggcacgattatccccattttgcagatgacaacactgaggtgcagagaggctaaggggctttccccgggattacacagccactaagccacgagctgggattccaacttgggaactggagttccgttggctcatactggagataacgcccttctgccttggttttttccttcgcctgtggtagatttatgtcccagcgagggtgagagcgacgccgaggccgagagcaaagaggagcatggccccgaggcctgcgacgcggccaagatctccaccaccacgtcggaggagccctgccgtgacaagggcagccccgcggtcaaggctcaccttttcgctgctgagcggccccgggacagcgggcggctggacaaagcgtcgcccgactcacgccatagccccgccaccatctcgtccagcactcgcggcctgggcgcggaggagcgcaggagcccggttcgcgagggcacagcgccggccaaggtggaagaggcgcgcgcgctcccgggcaaggaggccttcgcgccgctcacggtgcagacggacgcggccgccgcgcacctggcccagggccccctgcctggcctcggcttcgccccgggcctggcgggccaacagttcttcaacgggcacccgctcttcctgcaccccagccagtttgccatggggggcgccttctccagcatggcggccgctggcatgggtcccctcctggccacggtttctggggcctccaccggtgtctcgggcctggattccacggccatggcctctgccgctgcggcgcagggactgtccggggcgtccgcggccaccctgcccttccacctccagcagcacgtcctggcctctcagggcctggccatgtcccctttcggaagcctgttcccttacccctacacgtacatggccgcagcggcggccgcctcctctgcggcagcctccagctcggtgcaccgccaccccttcctcaatctgaacaccatgcgcccgcggctgcgctacagcccctactccatcccggtgccggtcccggacggcagcagtctgctcaccaccgccctgccctccatggcggcggccgcggggcccctggacggcaaagtcgccgccctggccgccagcccggcctcggtggcagtggactcgggctctgaactcaacagccgctcctccacgctctcctccagctccatgtccttgtcgcccaaactctgcgcggagaaagaggcggccaccagcgaactgcagagcatccagcggttggttagcggcttggaagccaagccggacaggtcccgcagcgcgtccccgtagacccgtcccagacacgtcttttcattccagtccagttcaggctgccgtgcactttgtcggatataaaataaaccacgggcccgccatggcgttagcccttccttttgcagttgcgtctgggaaggggccccggactccctcgagagaatgtgctagagacagcccctgtcttcttggcgtggtttatatgtccgggatctggatcagattctgggggctcagaaacgtcggttgcattgagctactgggggtaggagttccaacatttatgtccagagcaacttccagcaaggctggtctgggtctctgcccaccaggcggggaggtgttcaaagacatctccctcagtgcggatttatatatatatttttccttcactgtgtcaagtggaaacaaaaacaaaatctttcaaaaaaaaaatcgggacaagtgaacacattaacatgattctgtttgtgcagattaaaaactttatagggacttgcattatcggttctcaataaattactgagcagctttgtttggggagggaagtccctaccatccttgtttagtctatattaagaaaatctgtgtctttttaatattcttgtgatgttttcagagccgctgtaggtctcttcttgcatgtccacagtaatgtatttgtggtttttattttgaacgcttgcttttagagagaaaacaatatagccccctacccttttcccaatcctttgccctcaaatcagtgacccaagggagggggggatttaaagggaaggagtgggcaaaacacataaaatgaatttattatatctaagctctgtagcaggattcatgtcgttctttgacagttctttctctttcctgtatatgcaataacaaggttttaaaaaaataataaagaagtgagactattagacaaagtatttatgtaattatttgataactcttgtaaataggtggaatatgaatgcttggaaaattaaactttaatttattgacattgtacatagctctgtgtaaatagaattgcaactgtcaggttttgtgttcttgttttcctttagttgggtttatttccaggtcacagaattgctgttaacactagaaaacacacttcctgcaccaacaccaataccctttcaaaagagttgtctgcaacatttttgttttcttttttaatgtccaaaagtgggggaaagtgctatttcctattttcaccaaaattggggaaggagtgccactttccagctccacttcaaattccttaaaatataactgagattgctgtggggagggaggagggcagaggctgcggtttgactttttaatttttcttttgttatttgtatttgctagtctctgatttcctcaaaacgaagtggaatttactactgttgtcagtatcggtgttttgaattggtgcctgcctatagagatatattcacagttcaaaagtcaggtgctgagagatggtttaaagacaaattcatgaaggtatattttgtgttatagttgttgatgagttctttggttttctgtatttttccccctctctttaaaacatcactgaaatttcaataaatttttattgaaatgtc

SEQ ID NO: 299577 - DNA, 2479 bp, Homo sapiens
ctctgtggggtaaactgaatctgtatccccatttaacaggtgcaaggagatttcctgggggctgcacacactgtgtgcagcatattgcaggctttcactcatttaatatctacaaagtcctcaataagtatatgaattacttatgatttccctgttttttcttcctataaggaagctgaggcacaagttaatcaaagtctcttggcctagggtgacacagctaagatttgtacctagagatttctgagtgttgacttctctcctgcccccacctatctccccccccaaaaaaaaaaacacaacaacaacaacaacagaacataccagggattcatggcttgcccaatgttggagggggagaagagaggagagggatgagataagctcctcccacccggctgactcgctgtgtgtctcttttctcaccccagggcctggccatgtcccctttcggaagcctgttcccttacccctacacgtacatggccgcagcggcggccgcctcctctgcggcagcctccagctcggtgcaccgccaccccttcctcaatctgaacaccatgcgcccgcggctgcgctacagcccctactccatcccggtgccggtcccggacggcagcagtctgctcaccaccgccctgccctccatggcggcggccgcggggcccctggacggcaaagtcgccgccctggccgccagcccggcctcggtggcagtggactcgggctctgaactcaacagccgctcctccacgctctcctccagctccatgtccttgtcgcccaaactctgcgcggagaaagaggcggccaccagcgaactgcagagcatccagcggttggttagcggcttggaagccaagccggacaggtcccgcagcgcgtccccgtagacccgtcccagacacgtcttttcattccagtccagttcaggctgccgtgcactttgtcggatataaaataaaccacgggcccgccatggcgttagcccttccttttgcagttgcgtctgggaaggggccccggactccctcgagagaatgtgctagagacagcccctgtcttcttggcgtggtttatatgtccgggatctggatcagattctgggggctcagaaacgtcggttgcattgagctactgggggtaggagttccaacatttatgtccagagcaacttccagcaaggctggtctgggtctctgcccaccaggcggggaggtgttcaaagacatctccctcagtgcggatttatatatatatttttccttcactgtgtcaagtggaaacaaaaacaaaatctttcaaaaaaaaaatcgggacaagtgaacacattaacatgattctgtttgtgcagattaaaaactttatagggacttgcattatcggttctcaataaattactgagcagctttgtttggggagggaagtccctaccatccttgtttagtctatattaagaaaatctgtgtctttttaatattcttgtgatgttttcagagccgctgtaggtctcttcttgcatgtccacagtaatgtatttgtggtttttattttgaacgcttgcttttagagagaaaacaatatagccccctacccttttcccaatcctttgccctcaaatcagtgacccaagggagggggggatttaaagggaaggagtgggcaaaacacataaaatgaatttattatatctaagctctgtagcaggattcatgtcgttctttgacagttctttctctttcctgtatatgcaataacaaggttttaaaaaaataataaagaagtgagactattagacaaagtatttatgtaattatttgataactcttgtaaataggtggaatatgaatgcttggaaaattaaactttaatttattgacattgtacatagctctgtgtaaatagaattgcaactgtcaggttttgtgttcttgttttcctttagttgggtttatttccaggtcacagaattgctgttaacactagaaaacacacttcctgcaccaacaccaataccctttcaaaagagttgtctgcaacatttttgttttcttttttaatgtccaaaagtgggggaaagtgctatttcctattttcaccaaaattggggaaggagtgccactttccagctccacttcaaattccttaaaatataactgagattgctgtggggagggaggagggcagaggctgcggtttgactttttaatttttcttttgttatttgtatttgctagtctctgatttcctcaaaacgaagtggaatttactactgttgtcagtatcggtgttttgaattggtgcctgcctatagagatatattcacagttcaaaagtcaggtgctgagagatggtttaaagacaaattcatgaaggtatattttgtgttatagttgttgatgagttctttggttttctgtatttttccccctctctttaaaacatcactgaaatttcaataaatttttattgaaatgtc

SEQ ID NO: 299578 - DNA, 2657 bp, Homo sapiens
atatcggtcgacccacgcgtccgctcaccccccacgtcggaggagccctgccgtgacaagggcagccccgcggtcaaggctcaccttttcgctgctgagcggccccgggacagcgggcggctggacaaagcgtcgcccgactcacgccatagccccgccaccatctcgtccagcactcgcggcctgggcgcggaggagcgcaggagcccggttcgcgagggcacagcgccggccaaggtggaagaggcgcgcgcgctcccgggcaaggaggccttcgcgccgctcacggtgcagacggacgcggccgccgcgcacctggcccagggccccctgcctggcctcggcttcgccccgggcctggcgggccaacagttcttcaacgggcacccgctcttcctgcaccccagccagtttgccatggggggcgccttctccagcatggcggccgctggcatgggtcccctcctggccacggtttctggggcctccaccggtgtctcgggcctggattccacggccatggcctctgccgctgcggcgcagggactgtccggggcgtccgcggccaccctgcccttccacctccagcagcacgtcctggcctctcagggcctggccatgtcccctttcggaagcctgttcccttacccctacacgtacatggccgcagcggcggccgcctcctctgcggcagcctccagctcggtgcaccgccaccccttcctcaatctgaacaccatgcgcccgcggctgcgctacagcccctactccatcccggtgccggtcccggacggcagcagtctgctcaccaccgccctgccctccatggcggcggccgcggggcccctggacggcaaagtcgccgccctggccgccagcccggcctcggtggcagtggactcgggctctgaactcaacagccgctcctccacgctctcctccagctccatgtccttgtcgcccaaactctgcgcggagaaagaggcggccaccagcgaactgcagagcatccagcggttggttagcggcttggaagccaagccggacaggtcccgcagcgcgtccccgtagacccgtcccagacacgtcttttcattccagtccagttcaggctgccgtgcactttgtcggatataaaataaaccacgggcccgccatggcgttagcccttccttttgcagttgcgtctgggaaggggccccggactccctcgagagaatgtgctagagacagcccctgtcttcttggcgtggtttatatgtccgggatctggatcagattctgggggctcagaaacgtcggttgcattgagctactgggggtaggagttccaacatttatgtccagagcaacttccagcaaggctggtctgggtctctgcccaccaggcggggaggtgttcaaagacatctccctcagtgcggatttatatatatatttttccttcactgtgtcaagtggaaacaaaaacaaaatctttcaaaaaaaaaatcgggacaagtgaacacattaacatgattctgtttgtgcagattaaaaactttatagggacttgcattatcggttctcaataaattactgagcagctttgtttggggagggaagtccctaccatccttgtttagtctatattaagaaaatctgtgtctttttaatattcttgtgatgttttcagagccgctgtaggtctcttcttgcatgtccacagtaatgtatttgtggtttttattttgaacgcttgcttttagagagaaaacaatatagccccctacccttttcccaatcctttgccctcaaatcagtgacccaagggagggggggatttaaagggaaggagtgggcaaaacacataaaatgaatttattatatctaagctctgtagcaggattcatgtcgttctttgacagttctttctctttcctgtatatgcaataacaaggttttaaaaaaataataaagaagtgagactattagacaaagtatttatgtaattatttgataactcttgtaaataggtggaatatgaatgcttggaaaattaaactttaatttattgacattgtacatagctctgtgtaaatagaattgcaactgtcaggttttgtgttcttgttttcctttagttgggtttatttccaggtcacagaattgctgttaacactagaaaacacacttcctgcaccaacaccaataccctttcaaaagagttgtctgcaacatttttgttttcttttttaatgtccaaaagtgggggaaagtgctatttcctattttcaccaaaattggggaaggagtgccactttccagctccacttcaaattccttaaaatataactgagattgctgtggggagggaggagggcagaggctgcggtttgactttttaatttttcttttgttatttgtatttgctagtctctgatttcctcaaaacgaagtggaatttactactgttgtcagtatcggtgttttgaattggtgcctgcctatagagatatattcacagttcaaaagtcaggtgctgagagatggtttaaagacaaattcatgaaggtatattttgtgttatagttgttgatgagttctttggttttctgtatttttccccctctctttaaaacatcactgaaatttcaataaatttttattgaaatgtc

SEQ ID NO: 299579 - DNA, 4167 bp, Homo sapiens
  misc_feature (4083)..(4083): n is a, c, g, or t
  misc_feature (4086)..(4086): n is a, c, g, or t
ggaagcgaattcgctcacgttttaggacaaggaagagagagaggcacgggagaagagcccagcaagatttggattgaaaccgagacaccctccggaggctcggagcagaggaaggaggaggagggcggcgaacggaagccagtttgcaattcaagttttgatagcgctggtagaagggggtttaaatcagatttttttttttttaaaggagagagactttttccgctctctcgctccctgttaaagccgggtctagcacagctgcagacgccaccagcgagaaagagggagaggaagacagatagggggcgggggaagaagaaaaagaaaggtaaaaagtcttctaggagaacctttcacatttgcaacaaaagacctaggggctggagagagattcctgggacgcagggctggagtgtctatttcgagctcagcggcagggctcgggcgcgagtcgagaccctgctcgctcctctcgcttctgaaaccgacgttcaggagcggctttttaaaaacgcaaggcacaaggacggtcacccgcgcgactatgtttgctgatttttcgccttgccctctttaaaagcggcctcccattctccaaaagacacttcccctcctccctttgaagtgcattagttgtgatttctgcctccttttcttttttctttcttttttgttttgctttttccccccttttgaattatgtgctgctgttaaaacaacaacaaaaaaacaacaaaacacagcagctgcggacttgtccccggctggagcccagcgccccgcctggagtggatgagcctctccatgagagatccggtcattcctgggacaagcatggcctaccatccgttcctacctcaccgggcgccggacttcgccatgagcgcggtgctgggtcaccagccgccgttcttccccgcgctgacgctgcctcccaacggcgcggcggcgctctcgctgccgggcgccctggccaagccgatcatggatcaattggtgggggcggccgagaccggcatcccgttctcctccctggggccccaggcgcatctgaggcctttgaagaccatggagcccgaagaagaggtggaggacgaccccaaggtgcacctggaggctaaagaactttgggatcagtttcacaagcggggcaccgagatggtcattaccaagtcgggaaggcgaatgtttcctccatttaaagtgagatgttctgggctggataaaaaagccaaatacattttattgatggacattatagctgctgatgactgtcgttataaatttcacaattctcggtggatggtggctggtaaggccgaccccgaaatgccaaagaggatgtacattcacccggacagccccgctactggggaacagtggatgtccaaagtcgtcactttccacaaactgaaactcaccaacaacatttcagacaaacatggatttgtaagtttcattgctctcttcagtaaaattttctcctccttcactcagtcaaaggcagtgcttcccatttcatgagtttcagcccagacttctcctttgcttctccctaagcatagcaaacttgtcctcgtctggaaaaaggattcggggtgtttctctccaaataatggaaggcctggcgttctaaaagaaatggggcaagaaaacttaccggcttgtgttctatagcaattccagctctttggtagattcctgacctgagagtgaagttaaaaaccattttttaagagctaaaatcaatttcaaggctatgtattcctaaaggatttgttttgttttaaaatatcatacttctgttttgaaaccagtgatattattttctcaggagagtttacgtttcggagccttgactctgttggttaaatggtgtgaatacatttttaaaaactcgttcttttactaaaaaaagaattgggcttaggtgggagtccggcttaccctaaatgaggcttagatcttcagaaaaaaatggtttgtgtgttgggagtgtatatatggattcagtgacagtgcttagaaacttagaaaactttcattgcttgtagatatcaggcaaaggaccttttgcgccttttcctacccctccccaacatttcaataaaataaacagcgtgataagcaaggagtaagcagaaagattaggcccgcggctgcgctacagcccctactccatcccggtgccggtcccggacggcagcagtctgctcaccaccgccctgccctccatggcggcggccgcggggcccctggacggcaaagtcgccgccctggccgccagcccggcctcggtggcagtggactcgggctctgaactcaacagccgctcctccacgctctcctccagctccatgtccttgtcgcccaaactctgcgcggagaaagaggcggccaccagcgaactgcagagcatccagcggttggttagcggcttggaagccaagccggacaggtcccgcagcgcgtccccgtagacccgtcccagacacgtcttttcattccagtccagttcaggctgccgtgcactttgtcggatataaaataaaccacgggcccgccatggcgttagcccttccttttgcagttgcgtctgggaaggggccccggactccctcgagagaatgtgctagagacagcccctgtcttcttggcgtggtttatatgtccgggatctggatcagattctgggggctcagaaacgtcggttgcattgagctactgggggtaggagttccaacatttatgtccagagcaacttccagcaaggctggtctgggtctctgcccaccaggcggggaggtgttcaaagacatctccctcagtgcggatttatatatatatttttccttcactgtgtcaagtggaaacaaaaacaaaatctttcaaaaaaaaaatcgggacaagtgaacacattaacatgattctgtttgtgcagattaaaaactttatagggacttgcattatcggttctcaataaattactgagcagctttgtttggggagggaagtccctaccatccttgtttagtctatattaagaaaatctgtgtctttttaatattcttgtgatgttttcagagccgctgtaggtctcttcttgcatgtccacagtaatgtatttgtggtttttattttgaacgcttgcttttagagagaaaacaatatagccccctacccttttcccaatcctttgccctcaaatcagtgacccaagggagggggggatttaaagggaaggagtgggcaaaacacataaaatgaatttattatatctaagctctgtagcaggattcatgtcgttctttgacagttctttctctttcctgtatatgcaataacaaggttttaaaaaaataataaagaagtgagactattagacaaagtatttatgtaattatttgataactcttgtaaataggtggaatatgaatgcttggaaaattaaactttaatttattgacattgtacatagctctgtgtaaatagaattgcaactgtcaggttttgtgttcttgttttcctttagttgggtttatttccaggtcacagaattgctgttaacactagaaaacacacttcctgcaccaacaccaataccctttcaaaagagttgtctgcaacatttttgttttcttttttaatgtccaaaagtgggggaaagtgctatttcctattttcaccaaaattggggaaggagtgccactttccagctccacttcaaattccttaaaatataactgagattgctgtggggagggaggagggcagaggctgcggtttgactttttaatttttcttttgttatttgtatttgctagtctctgatttcctcaaaacgaagtggaatttactactgttgtcagtatcggtgttttgaattggtgcctgcctatagagatatattcacagttcaaaagtcaggtgctgagagatggtttaaagacaaattcatgaaggtatattttgtgttatagttgttgatgagttctttggttttctgtatttttccccctctctttaaaacatcactgaaatttcaataaatttttattgaaatgtcaaaaaaaaaaaaanaanaaaaactttgggggggcccgttcccattatcctttggtgggcggttccaattactggtcggctttaccaccctggacctgg

SEQ ID NO: 299580 - DNA, 4336 bp, Homo sapiens
  misc_feature (4252)..(4252): n is a, c, g, or t
  misc_feature (4255)..(4255): n is a, c, g, or t
ggaagcgaattcgctcacgttttaggacaaggaagagagagaggcacgggagaagagcccagcaagatttggattgaaaccgagacaccctccggaggctcggagcagaggaaggaggaggagggcggcgaacggaagccagtttgcaattcaagttttgatagcgctggtagaagggggtttaaatcagatttttttttttttaaaggagagagactttttccgctctctcgctccctgttaaagccgggtctagcacagctgcagacgccaccagcgagaaagagggagaggaagacagatagggggcgggggaagaagaaaaagaaaggtaaaaagtcttctaggagaacctttcacatttgcaacaaaagacctaggggctggagagagattcctgggacgcagggctggagtgtctatttcgagctcagcggcagggctcgggcgcgagtcgagaccctgctcgctcctctcgcttctgaaaccgacgttcaggagcggctttttaaaaacgcaaggcacaaggacggtcacccgcgcgactatgtttgctgatttttcgccttgccctctttaaaagcggcctcccattctccaaaagacacttcccctcctccctttgaagtgcattagttgtgatttctgcctccttttcttttttctttcttttttgttttgctttttccccccttttgaattatgtgctgctgttaaaacaacaacaaaaaaacaacaaaacacagcagctgcggacttgtccccggctggagcccagcgccccgcctggagtggatgagcctctccatgagagatccggtcattcctgggacaagcatggcctaccatccgttcctacctcaccgggcgccggacttcgccatgagcgcggtgctgggtcaccagccgccgttcttccccgcgctgacgctgcctcccaacggcgcggcggcgctctcgctgccgggcgccctggccaagccgatcatggatcaattggtgggggcggccgagaccggcatcccgttctcctccctggggccccaggcgcatctgaggcctttgaagaccatggagcccgaagaagaggtggaggacgaccccaaggtgcacctggaggctaaagaactttgggatcagtttcacaagcggggcaccgagatggtcattaccaagtcgggaaggcgaatgtttcctccatttaaagtgagatgttctgggctggataaaaaagccaaatacattttattgatggacattatagctgctgatgactgtcgttataaatttcacaattctcggtggatggtggctggtaaggccgaccccgaaatgccaaagaggatgtacattcacccggacagccccgctactggggaacagtggatgtccaaagtcgtcactttccacaaactgaaactcaccaacaacatttcagacaaacatggatttactatattgaactccatgcacaaataccagccccggttccacattgtaagagccaatgacatcttgaaactcccttatagtacatttcggacatacttgttccccgaaactgaattcatcgctgtgactgcataccagaatgataagataacccagttaaaaatagacaacaacccttttgcaaaaggtttccgggacactggaaatggccgaagagaaaaaagaaaacagctcaccctgcagtccatgagggtgtttgatgaaagacacaaaaaggagaatgggacctctgatgagtcctccagtgaacaagcagctttcaactgcttcgcccaggcttcttctccagccgcctccactgtagggacatcgaacctcaaagatttatgtcccagcgagggtgagagcgacgccgaggccgagagcaaagaggagcatggccccgaggcctgcgacgcggccaagatctccaccaccacgtcggaggagccctgccgtgacaagggcagccccgcggtcaaggctcaccttttcgctgctgagcggccccgggacagcgggcggctggacaaagcgtcgcccgactcacgccatagccccgccaccatctcgtccagcactcgcggcctgggcgcggaggagcgcaggagcccggttcgcgagggcacagcgccggccaaggtggaagaggcgcgcgcgctcccgggcaaggaggccttcgcgccgctcacggtgcagacggacgcggccgccgcgcacctggcccagggccccctgcctggcctcggcttcgccccgggcctggcgggccaacagttcttcaacgggcacccgctcttcctgcaccccagccagtttgccatggggggcgccttctccagcatggcggccgctggcatgggtcccctcctggccacggtttctggggcctccaccggtgtctcgggcctggattccacggccatggcctctgccgctgcggcgcagggactgtccggggcgtccgcggccaccctgcccttccacctccagcagcacgtcctggcctctcagggcctggccatgtcccctttcggaagcctgttcccttacccctacacgtacatggccgcagcggcggccgcctcctctgcggcagcctccagctcggtgcaccgccaccccttcctcaatctgaacaccatgcgcccgcggctgcgctacagcccctaacacgtcttttcattccagtccagttcaggctgccgtgcactttgtcggatataaaataaaccacgggcccgccatggcgttagcccttccttttgcagttgcgtctgggaaggggccccggactccctcgagagaatgtgctagagacagcccctgtcttcttggcgtggtttatatgtccgggatctggatcagattctgggggctcagaaacgtcggttgcattgagctactgggggtaggagttccaacatttatgtccagagcaacttccagcaaggctggtctgggtctctgcccaccaggcggggaggtgttcaaagacatctccctcagtgcggatttatatatatatttttccttcactgtgtcaagtggaaacaaaaacaaaatctttcaaaaaaaaaatcgggacaagtgaacacattaacatgattctgtttgtgcagattaaaaactttatagggacttgcattatcggttctcaataaattactgagcagctttgtttggggagggaagtccctaccatccttgtttagtctatattaagaaaatctgtgtctttttaatattcttgtgatgttttcagagccgctgtaggtctcttcttgcatgtccacagtaatgtatttgtggtttttattttgaacgcttgcttttagagagaaaacaatatagccccctacccttttcccaatcctttgccctcaaatcagtgacccaagggagggggggatttaaagggaaggagtgggcaaaacacataaaatgaatttattatatctaagctctgtagcaggattcatgtcgttctttgacagttctttctctttcctgtatatgcaataacaaggttttaaaaaaataataaagaagtgagactattagacaaagtatttatgtaattatttgataactcttgtaaataggtggaatatgaatgcttggaaaattaaactttaatttattgacattgtacatagctctgtgtaaatagaattgcaactgtcaggttttgtgttcttgttttcctttagttgggtttatttccaggtcacagaattgctgttaacactagaaaacacacttcctgcaccaacaccaataccctttcaaaagagttgtctgcaacatttttgttttcttttttaatgtccaaaagtgggggaaagtgctatttcctattttcaccaaaattggggaaggagtgccactttccagctccacttcaaattccttaaaatataactgagattgctgtggggagggaggagggcagaggctgcggtttgactttttaatttttcttttgttatttgtatttgctagtctctgatttcctcaaaacgaagtggaatttactactgttgtcagtatcggtgttttgaattggtgcctgcctatagagatatattcacagttcaaaagtcaggtgctgagagatggtttaaagacaaattcatgaaggtatattttgtgttatagttgttgatgagttctttggttttctgtatttttccccctctctttaaaacatcactgaaatttcaataaatttttattgaaatgtcaaaaaaaaaaaaanaanaaaaactttgggggggcccgttcccattatcctttggtgggcggttccaattactggtcggctttaccaccctggacctgg

SEQ ID NO: 299581 - DNA, 4059 bp, Homo sapiens
  misc_feature (3975)..(3975): n is a, c, g, or t
  misc_feature (3978)..(3978): n is a, c, g, or t
ggaagcgaattcgctcacgttttaggacaaggaagagagagaggcacgggagaagagcccagcaagatttggattgaaaccgagacaccctccggaggctcggagcagaggaaggaggaggagggcggcgaacggaagccagtttgcaattcaagttttgatagcgctggtagaagggggtttaaatcagatttttttttttttaaaggagagagactttttccgctctctcgctccctgttaaagccgggtctagcacagctgcagacgccaccagcgagaaagagggagaggaagacagatagggggcgggggaagaagaaaaagaaaggtaaaaagtcttctaggagaacctttcacatttgcaacaaaagacctaggggctggagagagattcctgggacgcagggctggagtgtctatttcgagctcagcggcagggctcgggcgcgagtcgagaccctgctcgctcctctcgcttctgaaaccgacgttcaggagcggctttttaaaaacgcaaggcacaaggacggtcacccgcgcgactatgtttgctgatttttcgccttgccctctttaaaagcggcctcccattctccaaaagacacttcccctcctccctttgaagtgcattagttgtgatttctgcctccttttcttttttctttcttttttgttttgctttttccccccttttgaattatgtgctgctgttaaaacaacaacaaaaaaacaacaaaacacagcagctgcggacttgtccccggctggagcccagcgccccgcctggagtggatgagcctctccatgagagatccggtcattcctgggacaagcatggcctaccatccgttcctacctcaccgggcgccggacttcgccatgagcgcggtgctgggtcaccagccgccgttcttccccgcgctgacgctgcctcccaacggcgcggcggcgctctcgctgccgggcgccctggccaagccgatcatggatcaattggtgggggcggccgagaccggcatcccgttctcctccctggggccccaggcgcatctgaggcctttgaagaccatggagcccgaagaagaggtggaggacgaccccaaggtgcacctggaggctaaagaactttgggatcagtttcacaagcggggcaccgagatggtcattaccaagtcgggaaggcgaatgtttcctccatttaaagtgagatgttctgggctggataaaaaagccaaatacattttattgatggacattatagctgctgatgactgtcgttataaatttcacaattctcggtggatggtggctggtaaggccgaccccgaaatgccaaagaggatgtacattcacccggacagccccgctactggggaacagtggatgtccaaagtcgtcactttccacaaactgaaactcaccaacaacatttcagacaaacatggatttactatattgaactccatgcacaaataccagccccggttccacattgtaagagccaatgacatcttgaaactcccttatagtacatttcggacatacttgttccccgaaactgaattcatcgctgtgactgcataccagaatgataagataacccagttaaaaatagacaacaacccttttgcaaaaggtttccgggacactggaaatggccgaagagaaaaaagaaaacagctcaccctgcagtccatgagggtgtttgatgaaagacacaaaaaggagaatgggacctctgatgagtcctccagtgaacaagcagctttcaactgcttcgcccaggcttcttctccagccgcctccactgtagggacatcgaacctcaaagatttatgtcccagcgagggtgagagcgacgccgaggccgagagcaaagaggagcatggccccgaggcctgcgacgcggccaagatctccaccaccacgtcggaggagccctgccgtgacaagggcagccccgcggtcaaggctcaccttttcgctgctgagcggccccgggacagcgggcggctggacaaagcgtcgcccgactcacgccatagccccgccaccatctcgtccagcactcgcggcctgggcgcggaggagcgcaggagcccggttcgcgagggcacagcgccggccaaggtggaagaggcgcgcgcgctcccgggcaaggaggccttcgcgccgctcacggtgcagacggacgcggccgccgcgcacctggcccagggccccctgcctggcctcggcttcgccccgggcctggcgggccaacagttcttcaacgggcacccgctcttcctgcaccccagccagtttgccatggggggcgccttctccagcatggcggccgctggcatgggtcccctcctggccacggtttctggggcctccaccggtgtctcgggcctggattccacggccatggcctctgccgctgcggcgcagggactgtccggggcgtccgcggccaccctgccccttccttttgcagttgcgtctgggaaggggccccggactccctcgagagaatgtgctagagacagcccctgtcttcttggcgtggtttatatgtccgggatctggatcagattctgggggctcagaaacgtcggttgcattgagctactgggggtaggagttccaacatttatgtccagagcaacttccagcaaggctggtctgggtctctgcccaccaggcggggaggtgttcaaagacatctccctcagtgcggatttatatatatatttttccttcactgtgtcaagtggaaacaaaaacaaaatctttcaaaaaaaaaatcgggacaagtgaacacattaacatgattctgtttgtgcagattaaaaactttatagggacttgcattatcggttctcaataaattactgagcagctttgtttggggagggaagtccctaccatccttgtttagtctatattaagaaaatctgtgtctttttaatattcttgtgatgttttcagagccgctgtaggtctcttcttgcatgtccacagtaatgtatttgtggtttttattttgaacgcttgcttttagagagaaaacaatatagccccctacccttttcccaatcctttgccctcaaatcagtgacccaagggagggggggatttaaagggaaggagtgggcaaaacacataaaatgaatttattatatctaagctctgtagcaggattcatgtcgttctttgacagttctttctctttcctgtatatgcaataacaaggttttaaaaaaataataaagaagtgagactattagacaaagtatttatgtaattatttgataactcttgtaaataggtggaatatgaatgcttggaaaattaaactttaatttattgacattgtacatagctctgtgtaaatagaattgcaactgtcaggttttgtgttcttgttttcctttagttgggtttatttccaggtcacagaattgctgttaacactagaaaacacacttcctgcaccaacaccaataccctttcaaaagagttgtctgcaacatttttgttttcttttttaatgtccaaaagtgggggaaagtgctatttcctattttcaccaaaattggggaaggagtgccactttccagctccacttcaaattccttaaaatataactgagattgctgtggggagggaggagggcagaggctgcggtttgactttttaatttttcttttgttatttgtatttgctagtctctgatttcctcaaaacgaagtggaatttactactgttgtcagtatcggtgttttgaattggtgcctgcctatagagatatattcacagttcaaaagtcaggtgctgagagatggtttaaagacaaattcatgaaggtatattttgtgttatagttgttgatgagttctttggttttctgtatttttccccctctctttaaaacatcactgaaatttcaataaatttttattgaaatgtcaaaaaaaaaaaaanaanaaaaactttgggggggcccgttcccattatcctttggtgggcggttccaattactggtcggctttaccaccctggacctgg

SEQ ID NO: 299582 - DNA, 615 bp, Homo sapiens
cccaagtgatcacgctacgtggcaggggaattatagttttggtactcaggtaggctagggttcaaggtatgaatgatccttagatggtgagggtggggggggccctttggcaactgaggagcaatttggattctccagaagataacatctgtggagcgaaacgtacccagggggtactccaaggaggtgggctcggtacaagcgtggtaccctgcggtggggaagatttcagcctggcaggggtcctaagatcccgtttgttctgctaaatccttgttttatgtatgtctcctcttccctgcccctgcagactatattgaactccatgcacaaataccagccccggttccacattgtaagagccaatgacatcttgaaactcccttatagtacatttcggacatacttgttccccgaaactgaattcatcgctgtgactgcataccagaatgataaggtaaactcaaggggctttcctttttaatggtgatattttgccttccccttaaaagctgctttaagtcaggatgagaaagttacaagagagtggagacgagagtcttgagttgtcttttgtgatttgtggagcatttggggggaaaggacaatgacacc

SEQ ID NO: 299583 - DNA, 477 bp, Homo sapiens
atggtgatgcatgcctgtagtcccagctattcaggaggctaaggtgggagaatcacctgagcccaggaataaataaataaataaatggctataactgtgaaacacaaaataaaaatgttattaaaaataaaacacaaaaaataatttcattagtaatttaaaacacaatcataccattgacaaaaatgttcccattgcaatggtaaacacaaagatcagaaataaccttatcatctattaataatacccttcagtgatttgtaggaaagtctagggtctctttgggttacatctacattatattagatgttaaaggctgctgcataaaaacacttacataccataggtggccactatataatcttgagatcatggtaccttagaccataaaaagctgaataaacacttatgatgtggatttgattcactaataaattctcactctgatgttcccactcccagcatcaccatatatca

SEQ ID NO: 299584 - DNA, 532 bp, Homo sapiens
agcttccgcagagatcctgcagatgtgattcgagtcttccagcaacaccacctcactctgctttgcacaatcactccacctccccacatgttgcggagattctcctggggattcacactcttcctacttgcagctgtgacacgggaaacatcctccaccaggtcttctctcacagtgtggcctctgcgcacaggttatccacctgtagacctggacgggaccctcgaggctccctactctgaccatctggttttatagttgaggaaccagaagccgaggcagggtctcgacggtgaagaagcaggctgtttccatcttcaggatacaagccatctgcgcataggaagagggtccagaggctcatctggaatccctcctcactcactggacggaggacctgaccccgttcccatcattggttctgaatccatcagcccagcaagacaggtgtctccagcaagttctgtaaaatacaaccatagccgggcctggagtcagcccccaataaagggttcaccatgaagtcaaagct

SEQ ID NO: 299585 - DNA, 942 bp, Homo sapiens
cctatggaaggggccccagtccctcccctgtgcatacagctccccagccgggggttcccttggattcataatcctccagctctacccccacccccagtgacccacatcttagccccatgacctctgacctcctgaccccttcctcatccttgcttccccttgtgaactctgacccttccgtggtgacctgagagccctacagactctgtggcccagagactccgtgacctccgaccccatcccagacccaggccccccccatgtcacagcccgcaggaggcctaggcctaagccccaggccccatgaccaccccgtgtccaccccggtgccctttccctggctgcccgggtgtgactgccatgtggccgcagacccgctgttcgtgctggagcacagcctgcccattgacacgcagtactacctggagcagcagctggccaagcccctcctgcgcatcttcgagcccatcctgggcgagggccgtgccgaggctgtgctactgcggggggaccacacgcgctgcaagacggtgctcacgggcaaggtgggcggcctcctggccttcgccaaacgccgcaactgctgcattggctgccgcacagtgctcagccaccagggagccgtgtgtgagttctgccagccccgggagtctgagctgtatcagaaggaggtatcccatctgaatgccctggaggagcgcttctcgcgcctctggacgcagtgccagcgctgccagggcagcctgcacgaggacgtcatctgcaccagccgggactgccccatcttctacatgcgcaagaaggtgcggaaggacctggaagaccaggagcagctcctgcggcgcttcggaccccctggacctgaggcctggtgaccttgcaagcatcccatggggcgggggcgggaccagggagaattaataaagttctggacttttgcta

SEQ ID NO: 299586 - DNA, 1006 bp, Homo sapiens
cctatggaaggggccccagtccctcccctgtgcatacagctccccagccgggggttcccttggattcataatcctccagctctacccccacccccagtgacccacatcttagccccatgacctctgacctcctgaccccttcctcatccttgcttccccttgtgaactctgacccttccgtggtgacctgagagccctacagactctgtggcccagagactccgtgacctccgaccccatcccagacccaggccccccccatgtcacagcccgcaggaggcctaggcctaagccccaggccccatgaccaccccgtgtccaccccggtgccctttccctggctgcccgggtgtgactgccatgtggccgcagacccgctgttcgtgctggagcacagcctgcccattgacacgcagtactacctggagcagcagctggccaagcccctcctgcgcatcttcgagcccatcctgggcgagggccgtgccgaggctgtgctactgcggggggaccacacgcgctgcaagacggtgctcacgggcaaggtgggcggcctcctggccttcgccaaacgccgcaactgctgcattggctgccgcacagtgctcagccaccagggagccgtgtgtgagttctgccagccccgggagtctgagctgtatcagaaggaggtatcccatctgaatgccctggaggagcgcttctcgcgcctctggacgcagtgccagcgctgccagggcagcctgcacgaggacgtcatctgcaccagccgggactgccccatcttctacatgcgcaagaaggtgcggaaggacctggaagaccaggagcagctcctgcggcgcttcggaccccctggacctgaggcctggtgaccttgcaagcatcccatggggcgggggcgggaccagggagaattaataaagttctggacttttgctaaaaaaaaacacacctccaacacaaacaacaacaccaaaaataaccacacaccacactacaacgg

SEQ ID NO: 299587 - DNA, 3431 bp, Homo sapiens
ggcggcgtaggctgtggcgggaaacgctgtttgaagcgggatggatggcaagcggcggccaggcccagggcccggggtgcccccaaagcgggcccgtgggggcctctgggatgatgatgatgcacctcggccatcccaattcgaggaggacctggcactgatggaggagatggaggcagaacacaggctgcaggagcaggaggaggaggagctgcagtcagtcctggagggggttgcagacgggcaggtcccaccatcagccatagatcctcgctggcttcggcccacaccaccagcgctggacccccagacagagcccctcatcttccaacagttggagattgaccattatgtgggcccagcgcagcctgtgcctggggggcccccaccatcccgcggctccgtgcctgtgctccgcgccttcggggtcaccgatgaggggttctctgtctgctgccacatccacggcttcgctccctacttctacaccccagcgccccctggtttcgggcccgagcacatgggtgacctgcaacgggagctgaacttggccatcagccgggacagtcgcggggggagggagctgactgggccggccgtgctggctgtggaactgtgctcccgagagagcatgtttgggtaccacgggcacggcccctccccgttcctgcgcatcaccgtggcgctgccgcgcctcgtggccccggcccgccgtctcctggaacagggcatccgtgtggcaggcctgggcacgcccagcttcgcgccctacgaggccaacgtcgactttgagatccggttcatggtggacacggacatcgtcggctgcaactggctggagctcccagctgggaaatacgccctgaggctgaaggagaaggctacgcagtgccagctggaggcggacgtgctgtggtctgacgtggtcagtcacccaccggaagggccatggcagcgcattgcgcccttgcgcgtgctcagcttcgatatcgagtgcgccggccgcaaaggcatcttccctgagcctgagcgggaccctgtcatccagatctgctcgctgggcctgcgctggggggagccggagcccttcctacgcctggcgctcaccctgcggccctgtgcccccatcctgggtgccaaggtgcagagctacgagaaggaggaggacctgctgcaggcctggtccaccttcatccgtatcatggaccccgacgtgatcaccggttacaacatccagaacttcgaccttccgtacctcatctctcgggcccagaccctcaaggtacaaacattccctttcctgggccgtgtggccggcctttgctccaacatccgggactcttcattccagtccaagcagacgggccggcgggacaccaaggttgtcagcatggtgggccgcgtgcagatggacatgctgcaggtgctgctgcgggagtacaagctccgctcctacacgctcaatgccgtgagcttccacttcctgggcgagcagaaggaggacgtgcagcacagcatcatcaccgacctgcagaatgggaacgaccagacccgccgccgcctggctgtgtactgcctgaaggatgcctacctgccactgcggctgctggagcggctcatggtgctggtgaacgccgtggagatggcgagggtcactggcgtgcccctcagctacctgctcagtcgtggccagcaggtcaaggtcgtatcccagctgttgcggcaggccatgcacgaggggctgctgatgcccgtggtgaagtcagagggcggcgaggactacacgggagccactgtcatcgagcccctcaaagggtactacgacgtccccatcgccaccctggacttctcctcgctgtacccgtccatcatgatggcccacaacctgtgttacaccacgctccttcggcccgggactgcacagaaactgggcctgactgaggatcagttcatcaggacccccaccggggacgagtttgtgaagacctcagtgcggaaggggctgctgccccagatcctggagaacctgctcagtgcccggaagagggccaaggccgagctggccaaggagacagaccccctccggcgccaggtcctggatggacggcagctggcgctgaaggtgagcgccaactccgtatacggcttcactggcgcccaggtgggcaagttgccgtgcctggagatctcacagagcgtcacggggttcggacgtcagatgatcgagaaaaccaagcagctggtggagtctaagtacacagtggagaatggctacagcaccagtgccaaggtggtgtatggtgacactgactccgtcatgtgccgattcggcgtgtcctcggtggctgaggcgatggccctggggcgggaggccgcggactgggtgtcaggtcacttcccgtcgcccatccggctggagtttgagaaggtctacttcccatacctgcttatcagcaagaagcgctacgcgggcctgctcttctcctcccggcccgacgcccacgaccgcatggactgcaagggcctggaggccgtgcgcagggacaactgccccctcgtggccaacctggtcactgcctcactgcgccgcctgctcatcgaccgagaccctgagggcgcggtggctcacgcacaggacgtcatctcggacctgctgtgcaaccgcatcgatatctcccagctggtcatcaccaaggagctgacccgcgcggcctccgactatgccggcaagcaggcccacgtggagctggccgagaggatgaggaagcgggaccccgggagtgcgcccagcctgggcgaccgcgtcccctacgtgatcatcagtgccgccaagggtgtggccgcctacatgaagtcggaggacccgctgttcgtgctggagcacagcctgcccattgacacgcagtactacctggagcagcagctggccaagcccctcctgcgcatcttcgagcccatcctgggcgagggccgtgccgaggctgtgctactgcggggggaccacacgcgctgcaagacggtgctcacgggcaaggtgggcggcctcctggccttcgccaaacgccgcaactgctgcattggctgccgcacagtgctcagccaccagggagccgtgtgtgagttctgccagccccgggagtctgagctgtatcagaaggaggtatcccatctgaatgccctggaggagcgcttctcgcgcctctggacgcagtgccagcgctgccagggcagcctgcacgaggacgtcatctgcaccagccgggactgccccatcttctacatgcgcaagaaggtgcggaaggacctggaagaccaggagcagctcctgcggcgcttcggaccccctggacctgaggcctggtgaccttgcaagcatcccatggggcgggggcgggaccagggagaattaataaagttctggacttttgcta

SEQ ID NO: 299588 - DNA, 1008 bp, Homo sapiens
ggcggcgtaggctgtggcgggaaacgctgtttgaagcggcttcagcactgactctgggctcccacaagcccctgcgcttcctctgtcccacccgggtctctcctcgcagatcatcactccctgtccctctctggctacttgcacaacccgaagccagagccgctaacgacgcttgcttcttcctgtctaagctgttgtaccaaggagcccccaaaacacagtggcccaagaaagatacaaattgatttctccacataacgctttggaagatagtagagacagggtttcaccatgttgataaggctggtctcaaacaactgacctcaagtgatccacccgcctcggcctctcaaagtgctgggattataggtgcgagccacggtgcccagctgggtacaggatggatggcaagcggcggccaggcccagggcccggggtgcccccaaagcgggcccgtgggggcctctgggatgatgatgatgcacctcggccatcccaattcgaggaggacctggcactgatggaggagatggaggcagaacacaggctgcaggagcaggaggaggaggagctgcagtcagtcctggagggggttgcagacgggcaggtcccaccatcagccatagatcctcgctggcttcggcccacaccaccagcgctggacccccagacagagcccctcatcttccaacagttggagattgaccattatgtgggccagacaggctgtgctggggggcccacattccaggggtcgggctgggtccgggctcggggtacggaaacggttccggtgcggccatcaccggtcgttcctattttaaaccaggccctggttttggccaccacttgtggcgcacgggctaatggccaccgggaactggcggcggaggagttgggccgctgtttaaataccccaaagtttgaagaaggccccctgaaaggggggtttacacccctacataaatgggatggagccacccataataggatgcacacacacaacac

SEQ ID NO: 299589 - DNA, 638 bp, Homo sapiens
  misc_feature (37)..(37): n is a, c, g, or t
  misc_feature (85)..(85): n is a, c, g, or t
gtgctccctggacgagaattccacatccggagaatcntcatcctgaatctcgatcggattctcgctctccccattctctgcagcnccattatcctcccccatcaccgtaacgtccggccagatctgcttccaaaaccacaacacctgtgcaaacacctccacggagttattgagctctttggccccgttgccagtcgtctgagcgttggcgatctcatcgacaatggctttgcacgcgtcgacaaattggctgaagccagctgatgtccagtttggaatgaatgcctcgtggatggcggctgtgtgcagccagggagccgtgtgtgagttctgccagccccgggagtctgagctgtatcagaaggaggtatcccatctgaatgccctggaggagcgcttctcgcgcctctggacgcagtgccagcgctgccagggcagcctgcacgaggacgtcatctgcaccagccgggactgccccatcttctacatgcgcaagaaggtgcggaaggacctggaagaccaggagcagctcctgcggcgcttcggaccccctggacctgaggcctggtgaccttgcaagcatcccatggggcgggggcgggaccagggagaattaataaagttctggacttttgcta

SEQ ID NO: 299590 - DNA, 416 bp, Homo sapiens
actttcagaagctgggattggcagtgggcagggatggggtggcccagttcctggctgggccccagcacttgggctgacccgcctccccacaggagccgtgtgtgagttctgccagccccgggagtctgagctgtatcagaaggaggtatcccatctgaatgccctggaggagcgcttctcgcgcctctggacgcagtgccagcgctgccagggcagcctgcacgaggacgtcatctgcaccagccgggactgccccatcttctacatgcgcaagaaggtgcggaaggacctggaagaccaggagcagctcctgcggcgcttcggaccccctggacctgaggcctggtgaccttgcaagcatcccatggggcgggggcgggaccagggagaattaataaagttctggacttttgcta

SEQ ID NO: 299591 - DNA, 324 bp, Homo sapiens
  misc_feature (31)..(32): n is a, c, g, or t
aagattacggctaggtacgaggctgggtggnnagttgagctgtatagaaggaggtatcccatctgaatgccctggaggagcgcttctcgcgcctctggacgcagtgccagcgctgccagggcagcctgcacgaggacgtcatctgcaccagccgggactgccccatcttctacatgcgcaagaaggtgcggaaggacctggaagaccaggagcagctcctgcggcgcttcggaccccctggacctgaggcctggtgaccttgcaagcatcccatggggcgggggcgggaccagggagaattaataaagttctggacttttgcta

SEQ ID NO: 299592 - DNA, 3791 bp, Homo sapiens
ggcggcgtaggctgtggcgggaaacgctgtttgaagcggcttcagcactgactctgggctcccacaagcccctgcgcttcctctgtcccacccgggtctctcctcgcagatcatcactccctgtccctctctggctacttgcacaacccgaagccagagccgctaacgacgcttgcttcttcctgtctaagctgttgtaccaaggagcccccaaaacacagtggcccaagaaagatacaaattgatttctccacataacgctttggaagatagtagagacagggtttcaccatgttgataaggctggtctcaaacaactgacctcaagtgatccacccgcctcggcctctcaaagtgctgggattataggtgcgagccacggtgcccagctgggtacaggatggatggcaagcggcggccaggcccagggcccggggtgcccccaaagcgggcccgtgggggcctctgggatgatgatgatgcacctcggccatcccaattcgaggaggacctggcactgatggaggagatggaggcagaacacaggctgcaggagcaggaggaggaggagctgcagtcagtcctggagggggttgcagacgggcaggtcccaccatcagccatagatcctcgctggcttcggcccacaccaccagcgctggacccccagacagagcccctcatcttccaacagttggagattgaccattatgtgggcccagcgcagcctgtgcctggggggcccccaccatcccgcggctccgtgcctgtgctccgcgccttcggggtcaccgatgaggggttctctgtctgctgccacatccacggcttcgctccctacttctacaccccagcgccccctggtttcgggcccgagcacatgggtgacctgcaacgggagctgaacttggccatcagccgggacagtcgcggggggagggagctgactgggccggccgtgctggctgtggaactgtgctcccgagagagcatgtttgggtaccacgggcacggcccctccccgttcctgcgcatcaccgtggcgctgccgcgcctcgtggccccggcccgccgtctcctggaacagggcatccgtgtggcaggcctgggcacgcccagcttcgcgccctacgaggccaacgtcgactttgagatccggttcatggtggacacggacatcgtcggctgcaactggctggagctcccagctgggaaatacgccctgaggctgaaggagaaggctacgcagtgccagctggaggcggacgtgctgtggtctgacgtggtcagtcacccaccggaagggccatggcagcgcattgcgcccttgcgcgtgctcagcttcgatatcgagtgcgccggccgcaaaggcatcttccctgagcctgagcgggaccctgtcatccagatctgctcgctgggcctgcgctggggggagccggagcccttcctacgcctggcgctcaccctgcggccctgtgcccccatcctgggtgccaaggtgcagagctacgagaaggaggaggacctgctgcaggcctggtccaccttcatccgtatcatggaccccgacgtgatcaccggttacaacatccagaacttcgaccttccgtacctcatctctcgggcccagaccctcaaggtacaaacattccctttcctgggccgtgtggccggcctttgctccaacatccgggactcttcattccagtccaagcagacgggccggcgggacaccaaggttgtcagcatggtgggccgcgtgcagatggacatgctgcaggtgctgctgcgggagtacaagctccgctcctacacgctcaatgccgtgagcttccacttcctgggcgagcagaaggaggacgtgcagcacagcatcatcaccgacctgcagaatgggaacgaccagacccgccgccgcctggctgtgtactgcctgaaggatgcctacctgccactgcggctgctggagcggctcatggtgctggtgaacgccgtggagatggcgagggtcactggcgtgcccctcagctacctgctcagtcgtggccagcaggtcaaggtcgtatcccagctgttgcggcaggccatgcacgaggggctgctgatgcccgtggtgaagtcagagggcggcgaggactacacgggagccactgtcatcgagcccctcaaagggtactacgacgtccccatcgccaccctggacttctcctcgctgtacccgtccatcatgatggcccacaacctgtgttacaccacgctccttcggcccgggactgcacagaaactgggcctgactgaggatcagttcatcaggacccccaccggggacgagtttgtgaagacctcagtgcggaaggggctgctgccccagatcctggagaacctgctcagtgcccggaagagggccaaggccgagctggccaaggagacagaccccctccggcgccaggtcctggatggacggcagctggcgctgaaggtgagcgccaactccgtatacggcttcactggcgcccaggtgggcaagttgccgtgcctggagatctcacagagcgtcacggggttcggacgtcagatgatcgagaaaaccaagcagctggtggagtctaagtacacagtggagaatggctacagcaccagtgccaaggtggtgtatggtgacactgactccgtcatgtgccgattcggcgtgtcctcggtggctgaggcgatggccctggggcgggaggccgcggactgggtgtcaggtcacttcccgtcgcccatccggctggagtttgagaaggtctacttcccatacctgcttatcagcaagaagcgctacgcgggcctgctcttctcctcccggcccgacgcccacgaccgcatggactgcaagggcctggaggccgtgcgcagggacaactgccccctcgtggccaacctggtcactgcctcactgcgccgcctgctcatcgaccgagaccctgagggcgcggtggctcacgcacaggacgtcatctcggacctgctgtgcaaccgcatcgatatctcccagctggtcatcaccaaggagctgacccgcgcggcctccgactatgccggcaagcaggcccacgtggagctggccgagaggatgaggaagcgggaccccgggagtgcgcccagcctgggcgaccgcgtcccctacgtgatcatcagtgccgccaagggtgtggccgcctacatgaagtcggaggacccgctgttcgtgctggagcacagcctgcccattgacacgcagtactacctggagcagcagctggccaagcccctcctgcgcatcttcgagcccatcctgggcgagggccgtgccgaggctgtgctactgcggggggaccacacgcgctgcaagacggtgctcacgggcaaggtgggcggcctcctggccttcgccaaacgccgcaactgctgcattggctgccgcacagtgctcagccaccagggagccgtgtgtgagttctgccagccccgggagtctgagctgtatcagaaggaggtatcccatctgaatgccctggaggagcgcttctcgcgcctctggacgcagtgccagcgctgccagggcagcctgcacgaggacgtcatctgcaccagccgggactgccccatcttctacatgcgcaagaaggtgcggaaggacctggaagaccaggagcagctcctgcggcgcttcggaccccctggacctgaggcctggtgaccttgcaagcatcccatggggcgggggcgggaccagggagaattaataaagttctggacttttgcta

SEQ ID NO: 299593 - DNA, 3359 bp, Homo sapiens
ggcggcgtaggctgtggcgggaaacgctgtttgaagcgggatggatggcaagcggcggccaggcccagggcccggggtgcccccaaagcgggcccgtgggggcctctgggatgatgatgatgcacctcggccatcccaattcgaggaggacctggcactgatggaggagatggaggcagaacacaggctgcaggagcaggaggaggaggagctgcagtcagtcctggagggggttgcagacgggcaggtcccaccatcagccatagatcctcgctggcttcggcccacaccaccagcgctggacccccagacagagcccctcatcttccaacagttggagattgaccattatgtgggcccagcgcagcctgtgcctggggggcccccaccatcccgcggctccgtgcctgtgctccgcgccttcggggtcaccgatgaggggttctctgtctgctgccacatccacggcttcgctccctacttctacaccccagcgccccctggtttcgggcccgagcacatgggtgacctgcaacgggagctgaacttggccatcagccgggacagtcgcggggggagggagctgactgggccggccgtgctggctgtggaactgtgctcccgagagagcatgtttgggtaccacgggcacggcccctccccgttcctgcgcatcaccgtggcgctgccgcgcctcgtggccccggcccgccgtctcctggaacagggcatccgtgtggcaggcctgggcacgcccagcttcgcgccctacgaggccaacgtcgactttgagatccggttcatggtggacacggacatcgtcggctgcaactggctggagctcccagctgggaaatacgccctgaggctgaaggagaaggctacgcagtgccagctggaggcggacgtgctgtggtctgacgtggtcagtcacccaccggaagggccatggcagcgcattgcgcccttgcgcgtgctcagcttcgatatcgagtgcgccggccgcaaaggcatcttccctgagcctgagcgggaccctgtcatccagatctgctcgctgggcctgcgctggggggagccggagcccttcctacgcctggcgctcaccctgcggccctgtgcccccatcctgggtgccaaggtgcagagctacgagaaggaggaggacctgctgcaggcctggtccaccttcatccgtatcatggaccccgacgtgatcaccggttacaacatccagaacttcgaccttccgtacctcatctctcgggcccagaccctcaaggtacaaacattccctttcctgggccgtgtggccggcctttgctccaacatccgggactcttcattccagtccaagcagacgggccggcgggacaccaaggttgtcagcatggtgggccgcgtgcagatggacatgctgcaggtgctgctgcgggagtacaagctccgctcctacacgctcaatgccgtgagcttccacttcctgggcgagcagaaggaggacgtgcagcacagcatcatcaccgacctgcagaatgggaacgaccagacccgccgccgcctggctgtgtactgcctgaaggatgcctacctgccactgcggctgctggagcggctcatggtgctggtgaacgccgtggagatggcgagggtcactggcgtgcccctcagctacctgctcagtcgtggccagcaggtcaaggtcgtatcccagctgttgcggcaggccatgcacgaggggctgctgatgcccgtggtgaagtcagagggcggcgaggactacacgggagccactgtcatcgagcccctcaaagggtactacgacgtccccatcgccaccctggacttctcctcgctgtacccgtccatcatgatggcccacaacctgtgttacaccacgctccttcggcccgggactgcacagaaactgggcctgactgaggatcagttcatcaggacccccaccggggacgagtttgtgaagacctcagtgcggaaggggctgctgccccagatcctggagaacctgctcagtgcccggaagagggccaaggccgagctggccaaggagacagaccccctccggcgccaggtcctggatggacggcagctggcgctgaagagcgtcacggggttcggacgtcagatgatcgagaaaaccaagcagctggtggagtctaagtacacagtggagaatggctacagcaccagtgccaaggtggtgtatggtgacactgactccgtcatgtgccgattcggcgtgtcctcggtggctgaggcgatggccctggggcgggaggccgcggactgggtgtcaggtcacttcccgtcgcccatccggctggagtttgagaaggtctacttcccatacctgcttatcagcaagaagcgctacgcgggcctgctcttctcctcccggcccgacgcccacgaccgcatggactgcaagggcctggaggccgtgcgcagggacaactgccccctcgtggccaacctggtcactgcctcactgcgccgcctgctcatcgaccgagaccctgagggcgcggtggctcacgcacaggacgtcatctcggacctgctgtgcaaccgcatcgatatctcccagctggtcatcaccaaggagctgacccgcgcggcctccgactatgccggcaagcaggcccacgtggagctggccgagaggatgaggaagcgggaccccgggagtgcgcccagcctgggcgaccgcgtcccctacgtgatcatcagtgccgccaagggtgtggccgcctacatgaagtcggaggacccgctgttcgtgctggagcacagcctgcccattgacacgcagtactacctggagcagcagctggccaagcccctcctgcgcatcttcgagcccatcctgggcgagggccgtgccgaggctgtgctactgcggggggaccacacgcgctgcaagacggtgctcacgggcaaggtgggcggcctcctggccttcgccaaacgccgcaactgctgcattggctgccgcacagtgctcagccaccagggagccgtgtgtgagttctgccagccccgggagtctgagctgtatcagaaggaggtatcccatctgaatgccctggaggagcgcttctcgcgcctctggacgcagtgccagcgctgccagggcagcctgcacgaggacgtcatctgcaccagccgggactgccccatcttctacatgcgcaagaaggtgcggaaggacctggaagaccaggagcagctcctgcggcgcttcggaccccctggacctgaggcctggtgaccttgcaagcatcccatggggcgggggcgggaccagggagaattaataaagttctggacttttgcta

SEQ ID NO: 299594 - DNA, 3495 bp, Homo sapiens
ggcggcgtaggctgtggcgggaaacgctgtttgaagcgggatggatggcaagcggcggccaggcccagggcccggggtgcccccaaagcgggcccgtgggggcctctgggatgatgatgatgcacctcggccatcccaattcgaggaggacctggcactgatggaggagatggaggcagaacacaggctgcaggagcaggaggaggaggagctgcagtcagtcctggagggggttgcagacgggcaggtcccaccatcagccatagatcctcgctggcttcggcccacaccaccagcgctggacccccagacagagcccctcatcttccaacagttggagattgaccattatgtgggcccagcgcagcctgtgcctggggggcccccaccatcccgcggctccgtgcctgtgctccgcgccttcggggtcaccgatgaggggttctctgtctgctgccacatccacggcttcgctccctacttctacaccccagcgccccctggtttcgggcccgagcacatgggtgacctgcaacgggagctgaacttggccatcagccgggacagtcgcggggggagggagctgactgggccggccgtgctggctgtggaactgtgctcccgagagagcatgtttgggtaccacgggcacggcccctccccgttcctgcgcatcaccgtggcgctgccgcgcctcgtggccccggcccgccgtctcctggaacagggcatccgtgtggcaggcctgggcacgcccagcttcgcgccctacgaggccaacgtcgactttgagatccggttcatggtggacacggacatcgtcggctgcaactggctggagctcccagctgggaaatacgccctgaggctgaaggagaaggctacgcagtgccagctggaggcggacgtgctgtggtctgacgtggtcagtcacccaccggaagggccatggcagcgcattgcgcccttgcgcgtgctcagcttcgatatcgagtgcgccggccgcaaaggcatcttccctgagcctgagcgggaccctgtcatccagatctgctcgctgggcctgcgctggggggagccggagcccttcctacgcctggcgctcaccctgcggccctgtgcccccatcctgggtgccaaggtgcagagctacgagaaggaggaggacctgctgcaggcctggtccaccttcatccgtatcatggaccccgacgtgatcaccggttacaacatccagaacttcgaccttccgtacctcatctctcgggcccagaccctcaaggtacaaacattccctttcctgggccgtgtggccggcctttgctccaacatccgggactcttcattccagtccaagcagacgggccggcgggacaccaaggttgtcagcatggtgggccgcgtgcagatggacatgctgcaggtgctgctgcgggagtacaagctccgctcctacacgctcaatgccgtgagcttccacttcctgggcgagcagaaggaggacgtgcagcacagcatcatcaccgacctgcagaatgggaacgaccagacccgccgccgcctggctgtgtactgcctgaaggatgcctacctgccactgcggctgctggagcggctcatggtgctggtgaacgccgtggagatggcgagggtcactggcgtgcccctcagctacctgctcagtcgtggccagcaggtcaaggtcgtatcccagctgttgcggcaggccatgcacgaggggctgctgatgcccgtggtgaagtcagagggcggcgaggactacacgggagccactgtcatcgagcccctcaaagggtactacgacgtccccatcgccaccctggacttctcctcgctgtacccgtccatcatgatggcccacaacctgtgttacaccacgctccttcggcccgggactgcacagaaactgggcctgactgaggatcagttcatcaggacccccaccggggacgagtttgtgaagacctcagtgcggaaggggctgctgccccagatcctggagaacctgctcagtgcccggaagagggccaaggccgagctggccaaggagacagaccccctccggcgccaggtcctggatggacggcagctggcgctgaaggtgagcgccaactccgtatacggcttcactggcgcccaggtgggcaagttgccgtgcctggagatctcacagagcgtcacggggttcggacgtcagatgatcgagaaaaccaagcagctggtggagtctaagtacacagtggagaatggctacagcaccagtgccaaggtggtgtatggtgacactgactccgtcatgtgccgattcggcgtgtcctcggtggctgaggcgatggccctggggcgggaggccgcggactgggtgtcaggtcacttcccgtcgcccatccggctggagtttgagaaggtctacttcccatacctgcttatcagcaagaagcgctacgcgggcctgctcttctcctcccggcccgacgcccacgaccgcatggactgcaagggcctggaggccgtgcgcagggacaactgccccctcgtggccaacctggtcactgcctcactgcgccgcctgctcatcgaccgagaccctgagggcgcggtggctcacgcacaggacgtcatctcggacctgctgtgcaaccgcatcgatatctcccagctggtcatcaccaaggagctgacccgcgcggcctccgactatgccggcaagcaggcccacgtggagctggccgagaggatgaggaagcgggaccccgggagtgcgcccagcctgggcgaccgcgtcccctacgtgatcatcagtgccgccaagggtgtggccgcctacatgaagtcggaggacccgctgttcgtgctggagcacagcctgcccattgacacgcagtactacctggagcagcagctggccaagcccctcctgcgcatcttcgagcccatcctgggcgagggccgtgccgaggctgtgctactgcggggggaccacacgcgctgcaagacggtgctcacgggcaaggtgggcggcctcctggccttcgccaaacgccgcaactgctgcattggctgccgcacagtgctcagccaccagggagccgtgtgtgagttctgccagccccgggagtctgagctgtatcagaaggaggtatcccatctgaatgccctggaggagcgcttctcgcgcctctggacgcagtgccagcgctgccagggcagcctgcacgaggacgtcatctgcaccagccgggactgccccatcttctacatgcgcaagaaggtgcggaaggacctggaagaccaggagcagctcctgcggcgcttcggaccccctggacctgaggcctggtgaccttgcaagcatcccatggggcgggggcgggaccagggagaattaataaagttctggacttttgctaaaaaaaaacacacctccaacacaaacaacaacaccaaaaataaccacacaccacactacaacgg

SEQ ID NO: 299595 - DNA, 3509 bp, Homo sapiens
ggcggcgtaggctgtggcgggaaacgctgtttgaagcgggatggatggcaagcggcggccaggcccagggcccggggtgcccccaaagcgggcccgtgggggcctctgggatgatgatgatgcacctcggccatcccaattcgaggaggacctggcactgatggaggagatggaggcagaacacaggctgcaggagcaggaggaggaggagctgcagtcagtcctggagggggttgcagacgggcaggtcccaccatcagccatagatcctcgctggcttcggcccacaccaccagcgctggacccccagacagagcccctcatcttccaacagttggagattgaccattatgtgggcccagcgcagcctgtgcctggggggcccccaccatcccgcggctccgtgcctgtgctccgcgccttcggggtcaccgatgaggggttctctgtctgctgccacatccacggcttcgctccctacttctacaccccagcgccccctggtttcgggcccgagcacatgggtgacctgcaacgggagctgaacttggccatcagccgggacagtcgcggggggagggagctgactgggccggccgtgctggctgtggaactgtgctcccgagagagcatgtttgggtaccacgggcacggcccctccccgttcctgcgcatcaccgtggcgctgccgcgcctcgtggccccggcccgccgtctcctggaacagggcatccgtgtggcaggcctgggcacgcccagcttcgcgccctacgaggccaacgtcgactttgagatccggttcatggtggacacggacatcgtcggctgcaactggctggagctcccagctgggaaatacgccctgaggctgaaggagaaggctacgcagtgccagctggaggcggacgtgctgtggtctgacgtggtcagtcacccaccggaagggccatggcagcgcattgcgcccttgcgcgtgctcagcttcgatatcgagtgcgccggccgcaaaggcatcttccctgagcctgagcgggaccctgtcatccagatctgctcgctgggcctgcgctggggggagccggagcccttcctacgcctggcgctcaccctgcggccctgtgcccccatcctgggtgccaaggtgcagagctacgagaaggaggaggacctgctgcaggcctggtccaccttcatccgtatcatggaccccgacgtgatcaccggttacaacatccagaacttcgaccttccgtacctcatctctcgggcccagaccctcaaggtacaaacattccctttcctgggccgtgtggccggcctttgctccaacatccgggactcttcattccagtccaagcagacgggccggcgggacaccaaggttgtcagcatggtgggccgcgtgcagatggacatgctgcaggtgctgctgcgggagtacaagctccgctcctacacgctcaatgccgtgagcttccacttcctgggcgagcagaaggaggacgtgcagcacagcatcatcaccgacctgcagaatgggaacgaccagacccgccgccgcctggctgtgtactgcctgaaggatgcctacctgccactgcggctgctggagcggctcatggtgctggtgaacgccgtggagatggcgagggtcactggcgtgcccctcagctacctgctcagtcgtggccagcaggtcaaggtcgtatcccagctgttgcggcaggccatgcacgaggggctgctgatgcccgtggtgaagtcagagggcggcgaggactacacgggagccactgtcatcgagcccctcaaaggggtgaggccacaagacagggcgggggcggcatgggaactcctagccctgactcccggccgcggctgctcccctcccaggtactacgacgtccccatcgccaccctggacttctcctcgctgtacccgtccatcatgatggcccacaacctgtgttacaccacgctccttcggcccgggactgcacagaaactgggcctgactgaggatcagttcatcaggacccccaccggggacgagtttgtgaagacctcagtgcggaaggggctgctgccccagatcctggagaacctgctcagtgcccggaagagggccaaggccgagctggccaaggagacagaccccctccggcgccaggtcctggatggacggcagctggcgctgaaggtgagcgccaactccgtatacggcttcactggcgcccaggtgggcaagttgccgtgcctggagatctcacagagcgtcacggggttcggacgtcagatgatcgagaaaaccaagcagctggtggagtctaagtacacagtggagaatggctacagcaccagtgccaaggtggtgtatggtgacactgactccgtcatgtgccgattcggcgtgtcctcggtggctgaggcgatggccctggggcgggaggccgcggactgggtgtcaggtcacttcccgtcgcccatccggctggagtttgagaaggtctacttcccatacctgcttatcagcaagaagcgctacgcgggcctgctcttctcctcccggcccgacgcccacgaccgcatggactgcaagggcctggaggccgtgcgcagggacaactgccccctcgtggccaacctggtcactgcctcactgcgccgcctgctcatcgaccgagaccctgagggcgcggtggctcacgcacaggacgtcatctcggacctgctgtgcaaccgcatcgatatctcccagctggtcatcaccaaggagctgacccgcgcggcctccgactatgccggcaagcaggcccacgtggagctggccgagaggatgaggaagcgggaccccgggagtgcgcccagcctgggcgaccgcgtcccctacgtgatcatcagtgccgccaagggtgtggccgcctacatgaagtcggaggacccgctgttcgtgctggagcacagcctgcccattgacacgcagtactacctggagcagcagctggccaagcccctcctgcgcatcttcgagcccatcctgggcgagggccgtgccgaggctgtgctactgcggggggaccacacgcgctgcaagacggtgctcacgggcaaggtgggcggcctcctggccttcgccaaacgccgcaactgctgcattggctgccgcacagtgctcagccaccagggagccgtgtgtgagttctgccagccccgggagtctgagctgtatcagaaggaggtatcccatctgaatgccctggaggagcgcttctcgcgcctctggacgcagtgccagcgctgccagggcagcctgcacgaggacgtcatctgcaccagccgggactgccccatcttctacatgcgcaagaaggtgcggaaggacctggaagaccaggagcagctcctgcggcgcttcggaccccctggacctgaggcctggtgaccttgcaagcatcccatggggcgggggcgggaccagggagaattaataaagttctggacttttgcta

SEQ ID NO: 299596 - DNA, 3604 bp, Homo sapiens
  misc_feature (3433)..(3433): n is a, c, g, or t
ggcggcgtaggctgtggcgggaaacgctgtttgaagcgggatggatggcaagcggcggccaggcccagggcccggggtgcccccaaagcgggcccgtgggggcctctgggatgatgatgatgcacctcggccatcccaattcgaggaggacctggcactgatggaggagatggaggcagaacacaggctgcaggagcaggaggaggaggagctgcagtcagtcctggagggggttgcagacgggcaggtcccaccatcagccatagatcctcgctggcttcggcccacaccaccagcgctggacccccagacagagcccctcatcttccaacagttggagattgaccattatgtgggcccagcgcagcctgtgcctggggggcccccaccatcccgcggctccgtgcctgtgctccgcgccttcggggtcaccgatgaggggttctctgtctgctgccacatccacggcttcgctccctacttctacaccccagcgccccctggtttcgggcccgagcacatgggtgacctgcaacgggagctgaacttggccatcagccgggacagtcgcggggggagggagctgactgggccggccgtgctggctgtggaactgtgctcccgagagagcatgtttgggtaccacgggcacggcccctccccgttcctgcgcatcaccgtggcgctgccgcgcctcgtggccccggcccgccgtctcctggaacagggcatccgtgtggcaggcctgggcacgcccagcttcgcgccctacgaggccaacgtcgactttgagatccggttcatggtggacacggacatcgtcggctgcaactggctggagctcccagctgggaaatacgccctgaggctgaaggagaaggctacgcagtgccagctggaggcggacgtgctgtggtctgacgtggtcagtcacccaccggaagggccatggcagcgcattgcgcccttgcgcgtgctcagcttcgatatcgagtgcgccggccgcaaaggcatcttccctgagcctgagcgggaccctgtcatccagatctgctcgctgggcctgcgctggggggagccggagcccttcctacgcctggcgctcaccctgcggccctgtgcccccatcctgggtgccaaggtgcagagctacgagaaggaggaggacctgctgcaggcctggtccaccttcatccgtatcatggaccccgacgtgatcaccggttacaacatccagaacttcgaccttccgtacctcatctctcgggcccagaccctcaaggtacaaacattccctttcctgggccgtgtggccggcctttgctccaacatccgggactcttcattccagtccaagcagacgggccggcgggacaccaaggttgtcagcatggtgggccgcgtgcagatggacatgctgcaggtgctgctgcgggagtacaagctccgctcctacacgctcaatgccgtgagcttccacttcctgggcgagcagaaggaggacgtgcagcacagcatcatcaccgacctgcagaatgggaacgaccagacccgccgccgcctggctgtgtactgcctgaaggatgcctacctgccactgcggctgctggagcggctcatggtgctggtgaacgccgtggagatggcgagggtcactggcgtgcccctcagctacctgctcagtcgtggccagcaggtcaaggtcgtatcccagctgttgcggcaggccatgcacgaggggctgctgatgcccgtggtgaagtcagagggcggcgaggactacacgggagccactgtcatcgagcccctcaaagggtactacgacgtccccatcgccaccctggacttctcctcgctgtacccgtccatcatgatggcccacaacctgtgttacaccacgctccttcggcccgggactgcacagaaactgggcctgactgaggatcagttcatcaggacccccaccggggacgagtttgtgaagacctcagtgcggaaggggctgctgccccagatcctggagaacctgctcagtgcccggaagagggccaaggccgagctggccaaggagacagaccccctccggcgccaggtcctggatggacggcagctggcgctgaaggtgagcgccaactccgtatacggcttcactggcgcccaggtgggcaagttgccgtgcctggagatctcacagagcgtcacggggttcggacgtcagatgatcgagaaaaccaagcagctggtggagtctaagtacacagtggagaatggctacagcaccagtgccaaggtggtgtatggtgacactgactccgtcatgtgccgattcggcgtgtcctcggtggctgaggcgatggccctggggcgggaggccgcggactgggtgtcaggtcacttcccgtcgcccatccggctggagtttgagaaggtctacttcccatacctgcttatcagcaagaagcgctacgcgggcctgctcttctcctcccggcccgacgcccacgaccgcatggactgcaagggcctggaggccgtgcgcagggacaactgccccctcgtggccaacctggtcactgcctcactgcgccgcctgctcatcgaccgagaccctgagggcgcggtggctcacgcacaggacgtcatctcggacctgctgtgcaaccgcatcgatatctcccagctggtcatcaccaaggagctgacccgcgcggcctccgactatgccggcaagcaggcccacgtggagctggccgagaggatgaggaagcgggaccccgggagtgcgcccagcctgggcgaccgcgtcccctacgtgatcatcagtgccgccaagggtgtggccgcctacatgaagtcggaggacccgctgttcgtgctggagcacagcctgcccattgacacgcagtactacctggagcagcagctggccaagcccctcctgcgcatcttcgagcccatcctgggcgagggccgtgccgaggctgtgctactgcggggggaccacacgcgctgcaagacggtgctcacgggcaaggtgggcggcctcctggccttcgccaaacgccgcaactgctgcattggctgccgcacagtgctcagccaccagggagccgtgtgtgagttctgccagccccgggagtctgagctgtatcagaaggaggtatcccatctgaatgccctggaggagcgcttctcgcgcctctggacgcagtgccagcgctgccagggcagcctgcacgaggacgtcatctgcaccagccgggactgccccatcttctacatgcgcaagaaggtgcggaaggacctggaagaccaggagcagctcctgcggcgcttcggaccccctggacctgaggcctggtgaccttgcaagcatcccatggggcgggggcgggaccagggagaattaataaagttctggacttttgctatnacacacacaacccaaaacccgaggggccccaatgccggcacgcggcgcaaagcccgctacggactgcgcccaggggccaaacctggtttccggacccaagttactgtggccacggtgggcacaattggccggccccctaatgggggcccaatacatccgaaaccaggtacg

SEQ ID NO: 299597 - DNA, 4003 bp, Homo sapiens
ggcggcgtaggctgtggcgggaaacgctgtttgaagcgggatggatggcaagcggcggccaggcccagggcccggggtgcccccaaagcgggcccgtgggggcctctgggatgatgatgatgcacctcggccatcccaattcgaggaggacctggcactgatggaggagatggaggcagaacacaggctgcaggagcaggaggaggaggagctgcagtcagtcctggagggggttgcagacgggcaggtcccaccatcagccatagatcctcgctggcttcggcccacaccaccagcgctggacccccagacagagcccctcatcttccaacagttggagattgaccattatgtgggcccagcgcagcctgtgcctggggggcccccaccatcccgcggctccgtgcctgtgctccgcgccttcggggtcaccgatgaggggttctctgtctgctgccacatccacggcttcgctccctacttctacaccccagcgccccctggtttcgggcccgagcacatgggtgacctgcaacgggagctgaacttggccatcagccgggacagtcgcggggggagggagctgactgggccggccgtgctggctgtggaactgtgctcccgagagagcatgtttgggtaccacgggcacggcccctccccgttcctgcgcatcaccgtggcgctgccgcgcctcgtggccccggcccgccgtctcctggaacagggcatccgtgtggcaggcctgggcacgcccagcttcgcgccctacgaggccaacgtcgactttgagatccggttcatggtggacacggacatcgtcggctgcaactggctggagctcccagctgggaaatacgccctgaggctgaaggagaaggctacgcagtgccagctggaggcggacgtgctgtggtctgacgtggtcagtcacccaccggaagggccatggcagcgcattgcgcccttgcgcgtgctcagcttcgatatcgagtgcgccggccgcaaaggcatcttccctgagcctgagcgggaccctgtcatccagatctgctcgctgggcctgcgctggggggagccggagcccttcctacgcctggcgctcaccctgcggccctgtgcccccatcctgggtgccaaggtgcagagctacgagaaggaggaggacctgctgcaggcctggtccaccttcatccgtatcatggaccccgacgtgatcaccggttacaacatccagaacttcgaccttccgtacctcatctctcgggcccagaccctcaaggtacaaacattccctttcctgggccgtgtggccggcctttgctccaacatccgggactcttcattccagtccaagcagacgggccggcgggacaccaaggttgtcagcatggtgggccgcgtgcagatggacatgctgcaggtgctgctgcgggagtacaagctccgctcctacacgctcaatgccgtgagcttccacttcctgggcgagcagaaggaggacgtgcagcacagcatcatcaccgacctgcagaatgggaacgaccagacccgccgccgcctggctgtgtactgcctgaaggatgcctacctgccactgcggctgctggagcggctcatggtgctggtgaacgccgtggagatggcgagggtcactggcgtgcccctcagctacctgctcagtcgtggccagcaggtcaaggtcgtatcccagctgttgcggcaggccatgcacgaggggctgctgatgcccgtggtgaagtcagagggcggcgaggactacacgggagccactgtcatcgagcccctcaaagggtactacgacgtccccatcgccaccctggacttctcctcgctgtacccgtccatcatgatggcccacaacctgtgttacaccacgctccttcggcccgggactgcacagaaactgggcctgactgaggatcagttcatcaggacccccaccggggacgagtttgtgaagacctcagtgcggaaggggctgctgccccagatcctggagaacctgctcagtgcccggaagagggccaaggccgagctggccaaggagacagaccccctccggcgccaggtcctggatggacggcagctggcgctgaaggtgagcgccaactccgtatacggcttcactggcgcccaggtgggcaagttgccgtgcctggagatctcacagagcgtcacggggttcggacgtcagatgatcgagaaaaccaagcagctggtggagtctaagtacacagtggagaatggctacagcaccagtgccaaggtggtgtatggtgacactgactccgtcatgtgccgattcggcgtgtcctcggtggctgaggcgatggccctggggcgggaggccgcggactgggtgtcaggtcacttcccgtcgcccatccggctggagtttgagaaggtctacttcccatacctgcttatcagcaagaagcgctacgcgggcctgctcttctcctcccggcccgacgcccacgaccgcatggactgcaagggcctggaggccgtgcgcagggacaactgccccctcgtggccaacctggtcactgcctcactgcgccgcctgctcatcgaccgagaccctgagggcgcggtggctcacgcacaggacgtcatctcggacctgctgtgcaaccgcatcgatatctcccagctggtcatcaccaaggagctgacccgcgcggcctccgactatgccggcaagcaggcccacgtggagctggccgagaggatgaggaagcgggaccccgggagtgcgcccagcctgggcgaccgcgtcccctacgtgatcatcagtgccgccaagggtgtggccgcctacatgaagtcggaggacccgctgttcgtgctggagcacagcctgcccattgacacgcagtactacctggagcagcagctggccaagcccctcctgcgcatcttcgagcccatcctgggcgagggccgtgccgaggctgtgctactgcggggggaccacacgcgctgcaagacggtgctcacgggcaaggtgggcggcctcctggccttcgccaaacgccgcaactgctgcattggctgccgcacagtgctcagccaccagggagccgtgtgtgagttctgccagccccgggagtctgagctgtatcagaaggaggtatcccatctgaatgccctggaggagcgcttctcgcgcctctggacgcagtgccagcgctgccagggcagcctgcacgaggacgtcatctgcaccagccgggactgccccatcttctacatgcgcaagaaggtgcggaaggacctggaagaccaggagcagctcctgcggcgcttcggaccccctggacctgaggcctggtgaccttgcaagcatcccatggggcgggggcgggaccagggagaattaataaagttctggacttttgctaaaagataaaactcaaagaaccaaaagagcaagaagacagaagacagccaagaaaaagcaaacgaggaacgggacatccgcggggggggcgagaaccaagagggaacagacacaagcgcggccccggggcccagctttcctcgcaagacccccctttgatgcaccaagggggcgggccctgcggggcgagcccccaaataggacgggcagcctcatatccttgcccacagaatacacaccgcggggggtggccccccggggaatttcaaggaaaagcgggaggaaacggttgcgcaccacgagatcagcgcactgacgcgtaggtagacgatgaacagcaggtacaggggaggccacagcaactcacctgttctcacagacaacaacgcagcgtgggcagccgatgaacacgcgcacatcacagagtaatccaggtcagcctcattaccgaacatcagtcccgcgcggtccccgagcaggcaggagccctatcgtacccttagaaccagaaccacgatttattgacctagcttgccccagtacgctaccgccaatgttgcaacctgcagtacc

SEQ ID NO: 299598 - DNA, 2188 bp, Homo sapiens
ggcggcgtaggctgtggcgggaaacgctgtttgaagcgggtacaaacattccctttcctgggccgtgtggccggcctttgctccaacatccgggactcttcattccagtccaagcagacgggccggcgggacaccaaggttgtcagcatggtgggccgcgtgcagatggacatgctgcaggtgctgctgcgggagtacaagctccgctcctacacgctcaatgccgtgagcttccacttcctgggcgagcagaaggaggacgtgcagcacagcatcatcaccgacctgcagaatgggaacgaccagacccgccgccgcctggctgtgtactgcctgaaggatgcctacctgccactgcggctgctggagcggctcatggtgctggtgaacgccgtggagatggcgagggtcactggcgtgcccctcagctacctgctcagtcgtggccagcaggtcaaggtcgtatcccagctgttgcggcaggccatgcacgaggggctgctgatgcccgtggtgaagtcagagggcggcgaggactacacgggagccactgtcatcgagcccctcaaagggtactacgacgtccccatcgccaccctggacttctcctcgctgtacccgtccatcatgatggcccacaacctgtgttacaccacgctccttcggcccgggactgcacagaaactgggcctgactgaggatcagttcatcaggacccccaccggggacgagtttgtgaagacctcagtgcggaaggggctgctgccccagatcctggagaacctgctcagtgcccggaagagggccaaggccgagctggccaaggagacagaccccctccggcgccaggtcctggatggacggcagctggcgctgaaggtgagcgccaactccgtatacggcttcactggcgcccaggtgggcaagttgccgtgcctggagatctcacagagcgtcacggggttcggacgtcagatgatcgagaaaaccaagcagctggtggagtctaagtacacagtggagaatggctacagcaccagtgccaaggtggtgtatggtgacactgactccgtcatgtgccgattcggcgtgtcctcggtggctgaggcgatggccctggggcgggaggccgcggactgggtgtcaggtcacttcccgtcgcccatccggctggagtttgagaaggtctacttcccatacctgcttatcagcaagaagcgctacgcgggcctgctcttctcctcccggcccgacgcccacgaccgcatggactgcaagggcctggaggccgtgcgcagggacaactgccccctcgtggccaacctggtcactgcctcactgcgccgcctgctcatcgaccgagaccctgagggcgcggtggctcacgcacaggacgtcatctcggacctgctgtgcaaccgcatcgatatctcccagctggtcatcaccaaggagctgacccgcgcggcctccgactatgccggcaagcaggcccacgtggagctggccgagaggatgaggaagcgggaccccgggagtgcgcccagcctgggcgaccgcgtcccctacgtgatcatcagtgccgccaagggtgtggccgcctacatgaagtcggaggacccgctgttcgtgctggagcacagcctgcccattgacacgcagtactacctggagcagcagctggccaagcccctcctgcgcatcttcgagcccatcctgggcgagggccgtgccgaggctgtgctactgcggggggaccacacgcgctgcaagacggtgctcacgggcaaggtgggcggcctcctggccttcgccaaacgccgcaactgctgcattggctgccgcacagtgctcagccaccagggagccgtgtgtgagttctgccagccccgggagtctgagctgtatcagaaggaggtatcccatctgaatgccctggaggagcgcttctcgcgcctctggacgcagtgccagcgctgccagggcagcctgcacgaggacgtcatctgcaccagccgggactgccccatcttctacatgcgcaagaaggtgcggaaggacctggaagaccaggagcagctcctgcggcgcttcggaccccctggacctgaggcctggtgaccttgcaagcatcccatggggcgggggcgggaccagggagaattaataaagttctggacttttgcta

SEQ ID NO: 299599 - DNA, 412 bp, Homo sapiens
cacgccaggtgacaggtgatatacggccagccatggccctgcacctcgccaggcacccgctgttatcggctccccccccccaccccccccgtgcctgctgagcaaacagcccgctgcgggagggggcgggtgggctgggcagcaggcggggaccaaagtcctgggaacagcccccacccctctcccaggctgggcactgggccttggctggtcctgaccctgcccctgcccccacccgcagccgggactgccccatcttctacatgcgcaagaaggtgcggaaggacctggaagaccaggagcagctcctgcggcgcttcggaccccctggacctgaggcctggtgaccttgcaagcatcccatggggcgggggcgggaccagggagaattaataaagttctggacttttgc

SEQ ID NO: 299600 - DNA, 7829 bp, Homo sapiens
  misc_feature (2440)..(2440): n is a, c, g, or t
gccaggggcacagtcctttcttactgtgaaactttactagaacccgaatgttcttcaagggttgctggcaggcctcagtgtaaacaaatagaccagtcatcatcagaccagaccaggaatgagggtgaagcaccgggatttcatgtggcatctctatctgctgaagcagggcagatagatctgttacctgatgagaggaaagtccaggccacatctctgtctgcagacagctttgaatctctgcccaatacggaaactgacagagagccatgggatcctgtgcaggctttctcccatgctgctcctgctcaagacaggaaacgtcgtactggagaactgaggcagttcgcgggagcaagtgaaccatttatatgtcactctagttcttctgaaatcatagagaaaaagaaagatgcaaccagaacaccttcctcagctgatcctttggccccagacagtcctcgttcttcagcacctgtggaggaggtcaggagggtagtatcaaagaaggtagtggctgccttaccttctcaggccccttatgatgatcctagagtgactctgcatgagctaagtcagtcagttccgcaggagactgcagagggcataccccctggcagtcaggacagcagcccagagcatcaggaacccagaactctagacaccacatatggagaagtttcagataatttgttagtgactgcacagggagaaaaaacagcccattttgaaagtcagtctgtgacctgtgatgttcagaattctacaagtgcctcagggcctaagcaagaccatgtccaatgccctgaggcttctactggctttgaagaaggtagggcaagtcccaaacaagataccattctgcctggagctctgacaagggttgcactggaagctcccacacagcagtgtgtgcagtgtaaggagagtgttgggtctgggttgacagaagtctgcagggctggcagcaaacattccaggccaattccactgccagatcaaagaccaagcgcaaatcctgggggaattggggaggaagccccatgtagacacccaagggaagctttagatggccctgtcttctcaaggaaccctgaaggcagcaggactctcagcccgtctagagggaaagagagcagaactcttccttgccgacagccatgcagttctcaacctgttgctactcatgcttattcctcccattcctctactttactgtgttttagagatggtgacctagggaaggagcctttcaaggctgccccacatactatccacccaccctgtgtagtaccttccagggcctatgaaatggatgagacaggagagatctctaggggacctgatgtgcacttgacacatggccttgagcccaaagatgttaacagggaatttaggctaacagagagcagcacttgtgagccttctactgtggctgctgtcctatctcgagctcaaggctgcagatccccttctgctcctgacgtgaggacaggttccttcagccactcagctactgatggaagcgtggggttaataggggttcctgagaaaaaggttgctgagaagcaagcaagcacagaacttgaggctgcctctttccctgcaggcatgtactctgagcccctgaggcagtttagggacagctctgtaggtgaccagaatgcacaggtgtgtcaaaccaatccagaaccacctgcaacaactcagggaccacacaccctggatttaagtgaagggtctgctgagagcaagttggtggtagagccacagcatgaatgtttagaaaataccactagatgttttttggaaaagccacaattttccactgagttgagggatcacaatcgcttggattcccaagccaagtttgtagcaaggttaaaacatacctgcagcccccaggaagacagtccctggcaggaagaagagcagcacagagaccaggcttcaggtggtggagaaggcttcgcccagggtgtgaatccccttcctgatgaagatggcttagatggctgtcagattttagatgctgggagagaggaggtggctgtggccaagcctcctgtgtccaagattttatcacagggcttcaaagacccagccactgtgtccttgaggcaaaatgaaacaccgcagcctgctgctcagaggagtggccacctctacactggcagagagcagccagcacccaaccacaggggctcacttcctgtgactacaatcttctctggccccaaacactccaggtcctcccccacaccacagttctcagttgtcggctcttctcgttctcttcaggagctgaacttgagtgtggagcctccttcccctacagacgaagatacacaggggcctaacagattgtggaacccacatctcaggggctattcctcaggaaagtcagtggcaagaacatctctgcaggctgaggacagcnatcagaaagcctcatctcgcttggatgatgggactaccgatcacaggcacctgaagcctgccacccctccttatccaatgccttccactctctcacacatgccaacccctgatttcacgaccagctggatgtctggtactttggaacaagcccaacagggaaagcgagagaaactgggtgtccaggttaggccagaaaattggtgctctcagatggacaaaggaatgctgcactttggctccagtgacatcagtccctatgcgctgccgtggcgtccggaggagcctgcacgtatcagctggaagcagtatatgtctggcagtgcagtcgatgtttcctgcagccagaagccccaggggctgacactatcaaatgtggcccggtgctccagcatggacaatggcctagaagaccagaactcccctttccactcccacctcagcacttacgccaatatttgtgatctgtcaaccacacacagcagcactgagaatgcccagggttcaaatgaggcctgggaagtattccgagggagttcttcaattgccttaggagacccccacatcccgacgagccctgaaggagtagcccccacttcgggtcatgacagaaggcctcagttcaggggcccttctggtgaagcagactgtctgaggagtaagccccccttggccaaaggaagtgctgcaggtccagtggatgagattatgctgctgtatccatcagaggcaggctgccctgtgggacagaccaggacgaacacattcgaacagggcacacagaccctcggcagcaggcgccactggagcagcactgacatctcctttgctcagcctgaagccagtgcagtatcagcctttgatctggcctcatggaccagcatgcacaatctgtctctccacctctcacagctcctgcacagtacctcagagctgcttgggagtctctcccagccagatgtggccagaagggagcagaacaccaagagggacatcccagataaagccccacaggccctgatgatggatggctctactcagaccactgtggatgagggcagccagactgacctcaccttacccaccctgtgcctccagacttcagaggctgaacctcagggagccaatgtgatccttgaagggctaggctcagatacctcgactgtgtctcaagaagagggagatgtgccaggggtacctcagaagagagaggcagaggaaacagcacagaaaatggctcagctcctctatcttcaggaagaaagcactccctacaagccccagagcccttcaataccctcatcccacttgaggtttcagaaagcccccgttgggcagcatcttccttctgtgagcccctcagtttctgatgctttcctgcctcccagctcccagccagaggagtcatattgcttagttgtcagcagtcccagtcccagctcccctcattccccagggctctttcccagtacttccgagtatcctggggactccagggtccagaagaagctgggccccacaagtgctttgttcgtggacagggcctcctccccaatcctcactcttagtgccagcacccaagagccgggtctttccccaggctctttgaccctctcagccccttcaactcaccctgttgaaggccaccagaagcttgactccagcccagaccctgttgatgccccaaggactccaatggataattattcccaaaccactgacgagttaggtggctcccagagaggtagaagttccttacaaaggagtaatgggagatccttccttgagttgcactccccacacagcccacagcagagtccaaaactccaatttagtttcttagggcagcaccctcagcagcttcagcccaggacaactatcggggtccaaagcagactgctgccaccaccactgaggcacaggagccaaaggctgggcaacagctttgtgcctgagaaggtggcttccccggagcattgcccactgagcggtagggagccaagtcagtggcagagcaggacagaaaatggaggtgagagttcagcatctccaggggaaccacaacgcactctggaccgaccttcttcatggggaggcctccagcacctcagcccctgccctgtctctgagttgactgatactgcagggctccgaggttctgccttgggcctccctcaggcctgccaacctgaggagttactgtgcttcagttgccagatgtgcatggcccctgagcaccagcaccacagtctgagggacctcccggtgcataacaaatttagtaactggtgtggggttcagaagggctcacctggggggttggacatgactgaggaggagctgggggccagcggtgatctcagctctgaaaagcaggaacagagtcccccacaacctcctaatgaccacagccaggattctgagtggtccaagagggagcagatccccctgcaagttggggcccagaacctctcactcagcgtggaactcacagaagcgaaactgcaccatggctttggggaggccgatgccctgctccaggtgctgcagagtgggacaggggaggcgcttgctgctgatgaacctgtgacatccacctggaaggagctctatgcacggcaaaaaaaggccattgagaccctcaggagagagcgggctgagcgacttgggaacttctgccggacgcgaagccttagccctcagaaacaactgagcctcctgcccaacaaagatctcttcatctgggatcttgacttgcccagcagacgccgagaatacctgcagcaactgaggaaggatgttgtggagaccaccaggagcccagagtcagtgtcaaggtcagctcacacaccctctgacatagagttgatgctgcaagactaccagcaggcccatgaggaggccaaggtggagattgcccgggcccgagaccaactgcgggagcggactgaacaagagaagctgagaatccaccagaagatcatttcccagctattgaaggaagaggataaactacataccttggccaattccagctccctgtgcaccagctctaatggaagcctctcgtctggcatgacctctggctataatagcagcccagccttgtcaggccagctccagttcccagagaatatggggcatacaaacttgcctgattccagggatgtatggataggggatgagcgaggaggccattctgcagtgaggaagaactctgcctacagccacagagcctccctgggcagttgctgctgttcaccatccagtctgtccagcttggggacctgcttttcctcctcctaccaggatttggccaagcatgtcgtggacacttctatggctgatgtaatggctgcttgttcggataatttgcacaacctcttcagctgccaggcaactgctggctggaactatcagggtgaggagcaggcggtgcagctttactacaaggtgttttctcccactcggcatggcttcctgggggcaggtgtggtgtcccagccgctgtctcgtgtgtgggcggctgtcagtgaccccactgtgtggcccctgtattacaagcccatccagacagcaaggctgcatcagcgagtgaccaacagcatcagcctggtgtacttggtgtgcaacaccaccctgtgcgcactgaagcagccacgggatttctgttgtgtctgcgtggaagccaaagagggtcacctgtctgtcatggcagcccagtctgtgtatgatacatccatgccaagacccagcagaaaaatggttcgcggggagatcctgcccagtgcctggatcttgcagcccatcactgtggaagggaaggaagtcaccagagtcatctacttggcccaggtggaacttggtgctccaggcttcccacctcagctcctgagctctttcatcaaacggcagccactggttatagccagactggcttccttccttggtaggtagcatctcaccgtcaagatggtgctgctgagatgcaggcccaggctgctcaagagagacactgtggcagctccttgttactttccataccacagtgcaggaaaagctgatgctacctgctgtggccgattggggcagacagcactggcccagggatgctagcaaagcccagtcagtacttggtcacagctggcaccagtgcagagcaaacggcctgagctcctggcccagactatccagagtgaatgcagctccgctcaccttttggatttctcacctttctttcctgtttctgggactctgcggcagacaggacacttaaggaccaggactgggcacagccagcagagccggggactgcagtgctttggcaaggtgcttccgcaggctggtagggaagcaggcagccactggccaagactctgctctgaatctacctcctctagcattcagctctactgtgtgatgggacgttaaaaataccaaaacagaaagagggtttaaaaaacagctgcacaaaccagaacaccgattcagaatcttttctccctcttgagtttttgcaaaatactttattattgatttttgctttttttctccctttccctcccaggagaagacatttgggtcttggcctgaggcaggggtgttgagcgatgatgctctgatatggagctgtcactctagagctcggtcagatggaagacactatagaaccaggttggacagatttggggtcagggttggaggctgagttcttttgaggactggttggagtggcagccagatggtggctgctgacaaggcaagaggaatttcagagattaaacattgtcctttgaggaagggagaggaggtgaatgaactcccagaggaggtgagtggcttgttgggaggaagctcagttccagaacttacctcagtgcacttgggaggggtggagtcctgagcattccatgatttctgccctggccccacctatcctaggatggggtgggatggagagtgggttcagttttcttgtactttagcctggctgaacatgaactttgtgtttacctggaagtggtaggggtgggagagattctcatctttagttctggtgcccaaaatctttggtagatggagggaactggggattcagaagatgtggtaaaggtctatttctgtagtgtggcagagatgtgtttttctaaagtgtttgcagggcatttttccctcttacctcagattaagttatttatatattgttgattgaaggttttttaaaattgcttttaaacttctatttctcgggtaaattttttggtgacatgatatatttaacaccctatttatatactcctacctcttttcatataaatctcttactaagactactgaccaaaaaagaacattttaaaattaaaagtcctctgtgtactttatctagtgaa

SEQ ID NO: 299601 - DNA, 3042 bp, Homo sapiens
acttagaggatcgtgatgtcatcccccttcgtagagtcccccacaacctcctaatgaccacagccaggattctgagtggtccaagagggagcagatccccctgcaagttggggcccagaacctctcactcagcgtggaactcacagaagcgaaactgcaccatggctttggggaggccgatgccctgctccaggtgctgcagagtgggacaggggaggcgcttgctgctgatgaacctgtgacatccacctggaaggagctctatgcacggcaaaaaaaggccattgagaccctcaggagagagcgggctgagcgacttgggaacttctgccggacgcgaagccttagccctcagaaacaactgagcctcctgcccaacaaagatctcttcatctgggatcttgacttgcccagcagacgccgagaatacctgcagcaactgaggaaggatgttgtggagaccaccaggagcccagagtcagtgtcaaggtcagctcacacaccctctgacatagagttgatgctgcaagactaccagcaggcccatgaggaggccaaggtggagattgcccgggcccgagaccaactgcgggagcggactgaacaagagaagctgagaatccaccagaagatcatttcccagctattgaaggaagaggataaactacataccttggccaattccagctccctgtgcaccagctctaatggaagcctctcgtctggcatgacctctggctataatagcagcccagccttgtcaggccagctccagttcccagagaatatggggcatacaaacttgcctgattccagggatgtatggataggggatgagcgaggaggccattctgcagtgaggaagaactctgcctacagccacagagcctccctgggcagttgctgctgttcaccatccagtctgtccagcttggggacctgcttttcctcctcctaccaggatttggccaagcatgtcgtggacacttctatggctgatgtaatggctgcttgttcggataatttgcacaacctcttcagctgccaggcaactgctggctggaactatcagggtgaggagcaggcggtgcagctttactacaaggtgttttctcccactcggcatggcttcctgggggcaggtgtggtgtcccagccgctgtctcgtgtgtgggcggctgtcagtgaccccactgtgtggcccctgtattacaagcccatccagacagcaaggctgcatcagcgagtgaccaacagcatcagcctggtgtacttggtgtgcaacaccaccctgtgcgcactgaagcagccacgggatttctgttgtgtctgcgtggaagccaaagagggtcacctgtctgtcatggcagcccagtctgtgtatgatacatccatgccaagacccagcagaaaaatggttcgcggggagatcctgcccagtgcctggatcttgcagcccatcactgtggaagggaaggaagtcaccagagtcatctacttggcccaggtggaacttggtgctccaggcttcccacctcagctcctgagctctttcatcaaacggcagccactggttatagccagactggcttccttccttggtaggtagcatctcaccgtcaagatggtgctgctgagatgcaggcccaggctgctcaagagagacactgtggcagctccttgttactttccataccacagtgcaggaaaagctgatgctacctgctgtggccgattggggcagacagcactggcccagggatgctagcaaagcccagtcagtacttggtcacagctggcaccagtgcagagcaaacggcctgagctcctggcccagactatccagagtgaatgcagctccgctcaccttttggatttctcacctttctttcctgtttctgggactctgcggcagacaggacacttaaggaccaggactgggcacagccagcagagccggggactgcagtgctttggcaaggtgcttccgcaggctggtagggaagcaggcagccactggccaagactctgctctgaatctacctcctctagcattcagctctactgtgtgatgggacgttaaaaataccaaaacagaaagagggtttaaaaaacagctgcacaaaccagaacaccgattcagaatcttttctccctcttgagtttttgcaaaatactttattattgatttttgctttttttctccctttccctcccaggagaagacatttgggtcttggcctgaggcaggggtgttgagcgatgatgctctgatatggagctgtcactctagagctcggtcagatggaagacactatagaaccaggttggacagatttggggtcagggttggaggctgagttcttttgaggactggttggagtggcagccagatggtggctgctgacaaggcaagaggaatttcagagattaaacattgtcctttgaggaagggagaggaggtgaatgaactcccagaggaggtgagtggcttgttgggaggaagctcagttccagaacttacctcagtgcacttgggaggggtggagtcctgagcattccatgatttctgccctggccccacctatcctaggatggggtgggatggagagtgggttcagttttcttgtactttagcctggctgaacatgaactttgtgtttacctggaagtggtaggggtgggagagattctcatctttagttctggtgcccaaaatctttggtagatggagggaactggggattcagaagatgtggtaaaggtctatttctgtagtgtggcagagatgtgtttttctaaagtgtttgcagggcatttttccctcttacctcagattaagttatttatatattgttgattgaaggttttttaaaattgcttttaaacttctatttctcgggtaaattttttggtgacatgatatatttaacaccctatttatatactcctacctcttttcatataaatctcttactaagactactgaccaaaaaagaacattttaaaattaaaagtcctctgtgtactttatctagtgaa

SEQ ID NO: 299602 - DNA, 7900 bp, Homo sapiens
  misc_feature (2440)..(2440): n is a, c, g, or t
gccaggggcacagtcctttcttactgtgaaactttactagaacccgaatgttcttcaagggttgctggcaggcctcagtgtaaacaaatagaccagtcatcatcagaccagaccaggaatgagggtgaagcaccgggatttcatgtggcatctctatctgctgaagcagggcagatagatctgttacctgatgagaggaaagtccaggccacatctctgtctgcagacagctttgaatctctgcccaatacggaaactgacagagagccatgggatcctgtgcaggctttctcccatgctgctcctgctcaagacaggaaacgtcgtactggagaactgaggcagttcgcgggagcaagtgaaccatttatatgtcactctagttcttctgaaatcatagagaaaaagaaagatgcaaccagaacaccttcctcagctgatcctttggccccagacagtcctcgttcttcagcacctgtggaggaggtcaggagggtagtatcaaagaaggtagtggctgccttaccttctcaggccccttatgatgatcctagagtgactctgcatgagctaagtcagtcagttccgcaggagactgcagagggcataccccctggcagtcaggacagcagcccagagcatcaggaacccagaactctagacaccacatatggagaagtttcagataatttgttagtgactgcacagggagaaaaaacagcccattttgaaagtcagtctgtgacctgtgatgttcagaattctacaagtgcctcagggcctaagcaagaccatgtccaatgccctgaggcttctactggctttgaagaaggtagggcaagtcccaaacaagataccattctgcctggagctctgacaagggttgcactggaagctcccacacagcagtgtgtgcagtgtaaggagagtgttgggtctgggttgacagaagtctgcagggctggcagcaaacattccaggccaattccactgccagatcaaagaccaagcgcaaatcctgggggaattggggaggaagccccatgtagacacccaagggaagctttagatggccctgtcttctcaaggaaccctgaaggcagcaggactctcagcccgtctagagggaaagagagcagaactcttccttgccgacagccatgcagttctcaacctgttgctactcatgcttattcctcccattcctctactttactgtgttttagagatggtgacctagggaaggagcctttcaaggctgccccacatactatccacccaccctgtgtagtaccttccagggcctatgaaatggatgagacaggagagatctctaggggacctgatgtgcacttgacacatggccttgagcccaaagatgttaacagggaatttaggctaacagagagcagcacttgtgagccttctactgtggctgctgtcctatctcgagctcaaggctgcagatccccttctgctcctgacgtgaggacaggttccttcagccactcagctactgatggaagcgtggggttaataggggttcctgagaaaaaggttgctgagaagcaagcaagcacagaacttgaggctgcctctttccctgcaggcatgtactctgagcccctgaggcagtttagggacagctctgtaggtgaccagaatgcacaggtgtgtcaaaccaatccagaaccacctgcaacaactcagggaccacacaccctggatttaagtgaagggtctgctgagagcaagttggtggtagagccacagcatgaatgtttagaaaataccactagatgttttttggaaaagccacaattttccactgagttgagggatcacaatcgcttggattcccaagccaagtttgtagcaaggttaaaacatacctgcagcccccaggaagacagtccctggcaggaagaagagcagcacagagaccaggcttcaggtggtggagaaggcttcgcccagggtgtgaatccccttcctgatgaagatggcttagatggctgtcagattttagatgctgggagagaggaggtggctgtggccaagcctcctgtgtccaagattttatcacagggcttcaaagacccagccactgtgtccttgaggcaaaatgaaacaccgcagcctgctgctcagaggagtggccacctctacactggcagagagcagccagcacccaaccacaggggctcacttcctgtgactacaatcttctctggccccaaacactccaggtcctcccccacaccacagttctcagttgtcggctcttctcgttctcttcaggagctgaacttgagtgtggagcctccttcccctacagacgaagatacacaggggcctaacagattgtggaacccacatctcaggggctattcctcaggaaagtcagtggcaagaacatctctgcaggctgaggacagcnatcagaaagcctcatctcgcttggatgatgggactaccgatcacaggcacctgaagcctgccacccctccttatccaatgccttccactctctcacacatgccaacccctgatttcacgaccagctggatgtctggtactttggaacaagcccaacagggaaagcgagagaaactgggtgtccaggttaggccagaaaattggtgctctcagatggacaaaggaatgctgcactttggctccagtgacatcagtccctatgcgctgccgtggcgtccggaggagcctgcacgtatcagctggaagcagtatatgtctggcagtgcagtcgatgtttcctgcagccagaagccccaggggctgacactatcaaatgtggcccggtgctccagcatggacaatggcctagaagaccagaactcccctttccactcccacctcagcacttacgccaatatttgtgatctgtcaaccacacacagcagcactgagaatgcccagggttcaaatgaggcctgggaagtattccgagggagttcttcaattgccttaggagacccccacatcccgacgagccctgaaggagtagcccccacttcgggtcatgacagaaggcctcagttcaggggcccttctggtgaagcagactgtctgaggagtaagccccccttggccaaaggaagtgctgcaggtccagtggatgagattatgctgctgtatccatcagaggcaggctgccctgtgggacagaccaggacgaacacattcgaacagggcacacagaccctcggcagcaggcgccactggagcagcactgacatctcctttgctcagcctgaagccagtgcagtatcagcctttgatctggcctcatggaccagcatgcacaatctgtctctccacctctcacagctcctgcacagtacctcagagctgcttgggagtctctcccagccagatgtggccagaagggagcagaacaccaagagggacatcccagataaagccccacaggccctgatgatggatggctctactcagaccactgtggatgagggcagccagactgacctcaccttacccaccctgtgcctccagacttcagaggctgaacctcagggagccaatgtgatccttgaagggctaggctcagatacctcgactgtgtctcaagaagagggagatgtgccaggggtacctcagaagagagaggcagaggaaacagcacagaaaatggctcagctcctctatcttcaggaagaaagcactccctacaagccccagagcccttcaataccctcatcccacttgaggtttcagaaagcccccgttgggcagcatcttccttctgtgagcccctcagtttctgatgctttcctgcctcccagctcccagccagaggagtcatattgcttagttgtcagcagtcccagtcccagctcccctcattccccagggctctttcccagtacttccgagtatcctggggactccagggtccagaagaagctgggccccacaagtgctttgttcgtggacagggcctcctccccaatcctcactcttagtgccagcacccaagagccgggtctttccccaggctctttgaccctctcagccccttcaactcaccctgttgaaggccaccagaagcttgactccagcccagaccctgttgatgccccaaggactccaatggataattattcccaaaccactgacgagttaggtggctcccagagaggtagaagttccttacaaaggagtaatgggagatccttccttgagttgcactccccacacagcccacagcagagtccaaaactccaatttagtttcttagggcagcaccctcagcagcttcagcccaggacaactatcggggtccaaagcagactgctgccaccaccactgaggcacaggagccaaaggctgggcaacagctttgtgcctgagaaggtggcttccccggagcattgcccactgagcggtagggagccaagtcagtggcagagcaggacagaaaatggaggtgagagttcagcatctccaggggaaccacaacgcactctggaccgaccttcttcatggggaggcctccagcacctcagcccctgccctgtctctgagttgactgatactgcagggctccgaggttctgccttgggcctccctcaggcctgccaacctgaggagttactgtgcttcagttgccagatgtgcatggcccctgagcaccagcaccacagtctgagggacctcccggtgcataacaaatttagtaactggtgtggggttcagaagggctcacctggggggttggacatgactgaggaggagctgggggccagcggtgatctcagctctgaaaagcaggaacagagtcccccacaacctcctaatgaccacagccaggattctgagtggtccaagagggagcagatccccctgcaagttggggcccagaacctctcactcagcgtggaactcacagaagcgaaactgcaccatggctttggggaggccgatgccctgctccaggtgctgcagagtgggacaggggaggcgcttgctgctgatgaacctgtgacatccacctggaaggagctctatgcacggcaaaaaaaggccattgagaccctcaggagagagcgggctgagcgacttgggaacttctgccggacgcgaagccttagccctcagaaacaactgagcctcctgcccaacaaagatctcttcatctgggatcttgacttgcccagcagacgccgagaatacctgcagcaactgaggaaggatgttgtggagaccaccaggagcccagagtcagtgtcaaggtcagctcacacaccctctgacatagagttgatgctgcaagactaccagcaggcccatgaggaggccaaggtggagattgcccgggcccgagaccaactgcgggagcggactgaacaagagaagctgagaatccaccagaagatcatttcccagctattgaaggaagaggataaactacataccttggccaattccagctccctgtgcaccagctctaatggaagcctctcgtctggcatgacctctggctataatagcagcccagccttgtcaggccagctccagttcccagagaatatggggcatacaaacttgcctgattccagggatgtatggataggggatgagcgaggaggccattctgcagtgaggaagaactctgcctacagccacagagcctccctgggcagttgctgctgttcaccatccagtctgtccagcttggggacctgcttttcctcctcctaccaggatttggccaagcatgtcgtggacacttctatggctgatgtaatggctgcttgttcggataatttgcacaacctcttcagctgccaggcaactgctggctggaactatcagggtgaggagcaggcggtgcagctttactacaaggtgttttctcccactcggcatggcttcctgggggcaggtgtggtgtcccagccgctgtctcgtgtgtgggcggctgtcagtgaccccactgtgtggcccctgtattacaagcccatccagacagcaaggctgcatcagcgagtgaccaacagcatcagcctggtgtacttggtgtgcaacaccaccctgtgcgcactgaagcagccacgggatttctgttgtgtctgcgtggaagccaaagagggtcacctgtctgtcatggcagcccagtctgtgtatgatacatccatgccaagacccagcagaaaaatggttcgcggggagatcctgcccagtgcctggatcttgcagcccatcactgtggaagggaaggaagtcaccagagtcatctacttggcccaggaggtgaacgccaatacttagatctggatggcagagcccaggggcctgtaaacaccaaaccacaatctgaggtggaacttggtgctccaggcttcccacctcagctcctgagctctttcatcaaacggcagccactggttatagccagactggcttccttccttggtaggtagcatctcaccgtcaagatggtgctgctgagatgcaggcccaggctgctcaagagagacactgtggcagctccttgttactttccataccacagtgcaggaaaagctgatgctacctgctgtggccgattggggcagacagcactggcccagggatgctagcaaagcccagtcagtacttggtcacagctggcaccagtgcagagcaaacggcctgagctcctggcccagactatccagagtgaatgcagctccgctcaccttttggatttctcacctttctttcctgtttctgggactctgcggcagacaggacacttaaggaccaggactgggcacagccagcagagccggggactgcagtgctttggcaaggtgcttccgcaggctggtagggaagcaggcagccactggccaagactctgctctgaatctacctcctctagcattcagctctactgtgtgatgggacgttaaaaataccaaaacagaaagagggtttaaaaaacagctgcacaaaccagaacaccgattcagaatcttttctccctcttgagtttttgcaaaatactttattattgatttttgctttttttctccctttccctcccaggagaagacatttgggtcttggcctgaggcaggggtgttgagcgatgatgctctgatatggagctgtcactctagagctcggtcagatggaagacactatagaaccaggttggacagatttggggtcagggttggaggctgagttcttttgaggactggttggagtggcagccagatggtggctgctgacaaggcaagaggaatttcagagattaaacattgtcctttgaggaagggagaggaggtgaatgaactcccagaggaggtgagtggcttgttgggaggaagctcagttccagaacttacctcagtgcacttgggaggggtggagtcctgagcattccatgatttctgccctggccccacctatcctaggatggggtgggatggagagtgggttcagttttcttgtactttagcctggctgaacatgaactttgtgtttacctggaagtggtaggggtgggagagattctcatctttagttctggtgcccaaaatctttggtagatggagggaactggggattcagaagatgtggtaaaggtctatttctgtagtgtggcagagatgtgtttttctaaagtgtttgcagggcatttttccctcttacctcagattaagttatttatatattgttgattgaaggttttttaaaattgcttttaaacttctatttctcgggtaaattttttggtgacatgatatatttaacaccctatttatatactcctacctcttttcatataaatctcttactaagactactgaccaaaaaagaacattttaaaattaaaagtcctctgtgtactttatctagtgaa

SEQ ID NO: 299603 - DNA, 2270 bp, Homo sapiens
  misc_feature (1)..(2): n is a, c, g, or t
  misc_feature (2072)..(2072): n is a, c, g, or t
  misc_feature (2239)..(2239): n is a, c, g, or t
  misc_feature (2270)..(2270): n is a, c, g, or t
nngggaagtggaggtgggagggagcgacaatggaaaaatcacctgaaaactgggacagaggaaggaagctacagttacgaaggagagctgcaaaagttgcagcagaaaggttgggagtcccgacaggttccgtagcccacagaaaagaagcaagggacggcaggactgtttcacacttttctgcttctggaaggtgctggacaaaaacatggaactaatttccccaacagtgattataatcctgggttgccttgctctgttcttactccttcagcggaagaatttgcgtagacccccgtgcatcaagggctggattccttggattggagttggatttgagtttgggaaagcccctctagaatttatagagaaagcaagaatcaaggtatgtggtcgtggcagacggggtctccagaggagacaatgctttcttttttaaactttctttcattgactcttaagtgcagggctagaacacggggaacatacctgcttgcctcaactaaaggatctagtcatttctgaattcctctactaacaattaacaacaatatcctgtgcaaaattttgcgaaagaaatgaaatacaattgcagcgtgcatcgacatttttggaagtagagattaacttttcgtatttttacttcatcgaagttaagttccaaatgtgtatgtgttaagtaaatgttttcagtaattgggaaagataaagtgtaatccaatttaagtttgtgaaaatgagtaattcgtatccaaattggagttaacaccaaagtattgtacaaattgcttgcacagttggtccgtacacaataaacaggctctgtatttttagctgacgttgttatttgatgatgatgtactccattttcactacggcctgaagagactagtaatcctccttgtagtagatgtttttgtcttgaaagtatcttttaaatgtctgagcactttaaggaacagacctttattaatgtcttttaagttttattcaatttccagtcacaaatattttatggtatttgattgtctaataaatttgtatgatattataattattcttatgaattataatactttctgtggtgacccattttccatctggttagcccaatttgtagaatgaatttatacgtagtagcattattttaccactgatcatttgccttcaaaatctctgagattccaatttagtaaaaaacatatagaaaattaaagagaactaagatgaaaataaaaataacccagaatatcacaccagctgtactgtaaaaatttagtgtatttatattattttggtcattttcctatgtatttacaactatttaatgaacaacaatggaataatagtataatactcttttatgtgcttttgattttaacatataatgtgaatgactttcctgtaccatgaaatactttgaatcttccttttatggctatattttgtcataggaggatacaatagtttacttaaatctcaatagttgggtttataggttgctgccaaacttttttctttcagccagtgcttcagtgaacattcttgcgtgtttgtgtgcatgtattgattgtgtggttgtacattttgcaattatctgattgtttactcagaataaattcctaggagtagaattgctgagtcaaaggacatgcacacttaaattgtttatatgaatgtgttacttttggaaaaagaagtatgaatatgcaatttttattttccattgactgtatgcaattgcctaacttctcaaatcctgggccatactgaataccataattctttgcaatttttgctagtctgatagatgaaacattatatctcctaaagaaatactcctttgtctcccacagccttccttatgcatatgatcttgataatttttaaggaactgtttttttacaagcttgtgtcagaaggctaaatatttgtgaggtctctattgctttcctgactaaacaaaacaagttattgctggactctgtgtctcacacctgtaatcccaacactttgggaggcaggggtgggaggattgcttgaggccaggaatttaagaccagcccgggagntatagcaagacctcatttctacaaaaactaaatagaaaaataaaaaatttaatctggtccagtggcacatgcctgtagtcccagctcctcgagaggctgaggcgggaggattgcttgagctcaggagttccagattccggtaagctatgattgagccactgcactcnagcctgggcaacagagcgagaccttgtctcn

SEQ ID NO: 299604 - DNA, 2178 bp, Homo sapiens
  misc_feature (1)..(2): n is a, c, g, or t
nngggaagtggaggtgggagggagcgacaatggaaaaatcacctgaaaactgggacagaggaaggaagctacagttacgaaggagagctgcaaaagttgcagcagaaaggttgggagtcccgacaggttccgtagcccacagaaaagaagcaagggacggcaggactgtttcacacttttctgcttctggaaggtgctggacaaaaacatggaactaatttccccaacagtgattataatcctgggttgccttgctctgttcttactccttcagcggaagaatttgcgtagacccccgtgcatcaagggctggattccttggattggagttggatttgagtttgggaaagcccctctagaatttatagagaaagcaagaatcaagtatggaccaatatttacagtctttgctatgggaaaccgaatgacctttgttactgaagaagaaggaattaatgtgtttctaaaatccaaaaaagtagattttgaactagcagtgcaaaatatcgtttatcgtacagcatcaattccaaagaatgtctttttagcactgcatgaaaaactctatattatgttgaaagggaaaatggggactgtcaatctccatcagtttactgggcaactgactgaagaattacatgaacaactggagaatttaggcactcatgggacaatggacctgaacaacttagtaagacatctcctttatccagtcacagtgaatatgctctttaataaaagtttgttttccacaaacaagaaaaaaatcaaggagttccatcagtattttcaagtttatgatgaagattttgagtatgggtcccagttgccagagtgtcttctaagaaactggtcaaaatccaaaaagtggttcctggaactgtttgagaaaaacattccagatataaaagcatgtaaatctgcaaaagataattccatgacattattgcaagctacgctggatattgtagagacggaaacaagtaaggaaaactcacccaattatgggctcttactgctttgggcttctctgtctaatgctgttcctgttgcattttggacacttgcatacgtcctttctcatcctgatatccacaaggccattatggaaggcatatcttctgtgtttggcaaagcaggcaaagataagattaaagtgtctgaggatgacctggagaatctccttctaattaaatggtgtgttttggaaaccattcgtttaaaagctcctggtgtcattactagaaaagtggtgaagcctgtggaaattttgaattacatcattccttctggtgacttgttgatgttgtctccattttggctgcatagaaatccaaagtattttcctgagcctgaattgttcaaacctgaacgttggaaaaaggcaaatttagagaagcactctttcttggactgcttcatggcatttggaagcgggaagttccagtgtcctgcaaggtggtttgctctgttagaggttcagatgtgtattattttaatactttataaatatgactgtagtcttctggacccattacccaaacagagttatctccatttggtgggtgtcccccagccggaagggcaatgccgaattgaatataaacaaagaatatgacatctgttgggcctcacaaggaccagggccttctggaggagtggcactaccccacctggcagcacctagacctgagctctacaaaaacacactgcttcactttgttttaggacttagttcaagaacacattcaaatggtgcatgtgtttggtatcttcaacagtagaccaagaatctaacatcactctcagtaatatagagaccggaatacatggtttataggaaatgatcaaatgatccaaaaaaactccacattttttaagaagttggaatttgatttcatgcataactgtattaaaacattaaatagaaataatgtcatttgaatgaaaatcttatcacattaaattcactgtgaagacagcatacttaaatttttattttgaaaagtctaaaaggcttagatttttaaaatttaataattatttctacaaattttctatttttcttgaggtgattctcaactagcaattggaactcctaggctctattaacataattctttattgtaaacgtatctaatgctaaaagtaataaaatggtagttttctgagacctgt

SEQ ID NO: 299605 - DNA, 2070 bp, Homo sapiens
  misc_feature (1)..(2): n is a, c, g, or t
nngggaagtggaggtgggagggagcgacaatggaaaaatcacctgaaaactgggacagaggaaggaagctacagttacgaaggagagctgcaaaagttgcagcagaaaggttgggagtcccgacaggttccgtagcccacagaaaagaagcaagggacggcaggactgtttcacacttttctgcttctggaaggtgctggacaaaaacatggaactaatttccccaacagtgattataatcctgggttgccttgctctgttcttactccttcagcggaagaatttgcgtagacccccgtgcatcaagggctggattccttggattggagttggatttgagtttgggaaagcccctctagaatttatagagaaagcaagaatcaagtatggaccaatatttacagtctttgctatgggaaaccgaatgacctttgttactgaagaagaaggaattaatgtgtttctaaaatccaaaaaagtagattttgaactagcagtgcaaaatatcgtttatcgtacagcatcaattccaaagaatgtctttttagcactgcatgaaaaactctatattatgttgaaagggaaaatggggactgtcaatctccatcagtttactgggcaactgactgaagaattacatgaacaactggagaatttaggcactcatgggacaatggacctgaacaacttagtaagacatctcctttatccagtcacagtgaatatgctctttaataaaagtttgttttccacaaacaagaaaaaaatcaaggagttccatcagtattttcaagtttatgatgaagattttgagtatgggtcccagttgccagagtgtcttctaagaaactggtcaaaatccaaaaagtggttcctggaactgtttgagaaaaacattccagatataaaagcatgtaaatctgcaaaagataattccatggttgcattttggacacttgcatacgtcctttctcatcctgatatccacaaggccattatggaaggcatatcttctgtgtttggcaaagcaggcaaagataagattaaagtgtctgaggatgacctggagaatctccttctaattaaatggtgtgttttggaaaccattcgtttaaaagctcctggtgtcattactagaaaagtggtgaagcctgtggaaattttgaattacatcattccttctggtgacttgttgatgttgtctccattttggctgcatagaaatccaaagtattttcctgagcctgaattgttcaaacctgaacgttggaaaaaggcaaatttagagaagcactctttcttggactgcttcatggcatttggaagcgggaagttccagtgtcctgcaaggtggtttgctctgttagaggttcagatgtgtattattttaatactttataaatatgactgtagtcttctggacccattacccaaacagagttatctccatttggtgggtgtcccccagccggaagggcaatgccgaattgaatataaacaaagaatatgacatctgttgggcctcacaaggaccagggccttctggaggagtggcactaccccacctggcagcacctagacctgagctctacaaaaacacactgcttcactttgttttaggacttagttcaagaacacattcaaatggtgcatgtgtttggtatcttcaacagtagaccaagaatctaacatcactctcagtaatatagagaccggaatacatggtttataggaaatgatcaaatgatccaaaaaaactccacattttttaagaagttggaatttgatttcatgcataactgtattaaaacattaaatagaaataatgtcatttgaatgaaaatcttatcacattaaattcactgtgaagacagcatacttaaatttttattttgaaaagtctaaaaggcttagatttttaaaatttaataattatttctacaaattttctatttttcttgaggtgattctcaactagcaattggaactcctaggctctattaacataattctttattgtaaacgtatctaatgctaaaagtaataaaatggtagttttctgagacctgt

SEQ ID NO: 299606 - DNA, 2168 bp, Homo sapiens
  misc_feature (1)..(2): n is a, c, g, or t
nngggaagtggaggtgggagggagcgacaatggaaaaatcacctgaaaactgggacagaggaaggaagctacagttacgaaggagagctgcaaaagttgcagcagaaaggttgggagtcccgacaggttccgtagcccacagaaaagaagcaagggacggcaggactgtttcacacttttctgcttctggaaggtgctggacaaaaacatggaactaatttccccaacagtgattataatcctgggttgccttgctctgttcttactccttcagcggaagaatttgcgtagacccccgtgcatcaagggctggattccttggattggagttggatttgagtttgggaaagcccctctagaatttatagagaaagcaagaatcaagtatggaccaatatttacagtctttgctatgggaaaccgaatgacctttgttactgaagaagaaggaattaatgtgtttctaaaatccaaaaaagtagattttgaactagcagtgcaaaatatcgtttatcgtacagcatcaattccaaagaatgtctttttagcactgcatgaaaaactctatattatgttgaaagggaaaatggggactgtcaatctccatcagtttactgggcaactgactgaagaattacatgaacaactggagaatttaggcactcatgggacaatggacctgaacaacttagtaagacatctcctttatccagtcacagtgaatatgctctttaataaaagtttgttttccacaaacaagaaaaaaatcaaggagttccatcagtattttcaagtttatgatgaagattttgagtatgggtcccagttgccagagtgtcttctaagaaactggtcaaaatccaaaaagtggttcctggaactgtttgagaaaaacattccagatataaaagcatgtaaatctgcaaaagataattccatggttgcattttggacacttgcatacgtcctttctcatcctgatatccacaaggccattatggaaggcatatcttctgtgtttggcaaagcaggcaaagataagattaaagtgtctgaggatgacctggagaatctccttctaattaaatggtgtgttttggaaaccattcgtttaaaagctcctggtgtcattactagaaaagtggtgaagcctgtggaaattttgaattacatcattccttctggtgacttgttgatgttgtctccattttggctgcatagaaatccaaagtattttcctgagcctgaattgttcaaacctgaacgttggaaaaaggcaaatttagagaagcactctttcttggactgcttcatggcatttggaagcgggaagttccagtgtcctgcaaggtggtttgctctgttagaggttcagatgtgtattattttaatactttataaatatgactgtagtcttctggacccattacccaaacagagttatctccatttggtgggtgtcccccagccggaagggcaatgccgaattgaatataaacaaagaatatgacatctgttgggcctcacaaggaccagggccttctggaggagtggcactaccccacctggcagcacctagacctgagctctacaaaaacacactgcttcactttgttttaggacttagttcaagaacacattcaaatggtgcatgtgtttggtatcttcaacagtagaccaagaatctaacatcactctcagtaatatagagaccggaatacatggtttataggaaatgatcaaatgatccaaaaaaactccacattttttaagaagttggaatttgatttcatgcataactgtattaaaacattaaatagaaataatgtcatttgaatgaaaatcttatcacattaaattcactgtgaagacagcatacttaaatttttattttgaaaagtctaaaaggcttagatttttaaaatttaataattatttctacaaattttctatttttcttgaggtgattctcaactagcaattggaactcctaggctctattaacataattctttattgtaaacgtatctaatgctaaaagtaataaaatggtagttttctgagacctgtgaggacaggaatggtgtcttacattcatttctacactttattatgctcaggattgcaccttctttacagagtatattcaataaatgtatgttgattga

SEQ ID NO: 299607 - DNA, 2300 bp, Homo sapiens
  misc_feature (1)..(2): n is a, c, g, or t
nngggaagtggaggtgggagggagcgacaatggaaaaatcacctgaaaactgggacagaggaaggaagctacagttacgaaggagagctgcaaaagttgcagcagaaaggttgggagtcccgacaggttccgtagcccacagaaaagaagcaagggacggcaggactgtttcacacttttctgcttctggaaggtgctggacaaaaacatggaactaatttccccaacagtgattataatcctgggttgccttgctctgttcttactccttcagcggaagaatttgcgtagacccccgtgcatcaagggctggattccttggattggagttggatttgagtttgggaaagcccctctagaatttatagagaaagcaagaatcaagtatggaccaatatttacagtctttgctatgggaaaccgaatgacctttgttactgaagaagaaggaattaatgtgtttctaaaatccaaaaaagtagattttgaactagcagtgcaaaatatcgtttatcgtacagcatcaattccaaagaatgtctttttagcactgcatgaaaaactctatattatgttgaaagggaaaatggggactgtcaatctccatcagtttactgggcaactgactgaagaattacatgaacaactggagaatttaggcactcatgggacaatggacctgaacaacttagtaagacatctcctttatccagtcacagtgaatatgctctttaataaaagtttgttttccacaaacaagaaaaaaatcaaggagttccatcagtattttcaagtttatgatgaagattttgagtatgggtcccagttgccagagtgtcttctaagaaactggtcaaaatccaaaaagtggttcctggaactgtttgagaaaaacattccagatataaaagcatgtaaatctgcaaaagataattccatggttgcattttggacacttgcatacgtcctttctcatcctgatatccacaaggccattatggaaggcatatcttctgtgtttggcaaagcaggcaaagataagattaaagtgtctgaggatgacctggagaatctccttctaattaaatggtgtgttttggaaaccattcgtttaaaagctcctggtgtcattactagaaaagtggtgaagcctgtggaaattttgaattacatcattccttctggtgacttgttgatgttgtctccattttggctgcatagaaatccaaagtattttcctgagcctgaattgttcaaacctgaacgttggaaaaaggcaaatttagagaagcactctttcttggactgcttcatggcatttggaagcgggaagttccagtgtcctgcaaggtggtttgctctgttagaggttcagatgtgtattattttaatactttataaatatgactgtagtcttctggacccattacccaaacagagttatctccatttggtgggtgtcccccagccggaagggcaatgccgaattgaatataaacaaagaatatgacatctgttgggcctcacaaggaccagggccttctggaggagtggcactaccccacctggcagcacctagacctgagctctacaaaaacacactgcttcactttgttttaggacttagttcaagaacacattcaaatggtgcatgtgtttggtatcttcaacagtagaccaagaatctaacatcactctcagtaatatagagaccggaatacatggtttataggaaatgatcaaatgatccaaaaaaactccacattttttaagaagttggaatttgatttcatgcataactgtattaaaacattaaatagaaataatgtcatttgaatgaaaatcttatcacattaaattcactgtgaagacagcatacttaaatttttattttgaaaagtctaaaaggcttagatttttaaaatttaataattatttctacaaattttctatttttcttgaggtgattctcaactagcaattggaactcctaggctctattaacataattctttattgtaaacgtatctaatgctaaaagtaataaaatggtagttttctgagacctgtgaggacaggaatggtgtcttacattcatttctacactttattatgctcaggattgcaccttctttacagagtatattcaataaatgtatgttgattgatgtattgatttatattttaattaacctggaagcattgttttgactcaaagtgtttgcaattatagtttggcagataccatatttttgctaatgcatagaaacacaaatataacggtatgccaagacaagtaa

SEQ ID NO: 299608 - DNA, 1806 bp, Homo sapiens
  misc_feature (1)..(2): n is a, c, g, or t
nngggaagtggaggtgggagggagcgacaatggaaaaatcacctgaaaactgggacagaggaaggaagctacagttacgaaggagagctgcaaaagttgcagcagaaaggttgggagtcccgacaggttccgtagcccacagaaaagaagcaagggacggcaggactgtttcacacttttctgcttctggaaggtgctggacaaaaacatggaactaatttccccaacagtgattataatcctgggttgccttgctctgttcttactccttcagcggaagaatttgcgtagacccccgtgcatcaagggctggattccttggattggagttggatttgagtttgggaaagcccctctagaatttatagagaaagcaagaatcaagtatggaccaatatttacagtctttgctatgggaaaccgaatgacctttgttactgaagaagaaggaattaatgtgtttctaaaatccaaaaaagtagattttgaactagcagtgcaaaatatcgtttatcgtacagcatcaattccaaagaatgtctttttagcactgcatgaaaaactctatattatgttgaaagggaaaatggggactgtcaatctccatcagtttactgggcaactgactgaagaattacatgaacaactggagaatttaggcactcatgggacaatggacctgaacaacttagtaagacatctcctttatccagtcacagtgaatatgctctttaataaaagtttgttttccacaaacaagaaaaaaatcaaggagttccatcagtattttcaagtttatgatgaagattttgagtatgggtcccagttgccagagtgtcttctaagaaactggtcaaaatccaaaaagtggttcctggaactgtttgagaaaaacattccagatataaaagcatgtaaatctgcaaaagataattccatggttgcattttggacacttgcatacgtcctttctcatcctgatatccacaaggccattatggaaggcatatcttctgtgtttggcaaagcaggcaaagataagattaaagtgtctgaggatgacctggagaatctccttctaattaaatggtgtgttttggaaaccattcgtttaaaagctcctggtgtcattactagaaaagtggtgaagcctgtggaaattttgaattacatcattccttctggtgacttgttgatgttgtctccattttggctgcatagaaatccaaagtattttcctgagcctgaattgttcaaacctgaacgttggaaaaaggcaaatttagagaagcactctttcttggactgcttcatggcatttggaagcgggaagttccagtgtcctgcaagaaaaacaaacaggaaagagcagcatgaacccccagacttcttcagaaattgtagcttgcaaagtgaagagtctcattatagcagacagtctcacattaaactatacgatttaaatggaggaataagacggagggttttcagtgtggaggaaaacttctttgagtgagcacctctgagagttgatgatcttagggatgtgcttgctatacctgtcccctggaacacacaccaaaaccaacaagcttgattttccttggttctaattcctgcaagaggatgcctgatttgctgtgtcattgtgcaaattgatatggcttaaactccagtgtaaaacaacagccctgatctttggcaagattaatctgcttataaaggcatgcttggataagaagagagtgtaataaaaggaaggctgcaatacttgagaagttaaaatgaagcatggattcctcagga

SEQ ID NO: 299609 - DNA, 1578 bp, Homo sapiens
  misc_feature (1)..(2): n is a, c, g, or t
nngggaagtggaggtgggagggagcgacaatggaaaaatcacctgaaaactgggacagaggaaggaagctacagttacgaaggagagctgcaaaagttgcagcagaaaggttgggagtcccgacaggttccgtagcccacagaaaagaagcaagggacggcaggactgtttcacacttttctgcttctggaaggtgctggacaaaaacatggaactaatttccccaacagtgattataatcctgggttgccttgctctgttcttactccttcagcggaagaatttgcgtagacccccgtgcatcaagggctggattccttggattggagttggatttgagtttgggaaagcccctctagaatttatagagaaagcaagaatcaagtatggaccaatatttacagtctttgctatgggaaaccgaatgacctttgttactgaagaagaaggaattaatgtgtttctaaaatccaaaaaagtagattttgaactagcagtgcaaaatatcgtttatcgtacagcatcaattccaaagaatgtctttttagcactgcatgaaaaactctatattatgttgaaagggaaaatggggactgtcaatctccatcagtttactgggcaactgactgaagaattacatgaacaactggagaatttaggcactcatgggacaatggacctgaacaacttagtaagacatctcctttatccagtcacagtgaatatgctctttaataaaagtttgttttccacaaacaagaaaaaaatcaaggagttccatcagtattttcaagtttatgatgaagattttgagtatgggtcccagttgccagagtgtcttctaagaaactggtcaaaatccaaaaagtggttcctggaactgtttgagaaaaacattccagatataaaagcatgtaaatctgcaaaagataattccatggttgcattttggacacttgcatacgtcctttctcatcctgatatccacaaggccattatggaaggcatatcttctgtgtttggcaaagcaggcaaagataagattaaagtgtctgaggatgacctggagaatctccttctaattaaatggtgtgttttggaaaccattcgtttaaaagctcctggtgtcattactagaaaagtggtgaagcctgtggaaattttgaattacatcattccttctggtgacttgttgatgttgtctccattttggctgcatagaaatccaaagtattttcctgagcctgaattgttcaaacctgaacgttggaaaaaggcaaatttagagaagcactctttcttggactgcttcatggcatttggaagcgggaagttccagtgtcctgcaagaaaaggtttttgaacatctcatctgtgccaggccctcttctaagcttcagagagcactgaggaagaccaacatggtccctgacttcatagaatttacaatctacattaaatatgtcacatttcttcattggggatgattctgtaggggaaatgtcagtacctgtttatgacaaaatctcactcaataaatgtagaaatccattaaatttttatatttaaaaaattgta

SEQ ID NO: 299610 - DNA, 209 bp, Homo sapiens
gtaagctttggtttggttttaaatgaatcaaccttctacaaaaaaagtacacattttgcccacatatatttttcaggttgacatatcttgatttatttttacttgacaaataaatattttatatatttgtcttgtacaacatgtggttttgaaatatgtatacattatggaatggctaaatcaaactaattaaaatatgcatcacttca

SEQ ID NO: 299611 - DNA, 4501 bp, Homo sapiens
cacgctcagagcagaccgctagcaggaggcaggatgtgatagtctaagaccctggaagctgacggccagagggagggaagggtggtcacagaggagaggcaaagcaacgggaggtggaggatcctggaggtgtctgcaaggagaatacacagcagcgaggggctgcagaagcggacccagcgacttctgcgctgacgcggggcgggcgggagagaggaagagaggggagcgcggtggcgctgcgagctggccccgccggggaaggggctgccatgtcccgtgagcggcccccgggcaccgacattccccgcaacctgagcttcatcgccgcgctaacggagcgcgcctactaccgtagccagcggcccagcctcgaggaggagccggaggaggagccaggcgagggcgggacgcggttcggggcccgatcccgcgctcacgcaccgagtcggggccgccgggcccgatctgcaccagccggaggcggcggggcccgggcgccccgcagccgtagcccagacacccgcaagagagtgcgtttcgccgacgcactggggttggagctggctgtcgtgcgccgcttccgtcccggtgagctgccccgggtgccccgccacgtgcagatccaattgcagagggacgccctccgccacttcgcgccctgccagccccgcgcccgcggcctccaggaggcgcgcgccgccctggagccggccagcgagcccggcttcgccgcccgcttgctgacgcagcgcatctgcctggaacgcgccgaggcgggcccgctgggcgtggccgggagcgcgcgcgtggtggacctggcctacgagaagcgcgtgagcgtgcgctggagcgccgacggctggcggagccaacgcgaggcgccagccgcctacgccggtccggccccgcccccgccgcgcgccgaccgcttcgccttccgcctgcccgcgccgccgattgggggcgccctgctcttcgccttgcgctaccgtgtgacaggtcacgagttctgggacaacaacggcggccgtgactatgctctacgtgggcccgagcacccgggcagtggcggagctccggagccgcagggctggatccactttatctgagacgaggcgcctgcggccgacggcggaaaacaccaaaggcacccgggggcggggcgacccgatgtggcggggaggagtaggagagaccaggattggcgggagcggtccaagggagtcaagccggggagggcgaaaagggaacctggccactgctccttggtccttggcattatgacgggattcccttgtcacctctgacagttcctggctgcggtgtccgcggactggctggggagtgatgacagaagggatggaaaccctattttcttttctccaagaccatggttggtctgcttccctcactcgggctccttgacagtcttctagaagagagaaggaggaaaagaagcagttcctgatgttacaaatgaacaaggatctcccagccttagtctttgagaaaagatggctgaaagagaggaactctccaagtcattccgcaaacaaatgcccatttaaacatcatccttgtcttgtgaagaaaacaggaagaatgtcatgtaccatgtggatcaccttcagttcaaagttgcagcaaagtgaagaaagaaactactggaagccacccagcaatgcactgtttagtcatcaattaggagcccatgggaggataatagggagactgggtggaggctcagtgtgtaataatctcttgtctaatgtatgtgtgtcactgccatgttgtatgaacaatagtgagggctcacatttacttaacacttgtgtgcgcaaatctgggtttttcttcctttccagaactatgactcgatcataaaatctgttttgtttgcatgcatgcccaaaacaaccctgtaagtagaacattgtcattatctctgttttagagatgaggaaacaggctcagagaagctcagaaatttgttcaagatcgcacagctagtaaatggcagaagtaggattgtgaacccagggaatctccagagcctctgtgtaaccatgatgttatattttttttcctctttaaaaacaaaatttaaaaccttgctataatctcttattaggaaatgatcatagtttctgactgtgctctgccttcccatcctgccaatctcctggactggcttggagaagacagggggcccccgagcttcatctgtgactcgaaggagtttgctgctgtctcctgtgtcagtgtcccatctatgcaggatcagcacaggacccccctcaccttcccacttacactctagcctttccatacattggaattctctcctggccctagccagcgctccacacctgttggtgtgccacctccctccctcttcccccactggccttgaacaggcaaaccccctaatgtcgccactaggttgggtccgtgactaggacacctgctagagggtctgtgcttgggccttttctaggaatcccgatgttactgggtaagtgccaactctgtgggcagaatgctaatgataatcctgttccctgacctctttctcagaagtaccctggctcactctccccaatctcagctttatagaacaacattttggtcttgattattcccatatcaagctgccccagggcttcggtaagctgttagttgccccactgcctcaaggctgggtctggctgagctacttcttaggcacacaaatagtgggtgtctccttggaacctgacacaaaactatcagtgctaccaagccttgtaaaatagggaggaaactaatatttcttgagtggcttctgagtgcctggtgctttcgcggctctctggagagattccttgccctgatggctttggtgtgtactcctctcccaggacttcagcactgagattttcccaaccccctggcttttcctcaccttgggttgagttgatccggcactaccacaaaccccaccatctgcaaaccaaccaagattaggcagtatgccctttccgtcttgcactgctcttccaaaacttccatctgtatttctcacaccctcagtaagcaaagctgagtgtgcatggacagagctgcatccactgctttctcccagcgggtgcagtctaatctgacacggggaacactaggagtttagcggaatcttcagccaccctattaatgtgttacgcattaggcattgtagtggaaactcctctgatggctcatgactatatgaacaggagcaatttggaatataacatgtcagctgtggactgggaagtgccgtgagagaaaacactacctgggtcataggcttgggtccctgaggcaacccagcagggacactgttgcccattcctctcatccagactgcaggtgtcttcctacacctccctgtcccatagcctccgtcctgttttttgtttgtttgtttttctttgtgaatgtagaaaaacatttcatcatgagccctagctcctcagttttccacctaacacccacattcccttgtttctaactgccgtgtttttctggagcctgctgggatctttgcagtttgcaggtcatagaatcagacatgaaaaggcttctcttccgacgtcattggttcctggctcctttacagatgagaacacaggtccagaggtgagaaatgactctagcagggtcatagaatttgttagtgcagctcaagatgggacttaaactcaggcctcctgatcacccattcccaggctaggaaacaggtctctgctcggtgtggtggttcatacctgtaatcgcaacactttgggaggctgaggcaggagcattgcttgagcccaggagttcgagaccagtctgagcaacatagtgggaccctgtctctacaaaaacttttaaaattagctgggcatggtggcacacatctgtattcccagctactcaggaagctgagacaggaggatcgcttgagcccaggagttggaggttactgagctatgatcgcaccactgcactccagcttggtgacagtgagaccctcaaaaaaaaaaagaaaagaaagaggtctctacacaagcccgtgattcttcatggcaagggataacatcagaaatgtttcattttctgctattagtttccattcctttccccatccaggcataaagagaaacaaaagacaatgatggtattctctgtgtcctcagctttggcacttttgttgatgttgctaaggagcagtgaccttgctaaaaagactgaataatccacccactgaatagctaacctggggaggaaatgaaaatttcctttgtggatctccccaaatccattgttgtcaccaggccctcccagaacctcctcagttccttcacagtgcaaccctgtgtacttggcccgcaacccaatagtattgtgcctcacttcaccttccatgggcaactgccctcccttctggacataaaacctcatattttaaataaagttgaaatatgaaaagaaagta

SEQ ID NO: 299612 - DNA, 921 bp, Homo sapiens
aacttgaatagtaaatggcaccagaagatggcagtctgctccataaccagagcaagtgcagtgggaaagctggactctcatacccactcacattcatgccttatataagcctctcctcctggttaaccttaacaggggagtgattcctctgctggttgctgtttttccttttctcttaccctattcctaacctctttgcttctctctttctttccttgtgtctcttccttctcttttctttttttttttaacatatagggtatttttttcttttaacatatagggtatttaccttcattttgtttatttccatttgtttccttcttcattcatgttcatctctgctattccttctccctccagaagggatggaaaccctattttcttttctccaagaccatggttggtctgcttccctcactcgggctccttgacagtcttctagaagagagaaggaggaaaagaagcagttcctgatgttacaaatgaacaaggatctcccaggtaaccagctccccacacccatttctgttactaatttctcaaacagaaatttctggttccccttcttccttatcactgagtgaaaggggacaggcatgcacatgtgcccatacatgcattcagaatagagtgtgggggcaggggcggtagttcattcctgtaatcccagcactttgggaggctgagttaggtggatcatttgaggtcaggagttcaagactagcctggccacatactgaaccctgtctctactaaaaatacaaaaattagccgggcatggtgattcatgcctgtagtcccagctactcatgaggctgaggcaggagaatcactttaacggggagacagaggttgcagtgagctgagattgcaccactgcactccagcctgggtgacagagtgagactccgtctcaaa

SEQ ID NO: 299613 - DNA, 751 bp, Homo sapiens
  misc_feature (704)..(704): n is a, c, g, or t
  misc_feature (709)..(709): n is a, c, g, or t
  misc_feature (731)..(731): n is a, c, g, or t
aacttgaatagtaaatggcaccagaagatggcagtctgctccataaccagagcaagtgcagtgggaaagctggactctcatacccactcacattcatgccttatataagcctctcctcctggttaaccttaacaggggagtgattcctctgctggttgctgtttttccttttctcttaccctattcctaacctttttttttttaacatatagggtatttttttcttttaacatatagggtatttaccttcattttgtttatttccatttgtttccttcttcattcatgttcatctctgctattccttctccctccagaagggatggaaaccctattttcttttctccaagaccatggttggtctgcttccctcactcgggctccttgacagtcttctagaagagagaaggaggaaaagaagcagttcctgatgttacaaatgaacaaggatctcccaggtaaccagctccccacacccatttctgttactaatttctcaaacagaaatttctggttccccttcttccttatcactgagtgaaaggggacaggcatgcacatgtgcccatacatgcattcagaatagagtgtgggggcaggggcggtagttcattcctgtaatcccagcactttgggaggctgagttaggtggatcatttgaggtcaggagttcaagactagcctggccacatactgaaccctgntttanttccacgggaataacttcgggngacacaggtgccatgaggtt

SEQ ID NO: 299614 - DNA, 752 bp, Homo sapiens
aacttgaatagtaaatggcaccagaagatggcagtctgctccataaccagagcaagtgcagtgggaaagctggactctcatacccactcacattcatgccttatataagcctctcctcctggttaaccttaacaggggagtgattcctctgctggttgctgtttttccttttctcttaccctattcctaacctttttttttttaacatatagggtatttttttcttttaacatatagggtatttaccttcattttgtttatttccatttgtttccttcttcattcatgttcatctctgctattccttctccctccagaagggatggaaaccctattttcttttctccaagaccatggttggtctgcttccctcactcgggctccttgacagtcttctagaagagagaaggaggaaaagaagcagttcctgatgttacaaatgaacaaggatctcccaggtaaccagctccccacacccatttctgttactaatttctcaaacagaaatttctggttccccttcttccttatcactgagtgaaaggggacaggcatgcacatgtgcccatacatgcattcagaatagagtgtgggggcaggggcggtagttcattcctgtaatcccagcactttgggaggctgagttaggtggatcatttgaggtcaggagttcaagactagcctggccacatactgaaccccctgttttactactggggagggaatcaacttcgggagaccgggtgcgtggg

SEQ ID NO: 299615 - DNA, 887 bp, Homo sapiens
aacttgaatagtaaatggcaccagaagatggcagtctgctccataaccagagcaagtgcagtgggaaagctggactctcatacccactcacattcatgccttatataagcctctcctcctggttaaccttaacaggggagtgattcctctgctggttgctgtttttccttttctcttaccctattcctaacctctttgcttctctctttctttccttgtgtctcttccttctcttttctttttttttttaacatatagggtatttttttcttttaacatatagggtatttaccttcattttgtttatttccatttgtttccttcttcattcatgttcatctctgctattccttctccctccagaagggatggaaaccctattttcttttctccaagaccatggttggtctgcttccctcactcgggctccttgacagtcttctagaagagagaaggaggaaaagaagcagttcctgatgttacaaatgaacaaggatctcccaggtaaccagctccccacacccatttctgttactaatttctcaaacagaaatttctggttccccttcttccttatcactgagtgaaaggggacaggcatgcacatgtgcccatacatgcattcagaatagagtgtgggggcaggggcggtagttcattcctgtaatcccagcactttgggaggcgggtcggtgatctagaagtccgagtcagactagcggccaactctgaaacggtgctctctagcggaagggatcagcgtagcccaccgagcggcggacccacggacaggtccgcaattccaacgccgggaggtcccaacacaaggcaccaggaatcagcccagactacggagcgagagcgcacagcaggacagccacgcgctc

SEQ ID NO: 299616 - DNA, 359 bp, Homo sapiens
atgcgggtgatctagaggatcccattaggcgtattctctgtgtcctcagctttggcacttttgttgatgttgctaaggagcagtgaccttgctaaaaagactgaataatccacccactgaatagctaacctggggaggaaatgaaaatttcctttgtggatctccccaaatccattgttgtcaccaggccctcccagaacctcctcagttccttcacagtgcaaccctgtgtacgcagaacgcgcctaatattaggcgcgttctgcgtggggcccatgggtgagacactccagtactgagacctagagtccagatgcttgtaggagccaagtcgtgttctaagtatttatttaaaacaa

SEQ ID NO: 299617 - DNA, 530 bp, Homo sapiens
aacttgaatagtaaatggcaccagaagatggcagtctgctccataaccagagcaagtgcagtgggaaagctggactctcatacccactcacattcatgccttatataagcctctcctcctggttaaccttaacaggggagtgattcctctgctggttgctgtttttccttttctcttaccctattcctaacctctttgcttctctctttctttccttgtgtctcttccttctcttttctttttttttttaacatatagggtatttttttcttttaacatatagggtatttaccttcattttgtttatttccatttgtttccttcttcattcatgttcatctctgctattccttctccctccagaagggatggaaaccctattttcttttctccaagaccatggttggtctgcttccctcactcgggctccttgacagtcttctagaagagagaaggagacaccattttgtactaattttcaacagttttggtccctttttcttatactgggggggacaggctgcccttgt

SEQ ID NO: 299618 - DNA, 5585 bp, Homo sapiens
cacgctcagagcagaccgctagcaggaggcaggatgtgatagtctaagaccctggaagctgacggccagagggagggaagggtggtcacagaggagaggcaaagcaacgggaggtggaggatcctggaggtgtctgcaaggagaatacacagcagcgaggggctgcagaagcggacccagcgacttctgcgctgacgcggggcgggcgggagagaggaagagaggggagcgcggtggcgctgcgagctggccccgccggggaaggggctgccatgtcccgtgagcggcccccgggcaccgacattccccgcaacctgagcttcatcgccgcgctaacggagcgcgcctactaccgtagccagcggcccagcctcgaggaggagccggaggaggagccaggcgagggcgggacgcggttcggggcccgatcccgcgctcacgcaccgagtcggggccgccgggcccgatctgcaccagccggaggcggcggggcccgggcgccccgcagccgtagcccagacacccgcaagagagtgcgtttcgccgacgcactggggttggagctggctgtcgtgcgccgcttccgtcccggtgagctgccccgggtgccccgccacgtgcagatccaattgcagagggacgccctccgccacttcgcgccctgccagccccgcgcccgcggcctccaggaggcgcgcgccgccctggagccggccagcgagcccggcttcgccgcccgcttgctgacgcagcgcatctgcctggaacgcgccgaggcgggcccgctgggcgtggccgggagcgcgcgcgtggtggacctggcctacgagaagcgcgtgagcgtgcgctggagcgccgacggctggcggagccaacgcgaggcgccagccgcctacgccggtccggccccgcccccgccgcgcgccgaccgcttcgccttccgcctgcccgcgccgccgattgggggcgccctgctcttcgccttgcgctaccgtgtgacaggtcacgagttctgggacaacaacggcggccgtgactatgctctacgtgggcccgagcacccgggcagtggcggagctccggagccgcagggctggatccactttatctgagacgaggcgcctgcggccgacggcggaaaacaccaaaggcacccgggggcggggcgacccgatgtggcggggaggagtaggagagaccaggattggcgggagcggtccaagggagtcaagccggggagggcgaaaagggtggggaaatcaggggcgtgggggcgtgggggcgtgggggcggggggagtgagcggaaccaaagaagctccgggagatccgggtgttaaaagctggttggatgtgagtggaaggaactcagaatataggaggaaggagacccgaaacggcaccggagggattataaaaaaaggaaaagaatggggatgatggtggccttcccttcagtgagtgggctctgggagaaagggaggaggtccatcaggcctaggcggttgaagaaggttaagaaccttttggagatggaggaggtatgatgtgaagtagcccacccagtcgaaggcatttacattgctggcgcattccctcttcttaccggccttttccacctcagatccccctgtcctacccatcctagctttaactcagccataattgccttgcttaatcccaggaacctggccactgctccttggtccttggcattatgacgggattcccttgtcacctctgacagttcctggctgcggtgtccgcggactggctggggagtgatgacaggtagctatcagagctccagcctccaggcagctttagggattaaaacggaggccaaagcaactccagacctgtttttatagccaaatactgagcctcaggggttgtacactcaggggcttccaggaaaatgccagccttacttttctggggtgccttttaataacctccaagcactttgtggactgtttgtcgagggacggtgaatcagaagaatcactattctgatttcctttgtctccgaagaggaagtccctgactagctatataactttgggcgagttacctctcacttctttgtgccccagtgttctccttgggaaactggatttaggttagatgaccttttaaggctccttgtatgatattttgtgatctgtacatggcagagtatagattaggagccaaattttccaacctagtgctatggttcagaatacatagcaccccaagcgtctggctggagccgaggatgggtcctccagtttttggcacagatgttccggagcccaggaagcatcccataaccaaccttcagccccaccgccacccccagcgtattccagagccgcttccaaaccacagcctatcctctgctccatttcactcttgccctcacagactttcagcctccatgctctgagacaactgtggaagggatggaaaccctattttcttttctccaagaccatggttggtctgcttccctcactcgggctccttgacagtcttctagaagagagaaggaggaaaagaagcagttcctgatgttacaaatgaacaaggatctcccagccttagtctttgagaaaagatggctgaaagagaggaactctccaagtcattccgcaaacaaatgcccatttaaacatcatccttgtcttgtgaagaaaacaggaagaatgtcatgtaccatgtggatcaccttcagttcaaagttgcagcaaagtgaagaaagaaactactggaagccacccagcaatgcactgtttagtcatcaattaggagcccatgggaggataatagggagactgggtggaggctcagtgtgtaataatctcttgtctaatgtatgtgtgtcactgccatgttgtatgaacaatagtgagggctcacatttacttaacacttgtgtgcgcaaatctgggtttttcttcctttccagaactatgactcgatcataaaatctgttttgtttgcatgcatgcccaaaacaaccctgtaagtagaacattgtcattatctctgttttagagatgaggaaacaggctcagagaagctcagaaatttgttcaagatcgcacagctagtaaatggcagaagtaggattgtgaacccagggaatctccagagcctctgtgtaaccatgatgttatattttttttcctctttaaaaacaaaatttaaaaccttgctataatctcttattaggaaatgatcatagtttctgactgtgctctgccttcccatcctgccaatctcctggactggcttggagaagacagggggcccccgagcttcatctgtgactcgaaggagtttgctgctgtctcctgtgtcagtgtcccatctatgcaggatcagcacaggacccccctcaccttcccacttacactctagcctttccatacattggaattctctcctggccctagccagcgctccacacctgttggtgtgccacctccctccctcttcccccactggccttgaacaggcaaaccccctaatgtcgccactaggttgggtccgtgactaggacacctgctagagggtctgtgcttgggccttttctaggaatcccgatgttactgggtaagtgccaactctgtgggcagaatgctaatgataatcctgttccctgacctctttctcagaagtaccctggctcactctccccaatctcagctttatagaacaacattttggtcttgattattcccatatcaagctgccccagggcttcggtaagctgttagttgccccactgcctcaaggctgggtctggctgagctacttcttaggcacacaaatagtgggtgtctccttggaacctgacacaaaactatcagtgctaccaagccttgtaaaatagggaggaaactaatatttcttgagtggcttctgagtgcctggtgctttcgcggctctctggagagattccttgccctgatggctttggtgtgtactcctctcccaggacttcagcactgagattttcccaaccccctggcttttcctcaccttgggttgagttgatccggcactaccacaaaccccaccatctgcaaaccaaccaagattaggcagtatgccctttccgtcttgcactgctcttccaaaacttccatctgtatttctcacaccctcagtaagcaaagctgagtgtgcatggacagagctgcatccactgctttctcccagcgggtgcagtctaatctgacacggggaacactaggagtttagcggaatcttcagccaccctattaatgtgttacgcattaggcattgtagtggaaactcctctgatggctcatgactatatgaacaggagcaatttggaatataacatgtcagctgtggactgggaagtgccgtgagagaaaacactacctgggtcataggcttgggtccctgaggcaacccagcagggacactgttgcccattcctctcatccagactgcaggtgtcttcctacacctccctgtcccatagcctccgtcctgttttttgtttgtttgtttttctttgtgaatgtagaaaaacatttcatcatgagccctagctcctcagttttccacctaacacccacattcccttgtttctaactgccgtgtttttctggagcctgctgggatctttgcagtttgcaggtcatagaatcagacatgaaaaggcttctcttccgacgtcattggttcctggctcctttacagatgagaacacaggtccagaggtgagaaatgactctagcagggtcatagaatttgttagtgcagctcaagatgggacttaaactcaggcctcctgatcacccattcccaggctaggaaacaggtctctgctcggtgtggtggttcatacctgtaatcgcaacactttgggaggctgaggcaggagcattgcttgagcccaggagttcgagaccagtctgagcaacatagtgggaccctgtctctacaaaaacttttaaaattagctgggcatggtggcacacatctgtattcccagctactcaggaagctgagacaggaggatcgcttgagcccaggagttggaggttactgagctatgatcgcaccactgcactccagcttggtgacagtgagaccctcaaaaaaaaaaagaaaagaaagaggtctctacacaagcccgtgattcttcatggcaagggataacatcagaaatgtttcattttctgctattagtttccattcctttccccatccaggcataaagagaaacaaaagacaatgatggtattctctgtgtcctcagctttggcacttttgttgatgttgctaaggagcagtgaccttgctaaaaagactgaataatccacccactgaatagctaacctggggaggaaatgaaaatttcctttgtggatctccccaaatccattgttgtcaccaggccctcccagaacctcctcagttccttcacagtgcaaccctgtgtacttggcccgcaacccaatagtattgtgcctcacttcaccttccatgggcaactgccctcccttctggacataaaacctcatattttaaataaagttgaaatatgaaaagaaagta

SEQ ID NO: 299619 - DNA, 5490 bp, Homo sapiens
cacgctcagagcagaccgctagcaggaggcaggatgtgatagtctaagaccctggaagctgacggccagagggagggaagggtggtcacagaggagaggcaaagcaacgggaggtggaggatcctggaggtgtctgcaaggagaatacacagcagcgaggggctgcagaagcggacccagcgacttctgcgctgacgcggggcgggcgggagagaggaagagaggggagcgcggtggcgctgcgagctggccccgccggggaaggggctgccatgtcccgtgagcggcccccgggcaccgacattccccgcaacctgagcttcatcgccgcgctaacggagcgcgcctactaccgtagccagcggcccagcctcgaggaggagccggaggaggagccaggcgagggcgggacgcggttcggggcccgatcccgcgctcacgcaccgagtcggggccgccgggcccgatctgcaccagccggaggcggcggggcccgggcgccccgcagccgtagcccagacacccgcaagagagtgcgtttcgccgacgcactggggttggagctggctgtcgtgcgccgcttccgtcccggtgagctgccccgggtgccccgccacgtgcagatccaattgcagagggacgccctccgccacttcgcgccctgccagccccgcgcccgcggcctccaggaggcgcgcgccgccctggagccggccagcgagcccggcttcgccgcccgcttgctgacgcagcgcatctgcctggaacgcgccgaggcgggcccgctgggcgtggccgggagcgcgcgcgtggtggacctggcctacgagaagcgcgtgagcgtgcgctggagcgccgacggctggcggagccaacgcgaggcgccagccgcctacgccggtccggccccgcccccgccgcgcgccgaccgcttcgccttccgcctgcccgcgccgccgattgggggcgccctgctcttcgccttgcgctaccgtgtgacaggtcacgagttctgggacaacaacggcggccgtgactatgctctacgtgggcccgagcacccgggcagtggcggagctccggagccgcagggctggatccactttatctgagacgaggcgcctgcggccgacggcggaaaacaccaaaggcacccgggggcggggcgacccgatgtggcggggaggagtaggagagaccaggattggcgggagcggtccaagggagtcaagccggggagggcgaaaagggtggggaaatcaggggcgtgggggcgtgggggcgtgggggcggggggagtgagcggaaccaaagaagctccgggagatccgggtgttaaaagctggttggatgtgagtggaaggaactcagaatataggaggaaggagacccgaaacggcaccggagggattataaaaaaaggaaaagaatggggatgatggtggccttcccttcagtgagtgggctctgggagaaagggaggaggtccatcaggcctaggcggttgaagaaggttaagaaccttttggagatggaggaggtatgatgtgaagtagcccacccagtcgaaggcatttacattgctggcgcattccctcttcttaccggccttttccacctcagatccccctgtcctacccatcctagctttaactcagccataattgccttgcttaatcccaggaacctggccactgctccttggtccttggcattatgacgggattcccttgtcacctctgacagttcctggctgcggtgtccgcggactggctggggagtgatgacaggtagctatcagagctccagcctccaggcagctttagggattaaaacggaggccaaagcaactccagacctgtttttatagccaaatactgagcctcaggggttgtacactcaggggcttccaggaaaatgccagccttacttttctggggtgccttttaataacctccaagcactttgtggactgtttgtcgagggacggtgaatcagaagaatcactattctgatttcctttgtctccgaagaggaagtccctgactagctatataactttgggcgagttacctctcacttctttgtgccccagtgttctccttgggaaactggatttaggttagatgaccttttaaggctccttgtatgatattttgtgatctgtacatggcagagtatagattaggagccaaattttccaacctagtgctatggttcagaatacatagcaccccaagcgtctggctggagccgaggatgggtcctccagtttttggcacagatgttccggagcccaggaagcatcccataaccaaccttcagccccaccgccacccccagcgtattccagagccgcttccaaaccacagcctatcctctgctccatttcactcttgccctcacagactttcagcctccatgctctgagacaactgtggaagggatggaaaccctattttcttttctccaagaccatggttggtctgcttccctcactcgggctccttgacagtcttctagaagagagaaggaggaaaagaagcagttcctgatgttacaaatgaacaaggatctcccagaaaacaggaagaatgtcatgtaccatgtggatcaccttcagttcaaagttgcagcaaagtgaagaaagaaactactggaagccacccagcaatgcactgtttagtcatcaattaggagcccatgggaggataatagggagactgggtggaggctcagtgtgtaataatctcttgtctaatgtatgtgtgtcactgccatgttgtatgaacaatagtgagggctcacatttacttaacacttgtgtgcgcaaatctgggtttttcttcctttccagaactatgactcgatcataaaatctgttttgtttgcatgcatgcccaaaacaaccctgtaagtagaacattgtcattatctctgttttagagatgaggaaacaggctcagagaagctcagaaatttgttcaagatcgcacagctagtaaatggcagaagtaggattgtgaacccagggaatctccagagcctctgtgtaaccatgatgttatattttttttcctctttaaaaacaaaatttaaaaccttgctataatctcttattaggaaatgatcatagtttctgactgtgctctgccttcccatcctgccaatctcctggactggcttggagaagacagggggcccccgagcttcatctgtgactcgaaggagtttgctgctgtctcctgtgtcagtgtcccatctatgcaggatcagcacaggacccccctcaccttcccacttacactctagcctttccatacattggaattctctcctggccctagccagcgctccacacctgttggtgtgccacctccctccctcttcccccactggccttgaacaggcaaaccccctaatgtcgccactaggttgggtccgtgactaggacacctgctagagggtctgtgcttgggccttttctaggaatcccgatgttactgggtaagtgccaactctgtgggcagaatgctaatgataatcctgttccctgacctctttctcagaagtaccctggctcactctccccaatctcagctttatagaacaacattttggtcttgattattcccatatcaagctgccccagggcttcggtaagctgttagttgccccactgcctcaaggctgggtctggctgagctacttcttaggcacacaaatagtgggtgtctccttggaacctgacacaaaactatcagtgctaccaagccttgtaaaatagggaggaaactaatatttcttgagtggcttctgagtgcctggtgctttcgcggctctctggagagattccttgccctgatggctttggtgtgtactcctctcccaggacttcagcactgagattttcccaaccccctggcttttcctcaccttgggttgagttgatccggcactaccacaaaccccaccatctgcaaaccaaccaagattaggcagtatgccctttccgtcttgcactgctcttccaaaacttccatctgtatttctcacaccctcagtaagcaaagctgagtgtgcatggacagagctgcatccactgctttctcccagcgggtgcagtctaatctgacacggggaacactaggagtttagcggaatcttcagccaccctattaatgtgttacgcattaggcattgtagtggaaactcctctgatggctcatgactatatgaacaggagcaatttggaatataacatgtcagctgtggactgggaagtgccgtgagagaaaacactacctgggtcataggcttgggtccctgaggcaacccagcagggacactgttgcccattcctctcatccagactgcaggtgtcttcctacacctccctgtcccatagcctccgtcctgttttttgtttgtttgtttttctttgtgaatgtagaaaaacatttcatcatgagccctagctcctcagttttccacctaacacccacattcccttgtttctaactgccgtgtttttctggagcctgctgggatctttgcagtttgcaggtcatagaatcagacatgaaaaggcttctcttccgacgtcattggttcctggctcctttacagatgagaacacaggtccagaggtgagaaatgactctagcagggtcatagaatttgttagtgcagctcaagatgggacttaaactcaggcctcctgatcacccattcccaggctaggaaacaggtctctgctcggtgtggtggttcatacctgtaatcgcaacactttgggaggctgaggcaggagcattgcttgagcccaggagttcgagaccagtctgagcaacatagtgggaccctgtctctacaaaaacttttaaaattagctgggcatggtggcacacatctgtattcccagctactcaggaagctgagacaggaggatcgcttgagcccaggagttggaggttactgagctatgatcgcaccactgcactccagcttggtgacagtgagaccctcaaaaaaaaaaagaaaagaaagaggtctctacacaagcccgtgattcttcatggcaagggataacatcagaaatgtttcattttctgctattagtttccattcctttccccatccaggcataaagagaaacaaaagacaatgatggtattctctgtgtcctcagctttggcacttttgttgatgttgctaaggagcagtgaccttgctaaaaagactgaataatccacccactgaatagctaacctggggaggaaatgaaaatttcctttgtggatctccccaaatccattgttgtcaccaggccctcccagaacctcctcagttccttcacagtgcaaccctgtgtacttggcccgcaacccaatagtattgtgcctcacttcaccttccatgggcaactgccctcccttctggacataaaacctcatattttaaataaagttgaaatatgaaaagaaagta

SEQ ID NO: 299620 - DNA, 5857 bp, Homo sapiens
cacgctcagagcagaccgctagcaggaggcaggatgtgatagtctaagaccctggaagctgacggccagagggagggaagggtggtcacagaggagaggcaaagcaacgggaggtggaggatcctggaggtgtctgcaaggagaatacacagcagcgaggggctgcagaagcggacccagcgacttctgcgctgacgcggggcgggcgggagagaggaagagaggggagcgcggtggcgctgcgagctggccccgccggggaaggggctgccatgtcccgtgagcggcccccgggcaccgacattccccgcaacctgagcttcatcgccgcgctaacggagcgcgcctactaccgtagccagcggcccagcctcgaggaggagccggaggaggagccaggcgagggcgggacgcggttcggggcccgatcccgcgctcacgcaccgagtcggggccgccgggcccgatctgcaccagccggaggcggcggggcccgggcgccccgcagccgtagcccagacacccgcaagagagtgcgtttcgccgacgcactggggttggagctggctgtcgtgcgccgcttccgtcccggtgagctgccccgggtgccccgccacgtgcagatccaattgcagagggacgccctccgccacttcgcgccctgccagccccgcgcccgcggcctccaggaggcgcgcgccgccctggagccggccagcgagcccggcttcgccgcccgcttgctgacgcagcgcatctgcctggaacgcgccgaggcgggcccgctgggcgtggccgggagcgcgcgcgtggtggacctggcctacgagaagcgcgtgagcgtgcgctggagcgccgacggctggcggagccaacgcgaggcgccagccgcctacgccggtccggccccgcccccgccgcgcgccgaccgcttcgccttccgcctgcccgcgccgccgattgggggcgccctgctcttcgccttgcgctaccgtgtgacaggtcacgagttctgggacaacaacggcggccgtgactatgctctacgtgggcccgagcacccgggcagtggcggagctccggagccgcagggctggatccactttatctgagacgaggcgcctgcggccgacggcggaaaacaccaaaggcacccgggggcggggcgacccgatgtggcggggaggagtaggagagaccaggattggcgggagcggtccaagggagtcaagccggggagggcgaaaagggtggggaaatcaggggcgtgggggcgtgggggcgtgggggcggggggagtgagcggaaccaaagaagctccgggagatccgggtgttaaaagctggttggatgtgagtggaaggaactcagaatataggaggaaggagacccgaaacggcaccggagggattataaaaaaaggaaaagaatggggatgatggtggccttcccttcagtgagtgggctctgggagaaagggaggaggtccatcaggcctaggcggttgaagaaggttaagaaccttttggagatggaggaggtatgatgtgaagtagcccacccagtcgaaggcatttacattgctggcgcattccctcttcttaccggccttttccacctcagatccccctgtcctacccatcctagctttaactcagccataattgccttgcttaatcccaggaacctggccactgctccttggtccttggcattatgacgggattcccttgtcacctctgacagttcctggctgcggtgtccgcggactggctggggagtgatgacaggtagctatcagagctccagcctccaggcagctttagggattaaaacggaggccaaagcaactccagacctgtttttatagccaaatactgagcctcaggggttgtacactcaggggcttccaggaaaatgccagccttacttttctggggtgccttttaataacctccaagcactttgtggactgtttgtcgagggacggtgaatcagaagaatcactattctgatttcctttgtctccgaagaggaagtccctgactagctatataactttgggcgagttacctctcacttctttgtgccccagtgttctccttgggaaactggatttaggttagatgaccttttaaggctccttgtatgatattttgtgatctgtacatggcagagtatagattaggagccaaattttccaacctagtgctatggttcagaatacatagcaccccaagcgtctggctggagccgaggatgggtcctccagtttttggcacagatgttccggagcccaggaagcatcccataaccaaccttcagccccaccgccacccccagcgtattccagagccgcttccaaaccacagcctatcctctgctccatttcactcttgccctcacagactttcagcctccatgctctgagacaactgtggaagggatggaaaccctattttcttttctccaagaccatggttggtctgcttccctcactcgggctccttgacagtcttctagaagagagaaggaggaaaagaagcagttcctgatgttacaaatgaacaaggatctcccagccttagtctttgagaaaagatggctgaaagagaggaactctccaagtcattccgcaaacaaatgcccatttaaacatcatccttgtcttgtgaagaaaacaggaagaatgtcatgtaccatgtggatcaccttcagttcaaagttgcagcaaagtgaagaaagaaactactggaagccacccagcaatgcactgtttagtcatcaattaggagcccatgggaggataatagggagactgggtggaggctcagtgtgtaataatctcttgtctaatgtatgtgtgtcactgccatgttgtatgaacaatagtgagggctcacatttacttaacacttgtgtgcgcaaatctgggtttttcttcctttccagaactatgactcgatcataaaatctgttttgtttgcatgcatgcccaaaacaaccctgtaagtagaacattgtcattatctctgttttagagatgaggaaacaggctcagagaagctcagaaatttgttcaagatcgcacagctagtaaatggcagaagtaggattgtgaacccagggaatctccagagcctctgtgtaaccatgatgttatattttttttcctctttaaaaacaaaatttaaaaccttgctataatctcttattaggaaatgatcatagtttctgactgtgctctgccttcccatcctgccaatctcctggactggcttggagaagacagggggcccccgagcttcatctgtgactcgaaggagtttgctgctgtctcctgtgtcagtgtcccatctatgcaggatcagcacaggacccccctcaccttcccacttacactctagcctttccatacattggaattctctcctggccctagccagcgctccacacctgttggtgtgccacctccctccctcttcccccactggccttgaacaggcaaaccccctaatgtcgccactaggttgggtccgtgactaggacacctgctagagggtctgtgcttgggccttttctaggaatcccgatgttactgggtaagtgccaactctgtgggcagaatgctaatgataatcctgttccctgacctctttctcagaagtaccctggctcactctccccaatctcagctttatagaacaacattttggtcttgattattcccatatcaagctgccccagggcttcggtaagctgttagttgccccactgcctcaaggctgggtctggctgagctacttcttaggcacacaaatagtgggtgtctccttggaacctgacacaaaactatcagtgctaccaagccttgtaaaatagggaggaaactaatatttcttgagtggcttctgagtgcctggtgctttcgcggctctctggagagattccttgccctgatggctttggtgtgtactcctctcccaggacttcagcactgagattttcccaaccccctggcttttcctcaccttgggttgagttgatccggcactaccacaaaccccaccatctgcaaaccaaccaagattaggcagtatgccctttccgtcttgcactgctcttccaaaacttccatctgtatttctcacaccctcagtaagcaaagctgagtgtgcatggacagagctgcatccactgctttctcccagcgggtgcagtctaatctgacacggggaacactaggagtttagcggaatcttcagccaccctattaatgtgttacgcattaggcattgtagtggaaactcctctgatggctcatgactatatgaacaggagcaatttggaatataacatgtcagctgtggactgggaagtgccgtgagagaaaacactacctgggtcataggcttgggtccctgaggcaacccagcagggacactgttgcccattcctctcatccagactgcaggtgtcttcctacacctccctgtcccatagcctccgtcctgttttttgtttgtttgtttttctttgtgaatgtagaaaaacatttcatcatgagccctagctcctcagttttccacctaacacccacattcccttgtttctaactgccgtgtttttctggagcctgctgggatctttgcagtttgcaggtcatagaatcagacatgaaaaggcttctcttccgacgtcattggttcctggctcctttacagatgagaacacaggtccagaggtgagaaatgactctagcagggtcatagaatttgttagtgcagctcaagatgggacttaaactcaggcctcctgatcacccattcccaggctaggaaacaggtctctgctcggtgtggtggttcatacctgtaatcgcaacactttgggaggctgaggcaggagcattgcttgagcccaggagttcgagaccagtctgagcaacatagtgggaccctgtctctacaaaaacttttaaaattagctgggcatggtggcacacatctgtattcccagctactcaggaagctgagacaggaggatcgcttgagcccaggagttggaggttactgagctatgatcgcaccactgcactccagcttggtgacagtgagaccctcaaaaaaaaaaagaaaagaaagaggtctctacacaagcccgtgattcttcatggcaagggataacatcagaaatgtttcattttctgctattagtttccattcctttccccatccaggcataaagagaaacaaaagacaatgatggtattctctgtgtcctcagctttggcacttttgttgatgttgctaaggagcagtgaccttgctaaaaagactgaataatccacccactgaatagctaacctggggaggaaatgaaaatttcctttgtggatctccccaaatccattgttgtcaccaggccctcccagaacctcctcagttccttcacagtgcaaccctgtgtacttggcccgcaacccaatagtattgtgcctcacttcaccttccatgggcaactgccctcccttctggacataaaacctcatattttaaataaagttgaaatatgaaaagaaagtatgtcataagatattcagaagtattgtgtgttttgggctaagggcagcaagagactcagaggcaagattccctccttgactcaatttcttggtcaccttgttttttgtgtgtgtgtgtccagaaaaatttaataagtttgcttaaattattataaagttgaaccactgaaatgttcactgaaacattttgacttgcattaatgctttacttccccacctacatttacattaaaaattcacacacaaatgaaaattgaaaactgacaacacctg

SEQ ID NO: 299621 - DNA, 5089 bp, Homo sapiens
cacgctcagagcagaccgctagcaggaggcaggatgtgatagtctaagaccctggaagctgacggccagagggagggaagggtggtcacagaggagaggcaaagcaacgggaggtggaggatcctggaggtgtctgcaaggagaatacacagcagcgaggggctgcagaagcggacccagcgacttctgcgctgacgcggggcgggcgggagagaggaagagaggggagcgcggtggcgctgcgagctggccccgccggggaaggggctgccatgtcccgtgagcggcccccgggcaccgacattccccgcaacctgagcttcatcgccgcgctaacggagcgcgcctactaccgtagccagcggcccagcctcgaggaggagccggaggaggagccaggcgagggcgggacgcggttcggggcccgatcccgcgctcacgcaccgagtcggggccgccgggcccgatctgcaccagccggaggcggcggggcccgggcgccccgcagccgtagcccagacacccgcaagagagtgcgtttcgccgacgcactggggttggagctggctgtcgtgcgccgcttccgtcccggtgagctgccccgggtgccccgccacgtgcagatccaattgcagagggacgccctccgccacttcgcgccctgccagccccgcgcccgcggcctccaggaggcgcgcgccgccctggagccggccagcgagcccggcttcgccgcccgcttgctgacgcagcgcatctgcctggaacgcgccgaggcgggcccgctgggcgtggccgggagcgcgcgcgtggtggacctggcctacgagaagcgcgtgagcgtgcgctggagcgccgacggctggcggagccaacgcgaggcgccagccgcctacgccggtccggccccgcccccgccgcgcgccgaccgcttcgccttccgcctgcccgcgccgccgattgggggcgccctgctcttcgccttgcgctaccgtgtgacaggtcacgagttctgggacaacaacggcggccgtgactatgctctacgtgggcccgagcacccgggcagtggcggagctccggagccgcagggctggatccactttatctgagacgaggcgcctgcggccgacggcggaaaacaccaaaggcacccgggggcggggcgacccgatgtggcggggaggagtaggagagaccaggattggcgggagcggtccaagggagtcaagccggggagggcgaaaagggtggggaaatcaggggcgtgggggcgtgggggcgtgggggcggggggagtgagcggaaccaaagaagctccgggagatccgggtgttaaaagctggttggatgtgagtggaaggaactcagaatataggaggaaggagacccgaaacggcaccggagggattataaaaaaaggaaaagaatggggatgatggtggccttcccttcagtgagtgggctctgggagaaagggaggaggtccatcaggcctaggcggttgaagaaggttaagaaccttttggagatggaggaggtatgatgtgaagtagcccacccagtcgaaggcatttacattgctggcgcattccctcttcttaccggccttttccacctcagatccccctgtcctacccatcctagctttaactcagccataattgccttgcttaatcccaggaacctggccactgctccttggtccttggcattatgacgggattcccttgtcacctctgacagttcctggctgcggtgtccgcggactggctggggagtgatgacaggtagctatcagagctccagcctccaggcagctttagggattaaaacggaggccaaagcaactccagacctgtttttatagccaaatactgagcctcaggggttgtacactcaggggcttccaggaaaatgccagccttacttttctggggtgccttttaataacctccaagcactttgtggactgtttgtcgagggacggtgaatcagaagaatcactattctgatttcctttgtctccgaagaggaagtccctgactagctatataactttgggcgagttacctctcacttctttgtgccccagtgttctccttgggaaactggatttaggttagatgaccttttaaggctccttgtatgatattttgtgatctgtacatggcagagtatagattaggagccaaattttccaacctagtgctatggttcagaatacatagcaccccaagcgtctggctggagccgaggatgggtcctccagtttttggcacagatgttccggagcccaggaagcatcccataaccaaccttcagccccaccgccacccccagcgtattccagagccgcttccaaaccacagcctatcctctgctccatttcactcttgccctcacagactttcagcctccatgctctgagacaactgtggaagggatggaaaccctattttcttttctccaagaccatggttggtctgcttccctcactcgggctccttgacagtcttctagaagagagaaggaggaaaagaagcagttcctgatgttacaaatgaacaaggatctcccagccttagtctttgagaaaagatggctgaaagagaggaactctccaagtcattccgcaaacaaatgcccatttaaacatcatccttgtcttgtgaagaaaacaggaagaatgtcatgtaccatgtggatcaccttcagttcaaagttgcagcaaagtgaagaaagaaactactggaagccacccagcaatgcactgtttagtcatcaattaggagcccatgggaggataatagggagactgggtggaggctcagtgtgtaataatctcttgtctaatgtatgtgtgtcactgccatgttgtatgaacaatagtgagggctcacatttacttaacacttgtgtgcgcaaatctgggtttttcttcctttccagaactatgactcgatcataaaatctgttttgtttgcatgcatgcccaaaacaaccctgtaagtagaacattgtcattatctctgttttagagatgaggaaacaggctcagagaagctcagaaatttgttcaagatcgcacagctagtaaatggcagaagtaggattgtgaacccagggaatctccagagcctctgtgtaaccatgatgttatattttttttcctctttaaaaacaaaatttaaaaccttgctataatctcttattaggaaatgatcatagtttctgactgtgctctgccttcccatcctgccaatctcctggactggcttggagaagacagggggcccccgagcttcatctgtgactcgaaggagtttgctgctgtctcctgtgtcagtgtcccatctatgcaggatcagcacaggacccccctcaccttcccacttacactctagcctttccatacattggaattctctcctggccctagccagcgctccacacctgttggtgtgccacctccctccctcttcccccactggccttgaacaggcaaaccccctaatgtcgccactaggttgggtccgtgactaggacacctgctagagggtctgtgcttgggccttttctaggaatcccgatgttactgggtaagtgccaactctgtgggcagaatgctaatgataatcctgttccctgacctctttctcagaagtaccctggctcactctccccaatctcagctttatagaacaacattttggtcttgattattcccatatcaagctgccccagggcttcggtaagctgttagttgccccactgcctcaaggctgggtctggctgagctacttcttaggcacacaaatagtgggtgtctccttggaacctgacacaaaactatcagtgctaccaagccttgtaaaatagggaggaaactaatatttcttgagtggcttctgagtgcctggtgctttcgcggctctctggagagattccttgccctgatggctttggtgtgtactcctctcccaggacttcagcactgagattttcccaaccccctggcttttcctcaccttgggttgagttgatccggcactaccacaaaccccaccatctgcaaaccaaccaagattaggcagtatgccctttccgtcttgcactgctcttccaaaacttccatctgtatttctcacaccctcagtaagcaaagctgagtgtgcatggacagagctgcatccactgctttctcccagcgggtgcagtctaatctgacacggggaacactaggagtttagcggaatcttcagccaccctattaatgtgttacgcattaggcattgtagtggaaactcctctgatggctcatgactatatgaacaggagcaatttggaatataacatgtcagctgtggactgggaagtgccgtgagagaaaacactacctgggtcataggcttgggtccctgaggcaacccagcagggacactgttgcccattcctctcatccagactgcaggtgtcttcctacacctccctgtcccatagcctccgtcctgttttttgtttgtttgtttttctttgtgaatgtagaaaaacatttcatcatgagccctagctcctcagttttccacctaacacccacattcccttgtttctaactgccgtgtttttctggagcctgctgggatctttgcagtttgcaggtcatagaatcagacatgaaaaggcttctcttccgacgtcattggttcctggctcctttacagatgagaacacaggtccagagcataaagagaaacaaaagacaatgatggtattctctgtgtcctcagctttggcacttttgttgatgttgctaaggagcagtgaccttgctaaaaagactgaataatccacccactgaatagctaacctggggaggaaatgaaaatttcctttgtggatctccccaaatccattgttgtcaccaggccctcccagaacctcctcagttccttcacagtgcaaccctgtgtacttggcccgcaacccaatagtattgtgcctcacttcaccttccatgggcaactgccctcccttctggacataaaacctcatattttaaataaagttgaaatatgaaaagaaagta

SEQ ID NO: 299622 - DNA, 5126 bp, Homo sapiens
cacgctcagagcagaccgctagcaggaggcaggatgtgatagtctaagaccctggaagctgacggccagagggagggaagggtggtcacagaggagaggcaaagcaacgggaggtggaggatcctggaggtgtctgcaaggagaatacacagcagcgaggggctgcagaagcggacccagcgacttctgcgctgacgcggggcgggcgggagagaggaagagaggggagcgcggtggcgctgcgagctggccccgccggggaaggggctgccatgtcccgtgagcggcccccgggcaccgacattccccgcaacctgagcttcatcgccgcgctaacggagcgcgcctactaccgtagccagcggcccagcctcgaggaggagccggaggaggagccaggcgagggcgggacgcggttcggggcccgatcccgcgctcacgcaccgagtcggggccgccgggcccgatctgcaccagccggaggcggcggggcccgggcgccccgcagccgtagcccagacacccgcaagagagtgcgtttcgccgacgcactggggttggagctggctgtcgtgcgccgcttccgtcccggtgagctgccccgggtgccccgccacgtgcagatccaattgcagagggacgccctccgccacttcgcgccctgccagccccgcgcccgcggcctccaggaggcgcgcgccgccctggagccggccagcgagcccggcttcgccgcccgcttgctgacgcagcgcatctgcctggaacgcgccgaggcgggcccgctgggcgtggccgggagcgcgcgcgtggtggacctggcctacgagaagcgcgtgagcgtgcgctggagcgccgacggctggcggagccaacgcgaggcgccagccgcctacgccggtccggccccgcccccgccgcgcgccgaccgcttcgccttccgcctgcccgcgccgccgattgggggcgccctgctcttcgccttgcgctaccgtgtgacaggtcacgagttctgggacaacaacggcggccgtgactatgctctacgtgggcccgagcacccgggcagtggcggagctccggagccgcagggctggatccactttatctgagacgaggcgcctgcggccgacggcggaaaacaccaaaggcacccgggggcggggcgacccgatgtggcggggaggagtaggagagaccaggattggcgggagcggtccaagggagtcaagccggggagggcgaaaagggtggggaaatcaggggcgtgggggcgtgggggcgtgggggcggggggagtgagcggaaccaaagaagctccgggagatccgggtgttaaaagctggttggatgtgagtggaaggaactcagaatataggaggaaggagacccgaaacggcaccggagggattataaaaaaaggaaaagaatggggatgatggtggccttcccttcagtgagtgggctctgggagaaagggaggaggtccatcaggcctaggcggttgaagaaggttaagaaccttttggagatggaggaggtatgatgtgaagtagcccacccagtcgaaggcatttacattgctggcgcattccctcttcttaccggccttttccacctcagatccccctgtcctacccatcctagctttaactcagccataattgccttgcttaatcccaggaacctggccactgctccttggtccttggcattatgacgggattcccttgtcacctctgacagttcctggctgcggtgtccgcggactggctggggagtgatgacaggtagctatcagagctccagcctccaggcagctttagggattaaaacggaggccaaagcaactccagacctgtttttatagccaaatactgagcctcaggggttgtacactcaggggcttccaggaaaatgccagccttacttttctggggtgccttttaataacctccaagcactttgtggactgtttgtcgagggacggtgaatcagaagaatcactattctgatttcctttgtctccgaagaggaagtccctgactagctatataactttgggcgagttacctctcacttctttgtgccccagtgttctccttgggaaactggatttaggttagatgaccttttaaggctccttgtatgatattttgtgatctgtacatggcagagtatagattaggagccaaattttccaacctagtgctatggttcagaatacatagcaccccaagcgtctggctggagccgaggatgggtcctccagtttttggcacagatgttccggagcccaggaagcatcccataaccaaccttcagccccaccgccacccccagcgtattccagagccgcttccaaaccacagcctatcctctgctccatttcactcttgccctcacagactttcagcctccatgctctgagacaactgtggaagggatggaaaccctattttcttttctccaagaccatggttggtctgcttccctcactcgggctccttgacagtcttctagaagagagaaggaggaaaagaagcagttcctgatgttacaaatgaacaaggatctcccagagatgaggaaacaggctcagagaagctcagaaatttgttcaagatcgcacagctagtaaatggcagaagtaggattgtgaacccagggaatctccagagcctctgtgtaaccatgatgttatattttttttcctctttaaaaacaaaatttaaaaccttgctataatctcttattaggaaatgatcatagtttctgactgtgctctgccttcccatcctgccaatctcctggactggcttggagaagacagggggcccccgagcttcatctgtgactcgaaggagtttgctgctgtctcctgtgtcagtgtcccatctatgcaggatcagcacaggacccccctcaccttcccacttacactctagcctttccatacattggaattctctcctggccctagccagcgctccacacctgttggtgtgccacctccctccctcttcccccactggccttgaacaggcaaaccccctaatgtcgccactaggttgggtccgtgactaggacacctgctagagggtctgtgcttgggccttttctaggaatcccgatgttactgggtaagtgccaactctgtgggcagaatgctaatgataatcctgttccctgacctctttctcagaagtaccctggctcactctccccaatctcagctttatagaacaacattttggtcttgattattcccatatcaagctgccccagggcttcggtaagctgttagttgccccactgcctcaaggctgggtctggctgagctacttcttaggcacacaaatagtgggtgtctccttggaacctgacacaaaactatcagtgctaccaagccttgtaaaatagggaggaaactaatatttcttgagtggcttctgagtgcctggtgctttcgcggctctctggagagattccttgccctgatggctttggtgtgtactcctctcccaggacttcagcactgagattttcccaaccccctggcttttcctcaccttgggttgagttgatccggcactaccacaaaccccaccatctgcaaaccaaccaagattaggcagtatgccctttccgtcttgcactgctcttccaaaacttccatctgtatttctcacaccctcagtaagcaaagctgagtgtgcatggacagagctgcatccactgctttctcccagcgggtgcagtctaatctgacacggggaacactaggagtttagcggaatcttcagccaccctattaatgtgttacgcattaggcattgtagtggaaactcctctgatggctcatgactatatgaacaggagcaatttggaatataacatgtcagctgtggactgggaagtgccgtgagagaaaacactacctgggtcataggcttgggtccctgaggcaacccagcagggacactgttgcccattcctctcatccagactgcaggtgtcttcctacacctccctgtcccatagcctccgtcctgttttttgtttgtttgtttttctttgtgaatgtagaaaaacatttcatcatgagccctagctcctcagttttccacctaacacccacattcccttgtttctaactgccgtgtttttctggagcctgctgggatctttgcagtttgcaggtcatagaatcagacatgaaaaggcttctcttccgacgtcattggttcctggctcctttacagatgagaacacaggtccagaggtgagaaatgactctagcagggtcatagaatttgttagtgcagctcaagatgggacttaaactcaggcctcctgatcacccattcccaggctaggaaacaggtctctgctcggtgtggtggttcatacctgtaatcgcaacactttgggaggctgaggcaggagcattgcttgagcccaggagttcgagaccagtctgagcaacatagtgggaccctgtctctacaaaaacttttaaaattagctgggcatggtggcacacatctgtattcccagctactcaggaagctgagacaggaggatcgcttgagcccaggagttggaggttactgagctatgatcgcaccactgcactccagcttggtgacagtgagaccctcaaaaaaaaaaagaaaagaaagaggtctctacacaagcccgtgattcttcatggcaagggataacatcagaaatgtttcattttctgctattagtttccattcctttccccatccaggcataaagagaaacaaaagacaatgatggtattctctgtgtcctcagctttggcacttttgttgatgttgctaaggagcagtgaccttgctaaaaagactgaataatccacccactgaatagctaacctggggaggaaatgaaaatttcctttgtggatctccccaaatccattgttgtcaccaggccctcccagaacctcctcagttccttcacagtgcaaccctgtgtacttggcccgcaacccaatagtattgtgcctcacttcaccttccatgggcaactgccctcccttctggacataaaacctcatattttaaataaagttgaaatatgaaaagaaagta

SEQ ID NO: 299623 - DNA, 5215 bp, Homo sapiens
cacgctcagagcagaccgctagcaggaggcaggatgtgatagtctaagaccctggaagctgacggccagagggagggaagggtggtcacagaggagaggcaaagcaacgggaggtggaggatcctggaggtgtctgcaaggagaatacacagcagcgaggggctgcagaagcggacccagcgacttctgcgctgacgcggggcgggcgggagagaggaagagaggggagcgcggtggcgctgcgagctggccccgccggggaaggggctgccatgtcccgtgagcggcccccgggcaccgacattccccgcaacctgagcttcatcgccgcgctaacggagcgcgcctactaccgtagccagcggcccagcctcgaggaggagccggaggaggagccaggcgagggcgggacgcggttcggggcccgatcccgcgctcacgcaccgagtcggggccgccgggcccgatctgcaccagccggaggcggcggggcccgggcgccccgcagccgtagcccagacacccgcaagagagtgcgtttcgccgacgcactggggttggagctggctgtcgtgcgccgcttccgtcccggtgagctgccccgggtgccccgccacgtgcagatccaattgcagagggacgccctccgccacttcgcgccctgccagccccgcgcccgcggcctccaggaggcgcgcgccgccctggagccggccagcgagcccggcttcgccgcccgcttgctgacgcagcgcatctgcctggaacgcgccgaggcgggcccgctgggcgtggccgggagcgcgcgcgtggtggacctggcctacgagaagcgcgtgagcgtgcgctggagcgccgacggctggcggagccaacgcgaggcgccagccgcctacgccggtccggccccgcccccgccgcgcgccgaccgcttcgccttccgcctgcccgcgccgccgattgggggcgccctgctcttcgccttgcgctaccgtgtgacaggtcacgagttctgggacaacaacggcggccgtgactatgctctacgtgggcccgagcacccgggcagtggcggagctccggagccgcagggctggatccactttatctgagacgaggcgcctgcggccgacggcggaaaacaccaaaggcacccgggggcggggcgacccgatgtggcggggaggagtaggagagaccaggattggcgggagcggtccaagggagtcaagccggggagggcgaaaagggtggggaaatcaggggcgtgggggcgtgggggcgtgggggcggggggagtgagcggaaccaaagaagctccgggagatccgggtgttaaaagctggttggatgtgagtggaaggaactcagaatataggaggaaggagacccgaaacggcaccggagggattataaaaaaaggaaaagaatggggatgatggtggccttcccttcagtgagtgggctctgggagaaagggaggaggtccatcaggcctaggcggttgaagaaggttaagaaccttttggagatggaggaggtatgatgtgaagtagcccacccagtcgaaggcatttacattgctggcgcattccctcttcttaccggccttttccacctcagatccccctgtcctacccatcctagctttaactcagccataattgccttgcttaatcccaggaacctggccactgctccttggtccttggcattatgacgggattcccttgtcacctctgacagttcctggctgcggtgtccgcggactggctggggagtgatgacaggtagctatcagagctccagcctccaggcagctttagggattaaaacggaggccaaagcaactccagacctgtttttatagccaaatactgagcctcaggggttgtacactcaggggcttccaggaaaatgccagccttacttttctggggtgccttttaataacctccaagcactttgtggactgtttgtcgagggacggtgaatcagaagaatcactattctgatttcctttgtctccgaagaggaagtccctgactagctatataactttgggcgagttacctctcacttctttgtgccccagtgttctccttgggaaactggatttaggttagatgaccttttaaggctccttgtatgatattttgtgatctgtacatggcagagtatagattaggagccaaattttccaacctagtgctatggttcagaatacatagcaccccaagcgtctggctggagccgaggatgggtcctccagtttttggcacagatgttccggagcccaggaagcatcccataaccaaccttcagccccaccgccacccccagcgtattccagagccgcttccaaaccacagcctatcctctgctccatttcactcttgccctcacagactttcagcctccatgctctgagacaactgtggaagggatggaaaccctattttcttttctccaagaccatggttggtctgcttccctcactcgggctccttgacagtcttctagaagagagaaggaggaaaagaagcagttcctgatgttacaaatgaacaaggatctcccagaactatgactcgatcataaaatctgttttgtttgcatgcatgcccaaaacaaccctgtaagtagaacattgtcattatctctgttttagagatgaggaaacaggctcagagaagctcagaaatttgttcaagatcgcacagctagtaaatggcagaagtaggattgtgaacccagggaatctccagagcctctgtgtaaccatgatgttatattttttttcctctttaaaaacaaaatttaaaaccttgctataatctcttattaggaaatgatcatagtttctgactgtgctctgccttcccatcctgccaatctcctggactggcttggagaagacagggggcccccgagcttcatctgtgactcgaaggagtttgctgctgtctcctgtgtcagtgtcccatctatgcaggatcagcacaggacccccctcaccttcccacttacactctagcctttccatacattggaattctctcctggccctagccagcgctccacacctgttggtgtgccacctccctccctcttcccccactggccttgaacaggcaaaccccctaatgtcgccactaggttgggtccgtgactaggacacctgctagagggtctgtgcttgggccttttctaggaatcccgatgttactgggtaagtgccaactctgtgggcagaatgctaatgataatcctgttccctgacctctttctcagaagtaccctggctcactctccccaatctcagctttatagaacaacattttggtcttgattattcccatatcaagctgccccagggcttcggtaagctgttagttgccccactgcctcaaggctgggtctggctgagctacttcttaggcacacaaatagtgggtgtctccttggaacctgacacaaaactatcagtgctaccaagccttgtaaaatagggaggaaactaatatttcttgagtggcttctgagtgcctggtgctttcgcggctctctggagagattccttgccctgatggctttggtgtgtactcctctcccaggacttcagcactgagattttcccaaccccctggcttttcctcaccttgggttgagttgatccggcactaccacaaaccccaccatctgcaaaccaaccaagattaggcagtatgccctttccgtcttgcactgctcttccaaaacttccatctgtatttctcacaccctcagtaagcaaagctgagtgtgcatggacagagctgcatccactgctttctcccagcgggtgcagtctaatctgacacggggaacactaggagtttagcggaatcttcagccaccctattaatgtgttacgcattaggcattgtagtggaaactcctctgatggctcatgactatatgaacaggagcaatttggaatataacatgtcagctgtggactgggaagtgccgtgagagaaaacactacctgggtcataggcttgggtccctgaggcaacccagcagggacactgttgcccattcctctcatccagactgcaggtgtcttcctacacctccctgtcccatagcctccgtcctgttttttgtttgtttgtttttctttgtgaatgtagaaaaacatttcatcatgagccctagctcctcagttttccacctaacacccacattcccttgtttctaactgccgtgtttttctggagcctgctgggatctttgcagtttgcaggtcatagaatcagacatgaaaaggcttctcttccgacgtcattggttcctggctcctttacagatgagaacacaggtccagaggtgagaaatgactctagcagggtcatagaatttgttagtgcagctcaagatgggacttaaactcaggcctcctgatcacccattcccaggctaggaaacaggtctctgctcggtgtggtggttcatacctgtaatcgcaacactttgggaggctgaggcaggagcattgcttgagcccaggagttcgagaccagtctgagcaacatagtgggaccctgtctctacaaaaacttttaaaattagctgggcatggtggcacacatctgtattcccagctactcaggaagctgagacaggaggatcgcttgagcccaggagttggaggttactgagctatgatcgcaccactgcactccagcttggtgacagtgagaccctcaaaaaaaaaaagaaaagaaagaggtctctacacaagcccgtgattcttcatggcaagggataacatcagaaatgtttcattttctgctattagtttccattcctttccccatccaggcataaagagaaacaaaagacaatgatggtattctctgtgtcctcagctttggcacttttgttgatgttgctaaggagcagtgaccttgctaaaaagactgaataatccacccactgaatagctaacctggggaggaaatgaaaatttcctttgtggatctccccaaatccattgttgtcaccaggccctcccagaacctcctcagttccttcacagtgcaaccctgtgtacttggcccgcaacccaatagtattgtgcctcacttcaccttccatgggcaactgccctcccttctggacataaaacctcatattttaaataaagttgaaatatgaaaagaaagta

SEQ ID NO: 299624 - DNA, 2614 bp, Homo sapiens
cacgctcagagcagaccgctagcaggaggcaggatgtgatagtctaagaccctggaagctgacggccagagggagggaagggtggtcacagaggagaggcaaagcaacgggaggtggaggatcctggaggtgtctgcaaggagaatacacagcagcgaggggctgcagaagcggacccagcgacttctgcgctgacgcggggcgggcgggagagaggaagagaggggagcgcggtggcgctgcgagctggccccgccggggaaggggctgccatgtcccgtgagcggcccccgggcaccgacattccccgcaacctgagcttcatcgccgcgctaacggagcgcgcctactaccgtagccagcggcccagcctcgaggaggagccggaggaggagccaggcgagggcgggacgcggttcggggcccgatcccgcgctcacgcaccgagtcggggccgccgggcccgatctgcaccagccggaggcggcggggcccgggcgccccgcagccgtagcccagacacccgcaagagagtgcgtttcgccgacgcactggggttggagctggctgtcgtgcgccgcttccgtcccggtgagctgccccgggtgccccgccacgtgcagatccaattgcagagggacgccctccgccacttcgcgccctgccagccccgcgcccgcggcctccaggaggcgcgcgccgccctggagccggccagcgagcccggcttcgccgcccgcttgctgacgcagcgcatctgcctggaacgcgccgaggcgggcccgctgggcgtggccgggagcgcgcgcgtggtggacctggcctacgagaagcgcgtgagcgtgcgctggagcgccgacggctggcggagccaacgcgaggcgccagccgcctacgccggtccggccccgcccccgccgcgcgccgaccgcttcgccttccgcctgcccgcgccgccgattgggggcgccctgctcttcgccttgcgctaccgtgtgacaggtcacgagttctgggacaacaacggcggccgtgactatgctctacgtgggcccgagcacccgggcagtggcggagctccggagccgcagggctggatccactttatctgagacgaggcgcctgcggccgacggcggaaaacaccaaaggcacccgggggcggggcgacccgatgtggcggggaggagtaggagagaccaggattggcgggagcggtccaagggagtcaagccggggagggcgaaaagggtggggaaatcaggggcgtgggggcgtgggggcgtgggggcggggggagtgagcggaaccaaagaagctccgggagatccgggtgttaaaagctggttggatgtgagtggaaggaactcagaatataggaggaaggagacccgaaacggcaccggagggattataaaaaaaggaaaagaatggggatgatggtggccttcccttcagtgagtgggctctgggagaaagggaggaggtccatcaggcctaggcggttgaagaaggttaagaaccttttggagatggaggaggtatgatgtgaagtagcccacccagtcgaaggcatttacattgctggcgcattccctcttcttaccggccttttccacctcagatccccctgtcctacccatcctagctttaactcagccataattgccttgcttaatcccaggaacctggccactgctccttggtccttggcattatgacgggattcccttgtcacctctgacagttcctggctgcggtgtccgcggactggctggggagtgatgacaggtagctatcagagctccagcctccaggcagctttagggattaaaacggaggccaaagcaactccagacctgtttttatagccaaatactgagcctcaggggttgtacactcaggggcttccaggaaaatgccagccttacttttctggggtgccttttaataacctccaagcactttgtggactgtttgtcgagggacggtgaatcagaagaatcactattctgatttcctttgtctccgaagaggaagtccctgactagctatataactttgggcgagttacctctcacttctttgtgccccagtgttctccttgggaaactggatttaggttagatgaccttttaaggctccttgtatgatattttgtgatctgtacatggcagagtatagattaggagccaaattttccaacctagtgctatggttcagaatacatagcaccccaagcgtctggctggagccgaggatgggtcctccagtttttggcacagatgttccggagcccaggaagcatcccataaccaaccttcagccccaccgccacccccagcgtattccagagccgcttccaaaccacagcctatcctctgctccatttcactcttgccctcacagactttcagcctccatgctctgagacaactgtgggtaggtacatctctgttggtggaaatgatgcttaagaaccccaaagattaaaggaaacaatgttaagggcttttgtgaggataaaagataatgggtatatggaatagaaacatttcaaatgaagaatcaaagcatttcaatcaatccacttagttgtaaaaaaaaaaaaaaaa

SEQ ID NO: 299625 - DNA, 5234 bp, Homo sapiens
  misc_feature (5215)..(5215): n is a, c, g, or t
  misc_feature (5228)..(5228): n is a, c, g, or t
  misc_feature (5231)..(5231): n is a, c, g, or t
cacgctcagagcagaccgctagcaggaggcaggatgtgatagtctaagaccctggaagctgacggccagagggagggaagggtggtcacagaggagaggcaaagcaacgggaggtggaggatcctggaggtgtctgcaaggagaatacacagcagcgaggggctgcagaagcggacccagcgacttctgcgctgacgcggggcgggcgggagagaggaagagaggggagcgcggtggcgctgcgagctggccccgccggggaaggggctgccatgtcccgtgagcggcccccgggcaccgacattccccgcaacctgagcttcatcgccgcgctaacggagcgcgcctactaccgtagccagcggcccagcctcgaggaggagccggaggaggagccaggcgagggcgggacgcggttcggggcccgatcccgcgctcacgcaccgagtcggggccgccgggcccgatctgcaccagccggaggcggcggggcccgggcgccccgcagccgtagcccagacacccgcaagagagtgcgtttcgccgacgcactggggttggagctggctgtcgtgcgccgcttccgtcccggtgagctgccccgggtgccccgccacgtgcagatccaattgcagagggacgccctccgccacttcgcgccctgccagccccgcgcccgcggcctccaggaggcgcgcgccgccctggagccggccagcgagcccggcttcgccgcccgcttgctgacgcagcgcatctgcctggaacgcgccgaggcgggcccgctgggcgtggccgggagcgcgcgcgtggtggacctggcctacgagaagcgcgtgagcgtgcgctggagcgccgacggctggcggagccaacgcgaggcgccagccgcctacgccggtccggccccgcccccgccgcgcgccgaccgcttcgccttccgcctgcccgcgccgccgattgggggcgccctgctcttcgccttgcgctaccgtgtgacaggtcacgagttctgggacaacaacggcggccgtgactatgctctacgtgggcccgagcacccgggcagtggcggagctccggagccgcagggctggatccactttatctgagacgaggcgcctgcggccgacggcggaaaacaccaaaggcacccgggggcggggcgacccgatgtggcggggaggagtaggagagaccaggattggcgggagcggtccaagggagtcaagccggggagggcgaaaagggtggggaaatcaggggcgtgggggcgtgggggcgtgggggcggggggagtgagcggaaccaaagaagctccgggagatccgggtgttaaaagctggttggatgtgagtggaaggaactcagaatataggaggaaggagacccgaaacggcaccggagggattataaaaaaaggaaaagaatggggatgatggtggccttcccttcagtgagtgggctctgggagaaagggaggaggtccatcaggcctaggcggttgaagaaggttaagaaccttttggagatggaggaggtatgatgtgaagtagcccacccagtcgaaggcatttacattgctggcgcattccctcttcttaccggccttttccacctcagatccccctgtcctacccatcctagctttaactcagccataattgccttgcttaatcccaggaacctggccactgctccttggtccttggcattatgacgggattcccttgtcacctctgacagttcctggctgcggtgtccgcggactggctggggagtgatgacaggtagctatcagagctccagcctccaggcagctttagggattaaaacggaggccaaagcaactccagacctgtttttatagccaaatactgagcctcaggggttgtacactcaggggcttccaggaaaatgccagccttacttttctggggtgccttttaataacctccaagcactttgtggactgtttgtcgagggacggtgaatcagaagaatcactattctgatttcctttgtctccgaagaggaagtccctgactagctatataactttgggcgagttacctctcacttctttgtgccccagtgttctccttgggaaactggatttaggttagatgaccttttaaggctccttgtatgatattttgtgatctgtacatggcagagtatagattaggagccaaattttccaacctagtgctatggttcagaatacatagcaccccaagcgtctggctggagccgaggatgggtcctccagtttttggcacagatgttccggagcccaggaagcatcccataaccaaccttcagccccaccgccacccccagcgtattccagagccgcttccaaaccacagcctatcctctgctccatttcactcttgccctcacagactttcagcctccatgctctgagacaactgtggaagggatggaaaccctattttcttttctccaagaccatggttggtctgcttccctcactcgggctccttgacagtcttctagaagagagaaggaggaaaagaagcagttcctgatgttacaaatgaacaaggatctcccagccttagtctttgagaaaagatggctgaaagagaggaactctccaagtcattccgcaaacaaatgcccatttaaacatcatccttgtcttgtgaagaaaacaggaagaatgtcatgtaccatgtggatcaccttcagttcaaagttgcagcaaagtgaagaaagaaactactggaagccacccagcaatgcactgtttagtcatcaattaggagcccatgggaggataatagggagactgggtggaggctcagtgtgtaataatctcttgtctaatgtatgtgtgtcactgccatgttgtatgaacaatagtgagggctcacatttacttaacacttgtgtgcgcaaatctgggtttttcttcctttccagaactatgactcgatcataaaatctgttttgtttgcatgcatgcccaaaacaaccctgtaagtagaacattgtcattatctctgttttagagatgaggaaacaggctcagagaagctcagaaatttgttcaagatcgcacagctagtaaatggcagaagtaggattgtgaacccagggaatctccagagcctctgtgtaaccatgatgttatattttttttcctctttaaaaacaaaatttaaaaccttgctataatctcttattaggaaatgatcatagtttctgactgtgctctgccttcccatcctgccaatctcctggactggcttggagaagacagggggcccccgagcttcatctgtgactcgaaggagtttgctgctgtctcctgtgtcagtgtcccatctatgcaggatcagcacaggacccccctcaccttcccacttacactctagcctttccatacattggaattctctcctggccctagccagcgctccacacctgttggtgtgccacctccctccctcttcccccactggccttgaacaggcaaaccccctaatgtcgccactaggttgggtccgtgactaggacacctgctagagggtctgtgcttgggccttttctaggaatcccgatgttactgggtaagtgccaactctgtgggcagaatgctaatgataatcctgttccctgacctctttctcagaagtaccctggctcactctccccaatctcagctttatagaacaacattttggtcttgattattcccatatcaagctgccccagggcttcggtaagctgttagttgccccactgcctcaaggctgggtctggctgagctacttcttaggcacacaaatagtgggtgtctccttggaacctgacacaaaactatcagtgctaccaagccttgtaaaatagggaggaaactaatatttcttgagtggcttctgagtgcctggtgctttcgcggctctctggagagattccttgccctgatggctttggtgtgtactcctctcccaggacttcagcactgagattttcccaaccccctggcttttcctcaccttgggttgagttgatccggcactaccacaaaccccaccatctgcaaaccaaccaagattaggcagtatgccctttccgtcttgcactgctcttccaaaacttccatctgtatttctcacaccctcagtaagcaaagctgagtgtgcatggacagagctgcatccactgctttctcccagcgggtgcagtctaatctgacacggggaacactaggagtttagcggaatcttcagccaccctattaatgtgttacgcattaggcattgtagtggaaactcctctgatggctcatgactatatgaacaggagcaatttggaatataacatgtcagctgtggactgggaagtgccgtgagagaaaacactacctgggtcataggcttgggtccctgaggcaacccagcagggacactgttgcccattcctctcatccagactgcaggtgtcttcctacacctccctgtcccatagcctccgtcctgttttttgtttgtttgtttttctttgtgaatgtagaaaaacatttcatcatgagccctagctcctcagttttccacctaacacccacattcccttgtttctaactgccgtgtttttctggagcctgctgggatctttgcagtttgcaggtcatagaatcagacatgaaaaggcttctcttccgacgtcattggttcctggctcctttacagatgagaacacaggtccagaggctaggaaacaggtctctgctcggtgtggtggttcatacctgtaatcgcaacactttgggaggctgaggcaggagcattgcttgagcccaggagttcgagaccagtctgagcaacatagtgggaccctgtctctacaaaaacttttaaaattagctgggcatggtggcacacatctgtattcccagctactcaggaagctgagacaggaggatcgcttgagcccaggagttggaggttactgagctatgatcgcaccactgcactccagcttggtgacagtgagaccctcaaaaaaaaaaagaaaagaaagaggtctctacacaagcccgtgattcttcatggcaagggataacatcagaaatgtttcattttctgctattagtttccattcctttccccatccagggagaacagtcacacgacagcccaaaaaaaccaccaaaacccaggtacaaaaaatcacagatctnagccgggccggtntcnccg

SEQ ID NO: 299626 - DNA, 4620 bp, Homo sapiens
cacgctcagagcagaccgctagcaggaggcaggatgtgatagtctaagaccctggaagctgacggccagagggagggaagggtggtcacagaggagaggcaaagcaacgggaggtggaggatcctggaggtgtctgcaaggagaatacacagcagcgaggggctgcagaagcggacccagcgacttctgcgctgacgcggggcgggcgggagagaggaagagaggggagcgcggtggcgctgcgagctggccccgccggggaaggggctgccatgtcccgtgagcggcccccgggcaccgacattccccgcaacctgagcttcatcgccgcgctaacggagcgcgcctactaccgtagccagcggcccagcctcgaggaggagccggaggaggagccaggcgagggcgggacgcggttcggggcccgatcccgcgctcacgcaccgagtcggggccgccgggcccgatctgcaccagccggaggcggcggggcccgggcgccccgcagccgtagcccagacacccgcaagagagtgcgtttcgccgacgcactggggttggagctggctgtcgtgcgccgcttccgtcccggtgagctgccccgggtgccccgccacgtgcagatccaattgcagagggacgccctccgccacttcgcgccctgccagccccgcgcccgcggcctccaggaggcgcgcgccgccctggagccggccagcgagcccggcttcgccgcccgcttgctgacgcagcgcatctgcctggaacgcgccgaggcgggcccgctgggcgtggccgggagcgcgcgcgtggtggacctggcctacgagaagcgcgtgagcgtgcgctggagcgccgacggctggcggagccaacgcgaggcgccagccgcctacgccggtccggccccgcccccgccgcgcgccgaccgcttcgccttccgcctgcccgcgccgccgattgggggcgccctgctcttcgccttgcgctaccgtgtgacaggtcacgagttctgggacaacaacggcggccgtgactatgctctacgtgggcccgagcacccgggcagtggcggagctccggagccgcagggctggatccactttatctgagacgaggcgcctgcggccgacggcggaaaacaccaaaggaacctggccactgctccttggtccttggcattatgacgggattcccttgtcacctctgacagttcctggctgcggtgtccgcggactggctggggagtgatgacagaatacatagcaccccaagcgtctggctggagccgaggatgggtcctccagtttttggcacagatgttccggagcccaggaagcatcccataaccaaccttcagccccaccgccacccccagcgtattccagagccgcttccaaaccacagcctatcctctgctccatttcactcttgccctcacagactttcagcctccatgctctgagacaactgtggaagggatggaaaccctattttcttttctccaagaccatggttggtctgcttccctcactcgggctccttgacagtcttctagaagagagaaggaggaaaagaagcagttcctgatgttacaaatgaacaaggatctcccagccttagtctttgagaaaagatggctgaaagagaggaactctccaagtcattccgcaaacaaatgcccatttaaacatcatccttgtcttgtgaagaaaacaggaagaatgtcatgtaccatgtggatcaccttcagttcaaagttgcagcaaagtgaagaaagaaactactggaagccacccagcaatgcactgtttagtcatcaattaggagcccatgggaggataatagggagactgggtggaggctcagtgtgtaataatctcttgtctaatgtatgtgtgtcactgccatgttgtatgaacaatagtgagggctcacatttacttaacacttgtgtgcgcaaatctgggtttttcttcctttccagaactatgactcgatcataaaatctgttttgtttgcatgcatgcccaaaacaaccctgtaagtagaacattgtcattatctctgttttagagatgaggaaacaggctcagagaagctcagaaatttgttcaagatcgcacagctagtaaatggcagaagtaggattgtgaacccagggaatctccagagcctctgtgtaaccatgatgttatattttttttcctctttaaaaacaaaatttaaaaccttgctataatctcttattaggaaatgatcatagtttctgactgtgctctgccttcccatcctgccaatctcctggactggcttggagaagacagggggcccccgagcttcatctgtgactcgaaggagtttgctgctgtctcctgtgtcagtgtcccatctatgcaggatcagcacaggacccccctcaccttcccacttacactctagcctttccatacattggaattctctcctggccctagccagcgctccacacctgttggtgtgccacctccctccctcttcccccactggccttgaacaggcaaaccccctaatgtcgccactaggttgggtccgtgactaggacacctgctagagggtctgtgcttgggccttttctaggaatcccgatgttactgggtaagtgccaactctgtgggcagaatgctaatgataatcctgttccctgacctctttctcagaagtaccctggctcactctccccaatctcagctttatagaacaacattttggtcttgattattcccatatcaagctgccccagggcttcggtaagctgttagttgccccactgcctcaaggctgggtctggctgagctacttcttaggcacacaaatagtgggtgtctccttggaacctgacacaaaactatcagtgctaccaagccttgtaaaatagggaggaaactaatatttcttgagtggcttctgagtgcctggtgctttcgcggctctctggagagattccttgccctgatggctttggtgtgtactcctctcccaggacttcagcactgagattttcccaaccccctggcttttcctcaccttgggttgagttgatccggcactaccacaaaccccaccatctgcaaaccaaccaagattaggcagtatgccctttccgtcttgcactgctcttccaaaacttccatctgtatttctcacaccctcagtaagcaaagctgagtgtgcatggacagagctgcatccactgctttctcccagcgggtgcagtctaatctgacacggggaacactaggagtttagcggaatcttcagccaccctattaatgtgttacgcattaggcattgtagtggaaactcctctgatggctcatgactatatgaacaggagcaatttggaatataacatgtcagctgtggactgggaagtgccgtgagagaaaacactacctgggtcataggcttgggtccctgaggcaacccagcagggacactgttgcccattcctctcatccagactgcaggtgtcttcctacacctccctgtcccatagcctccgtcctgttttttgtttgtttgtttttctttgtgaatgtagaaaaacatttcatcatgagccctagctcctcagttttccacctaacacccacattcccttgtttctaactgccgtgtttttctggagcctgctgggatctttgcagtttgcaggtcatagaatcagacatgaaaaggcttctcttccgacgtcattggttcctggctcctttacagatgagaacacaggtccagaggtgagaaatgactctagcagggtcatagaatttgttagtgcagctcaagatgggacttaaactcaggcctcctgatcacccattcccaggctaggaaacaggtctctgctcggtgtggtggttcatacctgtaatcgcaacactttgggaggctgaggcaggagcattgcttgagcccaggagttcgagaccagtctgagcaacatagtgggaccctgtctctacaaaaacttttaaaattagctgggcatggtggcacacatctgtattcccagctactcaggaagctgagacaggaggatcgcttgagcccaggagttggaggttactgagctatgatcgcaccactgcactccagcttggtgacagtgagaccctcaaaaaaaaaaagaaaagaaagaggtctctacacaagcccgtgattcttcatggcaagggataacatcagaaatgtttcattttctgctattagtttccattcctttccccatccaggcataaagagaaacaaaagacaatgatggtattctctgtgtcctcagctttggcacttttgttgatgttgctaaggagcagtgaccttgctaaaaagactgaataatccacccactgaatagctaacctggggaggaaatgaaaatttcctttgtggatctccccaaatccattgttgtcaccaggccctcccagaacctcctcagttccttcacagtgcaaccctgtgtacttggcccgcaacccaatagtattgtgcctcacttcaccttccatgggcaactgccctcccttctggacataaaacctcatattttaaataaagttgaaatatgaaaagaaagta

SEQ ID NO: 299627 - DNA, 4427 bp, Homo sapiens
cacgctcagagcagaccgctagcaggaggcaggatgtgatagtctaagaccctggaagctgacggccagagggagggaagggtggtcacagaggagaggcaaagcaacgggaggtggaggatcctggaggtgtctgcaaggagaatacacagcagcgaggggctgcagaagcggacccagcgacttctgcgctgacgcggggcgggcgggagagaggaagagaggggagcgcggtggcgctgcgagctggccccgccggggaaggggctgccatgtcccgtgagcggcccccgggcaccgacattccccgcaacctgagcttcatcgccgcgctaacggagcgcgcctactaccgtagccagcggcccagcctcgaggaggagccggaggaggagccaggcgagggcgggacgcggttcggggcccgatcccgcgctcacgcaccgagtcggggccgccgggcccgatctgcaccagccggaggcggcggggcccgggcgccccgcagccgtagcccagacacccgcaagagagtgcgtttcgccgacgcactggggttggagctggctgtcgtgcgccgcttccgtcccggtgagctgccccgggtgccccgccacgtgcagatccaattgcagagggacgccctccgccacttcgcgccctgccagccccgcgcccgcggcctccaggaggcgcgcgccgccctggagccggccagcgagcccggcttcgccgcccgcttgctgacgcagcgcatctgcctggaacgcgccgaggcgggcccgctgggcgtggccgggagcgcgcgcgtggtggacctggcctacgagaagcgcgtgagcgtgcgctggagcgccgacggctggcggagccaacgcgaggcgccagccgcctacgccggtccggccccgcccccgccgcgcgccgaccgcttcgccttccgcctgcccgcgccgccgattgggggcgccctgctcttcgccttgcgctaccgtgtgacaggtcacgagttctgggacaacaacggcggccgtgactatgctctacgtgggcccgagcacccgggcagtggcggagctccggagccgcagggctggatccactttatctgagacgaggcgcctgcggccgacggcggaaaacaccaaaggcacccgggggcggggcgacccgatgtggcggggaggagtaggagagaccaggattggcgggagcggtccaagggagtcaagccggggagggcgaaaaggactttcagcctccatgctctgagacaactgtggaagggatggaaaccctattttcttttctccaagaccatggttggtctgcttccctcactcgggctccttgacagtcttctagaagagagaaggaggaaaagaagcagttcctgatgttacaaatgaacaaggatctcccagccttagtctttgagaaaagatggctgaaagagaggaactctccaagtcattccgcaaacaaatgcccatttaaacatcatccttgtcttgtgaagaaaacaggaagaatgtcatgtaccatgtggatcaccttcagttcaaagttgcagcaaagtgaagaaagaaactactggaagccacccagcaatgcactgtttagtcatcaattaggagcccatgggaggataatagggagactgggtggaggctcagtgtgtaataatctcttgtctaatgtatgtgtgtcactgccatgttgtatgaacaatagtgagggctcacatttacttaacacttgtgtgcgcaaatctgggtttttcttcctttccagaactatgactcgatcataaaatctgttttgtttgcatgcatgcccaaaacaaccctgtaagtagaacattgtcattatctctgttttagagatgaggaaacaggctcagagaagctcagaaatttgttcaagatcgcacagctagtaaatggcagaagtaggattgtgaacccagggaatctccagagcctctgtgtaaccatgatgttatattttttttcctctttaaaaacaaaatttaaaaccttgctataatctcttattaggaaatgatcatagtttctgactgtgctctgccttcccatcctgccaatctcctggactggcttggagaagacagggggcccccgagcttcatctgtgactcgaaggagtttgctgctgtctcctgtgtcagtgtcccatctatgcaggatcagcacaggacccccctcaccttcccacttacactctagcctttccatacattggaattctctcctggccctagccagcgctccacacctgttggtgtgccacctccctccctcttcccccactggccttgaacaggcaaaccccctaatgtcgccactaggttgggtccgtgactaggacacctgctagagggtctgtgcttgggccttttctaggaatcccgatgttactgggtaagtgccaactctgtgggcagaatgctaatgataatcctgttccctgacctctttctcagaagtaccctggctcactctccccaatctcagctttatagaacaacattttggtcttgattattcccatatcaagctgccccagggcttcggtaagctgttagttgccccactgcctcaaggctgggtctggctgagctacttcttaggcacacaaatagtgggtgtctccttggaacctgacacaaaactatcagtgctaccaagccttgtaaaatagggaggaaactaatatttcttgagtggcttctgagtgcctggtgctttcgcggctctctggagagattccttgccctgatggctttggtgtgtactcctctcccaggacttcagcactgagattttcccaaccccctggcttttcctcaccttgggttgagttgatccggcactaccacaaaccccaccatctgcaaaccaaccaagattaggcagtatgccctttccgtcttgcactgctcttccaaaacttccatctgtatttctcacaccctcagtaagcaaagctgagtgtgcatggacagagctgcatccactgctttctcccagcgggtgcagtctaatctgacacggggaacactaggagtttagcggaatcttcagccaccctattaatgtgttacgcattaggcattgtagtggaaactcctctgatggctcatgactatatgaacaggagcaatttggaatataacatgtcagctgtggactgggaagtgccgtgagagaaaacactacctgggtcataggcttgggtccctgaggcaacccagcagggacactgttgcccattcctctcatccagactgcaggtgtcttcctacacctccctgtcccatagcctccgtcctgttttttgtttgtttgtttttctttgtgaatgtagaaaaacatttcatcatgagccctagctcctcagttttccacctaacacccacattcccttgtttctaactgccgtgtttttctggagcctgctgggatctttgcagtttgcaggtcatagaatcagacatgaaaaggcttctcttccgacgtcattggttcctggctcctttacagatgagaacacaggtccagaggtgagaaatgactctagcagggtcatagaatttgttagtgcagctcaagatgggacttaaactcaggcctcctgatcacccattcccaggctaggaaacaggtctctgctcggtgtggtggttcatacctgtaatcgcaacactttgggaggctgaggcaggagcattgcttgagcccaggagttcgagaccagtctgagcaacatagtgggaccctgtctctacaaaaacttttaaaattagctgggcatggtggcacacatctgtattcccagctactcaggaagctgagacaggaggatcgcttgagcccaggagttggaggttactgagctatgatcgcaccactgcactccagcttggtgacagtgagaccctcaaaaaaaaaaagaaaagaaagaggtctctacacaagcccgtgattcttcatggcaagggataacatcagaaatgtttcattttctgctattagtttccattcctttccccatccaggcataaagagaaacaaaagacaatgatggtattctctgtgtcctcagctttggcacttttgttgatgttgctaaggagcagtgaccttgctaaaaagactgaataatccacccactgaatagctaacctggggaggaaatgaaaatttcctttgtggatctccccaaatccattgttgtcaccaggccctcccagaacctcctcagttccttcacagtgcaaccctgtgtacttggcccgcaacccaatagtattgtgcctcacttcaccttccatgggcaactgccctcccttctggacataaaacctcatattttaaataaagttgaaatatgaaaagaaagta

SEQ ID NO: 299628 - DNA, 4394 bp, Homo sapiens
cacgctcagagcagaccgctagcaggaggcaggatgtgatagtctaagaccctggaagctgacggccagagggagggaagggtggtcacagaggagaggcaaagcaacgggaggtggaggatcctggaggtgtctgcaaggagaatacacagcagcgaggggctgcagaagcggacccagcgacttctgcgctgacgcggggcgggcgggagagaggaagagaggggagcgcggtggcgctgcgagctggccccgccggggaaggggctgccatgtcccgtgagcggcccccgggcaccgacattccccgcaacctgagcttcatcgccgcgctaacggagcgcgcctactaccgtagccagcggcccagcctcgaggaggagccggaggaggagccaggcgagggcgggacgcggttcggggcccgatcccgcgctcacgcaccgagtcggggccgccgggcccgatctgcaccagccggaggcggcggggcccgggcgccccgcagccgtagcccagacacccgcaagagagtgcgtttcgccgacgcactggggttggagctggctgtcgtgcgccgcttccgtcccggtgagctgccccgggtgccccgccacgtgcagatccaattgcagagggacgccctccgccacttcgcgccctgccagccccgcgcccgcggcctccaggaggcgcgcgccgccctggagccggccagcgagcccggcttcgccgcccgcttgctgacgcagcgcatctgcctggaacgcgccgaggcgggcccgctgggcgtggccgggagcgcgcgcgtggtggacctggcctacgagaagcgcgtgagcgtgcgctggagcgccgacggctggcggagccaacgcgaggcgccagccgcctacgccggtccggccccgcccccgccgcgcgccgaccgcttcgccttccgcctgcccgcgccgccgattgggggcgccctgctcttcgccttgcgctaccgtgtgacaggtcacgagttctgggacaacaacggcggccgtgactatgctctacgtgggcccgagcacccgggcagtggcggagctccggagccgcagggctggatccactttatctgagacgaggcgcctgcggccgacggcggaaaacaccaaaggcacccgggggcggggcgacccgatgtggcggggaggagtaggagagaccaggattggcgggagcggtccaagggagtcaagccggggagggcgaaaaggaagggatggaaaccctattttcttttctccaagaccatggttggtctgcttccctcactcgggctccttgacagtcttctagaagagagaaggaggaaaagaagcagttcctgatgttacaaatgaacaaggatctcccagccttagtctttgagaaaagatggctgaaagagaggaactctccaagtcattccgcaaacaaatgcccatttaaacatcatccttgtcttgtgaagaaaacaggaagaatgtcatgtaccatgtggatcaccttcagttcaaagttgcagcaaagtgaagaaagaaactactggaagccacccagcaatgcactgtttagtcatcaattaggagcccatgggaggataatagggagactgggtggaggctcagtgtgtaataatctcttgtctaatgtatgtgtgtcactgccatgttgtatgaacaatagtgagggctcacatttacttaacacttgtgtgcgcaaatctgggtttttcttcctttccagaactatgactcgatcataaaatctgttttgtttgcatgcatgcccaaaacaaccctgtaagtagaacattgtcattatctctgttttagagatgaggaaacaggctcagagaagctcagaaatttgttcaagatcgcacagctagtaaatggcagaagtaggattgtgaacccagggaatctccagagcctctgtgtaaccatgatgttatattttttttcctctttaaaaacaaaatttaaaaccttgctataatctcttattaggaaatgatcatagtttctgactgtgctctgccttcccatcctgccaatctcctggactggcttggagaagacagggggcccccgagcttcatctgtgactcgaaggagtttgctgctgtctcctgtgtcagtgtcccatctatgcaggatcagcacaggacccccctcaccttcccacttacactctagcctttccatacattggaattctctcctggccctagccagcgctccacacctgttggtgtgccacctccctccctcttcccccactggccttgaacaggcaaaccccctaatgtcgccactaggttgggtccgtgactaggacacctgctagagggtctgtgcttgggccttttctaggaatcccgatgttactgggtaagtgccaactctgtgggcagaatgctaatgataatcctgttccctgacctctttctcagaagtaccctggctcactctccccaatctcagctttatagaacaacattttggtcttgattattcccatatcaagctgccccagggcttcggtaagctgttagttgccccactgcctcaaggctgggtctggctgagctacttcttaggcacacaaatagtgggtgtctccttggaacctgacacaaaactatcagtgctaccaagccttgtaaaatagggaggaaactaatatttcttgagtggcttctgagtgcctggtgctttcgcggctctctggagagattccttgccctgatggctttggtgtgtactcctctcccaggacttcagcactgagattttcccaaccccctggcttttcctcaccttgggttgagttgatccggcactaccacaaaccccaccatctgcaaaccaaccaagattaggcagtatgccctttccgtcttgcactgctcttccaaaacttccatctgtatttctcacaccctcagtaagcaaagctgagtgtgcatggacagagctgcatccactgctttctcccagcgggtgcagtctaatctgacacggggaacactaggagtttagcggaatcttcagccaccctattaatgtgttacgcattaggcattgtagtggaaactcctctgatggctcatgactatatgaacaggagcaatttggaatataacatgtcagctgtggactgggaagtgccgtgagagaaaacactacctgggtcataggcttgggtccctgaggcaacccagcagggacactgttgcccattcctctcatccagactgcaggtgtcttcctacacctccctgtcccatagcctccgtcctgttttttgtttgtttgtttttctttgtgaatgtagaaaaacatttcatcatgagccctagctcctcagttttccacctaacacccacattcccttgtttctaactgccgtgtttttctggagcctgctgggatctttgcagtttgcaggtcatagaatcagacatgaaaaggcttctcttccgacgtcattggttcctggctcctttacagatgagaacacaggtccagaggtgagaaatgactctagcagggtcatagaatttgttagtgcagctcaagatgggacttaaactcaggcctcctgatcacccattcccaggctaggaaacaggtctctgctcggtgtggtggttcatacctgtaatcgcaacactttgggaggctgaggcaggagcattgcttgagcccaggagttcgagaccagtctgagcaacatagtgggaccctgtctctacaaaaacttttaaaattagctgggcatggtggcacacatctgtattcccagctactcaggaagctgagacaggaggatcgcttgagcccaggagttggaggttactgagctatgatcgcaccactgcactccagcttggtgacagtgagaccctcaaaaaaaaaaagaaaagaaagaggtctctacacaagcccgtgattcttcatggcaagggataacatcagaaatgtttcattttctgctattagtttccattcctttccccatccaggcataaagagaaacaaaagacaatgatggtattctctgtgtcctcagctttggcacttttgttgatgttgctaaggagcagtgaccttgctaaaaagactgaataatccacccactgaatagctaacctggggaggaaatgaaaatttcctttgtggatctccccaaatccattgttgtcaccaggccctcccagaacctcctcagttccttcacagtgcaaccctgtgtacttggcccgcaacccaatagtattgtgcctcacttcaccttccatgggcaactgccctcccttctggacataaaacctcatattttaaataaagttgaaatatgaaaagaaagta

SEQ ID NO: 299629 - DNA, 3507 bp, Homo sapiens
aacttgaatagtaaatggcaccagaagatggcagtctgctccataaccagagcaagtgcagtgggaaagctggactctcatacccactcacattcatgccttatataagcctctcctcctggttaaccttaacaggggagtgattcctctgctggttgctgtttttccttttctcttaccctattcctaacctctttgcttctctctttctttccttgtgtctcttccttctcttttctttttttttttaacatatagggtatttttttcttttaacatatagggtatttaccttcattttgtttatttccatttgtttccttcttcattcatgttcatctctgctattccttctccctccagaagggatggaaaccctattttcttttctccaagaccatggttggtctgcttccctcactcgggctccttgacagtcttctagaagagagaaggaggaaaagaagcagttcctgatgttacaaatgaacaaggatctcccagccttagtctttgagaaaagatggctgaaagagaggaactctccaagtcattccgcaaacaaatgcccatttaaacatcatccttgtcttgtgaagaaaacaggaagaatgtcatgtaccatgtggatcaccttcagttcaaagttgcagcaaagtgaagaaagaaactactggaagccacccagcaatgcactgtttagtcatcaattaggagcccatgggaggataatagggagactgggtggaggctcagtgtgtaataatctcttgtctaatgtatgtgtgtcactgccatgttgtatgaacaatagtgagggctcacatttacttaacacttgtgtgcgcaaatctgggtttttcttcctttccagaactatgactcgatcataaaatctgttttgtttgcatgcatgcccaaaacaaccctgtaagtagaacattgtcattatctctgttttagagatgaggaaacaggctcagagaagctcagaaatttgttcaagatcgcacagctagtaaatggcagaagtaggattgtgaacccagggaatctccagagcctctgtgtaaccatgatgttatattttttttcctctttaaaaacaaaatttaaaaccttgctataatctcttattaggaaatgatcatagtttctgactgtgctctgccttcccatcctgccaatctcctggactggcttggagaagacagggggcccccgagcttcatctgtgactcgaaggagtttgctgctgtctcctgtgtcagtgtcccatctatgcaggatcagcacaggacccccctcaccttcccacttacactctagcctttccatacattggaattctctcctggccctagccagcgctccacacctgttggtgtgccacctccctccctcttcccccactggccttgaacaggcaaaccccctaatgtcgccactaggttgggtccgtgactaggacacctgctagagggtctgtgcttgggccttttctaggaatcccgatgttactgggtaagtgccaactctgtgggcagaatgctaatgataatcctgttccctgacctctttctcagaagtaccctggctcactctccccaatctcagctttatagaacaacattttggtcttgattattcccatatcaagctgccccagggcttcggtaagctgttagttgccccactgcctcaaggctgggtctggctgagctacttcttaggcacacaaatagtgggtgtctccttggaacctgacacaaaactatcagtgctaccaagccttgtaaaatagggaggaaactaatatttcttgagtggcttctgagtgcctggtgctttcgcggctctctggagagattccttgccctgatggctttggtgtgtactcctctcccaggacttcagcactgagattttcccaaccccctggcttttcctcaccttgggttgagttgatccggcactaccacaaaccccaccatctgcaaaccaaccaagattaggcagtatgccctttccgtcttgcactgctcttccaaaacttccatctgtatttctcacaccctcagtaagcaaagctgagtgtgcatggacagagctgcatccactgctttctcccagcgggtgcagtctaatctgacacggggaacactaggagtttagcggaatcttcagccaccctattaatgtgttacgcattaggcattgtagtggaaactcctctgatggctcatgactatatgaacaggagcaatttggaatataacatgtcagctgtggactgggaagtgccgtgagagaaaacactacctgggtcataggcttgggtccctgaggcaacccagcagggacactgttgcccattcctctcatccagactgcaggtgtcttcctacacctccctgtcccatagcctccgtcctgttttttgtttgtttgtttttctttgtgaatgtagaaaaacatttcatcatgagccctagctcctcagttttccacctaacacccacattcccttgtttctaactgccgtgtttttctggagcctgctgggatctttgcagtttgcaggtcatagaatcagacatgaaaaggcttctcttccgacgtcattggttcctggctcctttacagatgagaacacaggtccagaggtgagaaatgactctagcagggtcatagaatttgttagtgcagctcaagatgggacttaaactcaggcctcctgatcacccattcccaggctaggaaacaggtctctgctcggtgtggtggttcatacctgtaatcgcaacactttgggaggctgaggcaggagcattgcttgagcccaggagttcgagaccagtctgagcaacatagtgggaccctgtctctacaaaaacttttaaaattagctgggcatggtggcacacatctgtattcccagctactcaggaagctgagacaggaggatcgcttgagcccaggagttggaggttactgagctatgatcgcaccactgcactccagcttggtgacagtgagaccctcaaaaaaaaaaagaaaagaaagaggtctctacacaagcccgtgattcttcatggcaagggataacatcagaaatgtttcattttctgctattagtttccattcctttccccatccaggcataaagagaaacaaaagacaatgatggtattctctgtgtcctcagctttggcacttttgttgatgttgctaaggagcagtgaccttgctaaaaagactgaataatccacccactgaatagctaacctggggaggaaatgaaaatttcctttgtggatctccccaaatccattgttgtcaccaggccctcccagaacctcctcagttccttcacagtgcaaccctgtgtacttggcccgcaacccaatagtattgtgcctcacttcaccttccatgggcaactgccctcccttctggacataaaacctcatattttaaataaagttgaaatatgaaaagaaagta

SEQ ID NO: 299630 - DNA, 3161 bp, Homo sapiens
cacgctcagagcagaccgctagcaggaggcaggatgtgatagtctaagaccctggaagctgacggccagagggagggaagggtggtcacagaggagaggcaaagcaacgggaggtggaggatcctggaggtgtctgcaaggagaatacacagcagcgaggggctgcagaagcggacccagcgacttctgcgctgacgcggggcgggcgggagagaggaagagaggggagcgcggtggcgctgcgagctggccccgccggggaaggggctgccatgtcccgtgagcggcccccgggcaccgacattccccgcaacctgagcttcatcgccgcgctaacggagcgcgcctactaccgtagccagcggcccagcctcgaggaggagccggaggaggagccaggcgagggcgggacgcggttcggggcccgatcccgcgctcacgcaccgagtcggggccgccgggcccgatctgcaccagccggaggcggcggggcccgggcgccccgcagccgtagcccagacacccgcaagagagtgcgtttcgccgacgcactggggttggagctggctgtcgtgcgccgcttccgtcccggtgagctgccccgggtgccccgccacgtgcagatccaattgcagagggacgccctccgccacttcgcgccctgccagccccgcgcccgcggcctccaggaggcgcgcgccgccctggagccggccagcgagcccggcttcgccgcccgcttgctgacgcagcgcatctgcctggaacgcgccgaggcgggcccgctgggcgtggccgggagcgcgcgcgtggtggacctggcctacgagaagcgcgtgagcgtgcgctggagcgccgacggctggcggagccaacgcgaggcgccagccgcctacgccggtccggccccgcccccgccgcgcgccgaccgcttcgccttccgcctgcccgcgccgccgattgggggcgccctgctcttcgccttgcgctaccgtgtgacaggtcacgagttctgggacaacaacggcggccgtgactatgctctacgtgggcccgagcacccgggcagtggcggagctccggagccgcagggctggatccactttatctgagacgaggcgcctgcggccgacggcggaaaacaccaaaggcacccgggggcggggcgacccgatgtggcggggaggagtaggagagaccaggattggcgggagcggtccaagggagtcaagccggggagggcgaaaagggtggggaaatcaggggcgtgggggcgtgggggcgtgggggcggggggagtgagcggaaccaaagaagctccgggagatccgggtgttaaaagctggttggatgtgagtggaaggaactcagaatataggaggaaggagacccgaaacggcaccggagggattataaaaaaaggaaaagaatggggatgatggtggccttcccttcagtgagtgggctctgggagaaagggaggaggtccatcaggcctaggcggttgaagaaggttaagaaccttttggagatggaggaggtatgatgtgaagtagcccacccagtcgaaggcatttacattgctggcgcattccctcttcttaccggccttttccacctcagatccccctgtcctacccatcctagctttaactcagccataattgccttgcttaatcccaggaacctggccactgctccttggtccttggcattatgacgggattcccttgtcacctctgacagttcctggctgcggtgtccgcggactggctggggagtgatgacaggtagctatcagagctccagcctccaggcagctttagggattaaaacggaggccaaagcaactccagacctgtttttatagccaaatactgagcctcaggggttgtacactcaggggcttccaggaaaatgccagccttacttttctggggtgccttttaataacctccaagcactttgtggactgtttgtcgagggacggtgaatcagaagaatcactattctgatttcctttgtctccgaagaggaagtccctgactagctatataactttgggcgagttacctctcacttctttgtgccccagtgttctccttgggaaactggatttaggttagatgaccttttaaggctccttgtatgatattttgtgatctgtacatggcagagtatagattaggagccaaattttccaacctagtgctatggttcagaatacatagcaccccaagcgtctggctggagccgaggatgggtcctccagtttttggcacagatgttccggagcccaggaagcatcccataaccaaccttcagccccaccgccacccccagcgtattccagagccgcttccaaaccacagcctatcctctgctccatttcactcttgccctcacagactttcagcctccatgctctgagacaactgtggaagggatggaaaccctattttcttttctccaagaccatggttggtctgcttccctcactcgggctccttgacagtcttctagaagagagaaggaggaaaagaagcagttcctgatgttacaaatgaacaaggatctcccagaaaacaggaagaatgtcatgtaccatgtggatcaccttcagttcaaagttgcagcaaagtgaagaaagaaactactggaagccacccagcaatgcactgtttagtcatcaattaggagcccatgggaggataatagggagactgggtggaggctcagtgtgtaataatctcttgtctaatgtatgtgtgtcactgccatgttgtatgaacaatagtgagggctcacatttacttaacacttgtgtgcgcaaatctgggtttttcttcctttccagaactatgactcgatcataaaatctgttttgtttgcatgcatgcccaaaacaaccctgtaagtagaacattgtcattatctctgttttagagatgaggaaacaggctcagagaagctcagaaatttgttcaagatcgcacagctagtaaatggcagaagtaggattgtgaacccagggaatctccagagcctctgtgtaaccatgatgttatattttttttcctctttaaaaacaaaatttaaaacctttgagaaaaaacaaaaaaacatgtcaatcacgtataagaaataaaaatatcccttgg

SEQ ID NO: 299631 - DNA, 3942 bp, Homo sapiens
cacgctcagagcagaccgctagcaggaggcaggatgtgatagtctaagaccctggaagctgacggccagagggagggaagggtggtcacagaggagaggcaaagcaacgggaggtggaggatcctggaggtgtctgcaaggagaatacacagcagcgaggggctgcagaagcggacccagcgacttctgcgctgacgcggggcgggcgggagagaggaagagaggggagcgcggtggcgctgcgagctggccccgccggggaaggggctgccatgtcccgtgagcggcccccgggcaccgacattccccgcaacctgagcttcatcgccgcgctaacggagcgcgcctactaccgtagccagcggcccagcctcgaggaggagccggaggaggagccaggcgagggcgggacgcggttcggggcccgatcccgcgctcacgcaccgagtcggggccgccgggcccgatctgcaccagccggaggcggcggggcccgggcgccccgcagccgtagcccagacacccgcaagagagtgcgtttcgccgacgcactggggttggagctggctgtcgtgcgccgcttccgtcccggtgagctgccccgggtgccccgccacgtgcagatccaattgcagagggacgccctccgccacttcgcgccctgccagccccgcgcccgcggcctccaggaggcgcgcgccgccctggagccggccagcgagcccggcttcgccgcccgcttgctgacgcagcgcatctgcctggaacgcgccgaggcgggcccgctgggcgtggccgggagcgcgcgcgtggtggacctggcctacgagaagcgcgtgagcgtgcgctggagcgccgacggctggcggagccaacgcgaggcgccagccgcctacgccggtccggccccgcccccgccgcgcgccgaccgcttcgccttccgcctgcccgcgccgccgattgggggcgccctgctcttcgccttgcgctaccgtgtgacaggtcacgagttctgggacaacaacggcggccgtgactatgctctacgtgggcccgagcacccgggcagtggcggagctccggagccgcagggctggatccactttatctgagacgaggcgcctgcggccgacggcggaaaacaccaaaggaacctggccactgctccttggtccttggcattatgacgggattcccttgtcacctctgacagttcctggctgcggtgtccgcggactggctggggagtgatgacagaagggatggaaaccctattttcttttctccaagaccatggttggtctgcttccctcactcgggctccttgacagtcttctagaagagagaaggaggaaaagaagcagttcctgatgttacaaatgaacaaggatctcccagagatgaggaaacaggctcagagaagctcagaaatttgttcaagatcgcacagctagtaaatggcagaagtaggattgtgaacccagggaatctccagagcctctgtgtaaccatgatgttatattttttttcctctttaaaaacaaaatttaaaaccttgctataatctcttattaggaaatgatcatagtttctgactgtgctctgccttcccatcctgccaatctcctggactggcttggagaagacagggggcccccgagcttcatctgtgactcgaaggagtttgctgctgtctcctgtgtcagtgtcccatctatgcaggatcagcacaggacccccctcaccttcccacttacactctagcctttccatacattggaattctctcctggccctagccagcgctccacacctgttggtgtgccacctccctccctcttcccccactggccttgaacaggcaaaccccctaatgtcgccactaggttgggtccgtgactaggacacctgctagagggtctgtgcttgggccttttctaggaatcccgatgttactgggtaagtgccaactctgtgggcagaatgctaatgataatcctgttccctgacctctttctcagaagtaccctggctcactctccccaatctcagctttatagaacaacattttggtcttgattattcccatatcaagctgccccagggcttcggtaagctgttagttgccccactgcctcaaggctgggtctggctgagctacttcttaggcacacaaatagtgggtgtctccttggaacctgacacaaaactatcagtgctaccaagccttgtaaaatagggaggaaactaatatttcttgagtggcttctgagtgcctggtgctttcgcggctctctggagagattccttgccctgatggctttggtgtgtactcctctcccaggacttcagcactgagattttcccaaccccctggcttttcctcaccttgggttgagttgatccggcactaccacaaaccccaccatctgcaaaccaaccaagattaggcagtatgccctttccgtcttgcactgctcttccaaaacttccatctgtatttctcacaccctcagtaagcaaagctgagtgtgcatggacagagctgcatccactgctttctcccagcgggtgcagtctaatctgacacggggaacactaggagtttagcggaatcttcagccaccctattaatgtgttacgcattaggcattgtagtggaaactcctctgatggctcatgactatatgaacaggagcaatttggaatataacatgtcagctgtggactgggaagtgccgtgagagaaaacactacctgggtcataggcttgggtccctgaggcaacccagcagggacactgttgcccattcctctcatccagactgcaggtgtcttcctacacctccctgtcccatagcctccgtcctgttttttgtttgtttgtttttctttgtgaatgtagaaaaacatttcatcatgagccctagctcctcagttttccacctaacacccacattcccttgtttctaactgccgtgtttttctggagcctgctgggatctttgcagtttgcaggtcatagaatcagacatgaaaaggcttctcttccgacgtcattggttcctggctcctttacagatgagaacacaggtccagaggtgagaaatgactctagcagggtcatagaatttgttagtgcagctcaagatgggacttaaactcaggcctcctgatcacccattcccaggctaggaaacaggtctctgctcggtgtggtggttcatacctgtaatcgcaacactttgggaggctgaggcaggagcattgcttgagcccaggagttcgagaccagtctgagcaacatagtgggaccctgtctctacaaaaacttttaaaattagctgggcatggtggcacacatctgtattcccagctactcaggaagctgagacaggaggatcgcttgagcccaggagttggaggttactgagctatgatcgcaccactgcactccagcttggtgacagtgagaccctcaaaaaaaaaaagaaaagaaagaggtctctacacaagcccgtgattcttcatggcaagggataacatcagaaatgtttcattttctgctattagtttccattcctttccccatccaggcataaagagaaacaaaagacaatgatggtattctctgtgtcctcagctttggcacttttgttgatgttgctaaggagcagtgaccttgctaaaaagactgaataatccacccactgaatagctaacctggggaggaaatgaaaatttcctttgtggatctccccaaatccattgttgtcaccaggccctcccagaacctcctcagttccttcacagtgcaaccctgtgtacttggcccgcaacccaatagtattgtgcctcacttcaccttccatgggcaactgccctcccttctggacataaaacctcatattttaaataaagttgaaatatgaaaagaaagta

SEQ ID NO: 299632 - DNA, 3765 bp, Homo sapiens
cacgctcagagcagaccgctagcaggaggcaggatgtgatagtctaagaccctggaagctgacggccagagggagggaagggtggtcacagaggagaggcaaagcaacgggaggtggaggatcctggaggtgtctgcaaggagaatacacagcagcgaggggctgcagaagcggacccagcgacttctgcgctgacgcggggcgggcgggagagaggaagagaggggagcgcggtggcgctgcgagctggccccgccggggaaggggctgccatgtcccgtgagcggcccccgggcaccgacattccccgcaacctgagcttcatcgccgcgctaacggagcgcgcctactaccgtagccagcggcccagcctcgaggaggagccggaggaggagccaggcgagggcgggacgcggttcggggcccgatcccgcgctcacgcaccgagtcggggccgccgggcccgatctgcaccagccggaggcggcggggcccgggcgccccgcagccgtagcccagacacccgcaagagagtgcgtttcgccgacgcactggggttggagctggctgtcgtgcgccgcttccgtcccggtgagctgccccgggtgccccgccacgtgcagatccaattgcagagggacgccctccgccacttcgcgccctgccagccccgcgcccgcggcctccaggaggcgcgcgccgccctggagccggccagcgagcccggcttcgccgcccgcttgctgacgcagcgcatctgcctggaacgcgccgaggcgggcccgctgggcgtggccgggagcgcgcgcgtggtggacctggcctacgagaagcgcgtgagcgtgcgctggagcgccgacggctggcggagccaacgcgaggcgccagccgcctacgccggtccggccccgcccccgccgcgcgccgaccgcttcgccttccgcctgcccgcgccgccgattgggggcgccctgctcttcgccttgcgctaccgtgtgacaggtcacgagttctgggacaacaacggcggccgtgactatgctctacgtgggcccgagcacccgggcagtggcggagctccggagccgcagggctggatccactttatctgagacgaggcgcctgcggccgacggcggaaaacaccaaaggaacctggccactgctccttggtccttggcattatgacgggattcccttgtcacctctgacagttcctggctgcggtgtccgcggactggctggggagtgatgacagaagggatggaaaccctattttcttttctccaagaccatggttggtctgcttccctcactcgggctccttgacagtcttctagaagagagaaggaggaaaagaagcagttcctgatgttacaaatgaacaaggatctcccaggaaatgatcatagtttctgactgtgctctgccttcccatcctgccaatctcctggactggcttggagaagacagggggcccccgagcttcatctgtgactcgaaggagtttgctgctgtctcctgtgtcagtgtcccatctatgcaggatcagcacaggacccccctcaccttcccacttacactctagcctttccatacattggaattctctcctggccctagccagcgctccacacctgttggtgtgccacctccctccctcttcccccactggccttgaacaggcaaaccccctaatgtcgccactaggttgggtccgtgactaggacacctgctagagggtctgtgcttgggccttttctaggaatcccgatgttactgggtaagtgccaactctgtgggcagaatgctaatgataatcctgttccctgacctctttctcagaagtaccctggctcactctccccaatctcagctttatagaacaacattttggtcttgattattcccatatcaagctgccccagggcttcggtaagctgttagttgccccactgcctcaaggctgggtctggctgagctacttcttaggcacacaaatagtgggtgtctccttggaacctgacacaaaactatcagtgctaccaagccttgtaaaatagggaggaaactaatatttcttgagtggcttctgagtgcctggtgctttcgcggctctctggagagattccttgccctgatggctttggtgtgtactcctctcccaggacttcagcactgagattttcccaaccccctggcttttcctcaccttgggttgagttgatccggcactaccacaaaccccaccatctgcaaaccaaccaagattaggcagtatgccctttccgtcttgcactgctcttccaaaacttccatctgtatttctcacaccctcagtaagcaaagctgagtgtgcatggacagagctgcatccactgctttctcccagcgggtgcagtctaatctgacacggggaacactaggagtttagcggaatcttcagccaccctattaatgtgttacgcattaggcattgtagtggaaactcctctgatggctcatgactatatgaacaggagcaatttggaatataacatgtcagctgtggactgggaagtgccgtgagagaaaacactacctgggtcataggcttgggtccctgaggcaacccagcagggacactgttgcccattcctctcatccagactgcaggtgtcttcctacacctccctgtcccatagcctccgtcctgttttttgtttgtttgtttttctttgtgaatgtagaaaaacatttcatcatgagccctagctcctcagttttccacctaacacccacattcccttgtttctaactgccgtgtttttctggagcctgctgggatctttgcagtttgcaggtcatagaatcagacatgaaaaggcttctcttccgacgtcattggttcctggctcctttacagatgagaacacaggtccagaggtgagaaatgactctagcagggtcatagaatttgttagtgcagctcaagatgggacttaaactcaggcctcctgatcacccattcccaggctaggaaacaggtctctgctcggtgtggtggttcatacctgtaatcgcaacactttgggaggctgaggcaggagcattgcttgagcccaggagttcgagaccagtctgagcaacatagtgggaccctgtctctacaaaaacttttaaaattagctgggcatggtggcacacatctgtattcccagctactcaggaagctgagacaggaggatcgcttgagcccaggagttggaggttactgagctatgatcgcaccactgcactccagcttggtgacagtgagaccctcaaaaaaaaaaagaaaagaaagaggtctctacacaagcccgtgattcttcatggcaagggataacatcagaaatgtttcattttctgctattagtttccattcctttccccatccaggcataaagagaaacaaaagacaatgatggtattctctgtgtcctcagctttggcacttttgttgatgttgctaaggagcagtgaccttgctaaaaagactgaataatccacccactgaatagctaacctggggaggaaatgaaaatttcctttgtggatctccccaaatccattgttgtcaccaggccctcccagaacctcctcagttccttcacagtgcaaccctgtgtacttggcccgcaacccaatagtattgtgcctcacttcaccttccatgggcaactgccctcccttctggacataaaacctcatattttaaataaagttgaaatatgaaaagaaagta

SEQ ID NO: 299633 - DNA, 2259 bp, Homo sapiens
ctaggcagagagaacagcataagcaaaaacagagatgagaaagtgtgtagtgggacagtgcaaagttctttttgactctagcctttccatacattggaattctctcctggccctagccagcgctccacacctgttggtgtgccacctccctccctcttcccccactggccttgaacaggcaaaccccctaatgtcgccactaggttgggtccgtgactaggacacctgctagagggtctgtgcttgggccttttctaggaatcccgatgttactgggtaagtgccaactctgtgggcagaatgctaatgataatcctgttccctgacctctttctcagaagtaccctggctcactctccccaatctcagctttatagaacaacattttggtcttgattattcccatatcaagctgccccagggcttcggtaagctgttagttgccccactgcctcaaggctgggtctggctgagctacttcttaggcacacaaatagtgggtgtctccttggaacctgacacaaaactatcagtgctaccaagccttgtaaaatagggaggaaactaatatttcttgagtggcttctgagtgcctggtgctttcgcggctctctggagagattccttgccctgatggctttggtgtgtactcctctcccaggacttcagcactgagattttcccaaccccctggcttttcctcaccttgggttgagttgatccggcactaccacaaaccccaccatctgcaaaccaaccaagattaggcagtatgccctttccgtcttgcactgctcttccaaaacttccatctgtatttctcacaccctcagtaagcaaagctgagtgtgcatggacagagctgcatccactgctttctcccagcgggtgcagtctaatctgacacggggaacactaggagtttagcggaatcttcagccaccctattaatgtgttacgcattaggcattgtagtggaaactcctctgatggctcatgactatatgaacaggagcaatttggaatataacatgtcagctgtggactgggaagtgccgtgagagaaaacactacctgggtcataggcttgggtccctgaggcaacccagcagggacactgttgcccattcctctcatccagactgcaggtgtcttcctacacctccctgtcccatagcctccgtcctgttttttgtttgtttgtttttctttgtgaatgtagaaaaacatttcatcatgagccctagctcctcagttttccacctaacacccacattcccttgtttctaactgccgtgtttttctggagcctgctgggatctttgcagtttgcaggtcatagaatcagacatgaaaaggcttctcttccgacgtcattggttcctggctcctttacagatgagaacacaggtccagaggtgagaaatgactctagcagggtcatagaatttgttagtgcagctcaagatgggacttaaactcaggcctcctgatcacccattcccaggctaggaaacaggtctctgctcggtgtggtggttcatacctgtaatcgcaacactttgggaggctgaggcaggagcattgcttgagcccaggagttcgagaccagtctgagcaacatagtgggaccctgtctctacaaaaacttttaaaattagctgggcatggtggcacacatctgtattcccagctactcaggaagctgagacaggaggatcgcttgagcccaggagttggaggttactgagctatgatcgcaccactgcactccagcttggtgacagtgagaccctcaaaaaaaaaaagaaaagaaagaggtctctacacaagcccgtgattcttcatggcaagggataacatcagaaatgtttcattttctgctattagtttccattcctttccccatccaggcataaagagaaacaaaagacaatgatggtattctctgtgtcctcagctttggcacttttgttgatgttgctaaggagcagtgaccttgctaaaaagactgaataatccacccactgaatagctaacctggggaggaaatgaaaatttcctttgtggatctccccaaatccattgttgtcaccaggccctcccagaacctcctcagttccttcacagtgcaaccctgtgtacttggcccgcaacccaatagtattgtgcctcacttcaccttccatgggcaactgccctcccttctggacataaaacctcatattttaaataaagttgaaatatgaaaagaaagta

SEQ ID NO: 299634 - DNA, 2999 bp, Homo sapiens
cacgctcagagcagaccgctagcaggaggcaggatgtgatagtctaagaccctggaagctgacggccagagggagggaagggtggtcacagaggagaggcaaagcaacgggaggtggaggatcctggaggtgtctgcaaggagaatacacagcagcgaggggctgcagaagcggacccagcgacttctgcgctgacgcggggcgggcgggagagaggaagagaggggagcgcggtggcgctgcgagctggccccgccggggaaggggctgccatgtcccgtgagcggcccccgggcaccgacattccccgcaacctgagcttcatcgccgcgctaacggagcgcgcctactaccgtagccagcggcccagcctcgaggaggagccggaggaggagccaggcgagggcgggacgcggttcggggcccgatcccgcgctcacgcaccgagtcggggccgccgggcccgatctgcaccagccggaggcggcggggcccgggcgccccgcagccgtagcccagacacccgcaagagagtgcgtttcgccgacgcactggggttggagctggctgtcgtgcgccgcttccgtcccggtgagctgccccgggtgccccgccacgtgcagatccaattgcagagggacgccctccgccacttcgcgccctgccagccccgcgcccgcggcctccaggaggcgcgcgccgccctggagccggccagcgagcccggcttcgccgcccgcttgctgacgcagcgcatctgcctggaacgcgccgaggcgggcccgctgggcgtggccgggagcgcgcgcgtggtggacctggcctacgagaagcgcgtgagcgtgcgctggagcgccgacggctggcggagccaacgcgaggcgccagccgcctacgccggtccggccccgcccccgccgcgcgccgaccgcttcgccttccgcctgcccgcgccgccgattgggggcgccctgctcttcgccttgcgctaccgtgtgacaggtcacgagttctgggacaacaacggcggccgtgactatgctctacgtgggcccgagcacccgggcagtggcggagctccggagccgcagggctggatccactttatctgagacgaggcgcctgcggccgacggcggaaaacaccaaaggcacccgggggcggggcgacccgatgtggcggggaggagtaggagagaccaggattggcgggagcggtccaagggagtcaagccggggagggcgaaaagggtggggaaatcaggggcgtgggggcgtgggggcgtgggggcggggggagtgagcggaaccaaagaagctccgggagatccgggtgttaaaagctggttggatgtgagtggaaggaactcagaatataggaggaaggagacccgaaacggcaccggagggattataaaaaaaggaaaagaatggggatgatggtggccttcccttcagtgagtgggctctgggagaaagggaggaggtccatcaggcctaggcggttgaagaaggttaagaaccttttggagatggaggaggtatgatgtgaagtagcccacccagtcgaaggcatttacattgctggcgcattccctcttcttaccggccttttccacctcagatccccctgtcctacccatcctagctttaactcagccataattgccttgcttaatcccaggaacctggccactgctccttggtccttggcattatgacgggattcccttgtcacctctgacagttcctggctgcggtgtccgcggactggctggggagtgatgacaggtagctatcagagctccagcctccaggcagctttagggattaaaacggaggccaaagcaactccagacctgtttttatagccaaatactgagcctcaggggttgtacactcaggggcttccaggaaaatgccagccttacttttctggggtgccttttaataacctccaagcactttgtggactgtttgtcgagggacggtgaatcagaagaatcactattctgatttcctttgtctccgaagaggaagtccctgactagctatataactttgggcgagttacctctcacttctttgtgccccagtgttctccttgggaaactggatttaggttagatgaccttttaaggctccttgtatgatattttgtgatctgtacatggcagagtatagattaggagccaaattttccaacctagtgctatggttcagaatacatagcaccccaagcgtctggctggagccgaggatgggtcctccagtttttggcacagatgttccggagcccaggaagcatcccataaccaaccttcagccccaccgccacccccagcgtattccagagccgcttccaaaccacagcctatcctctgctccatttcactcttgccctcacagactttcagcctccatgctctgagacaactgtggaagggatggaaaccctattttcttttctccaagaccatggttggtctgcttccctcactcgggctccttgacagtcttctagaagagagaaggaggaaaagaagcagttcctgatgttacaaatgaacaaggatctcccaggtaaccagctccccacacccatttctgttactaatttctcaaacagaaatttctggttccccttcttccttatcactgagtgaaaggggacaggcatgcacatgtgcccatacatgcattcagaatagagtgtgggggcaggggcggtagttcattcctgtaatcccagcactttgggaggctgagttaggtggatcatttgaggtcaggagttcaagactagcctggccacatactgaaccctgtctctactaaaaatacaaaaattagccgggcatggtgattcatgcctgtagtcccagctactcatgaggctgaggcaggagaatcactttaacggggagacagaggttgcagtgagctgagattgcaccactgcactccagcctgggtgacagagtgagactccgtctcaaa

SEQ ID NO: 299635 - DNA, 2177 bp, Homo sapiens
cacgctcagagcagaccgctagcaggaggcaggatgtgatagtctaagaccctggaagctgacggccagagggagggaagggtggtcacagaggagaggcaaagcaacgggaggtggaggatcctggaggtgtctgcaaggagaatacacagcagcgaggggctgcagaagcggacccagcgacttctgcgctgacgcggggcgggcgggagagaggaagagaggggagcgcggtggcgctgcgagctggccccgccggggaaggggctgccatgtcccgtgagcggcccccgggcaccgacattccccgcaacctgagcttcatcgccgcgctaacggagcgcgcctactaccgtagccagcggcccagcctcgaggaggagccggaggaggagccaggcgagggcgggacgcggttcggggcccgatcccgcgctcacgcaccgagtcggggccgccgggcccgatctgcaccagccggaggcggcggggcccgggcgccccgcagccgtagcccagacacccgcaagagagtgcgtttcgccgacgcactggggttggagctggctgtcgtgcgccgcttccgtcccggtgagctgccccgggtgccccgccacgtgcagatccaattgcagagggacgccctccgccacttcgcgccctgccagccccgcgcccgcggcctccaggaggcgcgcgccgccctggagccggccagcgagcccggcttcgccgcccgcttgctgacgcagcgcatctgcctggaacgcgccgaggcgggcccgctgggcgtggccgggagcgcgcgcgtggtggacctggcctacgagaagcgcgtgagcgtgcgctggagcgccgacggctggcggagccaacgcgaggcgccagccgcctacgccggtccggccccgcccccgccgcgcgccgaccgcttcgccttccgcctgcccgcgccgccgattgggggcgccctgctcttcgccttgcgctaccgtgtgacaggtcacgagttctgggacaacaacggcggccgtgactatgctctacgtgggcccgagcacccgggcagtggcggagctccggagccgcagggctggatccactttatctgagacgaggcgcctgcggccgacggcggaaaacaccaaaggcacccgggggcggggcgacccgatgtggcggggaggagtaggagagaccaggattggcgggagcggtccaagggagtcaagccggggagggcgaaaagggtggggaaatcaggggcgtgggggcgtgggggcgtgggggcggggggagtgagcggaaccaaagaagctccgggagatccgggtgttaaaagctggttggatgtgagtggaaggaactcagaatataggaggaaggagacccgaaacggcaccggagggattataaaaaaaggaaaagaatggggatgatggtggccttcccttcagtgagtgggctctgggagaaagggaggaggtccatcaggcctaggcggttgaagaaggttaagaaccttttggagatggaggaggtatgatgtgaagtagcccacccagtcgaaggcatttacattgctgggtattctctgtgtcctcagctttggcacttttgttgatgttgctaaggagcagtgaccttgctaaaaagactgaataatccacccactgaatagctaacctggggaggaaatgaaaatttcctttgtggatctccccaaatccattgttgtcaccaggccctcccagaacctcctcagttccttcacagtgcaaccctgtgtacttggcccgcaacccaatagtattgtgcctcacttcaccttccatgggcaactgccctcccttctggacataaaacctcatattttaaataaagttgaaatatgaaaagaaagtatgtcataagatattcagaagtattgtgtgttttgggctaagggcagcaagagactcagaggcaagattccctccttgactcaatttcttggtcaccttgttttttgtgtgtgtgtgtccagaaaaatttaataagtttgcttaaattattataaagttgaaccactgaaatgttcactgaaacattttgacttgcattaatgctttacttccccacctacatttacattaaaaattcacacacaaatgaaaattgaaaactgacaacacctg

SEQ ID NO: 299636 - DNA, 2172 bp, Homo sapiens
cacgctcagagcagaccgctagcaggaggcaggatgtgatagtctaagaccctggaagctgacggccagagggagggaagggtggtcacagaggagaggcaaagcaacgggaggtggaggatcctggaggtgtctgcaaggagaatacacagcagcgaggggctgcagaagcggacccagcgacttctgcgctgacgcggggcgggcgggagagaggaagagaggggagcgcggtggcgctgcgagctggccccgccggggaaggggctgccatgtcccgtgagcggcccccgggcaccgacattccccgcaacctgagcttcatcgccgcgctaacggagcgcgcctactaccgtagccagcggcccagcctcgaggaggagccggaggaggagccaggcgagggcgggacgcggttcggggcccgatcccgcgctcacgcaccgagtcggggccgccgggcccgatctgcaccagccggaggcggcggggcccgggcgccccgcagccgtagcccagacacccgcaagagagtgcgtttcgccgacgcactggggttggagctggctgtcgtgcgccgcttccgtcccggtgagctgccccgggtgccccgccacgtgcagatccaattgcagagggacgccctccgccacttcgcgccctgccagccccgcgcccgcggcctccaggaggcgcgcgccgccctggagccggccagcgagcccggcttcgccgcccgcttgctgacgcagcgcatctgcctggaacgcgccgaggcgggcccgctgggcgtggccgggagcgcgcgcgtggtggacctggcctacgagaagcgcgtgagcgtgcgctggagcgccgacggctggcggagccaacgcgaggcgccagccgcctacgccggtccggccccgcccccgccgcgcgccgaccgcttcgccttccgcctgcccgcgccgccgattgggggcgccctgctcttcgccttgcgctaccgtgtgacaggtcacgagttctgggacaacaacggcggccgtgactatgctctacgtgggcccgagcacccgggcagtggcggagctccggagccgcagggctggatccactttatctgagacgaggcgcctgcggccgacggcggaaaacaccaaaggcacccgggggcggggcgacccgatgtggcggggaggagtaggagagaccaggattggcgggagcggtccaagggagtcaagccggggagggcgaaaagggtggggaaatcaggggcgtgggggcgtgggggcgtgggggcggggggagtgagcggaaccaaagaagctccgggagatccgggtgttaaaagctggttggatgtgagtggaaggaactcagaatataggaggaaggagacccgaaacggcaccggagggattataaaaaaaggaaaagaatggggatgatggtggccttcccttcagtgagtgggctctgggagaaagggaggaggtccatcaggcctaggcggttgaagaaggttaagaaccttttggagatggaggaggtatgatgtgaagtagcccacccagtcgaaggcatttacattgctggcgcattccctcttcttaccggccttttccacctcagatccccctgtcctacccatcctagctttaactcagccataattgccttgcttaatcccaggaacctggccactgctccttggtccttggcattatgacgggattcccttgtcacctctgacagttcctggctgcggtgtccgcggactggctggggagtgatgacagaagggatggaaaccctattttcttttctccaagaccatggttggtctgcttccctcactcgggctccttgacagtcttctagaagagagaaggaggaaaagaagcagttcctgatgttacaaatgaacaaggatctcccagaaaacaggaagaatgtcatgtaccatgtggatcaccttcagttcaaagttgcagcaaagtgaagaaagaaactactggaagccacccagcaatgcactgtttagtcatcaattaggagcccatgggaggataataggacacctccctttgtggtgtgtccccctctttggggggggccccctgtggggggggttaagtaatctgttgtatgaacaatagtgagggctcacatttacttaaa

SEQ ID NO: 299637 - DNA, 1905 bp, Homo sapiens
cacgctcagagcagaccgctagcaggaggcaggatgtgatagtctaagaccctggaagctgacggccagagggagggaagggtggtcacagaggagaggcaaagcaacgggaggtggaggatcctggaggtgtctgcaaggagaatacacagcagcgaggggctgcagaagcggacccagcgacttctgcgctgacgcggggcgggcgggagagaggaagagaggggagcgcggtggcgctgcgagctggccccgccggggaaggggctgccatgtcccgtgagcggcccccgggcaccgacattccccgcaacctgagcttcatcgccgcgctaacggagcgcgcctactaccgtagccagcggcccagcctcgaggaggagccggaggaggagccaggcgagggcgggacgcggttcggggcccgatcccgcgctcacgcaccgagtcggggccgccgggcccgatctgcaccagccggaggcggcggggcccgggcgccccgcagccgtagcccagacacccgcaagagagtgcgtttcgccgacgcactggggttggagctggctgtcgtgcgccgcttccgtcccggtgagctgccccgggtgccccgccacgtgcagatccaattgcagagggacgccctccgccacttcgcgccctgccagccccgcgcccgcggcctccaggaggcgcgcgccgccctggagccggccagcgagcccggcttcgccgcccgcttgctgacgcagcgcatctgcctggaacgcgccgaggcgggcccgctgggcgtggccgggagcgcgcgcgtggtggacctggcctacgagaagcgcgtgagcgtgcgctggagcgccgacggctggcggagccaacgcgaggcgccagccgcctacgccggtccggccccgcccccgccgcgcgccgaccgcttcgccttccgcctgcccgcgccgccgattgggggcgccctgctcttcgccttgcgctaccgtgtgacaggtcacgagttctgggacaacaacggcggccgtgactatgctctacgtgggcccgagcacccgggcagtggcggagctccggagccgcagggctggatccactttatctgagacgaggcgcctgcggccgacggcggaaaacaccaaaggcacccgggggcggggcgacccgatgtggcggggaggagtaggagagaccaggattggcgggagcggtccaagggagtcaagccggggagggcgaaaagggtggggaaatcaggggcgtgggggcgtgggggcgtgggggcggggggagtgagcggaaccaaagaagctccgggagatccgggtgttaaaagctggttggatgtgagtggaaggaactcagaatataggaggaaggagacccgaaacggcaccggagggattataaaaaaaggaaaagaatggggatgatggtggccttcccttcagtgagtgggctctgggagaaagggaggaggtccatcaggcctaggcggttgaagaaggttaagaaccttttggagatggaggaggtatgatgtgaagtagcccacccagtcgaaggcatttacattgctgggtattctctgtgtcctcagctttggcacttttgttgatgttgctaaggagcagtgaccttgctaaaaagactgaataatccacccactgaatagctaacctggggaggaaatgaaaatttcctttgtggatctccccaaatccattgttgtcaccaggccctcccagaacctcctcagttccttcacagtgcaaccctgtgtacttggcccgcaacccaatagtattgtgcctcacttcaccttccatgggcaactgccctcccttctggacataaaacctcatattttaaataaagttgaaatatgaaaagaaagta

SEQ ID NO: 299638 - DNA, 620 bp, Homo sapiens
atgcgggtgatctagaggatcccattaggcgtattctctgtgtcctcagctttggcacttttgttgatgttgctaaggagcagtgaccttgctaaaaagactgaataatccacccactgaatagctaacctggggaggaaatgaaaatttcctttgtggatctccccaaatccattgttgtcaccaggccctcccagaacctcctcagttccttcacagtgcaaccctgtgtacttggcccgcaacccaatagtattgtgcctcacttcaccttccatgggcaactgccctcccttctggacataaaacctcatattttaaataaagttgaaatatgaaaagaaagtatgtcataagatattcagaagtattgtgtgttttgggctaagggcagcaagagactcagaggcaagattccctccttgactcaatttcttggtcaccttgttttttgtgtgtgtgtgtccagaaaaatttaataagtttgcttaaattattataaagttgaaccactgaaatgttcactgaaacattttgacttgcattaatgctttacttccccacctacatttacattaaaaattcacacacaaatgaaaattgaaaactgacaacacctg

SEQ ID NO: 299639 - DNA, 1633 bp, Homo sapiens
ggcggtgccggccgaacccagacccgaggttttagaagcagagtcaggcgaagctgggccagaaccgcgacctccgcaaccttgagcggcatccgtggagtgcgcctgcgcactacgaccgcagcaggaaagcgccgccggccaggcccagctgtggccggacagggactggaagagaggacgcggtcgagtaggtgtgcaccagccctggcaacgagagcgtctaccccgaactctgctggccttgaggtggggaagccggggagggcagttgaggaccccgcggaggcgcgtgactggttgagcgggcaggccagcctccgagccgggtggacacaggttttaaaacatgaatcctacactcatccttgctgccttttgcctgggaattgcctcagctactctaacatttgatcacagtttagaggcacagtggaccaagtggaaggcgatgcacaacagattatacggcatgaatgaagaaggatggaggagagcagtgtgggagaagaacatgaagatgattgaactgcacaatcaggaatacagggaagggaaacacagcttcacaatggccatgaacgcctttggagacatgaccagtgaagaattcaggcaggtgatgaatggctttcaaaaccgtaagcccaggaaggggaaagtgttccaggaacctctgttttatgaggcccccagatctgtggattggagagagaaaggctacgtgactcctgtgaagaatcagggtcagtgtggttcttgttgggcttttagtgctactggtgctcttgaaggacagatgttccggaaaactgggaggcttatctcactgagtgagcagaatctggtagactgctctgggcctcaaggcaatgaaggctgcaatggtggcctaatggattatgctttccagtatgttcaggataatggaggcctggactctgaggaatcctatccatatgaggcaacagaagaatcctgtaagtacaatcccaagtattctgttgctaatgacaccggctttgtggacatccctaagcaggagaaggccctgatgaaggcagttgcaactgtggggcccatttctgttgctattgatgcaggtcatgagtccttcctgttctataaagaaggcatttattttgagccagactgtagcagtgaagacatggatcatggtgtgctggtggttggctacggatttgaaagcacagaatcagataacaataaatattggctggtgaagaacagctggggtgaagaatggggcatgggtggctacgtaaagatggccaaagaccggagaaaccattgtggaattgcctcagcagccagctaccccactgtgtgagctggtggacggtgatgaggaaggacttgactggggatggcgcatgcatgggaggaattcatcttcagtctaccagcccccgctgtgtcggatacacactcgaatcattgaagatccgagtgtgatttgaattctgtgatattttcacactggtaaatgttacctctattttaattactgctataaataggtttatattattgattcacttactgactttgcattttcgtttttaaaaggatgtataaatttttacctgtttaaataaaatttaatttcaaa

SEQ ID NO: 299640 - DNA, 1715 bp, Homo sapiens
ggcggtgccggccgaacccagacccgaggttttagaagcagagtcaggcgaagctgggccagaaccgcgacctccgcaaccttgagcggcatccgtggagtgcgcctgcgcactacgaccgcagcaggaaagcgccgccggccaggcccagctgtggccggacagggactggaagagaggacgcggtcgagtaggtgtgcaccagccctggcaacgagagcgtctaccccgaactctgctggccttgaggtggggaagccggggagggcagttgaggaccccgcggaggcgcgtgactggttgagcgggcaggccagcctccgagccgggtggacacaggttttaaaacatgaatcctacactcatccttgctgccttttgcctgggaattgcctcagctactctaacatttgatcacagtttagaggcacagtggaccaagtggaaggcgatgcacaacagattatacggcatgaatgaagaaggatggaggagagcagtgtgggagaagaacatgaagatgattgaactgcacaatcaggaatacagggaagggaaacacagcttcacaatggccatgaacgcctttggagacatgaccagtgaagaattcaggcaggtgatgaatggctttcaaaaccgtaagcccaggaaggggaaagtgttccaggaacctctgttttatgaggcccccagatctgtggattggagagagaaaggctacgtgactcctgtgaagaatcagggtcagtgtggttcttgttgggcttttagtgctactggtgctcttgaaggacagatgttccggaaaactgggaggcttatctcactgagtgagcagaatctggtagactgctctgggcctcaaggcaatgaaggctgcaatggtggcctaatggattatgctttccagtatgttcaggataatggaggcctggactctgaggaatcctatccatatgaggcaacagaagaatcctgtaagtacaatcccaagtattctgttgctaatgacaccggctttgtggacatccctaagcaggagaaggccctgatgaaggcagttgcaactgtggggcccatttctgttgctattgatgcaggtcatgagtccttcctgttctataaagaaggcatttattttgagccagactgtagcagtgaagacatggatcatggtgtgctggtggttggctacggatttgaaagcacagaatcagataacaataaatattggctggtgaagaacagctggggtgaagaatggggcatgggtggctacgtaaagatggccaaagaccggagaaaccattgtggaattgcctcagcagccagctaccccactgtgtgagctggtggacggtgatgaggaaggacttgactggggatggcgcatgcatgggaggaattcatcttcagtctaccagcccccgctgtgtcggatacacactcgaatcattgaagatccgagtgtgatttgaattctgtgatattttcacactggtaaatgttacctctattttaattactgctataaataggtttatattattgattcacttactgactttgcattttcgtttttaaaaggatgtataaatttttacctgtttaaataaaatttaatttcaaaaaatgtagtggtggggcttctttctatttttgatgcactgaatttttgtgtaataaagaacataattgggctctaagccata

SEQ ID NO: 299641 - DNA, 1058 bp, Homo sapiens
ggcggtgccggccgaacccagacccgaggttttagaagcagagtcaggcgaagctgggccagaaccgcgacctccgcaaccttgagcggcatccgtggagtgcgcctgcgcactacgaccgcagcaggaaagcgccgccggccaggcccagctgtggccggacagggactggaagagaggacgcggtcgagtaggttttaaaacatgaatcctacactcatccttgctgccttttgcctgggaattgcctcagctactctaacatttgatcacagtttagaggcacagtggaccaagtggaaggctgcaatggtggcctaatggattatgctttccagtatgttcaggataatggaggcctggactctgaggaatcctatccatatgaggcaacagaagaatcctgtaagtacaatcccaagtattctgttgctaatgacaccggctttgtggacatccctaagcaggagaaggccctgatgaaggcagttgcaactgtggggcccatttctgttgctattgatgcaggtcatgagtccttcctgttctataaagaaggcatttattttgagccagactgtagcagtgaagacatggatcatggtgtgctggtggttggctacggatttgaaagcacagaatcagataacaataaatattggctggtgaagaacagctggggtgaagaatggggcatgggtggctacgtaaagatggccaaagaccggagaaaccattgtggaattgcctcagcagccagctaccccactgtgtgagctggtggacggtgatgaggaaggacttgactggggatggcgcatgcatgggaggaattcatcttcagtctaccagcccccgctgtgtcggatacacactcgaatcattgaagatccgagtgtgatttgaattctgtgatattttcacactggtaaatgttacctctattttaattactgctataaataggtttatattattgattcacttactgactttgcattttcgtttttaaaaggatgtataaatttttacctgtttaaataaaatttaatttcaaa

SEQ ID NO: 299642 - DNA, 1036 bp, Homo sapiens
aatatatatctgcaaattgtcagtactgtcattataaattattagcctttgcacaatcctgtgattagatgggtaacatatagctgttcttgcttctatgtaacgtgaagaatatacaagccattctaaatatacacatttctctattgtgaaaaatgtcttatggaagtaaacccagaggtctcattgaagagactggagtcaattttcagtttcagattaactaatagcatttcacttcctgggatgatttataacagtggtgacttggaaatactaagctgcacactgctgagtgttgtggttctaactcatgttctccaggaggaggacagcagtaatcaagtcttttttttccctttacctttgaaaggaagaatcctgtaagtacaatcccaagtattctgttgctaatgacaccggctttgtggacatccctaagcaggagaaggccctgatgaaggcagttgcaactgtggggcccatttctgttgctattgatgcaggtcatgagtccttcctgttctataaagaaggcatttattttgagccagactgtagcagtgaagacatggatcatggtgtgctggtggttggctacggatttgaaagcacagaatcagataacaataaatattggctggtgaagaacagctggggtgaagaatggggcatgggtggctacgtaaagatggccaaagaccggagaaaccattgtggaattgcctcagcagccagctaccccactgtgtgagctggtggacggtgatgaggaaggacttgactggggatggcgcatgcatgggaggaattcatcttcagtctaccagcccccgctgtgtcggatacacactcgaatcattgaagatccgagtgtgatttgaattctgtgatattttcacactggtaaatgttacctctattttaattactgctataaataggtttatattattgattcacttactgactttgcattttcgtttttaaaaggatgtataaatttttacctgtttaaataaaatttaatttcaaa

SEQ ID NO: 299643 - DNA, 1185 bp, Homo sapiens
ggcggtgccggccgaacccagacccgaggttttagaagcagagtcaggcgaagctgggccagaaccgcgacctccgcaaccttgagcggcatccgtggagtgcgcctgcgcactacgaccgcagcaggaaagcgccgccggccaggcccagctgtggccggacagggactggaagagaggacgcggtcgagtaggttttaaaacatgaatcctacactcatccttgctgccttttgcctgggaattgcctcagctactctaacatttgatcacagtttagaggcacagtggaccaagtggaaggcgatgcacaacagattatacggcatgaatgaagaaggatggaggagagcagtgtgggagaagaacatgaagatgattgaactgcacaatcaggaatacagggaagggaaacacagcttcacaatggccatgaacgcctttggagacatgaccagtgaagaattcaggcaggtgatgaatggctttcaaaaccgtaagcccaggaaggggaaagtgttccaggaacctctgttttatgaggcccccagatctgtggattggagagagaaaggctacgtgactcctgtgaagaatcagggtcagtgtggttcttgttgggcttttagtgctactggtgctcttgaaggacagatgttccggaaaactgggaggcttatctcactgagtgagcagaatctggtagactgctctgggcctcaaggcaatgaaggctgcaatggtggcctaatggattatgctttccagtatgttcaggataatggaggcctggactctgaggaatcctatccatatgaggcaacagtaagtggagctccttgtcatcattccagctcagcttttggaaggtggacactttcagagataacagatacctttttcggaattcatatattagggctgggtggggtggctcacgcctgtaatcccagccctttaggaggctgagccaggcagatggcttaagctcaggagtttgagaccagcctgggcaacaaggtgaaaccttgactctatcaaaaatacaacgaaaattagccggctgtggtggtgtgcgtctgtggtcccagctatgctgaggtagggcgattgcttgagtgtgggaggtggttgtgcaaatgcactctccagtctgagtgacagaatgagaccctgtctccaaaa

SEQ ID NO: 299644 - DNA, 1488 bp, Homo sapiens
ggcggtgccggccgaacccagacccgaggttttagaagcagagtcaggcgaagctgggccagaaccgcgacctccgcaaccttgagcggcatccgtggagtgcgcctgcgcactacgaccgcagcaggaaagcgccgccggccaggcccagctgtggccggacagggactggaagagaggacgcggtcgagtaggttttaaaacatgaatcctacactcatccttgctgccttttgcctgggaattgcctcagctactctaacatttgatcacagtttagaggcacagtggaccaagtggaaggcgatgcacaacagattatacggcatgaatgaagaaggatggaggagagcagtgtgggagaagaacatgaagatgattgaactgcacaatcaggaatacagggaagggaaacacagcttcacaatggccatgaacgcctttggagacatgaccagtgaagaattcaggcaggtgatgaatggctttcaaaaccgtaagcccaggaaggggaaagtgttccaggaacctctgttttatgaggcccccagatctgtggattggagagagaaaggctacgtgactcctgtgaagaatcagggtcagtgtggttcttgttgggcttttagtgctactggtgctcttgaaggacagatgttccggaaaactgggaggcttatctcactgagtgagcagaatctggtagactgctctgggcctcaaggcaatgaaggctgcaatggtggcctaatggattatgctttccagtatgttcaggataatggaggcctggactctgaggaatcctatccatatgaggcaacagaagaatcctgtaagtacaatcccaagtattctgttgctaatgacaccggctttgtggacatccctaagcaggagaaggccctgatgaaggcagttgcaactgtggggcccatttctgttgctattgatgcaggtcatgagtccttcctgttctataaagaaggcatttattttgagccagactgtagcagtgaagacatggatcatggtgtgctggtggttggctacggatttgaaagcacagaatcagataacaataaatattggctggtgaagaacagctggggtgaagaatggggcatgggtggctacgtaaagatggccaaagaccggagaaaccattgtggaattgcctcagcagccagctaccccactgtgtgagctggtggacggtgatgaggaaggacttgactggggatggcgcatgcatgggaggaattcatcttcagtctaccagcccccgctgtgtcggatacacactcgaatcattgaagatccgagtgtgatttgaattctgtgatattttcacactggtaaatgttacctctattttaattactgctataaataggtttatattattgattcacttactgactttgcattttcgtttttaaaaggatgtataaatttttacctgtttaaataaaatttaatttcaaa

SEQ ID NO: 299645 - DNA, 1543 bp, Homo sapiens
ggcggtgccggccgaacccagacccgaggttttagaagcagagtcaggcgaagctgggccagaaccgcgacctccgcaaccttgagcggcatccgtggagtgcgcctgcgcactacgaccgcagcaggaaagcgccgccggccaggcccagctgtggccggacagggactggaagagaggacgcggtcgagtaggtgtgcaccagccctggcaacgagagcgtctaccccgaactctgctggccttgaggttttaaaacatgaatcctacactcatccttgctgccttttgcctgggaattgcctcagctactctaacatttgatcacagtttagaggcacagtggaccaagtggaaggcgatgcacaacagattatacggcatgaatgaagaaggatggaggagagcagtgtgggagaagaacatgaagatgattgaactgcacaatcaggaatacagggaagggaaacacagcttcacaatggccatgaacgcctttggagacatgaccagtgaagaattcaggcaggtgatgaatggctttcaaaaccgtaagcccaggaaggggaaagtgttccaggaacctctgttttatgaggcccccagatctgtggattggagagagaaaggctacgtgactcctgtgaagaatcagggtcagtgtggttcttgttgggcttttagtgctactggtgctcttgaaggacagatgttccggaaaactgggaggcttatctcactgagtgagcagaatctggtagactgctctgggcctcaaggcaatgaaggctgcaatggtggcctaatggattatgctttccagtatgttcaggataatggaggcctggactctgaggaatcctatccatatgaggcaacagaagaatcctgtaagtacaatcccaagtattctgttgctaatgacaccggctttgtggacatccctaagcaggagaaggccctgatgaaggcagttgcaactgtggggcccatttctgttgctattgatgcaggtcatgagtccttcctgttctataaagaaggcatttattttgagccagactgtagcagtgaagacatggatcatggtgtgctggtggttggctacggatttgaaagcacagaatcagataacaataaatattggctggtgaagaacagctggggtgaagaatggggcatgggtggctacgtaaagatggccaaagaccggagaaaccattgtggaattgcctcagcagccagctaccccactgtgtgagctggtggacggtgatgaggaaggacttgactggggatggcgcatgcatgggaggaattcatcttcagtctaccagcccccgctgtgtcggatacacactcgaatcattgaagatccgagtgtgatttgaattctgtgatattttcacactggtaaatgttacctctattttaattactgctataaataggtttatattattgattcacttactgactttgcattttcgtttttaaaaggatgtataaatttttacctgtttaaataaaatttaatttcaaa

SEQ ID NO: 299646 - DNA, 1664 bp, Homo sapiens
ggcggtgccggccgaacccagacccgaggttttagaagcagagtcaggcgaagctgggccagaaccgcgacctccgcaaccttgagcggcatccgtggagtgcgcctgcgcactacgaccgcagcaggaaagcgccgccggccaggcccagctgtggccggacagggactggaagagaggacgcggtcgagtaggttttaaaacatgaatcctacactcatccttgctgccttttgcctgggaattgcctcagctactctaacatttgatcacagtttagaggcacagtggaccaagtggaaggcgatgcacaacagattatacggcatgaatgaagaaggatggaggagagcagtgtgggagaagaacatgaagatgattgaactgcacaatcaggaatacagggaagggaaacacagcttcacaatggccatgaacgcctttggagacatgaccagtgaagaattcaggcaggtgatgaatggctttcaaaaccgtaagcccaggaaggggaaagtgttccaggaacctctgttttatgaggcccccagatctgtggattggagagagaaaggctacgtgactcctgtgaagaatcagggtcagtgtggttcttgttgggcttttagtgctactggtgctcttgaaggacagatgttccggaaaactgggaggcttatctcactgagtgagcagaatctggtagactgctctgggcctcaaggcaatgaaggctgcaatggtggcctaatggattatgctttccagtatgttcaggataatggaggcctggactctgaggaatcctatccatatgaggcaacagaagaatcctgtaagtacaatcccaagtattctgttgctaatgacaccggctttgtggacatccctaagcaggagaaggccctgatgaaggcagttgcaactgtggggcccatttctgttgctattgatgcaggtcatgagtccttcctgttctataaagaaggcatttattttgagccagactgtagcagtgaagacatggatcatggtgtgctggtggttggctacggatttgaaagcacagaatcagataacaataaatattggctggtgaagaacagctggggtgaagaatggggcatgggtggctacgtaaagatggccaaagaccggagaaaccattgtggaattgcctcagcagccagctaccccactgtgtgagctggtggacggtgatgaggaaggacttgactggggatggcgcatgcatgggaggaattcatcttcagtctaccagcccccgctgtgtcggatacacactcgaatcattgaagatccgagtgtgatttgaattctgtgatattttcacactggtaaatgttacctctattttaattactgctataaataggtttatattattgattcacttactgactttgcattttcgtttttaaaaggatgtataaatttttacctgtttaaataaaatttaatttcaaaaaaaaaaaaaaaaaaaaaaaaaagaaaaaaaaaacaacaacacaaagacaaaagcacgaaaaccaacaaaaagaagacaaccgacaagagcaggcacaacaaaagagaaaacaaaaagaggcatgcaccccagcacccccaccacacagcagccctacaagatgggggacgcccga

SEQ ID NO: 299647 - DNA, 1637 bp, Homo sapiens
ggcggtgccggccgaacccagacccgaggttttagaagcagagtcaggcgaagctgggccagaaccgcgacctccgcaaccttgagcggcatccgtggagtgcgcctgcgcactacgaccgcagcaggaaagcgccgccggccaggcccagctgtggccggacagggactggaagagaggacgcggtcgagtaggttttaaaacatgaatcctacactcatccttgctgccttttgcctgggaattgcctcagctactctaacatttgatcacagtttagaggcacagtggaccaagtggaaggcgatgcacaacagattatacggcatgaatgaagaaggatggaggagagcagtgtgggagaagaacatgaagatgattgaactgcacaatcaggaatacagggaagggaaacacagcttcacaatggccatgaacgcctttggagacatgaccagtgaagaattcaggcaggtgatgaatggctttcaaaaccgtaagcccaggaaggggaaagtgttccaggaacctctgttttatgaggcccccagatctgtggattggagagagaaaggctacgtgactcctgtgaagaatcagggtcagtgtggttcttgttgggcttttagtgctactggtgctcttgaaggacagatgttccggaaaactgggaggcttatctcactgagtgagcagaatctggtagactgctctgggcctcaaggcaatgaaggctgcaatggtggcctaatggattatgctttccagtatgttcaggataatggaggcctggactctgaggaatcctatccatatgaggcaacagaagaatcctgtaagtacaatcccaagtattctgttgctaatgacaccggctttgtggacatccctaagcaggagaaggccctgatgaaggcagttgcaactgtggggcccatttctgttgctattgatgcaggtcatgagtccttcctgttctataaagaaggcatttattttgagccagactgtagcagtgaagacatggatcatggtgtgctggtggttggctacggatttgaaagcacagaatcagataacaataaatattggctggtgaagaacagctggggtgaagaatggggcatgggtggctacgtaaagatggccaaagaccggagaaaccattgtggaattgcctcagcagccagctaccccactgtgtgagctggtggacggtgatgaggaaggacttgactggggatggcgcatgcatgggaggaattcatcttcagtctaccagcccccgctgtgtcggatacacactcgaatcattgaagatccgagtgtgatttgaattctgtgatattttcacactggtaaatgttacctctattttaattactgctataaataggtttatattattgattcacttactgactttgcattttcgtttttaaaaggatgtataaatttttacctgtttaaataaaatttaatttcaaaaaaaaaaaaaaaaaaaaacttgaggggggggcccggtacccaatttcgcccctatagtggaggtcgtattacaaattcaaactggcccgtccgtttttacaaacgttctgggacttgggaaaaaaacccctggccgtgtttcccccaac

SEQ ID NO: 299648 - DNA, 1758 bp, Homo sapiens
aagatgtgtgaaggcctcctaactcttggggatctctttgtccctacttgggaatcccaccttatcattagtgaggttttgcctgggcacgaaacctggattttttgcgattggtacaaaacctggatcaaccgtttcccggtttcctagttgttgccttaagcttctcacacacaaggtagtttcataccgttctcataacctaaattgtcatcgcataaactgtttcagctcctacagctctggacaggctgcttttcattttggtgagtccatccagtacctccacgtgccctgtttttctccaggcacatccttggcctcttccacagtccttgggtaaatgcttgggagaataatttaaatatttttattctaccatggtggccctaatttttcagggggcagtaagatggctttttaggattggtctaatcagatcctcatttttgttcccttcctaggttttaaaacatgaatcctacactcatccttgctgccttttgcctgggaattgcctcagctactctaacatttgatcacagtttagaggcacagtggaccaagtggaaggcgatgcacaacagattatacggcatgaatgaagaaggatggaggagagcagtgtgggagaagaacatgaagatgattgaactgcacaatcaggaatacagggaagggaaacacagcttcacaatggccatgaacgcctttggagacatgaccagtgaagaattcaggcaggtgatgaatggctttcaaaaccgtaagcccaggaaggggaaagtgttccaggaacctctgttttatgaggcccccagatctgtggattggagagagaaaggctacgtgactcctgtgaagaatcagggtcagtgtggttcttgttgggcttttagtgctactggtgctcttgaaggacagatgttccggaaaactgggaggcttatctcactgagtgagcagaatctggtagactgctctgggcctcaaggcaatgaaggctgcaatggtggcctaatggattatgctttccagtatgttcaggataatggaggcctggactctgaggaatcctatccatatgaggcaacagaagaatcctgtaagtacaatcccaagtattctgttgctaatgacaccggctttgtggacatccctaagcaggagaaggccctgatgaaggcagttgcaactgtggggcccatttctgttgctattgatgcaggtcatgagtccttcctgttctataaagaaggcatttattttgagccagactgtagcagtgaagacatggatcatggtgtgctggtggttggctacggatttgaaagcacagaatcagataacaataaatattggctggtgaagaacagctggggtgaagaatggggcatgggtggctacgtaaagatggccaaagaccggagaaaccattgtggaattgcctcagcagccagctaccccactgtgtgagctggtggacggtgatgaggaaggacttgactggggatggcgcatgcatgggaggaattcatcttcagtctaccagcccccgctgtgtcggatacacactcgaatcattgaagatccgagtgtgatttgaattctgtgatattttcacactggtaaatgttacctctattttaattactgctataaataggtttatattattgattcacttactgactttgcattttcgtttttaaaaggatgtataaatttttacctgtttaaataaaatttaatttcaaa

SEQ ID NO: 299649 - DNA, 1699 bp, Homo sapiens
aagatgtgtgaaggcctcctaactcttggggatctctttgtccctacttgggaatcccaccttatcattagtgaggttttgcctgggcacgaaacctggattttttgcgattggtacaaaacctggatcaaccgtttcccggtttcctagttgttgccttaagcttctcacacacaaggtagtttcataccgttctcataacctaaattgtcatcgcataaactgtttcagctcctacagctctggacaggctgcttttcattttggtgagtccatccagtacctccacgtgccctgtttttctccaggcacatccttggcctcttccacagtccttgggtaaatgcttgggagaataatttaaatatttttattctaccatggtggccctaatttttcagggggcagtaagatggctttttaggattggtctaatcagatcctcatttttgttcccttcctagctactctaacatttgatcacagtttagaggcacagtggaccaagtggaaggcgatgcacaacagattatacggcatgaatgaagaaggatggaggagagcagtgtgggagaagaacatgaagatgattgaactgcacaatcaggaatacagggaagggaaacacagcttcacaatggccatgaacgcctttggagacatgaccagtgaagaattcaggcaggtgatgaatggctttcaaaaccgtaagcccaggaaggggaaagtgttccaggaacctctgttttatgaggcccccagatctgtggattggagagagaaaggctacgtgactcctgtgaagaatcagggtcagtgtggttcttgttgggcttttagtgctactggtgctcttgaaggacagatgttccggaaaactgggaggcttatctcactgagtgagcagaatctggtagactgctctgggcctcaaggcaatgaaggctgcaatggtggcctaatggattatgctttccagtatgttcaggataatggaggcctggactctgaggaatcctatccatatgaggcaacagaagaatcctgtaagtacaatcccaagtattctgttgctaatgacaccggctttgtggacatccctaagcaggagaaggccctgatgaaggcagttgcaactgtggggcccatttctgttgctattgatgcaggtcatgagtccttcctgttctataaagaaggcatttattttgagccagactgtagcagtgaagacatggatcatggtgtgctggtggttggctacggatttgaaagcacagaatcagataacaataaatattggctggtgaagaacagctggggtgaagaatggggcatgggtggctacgtaaagatggccaaagaccggagaaaccattgtggaattgcctcagcagccagctaccccactgtgtgagctggtggacggtgatgaggaaggacttgactggggatggcgcatgcatgggaggaattcatcttcagtctaccagcccccgctgtgtcggatacacactcgaatcattgaagatccgagtgtgatttgaattctgtgatattttcacactggtaaatgttacctctattttaattactgctataaataggtttatattattgattcacttactgactttgcattttcgtttttaaaaggatgtataaatttttacctgtttaaataaaatttaatttcaaa

SEQ ID NO: 299650 - DNA, 1352 bp, Homo sapiens
ggcggtgccggccgaacccagacccgaggttttagaagcagagtcaggcgaagctgggccagaaccgcgacctccgcaaccttgagcggcatccgtggagtgcgcctgcgcactacgaccgcagcaggaaagcgccgccggccaggcccagctgtggccggacagggactggaagagaggacgcggtcgagtagaatgaagaaggatggaggagagcagtgtgggagaagaacatgaagatgattgaactgcacaatcaggaatacagggaagggaaacacagcttcacaatggccatgaacgcctttggagacatgaccagtgaagaattcaggcaggtgatgaatggctttcaaaaccgtaagcccaggaaggggaaagtgttccaggaacctctgttttatgaggcccccagatctgtggattggagagagaaaggctacgtgactcctgtgaagaatcagggtcagtgtggttcttgttgggcttttagtgctactggtgctcttgaaggacagatgttccggaaaactgggaggcttatctcactgagtgagcagaatctggtagactgctctgggcctcaaggcaatgaaggctgcaatggtggcctaatggattatgctttccagtatgttcaggataatggaggcctggactctgaggaatcctatccatatgaggcaacagaagaatcctgtaagtacaatcccaagtattctgttgctaatgacaccggctttgtggacatccctaagcaggagaaggccctgatgaaggcagttgcaactgtggggcccatttctgttgctattgatgcaggtcatgagtccttcctgttctataaagaaggcatttattttgagccagactgtagcagtgaagacatggatcatggtgtgctggtggttggctacggatttgaaagcacagaatcagataacaataaatattggctggtgaagaacagctggggtgaagaatggggcatgggtggctacgtaaagatggccaaagaccggagaaaccattgtggaattgcctcagcagccagctaccccactgtgtgagctggtggacggtgatgaggaaggacttgactggggatggcgcatgcatgggaggaattcatcttcagtctaccagcccccgctgtgtcggatacacactcgaatcattgaagatccgagtgtgatttgaattctgtgatattttcacactggtaaatgttacctctattttaattactgctataaataggtttatattattgattcacttactgactttgcattttcgtttttaaaaggatgtataaatttttacctgtttaaataaaatttaatttcaaa

SEQ ID NO: 299651 - DNA, 1554 bp, Homo sapiens
  misc_feature (1490)..(1491): n is a, c, g, or t
  misc_feature (1493)..(1494): n is a, c, g, or t
  misc_feature (1536)..(1536): n is a, c, g, or t
ggcggtgccggccgaacccagacccgaggttttagaagcagagtcaggcgaagctgggccagaaccgcgacctccgcaaccttgagcggcatccgtggagtgcgcctgcgcactacgaccgcagcaggaaagcgccgccggccaggcccagctgtggccggacagggactggaagagaggacgcggtcgagtaggttttaaaacatgaatcctacactcatccttgctgccttttgcctgggaattgcctcagctactctaacatttgatcacagtttagaggcacagtggaccaagtggaaggcgatgcacaacagattatacggcatgaatgaagaaggatggaggagagcagtgtgggagaagaacatgaagatgattgaactgcacaatcaggaatacagggaagggaaacacagcttcacaatggccatgaacgcctttggagacatgaccagtgaagaattcaggcaggtgatgaatggctttcaaaaccgtaagcccaggaaggggaaagtgttccaggaacctctgttttatgaggcccccagatctgtggattggagagagaaaggctacgtgactcctgtgaagaatcagggtcagtgtggttcttgttgggcttttagtgctactggtgctcttgaaggacagatgttccggaaaactgggaggcttatctcactgagtgagcagaatctggtagactgctctgggcctcaaggcaatgaaggctgcaatggtggcctaatggattatgctttccagtatgttcaggataatggaggcctggactctgaggaatcctatccatatgaggcaacagaagaatcctgtaagtacaatcccaagtattctgttgctaatgacaccggctttgtggacatccctaagcaggagaaggccctgatgaaggcagttgcaactgtggggcccatttctgttgctattgatgcaggtcatgagtccttcctgttctataaagaaggcatttattttgagccagactgtagcagtgaagacatggatcatggtgtgctggtggttggctacggatttgaaagcacagaatcagataacaataaatattggctggtgaagaacagctggggtgaagaatggggcatgggtggctacgtaaagatggccaaagaccggagaaaccattgtggaattgcctcagcagccagctaccccactgtgtgagctggtggacggtgatgaggaaggacttgactggggatggcgcatgcatgggaggaattcatcttcagtctaccagcccccgctgtgtcggatacacactcgaatcattgaagatccgagtgtgatttgaattctgtgatattttcacactggtaaatgttacctctattttaattactgctataaataggtttatattattgattcacttactgactttgcattttcgtttttaaaaggatgtataaatttttacctgtttaaataaaatttaatttcaaacnncnngggggggggggggggggggggggggtggtgtctattttgggngttttggtttttgtgaat

SEQ ID NO: 299652 - DNA, 1588 bp, Homo sapiens
ggcggtgccggccgaacccagacccgaggttttagaagcagagtcaggcgaagctgggccagaaccgcgacctccgcaaccttgagcggcatccgtggagtgcgcctgcgcactacgaccgcagcaggaaagcgccgccggccaggcccagctgtggccggacagggactggaagagaggacgcggtcgagtaggttttaaaacatgaatcctacactcatccttgctgccttttgcctgggaattgcctcagctactctaacatttgatcacagtttagaggcacagtggaccaagtggaaggcgatgcacaacagattatacggcatgaatgaagaaggatggaggagagcagtgtgggagaagaacatgaagatgattgaactgcacaatcaggaatacagggaagggaaacacagcttcacaatggccatgaacgcctttggagacatggtaagtgtgctgtggactgccgagctctgtgcttcctctcttcggttctttactaaggtaatctcttgcttttcaacattttatttccttttccttgaagaccagtgaagaattcaggcaggtgatgaatggctttcaaaaccgtaagcccaggaaggggaaagtgttccaggaacctctgttttatgaggcccccagatctgtggattggagagagaaaggctacgtgactcctgtgaagaatcagggtcagtgtggttcttgttgggcttttagtgctactggtgctcttgaaggacagatgttccggaaaactgggaggcttatctcactgagtgagcagaatctggtagactgctctgggcctcaaggcaatgaaggctgcaatggtggcctaatggattatgctttccagtatgttcaggataatggaggcctggactctgaggaatcctatccatatgaggcaacagaagaatcctgtaagtacaatcccaagtattctgttgctaatgacaccggctttgtggacatccctaagcaggagaaggccctgatgaaggcagttgcaactgtggggcccatttctgttgctattgatgcaggtcatgagtccttcctgttctataaagaaggcatttattttgagccagactgtagcagtgaagacatggatcatggtgtgctggtggttggctacggatttgaaagcacagaatcagataacaataaatattggctggtgaagaacagctggggtgaagaatggggcatgggtggctacgtaaagatggccaaagaccggagaaaccattgtggaattgcctcagcagccagctaccccactgtgtgagctggtggacggtgatgaggaaggacttgactggggatggcgcatgcatgggaggaattcatcttcagtctaccagcccccgctgtgtcggatacacactcgaatcattgaagatccgagtgtgatttgaattctgtgatattttcacactggtaaatgttacctctattttaattactgctataaataggtttatattattgattcacttactgactttgcattttcgtttttaaaaggatgtataaatttttacctgtttaaataaaatttaatttcaaa

SEQ ID NO: 299653 - DNA, 2078 bp, Homo sapiens
ggcggtgccggccgaacccagacccgaggttttagaagcagagtcaggcgaagctgggccagaaccgcgacctccgcaaccttgagcggcatccgtggagtgcgcctgcgcactacgaccgcagcaggaaagcgccgccggccaggcccagctgtggccggacagggactggaagagaggacgcggtcgagtaggttttaaaacatgaatcctacactcatccttgctgccttttgcctgggaattgcctcagctactctaacatttgatcacagtttagaggcacagtggaccaagtggaaggcgatgcacaacagattatacggcatgaatgaagaaggatggaggagagcagtgtgggagaagaacatgaagatgattgaactgcacaatcaggaatacagggaagggaaacacagcttcacaatggccatgaacgcctttggagacatgaccagtgaagaattcaggcaggtgatgaatggctttcaaaaccgtaagcccaggaaggggaaagtgttccaggaacctctgttttatgaggcccccagatctgtggattggagagagaaaggctacgtgactcctgtgaagaatcagggtcagtgtggttcttgttgggcttttagtgctactggtgctcttgaaggacagatgttccggaaaactgggaggcttatctcactgagtgagcagaatctggtagactgctctgggcctcaaggcaatgaaggctgcaatggtggcctaatggattatgctttccagtatgttcaggataatggaggcctggactctgaggaatcctatccatatgaggcaacagaagaatcctgtaagtacaatcccaagtattctgttgctaatgacaccggctttgtggacatccctaagcaggagaaggccctgatgaaggcagttgcaactgtggggcccatttctgttgctattgatgcaggtcatgagtccttcctgttctataaagaaggcatttattttgagccagactgtagcagtgaagacatggatcatggtgtgctggtggttggctacggatttgaaagcacagaatcagataacaataaatattggctggtgaagaacaggtataaattgccagaaatacttacatttgaaattcaaaagagaatacttatttgcaaacagtgtttggatacagttccacatgcccttagcatacttctgaaatccccagaagtctaagttgaacatataatattaatgtttgattataaaagtaagaaactgtcacaaatatcttgggagtatgaatatagtctttgttccattgtataaaggtgtatctaaatctgaacagtttttaaattctgaggcatatctggctgcaaagacatcctattgttttcctgtctctgatctgtagttctgtgaaaggtcacagtttggaggctgggatggaaattatgtccaggttatgtcaagaattttttaaggataaacaggaacattgcctgtcctgattctttctgttaagtctatggcctctggcacagtgtttaagttgggtgttcctgttaataaccctttgggctttattctttctctgaaatggaaaacctgctcttttttcagctggggtgaagaatggggcatgggtggctacgtaaagatggccaaagaccggagaaaccattgtggaattgcctcagcagccagctaccccactgtgtgagctggtggacggtgatgaggaaggacttgactggggatggcgcatgcatgggaggaattcatcttcagtctaccagcccccgctgtgtcggatacacactcgaatcattgaagatccgagtgtgatttgaattctgtgatattttcacactggtaaatgttacctctattttaattactgctataaataggtttatattattgattcacttactgactttgcattttcgtttttaaaaggatgtataaatttttacctgtttaaataaaatttaatttcaaaaaatgtagtggtggggcttctttctatttttgatgcactgaatttttgtgtaataaagaacataattgggctctaagccata

SEQ ID NO: 299654 - DNA, 1996 bp, Homo sapiens
ggcggtgccggccgaacccagacccgaggttttagaagcagagtcaggcgaagctgggccagaaccgcgacctccgcaaccttgagcggcatccgtggagtgcgcctgcgcactacgaccgcagcaggaaagcgccgccggccaggcccagctgtggccggacagggactggaagagaggacgcggtcgagtaggttttaaaacatgaatcctacactcatccttgctgccttttgcctgggaattgcctcagctactctaacatttgatcacagtttagaggcacagtggaccaagtggaaggcgatgcacaacagattatacggcatgaatgaagaaggatggaggagagcagtgtgggagaagaacatgaagatgattgaactgcacaatcaggaatacagggaagggaaacacagcttcacaatggccatgaacgcctttggagacatgaccagtgaagaattcaggcaggtgatgaatggctttcaaaaccgtaagcccaggaaggggaaagtgttccaggaacctctgttttatgaggcccccagatctgtggattggagagagaaaggctacgtgactcctgtgaagaatcagggtcagtgtggttcttgttgggcttttagtgctactggtgctcttgaaggacagatgttccggaaaactgggaggcttatctcactgagtgagcagaatctggtagactgctctgggcctcaaggcaatgaaggctgcaatggtggcctaatggattatgctttccagtatgttcaggataatggaggcctggactctgaggaatcctatccatatgaggcaacagaagaatcctgtaagtacaatcccaagtattctgttgctaatgacaccggctttgtggacatccctaagcaggagaaggccctgatgaaggcagttgcaactgtggggcccatttctgttgctattgatgcaggtcatgagtccttcctgttctataaagaaggcatttattttgagccagactgtagcagtgaagacatggatcatggtgtgctggtggttggctacggatttgaaagcacagaatcagataacaataaatattggctggtgaagaacaggtataaattgccagaaatacttacatttgaaattcaaaagagaatacttatttgcaaacagtgtttggatacagttccacatgcccttagcatacttctgaaatccccagaagtctaagttgaacatataatattaatgtttgattataaaagtaagaaactgtcacaaatatcttgggagtatgaatatagtctttgttccattgtataaaggtgtatctaaatctgaacagtttttaaattctgaggcatatctggctgcaaagacatcctattgttttcctgtctctgatctgtagttctgtgaaaggtcacagtttggaggctgggatggaaattatgtccaggttatgtcaagaattttttaaggataaacaggaacattgcctgtcctgattctttctgttaagtctatggcctctggcacagtgtttaagttgggtgttcctgttaataaccctttgggctttattctttctctgaaatggaaaacctgctcttttttcagctggggtgaagaatggggcatgggtggctacgtaaagatggccaaagaccggagaaaccattgtggaattgcctcagcagccagctaccccactgtgtgagctggtggacggtgatgaggaaggacttgactggggatggcgcatgcatgggaggaattcatcttcagtctaccagcccccgctgtgtcggatacacactcgaatcattgaagatccgagtgtgatttgaattctgtgatattttcacactggtaaatgttacctctattttaattactgctataaataggtttatattattgattcacttactgactttgcattttcgtttttaaaaggatgtataaatttttacctgtttaaataaaatttaatttcaaa

SEQ ID NO: 299655 - DNA, 1434 bp, Homo sapiens
ggcggtgccggccgaacccagacccgaggttttagaagcagagtcaggcgaagctgggccagaaccgcgacctccgcaaccttgagcggcatccgtggagtgcgcctgcgcactacgaccgcagcaggaaagcgccgccggccaggcccagctgtggccggacagggactggaagagaggacgcggtcgagtaggttttaaaacatgaatcctacactcatccttgctgccttttgcctgggaattgcctcagctactctaacatttgatcacagtttagaggcacagtggaccaagtggaaggcgatgcacaacagattatacggcatgaatgaagaaggatggaggagagcagtgtgggagaagaacatgaagatgattgaactgcacaatcaggaatacagggaagggaaacacagcttcacaatggccatgaacgcctttggagacatgaccagtgaagaattcaggcaggtgatgaatggctttcaaaaccgtaagcccaggaaggggaaagtgttccaggaacctctgttttatgaggcccccagatctgtggattggagagagaaaggctacgtgactcctgtgaagaatcagggtcagtgtggttcttgttgggcttttagtgctactggtgctcttgaaggacagatgttccggcctcaaggcaatgaaggctgcaatggtggcctaatggattatgctttccagtatgttcaggataatggaggcctggactctgaggaatcctatccatatgaggcaacagaagaatcctgtaagtacaatcccaagtattctgttgctaatgacaccggctttgtggacatccctaagcaggagaaggccctgatgaaggcagttgcaactgtggggcccatttctgttgctattgatgcaggtcatgagtccttcctgttctataaagaaggcatttattttgagccagactgtagcagtgaagacatggatcatggtgtgctggtggttggctacggatttgaaagcacagaatcagataacaataaatattggctggtgaagaacagctggggtgaagaatggggcatgggtggctacgtaaagatggccaaagaccggagaaaccattgtggaattgcctcagcagccagctaccccactgtgtgagctggtggacggtgatgaggaaggacttgactggggatggcgcatgcatgggaggaattcatcttcagtctaccagcccccgctgtgtcggatacacactcgaatcattgaagatccgagtgtgatttgaattctgtgatattttcacactggtaaatgttacctctattttaattactgctataaataggtttatattattgattcacttactgactttgcattttcgtttttaaaaggatgtataaatttttacctgtttaaataaaatttaatttcaaa

SEQ ID NO: 299656 - DNA, 982 bp, Homo sapiens
aatatatatctgcaaattgtcagtactgtcattataaattattagcctttgcacaatcctgtgattagatgggtaacatatagctgttcttgcttctatgtaacgtgaagaatatacaagccattctaaatatacacatttctctattgtgatttcagtttcagattaactaatagcatttcacttcctgggatgatttataacagtggtgacttggaaatactaagctgcacactgctgagtgttgtggttctaactcatgttctccaggaggaggacagcagtaatcaagtcttttttttccctttacctttgaaaggaagaatcctgtaagtacaatcccaagtattctgttgctaatgacaccggctttgtggacatccctaagcaggagaaggccctgatgaaggcagttgcaactgtggggcccatttctgttgctattgatgcaggtcatgagtccttcctgttctataaagaaggcatttattttgagccagactgtagcagtgaagacatggatcatggtgtgctggtggttggctacggatttgaaagcacagaatcagataacaataaatattggctggtgaagaacagctggggtgaagaatggggcatgggtggctacgtaaagatggccaaagaccggagaaaccattgtggaattgcctcagcagccagctaccccactgtgtgagctggtggacggtgatgaggaaggacttgactggggatggcgcatgcatgggaggaattcatcttcagtctaccagcccccgctgtgtcggatacacactcgaatcattgaagatccgagtgtgatttgaattctgtgatattttcacactggtaaatgttacctctattttaattactgctataaataggtttatattattgattcacttactgactttgcattttcgtttttaaaaggatgtataaatttttacctgtttaaataaaatttaatttcaaa

SEQ ID NO: 299657 - DNA, 1044 bp, Homo sapiens
gtagtgacatgaacagtctctgttaagcacactcagacagatgagctgggtgagctggctcacacgctgtaatcacatgggtaacatatagctgttcttgcttctatgtaacgtgaagaatatacaagccattctaaatatacacatttctctattgtgaaaaatgtcttatggaagtaaacccagaggtctcattgaagagactggagtcaattttcagtttcagattaactaatagcatttcacttcctgggatgatttataacagtggtgacttggaaatactaagctgcacactgctgagtgttgtggttctaactcatgttctccaggaggaggacagcagtaatcaagtcttttttttccctttacctttgaaaggaagaatcctgtaagtacaatcccaagtattctgttgctaatgacaccggctttgtggacatccctaagcaggagaaggccctgatgaaggcagttgcaactgtggggcccatttctgttgctattgatgcaggtcatgagtccttcctgttctataaagaaggcatttattttgagccagactgtagcagtgaagacatggatcatggtgtgctggtggttggctacggatttgaaagcacagaatcagataacaataaatattggctggtgaagaacagctggggtgaagaatggggcatgggtggctacgtaaagatggccaaagaccggagaaaccattgtggaattgcctcagcagccagctaccccactgtgtgagctggtggacggtgatgaggaaggacttgactggggatggcgcatgcatgggaggaattcatcttcagtctaccagcccccgctgtgtcggatacacactcgaatcattgaagatccgagtgtgatttgaattctgtgatattttcacactggtaaatgttacctctattttaattactgctataaataggtttatattattgattcacttactgactttgcattttcgtttttaaaaggatgtataaatttttacctgtttaaataaaatttaatttcaaa

SEQ ID NO: 299658 - DNA, 715 bp, Homo sapiens
agacaggacactgtgggaggcaggacattaggaatctatcatataggcaacagaagaatcctgtaagtacaatcccaagtattctgttgctaatgacaccggctttgtggacatccctaagcaggagaaggccctgatgaaggcagttgcaactgtggggcccatttctgttgctattgatgcaggtcatgagtccttcctgttctataaagaaggcatttattttgagccagactgtagcagtgaagacatggatcatggtgtgctggtggttggctacggatttgaaagcacagaatcagataacaataaatattggctggtgaagaacagctggggtgaagaatggggcatgggtggctacgtaaagatggccaaagaccggagaaaccattgtggaattgcctcagcagccagctaccccactgtgtgagctggtggacggtgatgaggaaggacttgactggggatggcgcatgcatgggaggaattcatcttcagtctaccagcccccgctgtgtcggatacacactcgaatcattgaagatccgagtgtgatttgaattctgtgatattttcacactggtaaatgttacctctattttaattactgctataaataggtttatattattgattcacttactgactttgcattttcgtttttaaaaggatgtataaatttttacctgtttaaataaaatttaatttcaaa

SEQ ID NO: 299659 - DNA, 1144 bp, Homo sapiens
ggcggtgccggccgaacccagacccgaggttttagaagcagagtcaggcgaagctgggccagaaccgcgacctccgcaaccttgagcggcatccgtggagtgcgcctgcgcactacgaccgcagcaggaaagcgccgccggccaggcccagctgtggccggacagggactggaagagaggacgcggtcgagtaggtgtgcaccagccctggcaacgagagcgtctaccccgaactctgctggccttgaggtggggaagccggggagggcagttgaggaccccgcggaggcgcgtgactggttgagcgggcaggccagcctccgagccgggtggacacaggttttaaaacatgaatcctacactcatccttgctgccttttgcctgggaattgcctcagctactctaacatttgatcacagtttagaggcacagtggaccaagtggaaggcgatgcacaacagattatacggcatgaatgaagaaggatggaggagagcagtgtgggagaagaacatgaagatgattgaactgcacaatcaggaatacagggaagggaaacacagcttcacaatggccatgaacgcctttggagacatgaccagtgaagaattcaggcaggtgatgaatggctttcaaaaccgtaagcccaggaaggggaaagtgttccaggaacctctgttttatgaggcccccagatctgtggattggagagagaaaggctacgtgactcctgtgaagaatcagggtcagtgtggttcttgttgggcttttagtgctactggtgctcttgaaggacagatgttccggaaaactgggaggcttatctcactgagtgagcagaatctggtagactgctctgggcctcaaggcaatgaaggctgcaatggtggcctaatggattatgctttccagtatgttcaggataatggaggcctggactctgaggaatcctatccatatgaggcaacagaagaatcctgtaagtacaatcccaagtattctgttgctaatgacaccggctttgtggacatccctaagcaggagaaggccctgatgaaggcagttgcaactgtggggacccccgccggcaagcagagtgtcacagctggctttcctcacttgggaaacgggtactcctgtcta

SEQ ID NO: 299660 - DNA, 1364 bp, Homo sapiens
tgatatcctagagtagaattacaagcttacaaagaggggtctttttttcctctaggaaagcttttttttaatgaaggatttatgctgatttctatttctgctagttgtaaatgagagcttaaatccctggccttcttattgttgttaagtactatctggaatgtgtgtcacttcactgaattcagagatgcctcattccctgtgggtgacaggatgggttactgtcatgtgtcctctggagcttctcaccccagccctcattttaccatcccaggcatttattttgagccagactgtagcagtgaagacatggatcatggtgtgctggtggttggctacggatttgaaagcacagaatcagataacaataaatattggctggtgaagaacaggtataaattgccagaaatacttacatttgaaattcaaaagagaatacttatttgcaaacagtgtttggatacagttccacatgcccttagcatacttctgaaatccccagaagtctaagttgaacatataatattaatgtttgattataaaagtaagaaactgtcacaaatatcttgggagtatgaatatagtctttgttccattgtataaaggtgtatctaaatctgaacagtttttaaattctgaggcatatctggctgcaaagacatcctattgttttcctgtctctgatctgtagttctgtgaaaggtcacagtttggaggctgggatggaaattatgtccaggttatgtcaagaattttttaaggataaacaggaacattgcctgtcctgattctttctgttaagtctatggcctctggcacagtgtttaagttgggtgttcctgttaataaccctttgggctttattctttctctgaaatggaaaacctgctcttttttcagctggggtgaagaatggggcatgggtggctacgtaaagatggccaaagaccggagaaaccattgtggaattgcctcagcagccagctaccccactgtgtgagctggtggacggtgatgaggaaggacttgactggggatggcgcatgcatgggaggaattcatcttcagtctaccagcccccgctgtgtcggatacacactcgaatcattgaagatccgagtgtgatttgaattctgtgatattttcacactggtaaatgttacctctattttaattactgctataaataggtttatattattgattcacttactgactttgcattttcgtttttaaaaggatgtataaatttttacctgtttaaataaaatttaatttcaaaaaatgtagtggtggggcttctttctatttttgatgcactgaatttttgtgtaataaagaacataattgggctctaagccata

SEQ ID NO: 299661 - DNA, 856 bp, Homo sapiens
tgatatcctagagtagaattacaagcttacaaagaggggtctttttttcctctaggaaagcttttttttaatgaaggatttatgctgatttctatttctgctagttgtaaatgagagcttaaatccctggccttcttattgttgttaagtactatctggaatgtgtgtcacttcactgaattcagagatgcctcattccctgtgggtgacaggatgggttactgtcatgtgtcctctggagcttctcaccccagccctcattttaccatcccaggcatttattttgagccagactgtagcagtgaagacatggatcatggtgtgctggtggttggctacggatttgaaagcacagaatcagataacaataaatattggctggtgaagaacagctggggtgaagaatggggcatgggtggctacgtaaagatggccaaagaccggagaaaccattgtggaattgcctcagcagccagctaccccactgtgtgagctggtggacggtgatgaggaaggacttgactggggatggcgcatgcatgggaggaattcatcttcagtctaccagcccccgctgtgtcggatacacactcgaatcattgaagatccgagtgtgatttgaattctgtgatattttcacactggtaaatgttacctctattttaattactgctataaataggtttatattattgattcacttactgactttgcattttcgtttttaaaaggatgtataaatttttacctgtttaaataaaatttaatttcaaaaaatgtagtggtggggcttctttctatttttgatgcactgaatttttgtgtaataaagaacataattgggctctaagccata

SEQ ID NO: 299662 - DNA, 1330 bp, Homo sapiens
ggcggtgccggccgaacccagacccgaggttttagaagcagagtcaggcgaagctgggccagaaccgcgacctccgcaaccttgagcggcatccgtggagtgcgcctgcgcactacgaccgcagcaggaaagcgccgccggccaggcccagctgtggccggacagggactggaagagaggacgcggtcgagtaggtgtgcaccagccctggcaacgagagcgtctaccccgaactctgctggccttgaggtggggaagccggggagggcagttgaggaccccgcggaggcgcgtgactggttgagcgggcaggccagcctccgagccgggtggacacaggttttaaaacatgaatcctacactcatccttgctgccttttgcctgggaattgcctcagctactctaacatttgatcacagtttagaggcacagtggaccaagtggaaggcgatgcacaacagattatacggcatgaatgaagaaggatggaggagagcagtgtgggagaagaacatgaagatgattgaactgcacaatcaggaatacagggaagggaaacacagcttcacaatggccatgaacgcctttggagacatgaccagtgaagaattcaggcaggtgatgaatggctttcaaaaccgtaagcccaggaaggggaaagtgttccaggaacctctgttttatgaggcccccagatctgtggattggagagagaaaggctacgtgactcctgtgaagaatcagggtcagtgtggttcttgttgggcttttagtgctactggtgctcttgaaggacagatgttccggaaaactgggaggcttatctcactgagtgagcagaatctggtagactgctctgggcctcaaggcaatgaaggctgcaatggtggcctaatggattatgctttccagtatgttcaggataatggaggcctggactctgaggaatcctatccatatgaggcaacagtaagtggagctccttgtcatcattccagctcagcttttggaaggtggacactttcagagataacagatacctttttcggaattcatatattagggctgggtggggtggctcacgcctgtaatcccagccctttaggaggctgagccaggcagatggcttaagctcaggagtttgagaccagcctgggcaacaaggtgaaaccttgactctatcaaaaatacaacgaaaattagccggctgtggtggtgtgcgtctgtggtcccagctatgctgaggtagggcgattgcttgagtgtgggaggtggttgtgcaaatgcactctccagtctgagtgacagaatgagaccctgtctccaaaa

SEQ ID NO: 299663 - DNA, 522 bp, Homo sapiens
atgtacctccccctgatactttgctcaactctcctttgtacaaatgatcttgattcttatgccatctacctcttccttctgcttacctaccaaatcctggttatcccataatagtccattgtggaattgcctcagcagccagctaccccactgtgtgagctggtggacggtgatgaggaaggacttgactggggatggcgcatgcatgggaggaattcatcttcagtctaccagcccccgctgtgtcggatacacactcgaatcattgaagatccgagtgtgatttgaattctgtgatattttcacactggtaaatgttacctctattttaattactgctataaataggtttatattattgattcacttactgactttgcattttcgtttttaaaaggatgtataaatttttacctgtttaaataaaatttaatttcaaaaaatgtagtggtggggcttctttctatttttgatgcactgaatttttgtgtaataaagaacataattgggctctaagccata

SEQ ID NO: 299664 - DNA, 466 bp, Homo sapiens
tgttacctcatccagatgctgactttattatctgaattttctagcttgataaacaaacgtaccaccctgtcggtgcctgggatagcaaagagcacctttcacaggctactgggattctaacagagagaattaaggcaatccagaaaaaattccccacgtggagtgttgctcagcacctcaaaggtaggctgtattctgagtactttgtttaaatgagcaatgaatgagaccactgaaggccagtgtgacccgagactccctgggagcatttccacggggtcagcagtggccctgggaggagctgtctagaggctgcatttgcattccctgaaccactgagttactttgagaggtcctccatcctcaacctccatttcctcttctgcagaatgttggggttcttattcattgcttactgagctattgagtgataccttgaaacatagtgagaccctgtctctacaaa

SEQ ID NO: 299665 - DNA, 760 bp, Homo sapiens
gcacttccaggggctcataccccttcagtcactcaatgaagcctcacctacatccacgcctgtaccacggctgctatggggacatcatgaccatgaagacctctggggccacttgtgatgcaaacagtgtgatgaactgcgggatccgtggttctgaaatgtttgctgagatggatttgagggccataaaaccttaccagactctgatcaaagaagtcgggcagagacattgcgtggaccctgctgtcatcgcagccatcatctccagggaaagccatggcggatctgtcctgcaagacggctgggaccacaggggacttaaatttggcttgatgcagcttgataaacaaacgtaccaccctgtcggtgcctgggatagcaaagagcacctttcacaggctactgggattctaacagagagaattaaggcaatccagaaaaaattccccacgtggagtgttgctcagcacctcaaaggtaggctgtattctgagtactttgtttaaatgagcaatgaatgagaccactgaaggccagtgtgacccgagactccctgggagcatttccacggggtcagcagtggccctgggaggagctgtctagaggctgcatttgcattccctgaaccactgagttactttgagaggtcctccatcctcaacctccatttcctcttctgcagaatgttggggttcttattcattgcttactgagctattgagtgataccttgaaacatagtgagaccctgtctctacaaa

SEQ ID NO: 299666 - DNA, 774 bp, Homo sapiens
taattagagatgggctctcactatgatgcccaggctggtttcgaactcctcctgggttcaagcaatcctcctgtttcagcctcctgtgtagcaggaactgacttcaggcacacactaccatgcccggaaaaacagtttcttttctattgacgtagggatccgtggttctgaaatgtttgctgagatggatttgagggccataaaaccttaccagactctgatcaaagaagtcgggcagagacattgcgtggaccctgctgtcatcgcagccatcatctccagggaaagccatggcggatctgtcctgcaagacggctgggaccacaggggacttaaatttggcttgatgcagcttgataaacaaacgtaccaccctgtcggtgcctgggatagcaaagagcacctttcacaggctactgggattctaacagagagaattaaggcaatccagaaaaaattccccacgtggagtgttgctcagcacctcaaaggtaggctgtattctgagtactttgtttaaatgagcaatgaatgagaccactgaaggccagtgtgacccgagactccctgggagcatttccacggggtcagcagtggccctgggaggagctgtctagaggctgcatttgcattccctgaaccactgagttactttgagaggtcctccatcctcaacctccatttcctcttctgcagaatgttggggttcttattcattgcttactgagctattgagtgataccttgaaacatagtgagaccctgtctctacaaa

SEQ ID NO: 299667 - DNA, 2824 bp, Homo sapiens
cccccgcgccgcgcagccccggccgccaggccttagcccgccccggcccccgccaggccgcgtccccctcccctcccctcccccgcgcgccacccgcgcccgcccccgcccggcaccgcggacccacccggacctcggcggggagatggaggtcctggcggcagagaccacgtcccagcaggagcggctgcaggccatcgcagagaagcggaagcggcaggcggagatcgagaacaagcgccggcagctggaggacgagcggaggcagctgcagcacctgaagtccaaggcactgcgggagcgctggctgctggaggggacgccgtcctcggcctcagagggggatgaggacctgaggaggcagatgcaggacgacgagcagaagacacggctgctggaggactcggtgtccaggttggagaaggaaattgaggtgctggagcgtggagactccgccccagccgctgccaaggagaacgcggcggccccgagcccagtccgggccccagccccgagtccagccaaggaggagcgcaagacagaggtggtgatgaattcacagcagacgccggtgggcacgcccaaagacaagcgagtctccaacacgcccctgaggacggttgacggctcccccatgatgaaggcagccatgtactcggttgagatcactgtggagaaggacaaggtgacaggggagaccagggtgctgtccagcaccacgctgctccctcggcagccgctccctctgggcatcaaagtctacgaggacgagaccaaagtggtccatgctgtggacggcaccgccgagaacgggatccaccccctgagctcctccgaggtggacgaactcatccacaaagcggacgaggtcacgctgagcgaggcagggtccacggccggggcggcagagacccggggggctgtggagggggcagcccggaccacgccctcccggcgggagatcaccggtgtgcaggcacagccaggcgaggccacgtccggcccgccggggatccagcccggccaggagcccccggtcacaatgatcttcatgggttaccagaacgtggaggatgaggccgagaccaagaaggtgctgggccttcaagataccatcacggcggagctggtggtcatcgaagacgcggctgagcccaaggagcctgcaccacccaacggcagtgctgccgagcctcccacggaggccgcctccagggaagagaatcaggcggggcccgaggccaccaccagcgacccccaggacctcgacatgaagaagcaccgttgtaaatgctgctccatcatgtgagccggcccccgagaccccggcccccaccccacaccacagacacccaccagcccggcccctcccggcgcctgcccaccctccacccacagcctcacgggtccaggacttggcgtgttgttacatgttccttccgagttttctttcgctggaaagagggacaggggcccccacccgtcaccacgccccaacactccccccgaaccagagccgtgcacttgtgcctggtaggagagagacaggacagacccgcttttcccgagacaaggaccccccatgtcacggcagcttcacagacgcggctcgcgcccaccggggtcctggcgggtgggacccgcggcctccacgcggcccaggccagcctgccaccctctgggcctcctacctgtgcctttctctgaggggacaccccgccagagagggccccgggagccgggggtgggtactgaggcctgctcaggccctggaagtgaggctctatggggttccctggccaaggcgctggccccccaatctcaggcagttggggtgaggccgtgcctctttgggggctaaaggtcttgggtggaggacaggcccctctgctgtgcccctatgccctgtgtgggcccaaccagtggacaatggagtctgggggagggggaaccccggggacatgcccccacccgggaggggccggtaacccctgggctatcttctagacggggcgaaccaggggtcattgacctgccccctgcacagggcagggaccgagtgagccactccttgtcccgagctcccgcccccactgggccctccttcctcctggtgctaatttggggaccccaggggccgcccccggcctcttctccatcctgcttggaccagggtcctgggtcttcccaaccataccccgagatcaggccccacctgccagctctactgggcttggagcacgtccgggcagtggagggagggacacagcctgggacaggaagcctcttgggttggagcaggagaccctcatttgccacccagaccaatgtgagcctgcccccagccccctctcattggaagtggcaaggggcttccctcctgggggcagctacactcgtccccagaggcacattcgtgcacattctcacagacaccgtctcacacgttggctttggacaaccaggccccaacttggtccctgccctagggacctccagcctggtgcccagtgctcaggccacctcctggtccagtcaccacctgcagcctcggcagggcaggtacaggggccacctcggatgggagcctgggtccctgcctccgctctgcccctgggtggctgggaggagaggccctctcgggggtgacctgggcgtcagccgtggaaccccctcctcctccctggagtctgcctgagtccctcgagccgcgagccttcgctgaagtgcccttgctataaccccctctgcttctggtgtgtgacgaggcccccgatgttcttgattttcccagagaagcaaataaacagcgtgaacagcccca

SEQ ID NO: 299668 - DNA, 599 bp, Homo sapiens
gaggaggcagatgcaggacgacgagcagaagacacggctgctggaggactcggtgtcaggttggagaaggaaattgagtgtgctggagatggaggtcctggcggcagagaccacgtcccagcaggagcggctgcaggccatcgcagagaagcggaagcggcaggcggagatcgagaacaagcgccggcagctggaggacgagcggaggcagctgcagcacctgaagtccaaggcactgcgggagcgctggctgctggaggggacgccgtcctcggcctcagagggggatgaggacctgaggaggcagatgcaggacgacgagcagaagactccgccccagccgctgccaaggagaacgcggcggccccgagcccagtccgggccccagccccgagtccagccaaggaggagcgcaagacagaggtggtgatgaattcacagcagaacgcctggttgggcacgcccaaagacaaagcgagtctccaagacggcccctgaggaacggttgacggctcccccatgatgcaacggcagtggtccatgcctgtggaaccgggcaccgggccgaaggaaaccggggaattcccaagcccccttga

SEQ ID NO: 299669 - DNA, 2931 bp, Homo sapiens
tctgggcccttccaacaccaacgccccgcaccgcggaggcctctgcggggctcccgtcgggtttgggcctcatgaactcatctcctggagcaggactatctcacgcgctccagacgacgccctcgccgggccccgagccgcccacaccgccacacgccgtaaaaagcatcgcggggacgggaggcctgtgcgcgccggggtgggcgtcgggcggggggcgtggcgctccaggggctctgcgcggctgccgggagccagggaggctcggagacccagcacctgccccgggacccccagcacctgccctgggacccccagcagcaccaggaccgccgccgccctgagcttttccacgcctttgcccgggactcagctcctccgcccagcatggtcctggcggcagagaccacgtcccagcaggagcggctgcaggccatcgcagagaagcggaagcggcaggcggagatcgagaacaagcgccggcagctggaggacgagcggaggcagctgcagcacctgaagtccaaggcactgcgggagcgctggctgctggaggggacgccgtcctcggcctcagagggggatgaggacctgaggaggcagatgcaggacgacgagcagaagacacggctgctggaggactcggtgtccaggttggagaaggaaattgaggtgctggagcgtggagactccgccccagccgctgccaaggagaacgcggcggccccgagcccagtccgggccccagccccgagtccagccaaggaggagcgcaagacagaggtggtgatgaattcacagcagacgccggtgggcacgcccaaagacaagcgagtctccaacacgcccctgaggacggttgacggctcccccatgatgaaggcagtggtccatgctgtggacggcaccgccgagaacgggatccaccccctgagctcctccgaggtggacgaactcatccacaaagcggacgaggtcacgctgagcgaggcagggtccacggccggggcggcagagacccggggggctgtggagggggcagcccggaccacgccctcccggcgggagatcaccggtgtgcaggcacagccaggcgaggccacgtccggcccgccggggatccagcccggccaggagcccccggtcacaatgatcttcatgggttaccagaacgtggaggatgaggccgagaccaagaaggtgctgggccttcaagataccatcacggcggagctggtggtcatcgaagacgcggctgagcccaaggagcctgcaccacccaacggcagtgctgccgagcctcccacggaggccgcctccagggaagagaatcaggcggggcccgaggccaccaccagcgacccccaggacctcgacatgaagaagcaccgttgtaaatgctgctccatcatgtgagccggcccccgagaccccggcccccaccccacaccacagacacccaccagcccggcccctcccggcgcctgcccaccctccacccacagcctcacgggtccaggacttggcgtgttgttacatgttccttccgagttttctttcgctggaaagagggacaggggcccccacccgtcaccacgccccaacactccccccgaaccagagccgtgcacttgtgcctggtaggagagagacaggacagacccgcttttcccgagacaaggaccccccatgtcacggcagcttcacagacgcggctcgcgcccaccggggtcctggcgggtgggacccgcggcctccacgcggcccaggccagcctgccaccctctgggcctcctacctgtgcctttctctgaggggacaccccgccagagagggccccgggagccgggggtgggtactgaggcctgctcaggccctggaagtgaggctctatggggttccctggccaaggcgctggccccccaatctcaggcagttggggtgaggccgtgcctctttgggggctaaaggtcttgggtggaggacaggcccctctgctgtgcccctatgccctgtgtgggcccaaccagtggacaatggagtctgggggagggggaaccccggggacatgcccccacccgggaggggccggtaacccctgggctatcttctagacggggcgaaccaggggtcattgacctgccccctgcacagggcagggaccgagtgagccactccttgtcccgagctcccgcccccactgggccctccttcctcctggtgctaatttggggaccccaggggccgcccccggcctcttctccatcctgcttggaccagggtcctgggtcttcccaaccataccccgagatcaggccccacctgccagctctactgggcttggagcacgtccgggcagtggagggagggacacagcctgggacaggaagcctcttgggttggagcaggagaccctcatttgccacccagaccaatgtgagcctgcccccagccccctctcattggaagtggcaaggggcttccctcctgggggcagctacactcgtccccagaggcacattcgtgcacattctcacagacaccgtctcacacgttggctttggacaaccaggccccaacttggtccctgccctagggacctccagcctggtgcccagtgctcaggccacctcctggtccagtcaccacctgcagcctcggcagggcaggtacaggggccacctcggatgggagcctgggtccctgcctccgctctgcccctgggtggctgggaggagaggccctctcgggggtgacctgggcgtcagccgtggaaccccctcctcctccctggagtctgcctgagtccctcgagccgcgagccttcgctgaagtgcccttgctataaccccctctgcttctggtgtgtgacgaggcccccgatgttcttgattttcccagagaagcaaataaacagcgtgaacagcccca

SEQ ID NO: 299670 - DNA, 2956 bp, Homo sapiens
tctgggcccttccaacaccaacgccccgcaccgcggaggcctctgcggggctcccgtcgggtttgggcctcatgaactcatctcctggagcaggactatctcacgcgctccagacgacgccctcgccgggccccgagccgcccacaccgccacacgccgtaaaaagcatcgcggggacgggaggcctgtgcgcgccggggtgggcgtcgggcggggggcgtggcgctccaggggctctgcgcggctgccgggagccagggaggctcggagacccagcacctgccccgggacccccagcacctgccctgggacccccagcagcaccaggaccgccgccgccctgagcttttccacgcctttgcccgggactcagctcctccgcccagcatggtcctggcggcagagaccacgtcccagcaggagcggctgcaggccatcgcagagaagcggaagcggcaggcggagatcgagaacaagcgccggcagctggaggacgagcggaggcagctgcagcacctgaagtccaaggcactgcgggagcgctggctgctggaggggacgccgtcctcggcctcagagggggatgaggacctgaggaggcagatgcaggacgacgagcagaagacacggctgctggaggactcggtgtccaggttggagaaggaaattgaggtgctggagcgtggagactccgccccagccgctgccaaggagaacgcggcggccccgagcccagtccgggccccagccccgagtccagccaaggaggagcgcaagacagaggtggtgatgaattcacagcagacgccggtgggcacgcccaaagacaagcgagtctccaacacgcccctgaggacggttgacggctcccccatgatgaaggcagtggtccatgctgtggacggcaccgccgagaacgggatccaccccctgagctcctccgaggtggacgaactcatccacaaagcggacgaggtcacgctgagcgaggcagggtccacggccggggcggcagagacccggggggctgtggagggggcagcccggaccacgccctcccggcgggagatcaccggtgtgcaggcacagccaggcgaggccacgtccggcccgccggggatccagcccggccaggagcccccggtcacaatgatcttcatgggttaccagaacgtggaggatgaggccgagaccaagaaggtgctgggccttcaagataccatcacggcggagctggtggtcatcgaagacgcggctgagcccaaggagcctgcaccacccaacggcagtgctgccgagcctcccacggaggccgcctccagggaagagaatcaggcggggcccgaggccaccaccagcgacccccaggacctcgacatgaagaagcaccgttgtaaatgctgctccatcatgtgagccggcccccgagaccccggcccccaccccacaccacagacacccaccagcccggcccctcccggcgcctgcccaccctccacccacagcctcacgggtccaggacttggcgtgttgttacatgttccttccgagttttctttcgctggaaagagggacaggggcccccacccgtcaccacgccccaacactccccccgaaccagagccgtgcacttgtgcctggtaggagagagacaggacagacccgcttttcccgagacaaggaccccccatgtcacggcagcttcacagacgcggctcgcgcccaccggggtcctggcgggtgggacccgcggcctccacgcggcccaggccagcctgccaccctctgggcctcctacctgtgcctttctctgaggggacaccccgccagagagggccccgggagccgggggtgggtactgaggcctgctcaggccctggaagtgaggctctatggggttccctggccaaggcgctggccccccaatctcaggcagttggggtgaggccgtgcctctttgggggctaaaggtcttgggtggaggacaggcccctctgctgtgcccctatgccctgtgtgggcccaaccagtggacaatggagtctgggggagggggaaccccggggacatgcccccacccgggaggggccggtaacccctgggctatcttctagacggggcgaaccaggggtcattgacctgccccctgcacagggcagggaccgagtgagccactccttgtcccgagctcccgcccccactgggccctccttcctcctggtgctaatttggggaccccaggggccgcccccggcctcttctccatcctgcttggaccagggtcctgggtcttcccaaccataccccgagatcaggccccacctgccagctctactgggcttggagcacgtccgggcagtggagggagggacacagcctgggacaggaagcctcttgggttggagcaggagaccctcatttgccacccagaccaatgtgagcctgcccccagccccctctcattggaagtggcaaggggcttccctcctgggggcagctacactcgtccccagaggcacattcgtgcacattctcacagacaccgtctcacacgttggctttggacaaccaggccccaacttggtccctgccctagggacctccagcctggtgcccagtgctcaggccacctcctggtccagtcaccacctgcagcctcggcagggcaggtacaggggccacctcggatgggagcctgggtccctgcctccgctctgcccctgggtggctgggaggagaggccctctcgggggtgacctgggcgtcagccgtggaaccccctcctcctccctggagtctgcctgagtccctcgagccgcgagccttcgctgaagtgcccttgctataaccccctctgcttctggtgtgtgacgaggcccccgatgttcttgattttcccagagaagcaaataaacagcgtgaacagccccacagcaaaaaaacaaaacaaaaaaag

SEQ ID NO: 299671 - DNA, 417 bp, Homo sapiens
tcctcctccctggagtctgcctgagtccctcgagccgcgagccttcgctgaagtgcccttgctataaccccctctgcttctggtgtgtgacgaggcccccgatgttcttgattttcccagagaagcaaataaacagcgtgaacagccccacccagttcctggagttcttgcctttcaacctggcgaggaaggcgtggccaggccagggggtggggcctgccggcctttgagccattaaagggaggctgagcagggttgcggtgtgctggcttcacctgcctgcacccgctcaccctgagcgccttggggtggtgggaggcgctggaatccccactgtgcaggtaaggcctggctgtaaggggctgctgtgggggggcaggactggcttcccggggggccctcgggttctgcggccgc

SEQ ID NO: 299672 - DNA, 1829 bp, Homo sapiens
gtcgggggcggggggtgcgccggggtagccgagaggcggacgcaacagcggggtcccgcgctgtctgggcggccccaggggctgtcggctcacttccgggaacgccggggaaccgcagtagccgcctgctagtggcgctgctagccggccggcgcaggctgccgagcgggtgagcgcgcaggccaggccaaagccctggtacccgcgcggtgcgggcctcagtctgcggccatgggggcgtccgcgcggctgctgcgagcggtgatcatgggggccccgggctcgggcaagggcaccgtgtcgtcgcgcatcactacacacttcgagctgaagcacctctccagcggggacctgctccgggacaacatgctgcggggcacagaaattggcgtgttagccaaggctttcattgaccaagggaaactcatcccagatgatgtcatgactcggctggcccttcatgagctgaaaaatctcacccagtatagctggctgttggatggttttccaaggacacttccacaggcagaagccctagatagagcttatcagatcgacacagtgattaacctgaatgtgccctttgaggtcattaaacaacgccttactgctcgctggattcatcccgccagtggccgagtctataacattgaattcaaccctcccaaaactgtgggcattgatgacctgactggggagcctctcattcagcgtgaggatgataaaccagagacggttatcaagagactaaaggcttatgaagaccaaacaaagccagtcctggaatattaccagaaaaaaggggtgctggaaacattctccggaacagaaaccaacaagatttggccctatgtatatgctttcctacaaactaaagttccacaaagaagccagaaagcttcagttactccatgaggagaaatgtgtgtaactattaatagtaagatgggcaaacctcctagtccttgcatttagaagctgcttttcctaagacttctagtatgtatgaattctttgaaaattatattacttttatttctactgattttattttggatactaaggatgtgccaaatgattcggatactaagatgcatcgtttgaaatcatctagtgtgttgtatgcagttatcctcaaaaacatcagcgatgtctgaacctttaaaacatctgttagagcaaaattaaaagagcatttggtagtaatctaactttttgttcagttaataagtggttgataaagtttccatatttttctggaaaagttaaaaaaagttacatgtcatttggagaaaatacgtaatcagaaatttgtgcatagattgatgccaaaaaagacatttccagcattgtggaacatggtgagacactatataaaattccagaaagaaagcaactggatttacagatttattgtgagacacaaattcactgctgcctttacactaagaaatgtatatgttaaccatatatgctgtatttattttgtcgttaagcatactttcagtttactcagaattttcaatttgctataaagatgtatcaattagcatatagaaaaatattactttaagatgacttgtttcctttgaaaatacctgtgtactgagggttatgatttgtgtcaaaaattgacataagtgcttttacaagcaccaaagttgaatgaattttcaacaaaatgtaattaaagtctatgttttcagttatgactcaggttaagaaatgtgttttaggatctacttgctggtttttctttttgatccaaatgtgtgatctgccctgataaataacaagttatagtaccatctcccccgccaataaaaaag

SEQ ID NO: 299673 - DNA, 1519 bp, Homo sapiens
acacactcttttacgttatttataaaagagtctcactcaatggaagctggatttcctctcctgtaaaatgagaaattggcgtgttagccaaggctttcattgaccaagggaaactcatcccagatgatgtcatgactcggctggcccttcatgagctgaaaaatctcacccagtatagctggctgttggatggttttccaaggacacttccacaggcagaagccctagatagagcttatcagatcgacacagtgattaacctgaatgtgccctttgaggtcattaaacaacgccttactgctcgctggattcatcccgccagtggccgagtctataacattgaattcaaccctcccaaaactgtgggcattgatgacctgactggggagcctctcattcagcgtgaggatgataaaccagagacggttatcaagagactaaaggcttatgaagaccaaacaaagccagtcctggaatattaccagaaaaaaggggtgctggaaacattctccggaacagaaaccaacaagatttggccctatgtatatgctttcctacaaactaaagttccacaaagaagccagaaagcttcagttactccatgaggagaaatgtgtgtaactattaatagtaagatgggcaaacctcctagtccttgcatttagaagctgcttttcctaagacttctagtatgtatgaattctttgaaaattatattacttttatttctactgattttattttggatactaaggatgtgccaaatgattcggatactaagatgcatcgtttgaaatcatctagtgtgttgtatgcagttatcctcaaaaacatcagcgatgtctgaacctttaaaacatctgttagagcaaaattaaaagagcatttggtagtaatctaactttttgttcagttaataagtggttgataaagtttccatatttttctggaaaagttaaaaaaagttacatgtcatttggagaaaatacgtaatcagaaatttgtgcatagattgatgccaaaaaagacatttccagcattgtggaacatggtgagacactatataaaattccagaaagaaagcaactggatttacagatttattgtgagacacaaattcactgctgcctttacactaagaaatgtatatgttaaccatatatgctgtatttattttgtcgttaagcatactttcagtttactcagaattttcaatttgctataaagatgtatcaattagcatatagaaaaatattactttaagatgacttgtttcctttgaaaatacctgtgtactgagggttatgatttgtgtcaaaaattgacataagtgcttttacaagcaccaaagttgaatgaattttcaacaaaatgtaattaaagtctatgttttcagttatgactcaggttaagaaatgtgttttaggatctacttgctggtttttctttttgatccaaatgtgtgatctgccctgataaataacaagttatagtaccatctcccccgccaataaaaaag

SEQ ID NO: 299674 - DNA, 888 bp, Homo sapiens
gtcgggggcggggggtgcgccggggtagccgagaggcggacgcaacagcggggtcccgcgctgtctgggcggccccaggggctgtcggctcacttccgggaacgccggggaaccgcagtagccgcctgctagtggcgctgctagccggccggcgcaggctgccgagcgggtgagcgcgcaggccaggccaaagccctggtacccgcgcggtgcgggcctcagtctgcggccatgggggcgtccgcgcggctgctgcgagcggtgatcatgggggccccgggctcgggcaagggcaccgtgtcgtcgcgcatcactacacacttcgagctgaagcacctctccagcggggacctgctccgggacaacatgctgcggggcacagaaattggcgtgttagccaaggctttcattgaccaagggaaactcatcccagatgatgtcatgactcggctggcccttcatgagctgaaaaatctcacccagtatagctggctgttggatggttttccaaggacacttccacaggcagaagccctagatagagcttatcagatcgacacagtgattaacctgaatgtgccctttgaggtcattaaacaacgccttactgctcgctggattcatcccgccagtggccgagtctataacattgaattcaaccctcccaaaactgtgggcattgatgacctgactggggagcctctcattcagcgtgaggatgataaaccagagacggttatcaagagactaaaggcttatgaagaccaaacaaagccagtcctggaatattaccagaaggggtgctgaactaagttcacaagaagcagaagctcagtactcatgagggaatgggtgactattatagaagatggccctctagcctgcatg

SEQ ID NO: 299675 - DNA, 818 bp, Homo sapiens
gtcgggggcggggggtgcgccggggtagccgagaggcggacgcaacagcggggtcccgcgctgtctgggcggccccaggggctgtcggctcacttccgggaacgccggggaaccgcagtagccgcctgctagtggcgctgctagccggccggcgcaggctgccgagcgggtgagcgcgcaggccaggccaaagccctggtacccgcgcggtgcgggcctcagtctgcggccatgggggcgtccgcgcggctgctgcgagcggtgatcatgggggccccgggctcgggcaagggcaccgtgtcgtcgcgcatcactacacacttcgagctgaagcacctctccagcggggacctgctccgggacaacatgctgcggggcacagcttccctattccctgagacacaacaatattgaaattaggccaactaataaccctacagtggcctctaagtgttcaagttaaaggaagagagtggcacatctctcactttaaatcaaaagctagaaatgattaagcttagtgaggaaggcatgctgaaaaccaagacaggctgaaaccaggcttcttgcaccagttagccaagttgtaagtgcaaaggaagaccttgaaggaaattaaaagtgctgctccagtaaacactggagcacaagaaagcaaaacaaccttgttgttgatatggagaaagcttgagtggtctagaaagaagatcagaccagccacatcatccattaagccaaagcccagtccagagcaaggccctaattctcttcatttcagtgaaggctgagagatgtgttgaagctgcagaataaaaatt

SEQ ID NO: 299676 - DNA, 3233 bp, Homo sapiens
gtcgggggcggggggtgcgccggggtagccgagaggcggacgcaacagcggggtcccgcgctgtctgggcggccccaggggctgtcggctcacttccgggaacgccggggaaccgcagtagccgcctgctagtggcgctgctagccggccggcgcaggctgccgagcgggtgagcgcgcaggccaggccaaagccctggtacccgcgcggtgcgggcctcagtctgcggccatgggggcgtccgcgcggctgctgcgagcggtgatcatgggggccccgggctcgggcaagggcaccgtgtcgtcgcgcatcactacacacttcgagctgaagcacctctccagcggggacctgctccgggacaacatgctgcggggcacagaaattggcgtgttagccaaggctttcattgaccaagggaaactcatcccagatgatgtcatgactcggctggcccttcatgagctgaaaaatctcacccagtatagctggctgttggatggttttccaaggacacttccacaggcagaagccctagatagagcttatcagatcgacacagtgattaacctgaatgtgccctttgaggtcattaaacaacgccttactgctcgctggattcatcccgccagtggccgagtctataacattgaattcaaccctcccaaaactgtgggcattgatgacctgactggggagcctctcattcagcgtgaggatgataaaccagagacggttatcaagagactaaaggcttatgaagaccaaacaaagccagtcctggaatattaccagaaaaaaggggtgctggaaacattctccggaacagaaaccaacaagatttggccctatgtatatgctttcctacaaactaaagttccacaaagaagccagaaagcttcagttactccatgaggagaaatgtgtgtaactattaatagtaagatgggcaaacctcctagtccttgcatttagaagctgcttttcctaagacttctagtatgtatgaattctttgaaaattatattacttttatttctactgattttattttggatactaaggatgtgccaaatgattcggatactaagatgcatcgtttgaaatcatctagtgtgttgtatgcagttatcctcaaaaacatcagcgatgtctgaacctttaaaacatctgttagagcaaaattaaaagagcatttggtagtaatctaactttttgttcagttaataagtggttgataaagtttccatatttttctggaaaagttaaaaaaagttacatgtcatttggagaaaatacgtaatcagaaatttgtgcatagattgatgccaaaaaagacatttccagcattgtggaacatggtgagacactatataaaattccagaaagaaagcaactggatttacagatttattgtgagacacaaattcactgctgcctttacactaagaaatgtatatgttaaccatatatgctgtatttattttgtcgttaagcatactttcagtttactcagaattttcaatttgctataaagatgtatcaattagcatatagaaaaatattactttaagatgacttgtttcctttgaaaatacctgtgtactgagggttatgatttgtgtcaaaaattgacataagtgcttttacaagcaccaaagttgaatgaattttcaacaaaatgtaattaaagtctatgttttcagttatgactcaggttaagaaatgtgttttaggatctacttgctggtttttctttttgatccaaatgtgtgatctgccctgataaataacaagttatagtaccatctcccccgccaataaaaaagagaagaaaaaagagaaacccgtggcactatgtaaataaagtaagcatactttgttgttagtaaatagatgaggcatgcctgggaaatgctcccttggcataaatagcaatcaattataattagtaaacaggtgtaccaataaaaagaatttacatgataggttaacaaggaccaggaaagtgagtttcctgaaggagttctttgttcctgatcaaagaaattgatacctgttagcattcactgccaccatattttaaggagaaagaactctattggtgtcgtctgagcagccatttaaaaattggaatctaaaggatggttgctgatgtactgtgtggtctggtagaagtggggaaatatgagagatggaggaaaaacttgattatgtcttccatggcatatttactcttactttacttcgtgccaaatcaaatgaaacaagccgtcttacaagtcgttattgcctttaaaaatctgttccgtttttttcccaggtacttaaaatacaagtgccagtaagtggttcttatgtgttttggggggaaaattttatttcccttttcttctgatatttaaaaaattcatcgatctttcaagatgaaccaaggttttttaaaagaattataggaaacacttcattctttataaaactttctataatgccttatttgaatgttaatcttatgtgctttctaaaaaatgttgtgaaataccaaacttatggattatcactaggttatcaagcatatattagtctttatcagaataaaatgaaatttcataactgtggctattactttgttcttggtccttcacagggcctgctccatcccacctgcctttctgctgcctgatgtctcaatggcttctgaatgactgttctaataaatgatcttaaaacagtccaaaaaaaaaaaaaaaaaaacaaaacaaaaaaaaaaaaaaaaaaaaaaaaaaaaaaaaaacaaaaccaaaaaaacacaaaaaaaacaataccaaacaaaaaacaaaaaaaaaaaaggaagggggggggcgggaaaaaatatctccccggggggggcgcccaacacccccccccctttttgtaaaggggcccccccagagggggctaaaaaaaaggggcggcgggcgaacaccaggcggaggagacaaaacactgacgacgttcattggagaggaccacctctggcggtggggaagtagagagcgccccacgaagaagaaagcggcagcaaaacattgctggaggggcaacccgcttgtcgggtcgaaattcctcctgttcttcattcagacgttataaaacagacacgacgacgccaacaacagacgagataaataaatctaaaagatataaatcaccacagtactcgcacactcacactcctccacaatcacgctgac

SEQ ID NO: 299677 - DNA, 2612 bp, Homo sapiens
gtcgggggcggggggtgcgccggggtagccgagaggcggacgcaacagcggggtcccgcgctgtctgggcggccccaggggctgtcggctcacttccgggaacgccggggaaccgcagtagccgcctgctagtggcgctgctagccggccggcgcaggctgccgagcgggtgagcgcgcaggccaggccaaagccctggtacccgcgcggtgcgggcctcagtctgcggccatgggggcgtccgcgcggctgctgcgagcggtgatcatgggggccccgggctcgggcaagggcaccgtgtcgtcgcgcatcactacacacttcgagctgaagcacctctccagcggggacctgctccgggacaacatgctgcggggcacagaaattggcgtgttagccaaggctttcattgaccaagggaaactcatcccagatgatgtcatgactcggctggcccttcatgagctgaaaaatctcacccagtatagctggctgttggatggttttccaaggacacttccacaggcagaagccctagatagagcttatcagatcgacacagtgattaacctgaatgtgccctttgaggtcattaaacaacgccttactgctcgctggattcatcccgccagtggccgagtctataacattgaattcaaccctcccaaaactgtgggcattgatgacctgactggggagcctctcattcagcgtgaggatgataaaccagagacggttatcaagagactaaaggcttatgaagaccaaacaaagccagtcctggaatattaccagaaaaaaggggtgctggaaacattctccggaacagaaaccaacaagatttggccctatgtatatgctttcctacaaactaaagttccacaaagaagccagaaagcttcagttactccatgaggagaaatgtgtgtaactattaatagtaagatgggcaaacctcctagtccttgcatttagaagctgcttttcctaagacttctagtatgtatgaattctttgaaaattatattacttttatttctactgattttattttggatactaaggatgtgccaaatgattcggatactaagatgcatcgtttgaaatcatctagtgtgttgtatgcagttatcctcaaaaacatcagcgatgtctgaacctttaaaacatctgttagagcaaaattaaaagagcatttggtagtaatctaactttttgttcagttaataagtggttgataaagtttccatatttttctggaaaagttaaaaaaagttacatgtcatttggagaaaatacgtaatcagaaatttgtgcatagattgatgccaaaaaagacatttccagcattgtggaacatggtgagacactatataaaattccagaaagaaagcaactggatttacagatttattgtgagacacaaattcactgctgcctttacactaagaaatgtatatgttaaccatatatgctgtatttattttgtcgttaagcatactttcagtttactcagaattttcaatttgctataaagatgtatcaattagcatatagaaaaatattactttaagatgacttgtttcctttgaaaatacctgtgtactgagggttatgatttgtgtcaaaaattgacataagtgcttttacaagcaccaaagttgaatgaattttcaacaaaatgtaattaaagtctatgttttcagttatgactcaggttaagaaatgtgttttaggatctacttgctggtttttctttttgatccaaatgtgtgatctgccctgataaataacaagttatagtaccatctcccccgccaataaaaaagagaagaaaaaagagaaacccgtggcactatgtaaataaagtaagcatactttgttgttagtaaatagatgaggcatgcctgggaaatgctcccttggcataaatagcaatcaattataattagtaaacaggtgtaccaataaaaagaatttacatgataggttaacaaggaccaggaaagtgagtttcctgaaggagttctttgttcctgatcaaagaaattgatacctgttagcattcactgccaccatattttaaggagaaagaactctattggtgtcgtctgagcagccatttaaaaattggaatctaaaggatggttgctgatgtactgtgtggtctggtagaagtggggaaatatgagagatggaggaaaaacttgattatgtcttccatggcatatttactcttactttacttcgtgccaaatcaaatgaaacaagccgtcttacaagtcgttattgcctttaaaaatctgttccgtttttttcccaggtacttaaaatacaagtgccagtaagtggttcttatgtgttttggggggaaaattttatttcccttttcttctgatatttaaaaaattcatcgatctttcaagatgaaccaaggttttttaaaagaattataggaaacacttcattctttataaaactttctataatgccttatttgaatgttaatcttatgtgctttctaaaaaatgttgtgaaataccaaacttatggattatcactaggttatcaagcatatattagtctttatcagaataaaatgaaatttcata

SEQ ID NO: 299678 - DNA, 2632 bp, Homo sapiens
  misc_feature (2632)..(2632): n is a, c, g, or t
gtcgggggcggggggtgcgccggggtagccgagaggcggacgcaacagcggggtcccgcgctgtctgggcggccccaggggctgtcggctcacttccgggaacgccggggaaccgcagtagccgcctgctagtggcgctgctagccggccggcgcaggctgccgagcgggtgagcgcgcaggccaggccaaagccctggtacccgcgcggtgcgggcctcagtctgcggccatgggggcgtccgcgcggctgctgcgagcggtgatcatgggggccccgggctcgggcaagggcaccgtgtcgtcgcgcatcactacacacttcgagctgaagcacctctccagcggggacctgctccgggacaacatgctgcggggcacagaaattggcgtgttagccaaggctttcattgaccaagggaaactcatcccagatgatgtcatgactcggctggcccttcatgagctgaaaaatctcacccagtatagctggctgttggatggttttccaaggacacttccacaggcagaagccctagatagagcttatcagatcgacacagtgattaacctgaatgtgccctttgaggtcattaaacaacgccttactgctcgctggattcatcccgccagtggccgagtctataacattgaattcaaccctcccaaaactgtgggcattgatgacctgactggggagcctctcattcagcgtgaggatgataaaccagagacggttatcaagagactaaaggcttatgaagaccaaacaaagccagtcctggaatattaccagaaaaaaggggtgctggaaacattctccggaacagaaaccaacaagatttggccctatgtatatgctttcctacaaactaaagttccacaaagaagccagaaagcttcagttactccatgaggagaaatgtgtgtaactattaatagtaagatgggcaaacctcctagtccttgcatttagaagctgcttttcctaagacttctagtatgtatgaattctttgaaaattatattacttttatttctactgattttattttggatactaaggatgtgccaaatgattcggatactaagatgcatcgtttgaaatcatctagtgtgttgtatgcagttatcctcaaaaacatcagcgatgtctgaacctttaaaacatctgttagagcaaaattaaaagagcatttggtagtaatctaactttttgttcagttaataagtggttgataaagtttccatatttttctggaaaagttaaaaaaagttacatgtcatttggagaaaatacgtaatcagaaatttgtgcatagattgatgccaaaaaagacatttccagcattgtggaacatggtgagacactatataaaattccagaaagaaagcaactggatttacagatttattgtgagacacaaattcactgctgcctttacactaagaaatgtatatgttaaccatatatgctgtatttattttgtcgttaagcatactttcagtttactcagaattttcaatttgctataaagatgtatcaattagcatatagaaaaatattactttaagatgacttgtttcctttgaaaatacctgtgtactgagggttatgatttgtgtcaaaaattgacataagtgcttttacaagcaccaaagttgaatgaattttcaacaaaatgtaattaaagtctatgttttcagttatgactcaggttaagaaatgtgttttaggatctacttgctggtttttctttttgatccaaatgtgtgatctgccctgataaataacaagttatagtaccatctcccccgccaataaaaaagagaagaaaaaagagaaacccgtggcactatgtaaataaagtaagcatactttgttgttagtaaatagatgaggcatgcctgggaaatgctcccttggcataaatagcaatcaattataattagtaaacaggtgtaccaataaaaagaatttacatgataggttaacaaggaccaggaaagtgagtttcctgaaggagttctttgttcctgatcaaagaaattgatacctgttagcattcactgccaccatattttaaggagaaagaactctattggtgtcgtctgagcagccatttaaaaattggaatctaaaggatggttgctgatgtactgtgtggtctggtagaagtggggaaatatgagagatggaggaaaaacttgattatgtcttccatggcatatttactcttactttacttcgtgccaaatcaaatgaaacaagccgtcttacaagtcgttattgcctttaaaaatctgttccgtttttttcccaggtacttaaaatacaagtgccagtaagtggttcttatgtgttttggggggaaaattttatttcccttttcttctgatatttaaaaaattcatcgatctttcaagatgaaccaaggttttaaagaatttgaaccttcatcttataacttctataggctatgagtaactaggtgctctaaagtggattcacttggtttcctgttcaggtttgctttcgaaaagaaacagggaaggtggccagggcccccctttggggtcgcggtggtggttaaaaaaaggcgggaagggggggaggttagagtaactggagn

SEQ ID NO: 299679 - DNA, 2480 bp, Homo sapiens
  misc_feature (2410)..(2410): n is a, c, g, or t
  misc_feature (2412)..(2412): n is a, c, g, or t
  misc_feature (2418)..(2419): n is a, c, g, or t
  misc_feature (2423)..(2423): n is a, c, g, or t
  misc_feature (2428)..(2428): n is a, c, g, or t
  misc_feature (2435)..(2435): n is a, c, g, or t
  misc_feature (2441)..(2441): n is a, c, g, or t
  misc_feature (2446)..(2446): n is a, c, g, or t
gtcgggggcggggggtgcgccggggtagccgagaggcggacgcaacagcggggtcccgcgctgtctgggcggccccaggggctgtcggctcacttccgggaacgccggggaaccgcagtagccgcctgctagtggcgctgctagccggccggcgcaggctgccgagcgggtgagcgcgcaggccaggccaaagccctggtacccgcgcggtgcgggcctcagtctgcggccatgggggcgtccgcgcggctgctgcgagcggtgatcatgggggccccgggctcgggcaagggcaccgtgtcgtcgcgcatcactacacacttcgagctgaagcacctctccagcggggacctgctccgggacaacatgctgcggggcacagaaattggcgtgttagccaaggctttcattgaccaagggaaactcatcccagatgatgtcatgactcggctggcccttcatgagctgaaaaatctcacccagtatagctggctgttggatggttttccaaggacacttccacaggcagaagccctagatagagcttatcagatcgacacagtgattaacctgaatgtgccctttgaggtcattaaacaacgccttactgctcgctggattcatcccgccagtggccgagtctataacattgaattcaaccctcccaaaactgtgggcattgatgacctgactggggagcctctcattcagcgtgaggatgataaaccagagacggttatcaagagactaaaggcttatgaagaccaaacaaagccagtcctggaatattaccagaaaaaaggggtgctggaaacattctccggaacagaaaccaacaagatttggccctatgtatatgctttcctacaaactaaagttccacaaagaagccagaaagcttcagttactccatgaggagaaatgtgtgtaactattaatagtaagatgggcaaacctcctagtccttgcatttagaagctgcttttcctaagacttctagtatgtatgaattctttgaaaattatattacttttatttctactgattttattttggatactaaggatgtgccaaatgattcggatactaagatgcatcgtttgaaatcatctagtgtgttgtatgcagttatcctcaaaaacatcagcgatgtctgaacctttaaaacatctgttagagcaaaattaaaagagcatttggtagtaatctaactttttgttcagttaataagtggttgataaagtttccatatttttctggaaaagttaaaaaaagttacatgtcatttggagaaaatacgtaatcagaaatttgtgcatagattgatgccaaaaaagacatttccagcattgtggaacatggtgagacactatataaaattccagaaagaaagcaactggatttacagatttattgtgagacacaaattcactgctgcctttacactaagaaatgtatatgttaaccatatatgctgtatttattttgtcgttaagcatactttcagtttactcagaattttcaatttgctataaagatgtatcaattagcatatagaaaaatattactttaagatgacttgtttcctttgaaaatacctgtgtactgagggttatgatttgtgtcaaaaattgacataagtgcttttacaagcaccaaagttgaatgaattttcaacaaaatgtaattaaagtctatgttttcagttatgactcaggttaagaaatgtgttttaggatctacttgctggtttttctttttgatccaaatgtgtgatctgccctgataaataacaagttatagtaccatctcccccgccaataaaaaagagaagaaaaaagagaaacccgtggcactatgtaaataaagtaagcatactttgttgttagtaaatagatgaggcatgcctgggaaatgctcccttggcataaatagcaatcaattataattagtaaacaggtgtaccaataaaaagaatttacatgataggttaacaaggaccaggaaagtgagtttcctgaaggagttctttgttcctgatcaaagaaattgatacctgttagcattcactgccaccatattttaaggagaaagaactctattggtgtcgtctgagcagccatttaaaaattggaatctaaaggatggttgctgatgtactgtgtggtctggtagaagtggggaaatatgagagatggaggaaaaacttgattatgtcttccatggcatatttactcttactttacttcgtgccaaatcaaatgaaacaagccgtcttacaagtcgttattgcctttaaaaatctgttccgtttttttcccaggtacttaaaatacaagtgccagtaagtggttcttatgtgttttggggggaaaattttatttcccttttcttctgatatttaaaaatncngcttcnnatanccggntttaaanttggancctcntttaaattataaacataaagaacatgcccacagg

SEQ ID NO: 299680 - DNA, 3179 bp, Homo sapiens
gtcgggggcggggggtgcgccggggtagccgagaggcggacgcaacagcggggtcccgcgctgtctgggcggccccaggggctgtcggctcacttccgggaacgccggggaaccgcagtagccgcctgctagtggcgctgctagccggccggcgcaggctgccgagcgggtgagcgcgcaggccaggccaaagccctggtacccgcgcggtgcgggcctcagtctgcggccatgggggcgtccgcgcggctgctgcgagcggtgatcatgggggccccgggctcgggcaagggcaccgtgtcgtcgcgcatcactacacacttcgagctgaagcacctctccagcggggacctgctccgggacaacatgctgcggggcacagaaattggcgtgttagccaaggctttcattgaccaagggaaactcatcccagatgatgtcatgactcggctggcccttcatgagctgaaaaatctcacccagtatagctggctgttggatggttttccaaggacacttccacaggcagaagccctagatagagcttatcagatcgacacagtgattaacctgaatgtgccctttgaggtcattaaacaacgccttactgctcgctggattcatcccgccagtggccgagtctataacattgaattcaaccctcccaaaactgtgggcattgatgacctgactggggagcctctcattcagcgtgaggatgataaaccagagacggttatcaagagactaaaggcttatgaagaccaaacaaagccagtcctggaatattaccagaaaaaaggggtgctggaaacattctccggaacagaaaccaacaagatttggccctatgtatatgctttcctacaaactaaagttccacaaagaagccagaaagcttcagttactccatgaggagaaatgtgtgtaactattaatagtaagatgggcaaacctcctagtccttgcatttagaagctgcttttcctaagacttctagtatgtatgaattctttgaaaattatattacttttatttctactgattttattttggatactaaggatgtgccaaatgattcggatactaagatgcatcgtttgaaatcatctagtgtgttgtatgcagttatcctcaaaaacatcagcgatgtctgaacctttaaaacatctgttagagcaaaattaaaagagcatttggtagtaatctaactttttgttcagttaataagtggttgataaagtttccatatttttctggaaaagttaaaaaaagttacatgtcatttggagaaaatacgtaatcagaaatttgtgcatagattgatgccaaaaaagacatttccagcattgtggaacatggtgagacactatataaaattccagaaagaaagcaactggatttacagatttattgtgagacacaaattcactgtcgttaagcatactttcagtttactcagaattttcaatttgctataaagatgtatcaattagcatatagaaaaatattactttaagatgacttgtttcctttgaaaatacctgtgtactgagggttatgatttgtgtcaaaaattgacataagtgcttttacaagcaccaaagttgaatgaattttcaacaaaatgtaattaaagtctatgttttcagttatgactcaggttaagaaatgtgttttaggatctacttgctggtttttctttttgatccaaatgtgtgatctgccctgataaataacaagttatagtaccatctcccccgccaataaaaaagagaagaaaaaagagaaacccgtggcactatgtaaataaagtaagcatactttgttgttagtaaatagatgaggcatgcctgggaaatgctcccttggcataaatagcaatcaattataattagtaaacaggtgtaccaataaaaagaatttacatgataggttaacaaggaccaggaaagtgagtttcctgaaggagttctttgttcctgatcaaagaaattgatacctgttagcattcactgccaccatattttaaggagaaagaactctattggtgtcgtctgagcagccatttaaaaattggaatctaaaggatggttgctgatgtactgtgtggtctggtagaagtggggaaatatgagagatggaggaaaaacttgattatgtcttccatggcatatttactcttactttacttcgtgccaaatcaaatgaaacaagccgtcttacaagtcgttattgcctttaaaaatctgttccgtttttttcccaggtacttaaaatacaagtgccagtaagtggttcttatgtgttttggggggaaaattttatttcccttttcttctgatatttaaaaaattcatcgatctttcaagatgaaccaaggttttttaaaagaattataggaaacacttcattctttataaaactttctataatgccttatttgaatgttaatcttatgtgctttctaaaaaatgttgtgaaataccaaacttatggattatcactaggttatcaagcatatattagtctttatcagaataaaatgaaatttcataactgtggctattactttgttcttggtccttcacagggcctgctccatcccacctgcctttctgctgcctgatgtctcaatggcttctgaatgactgttctaataaatgatcttaaaacagtccaaaaaaaaaaaaaaaaaaacaaaacaaaaaaaaaaaaaaaaaaaaaaaaaaaaaaaaaacaaaaccaaaaaaacacaaaaaaaacaataccaaacaaaaaacaaaaaaaaaaaaggaagggggggggcgggaaaaaatatctccccggggggggcgcccaacacccccccccctttttgtaaaggggcccccccagagggggctaaaaaaaaggggcggcgggcgaacaccaggcggaggagacaaaacactgacgacgttcattggagaggaccacctctggcggtggggaagtagagagcgccccacgaagaagaaagcggcagcaaaacattgctggaggggcaacccgcttgtcgggtcgaaattcctcctgttcttcattcagacgttataaaacagacacgacgacgccaacaacagacgagataaataaatctaaaagatataaatcaccacagtactcgcacactcacactcctccacaatcacgctgac

SEQ ID NO: 299681 - DNA, 2923 bp, Homo sapiens
acacactcttttacgttatttataaaagagtctcactcaatggaagctggatttcctctcctgtaaaatgagaaattggcgtgttagccaaggctttcattgaccaagggaaactcatcccagatgatgtcatgactcggctggcccttcatgagctgaaaaatctcacccagtatagctggctgttggatggttttccaaggacacttccacaggcagaagccctagatagagcttatcagatcgacacagtgattaacctgaatgtgccctttgaggtcattaaacaacgccttactgctcgctggattcatcccgccagtggccgagtctataacattgaattcaaccctcccaaaactgtgggcattgatgacctgactggggagcctctcattcagcgtgaggatgataaaccagagacggttatcaagagactaaaggcttatgaagaccaaacaaagccagtcctggaatattaccagaaaaaaggggtgctggaaacattctccggaacagaaaccaacaagatttggccctatgtatatgctttcctacaaactaaagttccacaaagaagccagaaagcttcagttactccatgaggagaaatgtgtgtaactattaatagtaagatgggcaaacctcctagtccttgcatttagaagctgcttttcctaagacttctagtatgtatgaattctttgaaaattatattacttttatttctactgattttattttggatactaaggatgtgccaaatgattcggatactaagatgcatcgtttgaaatcatctagtgtgttgtatgcagttatcctcaaaaacatcagcgatgtctgaacctttaaaacatctgttagagcaaaattaaaagagcatttggtagtaatctaactttttgttcagttaataagtggttgataaagtttccatatttttctggaaaagttaaaaaaagttacatgtcatttggagaaaatacgtaatcagaaatttgtgcatagattgatgccaaaaaagacatttccagcattgtggaacatggtgagacactatataaaattccagaaagaaagcaactggatttacagatttattgtgagacacaaattcactgctgcctttacactaagaaatgtatatgttaaccatatatgctgtatttattttgtcgttaagcatactttcagtttactcagaattttcaatttgctataaagatgtatcaattagcatatagaaaaatattactttaagatgacttgtttcctttgaaaatacctgtgtactgagggttatgatttgtgtcaaaaattgacataagtgcttttacaagcaccaaagttgaatgaattttcaacaaaatgtaattaaagtctatgttttcagttatgactcaggttaagaaatgtgttttaggatctacttgctggtttttctttttgatccaaatgtgtgatctgccctgataaataacaagttatagtaccatctcccccgccaataaaaaagagaagaaaaaagagaaacccgtggcactatgtaaataaagtaagcatactttgttgttagtaaatagatgaggcatgcctgggaaatgctcccttggcataaatagcaatcaattataattagtaaacaggtgtaccaataaaaagaatttacatgataggttaacaaggaccaggaaagtgagtttcctgaaggagttctttgttcctgatcaaagaaattgatacctgttagcattcactgccaccatattttaaggagaaagaactctattggtgtcgtctgagcagccatttaaaaattggaatctaaaggatggttgctgatgtactgtgtggtctggtagaagtggggaaatatgagagatggaggaaaaacttgattatgtcttccatggcatatttactcttactttacttcgtgccaaatcaaatgaaacaagccgtcttacaagtcgttattgcctttaaaaatctgttccgtttttttcccaggtacttaaaatacaagtgccagtaagtggttcttatgtgttttggggggaaaattttatttcccttttcttctgatatttaaaaaattcatcgatctttcaagatgaaccaaggttttttaaaagaattataggaaacacttcattctttataaaactttctataatgccttatttgaatgttaatcttatgtgctttctaaaaaatgttgtgaaataccaaacttatggattatcactaggttatcaagcatatattagtctttatcagaataaaatgaaatttcataactgtggctattactttgttcttggtccttcacagggcctgctccatcccacctgcctttctgctgcctgatgtctcaatggcttctgaatgactgttctaataaatgatcttaaaacagtccaaaaaaaaaaaaaaaaaaacaaaacaaaaaaaaaaaaaaaaaaaaaaaaaaaaaaaaaacaaaaccaaaaaaacacaaaaaaaacaataccaaacaaaaaacaaaaaaaaaaaaggaagggggggggcgggaaaaaatatctccccggggggggcgcccaacacccccccccctttttgtaaaggggcccccccagagggggctaaaaaaaaggggcggcgggcgaacaccaggcggaggagacaaaacactgacgacgttcattggagaggaccacctctggcggtggggaagtagagagcgccccacgaagaagaaagcggcagcaaaacattgctggaggggcaacccgcttgtcgggtcgaaattcctcctgttcttcattcagacgttataaaacagacacgacgacgccaacaacagacgagataaataaatctaaaagatataaatcaccacagtactcgcacactcacactcctccacaatcacgctgac

SEQ ID NO: 299682 - DNA, 3004 bp, Homo sapiens
cacagccacctcatcatttagcaacctccatcctgatcagtcagcagccatcagccatggaggcaagaccctccatcagcaaaaagattaagactctctgaaggctcagatgatcattaacattttttagcaataaaactattttaaattaagaaattggcgtgttagccaaggctttcattgaccaagggaaactcatcccagatgatgtcatgactcggctggcccttcatgagctgaaaaatctcacccagtatagctggctgttggatggttttccaaggacacttccacaggcagaagccctagatagagcttatcagatcgacacagtgattaacctgaatgtgccctttgaggtcattaaacaacgccttactgctcgctggattcatcccgccagtggccgagtctataacattgaattcaaccctcccaaaactgtgggcattgatgacctgactggggagcctctcattcagcgtgaggatgataaaccagagacggttatcaagagactaaaggcttatgaagaccaaacaaagccagtcctggaatattaccagaaaaaaggggtgctggaaacattctccggaacagaaaccaacaagatttggccctatgtatatgctttcctacaaactaaagttccacaaagaagccagaaagcttcagttactccatgaggagaaatgtgtgtaactattaatagtaagatgggcaaacctcctagtccttgcatttagaagctgcttttcctaagacttctagtatgtatgaattctttgaaaattatattacttttatttctactgattttattttggatactaaggatgtgccaaatgattcggatactaagatgcatcgtttgaaatcatctagtgtgttgtatgcagttatcctcaaaaacatcagcgatgtctgaacctttaaaacatctgttagagcaaaattaaaagagcatttggtagtaatctaactttttgttcagttaataagtggttgataaagtttccatatttttctggaaaagttaaaaaaagttacatgtcatttggagaaaatacgtaatcagaaatttgtgcatagattgatgccaaaaaagacatttccagcattgtggaacatggtgagacactatataaaattccagaaagaaagcaactggatttacagatttattgtgagacacaaattcactgctgcctttacactaagaaatgtatatgttaaccatatatgctgtatttattttgtcgttaagcatactttcagtttactcagaattttcaatttgctataaagatgtatcaattagcatatagaaaaatattactttaagatgacttgtttcctttgaaaatacctgtgtactgagggttatgatttgtgtcaaaaattgacataagtgcttttacaagcaccaaagttgaatgaattttcaacaaaatgtaattaaagtctatgttttcagttatgactcaggttaagaaatgtgttttaggatctacttgctggtttttctttttgatccaaatgtgtgatctgccctgataaataacaagttatagtaccatctcccccgccaataaaaaagagaagaaaaaagagaaacccgtggcactatgtaaataaagtaagcatactttgttgttagtaaatagatgaggcatgcctgggaaatgctcccttggcataaatagcaatcaattataattagtaaacaggtgtaccaataaaaagaatttacatgataggttaacaaggaccaggaaagtgagtttcctgaaggagttctttgttcctgatcaaagaaattgatacctgttagcattcactgccaccatattttaaggagaaagaactctattggtgtcgtctgagcagccatttaaaaattggaatctaaaggatggttgctgatgtactgtgtggtctggtagaagtggggaaatatgagagatggaggaaaaacttgattatgtcttccatggcatatttactcttactttacttcgtgccaaatcaaatgaaacaagccgtcttacaagtcgttattgcctttaaaaatctgttccgtttttttcccaggtacttaaaatacaagtgccagtaagtggttcttatgtgttttggggggaaaattttatttcccttttcttctgatatttaaaaaattcatcgatctttcaagatgaaccaaggttttttaaaagaattataggaaacacttcattctttataaaactttctataatgccttatttgaatgttaatcttatgtgctttctaaaaaatgttgtgaaataccaaacttatggattatcactaggttatcaagcatatattagtctttatcagaataaaatgaaatttcataactgtggctattactttgttcttggtccttcacagggcctgctccatcccacctgcctttctgctgcctgatgtctcaatggcttctgaatgactgttctaataaatgatcttaaaacagtccaaaaaaaaaaaaaaaaaaacaaaacaaaaaaaaaaaaaaaaaaaaaaaaaaaaaaaaaacaaaaccaaaaaaacacaaaaaaaacaataccaaacaaaaaacaaaaaaaaaaaaggaagggggggggcgggaaaaaatatctccccggggggggcgcccaacacccccccccctttttgtaaaggggcccccccagagggggctaaaaaaaaggggcggcgggcgaacaccaggcggaggagacaaaacactgacgacgttcattggagaggaccacctctggcggtggggaagtagagagcgccccacgaagaagaaagcggcagcaaaacattgctggaggggcaacccgcttgtcgggtcgaaattcctcctgttcttcattcagacgttataaaacagacacgacgacgccaacaacagacgagataaataaatctaaaagatataaatcaccacagtactcgcacactcacactcctccacaatcacgctgac

SEQ ID NO: 299683 - DNA, 2137 bp, Homo sapiens
gtcgggggcggggggtgcgccggggtagccgagaggcggacgcaacagcggggtcccgcgctgtctgggcggccccaggggctgtcggctcacttccgggaacgccggggaaccgcagtagccgcctgctagtggcgctgctagccggccggcgcaggctgccgagcgggtgagcgcgcaggccaggccaaagccctggtacccgcgcggtgcgggcctcagtctgcggccatgggggcgtccgcgcggctgctgcgagcggtgatcatgggggccccgggctcgggcaagggcaccgtgtcgtcgcgcatcactacacacttcgagctgaagcacctctccagcggggacctgctccgggacaacatgctgcggggcacagaaattggcgtgttagccaaggctttcattgaccaagggaaactcatcccagatgatgtcatgactcggctggcccttcatgagctgaaaaatctcacccagtatagctggctgttggatggttttccaaggacacttccacaggcagaagccctagatagagcttatcagatcgacacagtgattaacctgaatgtgccctttgaggtcattaaacaacgccttactgctcgctggattcatcccgccagtggccgagtctataacattgaattcaaccctcccaaaactgtgggcattgatgacctgactggggagcctctcattcagcgtgaggatgataaaccagagacggttatcaagagactaaaggcttatgaagaccaaacaaagccagtcctggaatattaccagaaaaaaggggtgctggaaacattctccggaacagaaaccaacaagatttggccctatgtatatgctttcctacaaactaaagttccacaaagaagccagaaagcttcagttactccatgaggagaaatgtgtgtaactattaatagtaagatgggcaaacctcctagtccttgcatttagaagctgcttttcctaagacttctagtatgtatgaattctttgaaaattatattacttttatttctactgattttattttggatactaaggatgtgccaaatgattcggatactaagatgcatcgtttgaaatcatctagtgtgttgtatgcagttatcctcaaaaacatcagcgatgtctgaacctttaaaacatctgttagagcaaaattaaaagagcatttggtagtaatctaactttttgttcagttaataagtggttgataaagtttccatatttttctggaaaagttaaaaaaagttacatgtcatttggagaaaatacgtaatcagaaatttgtgcatagattgatgccaaaaaagacatttccagcattgtggaacatggtgagacactatataaaattccagaaagaaagcaactggatttacagatttattgtgagacacaaattcactgctgcctttacactaagaaatgtatatgttaaccatatatgctgtatttattttgtcgttaagcatactttcagtttactcagaattttcaatttgctataaagatgtatcaattagcatatagaaaaatattactttaagatgacttgtttcctttgaaaatacctgtgtactgagggttatgatttgtgtcaaaaattgacataagtgcttttacaagcaccaaagttgaatgaattttcaacaaaatgtaattaaagtctatgttttcagttatgactcaggttaagaaatgtgttttaggatctacttgctggtttttctttttgatccaaatgtgtgatctgccctgataaataacaagttatagtaccatctcccccgccaataaaaaagagaagaaaaaagagaaacccgtggcactatgtaaataaagtaagcatactttgttgttagtaaatagatgaggcatgcctgggaaatgctcccttggcataaatagcaatcaattataattagtaaacaggtgtaccaataaaaagaatttacatgataggttaacaaggaccaggaaagtgagtttcctgaaggagttctttgttcctgatcaaagaaattgatacctgttagcattcactgccaccatattttaaggagaaagaactctattgatgggtgcgctgtacggggtcctctagttagcc

SEQ ID NO: 299684 - DNA, 1775 bp, Homo sapiens
gtcgggggcggggggtgcgccggggtagccgagaggcggacgcaacagcggggtcccgcgctgtctgggcggccccaggggctgtcggctcacttccgggaacgccggggaaccgcagtagccgcctgctagtggcgctgctagccggccggcgcaggctgccgagcgggtgagcgcgcaggccaggccaaagccctggtacccgcgcggtgcgggcctcagtctgcggccatgggggcgtccgcgcggctgctgcgagcggtgatcatgggggccccgggctcgggcaagggcaccgtgtcgtcgcgcatcactacacacttcgagctgaagcacctctccagcggggacctgctccgggacaacatgctgcggggcacagaaattggcgtgttagccaaggctttcattgaccaagggaaactcatcccagatgatgtcatgactcggctggcccttcatgagctgaaaaatctcacccagtatagctggctgttggatggttttccaaggacacttccacaggcagaagccctagatagagcttatcagatcgacacagtgattaacctgaatgtgccctttgaggtcattaaacaacgccttactgctcgctggattcatcccgccagtggccgagtctataacattgaattcaaccctcccaaaactgtgggcattgatgacctgactggggagcctctcattcagcgtgaggatgataaaccagagacggttatcaagagactaaaggcttatgaagaccaaacaaagccagtcctggaatattaccagaaaaaaggggtgctggaaacattctccggaacagaaaccaacaagatttggccctatgtatatgctttcctacaaactaaagttccacaaagaagccagaaagcttcagttactccatgaggagaaatgtgtgtaactattaatagtaagatgggcaaacctcctagtccttgcatttagaagctgcttttcctaagacttctagtatgtatgaattctttgaaaattatattacttttatttctactgattttattttggatactaaggatgtgccaaatgattcggatactaagatgcatcgtttgaaatcatctagtgtgttgtatgcagttatcctcaaaaacatcagcgatgtctgaacctttaaaacatctgttagagcaaaattaaaagagcatttggtagtaatctaactttttgttcagttaataagtggttgataaagtttccatatttttctggaaaagttaaaaaaagttacatgtcatttggagaaaatacgtaatcagaaatttgtgcatagattgatgccaaaaaagacatttccagcattgtggaacatggtgagacactatataaaattccagaaagaaagcaactggatttacagatttattgtgagacacaaattcactgtcgttaagcatactttcagtttactcagaattttcaatttgctataaagatgtatcaattagcatatagaaaaatattactttaagatgacttgtttcctttgaaaatacctgtgtactgagggttatgatttgtgtcaaaaattgacataagtgcttttacaagcaccaaagttgaatgaattttcaacaaaatgtaattaaagtctatgttttcagttatgactcaggttaagaaatgtgttttaggatctacttgctggtttttctttttgatccaaatgtgtgatctgccctgataaataacaagttatagtaccatctcccccgccaataaaaaag

SEQ ID NO: 299685 - DNA, 2066 bp, Homo sapiens
tccccccccagacggagtctcgctctcttgccaggctggagtgcagtgacattatcttggctcactgcagcctctgattccctggttcaagcaattctcctgcctcagcctcccgagtagctgggattacaggcatccaccaccacgtccagctaatttttgtatttttagtagagacggggtttcaccatgttggccaggatgggaaaattttttaaaagacatttattaaaaaaaaatgtctatgccttatcaaagtttataactcaagaattaatgagataaacagtggacaaaaagtgttggcagataacatgcataattttaattaaaagttaagcagtgaaaaataaacatctttttttcttaaagagatatttcatatctgttctatttgtttagttttatttattctttttagagacagggtctctctgtggagtgcagtggcatgattatagccctctgcggcctcaatcttcagggcttaagttatcctcctgcctcatcctcccaagtagctgggactgcaagtgtgtgccaccatacctggctaatttttaaaaactattttgtagagacagggtcttactatgttgcccagagtggtcttgaactcccatcctcatggaatcctcccacttcagtctctgaaagtgctaggattataggcatgagccatttatgcccagccagttttcttttttctaattgaagcttggcaagcagagggaaatgtattagggaaatagctttagttttgagtgggtgtcagtagccagctgaagaaaaagcaaaatgaaataggtagtagaaatgagaaagggagagagggaagaagaaaaaaatggatgttggaaagttgttgcatgtctctctggatagctcagaagtatcagttgtggttattgcctcacttggcttttgtaagcatgaaaaagccagggacaatttcaactaccatttctgaccatcatcaaccacaaattttaggcaatttgttagaattttttttaaatgttcttaatagttgttgggtacctgggagatttcagagaaagtaatcacctttgtatatattattaatgtgtttataatagaaattaaattctttgggatgtacaggtaagataagctatgtgaagcatagctgttatccaagtcgtgtgcctttgaaatacttggaatttgaagaacaggacatgcagcttatgttataattaatttgcgagcaatatatggcatgatagtattttcttatctaaattctgagtgcattgaaagtttaaagcaaaggacaaaagcttcctttgttcatggcccatattccagtatatttttctgaaactgccaatattttctgatcggtactttcatttttctagttggttaccaaatactgttattggtattatttctatataaaaggctttaagaagactatagtataattttcttaagaaaaaagacatgattataagctaaaatatgccttcggttttgtgtgctacaaattgagggagattgagaatattttaaatcaagggcagacattgagtaaaagcttatgactttggatggatttgaaacatgattaaatgacagagtaaataaaagcccctagtcaagtgaattctaatgggggaaataagaggactatataaaaattgaacctctgttttgaaaacaaatctttccaggaagtggtaccactctggggtcaagagaaattgtaagaacaataaaatgagcacacatgaccttcctttcctataaaaatatgaagcagaaaactcccccatgatttcctcatgttgcttagaatagtgtgtatttcagaacttttccatttaatatttttggaccacagttgactgaaactgaggatgggaggaagggatgcttaaaaccttggatagtaccaaaccctatatatattatgtttttttctatatatacacagctatgataaagttcataaattaggcacagtaagagattaaaaatattaaattgggccaattaatatattgtaataaaagctatgttaatgtggtctccctctc

SEQ ID NO: 299686 - DNA, 536 bp, Homo sapiens
cttgcccagagacctttccctcaaacagatgctttcaagagctgcgaaagagtagggcatcccctgtggtggtacctctatgtttaaagaaagaagaaaaaaaccccagaatttggttgtagaaaacaatgcccacaacagactggccagtgcttagacaaatttggggttggggggagtcactccgacgacacagggacatcgcgaggccactgcatgcgatgtcgcgggaggattgcttgagcccaggagttcatgcctgagcaacatagcaagaccctggctctctataaaacagaaaacgcaaactttaatattatcaacaatcaatatattataagagattgcaatttctaagtttctacctgagtcatcgccggagacatcgcatgctgggggggccagtgttgtgggcttcctgctgggactgagaaggctcacgaagggcatccgcaatgttggtttcactgagagctgcctcctggtctcttcaccactgtagttctctcatttccaacccacccgccggatggagg

SEQ ID NO: 299687 - DNA, 3070 bp, Homo sapiens
aaaaaaagagctaaaaaattacattttacaagtttatggccagcccacctgtaataacattctctgatattcctttacttaggatgtccctattgagatcattttttaaatttatgtggaaggattctctagattattattagaatgagcaattcagttttgtttgtttttgagcctgtcttgtacctggttgcactaaatatataatagttatcttttgtggagaccttaaaaccctaaatttgaatacatgttcaatgatagtaaagatatgacagaaactagaagatagctgtttatgatttgagcttttggaaaattttcgtttcttgaatgtaatagtattttttcctgaattggaggagactgatctatattgtttcatttttcttttgtcctagtctatttcactttcttttgtcataatctatttaatttcccactttcttattttagtaaagagagaataaatagcaagtgcaggccaggcatggtggtgcaggccagacatagcggtacatgcctgtaatcctagcactttgggatgccaaggcgggaggattgcttgagcccaggagttcatgcctgagcaacatagcaagaccctggctctctataaaacagaaaacgcaaactttaatattatcaacaatcaatatattataagagattgcaatttctaagtttctacctgagtgtttcacaaatacaaactggacattttccctttaaatgagttttattataaaatgtacatattgattgtaaaaacaaaaaattcaaatagtacaaaagcatataagtaactaataaaagctccctttctgcattaggcccctcagttcttcccagggaaaatgattaatagtttacattcttgcagaaattttttatgtataaatttttacccaaatgaattcattatataaattttttccaacttagtgtttttttacataatagtagcaagttaaaaaattgtacttcaggccaggcacggtgggtcacgcctgttaatctcagcactttgggaggctgaggcaggaagaccacttgaggtcaggagttcaagaccagcctggccaacatggtgaaaacccatctctactaaaatacaaaaatcactgggattacaggcatccaccaccacgtccagctaatttttgtatttttagtagagacggggtttcaccatgttggccaggatgggaaaattttttaaaagacatttattaaaaaaaaatgtctatgccttatcaaagtttataactcaagaattaatgagataaacagtggacaaaaagtgttggcagataacatgcataattttaattaaaagttaagcagtgaaaaataaacatctttttttcttaaagagatatttcatatctgttctatttgtttagttttatttattctttttagagacagggtctctctgtggagtgcagtggcatgattatagccctctgcggcctcaatcttcagggcttaagttatcctcctgcctcatcctcccaagtagctgggactgcaagtgtgtgccaccatacctggctaatttttaaaaactattttgtagagacagggtcttactatgttgcccagagtggtcttgaactcccatcctcatggaatcctcccacttcagtctctgaaagtgctaggattataggcatgagccatttatgcccagccagttttcttttttctaattgaagcttggcaagcagagggaaatgtattagggaaatagctttagttttgagtgggtgtcagtagccagctgaagaaaaagcaaaatgaaataggtagtagaaatgagaaagggagagagggaagaagaaaaaaatggatgttggaaagttgttgcatgtctctctggatagctcagaagtatcagttgtggttattgcctcacttggcttttgtaagcatgaaaaagccagggacaatttcaactaccatttctgaccatcatcaaccacaaattttaggcaatttgttagaattttttttaaatgttcttaatagttgttgggtacctgggagatttcagagaaagtaatcacctttgtatatattattaatgtgtttataatagaaattaaattctttgggatgtacaggtaagataagctatgtgaagcatagctgttatccaagtcgtgtgcctttgaaatacttggaatttgaagaacaggacatgcagcttatgttataattaatttgcgagcaatatatggcatgatagtattttcttatctaaattctgagtgcattgaaagtttaaagcaaaggacaaaagcttcctttgttcatggcccatattccagtatatttttctgaaactgccaatattttctgatcggtactttcatttttctagttggttaccaaatactgttattggtattatttctatataaaaggctttaagaagactatagtataattttcttaagaaaaaagacatgattataagctaaaatatgccttcggttttgtgtgctacaaattgagggagattgagaatattttaaatcaagggcagacattgagtaaaagcttatgactttggatggatttgaaacatgattaaatgacagagtaaataaaagcccctagtcaagtgaattctaatgggggaaataagaggactatataaaaattgaacctctgttttgaaaacaaatctttccaggaagtggtaccactctggggtcaagagaaattgtaagaacaataaaatgagcacacatgaccttcctttcctataaaaatatgaagcagaaaactcccccatgatttcctcatgttgcttagaatagtgtgtatttcagaacttttccatttaatatttttggaccacagttgactgaaactgaggatgggaggaagggatgcttaaaaccttggatagtaccaaaccctatatatattatgtttttttctatatatacacagctatgataaagttcataaattaggcacagtaagagattaaaaatattaaattgggccaattaatatattgtaataaaagctatgttaatgtggtctccctctc

SEQ ID NO: 299688 - DNA, 1272 bp, Homo sapiens
aaaaaaagagctaaaaaattacattttacaagtttatggccagcccacctgtaataacattctctgatattcctttacttaggatgtccctattgagatcattttttaaatttatgtggaaggattctctagattattattagaatgagcaattcagttttgtttgtttttgagcctgtcttgtacctggttgcactaaatatataatagttatcttttgtggagaccttaaaaccctaaatttgaatacatgttcaatgatagtaaagatatgacagaaactagaagatagctgtttatgatttgagcttttggaaaattttcgtttcttgaatgtaatagtattttttcctgaattggaggagactgatctatattgtttcatttttcttttgtcctagtctatttcactttcttttgtcataatctatttaatttcccactttcttattttagtaaagagagaataaatagcaagtgcaggccaggcatggtggtgcaggccagacatagcggtacatgcctgtaatcctagcactttgggatgccaaggcgggaggattgcttgagcccaggagttcatgcctgagcaacatagcaagaccctggctctctataaaacagaaaacgcaaactttaatattatcaacaatcaatatattataagagattgcaatttctaagtttctacctgagtgtttcacaaatacaaactggacattttccctttaaatgagttttattataaaatgtacatattgattgtaaaaacaaaaaattcaaatagtacaaaagcatataagtaactaataaaagctccctttctgcattaggcccctcagttcttcccagggaaaatgattaatagtttacattcttgcagaaattttttatgtataaatttttacccaaatgaattcattatataaattttttccaacttagtgtttttttacataatagtagcaagttaaaaaattgtacttcaggccaggcacggtgggtcacgcctgttaatctcagcactttgggaggctgaggcaggaagaccacttgaggtcaggagttcaagaccagcctggccaacatggtgaaaacccatctctactaaaatacaaaaatcagctgggcatggtggcgcatgtctgtaatcccagctactcgggaggctgaggcaggagaatcgcttgaacccgggaggcggaggttgcagtgagctgagattgcgccattgcactccagcctggaggacaagagggagacttcctctca

SEQ ID NO: 299689 - DNA, 1769 bp, Homo sapiens
tctcttcttgacttgatgcaggcacagatttatcaagctcctcagtcaacaaacacatcaccggaagaaacatggaaggaaaggaattttaaaaggaaataccaatctctgtgcaaacaaagccttgtatattcatgtttgcaccaatctactgtgagatttatgaagaaaaacaaattgcggacaactctctatgtacacttacaaatgcctcagttgatgcttgtgggctgtttgtcagcgttctgtgataatgaacacatggacttctgtttattaaattcagttgacccctttagccaattgccaggagcctggatttttacttccaactgctgatatctgtgtaaaaattgatctacatccaccctttaaaagcattgatgaattaattagaactttagacaacaaagaaaaattgaaaaagaattctcagtaaaagcgaattcgatgttcaaaacaaactacaaagagacaagacttctctgtttactttctaagaactaatataattgctaccttaaaaaggaaaaaatgaacagcacatgtattgaagaacagcatgacctggatcactatttgtttcccattgtttacatctttgtgattatagtcagcattccagccaatattggatctctgtgtgtgtctttcctgcaagcaaagaaggaaagtgaactaggaatttacctcttcagtttgtcactatcagatttactctatgcattaactctccctttatggattgattatacttggaataaagacaactggactttctctcctgccttgtgcaaagggagtgcttttctcatgtacatgaatttttacagcagcacagcattcctcacctgcattgccgttgatcggtatttggctgttgtctaccctttgaagttttttttcctaaggacaagaagatttgcactcatggtcagcctgtccatctggatattggaaaccatcttcaatgctgtcatgttgtgggaagatgaaacagttgttgaatattgcgatgccgaaaagtctaattttactttatgctatgacaaataccctttagagaaatggcaaatcaacctcaacttgttcaggacgtgtacaggctatgcaatacctttggtcaccatcctgatctgcaaccggaaagtctaccaagctgtgcggcacaataaagccacggaaaacaaggaaaagaagagaatcataaaactacttgtcagcatcacagttacttttgtcttatgctttactccctttcatgtgatgttgctgattcgctgcattttagagcatgctgtgaacttcgaagaccacagcaattctgggaagcgaacttacacaatgtatagaatcacggttgcattaacaagtttaaattgtgttgctgatccaattctgtactgttttgtaaccgaaacaggaagatatgatatgtggaatatattaaaattctgcactgggaggtgtaatacatcacaaagacaaagaaaacgcatactttctgtgtctacaaaagatactatggaattagaggtccttgagtagaaccaaggatgttttgaagggaagggaagtttaagttatgcattattatatcatcaagattacattttgaaaaggaaatctagcatgtgaggggactaagtgttctcagagtgatgttttaatccagtccaataaaaatatcttaaaactgcattgtacagctccctccctgcgttttattaaatgatgtatattaaacaaagatcaatattttcttaatg

SEQ ID NO: 299690 - DNA, 1715 bp, Homo sapiens
tctcttcttgacttgatgcaggcacagatttatcaagctcctcagtcaacaaacacatcaccggaagaaacatggaaggaaaggaattttaaaaggaaataccaatctctgtgcaaacaaagccttgtatattcatgtttgcaccaatctactgtgagatttatgaagaaaaacaaattgcggacaactctctatgtacacttacaaatgcctcagttgatgcttgtgggctgtttgtcagcgttctgtgataatgaacacatggacttctgtttattaaattcagttgacccctttagccaattgccaggagcctggatttttacttccaactgctgatatctgtgtaaaaattgatctacatccaccctttaaaagcattgatgaattaattagaactttagacaacaaagaaaaattgaaaaagaattctcagtaaaagcgaattcgatgttcaaaacaaactacaaagagacaagacttctctgtttactttctaagaactaatataattgctaccttaaaaaggaacccattgtttacatctttgtgattatagtcagcattccagccaatattggatctctgtgtgtgtctttcctgcaagcaaagaaggaaagtgaactaggaatttacctcttcagtttgtcactatcagatttactctatgcattaactctccctttatggattgattatacttggaataaagacaactggactttctctcctgccttgtgcaaagggagtgcttttctcatgtacatgaatttttacagcagcacagcattcctcacctgcattgccgttgatcggtatttggctgttgtctaccctttgaagttttttttcctaaggacaagaagatttgcactcatggtcagcctgtccatctggatattggaaaccatcttcaatgctgtcatgttgtgggaagatgaaacagttgttgaatattgcgatgccgaaaagtctaattttactttatgctatgacaaataccctttagagaaatggcaaatcaacctcaacttgttcaggacgtgtacaggctatgcaatacctttggtcaccatcctgatctgcaaccggaaagtctaccaagctgtgcggcacaataaagccacggaaaacaaggaaaagaagagaatcataaaactacttgtcagcatcacagttacttttgtcttatgctttactccctttcatgtgatgttgctgattcgctgcattttagagcatgctgtgaacttcgaagaccacagcaattctgggaagcgaacttacacaatgtatagaatcacggttgcattaacaagtttaaattgtgttgctgatccaattctgtactgttttgtaaccgaaacaggaagatatgatatgtggaatatattaaaattctgcactgggaggtgtaatacatcacaaagacaaagaaaacgcatactttctgtgtctacaaaagatactatggaattagaggtccttgagtagaaccaaggatgttttgaagggaagggaagtttaagttatgcattattatatcatcaagattacattttgaaaaggaaatctagcatgtgaggggactaagtgttctcagagtgatgttttaatccagtccaataaaaatatcttaaaactgcattgtacagctccctccctgcgttttattaaatgatgtatattaaacaaagatcaatattttcttaatg

SEQ ID NO: 299691 - DNA, 1296 bp, Homo sapiens
tctcttcttgacttgatgcaggcacagatttatcaagctcctcagtcaacaaacacatcaccggaagaaacatggaaggaaaggaattttaaaaggaaataccaatctctgtgcaaacaaagccttgtatattcatgtttgcaccaatctactgtgagatttatgaagaaaaacaaattgcggacaactctctatgtacacttacaaatgcctcagttgatgcttgtgggctgtttgtcagcgttctgtgataatgaacacatggacttctgtttattaaattcagttgacccctttagccaattgccaggagcctggatttttacttccaactgctgatatctgtgtaaaaattgatctacatccaccctttaaaagcattgatgaattaattagaactttagacaacaaagaaaaattgaaaaagaattctcagtaaaagcgaattcgatgttcaaaacaaactacaaagagacaagacttctctgtttactttctaagaactaatataattgctaccttaaaaaggaaaaaatgaacagcacatgtattgaagaacagcatgacctggatcactatttgtttcccattgtttacatctttgtgattatagtcagcattccagccaatattggatctctgtgtgtgtctttcctgcaagcaaagaaggaaagtgaactaggaatttacctcttcagtttgtcactatcagatttactctatgcattaactctccctttatggattgattatacttggaataaagacaactggactttctctcctgccttgtgcaaagggagtgcttttctcatgtacatgaatttttacagcagcacagcattcctcacctgcattgccgttgatcggtatttggctgttgtctaccctttgaagttttttttcctaaggacaagaagatttgcactcatggtcagcctgtccatctggatattggaaaccatcttcaatgctgtcatgttgtgggaagatgaaacagttgttgaatattgcgatgccgaaaagtctaattttactttatgctatgacaaataccctttagagaaatggcaaatcaacctcaacttgttcaggacgtgtacaggctatgcaatacctttggtcaccatcctgatctgcaaccggaaagtctaccaagctgtgcggcacaataaagccacggaaaacaaggaaaagaagagaattttaaatctttttggcaacaaaaaaaatctttgggtaataggctaacccccctattaagggagagtgcctcatccttaaataattaaaact

SEQ ID NO: 299692 - DNA, 953 bp, Homo sapiens
gagggtaagaagtttgtcccacgaggtttctcttactttgcctccgcagtatacacgtacatccaaagccggttctaccgatccccagaagtgatcctgggccacccctacgacgtggccattgacatgtggagcctgggctgcatcacggcggagttgtacacgggctaccccctgttccccggggagaatgaggtggagcagctggcctgcatcatggaggtgctgggtctgccgccagccggcttcattcagacagcctccaggagacagacattctttgattccaaaggttttcctaaaaatataaccaacaacagggggaaaaaaagatacccagattccaaggacctcacgatggtgctgaaaacctatgacaccagcttcctggactttctcagaaggtgtttggtatgggaaccttctcttcgcatgaccccggaccaggccctcaagcatgcttggattcatcagtctcggaacctcaagccacagcccaggccccagaccctgaggaaatccaattcctttttcccctctgagacaaggaaggacaaggttcaaggctgtcatcactcgagcagaaaagcagatgagatcaccaaagagactacagagaaaacaaaagatagccccacgaagcatgttcagcattcaggtgatcagcaggactgtctccagcacggagctgacactgttcagctgcctcaactggtagacgctcccaagaagtcagaggcagctgtcggggcggaggtgtccatgacctccccaggacagagcaaaaacttctccctcaagaacacaaacgttttaccccctattgtatgacctttgctgagggtatgtcctgctcctttccaccagtgatttgtattaagacagcacttatattgtacaatacttcagactgttttttttaaatacataaaactttatgttaaaaaactcta

SEQ ID NO: 299693 - DNA, 893 bp, Homo sapiens
  misc_feature (24)..(24): n is a, c, g, or t
  misc_feature (740)..(740): n is a, c, g, or t
  misc_feature (806)..(806): n is a, c, g, or t
gctaggtacgaggcggtgttaatnggcgaggccgggttgtccgggtcctgtcaatgtcacgttctgccattactgcaatagccacatctgtgtgtcacggcccaccctgtcgccagcttcatcatgccctcatgcctcatgggaaaggtggacgttcctcagtcagtgggattgtggccactgtgtttggagcaacaggattcctggggcgatatgttgtcaaccaccttggacgcatggggtcacaggtaatcataccctatcggtgtgataaatatgacatcatgcaccttcgtcccatgggtgacctgggccagcttctgtttctggaatgggacgcgagagataaagattctatccgacgagtagtacaacacagcaatgtggtcatcaatcttattggacgagactgggaaaccaaaaactttgattttgaggatgtttttgtgaagattccccaagcaattgctcaactgtccaaggaagctggagttgaaaaattcattcatgtttcacatctgaatgcgaatattaaaagctcttctagatatttgagaaataaggctgttggagagaaagtagtgagagatgcatttccggaagccattatcgtaaagccgtcggacatctttggaagagaggatagattccttaattcttttgcaagtatgcatcggtttggtcctataccccttggttccttgggctggaagacagttaaacaaccagtatatcgtgcngttccccggcatgtatggcgtagggtccgggccgggaacctggtcggggcccgcggccccttcccngggagaaacttgcggggccacaatgtcccacaccgcgcgttggcctacaggggacattaaacccccccaaaaaaaggggcacacaag

SEQ ID NO: 299694 - DNA, 771 bp, Homo sapiens
acatgatcatgactttaggagctttgttattgataagactgtgagcttgattcttctttggtcattggtaaaaaggacaatgtaggatgaagtgggagggctaaggccatgatccaaaaggaaatggatatttgtacaatttcacaggaccttgtcacttaacatttactttaccattgtcattattatcattagcattattattttatcttggttggtgttaagccatttaaattatttctttgatttggagaggaggcagtgggaaggaagttcagaacatactgaatagtaggaaaaaatcaatttttaaagtaaattgcattccttgggtaatctacacatggttatttcaaactgagtgtgtgtgtgtgtgtttattggggtgtggcatgaggcgagtgtgtaagacagagagcaaaagagctacagaggccactctaagcagcagcatcatgtgaccactaaagatttacacctgaaactaaatacagaatgttctatctctacagattccaaaggttttcctaaaaatataaccaacaacagggggaaaaaaagatacccagattccaaggacctcacgatggtgctgaaaacctatgacaccagcttcctggactttctcagaaggtgtttggtgtgagtttgttgggacatctctgcttctgggtttcctcttaaatgctgtactttgacacacgtttgctggtgaaagactaaggctgggagatagttataaaagtaacaagaaatgctaacaatagagct

SEQ ID NO: 299695 - DNA, 442 bp, Homo sapiens
cgaaaagggacttgcaaaggacacagagcaagcggtttcagctgtactctgctaatgtaacagggaatagactcaaatggatgctaaaaagccaaggaaatgtgatttgactcccttcctggttttgaaagcaagaaagaaacaaaagttcacctctgcgaagggccccactctttctgagatctacatggttggaagtaaactttcggttcagatccagaagccaccttccaatatcaagaactccagaatgacccaagtctttcataagaacaccagtgttacttcactcccctttgtggacaccaaggggaagaagaatacggtaagcttcccacacattagcaagaaagtcctgctgaagtcatccctgctgtatcaggtgagtgcagacggactggaccctgagaaggcaggtgaaagacctggttttagtccaaag

SEQ ID NO: 299696 - DNA, 129 bp, Homo sapiens
taggtcccagggtgggtgcccaccgcctgctcctttccaccagtgatttgtattaagacagcacttatattgtacaatacttcagactgttttttttaaatacataaaactttatgttaaaaaactcta

SEQ ID NO: 299697 - DNA, 1314 bp, Homo sapiens
cagcttagcagccgtagtcagccgggagtgctgtcgtgggggattgtgggaaaagatggcggctgccgcacaatcccgggttgtccgggtcctgtcaatgtcacgttctgccattactgcaatagccacatctgtgtgtcacggcccaccctgtcgccagcttcatcatgccctcatgcctcatgggaaaggtggacgttcctcagtcagtgggattgtggccactgtgtttggagcaacaggattcctggggcgatatgttgtcaaccaccttggacgcatggggtcacaggtaatcataccctatcggtgtgataaatatgacatcatgcaccttcgtcccatgggtgacctgggccagcttctgtttctggaatgggacgcgagagataaagattctatccgacgagtagtacaacacagcaatgtggtcatcaatcttattggacgagactgggaaaccaaaaactttgattttgaggatgtttttgtgaagattccccaagcaattgctcaactgtccaaggaagctggagttgaaaaattcattcatgtttcacatctgaatgcgaatattaaaagctcttctagatatttgagaaataaggctgttggagagaaagtagtgagagatgcatttccggaagccattatcgtaaagccgtcggacatctttggaagagaggatagattccttaattcttttgcaagtatgcatcggtttggtcctataccccttggttccttgggctggaagacagttaaacaaccagtatatgtcgtagatgtatccaaaggaattgttaatgcagttaaggatcctgatgccaatgggaaatcctttgctttcgttggtcccagtcggtacctccttttccacctggtgaagtacatctttgctgtggctcacagattgttcctcccattccccttgccgctttttgcctatcgatgggtagcaagagtctttgaaataagcccatttgagccctggataacaagggataaagtggagcggatgcacatcacagacatgaaattgcctcacctgcctggcttagaagaccttggtattcaggcaacaccactggaactcaaggccattgaggtgctgcggcgtcatcgcacttaccgctggctgtctgctgaaattgaggatgtgaagccggccaagaccgtcaacatttagtgcctcctgagcagctcttggttttggcgtcttttgggtcggcccatgtggtttgagcacccagccaggcggtctctttagaggatcctgtacacagttccactattaaaacatttcaggttgaa

SEQ ID NO: 299698 - DNA, 1585 bp, Homo sapiens
cagcttagcagccgtagtcagccgggagtgctgtcgtgggggattgtgggaaaagatggcggctgccgcacaatcccgggttgtccgggtcctgtcaatgtcacgttctgccattactgcaatagccacatctgtgtgtcacggcccaccctgtcgccagcttcatcatgccctcatgcctcatgggaaaggtggacgttcctcagtcagtgggattgtggccactgtgtttggagcaacaggattcctggggcgatatgttgtcaaccaccttggacgcatggggtcacaggtaatcataccctatcggtgtgataaatatgacatcatgcaccttcgtcccatgggtgacctgggccagcttctgtttctggaatgggacgcgagagataaagattctatccgacgagtagtacaacacagcaatgtggtcatcaatcttattggacgagactgggaaaccaaaaactttgattttgaggatgtttttgtgaagattccccaagcaattgctcaactgtccaaggaagctggagttgaaaaattcattcatgtttcacatctgaatgcgaatattaaaagctcttctagatatttgagaaataaggctgttggagagaaagtagtgagagatgcatttccggaagccattatcgtaaagccgtcggacatctttggaagagaggatagattccttaattcttttgcaagtatgcatcggtttggtcctataccccttggttccttgggctggaagacagttaaacaaccagtatatgtcgtagatgtatccaaaggaattgttaatgcagttaaggatcctgatgccaatgggaaatcctttgctttcgttggtcccagtcggtacctccttttccacctggtgaagtacatctttgctgtggctcacagattgttcctcccattccccttgccgctttttgcctatcgatgggtagcaagagtctttgaaataagcccatttgagccctggataacaagggataaagtggagcggatgcacatcacagacatgaaattgcctcacctgcctggcttagaagaccttggtattcaggcaacaccactggaactcaaggccattgaggtgctgcggcgtcatcgcacttaccgctggctgtctgctgaaattgaggatgtgaagccggccaagaccgtcaacatttagtgcctcctgagcagctcttggttttggcgtcttttgggtcggcccatgtggtttgagcacccagccaggcggtctctttagaggatcctgtacacagttccactattaaaacatttcaggttgaattctgcagtattttcttccttgatttacaaaatgagaaatgtagtcacttagaacttgagcatgatttttgttaaacatatttaataatgatatatatactatttattctctgaaatgccagagagtttgaattttcctatgacaaaccacttctagcatacgttctagaagacaaggaccctttttaatgtcaaagtattgtaaagaccccaagtgatatgtgattgttttttaatttccattaaatgagagagcatacagtatccccta

SEQ ID NO: 299699 - DNA, 2103 bp, Homo sapiens
cagcttagcagccgtagtcagccgggagtgctgtcgtgggggattgtgggaaaagatggcggctgccgcacaatcccgggttgtccgggtcctgtcaatgtcacgttctgccattactgcaatagccacatctgtgtgtcacggcccaccctgtcgccagcttcatcatgccctcatgcctcatgggaaaggtggacgttcctcagtcagtgggattgtggccactgtgtttggagcaacaggattcctggggcgatatgttgtcaaccaccttggacgcatggggtcacaggtaatcataccctatcggtgtgataaatatgacatcatgcaccttcgtcccatgggtgacctgggccagcttctgtttctggaatgggacgcgagagataaagattctatccgacgagtagtacaacacagcaatgtggtcatcaatcttattggacgagactgggaaaccaaaaactttgattttgaggatgtttttgtgaagattccccaagcaattgctcaactgtccaaggaagctggagttgaaaaattcattcatgtttcacatctgaatgcgaatattaaaagctcttctagatatttgagaaataaggctgttggagagaaagtagtgagagatgcatttccggaagccattatcgtaaagccgtcggacatctttggaagagaggatagattccttaattcttttgcaagtatgcatcggtttggtcctataccccttggttccttgggctggaagacagttaaacaaccagtatatgtcgtagatgtatccaaaggaattgttaatgcagttaaggatcctgatgccaatgggaaatcctttgctttcgttggtcccagtcggtacctccttttccacctggtgaagtacatctttgctgtggctcacagattgttcctcccattccccttgccgctttttgcctatcgatgggtagcaagagtctttgaaataagcccatttgagccctggataacaagggataaagtggagcggatgcacatcacagacatgaaattgcctcacctgcctggcttagaagaccttggtattcaggcaacaccactggaactcaaggccattgaggtgctgcggcgtcatcgcacttaccgctggctgtctgctgaaattgaggatgtgaagccggccaagaccgtcaacatttagtgcctcctgagcagctcttggttttggcgtcttttgggtcggcccatgtggtttgagcacccagccaggcggtctctttagaggatcctgtacacagttccactattaaaacatttcaggttgaattctgcagtattttcttccttgatttacaaaatgagaaatgtagtcacttagaacttgagcatgatttttgttaaacatatttaataatgatatatatactatttattctctgaaatgccagagagtttgaattttcctatgacaaaccacttctagcatacgttctagaagacaaggaccctttttaatgtcaaagtattgtaaagaccccaagtgatatgtgattgttttttaatttccattaaatgagagagcatacagtatcccctaacctgaatgtgtttacactgaaggtgtttttaaaatttattttaataatgtccatatgccttttaaaaatagtagtacatatatagaaaaacattgtccatagattctcaaaccccttgcagtaattccacagtcttcttggatctgagctatctgaggccagcccgatgcccttagtaccacatctggattatttcagacacataggtggagatagattctcttcccatgcaaaggagatgcttcagcttctatgccagcagtgccagcacttaggaattatgaccttctaatgaagttcttaaaattgcagccaagacccagatgaacaattggtttagtgttggcaaatcccaccagtacagtgtgatttaaaactcccacaatttgtggtgaagccaacataccaccatcctaggtgacccagggttggtcattgtgtttcactggacttcagcctcctgatctatatttgggacagggatgtcagtaaaaacgctgtttgatgagggaatgcc

SEQ ID NO: 299700 - DNA, 1727 bp, Homo sapiens
  misc_feature (1588)..(1588): n is a, c, g, or t
  misc_feature (1590)..(1590): n is a, c, g, or t
cagcttagcagccgtagtcagccgggagtgctgtcgtgggggattgtgggaaaagatggcggctgccgcacaatcccgggttgtccgggtcctgtcaatgtcacgttctgccattactgcaatagccacatctgtgtgtcacggcccaccctgtcgccagcttcatcatgccctcatgcctcatgggaaaggtggacgttcctcagtcagtgggattgtggccactgtgtttggagcaacaggattcctggggcgatatgttgtcaaccaccttggacgcatggggtcacaggtaatcataccctatcggtgtgataaatatgacatcatgcaccttcgtcccatgggtgacctgggccagcttctgtttctggaatgggacgcgagagataaagattctatccgacgagtagtacaacacagcaatgtggtcatcaatcttattggacgagactgggaaaccaaaaactttgattttgaggatgtttttgtgaagattccccaagcaattgctcaactgtccaaggaagctggagttgaaaaattcattcatgtttcacatctgaatgcgaatattaaaagctcttctagatatttgagaaataaggctgttggagagaaagtagtgagagatgcatttccggaagccattatcgtaaagccgtcggacatctttggaagagaggatagattccttaattcttttgcaagtatgcatcggtttggtcctataccccttggttccttgggctggaagacagttaaacaaccagtatatgtcgtagatgtatccaaaggaattgttaatgcagttaaggatcctgatgccaatgggaaatcctttgctttcgttggtcccagtcggtacctccttttccacctggtgaagtacatctttgctgtggctcacagattgttcctcccattccccttgccgctttttgcctatcgatgggtagcaagagtctttgaaataagcccatttgagccctggataacaagggataaagtggagcggatgcacatcacagacatgaaattgcctcacctgcctggcttagaagaccttggtattcaggcaacaccactggaactcaaggccattgaggtgctgcggcgtcatcgcacttaccgctggctgtctgctgaaattgaggatgtgaagccggccaagaccgtcaacatttagtgcctcctgagcagctcttggttttggcgtcttttgggtcggcccatgtggtttgagcacccagccaggcggtctctttagaggatcctgtacacagttccactattaaaacatttcaggttgaattctgcagtattttcttccttgatttacaaaatgagaaatgtagtcacttagaacttgagcatgatttttgttaaacatatttaataatgatatatatactatttattctctgaaatgccagagagtttgaattttcctatgacaaaccacttctagcatacgttctagaagacaaggaccctttttaatgtcaaagtattgtaaagaccccaagtgatatgtgattgttttttaatttccattaaatgagagagcatacagtatcccctattntnaaataaatatttatatttatttttaataattctattaatttatattatttattataattttcccccggggggggcccgggtcccaaattccccctaaagggggtccttattaaaattccacgggccgtcgtttttaa

SEQ ID NO: 299701 - DNA, 1658 bp, Homo sapiens
cagcttagcagccgtagtcagccgggagtgctgtcgtgggggattgtgggaaaagatggcggctgccgcacaatcccgggttgtccgggtcctgtcaatgtcacgttctgccattactgcaatagccacatctgtgtgtcacggcccaccctgtcgccagcttcatcatgccctcatgcctcatgggaaaggtggacgttcctcagtcagtgggattgtggccactgtgtttggagcaacaggattcctggggcgatatgttgtcaaccaccttggacgcatggggtcacaggtaatcataccctatcggtgtgataaatatgacatcatgcaccttcgtcccatgggtgacctgggccagcttctgtttctggaatgggacgcgagagataaagattctatccgacgagtagtacaacacagcaatgtggtcatcaatcttattggacgagactgggaaaccaaaaactttgattttgaggatgtttttgtgaagattccccaagcaattgctcaactgtccaaggaagctggagttgaaaaattcattcatgtttcacatctgaatgcgaatattaaaagctcttctagatatttgagaaataaggctgttggagagaaagtagtgagagatgcatttccggaagccattatcgtaaagccgtcggacatctttggaagagaggatagattccttaattcttttgcaagtatgcatcggtttggtcctataccccttggttccttgggctggaagacagttaaacaaccagtatatgtcgtagatgtatccaaaggaattgttaatgcagttaaggatcctgatgccaatgggaaatcctttgctttcgttggtcccagtcggtacctccttttccacctggtgaagtacatctttgctgtggctcacagattgttcctcccattccccttgccgctttttgcctatcgatgggtagcaagagtctttgaaataagcccatttgagccctggataacaagggataaagtggagcggatgcacatcacagacatgaaattgcctcacctgcctggcttagaagaccttggtattcaggcaacaccactggaactcaaggccattgaggtgctgcggcgtcatcgcacttaccgctggctgtctgctgaaattgaggatgtgaagccggccaagaccgtcaacatttagtgcctcctgagcagctcttggttttggcgtcttttgggtcggcccatgtggtttgagcacccagccaggcggtctctttagaggatcctgtacacagttccactattaaaacatttcaggttgaattctgcagtattttcttccttgatttacaaaatgagaaatgtagtcacttagaacttgagcatgatttttgttaaacatatttaataatgatatatatactatttattctctgaaatgccagagagtttgaattttcctatgacaaaccacttctagcatacgttctagaagacaaggaccctttttaatgtcaaagtattgtaaagaccccaagtgatatgtgattgttttttaatttccattaaatgagagagcatacagtatcccctaaaaaaaaaaatataaatgatgatatattggttagtgtattttaattgaaaatataaataaatacctttggggg

SEQ ID NO: 299702 - DNA, 2026 bp, Homo sapiens
  misc_feature (2024)..(2024): n is a, c, g, or t
  misc_feature (2026)..(2026): n is a, c, g, or t
cagcttagcagccgtagtcagccgggagtgctgtcgtgggggattgtgggaaaagatggcggctgccgcacaatcccgggttgtccgggtcctgtcaatgtcacgttctgccattactgcaatagccacatctgtgtgtcacggcccaccctgtcgccagcttcatcatgccctcatgcctcatgggaaaggtggacgttcctcagtcagtgggattgtggccactgtgtttggagcaacaggattcctggggcgatatgttgtcaaccaccttggacgcatggggtcacaggtaatcataccctatcggtgtgataaatatgacatcatgcaccttcgtcccatgggtgacctgggccagcttctgtttctggaatgggacgcgagagataaagattctatccgacgagtagtacaacacagcaatgtggtcatcaatcttattggacgagactgggaaaccaaaaactttgattttgaggatgtttttgtgaagattccccaagcaattgctcaactgtccaaggaagctggagttgaaaaattcattcatgtttcacatctgaatgcgaatattaaaagctcttctagatatttgagaaataaggctgttggagagaaagtagtgagagatgcatttccggaagccattatcgtaaagccgtcggacatctttggaagagaggatagattccttaattcttttgcaagtatgcatcggtttggtcctataccccttggttccttgggctggaagacagttaaacaaccagtatatgtcgtagatgtatccaaaggaattgttaatgcagttaaggatcctgatgccaatgggaaatcctttgctttcgttggtcccagtcggtacctccttttccacctggtgaagtacatctttgctgtggctcacagattgttcctcccattccccttgccgctttttgcctatcgatgggtagcaagagtctttgaaataagcccatttgagccctggataacaagggataaagtggagcggatgcacatcacagacatgaaattgcctcacctgcctggcttagaagaccttggtattcaggcaacaccactggaactcaaggccattgaggtgctgcggcgtcatcgcacttaccgctggctgtctgctgaaattgaggatgtgaagccggccaagaccgtcaacatttagtgcctcctgagcagctcttggttttggcgtcttttgggtcggcccatgtggtttgagcacccagccaggcggtctctttagaggatcctgtacacagttccactattaaaacatttcaggttgaaaaaaaaaaaaaaaaaaaagaaaaaaaaaaaaaaaaaaaaaaaaaaaaaaaaaaaaaaaaaaaaaaaaaaaacaaaaagaaaaaaaaaaaaaaaaaaaaaaagaaacacaaagcacaaggaagacaacaagaacggaggaggagggcggaagagaaaggcgggaggcaccacacacagcgaagaggacacgaaggagacgaggagagacacaacgaaagaagagagcgcagaaagaagaaggagagcaggcaggagatgaagagaagagaggggacagcaaaaagagaggcgcgacaaagagaaaaccacaacgagggcagggacacaagagaaagagagaagagaaggagagagagaggcagcggaggagaaaaaaaacagccgccggaggagaggagaggcagcaagcccgaggggagagggagagaagaagaaagcgaagagagaagaagaatgaagaggagggagagagagggaggggtgccgggcacgcgcgcgagcgactagcaagagcaacacaagacacgatacacaaagaggaagcacaacagaagaagatactagtaacagggaaaacaacgaagacaaactaaaaacacagcagaagaacccgaccagcagaaacagaacacgagcaaccagagaagtaaaacaacagagcaaaagacaagaacaagagcaccatcgtacgataaactatcggccgttgnan

SEQ ID NO: 299703 - DNA, 1326 bp, Homo sapiens
cagcttagcagccgtagtcagccgggagtgctgtcgtgggggattgtgggaaaagatggcggctgccgcacaatcccgggttgtccgggtcctgtcaatgtcacgttctgccattactgcaatagccacatctgtgtgtcacggcccaccctgtcgccagcttcatcatgccctcatgcctcatgggaaaggtggacgttcctcagtcagtgggattgtggccactgtgtttggagcaacaggattcctggggcgatatgttgtcaaccaccttggacgcatggggtcacaggtaatcataccctatcggtgtgataaatatgacatcatgcaccttcgtcccatgggtgacctgggccagcttctgtttctggaatgggacgcgagagataaagattctatccgacgagtagtacaacacagcaatgtggtcatcaatcttattggacgagactgggaaaccaaaaactttgattttgaggatgtttttgtgaagattccccaagcaattgctcaactgtccaaggaagctggagttgaaaaattcattcatgtttcacatctgaatgcgaatattaaaagctcttctagatatttgagaaataaggctgttggagagaaagtagtgagagatgcatttccggaagccattatcgtaaagccgtcggacatctttggaagagaggatagattccttaattcttttgcaagtatgcatcggtttggtcctataccccttggttccttgggctggaagacagttaaacaaccagtatatgtcgtagatgtatccaaaggaattgttaatgcagttaaggatcctgatgccaatgggaaatcctttgctttcgttggtcccagtcggtacctccttttccacctggtgaagtacatctttgctgtggctcacagattgttcctcccattccccttgccgctttttgcctatcgatgggtagcaagagtctttgaaataagcccatttgagccctggataacaagggataaagtggagcggatgcacatcacagacatgaaattgcctcacctgcctggcttagaagaccttggtattcaggcaacaccactggaactcaaggccattgaggtgctgcggcgtcatcgcacttaccgctggctgtctgctgaaattgaggatgtgaagccggccaagaccgtcaacatttagtgcctcctgagcagctcttggttttggcgtcttttgggtcggcccatgtggtttgagcacccagccaggcggtctctttagatgtgcggtagggggtgtcgttggggagttccggctatttaaaacattttatgttg

SEQ ID NO: 299704 - DNA, 1096 bp, Homo sapiens
cagcttagcagccgtagtcagccgggagtgctgtcgtgggggattgtgggaaaagatggcggctgccgcacaatcccgggttgtccgggtcctgtcaatgtcacgttctgccattactgcaatagccacatctgtgtgtcacggcccaccctgtcgccagcttcatcatgccctcatgcctcatgggaaaggtggacgttcctcagtcagtgggattgtggccactgtgtttggagcaacaggattcctggggcgatatgttgtcaaccaccttggacgcatggggtcacaggtaatcataccctatcggtgtgataaatatgacatcatgcaccttcgtcccatgggtgacctgggccagcttctgtttctggaatgggacgcgagagataaagattctatccgacgagtagtacaacacagcaatgtggtcatcaatcttattggacgagactgggaaaccaaaaactttgattttgaggatgtttttgtgaagattccccaagcaattgctcaactgtccaaggaagctggagttgaaaaattcattcatgtttcacatctgaatgcgaatattaaaagctcttctagatatttgagaaataaggctgttggagagaaagtagtgagagatgcatttccggaagccattatcgtaaagccgtcggacatctttggaagagaggatagattccttaattcttttgcaagtatgcatcggtttggtcctataccccttggttccttgggctggaagacagttaaacaaccagtatatgtcgtagatgtatccaaaggaattgttaatgcagttaaggatcctgatgccaatgggaaatcctttgctttcgttggtcccagtcggtacctccttttccacctggtgaagtacatctttgctgtggctcacagattgttcctcccattccccttgccgctttttgcctatcgatgggtagcaagagtctttgaaataagcccatttgagccctggataacaagggataaagtggagcggattgagcttgagggagttcaaggtgcatatgctaagatactccagcacaaatcttactgggtggaaaggtgaggtaaa

SEQ ID NO: 299705 - DNA, 1247 bp, Homo sapiens
cagcttagcagccgtagtcagccgggagtgctgtcgtgggggattgtgggaaaagatggcggctgccgcacaatcccgggttgtccgggtcctgtcaatgtcacgttctgccattactgcaatagccacatctgtgtgtcacggcccaccctgtcgccagcttcatcatgccctcatgcctcatgggaaaggtggacgttcctcagtcagtgggattgtggccactgtgtttggagcaacaggattcctggggcgatatgttgtcaaccaccttggacgcatggggtcacaggtaatcataccctatcggtgtgataaatatgacatcatgcaccttcgtcccatgggtgacctgggccagcttctgtttctggaatgggacgcgagagataaagattctatccgacgagtagtacaacacagcaatgtggtcatcaatcttattggacgagactgggaaaccaaaaactttgattttgaggatgtttttgtgaagattccccaagcaattgctcaactgtccaaggaagctggagttgaaaaattcattcatgtttcacatctgaatgcgaatattaaaagctcttctagatatttgagaaataaggctgttggagagaaagtagtgagagatgcatttccggaagccattatcgtaaagccgtcggacatctttggaagagaggatagattccttaattcttttgcaagtatgcatcggtttggtcctataccccttggttccttgggctggaagacagttaaacaaccagtatatgtcgtagatgtatccaaaggaattgttaatgcagttaaggatcctgatgccaatgggaaatcctttgctttcgttggtcccagtcggtacctccttttccacctggtgaagtacatctttgctgtggctcacagattgttcctcccattccccttgccgctttttgcctatcgatgcacatcacagacatgaaattgcctcacctgcctggcttagaagaccttggtattcaggcaacaccactggaactcaaggccattgaggtgctgcggcgtcatcgcacttaccgctggctgtctgctgaaattgaggatgtgaagccggccaagaccgtcaacatttagtgcctcctgagcagctcttggttttggcgtcttttgggtcggcccatgtggtttgagcacccagccaggcggtctctttagaggatcctgtacacagttccactattaaaacatttcaggttgaa

SEQ ID NO: 299706 - DNA, 1117 bp, Homo sapiens
cagcttagcagccgtagtcagccgggagtgctgtcgtgggggattgtgggaaaagatggcggctgccgcacaatcccgggttgtccgggtcctgtcaatgtcacgttctgccattactgcaatagccacatctgtgtgtcacggcccaccctgtcgccagcttcatcatgccctcatgcctcatgggaaaggtggacgttcctcagtcagtgggattgtggccactgtgtttggagcaacaggattcctggggcgatatgttgtcaaccaccttggacgcatggggtcacaggtaatcataccctatcggtgtgataaatatgacatcatgcaccttcgtcccatgggtgacctgggccagcttctgtttctggaatgggacgcgagagataaagattctatccgacgagtagtacaacacagcaatgtggtcatcaatcttattggacgagactgggaaaccaaaaactttgattttgaggatgtttttgtgaagattccccaagcaattgctcaactgtccaaggaagctggagttgaaaaattcattcatgtttcacatctgaatgcgaatattaaaagctcttctagatatttgagaaataaggctgttggagagaaagtagtgagagatgcatttccggaagccattatcgtaaagccgtcggacatctttggaagagaggatagattccttaattcttttgcaagtatgcatcggtttggtcctataccccttggttccttgggctggaagacagttaaacaaccagtatatgtcgtagatgtatccaaaggaattgttaatgcagttaaggatcctgatgccaatgggaaatcctttgctttcgttggtcccagtcggtacctccttttccacctggtgaagtacatctttgctgtggctcacagattgttcctcccattccccttgccgctttttgcctatcggtaagtagagtgctccttttgtgtgacttctgaaaaagccagctccacacgcgtgttcctaatgttctcccttagggttatagggtgtgtgaagggctggtctccagatctacaaagtgttatgacattagcatagagaagaagcagaaatagattagtgttggtt

SEQ ID NO: 299707 - DNA, 1431 bp, Homo sapiens
agcacgaggggcgggtattcccgatctgccatgtattccagaaaggccatgtacaagaggaagtactcagccgctaaatccaaggttgaaaagaaaaagaaggagaaggttctcgcaactgttacaaaaccagttggtggtgacaagaacggcggtacccgggtaccgccagatggcggctgccgcacaatcccgggttgtccgggtcctgtcaatgtcacgttctgccattactgcaatagccacatctgtgtgtcacggcccaccctgtcgccagcttcatcatgccctcatgcctcatgggaaaggtggacgttcctcagtcagtgggattgtggccactgtgtttggagcaacaggattcctggggcgatatgttgtcaaccaccttggacgcatggggtcacaggtaatcataccctatcggtgtgataaatatgacatcatgcaccttcgtcccatgggtgacctgggccagcttctgtttctggaatgggacgcgagagataaagattctatccgacgagtagtacaacacagcaatgtggtcatcaatcttattggacgagactgggaaaccaaaaactttgattttgaggatgtttttgtgaagattccccaagcaattgctcaactgtccaaggaagctggagttgaaaaattcattcatgtttcacatctgaatgcgaatattaaaagctcttctagatatttgagaaataaggctgttggagagaaagtagtgagagatgcatttccggaagccattatcgtaaagccgtcggacatctttggaagagaggatagattccttaattcttttgcaagtatgcatcggtttggtcctataccccttggttccttgggctggaagacagttaaacaaccagtatatgtcgtagatgtatccaaaggaattgttaatgcagttaaggatcctgatgccaatgggaaatcctttgctttcgttggtcccagtcggtacctccttttccacctggtgaagtacatctttgctgtggctcacagattgttcctcccattccccttgccgctttttgcctatcgatgggtagcaagagtctttgaaataagcccatttgagccctggataacaagggataaagtggagcggatgcacatcacagacatgaaattgcctcacctgcctggcttagaagaccttggtattcaggcaacaccactggaactcaaggccattgaggtgctgcggcgtcatcgcacttaccgctggctgtctgctgaaattgaggatgtgaagccggccaagaccgtcaacatttagtgcctcctgagcagctcttggttttggcgtcttttgggtcggcccatgtggtttgagcacccagccaggcggtctctttagaggatcctgtacacagttccactattaaaacatttcaggttgaa

SEQ ID NO: 299708 - DNA, 1044 bp, Homo sapiens
cagcttagcagccgtagtcagccgggagtgctgtcgtgggggattgtgggaaaagatggcggctgccgcacaatcccgggttgtccgggtcctgtcaatgtcacgttctgccattactgcaatagccacatctgtgtgtcacggcccaccctgtcgccagcttcatcatgccctcatgcctcatgggaaaggtggacgttcctcagtcagtgggattgtggccactgtgtttggagcaacaggattcctggggcgatatgttgtcaaccaccttggacgcatggggtcacaggtaatcataccctatcggtgtgataaatatgacatcatgcaccttcgtcccatgggtgacctgggccagcttctgtttctggaatgggacgcgagagataaagattctatccgacgagtagtacaacacagcaatgtggtcatcaatcttattggacgagactgggaaaccaaaaactttgattttgaggatgtttttgtgaagattccccaagcaattgctcaactgtccaaggaagctggagttgaaaaattcattcatgtttcacatctgaatgcgaatattaaaagctcttctagatatttgagaaataaggctgttggagagaaagtagtgagagatgcatttccggaagccattatcgtaaagccgtcggacatctttggaagagaggatagattccttaattcttttgcaagtatgcatcggtttggtcctataccccttggttccttgggctggaagacagttaaacaaccagtatatgttcgtagatgttcccacggagtgtgagtgcgttaggttcctgatgcagtgggaactccttgttcgttggtccagtcggtacttcttcccggtgagtctcttggctggggcccgattgtctccatcctgccgtttgcttgtggtgcggttctgatagccttggccggatacaggtagggggtgcccagcatgtgcccgcgtaacctggtgcccggctgctgggggccctccgtgtgagggggcaccctctccctggtgggctaccg

SEQ ID NO: 299709 - DNA, 1432 bp, Homo sapiens
cagcttagcagccgtagtcagccgggagtgctgtcgtgggggattgtgggaaaagatggcggctgccgcacaatcccgggttgtccgggtcctgtcaatgtcacgttctgccattactgcaatagccacatctgtgtgtcacggcccaccctgtcgccagcttcatcatgccctcatgcctcatgggaaaggtggacgttcctcagtcagtgggattgtggccactgtgtttggagcaacaggattcctggggcgatatgttgtcaaccaccttggacgcatggggtcacaggtaatcataccctatcggtgtgataaatatgacatcatgcaccttcgtcccatgggtgacctgggccagcttctgtttctggaatgggacgcgagagataaagattctatccgacgagtagtacaacacagcaatgtggtcatcaatcttattggacgagactgggaaaccaaaaactttgattttgaggatgtttttgtgaagattccccaagcaattgctcaactgtccaaggaagctggagttgaaaaattcattcatgtttcacatctgaatgcgaatattaaaagctcttctagatatttgagaaataaggctgttggagagaaagtagtgagagatgcatttccggaagccattatcgtaaagccgtcggacatctttggaagagaggatagattccttaattcttttgcaaagtcgcactctgacacccaggctggagtgcggtggcgtgatctcggctcactgcaacctctgcctcccaggttcaagcgattctctggcctcagcctcccaagtagctgggactacaggtatgcatcggtttggtcctataccccttggttccttgggctggaagacagttaaacaaccagtatatgtcgtagatgtatccaaaggaattgttaatgcagttaaggatcctgatgccaatgggaaatcctttgctttcgttggtcccagtcggtacctccttttccacctggtgaagtacatctttgctgtggctcacagattgttcctcccattccccttgccgctttttgcctatcgatgggtagcaagagtctttgaaataagcccatttgagccctggataacaagggataaagtggagcggatgcacatcacagacatgaaattgcctcacctgcctggcttagaagaccttggtattcaggcaacaccactggaactcaaggccattgaggtgctgcggcgtcatcgcacttaccgctggctgtctgctgaaattgaggatgtgaagccggccaagaccgtcaacatttagtgcctcctgagcagctcttggttttggcgtcttttgggtcggcccatgtggtttgagcacccagccaggcggtctctttagaggatcctgtacacagttccactattaaaacatttcaggttgaa

SEQ ID NO: 299710 - DNA, 2391 bp, Homo sapiens
agagtcagtgtgagctgttgaaagcctgcagctaaacaccagtgttacttcactcccctttgtggacaccaaggggaagaagaatacggtaagcttcccacacattagcaagaaagtcctgctgaagtcatccctgctgtatcaggagaatcaagctcacaatcagatgccggcctcagagctcaaggcttcagaaatacctttccaccctagcattaaaacccaggatcccaaggcagaggagaagtcaccaaagaagcaaaaggtgactctgacagcggcagaggccctaaagctttttaagaaccagctgtctccatatgaacaaagtgaaatcctgggctacgcggagctgtggttcctgggtcttgaagccaagaagctcgacacggctcctgagaaatttagcaagacgagttttgatgatgagcatggcttctatctgaaggtcctgcatgatcacattgcctaccgctatgaagttctggagacaatcgggaaggggtcctttggacaggtggccaagtgcttggatcacaaaaacaatgagctggtggccctgaaaatcatcaggaacaagaagaggtttcaccagcaggccctgatggagctgaagatcctggaagctctcagaaagaaggacaaagacaacacctacaatgtggtgcatatgaaggactttttctactttcgcaatcacttctgcatcacctttgagctcctgggaatcaacttgtatgagttgatgaagaataacaactttcaaggcttcagtctgtccatagttcggcgcttcactctctctgttttgaagtgcttgcagatgctttcggtagagaaaatcattcactgtgatctcaagcccgaaaatatagtgctataccaaaagggccaagcctctgttaaagtcattgactttggatcaagctgttatgaacaccagaaagtatacacgtacatccaaagccggttctaccgatccccagaagtgatcctgggccacccctacgacgtggccattgacatgtggagcctgggctgcatcacggcggagttgtacacgggctaccccctgttccccggggagaatgaggtggagcagctggcctgcatcatggagctcaccaactaagacgtttgtgctcacatggaaggagaagtgctccttgatgtccggacaggttctgccattactgcaatagccacatctgtgtgtcacggcccaccctgtcgccagcttcatcatgccctcatgcctcatgggaaaggtggacgttcctcagtcagtgggattgtggccactgtgtttggagcaacaggattcctggggcgatatgttgtcaaccaccttggacgcatggggtcacaggtaatcataccctatcggtgtgataaatatgacatcatgcaccttcgtcccatgggtgacctgggccagcttctgtttctggaatgggacgcgagagataaagattctatccgacgagtagtacaacacagcaatgtggtcatcaatcttattggacgagactgggaaaccaaaaactttgattttgaggatgtttttgtgaagattccccaagcaattgctcaactgtccaaggaagctggagttgaaaaattcattcatgtttcacatctgaatgcgaatattaaaagctcttctagatatttgagaaataaggctgttggagagaaagtagtgagagatgcatttccggaagccattatcgtaaagccgtcggacatctttggaagagaggatagattccttaattcttttgcaagtatgcatcggtttggtcctataccccttggttccttgggctggaagacagttaaacaaccagtatatgtcgtagatgtatccaaaggaattgttaatgcagttaaggatcctgatgccaatgggaaatcctttgctttcgttggtcccagtcggtacctccttttccacctggtgaagtacatctttgctgtggctcacagattgttcctcccattccccttgccgctttttgcctatcgatgggtagcaagagtctttgaaataagcccatttgagccctggataacaagggataaagtggagcggatgcacatcacagacatgaaattgcctcacctgcctggcttagaagaccttggtattcaggcaacaccactggaactcaaggccattgaggtgctgcggcgtcatcgcacttaccgctggctgtctgctgaaattgaggatgtgaagccggccaagaccgtcaacatttagtgcctcctgagcagctcttggttttggcgtcttttgggtcggcccatgtggtttgagcacccagccaggcggtctctttagaggatcctgtacacagttccactattaaaacatttcaggttgaa

SEQ ID NO: 299711 - DNA, 1426 bp, Homo sapiens
cgggaacggcggcccctggtcgggattccgagacggggatttaaggttttggaagtggcaccgtgctgcagcggtcacgccaacttcctaggcacactctggtttctctaggtttggagctgcctcagtctggtttctcctttcgctttccgcttccccggctcacatattcaattgtgcaccaccttgggaggggacaaaagatcttaagcagctgttctgccattactgcaatagccacatctgtgtgtcacggcccaccctgtcgccagcttcatcatgccctcatgcctcatgggaaaggtggacgttcctcagtcagtgggattgtggccactgtgtttggagcaacaggattcctggggcgatatgttgtcaaccaccttggacgcatggggtcacaggtaatcataccctatcggtgtgataaatatgacatcatgcaccttcgtcccatgggtgacctgggccagcttctgtttctggaatgggacgcgagagataaagattctatccgacgagtagtacaacacagcaatgtggtcatcaatcttattggacgagactgggaaaccaaaaactttgattttgaggatgtttttgtgaagattccccaagcaattgctcaactgtccaaggaagctggagttgaaaaattcattcatgtttcacatctgaatgcgaatattaaaagctcttctagatatttgagaaataaggctgttggagagaaagtagtgagagatgcatttccggaagccattatcgtaaagccgtcggacatctttggaagagaggatagattccttaattcttttgcaagtatgcatcggtttggtcctataccccttggttccttgggctggaagacagttaaacaaccagtatatgtcgtagatgtatccaaaggaattgttaatgcagttaaggatcctgatgccaatgggaaatcctttgctttcgttggtcccagtcggtacctccttttccacctggtgaagtacatctttgctgtggctcacagattgttcctcccattccccttgccgctttttgcctatcgatgggtagcaagagtctttgaaataagcccatttgagccctggataacaagggataaagtggagcggatgcacatcacagacatgaaattgcctcacctgcctggcttagaagaccttggtattcaggcaacaccactggaactcaaggccattgaggtgctgcggcgtcatcgcacttaccgctggctgtctgctgaaattgaggatgtgaagccggccaagaccgtcaacatttagtgcctcctgagcagctcttggttttggcgtcttttgggtcggcccatgtggtttgagcacccagccaggcggtctctttagaggatcctgtacacagttccactattaaaacatttcaggttgaa

SEQ ID NO: 299712 - DNA, 1270 bp, Homo sapiens
  misc_feature (24)..(24): n is a, c, g, or t
gctaggtacgaggcggtgttaatnggcgaggccgggttgtccgggtcctgtcaatgtcacgttctgccattactgcaatagccacatctgtgtgtcacggcccaccctgtcgccagcttcatcatgccctcatgcctcatgggaaaggtggacgttcctcagtcagtgggattgtggccactgtgtttggagcaacaggattcctggggcgatatgttgtcaaccaccttggacgcatggggtcacaggtaatcataccctatcggtgtgataaatatgacatcatgcaccttcgtcccatgggtgacctgggccagcttctgtttctggaatgggacgcgagagataaagattctatccgacgagtagtacaacacagcaatgtggtcatcaatcttattggacgagactgggaaaccaaaaactttgattttgaggatgtttttgtgaagattccccaagcaattgctcaactgtccaaggaagctggagttgaaaaattcattcatgtttcacatctgaatgcgaatattaaaagctcttctagatatttgagaaataaggctgttggagagaaagtagtgagagatgcatttccggaagccattatcgtaaagccgtcggacatctttggaagagaggatagattccttaattcttttgcaagtatgcatcggtttggtcctataccccttggttccttgggctggaagacagttaaacaaccagtatatgtcgtagatgtatccaaaggaattgttaatgcagttaaggatcctgatgccaatgggaaatcctttgctttcgttggtcccagtcggtacctccttttccacctggtgaagtacatctttgctgtggctcacagattgttcctcccattccccttgccgctttttgcctatcgatgggtagcaagagtctttgaaataagcccatttgagccctggataacaagggataaagtggagcggatgcacatcacagacatgaaattgcctcacctgcctggcttagaagaccttggtattcaggcaacaccactggaactcaaggccattgaggtgctgcggcgtcatcgcacttaccgctggctgtctgctgaaattgaggatgtgaagccggccaagaccgtcaacatttagtgcctcctgagcagctcttggttttggcgtcttttgggtcggcccatgtggtttgagcacccagccaggcggtctctttagaggatcctgtacacagttccactattaaaacatttcaggttgaa

SEQ ID NO: 299713 - DNA, 1389 bp, Homo sapiens
agcattggtacatgaactttgagggttcattctagtaccaagaacctcagtcaatgaaaaagaaatggtggaatgtttgacaagtctcttgctgttaaactttctaaaagtcagaatatcttttctcaagcacttcactccttttatcattatttgtgatgttcttcagtggttttatagttctgccattactgcaatagccacatctgtgtgtcacggcccaccctgtcgccagcttcatcatgccctcatgcctcatgggaaaggtggacgttcctcagtcagtgggattgtggccactgtgtttggagcaacaggattcctggggcgatatgttgtcaaccaccttggacgcatggggtcacaggtaatcataccctatcggtgtgataaatatgacatcatgcaccttcgtcccatgggtgacctgggccagcttctgtttctggaatgggacgcgagagataaagattctatccgacgagtagtacaacacagcaatgtggtcatcaatcttattggacgagactgggaaaccaaaaactttgattttgaggatgtttttgtgaagattccccaagcaattgctcaactgtccaaggaagctggagttgaaaaattcattcatgtttcacatctgaatgcgaatattaaaagctcttctagatatttgagaaataaggctgttggagagaaagtagtgagagatgcatttccggaagccattatcgtaaagccgtcggacatctttggaagagaggatagattccttaattcttttgcaagtatgcatcggtttggtcctataccccttggttccttgggctggaagacagttaaacaaccagtatatgtcgtagatgtatccaaaggaattgttaatgcagttaaggatcctgatgccaatgggaaatcctttgctttcgttggtcccagtcggtacctccttttccacctggtgaagtacatctttgctgtggctcacagattgttcctcccattccccttgccgctttttgcctatcgatgggtagcaagagtctttgaaataagcccatttgagccctggataacaagggataaagtggagcggatgcacatcacagacatgaaattgcctcacctgcctggcttagaagaccttggtattcaggcaacaccactggaactcaaggccattgaggtgctgcggcgtcatcgcacttaccgctggctgtctgctgaaattgaggatgtgaagccggccaagaccgtcaacatttagtgcctcctgagcagctcttggttttggcgtcttttgggtcggcccatgtggtttgagcacccagccaggcggtctctttagaggatcctgtacacagttccactattaaaacatttcaggttgaa

SEQ ID NO: 299714 - DNA, 808 bp, Homo sapiens
  misc_feature (715)..(715): n is a, c, g, or t
  misc_feature (746)..(746): n is a, c, g, or t
cagcttagcagccgtagtcagccgggagtgctgtcgtgggggattgtgggaaaagatggcggctgccgcacaatcccgggttgtccgggtcctgtcaatgtcacgttctgccattactgcaatagccacatctgtgtgtcacggcccaccctgtcgccagcttcatcatgccctcatgcctcatgggaaaggtggacgttcctcagtcagtgggattgtggccactgtgtttggagcaacaggattcctggggcgatatgttgtcaaccaccttggacgcatggggtcacaggtaatcataccctatcggtgtgataaatatgacatcatgcaccttcgtcccatgggtgacctgggccagcttctgtttctggaatgggacgcgagagataaagattctatccgacgagtagtacaacacagcaatgtggtcatcaatcttattggacgagactgggaaaccaaaaactttgattttgaggatgtttttgtgaagattccccaagcaattgctcaactgtccaaggaagctggagttgaaaaattcattcatgtttcacatctgaatgcgaatattaaaagctcttctagatatttgagaaataaggctgttggagagaaagtagtgagagatgcatttccggaagccattatcgtaaagccgtcggacatctttggaagagaggatagattccttaattcttttgcaagatgnttcgggttggcctataccctgggtcctgggnggagacactctaacaccctttttcgcctttttccacggaggcaccagaacttgcccgggacc

SEQ ID NO: 299715 - DNA, 735 bp, Homo sapiens
cagcttagcagccgtagtcagccgggagtgctgtcgtgggggattgtgggaaaagatggcggctgccgcacaatcccgggttgtccgggtcctgtcaatgtcacgttctgccattactgcaatagccacatctgtgtgtcacggcccaccctgtcgccagcttcatcatgccctcatgcctcatgggaaaggtggacgttcctcagtcagtgggattgtggccactgtgtttggagcaacaggattcctggggcgatatgttgtcaaccaccttggacgcatggggtcacaggtaatcataccctatcggtgtgataaatatgacatcatgcaccttcgtcccatgggtgacctgggccagcttctgtttctggaatgggacgcgagagataaagattctatccgacgagtagtacaacacagcaatgtggtcatcaatcttattggacgagactgggaaaccaaaaactttgattttgaggatgtttttgtgaagattccccaagcaattgctcaactgtccaaggaagctggagttgaaaaattcattcatgtttcacatctgaatgcgaatattaaaagctcttctagatatttgagaaataaggctgttggagagaaagtagtgagagatgcatttccggaagccattatcgtaaagccgtcggacatctttggaagagaggatagattccttaattcttttgcaaagtacgtattctttcttaatggtag

SEQ ID NO: 299716 - DNA, 1216 bp, Homo sapiens
cagcttagcagccgtagtcagccgggagtgctgtcgtgggggattgtgggaaaagatggcggctgccgcacaatcccgggttgtccgggtcctgtcaatgtcacgttctgccattactgcaatagccacatctgtgtgtcacggcccaccctgtcgccagcttcatcatgccctcatgcctcatgggaaaggtggacgttcctcagtcagtgggattgtggccactgtgtttggagcaacaggattcctggggcgatatgttgtcaaccaccttggaatgggacgcgagagataaagattctatccgacgagtagtacaacacagcaatgtggtcatcaatcttattggacgagactgggaaaccaaaaactttgattttgaggatgtttttgtgaagattccccaagcaattgctcaactgtccaaggaagctggagttgaaaaattcattcatgtttcacatctgaatgcgaatattaaaagctcttctagatatttgagaaataaggctgttggagagaaagtagtgagagatgcatttccggaagccattatcgtaaagccgtcggacatctttggaagagaggatagattccttaattcttttgcaagtatgcatcggtttggtcctataccccttggttccttgggctggaagacagttaaacaaccagtatatgtcgtagatgtatccaaaggaattgttaatgcagttaaggatcctgatgccaatgggaaatcctttgctttcgttggtcccagtcggtacctccttttccacctggtgaagtacatctttgctgtggctcacagattgttcctcccattccccttgccgctttttgcctatcgatgggtagcaagagtctttgaaataagcccatttgagccctggataacaagggataaagtggagcggatgcacatcacagacatgaaattgcctcacctgcctggcttagaagaccttggtattcaggcaacaccactggaactcaaggccattgaggtgctgcggcgtcatcgcacttaccgctggctgtctgctgaaattgaggatgtgaagccggccaagaccgtcaacatttagtgcctcctgagcagctcttggttttggcgtcttttgggtcggcccatgtggtttgagcacccagccaggcggtctctttagaggatcctgtacacagttccactattaaaacatttcaggttgaa

SEQ ID NO: 299717 - DNA, 1851 bp, Homo sapiens
agagtcagtgtgagctgttgaaagcctgcagctaaacaccagtgttacttcactcccctttgtggacaccaaggggaagaagaatacggtaagcttcccacacattagcaagaaagtcctgctgaagtcatccctgctgtatcaggagaatcaagctcacaatcagatgccggcctcagagctcaaggcttcagaaatacctttccaccctagcattaaaacccaggatcccaaggcagaggagaagtcaccaaagaagcaaaaggtgactctgacagcggcagaggccctaaagctttttaagaaccagctgtctccatatgaacaaagtgaaatcctgggctacgcggagctgtggttcctgggtcttgaagccaagaagctcgacacggctcctgagaaatttagcaagacgagttttgatgatgagcatggcttctatctgaaggtcctgcatgatcacattgcctaccgctatgaagttctggagacaatcgggaaggggtcctttggacaggtggccaagtgcttggatcacaaaaacaatgagctggtggccctgaaaatcatcaggaacaagaagaggtttcaccagcaggccctgatggagctgaagatcctggaagctctcagaaagaaggacaaagacaacacctacaatgtggtgcatatgaaggactttttctactttcgcaatcacttctgcatcacctttgagctcctgggaatcaacttgtatgagttgatgaagaataacaactttcaaggcttcagtctgtccatagttcggcgcttcactctctctgttttgaagtgcttgcagatgctttcggtagagaaaatcattcactgtgatctcaagcccgaaaatatagtgctataccaaaagggccaagcctctgttaaagtcattgactttggatcaagctgttatgaacaccagaaagtatacacgtacatccaaagccggttctaccgatccccagaagtgatcctgggccacccctacgacgtggccattgacatgtggagcctgggctgcatcacggcggagttgtacacgggctaccccctgttccccggggagaatgaggtggagcagctggcctgcatcatggaggtgctgggtctgccgccagccggcttcattcagacagcctccaggagacagacattctttgattccaaaggttttcctaaaaatataaccaacaacagggggaaaaaaagatacccagattccaaggacctcacgatggtgctgaaaacctatgacaccagcttcctggactttctcagaaggtgtttggtatgggaaccttctcttcgcatgaccccggaccaggccctcaagcatgcttggattcatcagtctcggaacctcaagccacagcccaggccccagaccctgaggaaatccaattcctttttcccctctgagacaaggaaggacaaggttcaaggctgtcatcactcgagcagaaaagcagatgagatcaccaaagagactacagagaaaacaaaagatagccccacgaagcatgttcagcattcaggtgatcagcaggactgtctccagcacggagctgacactgttcagctgcctcaactggtagacgctcccaagaagtcagaggcagctgtcggggcggaggtgtccatgacctccccaggacagagcaaaaacttctccctcaagaacacaaacgttttaccccctattgtatgacctttgctgagggtatgtcctgctcctttccaccagtgatttgtattaagacagcacttatattgtacaatacttcagactgttttttttaaatacataaaactttatgttaaaaaactcta

SEQ ID NO: 299718 - DNA, 1790 bp, Homo sapiens
agagtcagtgtgagctgttgaaagcctgcagctaaacaccagtgttacttcactcccctttgtggacaccaaggggaagaagaatacggtaagcttcccacacattagcaagaaagtcctgctgaagtcatccctgctgtatcaggagaatcaagctcacaatcagatgccggcctcagagctcaaggcttcagaaatacctttccaccctagcattaaaacccaggatcccaaggcagaggagaagtcaccaaagaagcaaaaggtgactctgacagcggcagaggccctaaagctttttaagaaccagctgtctccatatgaacaaagtgaaatcctgggctacgcggagctgtggttcctgggtcttgaagccaagaagctcgacacggctcctgagaaatttagcaagacgagttttgatgatgagcatggcttctatctgaaggtcctgcatgatcacattgcctaccgctatgaagttctggagacaatcgggaaggggtcctttggacaggtggccaagtgcttggatcacaaaaacaatgagctggtggccctgaaaatcatcaggaacaagaagaggtttcaccagcaggccctgatggagctgaagatcctggaagctctcagaaagaaggacaaagacaacacctacaatgtggtgcatatgaaggactttttctactttcgcaatcacttctgcatcacctttgagctcctgggaatcaacttgtatgagttgatgaagaataacaactttcaaggcttcagtctgtccatagttcggcgcttcactctctctgttttgaagtgcttgcagatgctttcggtagagaaaatcattcactgtgatctcaagcccgaaaatatagtgctataccaaaagggccaagcctctgttaaagtcattgactttggatcaagctgttatgaacaccagaaagtatacacgtacatccaaagccggttctaccgatccccagaagtgatcctgggccacccctacgacgtggccattgacatgtggagcctgggctgcatcacggcggagttgtacacgggctaccccctgttccccggggagaatgaggtggagcagctggcctgcatcatggagattccaaaggttttcctaaaaatataaccaacaacagggggaaaaaaagatacccagattccaaggacctcacgatggtgctgaaaacctatgacaccagcttcctggactttctcagaaggtgtttggtatgggaaccttctcttcgcatgaccccggaccaggccctcaagcatgcttggattcatcagtctcggaacctcaagccacagcccaggccccagaccctgaggaaatccaattcctttttcccctctgagacaaggaaggacaaggttcaaggctgtcatcactcgagcagaaaagcagatgagatcaccaaagagactacagagaaaacaaaagatagccccacgaagcatgttcagcattcaggtgatcagcaggactgtctccagcacggagctgacactgttcagctgcctcaactggtagacgctcccaagaagtcagaggcagctgtcggggcggaggtgtccatgacctccccaggacagagcaaaaacttctccctcaagaacacaaacgttttaccccctattgtatgacctttgctgagggtatgtcctgctcctttccaccagtgatttgtattaagacagcacttatattgtacaatacttcagactgttttttttaaatacataaaactttatgttaaaaaactcta

SEQ ID NO: 299719 - DNA, 1063 bp, Homo sapiens
gatgaggagcatttaggtaagtagagggcctagggccgcattactgtagcttgacatatgtcttttcttctctctaggaaaatatagtgctataccaaaagggccaagcctctgttaaagtcattgactttggatcaagctgttatgaacaccagaaagtatacacgtacatccaaagccggttctaccgatccccagaagtgatcctgggccacccctacgacgtggccattgacatgtggagcctgggctgcatcacggcggagttgtacacgggctaccccctgttccccggggagaatgaggtggagcagctggcctgcatcatggaggtgctgggtctgccgccagccggcttcattcagacagcctccaggagacagacattctttgattccaaaggttttcctaaaaatataaccaacaacagggggaaaaaaagatacccagattccaaggacctcacgatggtgctgaaaacctatgacaccagcttcctggactttctcagaaggtgtttggtatgggaaccttctcttcgcatgaccccggaccaggccctcaagcatgcttggattcatcagtctcggaacctcaagccacagcccaggccccagaccctgaggaaatccaattcctttttcccctctgagacaaggaaggacaaggttcaaggctgtcatcactcgagcagaaaagcagatgagatcaccaaagagactacagagaaaacaaaagatagccccacgaagcatgttcagcattcaggtgatcagcaggactgtctccagcacggagctgacactgttcagctgcctcaactggtagacgctcccaagaagtcagaggcagctgtcggggcggaggtgtccatgacctccccaggacagagcaaaaacttctccctcaagaacacaaacgttttaccccctattgtatgacctttgctgagggtatgtcctgctcctttccaccagtgatttgtattaagacagcacttatattgtacaatacttcagactgttttttttaaatacataaaactttatgttaaaaaactcta

SEQ ID NO: 299720 - DNA, 1182 bp, Homo sapiens
acatgatcatgactttaggagctttgttattgataagactgtgagcttgattcttctttggtcattggtaaaaaggacaatgtaggatgaagtgggagggctaaggccatgatccaaaaggaaatggatatttgtacaatttcacaggaccttgtcacttaacatttactttaccattgtcattattatcattagcattattattttatcttggttggtgttaagccatttaaattatttctttgatttggagaggaggcagtgggaaggaagttcagaacatactgaatagtaggaaaaaatcaatttttaaagtaaattgcattccttgggtaatctacacatggttatttcaaactgagtgtgtgtgtgtgtgtttattggggtgtggcatgaggcgagtgtgtaagacagagagcaaaagagctacagaggccactctaagcagcagcatcatgtgaccactaaagatttacacctgaaactaaatacagaatgttctatctctacagattccaaaggttttcctaaaaatataaccaacaacagggggaaaaaaagatacccagattccaaggacctcacgatggtgctgaaaacctatgacaccagcttcctggactttctcagaaggtgtttggtatgggaaccttctcttcgcatgaccccggaccaggccctcaagcatgcttggattcatcagtctcggaacctcaagccacagcccaggccccagaccctgaggaaatccaattcctttttcccctctgagacaaggaaggacaaggttcaaggctgtcatcactcgagcagaaaagcagatgagatcaccaaagagactacagagaaaacaaaagatagccccacgaagcatgttcagcattcaggtgatcagcaggactgtctccagcacggagctgacactgttcagctgcctcaactggtagacgctcccaagaagtcagaggcagctgtcggggcggaggtgtccatgacctccccaggacagagcaaaaacttctccctcaagaacacaaacgttttaccccctattgtatgacctttgctgagggtatgtcctgctcctttccaccagtgatttgtattaagacagcacttatattgtacaatacttcagactgttttttttaaatacataaaactttatgttaaaaaactcta

SEQ ID NO: 299721 - DNA, 2231 bp, Homo sapiens
agagtcagtgtgagctgttgaaagcctgcagctaaacaccagtgttacttcactcccctttgtggacaccaaggggaagaagaatacggtaagcttcccacacattagcaagaaagtcctgctgaagtcatccctgctgtatcaggagaatcaagctcacaatcagatgccggcctcagagctcaaggcttcagaaatacctttccaccctagcattaaaacccaggatcccaaggcagaggagaagtcaccaaagaagcaaaaggtgactctgacagcggcagaggccctaaagctttttaagaaccagctgtctccatatgaacaaagtgaaatcctgggctacgcggagctgtggttcctgggtcttgaagccaagaagctcgacacggctcctgagaaatttagcaagacgagttttgatgatgagcatggcttctatctgaaggtcctgcatgatcacattgcctaccgctatgaagttctggagacaatcgggaaggggtcctttggacaggtggccaagtgcttggatcacaaaaacaatgagctggtggccctgaaaatcatcaggaacaagaagaggtttcaccagcaggccctgatggagctgaagatcctggaagctctcagaaagaaggacaaagacaacacctacaatgtggtgcatatgaaggactttttctactttcgcaatcacttctgcatcacctttgagctcctgggaatcaacttgtatgagttgatgaagaataacaactttcaaggcttcagtctgtccatagttcggcgcttcactctctctgttttgaagtgcttgcagatgctttcggtagagaaaatcattcactgtgatctcaagcccgaaaatatagtgctataccaaaagggccaagcctctgttaaagtcattgactttggatcaagctgttatgaacaccagaaagtatacacgtacatccaaagccggttctaccgatccccagaagtgatcctgggccacccctacgacgtggccattgacatgtggagcctgggctgcatcacggcggagttgtacacgggctaccccctgttccccggggagaatgaggtggagcagctggcctgcatcatggagattccaaaggttttcctaaaaatataaccaacaacagggggaaaaaaagatacccagattccaaggacctcacgatggtgctgaaaacctatgacaccagcttcctggactttctcagaaggtgtttggtatgggaaccttctcttcgcatgaccccggaccaggccctcaagcatgcttggattcatcagtctcggaacctcaagccacagcccaggccccagaccctgaggaaatccaattcctttttcccctctgagacaaggaaggacaaggttcaaggctgtcatcactcgagcagaaaagcagatgagatcaccaaagagactacagagaaaacaaaagatagccccacgaagcatgttcagcattcaggtgatcagcaggactgtctccagcacggagctgacactgttcagctgcctcaactggtagacgctcccaagaagtcagaggcagctgtcggggcggaggtgtccatgacctccccaggacagagcaaaaacttctccctcaagaacacaaacgttttaccccctattgtatgacctttgctgagggtatgtcctgctcctttccaccagtgatttgtattaagacagcacttatattgtacaatacttcagactgttttttttaaatacataaaactttatgttaaaaaactctattaacatggccaattggcatgactcctcttatgagggatgggggaggatgtccttgcacttaaactcattccatatgcatctgtgtgtgtagagggggcgggtagttttgaactctcagtgttacagcatcattaatggaactccaaacaaaagaaattttttttcttcttgcccatgactgccaacctatgtcaggatttttgtttgaaaatgatagaagctgaattcaaaagcagtttaaacaacggaagacacttattgacttacataattggggcatcagaaaaggtagatgtagtttcaggcgcagcaggatccaggaattcaaatgaggttgtagggctcagactccctcttcatctattagccttgcttctcactatggttaacttcatcctgatgtcaggccctgctcagaagttaaccgccaacatccagtc

SEQ ID NO: 299722 - DNA, 818 bp, Homo sapiens
  misc_feature (594)..(594): n is a, c, g, or t
cagcttagcagccgtagtcagccgggagtgctgtcgtgggggattgtgggaaaagatggcggctgccgcacaatcccgggttgtccgggtcctgtcaatgtcacgttctgccattactgcaatagccacatctgtgtgtcacggcccaccctgtcgccagcttcatcatgccctcatgcctcatgggaaaggtggacgttcctcagtcagtgggattgtggccactgtgtttggagcaacaggattcctggggcgatatgttgtcaaccaccttggacgcatggggtcacaggtaatcataccctatcggtgtgataaatatgacatcatgcaccttcgtcccatgggtgacctgggccagcttctgtttctggaatgggacgcgagagataaagattctatccgacgagtagtacaacacagcaatgtggtcatcttttcaatcttattgggaagggaagaaccttgggggaaaaaaaacccaaaaaaaaaaaaaacttttttgggaaatttttttcgggaacgggggcgggacacatgaggggtatcacatcaaccaacggcgggcggtcttcggcggcaaacacacgacangcgcgaacatttttttttcccccaccccgccacgaccccaaaaaagaaagggcgcggcccccacaacaaaacttttttgcttgggcgggcgccgtttttccccccaaaaaaaaacactgctgtctgtggggggtggctgttttctcccccacccccaaaaaaaagaccaggggggcgggggggccaacacaaacaagaacgcgggcgcccccctctttctggtg

SEQ ID NO: 299723 - DNA, 734 bp, Homo sapiens
gcttttatagtgatttgcatgaatcgaaaattgccacatattctttgaaagcaattaagtctcaataataggactcatgccagcttgaatgtttaagtgcctgctaggatagcactttgttctcagccagttttcagcattgtctgtggtcctttgtttatccaaagatgcacatcacagacatgaaattgcctcacctgcctggcttagaagaccttggtattcaggcaacaccactggaactcaaggccattgaggtgctgcggcgtcatcgcacttaccgctggctgtctgctgaaattgaggatgtgaagccggccaagaccgtcaacatttagtgcctcctgagcagctcttggttttggcgtcttttgggtcggcccatgtggtttgagcacccagccaggcggtctctttagaggatcctgtacacagttccactattaaaacatttcaggttgaattctgcagtattttcttccttgatttacaaaatgagaaatgtagtcacttagaacttgagcatgatttttgttaaacatatttaataatgatatatatactatttattctctgaaatgccagagagtttgaattttcctatgacaaaccacttctagcatacgttctagaagacaaggaccctttttaatgtcaaagtattgtaaagaccccaagtgatatgtgattgttttttaatttccattaaatgagagagcatacagtatccccta

SEQ ID NO: 299724 - DNA, 1654 bp, Homo sapiens
agagtcagtgtgagctgttgaaagcctgcagctaaacaccagtgttacttcactcccctttgtggacaccaaggggaagaagaatacggtaagcttcccacacattagcaagaaagtcctgctgaagtcatccctgctgtatcaggagaatcaagctcacaatcagatgccggcctcagagctcaaggcttcagaaatacctttccaccctagcattaaaacccaggatcccaaggcagaggagaagtcaccaaagaagcaaaaggtgactctgacagcggcagaggccctaaagctttttaagaaccagctgtctccatatgaacaaagtgaaatcctgggctacgcggagctgtggttcctgggtcttgaagccaagaagctcgacacggctcctgagaaatttagcaagacgagttttgatgatgagcatggcttctatctgaaggtcctgcatgatcacattgcctaccgctatgaagttctggagacaatcgggaaggggtcctttggacaggtggccaagtgcttggatcacaaaaacaatgagctggtggccctgaaaatcatcaggaacaagaagaggtttcaccagcaggccctgatggagctgaagatcctggaagctctcagaaagaaggacaaagacaacacctacaatgtggtgcatatgaaggactttttctactttcgcaatcacttctgcatcacctttgagctcctgggaatcaacttgtatgagttgatgaagaataacaactttcaaggcttcagtctgtccatagttcggcgcttcactctctctgttttgaagtgcttgcagatgctttcggtagagaaaatcattcactgtgatctcaagcccgaaaatatagtgctataccaaaagggccaagcctctgttaaagtcattgactttggatcaagctgttatgaacaccagaaagtatacacgtacatccaaagccggttctaccgatccccagaagtgatcctgggccacccctacgacgtggccattgacatgtggagcctgggctgcatcacggcggagttgtacacgggctaccccctgttccccggggagaatgaggtggagcagctggcctgcatcatggaggtgctgggtctgccgccagccggcttcattcagacagcctccaggagacagacattctttgattccaaaggttttcctaaaaatataaccaacaacagggggaaaaaaagatacccagattccaaggacctcacgatggtgctgaaaacctatgacaccagcttcctggactttctcagaaggtgtttggtatgggaaccttctcttcgcatgaccccggaccaggccctcaagcatgcttggattcatcagtctcggaacctcaagccacagcccaggccccagaccctgaggaaatccaattcctttttcccctctgagacaaggaaggacaaggttcaaggctgtcatcactcgagcagaaaagcaggtacagcctgtcaaataaccagtcctagtcccacagtccgggaattaatattctagaattctgtaaatctccttgtgatatttttgaagccccagttctgtagtctggaaattaaaatctttgtttttaatattctgtttaatatgctgtttaagcatttctga

SEQ ID NO: 299725 - DNA, 860 bp, Homo sapiens
cagcttagcagccgtagtcagccgggagtgctgtcgtgggggattgtgggaaaagatggcggctgccgcacaatcccgggttgtccgggtcctgtcaatgtcacgttctgccattactgcaatagccacatctgtgtgtcacggcccaccctgtcgccagcttcatcatgccctcatgcctcatgggaaaggtggacgttcctcagtcagtgggattgtggccactgtgtttggagcaacaggattcctggggcgatatgttgtcaaccaccttggacgcatggggtcacaggtaatcataccctatcggtgtgataaatatgacatcatgcaccttcgtcccatgggtgacctgggccagcttctgtttctggtaagggcctttatgactgaatgaagttgacaaatataaattactaaggtcatttttaggagtgataggcagtataataaagcagtaatttcttcccagaatggaccaaaggcatcctctgttcccaggtcattctttcagctaggttccggcatctcctttgtcatgcaagctctagattggcagttggcaaactttttctttgaagggacagagagtaaatacttctggctttgcaggtcgtagagtctttgtcataattactcagctctgcccttgtaactggaagtagccatagacaatatgtacacaaatgggcatggctgcatttcagtaaaattttatttacaaaatgaggctgcaggctgaatttggcctatggactatagtttatcaatccctgctctagacctgtgctgtccagtgtggtagccactggccacatgtggctactgagcacatgaaatgtggctagtctgaattgaga

SEQ ID NO: 299726 - DNA, 651 bp, Homo sapiens
tctggttctaccacttatcaggtgtggacttaacctctctgtagctcagtatctccatttatgagaatgagaataaagcctgttctccagggtcgctgaaatgatcagacgaattagtaaatgtacagtgcttagaataatgcccggcacattggaggtgctttacaaatgaactgtttttatatcatcacggtcatcgtttccactaagtgatgtacaacctaaaggacaattaacatataatccacatttgaatcttgttcccttctgtcttctctctcctttagcagatgagatcaccaaagagactacagagaaaacaaaagatagccccacgaagcatgttcagcattcaggtgatcagcaggactgtctccagcacggagctgacactgttcagctgcctcaactggtagacgctcccaagaagtcagaggcagctgtcggggcggaggtgtccatgacctccccaggacagagcaaaaacttctccctcaagaacacaaacgttttaccccctattgtatgacctttgctgagggtatgtcctgctcctttccaccagtgatttgtattaagacagcacttatattgtacaatacttcagactgttttttttaaatacataaaactttatgttaaaaaactcta

SEQ ID NO: 299727 - DNA, 1379 bp, Homo sapiens
agagtcagtgtgagctgttgaaagcctgcagctaaacaccagtgttacttcactcccctttgtggacaccaaggggaagaagaatacggtaagcttcccacacattagcaagaaagtcctgctgaagtcatccctgctgtatcaggagaatcaagctcacaatcagatgccggcctcagagctcaaggcttcagaaatacctttccaccctagcattaaaacccaggatcccaaggcagaggagaagtcaccaaagaagcaaaaggtgactctgacagcggcagaggccctaaagctttttaagaaccagctgtctccatatgaacaaagtgaaatcctgggctacgcggagctgtggttcctgggtcttgaagccaagaagctcgacacggctcctgagaaatttagcaagacgagttttgatgatgagcatggcttctatctgaaggtcctgcatgatcacattgcctaccgctatgaagttctggagacaatcgggaaggggtcctttggacaggtggccaagtgcttggatcacaaaaacaatgagctggtggccctgaaaatcatcaggaacaagaagaggtttcaccagcaggccctgatggagctgaagatcctggaagctctcagaaagaaggacaaagacaacacctacaatgtggtgcatatgaaggactttttctactttcgcaatcacttctgcatcacctttgagctcctgggaatcaacttgtatgagttgatgaagaataacaactttcaaggcttcagtctgtccatagttcggcgcttcactctctctgttttgaagtgcttgcagatgctttcggtagagaaaatcattcactgtgatctcaagcccgaaaatatagtgctataccaaaagggccaagcctctgttaaagtcattgactttggatcaagctgttatgaacaccagaaagtatacacgtacatccaaagccggttctaccgatccccagaagtgatcctgggccacccctacgacgtggccattgacatgtggagcctgggctgcatcacggcggagttgtacacgggctaccccctgttccccggggagaatgaggtggagcagctggcctgcatcatggagattccaaaggttttcctaaaaatataaccaacaacagggggaaaaaaagatacccagattccaaggacctcacgatggtgctgaaaacctatgacaccagcttcctggactttctcagaaggtgtttggtgtgagtttgttgggacatctctgcttctgggtttcctcttaaatgctgtactttgacacacgtttgctggtgaaagactaaggctgggagatagttataaaagtaacaagaaatgctaacaatagagct

SEQ ID NO: 299728 - DNA, 516 bp, Homo sapiens
cgaaaagggacttgcaaaggacacagagcaagcggtttcagctgtactctgctaatgtaacagggaatagactcaaatggatgctaaaaagccaaggaaatgtgatttgactcccttcctggttttgaaagcaagaaagaaacaaaagttcacctctgcgaagaaaggggcttcctgcaagagacgggcttatcagtgagtgtcacacagtggaagaggatatccgacggtcattcattgtctcatttccatgtctcatcagcacttcctatacgaaaagcaggaacaaaacaaaatcctgatccgaccatttggtgttgggcaaaggaatggaaatcagttcaagctgaagagacagcaaacagcagagatgtgaattgctagttctgtctaggtttttaggttggcacactattatttatggtaatgcattcacctgttaaatgcaaatggaagactcgaactagaagaacttgtaatgatcattgcaagttaacattaaaacgtttaaaatat

SEQ ID NO: 299729 - DNA, 710 bp, Homo sapiens
cgaaaagggacttgcaaaggacacagagcaagcggtttcagctgtactctgctaatgtaacagggaatagactcaaatggatgctaaaaagccaaggaaatgtgatttgactcccttcctggttttgaaagcaagaaagaaacaaaagttcacctctgcgaagggccccactctttctgagatctacatggttggaagtaaactttcggttcagatccagaagccaccttccaatatcaagaactccagaatgacccaagtctttcataagaacaccagtgttacttcactcccctttgtggacaccaaggggaagaagaatacggtaagcttcccacacattagcaagaaagtcctgctgaagtcatccctgctgtatcaggagaatcaagctcacaatcagatgccggcctcagagctcaaggcttcagaaatacctttccaccctagcattaaaacccaggatcccaaggcagaggagaagtcaccaaagaagcaaaaggtgactctgacagcggcaggtccttcctgatccagctgcagatttgagcgtgaagcctcctgggcctttaatgttgcctttatgttacctgtctggccctgcagacattacagttctcaaagcctctcaagacggactaattatagcttaattccacgttaacttgggcaacttgccacctaaactatatactattgtcgacactaat

SEQ ID NO: 299730 - DNA, 500 bp, Homo sapiens
ctctctagtgcttcagcagtttgtcaaataatatggtgccccctatcctaatcctagtttcttttctctgagaatgctctagttcatcagttactgtgaattttacccctgaccacgcacgagagcgccaatgtgatctggctggtgtagggaagtcctaactcataatctcttcttgcaatctgaggtccttcctgatccagctgcagatttgagcgtgaagcctcctgggcctttaatgttgcctttatgttacctgtctggccctgcagacattacagttctcaaagcctctcaagacggactaattatagcttaattccacgttaacttgggcaacttgccacctaaactatatactattgtcgacactaatttgactcctggaatttttacctgcgctgctctaacccccaggtgtttgggaactgagctctctgttcccctgtccttgtgttcctttctcgatttgttgaaataaatacaagaccttgacattt

SEQ ID NO: 299731 - DNA, 4668 bp, Homo sapiens
  misc_feature (93)..(93): n is a, c, g, or t
  misc_feature (307)..(307): n is a, c, g, or t
gaactctgcatcccctaagagtcctctgttcctcccatgtcaggtggctctcagagtacagggaccttggcaggtggagaggaggatggggancagcagctgggcagcccccagggctcctcctccagtgagctcacatcagagcacctcacagagcaatagccgtcctcagatgctcagcaaagttgtggcagtttgcatttctagggtaaactaactaggaaggatgtcgtgaaatggactatgcaagagtaagtttgtgtgtttcgccttaatctgaggcagagacacagcagaacctgagganaaaagcaggtggaaggtgacggttagatggtaagccatgggcttgtcctggaactgcttcaactcagtggcttaaaatgagaactgcccaggtgagcatggagcatctcctaggctcgaggacatctctggagaatcatctggaaggtttatactgtgccttcccctcgtagcaaaaaggaagattgttcatggcctttaaggaaggctgagatcactcacacacagcgcccccccaccccagagaaaccgagtcagcctacatgacttccaaggggacctggggccagataagccctgccccggtgagaccaaatgagctggagcatgtatggaggtgcggaccctgcagtcagtttgcgagtgtggaggacccgagacatcctgtaaaggcaacttggtctccctcccactcacctgccaacattgctgcaatacacatggtttatctgaaattccaaggccagagtgcacatcagctcacatgactggcaactctaaatagagagccctaatggactgaggcaggaaacgtctaaaagctcaatctgctgtatgtcatgaccccttaggttgggtttatgccacatcggtcattttgaagtaggtgtttgatgccagctcagagactgtctcaggagtgcctccctggcctgggtagctaccctggaggtcatctccctgttctctgttggataaaggaacctcccccatctgtgacattcccttgggcccaggcttatgacctgcaccttttctgacacctgcccccaaagcacaggatgtgaattggtctctctccagataccccacgaggaagcaccttggacattctgcacatgataataatgcaacagagtcccccattgctgagagatactaacccgtgagaaacaagtatgctctcagctggtattgaactggtgggagaaactgcctcctacttttataatactgaattattcacaaaaaacctggtctgctctccaaaatgagagcatgttcctgggagccacatggggaccatccccagctgcctgctcctggtacctcccccatgatcatgcacagaccgtagagtcgagtcatctcgcagatccagaccatctcctctcattctcactctaaaaatgctggtggcccgcacatgacagcaactccccgaagccttccctttggaatcccatagaatgttctgcaatgattgggtccatcttgctgctcagaagaatcccgtcctgctctctagtgtggtgggatgaacttcaggcaacaaacaactggcagggttcccagttcctggagttatggagcagaaacacccaggcctagcagaattgtggctgaaacctggtgcccaaattccacaccctggaaatgtgtcaactgcccgtcagcctggattcaattctgagggctaagccacgaccttatccatgagtggcgaagacacccctgaggaaaggattgcttgcacctcacatctgtcttcttctaagattactcggagattttcaaacaacatctgagaacagaagccccctcccctactcagagaggaacgagggtggcccacctctcaagggccttggattcctgggaccaccctttgctgggaggaagaatccacaccgaatccttctgtcttcatggcctgctgtgctgaaacagaacagcaggttccatctttcacatctttttttctcccccagatgaaagacgactcaggaacggtagggctgggcagaggtgtctctccttgagagacaacaaaagcttctaagggagggagcttaaaggctgctagaaacctagcccaaccatccactcctgatctgagacagaaccttctccgccactcttcctgcaatcagtgtgaaattccagcttctttgattcccacttagcagtatgctccaatcacgttgctggcaaggcattttagagtttggagctgaggttcaaagccccctgcatttctctactggcaggccctggtgaaggaagacactttcagggaagaggctcttacagtctatggtggtagccatcttcacatccagtcaccagttgcatctagggagctgctggctataaaagggatcatccagtggagttgtaaacaagggaaccatcttgcaagatctaggaagaggaaggggagggatgtggactgggtctgatcacagcccttggccctgcttcatactttggagcttattaagatcaattttgataaccatgtaatttcttagaaccatggcaggtagtattgtgctttaaaaaccagaggctcctgaaagtcgtttacaccaggtggattgataccatggctgtagctgatgcaactaacaagtactggggccagtgatcacaatccagggttggaaacaggagtgaagcccaccagcctgcctggttgatggacagcaggctctgccttctggaggcggcttatatcccaacagcctgaggcagggctctgtggcccaggccagcagtggctgcctctcttggttctgcatggtacattttgccaaccctgaggaccagttcttggggttccaggcctcggccttcctgctccacgtgctcaagcccccacatggggctgcgacaccatctggctcctcacagggaggtccagccatgttctctgggctcccagtgagccccctgccctccagctacccccagaatccatccttcattcctccaccaagctcctgtgtgagctgcagcacccacacgggggaagccctgcactccagcagcatcttccagccttggcacagaactgatggcaaaggaagggctgggttttcagcttctgggacccgaggaagaccccacctcactcctccttccccagtacatcagactggttaggaggcatcccagaaggggcagcctcatgcccaggtttcagccctaaaggtaatgattgtcttgactctgccttggcatttcgctcggaatcacggcagacttggagtgtttcttcaaggcaggcatctgcttatgagcaaggtcaaagatttttcaaaatattgtgcattaattcattaaagctactgttaaatatttgctgtttttagattggcgtccgtgctaattctgcagttgtagcactgtatattttatctcatttctgtgccaagaaagttcatctttatgtttttctaatacacaatcttgatcatgtttccaaaataaagcttcagctccttggtcaatagaagtaagggtgtagccatccagggtctcccggctctaggcagaccggatcccgcagttcatcccatggttgttgaaatgtacctcgatcagtcatctctggtattcctcactctagccatgagccattgccatcttatgggcccgatttgggtactctgaattatgtcatggagtagacagttacttctaaatcccagcaaccaagttgcgtatccttccttatagctagtttctatagagaagtgaaaaagaaatctggcttccttaataagatagttgagcctatgacattaaggagcagcgctgctggcggaagattctagattcactggtggtttaagaggcccagggatttagttcttactggtgcgtaagtgttttcccatcctaaccggaaaaccactcacccaggcttcccccacttcccctcaaattttctcagctctgccgctggtctccatgaacggcaaggggaaccaccactcattcactgtcagtgtaggtaagacagaggatgcccttgcaaaaattgggactgaggacagtagcacacggaatggtggatcgtacatttgcacccagagctactaaacgctcagtgaccccagagaccattaatttcccggagtgaaggggatgggggtagagctaattggaatttttattatccaggactcatcctaagaagaatgttggcctctcttcatccctggcttagccgtcaggtagaacgcttactcacctgacaccgacttcttagagaagcgagtcttttttgaatggaggagcgatggtaaccccactagggggcgcccatgatcggctcccagtgcacccccttaagggtaagcaggccacatatctagagtctgatagtctgtgtgtacataaggtctagaagtctgtggaaacgccctgaaacctgtagtattatcttaactaccctcttatgttaaggtttacataataggatttttaaacaaatgtgtttaattttttaagatctcttgtattaaaattttcttttggaataagctgtggaaattttgttacaacctggttgagatcaacctctttacaatgacacaaattgtgacattttataaattagatacttcagtg

SEQ ID NO: 299732 - DNA, 3822 bp, Homo sapiens
  misc_feature (93)..(93): n is a, c, g, or t
  misc_feature (307)..(307): n is a, c, g, or t
gaactctgcatcccctaagagtcctctgttcctcccatgtcaggtggctctcagagtacagggaccttggcaggtggagaggaggatggggancagcagctgggcagcccccagggctcctcctccagtgagctcacatcagagcacctcacagagcaatagccgtcctcagatgctcagcaaagttgtggcagtttgcatttctagggtaaactaactaggaaggatgtcgtgaaatggactatgcaagagtaagtttgtgtgtttcgccttaatctgaggcagagacacagcagaacctgagganaaaagcaggtggaaggtgacggttagatggtaagccatgggcttgtcctggaactgcttcaactcagtggcttaaaatgagaactgcccaggtgagcatggagcatctcctaggctcgaggacatctctggagaatcatctggaaggtttatactgtgccttcccctcgtagcaaaaaggaagattgttcatggcctttaaggaaggctgagatcactcacacacagcgcccccccaccccagagaaaccgagtcagcctacatgacttccaaggggacctggggccagataagccctgccccggtgagaccaaatgagctggagcatgtatggaggtgcggaccctgcagtcagtttgcgagtgtggaggacccgagacatcctgtaaaggcaacttggtctccctcccactcacctgccaacattgctgcaatacacatggtttatctgaaattccaaggccagagtgcacatcagctcacatgactggcaactctaaatagagagccctaatggactgaggcaggaaacgtctaaaagctcaatctgctgtatgtcatgaccccttaggttgggtttatgccacatcggtcattttgaagtaggtgtttgatgccagctcagagactgtctcaggagtgcctccctggcctgggtagctaccctggaggtcatctccctgttctctgttggataaaggaacctcccccatctgtgacattcccttgggcccaggcttatgacctgcaccttttctgacacctgcccccaaagcacaggatgtgaattggtctctctccagataccccacgaggaagcaccttggacattctgcacatgataataatgcaacagagtcccccattgctgagagatactaacccgtgagaaacaagtatgctctcagctggtattgaactggtgggagaaactgcctcctacttttataatactgaattattcacaaaaaacctggtctgctctccaaaatgagagcatgttcctgggagccacatggggaccatccccagctgcctgctcctggtacctcccccatgatcatgcacagaccgtagagtcgagtcatctcgcagatccagaccatctcctctcattctcactctaaaaatgctggtggcccgcacatgacagcaactccccgaagccttccctttggaatcccatagaatgttctgcaatgattgggtccatcttgctgctcagaagaatcccgtcctgctctctagtgtggtgggatgaacttcaggcaacaaacaactggcagggttcccagttcctggagttatggagcagaaacacccaggcctagcagaattgtggctgaaacctggtgcccaaattccacaccctggaaatgtgtcaactgcccgtcagcctggattcaattctgagggctaagccacgaccttatccatgagtggcgaagacacccctgaggaaaggattgcttgcacctcacatctgtcttcttctaagattactcggagattttcaaacaacatctgagaacagaagccccctcccctactcagagaggaacgagggtggcccacctctcaagggccttggattcctgggaccaccctttgctgggaggaagaatccacaccgaatccttctgtcttcatggcctgctgtgctgaaacagaacagcaggttccatctttcacatctttttttctcccccagatgaaagacgactcaggaacggtagggctgggcagaggtgtctctccttgagagacaacaaaagcttctaagggagggagcttaaaggctgctagaaacctagcccaaccatccactcctgatctgagacagaaccttctccgccactcttcctgcaatcagtgtgaaattccagcttctttgattcccacttagcagtatgctccaatcacgttgctggcaaggcattttagagtttggagctgaggttcaaagccccctgcatttctctactggcaggccctggtgaaggaagacactttcagggaagaggctcttacagtctatggtggtagccatcttcacatccagtcaccagttgcatctagggagctgctggctataaaagggatcatccagtggagttgtaaacaagggaaccatcttgcaagatctaggaagaggaaggggagggatgtggactgggtctgatcacagcccttggccctgcttcatactttggagcttattaagatcaattttgataaccatgtaatttcttagaaccatggcaggtagtattgtgctttaaaaaccagaggctcctgaaagtcgtttacaccaggtggattgataccatggctgtagctgatgcaactaacaagtactggggccagtgatcacaatccagggttggaaacaggagtgaagcccaccagcctgcctggttgatggacagcaggctctgccttctggaggcggcttatatcccaacagcctgaggcagggctctgtggcccaggccagcagtggctgcctctcttggttctgcatggtacattttgccaaccctgaggaccagttcttggggttccaggcctcggccttcctgctccacgtgctcaagcccccacatggggctgcgacaccatctggctcctcacagggaggtccagccatgttctctgggctcccagtgagccccctgccctccagctacccccagaatccatccttcattcctccaccaagctcctgtgtgagctgcagcacccacacgggggaagccctgcactccagcagcatcttccagccttggcacagaactgatggcaaaggaagggctgggttttcagcttctgggacccgaggaagaccccacctcactcctccttccccagtacatcagactggttaggaggcatcccagaaggggcagcctcatgcccaggtttcagccctaaaggtaatgattgtcttgactctgccttggcatttcgctcggaatcacggcagacttggagtgtttcttcaaggcaggcatctgcttatgagcaaggtcaaagatttttcaaaatattgtgcattaattcattaaagctactgttaaatatttgctgtttttagattggcgtccgtgctaattctgcagttgtagcactgtatattttatctcatttctgtgccaagaaagttcatctttatgtttttctaatacacaatcttgatcatgtttccaaaataaagcttcagctccttggtcaatagaagtaagggtgtagccatccagggtctcccggctctaggcagaccggatcccgcagttcatcccatggttgttgaaatgtacctcgatcagtcatctctggtattcctcactctagccatgagccattgccatcttatgggcccgatttgggtactctgaattatgtcatggagtagacagttacttctaaatcccagcaaccaagttgcgtatccttccttatagctatcctcttcaacaatatactctccggacaatgaactgcttgggctgttt

SEQ ID NO: 299733 - DNA, 3670 bp, Homo sapiens
aaagagtcaaggcttagtaatattcctgaattcctgaaggagttaagaaaggaaaaggacaagcgggggtctaaacgagagcacgaaccctcagcgtatgacggctccaggctccgggggaaagtcctttagccatccatcccaaaattaagcacgctgggagctggagtcacagcagtgataaaacgaacaatgattctggttcctactgactgacaggagaggtttaagggtctctcactctccggggagcccctttccttcctggctgcggagggcggagcccgagagaggcacgcatgcgcaatgcaacgtctgccttaggcccggaacttcggtgcctgggcgcagcggtgcacccggacccggaacattctcaggcgaaagtgtctcttgcgtgcgtgggccggaggttagtgtgcggggcccgccgggcggttgaaaagtccgagagaatcaggatggaggccgtggcgacggcgacggcggcgaaggaacccgataagggctgcatagagcctggacctgggcactggggtgagctgagccggacaccagtcccatctaaaccccaggacaaagtggaagcagctgaggcaacaccagtggccctggacagtgacacctccggggctgaaaatgcagcagtgagtgctatgctgcacgctgtagccgccagccgcctgcctgtttgcagccagcagcagggtgaacccgacttgacagagcatgagaaagtggccatcctggcccagctgtaccacgagaagccactggtgttcctggagcgcttccgcacaggcctccgtgaggagcatctggcctgctttggccacgtgcgtggcgaccaccgtgcagacttctactgtgctgaggtggcccggcagggcactgcccggccccgcaccctgcgtacccgcctgcgtaaccggcgctatgctgccctgcgagagctgatccaagggggcgagtacttcagtgatgagcagatgcggttccgggcccccctgctatatgagcagtacatcgggcagtatctcacccaggaggagctcagtgcccgcaccccaacccaccagccccccaagcccgggtcccccgggagacctgcttgcccgctctccaacttgctgctccagtcctacgaggagcgggagctacagcagcgtctgctccaacagcaggaggaggaggaggcctgcttggaggaagaggaagaggaggaggacagtgacgaggaagaccagaggtcaggcaaggactcggaggcctgggttcccgactcggaggagaggctgatcctgcgagaggagttcaccagccgcatgcaccagcgcttcctagatggcaaggacggggactttgactacagcacagtagacgacaaccccgacttcgacaacctcgacatcgtggcacgggatgaggaggagaggtactttgatgaggaagaacctgaggatgcgcccagcccagagctggatggggactgatggccgccacccttcccaccgcctgccccatccccatccccaacaaggcagctgattccaggcctgctcagtgaccctttctctagggggacatcagggcagtgccccacaacccacacacaccaccatctcactgggtctagtctcatctcagacaacccccacccccactgtttctggggttccctttctcatctctcccaccctgtctcctgcctctgtctttcttggtgtctgtctgggcttctttctgtctctttctgtctttctgtctctctccctacccccgctccctctttccagtgctctggctggctgtctctccctttctccccctctctctctgccttaggctctgtctccaccgcagggcccaaggtgaaagtcctccccttgccggaggccagctggcagggcctttcgtggctggaagtggccagtttggttccggtgctgacccctaggccccagcgcagctgcctcccgtgctgtctgtctccccctctctgtttatgtctgcgctgtgtctcacactcagagcctccttgcttctgttaggttcccatctctccttctgcctcactctgggcctcttctttctacttgtacatttccacctctctaggcctctgctctcactgtccctctctgtctgtctctcagcctttatctctgggttttgatcccccactccaggctctgggccccttcttcccccttccctcaaacctggctgctataggcagcagaaccctgaccactgagtaatacagccccaggggagggaggagaccccaggcagggaggatgggggcagctctcttctctccccaggacccaggctgtggatcacggggcctgccagcttgagtgtagagggaggggggactctacccttctcagccccaccagcccccctctgcccaaccacaattttcccttcctccgccttcctctccctctcctgtttacactccccaaatgcgcacaggctgttatcatgggtcctgagtcatcccacacacagcctgccccagcgtccctgcccccagctggccgcagggcccgccccatggagccccctgccgccctgggctaatgggagccagatggccgcctggtgactcagccaccgggcctgtgggaacccaggcgtcccgccttcccatgcccccacacccggctcctgctcccccagcagacacacacaggagggcctggccactgttgagggggcacacagggcaagggtcaccaagtcggggcctagggactcctcatgcctctgagatggaatggtggtatcctgccgtggccaagcctgaaggaccctcaaaactgcctcctggagtccacggttcctgacctccgagcctcagctatgccctctgggtcaaccagaattagagccagacagggaaagtgagagctggatggaggcagacaagatgctcagagcgactattaaagaacgaaagcctctgctacggagcgcttctgtcctctgtcaggcccgagcgaagtgcctgacaccgggttggatcctcagatggccccatgaactagtgaagtgggtcaaaggaggcctggaaagatgttgcttcctcaaggccactcggccatcagaggcagaaatgaaacaggaacccaggcctagaatcacaaaggtcctagaaaccacttggctgtctggcctctcaggtgtcagggccatccagagtgagacagcattggagggacaagtgtgcatgcagatgtcctcagacgggaaggtttgagaagggtcagatggtaggcgggcctaacaagggctccgtgctagccactgtcccgcacacagacaggatcaggtcatcttgatatggagatcagtccccaaatcactgaattgtcccagcagtgctatgccctaggtactaccaatatcactcctctatttcccagaggaggaagcagcagctagactccaggaccttggggtcatatctctcagaaagccaagagtgcaggatgagagctgtctgtctcttacctgcctgtatttgtgccccatttttaaagagcagagggcctgggccacaggaaaggtatcagcccttggtgataggcacattttttaccagtctatcatttggtcattaaatttgtttacaatatactttgctatacgtaaattt

SEQ ID NO: 299734 - DNA, 3409 bp, Homo sapiens
cttctacctgcctcatgcaaacttatcccaatctaacgattccttcatttcattgtaactcccgtttcccccaaagtccgaaatccagccaggctcctttcaaagtccttactcaatttctgtgctttcccacaaccttcaaagtaatccgacgtcgggtgaggtgtgattggaagcgtggctccaacaccactggccaagaattggtaattgtggaagccagatggagatgattggtatatggaggctgcatagagcctggacctgggcactggggtgagctgagccggacaccagtcccatctaaaccccaggacaaagtggaagcagctgaggcaacaccagtggccctggacagtgacacctccggggctgaaaatgcagcagtgagtgctatgctgcacgctgtagccgccagccgcctgcctgtttgcagccagcagcagggtgaacccgacttgacagagcatgagaaagtggccatcctggcccagctgtaccacgagaagccactggtgttcctggagcgcttccgcacaggcctccgtgaggagcatctggcctgctttggccacgtgcgtggcgaccaccgtgcagacttctactgtgctgaggtggcccggcagggcactgcccggccccgcaccctgcgtacccgcctgcgtaaccggcgctatgctgccctgcgagagctgatccaagggggcgagtacttcagtgatgagcagatgcggttccgggcccccctgctatatgagcagtacatcgggcagtatctcacccaggaggagctcagtgcccgcaccccaacccaccagccccccaagcccgggtcccccgggagacctgcttgcccgctctccaacttgctgctccagtcctacgaggagcgggagctacagcagcgtctgctccaacagcaggaggaggaggaggcctgcttggaggaagaggaagaggaggaggacagtgacgaggaagaccagaggtcaggcaaggactcggaggcctgggttcccgactcggaggagaggctgatcctgcgagaggagttcaccagccgcatgcaccagcgcttcctagatggcaaggacggggactttgactacagcacagtagacgacaaccccgacttcgacaacctcgacatcgtggcacgggatgaggaggagaggtactttgatgaggaagaacctgaggatgcgcccagcccagagctggatggggactgatggccgccacccttcccaccgcctgccccatccccatccccaacaaggcagctgattccaggcctgctcagtgaccctttctctagggggacatcagggcagtgccccacaacccacacacaccaccatctcactgggtctagtctcatctcagacaacccccacccccactgtttctggggttccctttctcatctctcccaccctgtctcctgcctctgtctttcttggtgtctgtctgggcttctttctgtctctttctgtctttctgtctctctccctacccccgctccctctttccagtgctctggctggctgtctctccctttctccccctctctctctgccttaggctctgtctccaccgcagggcccaaggtgaaagtcctccccttgccggaggccagctggcagggcctttcgtggctggaagtggccagtttggttccggtgctgacccctaggccccagcgcagctgcctcccgtgctgtctgtctccccctctctgtttatgtctgcgctgtgtctcacactcagagcctccttgcttctgttaggttcccatctctccttctgcctcactctgggcctcttctttctacttgtacatttccacctctctaggcctctgctctcactgtccctctctgtctgtctctcagcctttatctctgggttttgatcccccactccaggctctgggccccttcttcccccttccctcaaacctggctgctataggcagcagaaccctgaccactgagtaatacagccccaggggagggaggagaccccaggcagggaggatgggggcagctctcttctctccccaggacccaggctgtggatcacggggcctgccagcttgagtgtagagggaggggggactctacccttctcagccccaccagcccccctctgcccaaccacaattttcccttcctccgccttcctctccctctcctgtttacactccccaaatgcgcacaggctgttatcatgggtcctgagtcatcccacacacagcctgccccagcgtccctgcccccagctggccgcagggcccgccccatggagccccctgccgccctgggctaatgggagccagatggccgcctggtgactcagccaccgggcctgtgggaacccaggcgtcccgccttcccatgcccccacacccggctcctgctcccccagcagacacacacaggagggcctggccactgttgagggggcacacagggcaagggtcaccaagtcggggcctagggactcctcatgcctctgagatggaatggtggtatcctgccgtggccaagcctgaaggaccctcaaaactgcctcctggagtccacggttcctgacctccgagcctcagctatgccctctgggtcaaccagaattagagccagacagggaaagtgagagctggatggaggcagacaagatgctcagagcgactattaaagaacgaaagcctctgctacggagcgcttctgtcctctgtcaggcccgagcgaagtgcctgacaccgggttggatcctcagatggccccatgaactagtgaagtgggtcaaaggaggcctggaaagatgttgcttcctcaaggccactcggccatcagaggcagaaatgaaacaggaacccaggcctagaatcacaaaggtcctagaaaccacttggctgtctggcctctcaggtgtcagggccatccagagtgagacagcattggagggacaagtgtgcatgcagatgtcctcagacgggaaggtttgagaagggtcagatggtaggcgggcctaacaagggctccgtgctagccactgtcccgcacacagacaggatcaggtcatcttgatatggagatcagtccccaaatcactgaattgtcccagcagtgctatgccctaggtactaccaatatcactcctctatttcccagaggaggaagcagcagctagactccaggaccttggggtcatatctctcagaaagccaagagtgcaggatgagagctgtctgtctcttacctgcctgtatttgtgccccatttttaaagagcagagggcctgggccacaggaaaggtatcagcccttggtgataggcacattttttaccagtctatcatttggtcattaaatttgtttacaatatactttgctatacgtaaattt

SEQ ID NO: 299735 - DNA, 3649 bp, Homo sapiens
aaagagtcaaggcttagtaatattcctgaattcctgaaggagttaagaaaggaaaaggacaagcgggggtctaaacgagagcacgaaccctcagcgtatgacggctccaggctccgggggaaagtcctttagccatccatcccaaaattaagcacgctgggagctggagtcacagcagtgataaaacgaacaatgattctggttcctactgactgacaggagaggtttaagggtctctcactctccggggagcccctttccttcctggctgcggagggcggagcccgagagaggcacgcatgcgcaatgcaacgtctgccttaggcccggaacttcggtgcctgggcgcagcggtgcacccggacccggaacattctcaggcgaaagtgtctcttgcgtgcgtgggccggaggttagtgtgcggggcccgccgggcggttgaaaagtccgagagaatcaggatggaggccgtggcgacggcgacggcggcgaaggaacccgataagggctgcatagagcctggacctgggcactggggtgagctgagccggacaccagtcccatctaaaccccaggacaaagtggaagcagctgaggcaacaccagtggccctggacagtgacacctccggggctgaaaatgcagcagtgagtgctatgctgcacgctgtagccgccagccgcctgcctgtttgcagccagcagcagggtgaacccgacttgacagagcatgagaaagtggccatcctggcccagctgtaccacgagaagccactggtgttcctggagcgcttccgcacaggcctccgtgaggagcatctggcctgctttggccacgtgcgtggcgaccaccgtgcagacttctactgtgctgaggtggcccggcagggcactgcccggccccgcaccctgcgtacccgcctgcgtaaccggcgctatgctgccctgcgagagctgatccaagggggcgagtacttcagtgatgagcagatgcggttccgggcccccctgctatatgagcagtacatcgggcagtatctcacccaggaggagctcagtgcccgcaccccaacccaccagccccccaagcccgggtcccccgggagacctgcttgcccgctctccaacttgctgctccagtcctacgaggagcgggagctacagcagcgtctgctccaacagcaggaggaggaggaggcctgcttggaggaagaggaagaggaggaggacagtgacgaggaagaccagaggtcaggcaaggactcggaggcctgggttcccgactcggaggagaggctgatcctgcgagaggagttcaccagccgcatgcaccagcgcttcctagatggcaaggacggggactttgactacagcacagtagacgacaaccccgacttcgacaacctcgacatcgtggcacgggatgaggaggagaggtactttgatgaggaagaacctgaggatgcgcccagcccagagctggatggggactgatggccgccacccttcccaccgcctgccccatccccatccccaacaaggcagctgattccaggcctgctcagtgaccctttctctagggggacatcagggcagtgccccacaacccacacacaccaccatctcactgggtctagtctcatctcagacaacccccacccccactgtttctggggttccctttctcatctctcccaccctgtctcctgcctctgtctttcttggtgtctgtctgggcttctttctgtctctttctgtctttctgtctctctccctacccccgctccctctttccagtgctctggctggctgtctctccctttctccccctctctctctgccttaggctctgtctccaccgcagggcccaaggtgaaagtcctccccttgccggaggccagctggcagggcctttcgtggctggaagtggccagtttggttccggtgctgacccctaggccccagcgcagctgcctcccgtgctgtctgtctccccctctctgtttatgtctgcgctgtgtctcacactcagagcctccttgcttctgttaggttcccatctctccttctgcctcactctgggcctcttctttctacttgtacatttccacctctctaggcctctgctctcactgtccctctctgtctgtctctcagcctttatctctgggttttgatcccccactccaggctctgggccccttcttcccccttccctcaaacctggctgctataggcagcagaaccctgaccactgagtaatacagccccaggggagggaggagaccccaggcagggaggatgggggcagctctcttctctccccaggacccaggctgtggatcacggggcctgccagcttgagtgtagagggaggggggactctacccttctcagccccaccagcccccctctgcccaaccacaattttcccttcctccgccttcctctccctctcctgtttacactccccaaatgcgcacaggctgttatcatgggtcctgagtcatcccacacacagcctgccccagcgtccctgcccccagctggccgcagggcccgccccatggagccccctgccgccctgggctaatgggagccagatggccgcctggtgactcagccaccgggcctgtgggaacccaggcgtcccgccttcccatgcccccacacccggctcctgctcccccagcagacacacacaggagggcctggccactgttgagggggcacacagggcaagggtcaccaagtcggggcctagggactcctcatgcctctgagatggaatggtggtatcctgccgtggccaagcctgaaggaccctcaaaactgcctcctggagtccacggttcctgacctccgagcctcagctatgccctctgggtcaaccagaattagagccagacagggaaagtgagagctggatggaggcagacaagatgctcagagcgactattaaagaacgaaagcctctgctacggagcgcttctgtcctctgtcaggcccgagcgaagtgcctgacaccgggttggatcctcagatggccccatgaactagtgaagtgggtcaaaggaggcctggaaagatgttgcttcctcaaggccactcggccatcagaggcagaaatgaaacaggaacccaggcctagaatcacaaaggtcctagaaaccacttggctgtctggcctctcaggtgtcagggccatccagagtgagacagcattggagggacaagtgtgcatgcagatgtcctcagacgggaaggtttgagaagggtcagatggtaggcgggcctaacaagggctccgtgctagccactgtcccgcacacagacaggatcaggtcatcttgatatggagatcagtccccaaatcactgaattgtcccagcagtgctatgccctaggtactaccaatatcactcctctatttcccagaggaggaagcagcagctagactccaggaccttggggtcatatctctcagaaagccaagagtgcaggatgagagctgtctgtctcttacctgcctgtatttgtgccccatttttaaagagcagagggcctgggccacaggaaaggtatcagcccttggtgataggcacattttttaccagtctatcatttggtcattaaatttgtttacaata

SEQ ID NO: 299736 - DNA, 4002 bp, Homo sapiens
  misc_feature (3976)..(3976): n is a, c, g, or t
aaagagtcaaggcttagtaatattcctgaattcctgaaggagttaagaaaggaaaaggacaagcgggggtctaaacgagagcacgaaccctcagcgtatgacggctccaggctccgggggaaagtcctttagccatccatcccaaaattaagcacgctgggagctggagtcacagcagtgataaaacgaacaatgattctggttcctactgactgacaggagaggtttaagggtctctcactctccggggagcccctttccttcctggctgcggagggcggagcccgagagaggcacgcatgcgcaatgcaacgtctgccttaggcccggaacttcggtgcctgggcgcagcggtgcacccggacccggaacattctcaggcgaaagtgtctcttgcgtgcgtgggccggaggttagtgtgcggggcccgccgggcggttgaaaagtccgagagaatcaggatggaggccgtggcgacggcgacggcggcgaaggaacccgataagggctgcatagagcctggacctgggcactggggtgagctgagccggacaccagtcccatctaaaccccaggacaaagtggaagcagctgaggcaacaccagtggccctggacagtgacacctccggggctgaaaatgcagcagtgagtgctatgctgcacgctgtagccgccagccgcctgcctgtttgcagccagcagcagggtgaacccgacttgacagagcatgagaaagtggccatcctggcccagctgtaccacgagaagccactggtgttcctggagcgcttccgcacaggcctccgtgaggagcatctggcctgctttggccacgtgcgtggcgaccaccgtgcagacttctactgtgctgaggtggcccggcagggcactgcccggccccgcaccctgcgtacccgcctgcgtaaccggcgctatgctgccctgcgagagctgatccaagggggcgagtacttcagtgatgagcagatgcggttccgggcccccctgctatatgagcagtacatcgggcagtatctcacccaggaggagctcagtgcccgcaccccaacccaccagccccccaagcccgggtcccccgggagacctgcttgcccgctctccaacttgctgctccagtcctacgaggagcgggagctacagcagcgtctgctccaacagcaggaggaggaggaggcctgcttggaggaagaggaagaggaggaggacagtgacgaggaagaccagaggtcaggcaaggactcggaggcctgggttcccgactcggaggagaggctgatcctgcgagaggagttcaccagccgcatgcaccagcgcttcctagatggcaaggacggggactttgactacagcacagtagacgacaaccccgacttcgacaacctcgacatcgtggcacgggatgaggaggagaggtactttgatgaggaagaacctgaggatgcgcccagcccagagctggatggggactgatggccgccacccttcccaccgcctgccccatccccatccccaacaaggcagctgattccaggcctgctcagtgaccctttctctagggggacatcagggcagtgccccacaacccacacacaccaccatctcactgggtctagtctcatctcagacaacccccacccccactgtttctggggttccctttctcatctctcccaccctgtctcctgcctctgtctttcttggtgtctgtctgggcttctttctgtctctttctgtctttctgtctctctccctacccccgctccctctttccagtgctctggctggctgtctctccctttctccccctctctctctgccttaggctctgtctccaccgcagggcccaaggtgaaagtcctccccttgccggaggccagctggcagggcctttcgtggctggaagtggccagtttggttccggtgctgacccctaggccccagcgcagctgcctcccgtgctgtctgtctccccctctctgtttatgtctgcgctgtgtctcacactcagagcctccttgcttctgttaggttcccatctctccttctgcctcactctgggcctcttctttctacttgtacatttccacctctctaggcctctgctctcactgtccctctctgtctgtctctcagcctttatctctgggttttgatcccccactccaggctctgggccccttcttcccccttccctcaaacctggctgctataggcagcagaaccctgaccactgagtaatacagccccaggggagggaggagaccccaggcagggaggatgggggcagctctcttctctccccaggacccaggctgtggatcacggggcctgccagcttgagtgtagagggaggggggactctacccttctcagccccaccagcccccctctgcccaaccacaattttcccttcctccgccttcctctccctctcctgtttacactccccaaatgcgcacaggctgttatcatgggtcctgagtcatcccacacacagcctgccccagcgtccctgcccccagctggccgcagggcccgccccatggagccccctgccgccctgggctaatgggagccagatggccgcctggtgactcagccaccgggcctgtgggaacccaggcgtcccgccttcccatgcccccacacccggctcctgctcccccagcagacacacacaggagggcctggccactgttgagggggcacacagggcaagggtcaccaagtcggggcctagggactcctcatgcctctgagatggaatggtggtatcctgccgtggccaagcctgaaggaccctcaaaactgcctcctggagtccacggttcctgacctccgagcctcagctatgccctctgggtcaaccagaattagagccagacagggaaagtgagagctggatggaggcagacaagatgctcagagcgactattaaagaacgaaagcctctgctacggagcgcttctgtcctctgtcaggcccgagcgaagtgcctgacaccgggttggatcctcagatggccccatgaactagtgaagtgggtcaaaggaggcctggaaagatgttgcttcctcaaggccactcggccatcagaggcagaaatgaaacaggaacccaggcctagaatcacaaaggtcctagaaaccacttggctgtctggcctctcaggtgtcagggccatccagagtgagacagcattggagggacaagtgtgcatgcagatgtcctcagacgggaaggtttgagaagggtcagatggtaggcgggcctaacaagggctccgtgctagccactgtcccgcacacagacaggatcaggtcatcttgatatggagatcagtccccaaatcactgaattgtcccagcagtgctatgccctaggtactaccaatatcactcctctatttcccagaggaggaagcagcagctagactccaggaccttggggtcatatctctcagaaagccaagagtgcaggatgagagctgtctgtctcttacctgcctgtatttgtgccccatttttaaagagcagagggcctgggccacaggaaaggtatcagcccttggtgataggcacattttttaccagtctatcatttggtcattaaatttgtttacaataaaaaaaaaaaaaaaaaaaactcgagtttttttttttttttttttttccaaatgtacaattttattttaacagatttcaagagtccattttttaaaaaatgagcactaaagaacctctatcagtgagactcctcattttatagcaaatacatttttgcagcttaaatattcttgaaacatatacgcttctgtcatttaaacaaacttccagagaaaactgggctcttatatttaagaacaaatttgacaaatacatatttatcatatatagatctctatataaaattaaatttgatcaaatgtgaacagaaactgtgtacaggatatngattattatttatacacgtttgggtg

SEQ ID NO: 299737 - DNA, 1501 bp, Homo sapiens
cctcgcagcccacacacttacggctaagtcgcacgcctgcgctgtgtactcaggccgcaggtataggcagcagaaccctgaccactgagtaatacagccccaggggagggaggagaccccaggcagggaggatgggggcagctctcttctctccccaggacccaggctgtggatcacggggcctgccagcttgagtgtagagggaggggggactctacccttctcagccccaccagcccccctctgcccaaccacaattttcccttcctccgccttcctctccctctcctgtttacactccccaaatgcgcacaggctgttatcatgggtcctgagtcatcccacacacagcctgccccagcgtccctgcccccagctggccgcagggcccgccccatggagccccctgccgccctgggctaatgggagccagatggccgcctggtgactcagccaccgggcctgtgggaacccaggcgtcccgccttcccatgcccccacacccggctcctgctcccccagcagacacacacaggagggcctggccactgttgagggggcacacagggcaagggtcaccaagtcggggcctagggactcctcatgcctctgagatggaatggtggtatcctgccgtggccaagcctgaaggaccctcaaaactgcctcctggagtccacggttcctgacctccgagcctcagctatgccctctgggtcaaccagaattagagccagacagggaaagtgagagctggatggaggcagacaagatgctcagagcgactattaaagaacgaaagcctctgctacggagcgcttctgtcctctgtcaggcccgagcgaagtgcctgacaccgggttggatcctcagatggccccatgaactagtgaagtgggtcaaaggaggcctggaaagatgttgcttcctcaaggccactcggccatcagaggcagaaatgaaacaggaacccaggcctagaatcacaaaggtcctagaaaccacttggctgtctggcctctcaggtgtcagggccatccagagtgagacagcattggagggacaagtgtgcatgcagatgtcctcagacgggaaggtttgagaagggtcagatggtaggcgggcctaacaagggctccgtgctagccactgtcccgcacacagacaggatcaggtcatcttgatatggagatcagtccccaaatcactgaattgtcccagcagtgctatgccctaggtactaccaatatcactcctctatttcccagaggaggaagcagcagctagactccaggaccttggggtcatatctctcagaaagccaagagtgcaggatgagagctgtctgtctcttacctgcctgtatttgtgccccatttttaaagagcagagggcctgggccacaggaaaggtatcagcccttggtgataggcacattttttaccagtctatcatttggtcattaaatttgtttacaatatactttgctatacgtaaattt

SEQ ID NO: 299738 - DNA, 1927 bp, Homo sapiens
aaagagtcaaggcttagtaatattcctgaattcctgaaggagttaagaaaggaaaaggacaagcgggggtctaaacgagagcacgaaccctcagcgtatgacggctccaggctccgggggaaagtcctttagccatccatcccaaaattaagcacgctgggagctggagtcacagcagtgataaaacgaacaatgattctggttcctactgactgacaggagaggtttaagggtctctcactctccggggagcccctttccttcctggctgcggagggcggagcccgagagaggcacgcatgcgcaatgcaacgtctgccttaggcccggaacttcggtgcctgggcgcagcggtgcacccggacccggaacattctcaggcgaaagtgtctcttgcgtgcgtgggccggaggttagtgtgcggggcccgccgggcggttgaaaagtccgagagaatcaggatggaggccgtggcgacggcgacggcggcgaaggaacccgataagggctgcatagagcctggacctgggcactggggtgagctgagccggacaccagtcccatctaaaccccaggacaaagtggaagcagctgaggcaacaccagtggccctggacagtgacacctccggggctgaaaatgcagcagtgagtgctatgctgcacgctgtagccgccagccgcctgcctgtttgcagccagcagcagggtgaacccgacttgacagagcatgagaaagtggccatcctggcccagctgtaccacgagaagccactggtgttcctggagcgcttccgcacaggcctccgtgaggagcatctggcctgctttggccacgtgcgtggcgaccaccgtgcagacttctactgtgctgaggtggcccggcagggcactgcccggccccgcaccctgcgtacccgcctgcgtaaccggcgctatgctgccctgcgagagctgatccaagggggcgagtacttcagtgatgagcagatgcggttccgggcccccctgctatatgagcagtacatcgggcagtatctcacccaggaggagctcagtgcccgcaccccaacccaccagccccccaagcccgggtcccccgggagacctgcttgcccgctctccaacttgctgctccagtcctacgaggagcgggagctacagcagcgtctgctccaacagcaggaggaggaggaggcctgcttggaggaagaggaagaggaggaggacagtgacgaggaagaccagaggtcaggcaaggactcggaggcctgggttcccgactcggaggagaggctgatcctgcgagaggagttcaccagccgcatgcaccagcgcttcctagatggcaaggacggggactttgactacagcacagtagacgacaaccccgacttcgacaacctcgacatcgtggcacgggatgaggaggagaggtactttgatgaggaagaacctgaggatgcgcccagcccagagctggatggggactgatggccgccacccttcccaccgcctgccccatccccatccccaacaaggcagctgattccaggcctgctcagtgaccctttctctagggggacatcagggcagtgccccacaacccacacacaccaccatctcactgggtctagtctcatctcagacaacccccacccccactgtttctggggttccctttctcatctctcccaccctgtctcctgcctctgtctttcttggtgtctgtctgggcttctttctgtctctttctgtctctcagaaagccaagagtgcaggatgagagctgtctgtctcttacctgcctgtatttgtgccccatttttaaagagcagagggcctgggccacaggaaaggtatcagcccttggtgataggcacattttttaccagtctatcatttggtcattaaatttgtttacaata

SEQ ID NO: 299739 - DNA, 1835 bp, Homo sapiens
aaagagtcaaggcttagtaatattcctgaattcctgaaggagttaagaaaggaaaaggacaagcgggggtctaaacgagagcacgaaccctcagcgtatgacggctccaggctccgggggaaagtcctttagccatccatcccaaaattaagcacgctgggagctggagtcacagcagtgataaaacgaacaatgattctggttcctactgactgacaggagaggtttaagggtctctcactctccggggagcccctttccttcctggctgcggagggcggagcccgagagaggcacgcatgcgcaatgcaacgtctgccttaggcccggaacttcggtgcctgggcgcagcggtgcacccggacccggaacattctcaggcgaaagtgtctcttgcgtgcgtgggccggaggttagtgtgcggggcccgccgggcggttgaaaagtccgagagaatcaggatggaggccgtggcgacggcgacggcggcgaaggaacccgataagggctgcatagagcctggacctgggcactggggtgagctgagccggacaccagtcccatctaaaccccaggacaaagtggaagcagctgaggcaacaccagtggccctggacagtgacacctccggggctgaaaatgcagcagtgagtgctatgctgcacgctgtagccgccagccgcctgcctgtttgcagccagcagcagggtgaacccgacttgacagagcatgagaaagtggccatcctggcccagctgtaccacgagaagccactggtgttcctggagcgcttccgcacaggcctccgtgaggagcatctggcctgctttggccacgtgcgtggcgaccaccgtgcagacttctactgtgctgaggtggcccggcagggcactgcccggccccgcaccctgcgtacccgcctgcgtaaccggcgctatgctgccctgcgagagctgatccaagggggcgagtacttcagtgatgagcagatgcggttccgggcccccctgctatatgagcagtacatcgggcagtatctcacccaggaggagctcagtgcccgcaccccaacccaccagccccccaagcccgggtcccccgggagacctgcttgcccgctctccaacttgctgctccagtcctacgaggagcgggagctacagcagcgtctgctccaacagcaggaggaggaggaggcctgcttggaggaagaggaagaggaggaggacagtgacgaggaagaccagaggtcaggcaaggactcggaggcctgggttcccgactcggaggagaggctgatcctgcgagaggagttcaccagccgcatgcaccagcgcttcctagatggcaaggacggggactttgactacagcacagtagacgacaaccccgacttcgacaacctcgacatcgtggcacgggatgaggaggagatgtcctcagacgggaaggtttgagaagggtcagatggtaggcgggcctaacaagggctccgtgctagccactgtcccgcacacagacaggatcaggtcatcttgatatggagatcagtccccaaatcactgaattgtcccagcagtgctatgccctaggtactaccaatatcactcctctatttcccagaggaggaagcagcagctagactccaggaccttggggtcatatctctcagaaagccaagagtgcaggatgagagctgtctgtctcttacctgcctgtatttgtgccccatttttaaagagcagagggcctgggccacaggaaaggtatcagcccttggtgataggcacattttttaccagtctatcatttggtcattaaatttgtttacaata

SEQ ID NO: 299740 - DNA, 1819 bp, Homo sapiens
aaagagtcaaggcttagtaatattcctgaattcctgaaggagttaagaaaggaaaaggacaagcgggggtctaaacgagagcacgaaccctcagcgtatgacggctccaggctccgggggaaagtcctttagccatccatcccaaaattaagcacgctgggagctggagtcacagcagtgataaaacgaacaatgattctggttcctactgactgacaggagaggtttaagggtctctcactctccggggagcccctttccttcctggctgcggagggcggagcccgagagaggcacgcatgcgcaatgcaacgtctgccttaggcccggaacttcggtgcctgggcgcagcggtgcacccggacccggaacattctcaggcgaaagtgtctcttgcgtgcgtgggccggaggttagtgtgcggggcccgccgggcggttgaaaagtccgagagaatcaggatggaggccgtggcgacggcgacggcggcgaaggaacccgataagggctgcatagagcctggacctgggcactggggtgagctgagccggacaccagtcccatctaaaccccaggacaaagtggaagcagctgaggcaacaccagtggccctggacagtgacacctccggggctgaaaatgcagcagtgagtgctatgctgcacgctgtagccgccagccgcctgcctgtttgcagccagcagcagggtgaacccgacttgacagagcatgagaaagtggccatcctggcccagctgtaccacgagaagccactggtgttcctggagcgcttccgcacaggcctccgtgaggagcatctggcctgctttggccacgtgcgtggcgaccaccgtgcagacttctactgtgctgaggtggcccggcagggcactgcccggccccgcaccctgcgtacccgcctgcgtaaccggcgctatgctgccctgcgagagctgatccaagggggcgagtacttcagtgatgagcagatgcggttccgggcccccctgctatatgagcagtacatcgggcagtatctcacccaggaggagctcagtgcccgcaccccaacccaccagccccccaagcccgggtcccccgggagacctgcttgcccgctctccaacttgctgctccagtcctacgaggagcgggagctacagcagcgtctgctccaacagcaggaggaggaggaggcctgcttggaggaagaggaagaggaggaggacagtgacgaggaagaccagaggtcaggcaaggactcggaggcctgggttcccgactcggaggagaggctgatcctgcgagaggagttcaccagccgcatgcaccagcgcttcctagatggcaaggacggggactttgactacaggtgctcctgtgcctccacctccccatcccccagcccagcatcccacggcctttggtcacatgcagagcccttaacaagctgtgggggtctccctttgtggagctacaaggccccaaaacagttccaggatgtggggttgaacagccaaaggaagaggctgggtgacctcggactagccttgtccatctcagaccctcagtctcctcacctctaaggcaggggatggacagggatgacatatagctcagtatcaatgaaaccctgaaacacttccctcctggcaatggcagaggctactaccccaagccccccaagtctccctaggaagcccaacctcttccgcttcaccttggacctcctcatgctgcaggaagtaacccctggcaaagttcatgcccggcatggaggggcctgcactggctgcccccacagttacagttgttcatt

SEQ ID NO: 299741 - DNA, 762 bp, Homo sapiens
ccctctggctgcaacatggagtatattgtaggagggtaccattgcctgcagtgaggcgttaaggacgcagcatggatgagagatgaggaaagctgaaatgaaacagaggcaggagaaatggagaggaggacatggccttgaggaatttccaggacataaatttggcatcacttcttggaccatgagagggagagggagcaggaagaatcaaagatgaatccaagaatgaacaaatctaatttttgaaataatgcaatgaaaagtagaactggtctgttttcctaggagaggatggtgaaatagaggtagtttgtgtgatttgcccagagtcccatgaagaattcacagaagaattgagactacagtcagtatggccacattcccagagaactgctttttctgccataccctgtgaatccttcatctcaaggacaatatctaaggaattcactggtaaaacattttatgcttggtcacaagcagctagagaaagcaaactacttccggcctggtgcggtggctcatgtctgtaatctcagcactttgggaggccgaggtggtggatcacgaggacaggagttcaagaccagcctggccaacatggtgaaaccccgtctctactaaaaatacaaaatttggtcgggaggctggggcaggagacatgcttgaacccgggaggggaggttgcaatgagctgagattgcaccacctgcctccacgcctgggtgacaaacgattctctgtcttggaagggaggaagca

SEQ ID NO: 299742 - DNA, 470 bp, Homo sapiens
ccctctggctgcaacatggagtatattgtaggagggtaccattgcctgcagtgaggcgttaaggacgcagcatggatgagagatgaggaaagctgaaatgaaacagaggcaggagaaatggagaggaggacatggccttgaggaatttccaggacataaatttggcatcacttcttggaccatgagagggagagggagcaggaagaatcaaagatgaatccaagaatgaacaaatctaatttttgaaataatgcaatgaaaagtagaactggtctgttttcctaggagaggatggtgaaatagaggtagtttgtgtgatttgcccagagtcccatgaagaattcacagaagaattgagactacagtcagtatggccacattcccagagaactgctttttctgccataccctgtggtaataatattgtcacaagacaattggacagtgtttcacatattcagtgatggaag

SEQ ID NO: 299743 - DNA, 1348 bp, Homo sapiens
ataaacttcccaaatgtctgcaaaaacataaaaagctagttatgggtttttctgtaattttcaaataatttcttacagctaactttttcctttcgagggtttgtttcctttctcattctacagcccagtggccatgggctctttgggttcactgggccattcatgggccattggattcgctgtaacacctacatgtccttctccattttctttagctgatgactggagaatatattagttttcttatgactcaccctttttttgatctcctgttctattgtcctactgtccccagtatattttagataaagcataaggaatgatatagaaaagaacaccaaaatgagaattaggattgattctgattccaacttttctagtagttgaacatgtctttggacatcagattttttttatgtgtcaaatgaggaagttaacctggtaaaatccataaacaccctttaattctcaaaatcagtcattgttttatttctttcattgttatctctaatgcatttcaaaaataattgttgtctttcctctctttcattgtctcattcttaaatatatactttttttagttttaatactcaaatagatgtctgaagtagttaacttgaaaagaaatgacatttgcactgtattttcaaggatttttcagtcttattgaagaaatgtacatgaaacaatttaaaaagactaccactgaacaacttaggaaaaacaaagttataaactatatactaaagtttctgtaaaatttgagaaaagaaaaatctgcccaaggaggcagtatggggggagtagttagtaaagtattgattgtagagggacctcagccttagagcatgagtacctatggagagagaaactgaggcaacctgatatgtcagatagggtggcagcaggagcaaggacatccatgcgggcccggtatggtggagcatggggaggcttgtgcaggggaatgtggaagatcccgttagatggatgcaatggagctggttagtgagagtctgtgttaatggacttcatcctccagactacatcaagtctaaatcctctgaaagaatttaacgtgcactacatttggtgccactcacagaattttgagcagggctgacttatctaaaattagaatgcaagtagattgaactaaatttctaagaaatcagttaggaagacgcaaaagtagaaaactatagtattctagtaacaaataatccaggactggacttgaagggaaggagtcagggtaaagaagtagtgtagaaaatgttttgaaaatcccaagattccacatgtattccagaacttgaagtataataaaaaaaaaaaattggaaaaa

SEQ ID NO: 299744 - DNA, 1293 bp, Homo sapiens
ataaacttcccaaatgtctgcaaaaacataaaaagctagttatgggtttttctgtaattttcaaataatttcttacagctaactttttcctttcgagggtttgtttcctttctcattctacagcccagtggccatgggctctttgggttcactgggccattcatgggccattggattcgctgtaacacctacatgtccttctccattttctttagctgatgactggagaatatattagttttcttatgactcaccctttttttgatctcctgttctattgtcctactgtccccagtatattttagataaagcataaggaatgatatagaaaagaacaccaaaatgagaattaggattgattctgattccaacttttctagtagttgaacatgtctttggacatcagattttttttatgtgtcaaatgaggaagttaacctggtaaaatccataaacaccctttaattctcaaaatcagtcattgttttatttctttcattgttatctctaatgcatttcaaaaataattgttgtctttcctctctttcattgtctcattcttaaatatatactttttttagttttaatactcaaatagatgtctgaagtagttaacttgaaaagaaatgacatttgcactgtattttcaaggatttttcagtcttattgaagaaatgtacatgaaacaatttaaaaagactaccactgaacaacttaggaaaaacaaagttataaactatatactaaagtttctgtaaaatttgagaaaagaaagggacctcagccttagagcatgagtacctatggagagagaaactgaggcaacctgatatgtcagatagggtggcagcaggagcaaggacatccatgcgggcccggtatggtggagcatggggaggcttgtgcaggggaatgtggaagatcccgttagatggatgcaatggagctggttagtgagagtctgtgttaatggacttcatcctccagactacatcaagtctaaatcctctgaaagaatttaacgtgcactacatttggtgccactcacagaattttgagcagggctgacttatctaaaattagaatgcaagtagattgaactaaatttctaagaaatcagttaggaagacgcaaaagtagaaaactatagtattctagtaacaaataatccaggactggacttgaagggaaggagtcagggtaaagaagtagtgtagaaaatgttttgaaaatcccaagattccacatgtattccagaacttgaagtataataaaaaaaaaaaattggaaaaa

SEQ ID NO: 299745 - DNA, 772 bp, Homo sapiens
ctctctctctctctctctctctctctctctctctctctctctctctctctctctctctctcctcgtgccgaattcggcacgaggctgcccaccctctggacattcacccagccaggtggtctcgtcacctcagaggctccgccagactcctgcccaggccaggactgaggcaagcctcaaggcacttctaggacctgcctcttctcaccaagatgaactcactggtttcttggcagctactgcttttcctctgtgccacccactttggggagccattagaaaaggtggcctctgtggggaattctagacccacaggccagcagctagaatccctgggcctcctggcccccggggagcagagcctgccgtgcaccgagaggaagccagctgctactgccaggctgagccgtcgggggacctcgctgtccccgccccccgagagctccgggagcccccagcagccgggcctgtccgccccccacagccgccagatccccgcaccccagggcgcggtgctggtgcagcgggagaaggacctgccgaactacaactggaactccttcggcctgcgcttcggcaagcgggaggcggcaccagggaaccacggcagaagcgctgggcggggctgagggcgcaggtgcggggcagtgaacttcagaccccaaaggagtcagagcatgtggggcgggggcgggggggggcaacgtagggctaagggagggggcgctggagcttccaacccgaggcaataaaagaaatgttgcgtaactca

SEQ ID NO: 299746 - DNA, 870 bp, Homo sapiens
ttcctctcaagcaaccctgagattcagaatcctggccattctctgacccaagcagtcctgccccttccaccaaattgggtctttccttttttcctaactttactgtcctcacctcctccaggaagccctccctgatgaccctcacctagcatgaattcagctttaactacactgtgtaaagagtctcaatcccatttcactgatatatttgtttagactcatccctctaccaggagcctccaaaggcaagaacttgcccctctcttggaggactgtcccttttgcactgggctctgccctcagcacccagcccagatcctgtgcctgacctagtctttgttccctctctctgtctcagcctcaaggcacttctaggacctgcctcttctcaccaagatgaactcactggtttcttggcagctactgcttttcctctgtgccacccactttggggagccattagaaaaggtggcctctgtggggaattctagacccacaggtatgtatcctctggggaaaggagtgggagggagcaagtgggttgttgcaaaatgagctttcccgtattttccatctagtcgactggtgtgagtttaacattgcatttggtggaaatctaagactggcacacatgcaactcattgagggggtcctgttaaccctgcaagtgatggatgccttgcctctgtgatggcctcagtccgcccacctaggttccagggcttattaacccttgagctctttcatggtttcctcacactgtgttctctgctctacgtcagcaacctctctgtgccgatgttgagaagaaacttcatatgcaaccttgctttatcggtgacctcagattctttgtggagaatttggaaa

SEQ ID NO: 299747 - DNA, 815 bp, Homo sapiens
  misc_feature (741)..(742): n is a, c, g, or t
  misc_feature (744)..(746): n is a, c, g, or t
  misc_feature (787)..(787): n is a, c, g, or t
atgctctctctgctgggggagaactcttgagaccgggagcccagctgcccaccctctggacattcacccagccaggtggtctcgtcacctcagaggctccgccagactcctgcccaggccaggactgaggcaagcctcaaggcacttctaggacctgcctcttctcaccaagatgaactcactggtttcttggcagctactgcttttcctctgtgccacccactttggggagccattagaaaaggtggcctctgtggggaattctagacccacaggccagcagctagaatccctgggcctcctggcccccggggagcagagcctgccgtgcaccgagaggaagccagctgctactgccaggctgagccgtcgggggacctcgctgtccccgccccccgagagctccgggagcccccagcagccgggcctgtccgccccccacagccgccagatccccgcaccccagggcgcggtgctggtgcagcgggagaaggacctgccgaactacaactggaactccttcggcctgcgcttcggcaagcgggaggcggcaccagggaaccacggcagaagcgctgggcggggctgagggcgcaggtgcggggcagtgaacttcagaccccaaaggagtcagagcatgtggggcgggggcgggggggggcaacgtagggctaagggagggggcgctggagcttccaacccgaggcaataaaagaaatgttgcgtaactcaaaaaaaaanntnnnacccccccccccccccccccccccccccccccccccggggnggggggagcggcgggggggggggggggg

SEQ ID NO: 299748 - DNA, 819 bp, Homo sapiens
  misc_feature (16)..(16): n is a, c, g, or t
  misc_feature (745)..(746): n is a, c, g, or t
  misc_feature (748)..(750): n is a, c, g, or t
  misc_feature (791)..(791): n is a, c, g, or t
cctgtcagtcgcttcntggcctgtcaactcttgagaccgggagcccagctgcccaccctctggacattcacccagccaggtggtctcgtcacctcagaggctccgccagactcctgcccaggccaggactgaggcaagcctcaaggcacttctaggacctgcctcttctcaccaagatgaactcactggtttcttggcagctactgcttttcctctgtgccacccactttggggagccattagaaaaggtggcctctgtggggaattctagacccacaggccagcagctagaatccctgggcctcctggcccccggggagcagagcctgccgtgcaccgagaggaagccagctgctactgccaggctgagccgtcgggggacctcgctgtccccgccccccgagagctccgggagcccccagcagccgggcctgtccgccccccacagccgccagatccccgcaccccagggcgcggtgctggtgcagcgggagaaggacctgccgaactacaactggaactccttcggcctgcgcttcggcaagcgggaggcggcaccagggaaccacggcagaagcgctgggcggggctgagggcgcaggtgcggggcagtgaacttcagaccccaaaggagtcagagcatgtggggcgggggcgggggggggcaacgtagggctaagggagggggcgctggagcttccaacccgaggcaataaaagaaatgttgcgtaactcaaaaaaaaanntnnnacccccccccccccccccccccccccccccccccccggggnggggggagcggcgggggggggggggggg

SEQ ID NO: 299749 - DNA, 732 bp, Homo sapiens
atgctctctctgctgggggagaactcttgagaccgggagcccagctgcccaccctctggacattcacccagccaggtggtctcgtcacctcagaggctccgccagactcctgcccaggccaggactgaggcaagcctcaaggcacttctaggacctgcctcttctcaccaagatgaactcactggtttcttggcagctactgcttttcctctgtgccacccactttggggagccattagaaaaggtggcctctgtggggaattctagacccacaggccagcagctagaatccctgggcctcctggcccccggggagcagagcctgccgtgcaccgagaggaagccagctgctactgccaggctgagccgtcgggggacctcgctgtccccgccccccgagagctccgggagcccccagcagccgggcctgtccgccccccacagccgccagatccccgcaccccagggcgcggtgctggtgcagcgggagaaggacctgccgaactacaactggaactccttcggcctgcgcttcggcaagcgggaggcggcaccagggaaccacggcagaagcgctgggcggggctgagggcgcaggtgcggggcagtgaacttcagaccccaaaggagtcagagcatgtggggcgggggcgggggggggcaacgtagggctaagggagggggcgctggagcttccaacccgaggcaataaaagaaatgttgcgtaactca

SEQ ID NO: 299750 - DNA, 1039 bp, Homo sapiens
  misc_feature (965)..(966): n is a, c, g, or t
  misc_feature (968)..(970): n is a, c, g, or t
  misc_feature (1011)..(1011): n is a, c, g, or t
ttcctctcaagcaaccctgagattcagaatcctggccattctctgacccaagcagtcctgccccttccaccaaattgggtctttccttttttcctaactttactgtcctcacctcctccaggaagccctccctgatgaccctcacctagcatgaattcagctttaactacactgtgtaaagagtctcaatcccatttcactgatatatttgtttagactcatccctctaccaggagcctccaaaggcaagaacttgcccctctcttggaggactgtcccttttgcactgggctctgccctcagcacccagcccagatcctgtgcctgacctagtctttgttccctctctctgtctcagcctcaaggcacttctaggacctgcctcttctcaccaagatgaactcactggtttcttggcagctactgcttttcctctgtgccacccactttggggagccattagaaaaggtggcctctgtggggaattctagacccacaggccagcagctagaatccctgggcctcctggcccccggggagcagagcctgccgtgcaccgagaggaagccagctgctactgccaggctgagccgtcgggggacctcgctgtccccgccccccgagagctccgggagcccccagcagccgggcctgtccgccccccacagccgccagatccccgcaccccagggcgcggtgctggtgcagcgggagaaggacctgccgaactacaactggaactccttcggcctgcgcttcggcaagcgggaggcggcaccagggaaccacggcagaagcgctgggcggggctgagggcgcaggtgcggggcagtgaacttcagaccccaaaggagtcagagcatgtggggcgggggcgggggggggcaacgtagggctaagggagggggcgctggagcttccaacccgaggcaataaaagaaatgttgcgtaactcaaaaaaaaanntnnnacccccccccccccccccccccccccccccccccccggggnggggggagcggcgggggggggggggggg

SEQ ID NO: 299751 - DNA, 1197 bp, Homo sapiens
atgctctctctgctgggggagaactcttgagaccgggagcccagctgcccaccctctggacattcacccagccaggtggtctcgtcacctcagaggctccgccagactcctgcccaggccaggactgaggcaagcctcaaggcacttctaggacctgcctcttctcaccaagatgaactcactggtttcttggcagctactgcttttcctctgtgccacccactttggggagccattagaaaaggtggcctctgtggggaattctagacccacaggccagcagctagaatccctgggcctcctggcccccggggagcagagcctgccgtgcaccgagaggaagccagctgctactgccaggctgagccgtcgggggacctcgctgtccccgccccccgagagctccgggagcccccagcagccgggcctgtccgccccccacagccgccagatccccgcaccccagggcgcggtgctggtgcagcgggagaaggacctgccgaactacaactggaactccttcggcctgcgcttcggcaagcgggaggcggcaccagggaaccacggcagaagcgctgggcggggctgagggcgcaggtgcggggcagtgaacttcagaccccaaaggagtcagagcatgtggggcgggggcgggggggggcaacgtagggctaagggagggggcgctggagcttccaacccgaggcaataaaagaaatgttgcgtaactcaaaaaaaaaaaaaaaaaaaaaaaaaaaaaaaaaaaaaaaaaaaaaaattttggggggcagctagcgagcgcgccacagaagaaaaacttttatagaagaacaccttagtggtgaggcgcgcgcgaggggccccaaaagaagaggaagaagagagaaaggaggagcacaacaagagtggactactctagaagagaacacccgggagaaagaaacacaaagggcgtagagatcccgcgcgcaaataaagaaaaaacgccgcgcgggggggggacaacaccggcgcgagcggatctagaaagagaaaacaaacgctccccaagagagagggcgcgatctatagagagggggagtatataaagaggggggggctatcaataaaaaacacggagggagcgcccacagaaggagagagagcgagcagaagaatacaaaatattaaagacgccgcgggctcggtgtggggaga

SEQ ID NO: 299752 - DNA, 693 bp, Homo sapiens
  misc_feature (599)..(599): n is a, c, g, or t
  misc_feature (603)..(603): n is a, c, g, or t
  misc_feature (613)..(614): n is a, c, g, or t
  misc_feature (617)..(617): n is a, c, g, or t
  misc_feature (668)..(668): n is a, c, g, or t
atgctctctctgctgggggagaactcttgagaccgggagcccagctgcccaccctctggacattcacccagccaggtggtctcgtcacctcagaggctccgccagactcctgcccaggccaggactgaggcaagcctcaaggcacttctaggacctgcctcttctcaccaagatgaactcactggtttcttggcagctactgcttttcctctgtgccacccactttggggagccattagaaaaggtggcctctgtggggaattctagacccacaggccagcagctagaatccctgggcctcctggcccccggggagcagagcctgccgtgcaccgagaggaagccagctgctactgccaggctgagccgtcgggggacctcgctgtccccgccccccgagagctccgggagcccccagcagccgggcctgtccgccccccacagccgccagatccccgcaccccagggcgcggtgctggtgcagcgggagaaggacctgccgaactacaactggaactccttcggcctgcgcttcggcaagcgggaggcggcaccagggaaccacggcagaagacgactagagagcaggaggctggganacangatagcaggnncantgaactatacaaacacacacaaagagagatacaagaagaaatagacgagancgggggacggggatagagagagaga

SEQ ID NO: 299753 - DNA, 642 bp, Homo sapiens
atgctctctctgctgggggagaactcttgagaccgggagcccagctgcccaccctctggacattcacccagccaggtggtctcgtcacctcagaggctccgccagactcctgcccaggccaggactgaggcaagcctcaaggcacttctaggacctgcctcttctcaccaagatgaactcactggtttcttggcagctactgcttttcctctgtgccacccactttggggagccattagaaaaggtggcctctgtggggaattctagacccacaggccagcagctagaatccctgggcctcctggcccccggggagcagagcctgccgtgcaccgagaggaagccagctgctactgccaggctgagccgtcgggggacctcgctgtccccgccccccgagagctccgggagcccccagcagccgggcctgtccgccccccacagccgccagatccccgcaccccagggcgcggtgctggtgcacgctgggcggggctgagggcgcaggtgcggggcagtgaacttcagaccccaaaggagtcagagcatgtggggcgggggcgggggggggcaacgtagggctaagggagggggcgctggagcttccaacccgaggcaataaaagaaatgttgcgtaactca

SEQ ID NO: 299754 - DNA, 599 bp, Homo sapiens
  misc_feature (16)..(16): n is a, c, g, or t
cctgtcagtcgcttcntggcctgtcaactcttgagaccgggagcccagctgcccaccctctggacattcacccagccaggtggtctcgtcacctcagaggctccgccagactcctgcccaggccaggactgaggcaagcctcaaggcacttctaggacctgcctcttctcaccaagatgaactcactggtttcttggcagctactgcttttcctctgtgccacccactttggggagccattagaaaaggtggcctctgtggggaattctagacccacaggccagcagctagaatccctgggcctcctggcccccggggagcagagcctgccgtgcaccgagaggaagccagctgctactgccaggctgagccgtcgggggacctcgctgtccccgccccccgagagctccgggagcccccacagggaaccacggcagaagcgctgggcggggctgagggcgcaggtgcggggcagtgaacttcagaccccaaaggagtcagagcatgtggggcgggggcgggggggggcaacgtagggctaagggagggggcgctggagcttccaacccgaggcaataaaagaaatgttgcgtaactca

SEQ ID NO: 299755 - DNA, 449 bp, Homo sapiens
  misc_feature (16)..(16): n is a, c, g, or t
cctgtcagtcgcttcntggcctgtcaactcttgagaccgggagcccagctgcccaccctctggacattcacccagccaggtggtctcgtcacctcagaggctccgccagactcctgcccaggccaggactgaggcaagcctcaaggcacttctaggacctgcctcttctcaccaagatgaactcactggtttcttggcagctactgcttttcctctgtgccacccactttggggagccattagaaaaggtggcctctgtggggaattctagacccacaggccagcagctagaatccctgggcctcctggcccccggggagcagagcctgccgtgcaccgagaggaagccagctgctactgccaggctgagccgtcgggggacgtagggctaagggagggggcgctggagcttccaacccgaggcaataaaagaaatgttgcgtaactca

SEQ ID NO: 299756 - DNA, 333 bp, Homo sapiens
  misc_feature (16)..(16): n is a, c, g, or t
  misc_feature (325)..(325): n is a, c, g, or t
cctgtcagtcgcttcntggcctgtcaactcttgagaccgggagcccagctgcccaccctctggacattcacccagccaggtggtctcgtcacctcagaggctccgccagactcctgcccaggccaggactgaggcaagcctcaaggcacttctaggacctgcctcttctcaccaagatgaactcactggtttcttggcagctactgcttttcctctgtgccacccactttggggagccattagaaaaggtggcctctgtggggaattctagacccacaggccagcagctagatcactggcctcctgcccccgacgaacctgcctnccggaccg

SEQ ID NO: 299757 - DNA, 650 bp, Homo sapiens
  misc_feature (16)..(16): n is a, c, g, or t
cctgtcagtcgcttcntggcctgtcaactcttgagaccgggagcccagctgcccaccctctggacattcacccagccaggtggtctcgtcacctcagaggctccgccagactcctgcccaggccaggactgaggcaagcctcaaggcacttctaggacctgcctcttctcaccaagatgaactcactggtttcttggcagctactgcttttcctctgtgccacccactttggggagccattagaaaaggtggcctctgtggggaattctagacccacaggtatgtatcctctggggaaaggagtgggagggagcaagtgggttgttgcaaaatgagctttcccgtattttccatctagtcgactggtgtgagtttaacattgcatttggtggaaatctaagactggcacacatgcaactcattgagggggtcctgttaaccctgcaagtgatggatgccttgcctctgtgatggcctcagtccgcccacctaggttccagggcttattaacccttgagctctttcatggtttcctcacactgtgttctctgctctacgtcagcaacctctctgtgccgatgttgagaagaaacttcatatgcaaccttgctttatcggtgacctcagattctttgtggagaatttggaaa

SEQ ID NO: 299758 - DNA, 807 bp, Homo sapiens
  misc_feature (733)..(734): n is a, c, g, or t
  misc_feature (736)..(738): n is a, c, g, or t
  misc_feature (779)..(779): n is a, c, g, or t
tcggacctgattgactacgcggctcgatctgactacgcggctcgatctgacacgcggctccagccaggtggtctcgtcacctcagaggctccgccagactcctgcccaggccaggactgaggcaagcctcaaggcacttctaggacctgcctcttctcaccaagatgaactcactggtttcttggcagctactgcttttcctctgtgccacccactttggggagccattagaaaaggtggcctctgtggggaattctagacccacaggccagcagctagaatccctgggcctcctggcccccggggagcagagcctgccgtgcaccgagaggaagccagctgctactgccaggctgagccgtcgggggacctcgctgtccccgccccccgagagctccgggagcccccagcagccgggcctgtccgccccccacagccgccagatccccgcaccccagggcgcggtgctggtgcagcgggagaaggacctgccgaactacaactggaactccttcggcctgcgcttcggcaagcgggaggcggcaccagggaaccacggcagaagcgctgggcggggctgagggcgcaggtgcggggcagtgaacttcagaccccaaaggagtcagagcatgtggggcgggggcgggggggggcaacgtagggctaagggagggggcgctggagcttccaacccgaggcaataaaagaaatgttgcgtaactcaaaaaaaaanntnnnacccccccccccccccccccccccccccccccccccggggnggggggagcggcgggggggggggggggg

SEQ ID NO: 299759 - DNA, 529 bp, Homo sapiens
atttggtaatatggcaaattttctagtgacagaggtttggaatactttttcctattttcttaaggaatgacagtgttttcagttttgaaacagactaacccaaggaagagagattcttgtgctaagcacataccagctacctacttctcaaacccattcctaaatttgaatactttcagtgaggctgggctctcctaggcccatttcagggcaataccaggagcaggagaagccaccatagggaatactgagaccacaataattatgtgttcacaaggcagtgaaactggcgacttataactaatttattggcaaccactttctaaataaaatatccaagtacctgtcaacagaaattagttaacaggaagctaaccactgagtctgtagattgaacagtgtattttacaaagagtgtgttaacctaagttatgttaacttaaaaacaaatcttgagaattgaggaagaataagggataaactgggataaactgggatctttctttttttttttttttttgagatggag

SEQ ID NO: 299760 - DNA, 582 bp, Homo sapiens
atttggtaatatggcaaattttctagtgacagaggtttggaatactttttcctattttcttaaggaatgacagtgttttcagttttgaaacagactaacccaaggaagagagattcttgtgctaagcacataccagctacctacttctcaaacccattcctaaatttgaatactttcagtgaggctgggctctcctaggtggtacctggacaatgttctataacctgagtattggggagccacggcttttggcccatttcagggcaataccaggagcaggagaagccaccatagggaatactgagaccacaataattatgtgttcacaaggcagtgaaactggcgacttataactaatttattggcaaccactttctaaataaaatatccaagtacctgtcaacagaaattagttaacaggaagctaaccactgagtctgtagattgaacagtgtattttacaaagagtgtgttaacctaagttatgttaacttaaaaacaaatcttgagaattgaggaagaataagggataaactgggataaactgggatctttctttttttttttttttttgagatggag

SEQ ID NO: 299761 - DNA, 390 bp, Homo sapiens
agtttaccagaaactgggactttctcatttcctgagaggtttttgagatttggtaatatggcaaattttctagtgacagaggtttggaatactttttcctattttcttaaggaatgacagtgttttcagttttgaaacagactaacccaaggaagagagattcttgtgctaagcacataccagctacctacttctcaaacccattcctaaatttgaatactttcagtgaggctgggctctcctaggtggtacctggacaatgttctataacctgagtattggggagccacggcttttggcccatttcagggcaataccaggagcaggagaagccaccatagggaatactgagaccacaataattatgtgttcacaaggcagtgaaactgg

SEQ ID NO: 299762 - DNA, 4547 bp, Homo sapiens
cgagctcggtaccccatcctgtgcggccctccgatgggctggatgaccaaagcattgtaacagggctggaagccaaggaagacctctatcttgaaccccaagttggccatgaccccgccggccctgctgcctcgcctgtcctggcagatggactgtccgtgtcccaggcccctgccattattgcccgtctccaagaacactgtaaagctgttggagtcccctgttccagcagcacaagtattaagtacagtgccattgggctgtgtccccagggtcgtcttcgtcggggcccttagctagctctcccagatgtgtcatcccatttctgagcagaaaaccagttcttcctccccattgtcctctccttctaagtctcccatcctctcatccagtgcctcaagctccaccctttccagtgcaaaaaccttcatgagccttgtgaagtccctgtcgaccgaggtggagccaaaagaatccccacaccccgcaaggcacaggcacttgatgaagacattagtcaagtctctgtccacggacacttcccggcaggagtcggatacagtgtcctataagccacctgattccaaactgaacttacacctgttcaagcagttcacacagccccgaaacacaggtggagattccaaaactgcaccttcttccccactgacttctccctctgatactcgttccttttttaaagtgcccgaaatggaggctaaaattgaagatactaaacgacgcctttcagaagtcatctatgagccttttcagctccttagtaaaattataggggaagaaagtggcagccataggcccaaagccttatcttcaagtgcttcagaactctccaatctgtccagcttgaatgggcacttggaaagcaataacaactacagcatcaaggaggaggagtgtgattctgagggggatggctacggaagtgattccaacatccccagaagtgaccacccaaagtccactggtgagcccacaagagagatagaactgaaaagttcccaggggagcagtctgaaggatttaggcctgaagacaagttctctagttctggagaaatgttctttgtctgccttagtgagcaaagaagatgaagagttttgtgaactgtacactgaggacttcgatttggaaacggagggggagagtaaagttgataagctctcagatattcctctcaagccagaggtgctcgcggaagatggtgtggtccttgacagtgaggacgaggtggactcggccgtgcagcacccggaattgccagtgaagacgttgggcttctttataatgtgtgtctatgtgtacctcatcctccccctcccccactatgtgagtggactctttctgggaattggccttggattcatgactgcagtttgcgtgatttggttttttacaccaccaagtgctcataaatatcacaagttacacaaaaatctgcgacactggaacacaagatctctggatatcaaagaacctgaaatactgaagggatggatgaatgagatttacaactatgatccagaaacctaccatgcgactttgacacattcagtctttgttcgacttgagggtggaaccttaagactttcaaagcccaataaaaatatatccaggagggccagctacaatgaacccaagccagaggtcacctacatcagccagaaaatctatgacctctcagacagcaagatttatcttgtacctaaaactttggctcgaaagcgaatctggaataaaaagtaccccatttgtatcgagcttggtcagcaagatgactttatgtctaaagctcagactgataaggagacttcagaagagaagccgccagctgagggaagtgaggaccctaagaagccaccccgccctcaggagggaacaagatctagccagcgagatcagatactctatctctttgggagaactggccgagaaaaagaggaatggtttaggagatttattctggcatctaagctaaagtcggaaatcaagaagtcatcgggtgtctctggaggtaaaccagggcttttgcctgcacacagcagacacaacagtccgtccgggcacctgacccacagccgcagcagcagcaaaggcagtgtggaggagatcatgtcacagccaaagcagaaggagctggcaggcagcgtgcggcagaagatgcttctcgactacagcgtgtacatgggcaggtgtgtcccccaggaaagccgaagcccccagaggagccccctgcagagtgcggagagcagccccacagctgggaagaagttgccagaggttccaccctctgaggaggaagaacaggaagcctgggtgaatgccttgcttggaagaatattttgggacttcttaggagagaaatactggtctgatctggtgtctaagaagatccaaatgaaactcagcaaaataaagctcccctactttatgaatgagctcactctgacggaacttgacatgggcgtggctgtgccaaaaatcctccaggccttcaagccttacgttgatcaccaaggactctggattgatttggaaatgtcctacaatgggtcctttctgatgactctcgagaccaaaatgaatttgaccaaactaggtaaagagcctcttgttgaagccctgaaggttggagaaattggcaaagaaggttgcaggccccgggcattctgtctggcggacagcgatgaggaatcctccagcgctggctcctccgaggaagacgatgccccagagcccagcgggggagacaaacagctcctcccaggggctgaagggtacgttggaggtcatcgaacaagtaagattatgaggtttgttgataaaattaccaagtcaaaatatttccaaaaagcaacagagacagagtttattaaaaagaagatcgaagaagtctccaacacacccctgctgctcactgttgaagtacaagaatgtagaggaaccttggcggtcaacattccaccacccccgactgaccgagtatggtatggtttccgaaagccaccacatgtggagctgaaagctcggccaaaacttggagagagagaagtgactttagttcatgtgacagactggatagagaagaaactggagcaagagtttcagaaagtttttgtcatgccaaacatggatgatgtttatatcactataatgcactcagccatggaccctcgctctacttcctgcctcctgaaagacccacctgtggaggctgctgatcagccatgatgggtgatgtcagatgttccccatattgtgacatcgagctggatgtgtggggttcttggccgccatctgtactgtagcactggcctctgtgccacagctactgtttcttaaaggactgcttctgccctctgcctgccagtgcccattccactgtgaggtgtcattccctgcatctagtgacaactgtctggattgcctgctgcaaagctttgatttggcaaaggagaccatggaagaatcatggtggatccagaagttatacgtgacccacaccatggcttttaaaagtctacccatgtttgtggcagcaaatgagcacagtaagagcaaagctgaacaacttgcctcctctactcctccaaagcttttcttcaggcagccggtgcacagtggactttttcacttctatactttgtatgcggccttccacacttccagagaatgtcagtgtgcaatgtgtctggagggtggggagaggaattctgtgagccttttcatttcggtgacagaagagatgggcagagcaacttattttccacattaaattgtgcatttgggaagcaagtagccatagtacacacacaacacgctatcagcttgggtaaggacagtgggatttatgtgaacatcaggcaaagccatgagatcaaaccatcccaagcctttcaccaatgaggtacaaccacctgggggctagctaatcttgaatgttttcctgagacaggagcgtatgtgaaaacatcaaacactgcacatgacaggatgggtcctctcatacagatgggatggggttagaaagccagagccagtttttccatctggcgtttcctgtgtcctccaggtttatatgggaatcgaaacagtttgttaatctgattgggagagttccatgggcagatttcccttcctgaaggccaaaacggagaactgctctctttaattatttcaagagtcaagaccaaaagtttgctcagcatcacactacatctcaaaattaatgttgccaacttaattttgtgcatttgtgtcagaatgtttagtttacaaggttgggggctctctttgcttcgagaagtaaacctaataccatttttttattgtttaaagctgcattcaacgtcaaaattaccttgggtaacttttgataacttacatgtgtggacaaagctaatagtggttttttaaacagcaccttgcctgaacatgactttaaagaaattaatatattgaaaacatgtttgaacccttattttaattgcaccattaaaacatttgacttaaattgtttgaccattcca

SEQ ID NO: 299763 - DNA, 5243 bp, Homo sapiens
cggggcggcgtgtgcccgggggcgggcgggcggcagggcagcaggaccgcggccggtgccccagccgaagccggagtcgcgcggccgggagcacgggcgccggcatagtacaatgaggcagccagcggatcttggagcctgagcccttgtgaagccggcaatgacaagtctgtatggtcgccatgccgagaaaaccactgacatgccaaaaccatcagcccctaaagtgcacgtgcagaggtccgtgtcccgagataccatcgccattcacttctcggcatccggcgaggaggaggaggaagaggaggaggagttcagggagtactttgaggaggggctggatgaccaaagcattgtaacagggctggaagccaaggaagacctctatcttgaaccccaagttggccatgaccccgccggccctgctgcctcgcctgtcctggcagatggactgtccgtgtcccaggcccctgccattattgcccgtctccaagaacactgtaaagctgttggagtcccctgttccagcagcacaagtattaagtacagtgccattgggctgtgtccccagggtcgtcttcgtcggggcccttagctagctctcccagatgtgtcatcccatttctgagcagaaaaccagttcttcctccccattgtcctctccttctaagtctcccatcctctcatccagtgcctcaagctccaccctttccagtgcaaaaaccttcatgagccttgtgaagtccctgtcgaccgaggtggagccaaaagaatccccacaccccgcaaggcacaggcacttgatgaagacattagtcaagtctctgtccacggacacttcccggcaggagtcggatacagtgtcctataagccacctgattccaaactgaacttacacctgttcaagcagttcacacagccccgaaacacaggtggagattccaaaactgcaccttcttccccactgacttctccctctgatactcgttccttttttaaagtgcccgaaatggaggctaaaattgaagatactaaacgacgcctttcagaagtcatctatgagccttttcagctccttagtaaaattataggggaagaaagtggcagccataggcccaaagccttatcttcaagtgcttcagaactctccaatctgtccagcttgaatgggcacttggaaagcaataacaactacagcatcaaggaggaggagtgtgattctgagggggatggctacggaagtgattccaacatccccagaagtgaccacccaaagtccactggtgagcccacaagagagatagaactgaaaagttcccaggggagcagtctgaaggatttaggcctgaagacaagttctctagttctggagaaatgttctttgtctgccttagtgagcaaagaagatgaagagttttgtgaactgtacactgaggacttcgatttggaaacggagggggagagtaaagttgataagctctcagatattcctctcaagccagaggtgctcgcggaagatggtgtggtccttgacagtgaggacgaggtggactcggccgtgcagcacccggaattgccagtgaagacgttgggcttctttataatgtgtgtctatgtgtacctcatcctccccctcccccactatgtgagtggactctttctgggaattggccttggattcatgactgcagtttgcgtgatttggttttttacaccaccaagtgctcataaatatcacaagttacacaaaaatctgcgacactggaacacaagatctctggatatcaaagaacctgaaatactgaagggatggatgaatgagatttacaactatgatccagaaacctaccatgcgactttgacacattcagtctttgttcgacttgagggtggaaccttaagactttcaaagcccaataaaaatatatccaggagggccagctacaatgaacccaagccagaggtcacctacatcagccagaaaatctatgacctctcagacagcaagatttatcttgtacctaaaactttggctcgaaagcgaatctggaataaaaagtaccccatttgtatcgagcttggtcagcaagatgactttatgtctaaagctcagactgataaggagacttcagaagagaagccgccagctgagggaagtgaggaccctaagaagccaccccgccctcaggagggaacaagatctagccagcgagatcagatactctatctctttgggagaactggccgagaaaaagaggaatggtttaggagatttattctggcatctaagctaaagtcggaaatcaagaagtcatcgggtgtctctggaggtaaaccagggcttttgcctgcacacagcagacacaacagtccgtccgggcacctgacccacagccgcagcagcagcaaaggcagtgtggaggagatcatgtcacagccaaagcagaaggagctggcaggcagcgtgcggcagaagatgcttctcgactacagcgtgtacatgggcaggtgtgtcccccaggaaagccgaagcccccagaggagccccctgcagagtgcggagagcagccccacagctgggaagaagttgccagaggttccaccctctgaggaggaagaacaggaagcctgggtgaatgccttgcttggaagaatattttgggacttcttaggagagaaatactggtctgatctggtgtctaagaagatccaaatgaaactcagcaaaataaagctcccctactttatgaatgagctcactctgacggaacttgacatgggcgtggctgtgccaaaaatcctccaggccttcaagccttacgttgatcaccaaggactctggattgatttggaaatgtcctacaatgggtcctttctgatgactctcgagaccaaaatgaatttgaccaaactaggtaaagagcctcttgttgaagccctgaaggttggagaaattggcaaagaaggttgcaggccccgggcattctgtctggcggacagcgatgaggaatcctccagcgctggctcctccgaggaagacgatgccccagagcccagcgggggagacaaacagctcctcccaggggctgaagggtacgttggaggtcatcgaacaagtaagattatgaggtttgttgataaaattaccaagtcaaaatatttccaaaaagcaacagagacagagtttattaaaaagaagatcgaagaagtctccaacacacccctgctgctcactgttgaagtacaagaatgtagaggaaccttggcggtcaacattccaccacccccgactgaccgagtatggtatggtttccgaaagccaccacatgtggagctgaaagctcggccaaaacttggagagagagaagtgactttagttcatgtgacagactggatagagaagaaactggagcaagagtttcagaaagtttttgtcatgccaaacatggatgatgtttatatcactataatgcactcagccatggaccctcgctctacttcctgcctcctgaaagacccacctgtggaggctgctgatcagccatgatgggtgatgtcagatgttccccatattgtgacatcgagctggatgtgtggggttcttggccgccatctgtactgtagcactggcctctgtgccacagctactgtttcttaaaggactgcttctgccctctgcctgccagtgcccattccactgtgaggtgtcattccctgcatctagtgacaactgtctggattgcctgctgcaaagctttgatttggcaaaggagaccatggaagaatcatggtggatccagaagttatacgtgacccacaccatggcttttaaaagtctacccatgtttgtggcagcaaatgagcacagtaagagcaaagctgaacaacttgcctcctctactcctccaaagcttttcttcaggcagccggtgcacagtggactttttcacttctatactttgtatgcggccttccacacttccagagaatgtcagtgtgcaatgtgtctggagggtggggagaggaattctgtgagccttttcatttcggtgacagaagagatgggcagagcaacttattttccacattaaattgtgcatttgggaagcaagtagccatagtacacacacaacacgctatcagcttgggtaaggacagtgggatttatgtgaacatcaggcaaagccatgagatcaaaccatcccaagcctttcaccaatgaggtacaaccacctgggggctagctaatcttgaatgttttcctgagacaggagcgtatgtgaaaacatcaaacactgcacatgacaggatgggtcctctcatacagatgggatggggttagaaagccagagccagtttttccatctggcgtttcctgtgtcctccaggtttatatgggaatcgaaacagtttgttaatctgattgggagagttccatgggcagatttcccttcctgaaggccaaaacggagaactgctctctttaattatttcaagagtcaagaccaaaagtttgctcagcatcacactacatctcaaaattaatgttgccaacttaattttgtgcatttgtgtcagaatgtttagtttacaaggttgggggctctctttgcttcgagaagtaaacctaataccatttttttattgtttaaagctgcattcaacgtcaaaattaccttgggtaacttttgataacttacatgtgtggacaaagctaatagtggttttttaaacagcaccttgcctgaacatgactttaaagaaattaatatattgaaaacatgtttgaacccttattttaattgcaccattaaaacatttgacttaaattgtttgaccattccagttggtgtactgttctgatttttcgttgtgtaggccgatctgcctgtcagagtccacgtgtcctggtcactggtctttataattgttgtgcaataactaaaggctaaggactagatgcactatcgtgtaaagagattacacatgactgtaccatgttgcacttaatcaaatagtatgtggggatttaaaatcgcttgcattgtttcacaaaataaatatctcaatgtcaaatactagataagcatctaagtcatttctacggaatcctgttcagataggggcacaataaaatgagtacagagcaccggggccctcacctggcaatcgcagctttcatttactgcgttgatcactgcccagtcctaaggctacaaagccatcctcactacatccttca

SEQ ID NO: 299764 - DNA, 5565 bp, Homo sapiens
cggggcggcgtgtgcccgggggcgggcgggcggcagggcagcaggaccgcggccggtgccccagccgaagccggagtcgcgcggccgggagcacgggcgccggcatagtacaatgaggcagccagcggatcttggagcctgagcccttgtgaagccggcaatgacaagtctgtatggtcgccatgccgagaaaaccactgacatgccaaaaccatcagcccctaaagtgcacgtgcagaggtccgtgtcccgagataccatcgccattcacttctcggcatccggcgaggaggaggaggaagaggaggaggagttcagggagtactttgaggaggggctggatgaccaaagcattgtaacagggctggaagccaaggaagacctctatcttgaaccccaagttggccatgaccccgccggccctgctgcctcgcctgtcctggcagatggactgtccgtgtcccaggcccctgccattattgcccgtctccaagaacactgtaaagctgttggagtcccctgttccagcagcacaagtattaagtacagtgccattgggctgtgtccccagggtcgtcttcgtcggggcccttagctagctctcccagatgtgtcatcccatttctgagcagaaaaccagttcttcctccccattgtcctctccttctaagtctcccatcctctcatccagtgcctcaagctccaccctttccagtgcaaaaaccttcatgagccttgtgaagtccctgtcgaccgaggtggagccaaaagaatccccacaccccgcaaggcacaggcacttgatgaagacattagtcaagtctctgtccacggacacttcccggcaggagtcggatacagtgtcctataagccacctgattccaaactgaacttacacctgttcaagcagttcacacagccccgaaacacaggtggagattccaaaactgcaccttcttccccactgacttctccctctgatactcgttccttttttaaagtgcccgaaatggaggctaaaattgaagatactaaacgacgcctttcagaagtcatctatgagccttttcagctccttagtaaaattataggggaagaaagtggcagccataggcccaaagccttatcttcaagtgcttcagaactctccaatctgtccagcttgaatgggcacttggaaagcaataacaactacagcatcaaggaggaggagtgtgattctgagggggatggctacggaagtgattccaacatccccagaagtgaccacccaaagtccactggtgagcccacaagagagatagaactgaaaagttcccaggggagcagtctgaaggatttaggcctgaagacaagttctctagttctggagaaatgttctttgtctgccttagtgagcaaagaagatgaagagttttgtgaactgtacactgaggacttcgatttggaaacggagggggagagtaaagttgataagctctcagatattcctctcaagccagaggtgctcgcggaagatggtgtggtccttgacagtgaggacgaggtggactcggccgtgcagcacccggaattgccagtgaagacgttgggcttctttataatgtgtgtctatgtgtacctcatcctccccctcccccactatgtgagtggactctttctgggaattggccttggattcatgactgcagtttgcgtgatttggttttttacaccaccaagtgctcataaatatcacaagttacacaaaaatctgcgacactggaacacaagatctctggatatcaaagaacctgaaatactgaagggatggatgaatgagatttacaactatgatccagaaacctaccatgcgactttgacacattcagtctttgttcgacttgagggtggaaccttaagactttcaaagcccaataaaaatatatccaggagggccagctacaatgaacccaagccagaggtcacctacatcagccagaaaatctatgacctctcagacagcaagatttatcttgtacctaaaactttggctcgaaagcgaatctggaataaaaagtaccccatttgtatcgagcttggtcagcaagatgactttatgtctaaagctcagactgataaggagacttcagaagagaagccgccagctgagggaagtgaggaccctaagaagccaccccgccctcaggagggaacaagatctagccagcgagatcagatactctatctctttgggagaactggccgagaaaaagaggaatggtttaggagatttattctggcatctaagctaaagtcggaaatcaagaagtcatcgggtgtctctggaggtaaaccagggcttttgcctgcacacagcagacacaacagtccgtccgggcacctgacccacagccgcagcagcagcaaaggcagtgtggaggagatcatgtcacagccaaagcagaaggagctggcaggcagcgtgcggcagaagatgcttctcgactacagcgtgtacatgggcaggtgtgtcccccaggaaagccgaagcccccagaggagccccctgcagagtgcggagagcagccccacagctgggaagaagttgccagaggttccaccctctgaggaggaagaacaggaagcctgggtgaatgccttgcttggaagaatattttgggacttcttaggagagaaatactggtctgatctggtgtctaagaagatccaaatgaaactcagcaaaataaagctcccctactttatgaatgagctcactctgacggaacttgacatgggcgtggctgtgccaaaaatcctccaggccttcaagccttacgttgatcaccaaggactctggattgatttggaaatgtcctacaatgggtcctttctgatgactctcgagaccaaaatgaatttgaccaaactaggtaaagagcctcttgttgaagccctgaaggttggagaaattggcaaagaaggttgcaggccccgggcattctgtctggcggacagcgatgaggaatcctccagcgctggctcctccgaggaagacgatgccccagagcccagcgggggagacaaacagctcctcccaggggctgaagggtacgttggaggtcatcgaacaagtaagattatgaggtttgttgataaaattaccaagtcaaaatatttccaaaaagcaacagagacagagtttattaaaaagaagatcgaagaagtctccaacacacccctgctgctcactgttgaagtacaagaatgtagaggaaccttggcggtcaacattccaccacccccgactgaccgagtatggtatggtttccgaaagccaccacatgtggagctgaaagctcggccaaaacttggagagagagaagtgactttagttcatgtgacagactggatagagaagaaactggagcaagagtttcagaaagtttttgtcatgccaaacatggatgatgtttatatcactataatgcactcagccatggaccctcgctctacttcctgcctcctgaaagacccacctgtggaggctgctgatcagccatgatgggtgatgtcagatgttccccatattgtgacatcgagctggatgtgtggggttcttggccgccatctgtactgtagcactggcctctgtgccacagctactgtttcttaaaggactgcttctgccctctgcctgccagtgcccattccactgtgaggtgtcattccctgcatctagtgacaactgtctggattgcctgctgcaaagctttgatttggcaaaggagaccatggaagaatcatggtggatccagaagttatacgtgacccacaccatggcttttaaaagtctacccatgtttgtggcagcaaatgagcacagtaagagcaaagctgaacaacttgcctcctctactcctccaaagcttttcttcaggcagccggtgcacagtggactttttcacttctatactttgtatgcggccttccacacttccagagaatgtcagtgtgcaatgtgtctggagggtggggagaggaattctgtgagccttttcatttcggtgacagaagagatgggcagagcaacttattttccacattaaattgtgcatttgggaagcaagtagccatagtacacacacaacacgctatcagcttgggtaaggacagtgggatttatgtgaacatcaggcaaagccatgagatcaaaccatcccaagcctttcaccaatgaggtacaaccacctgggggctagctaatcttgaatgttttcctgagacaggagcgtatgtgaaaacatcaaacactgcacatgacaggatgggtcctctcatacagatgggatggggttagaaagccagagccagtttttccatctggcgtttcctgtgtcctccaggtttatatgggaatcgaaacagtttgttaatctgattgggagagttccatgggcagatttcccttcctgaaggccaaaacggagaactgctctctttaattatttcaagagtcaagaccaaaagtttgctcagcatcacactacatctcaaaattaatgttgccaacttaattttgtgcatttgtgtcagaatgtttagtttacaaggttgggggctctctttgcttcgagaagtaaacctaataccatttttttattgtttaaagctgcattcaacgtcaaaattaccttgggtaacttttgataacttacatgtgtggacaaagctaatagtggttttttaaacagcaccttgcctgaacatgactttaaagaaattaatatattgaaaacatgtttgaacccttattttaattgcaccattaaaacatttgacttaaattgtttgaccattccagttggtgtactgttctgatttttcgttgtgtaggccgatctgcctgtcagagtccacgtgtcctggtcactggtctttataattgttgtgcaataactaaaggctaaggactagatgcactatcgtgtaaagagattacacatgactgtaccatgttgcacttaatcaaatagtatgtggggatttaaaatcgcttgcattgtttcacaaaataaatatctcaatgtcaaataaaaaaaaaaaaaaaaaaaaacaaaaaaaaaaaaagaaaaaaaaaaaaaaaaaaaaaaaaaaaaaaaagaaaaaaaaaaaaaaaaaaaaacaaaacaaaacacaaaaaaaaaaacaaaaaaaagagaggaggggggggcgggccaaaaaaaatttaccccgcgggggggccccccctagccccacccccccttttgtgctgacagagagcggtcgcccccaaagtagagggatctgatcataaaagaagggacgaccacgacgtcacgcttcaaacaaaccatggtggtcgaagaaacacacaagatagtcgggtcgattatcgtatcgaagaaacccacccactcgcggtgaggcaatacaatgtgaagagacccaccccccagaacaagacgagccggcggaagaaaaaaaacaagggacggtgatcaattcaaccaccacgaatccgcgcggaagagggagccgagagtataaataaaacgcgc

SEQ ID NO: 299765 - DNA, 5186 bp, Homo sapiens
cggggcggcgtgtgcccgggggcgggcgggcggcagggcagcaggaccgcggccggtgccccagccgaagccggagtcgcgcggccgggagcacgggcgccggcatagtacaatgaggcagccagcggatcttggagcctgagcccttgtgaagccggcaatgacaagtctgtatggtcgccatgccgagaaaaccactgacatgccaaaaccatcagcccctaaagtgcacgtgcagaggtccgtgtcccgagataccatcgccattcacttctcggcatccggcgaggaggaggaggaagaggaggaggagttcagggagtactttgaggaggggctggatgaccaaagcattgtaacagggctggaagccaaggaagacctctatcttgaaccccaagttggccatgaccccgccggccctgctgcctcgcctgtcctggcagatggactgtccgtgtcccaggcccctgccattattgcccgtctccaagaacactgtaaagctgttggagtcccctgttccagcagcacaagtattaagtacagtgccattgggctgtgtccccagggtcgtcttcgtcggggcccttagctagctctcccagatgtgtcatcccatttctgagcagaaaaccagttcttcctccccattgtcctctccttctaagtctcccatcctctcatccagtgcctcaagctccaccctttccagtgcaaaaaccttcatgagccttgtgaagtccctgtcgaccgaggtggagccaaaagaatccccacaccccgcaaggcacaggcacttgatgaagacattagtcaagtctctgtccacggacacttcccggcaggagtcggatacagtgtcctataagccacctgattccaaactgaacttacacctgttcaagcagttcacacagccccgaaacacaggtggagattccaaaactgcaccttcttccccactgacttctccctctgatactcgttccttttttaaagtgcccgaaatggaggctaaaattgaagatactaaacgacgcctttcagaagtcatctatgagccttttcagctccttagtaaaattataggggaagaaagtggcagccataggcccaaagccttatcttcaagtgcttcagaactctccaatctgtccagcttgaatgggcacttggaaagcaataacaactacagcatcaaggaggaggagtgtgattctgagggggatggctacggaagtgattccaacatccccagaagtgaccacccaaagtccactggtgagcccacaagagagatagaactgaaaagttcccaggggagcagtctgaaggatttaggcctgaagacaagttctctagttctggagaaatgttctttgtctgccttagtgagcaaagaagatgaagagttttgtgaactgtacactgaggacttcgatttggaaacggagggggagagtaaagttgataagctctcagatattcctctcaagccagaggtgctcgcggaagatggtgtggtccttgacagtgaggacgaggtggactcggccgtgcagcacccggaattgccagtgaagacgttgggcttctttataatgtgtgtctatgtgtacctcatcctccccctcccccactatgtgagtggactctttctgggaattggccttggattcatgactgcagtttgcgtgatttggttttttacaccaccaagtgctcataaatatcacaagttacacaaaaatctgcgacactggaacacaagatctctggatatcaaagaacctgaaatactgaagggatggatgaatgagatttacaactatgatccagaaacctaccatgcgactttgacacattcagtctttgttcgacttgagggtggaaccttaagactttcaaagcccaataaaaatatatccaggagggccagctacaatgaacccaagccagaggtcacctacatcagccagaaaatctatgacctctcagacagcaagatttatcttgtacctaaaactttggctcgaaagcgaatctggaataaaaagtaccccatttgtatcgagcttggtcagcaagatgactttatgtctaaagctcagactgataaggagacttcagaagagaagccgccagctgagggaagtgaggaccctaagaagccaccccgccctcaggagggaacaagatctagccagcgagatcagatactctatctctttgggagaactggccgagaaaaagaggaatggtttaggagatttattctggcatctaagctaaagtcggaaatcaagaagtcatcgggtgtctctggaggtaaaccagggcttttgcctgcacacagcagacacaacagtccgtccgggcacctgacccacagccgcagcagcagcaaaggcagtgtggaggagatcatgtcacagccaaagcagaaggagctggcaggcagcgtgcggcagaagatgcttctcgactacagcgtgtacatgggcaggtgtgtcccccaggaaagccgaagcccccagaggagccccctgcagagtgcggagagcagccccacagctgggaagaagttgccagaggttccaccctctgaggaggaagaacaggaagcctgggtgaatgccttgcttggaagaatattttgggacttcttaggagagaaatactggtctgatctggtgtctaagaagatccaaatgaaactcagcaaaataaagctcccctactttatgaatgagctcactctgacggaacttgacatgggcgtggctgtgccaaaaatcctccaggccttcaagccttacgttgatcaccaaggactctggattgatttggaaatgtcctacaatgggtcctttctgatgactctcgagaccaaaatgaatttgaccaaactaggtaaagagcctcttgttgaagccctgaaggttggagaaattggcaaagaaggttgcaggccccgggcattctgtctggcggacagcgatgaggaatcctccagcgctggctcctccgaggaagacgatgccccagagcccagcgggggagacaaacagctcctcccaggggctgaagggtacgttggaggtcatcgaacaagtaagattatgaggtttgttgataaaattaccaagtcaaaatatttccaaaaagcaacagagacagagtttattaaaaagaagatcgaagaagtctccaacacacccctgctgctcactgttgaagtacaagaatgtagaggaaccttggcggtcaacattccaccacccccgactgaccgagtatggtatggtttccgaaagccaccacatgtggagctgaaagctcggccaaaacttggagagagagaaaaagtttttgtcatgccaaacatggatgatgtttatatcactataatgcactcagccatggaccctcgctctacttcctgcctcctgaaagacccacctgtggaggctgctgatcagccatgatgggtgatgtcagatgttccccatattgtgacatcgagctggatgtgtggggttcttggccgccatctgtactgtagcactggcctctgtgccacagctactgtttcttaaaggactgcttctgccctctgcctgccagtgcccattccactgtgaggtgtcattccctgcatctagtgacaactgtctggattgcctgctgcaaagctttgatttggcaaaggagaccatggaagaatcatggtggatccagaagttatacgtgacccacaccatggcttttaaaagtctacccatgtttgtggcagcaaatgagcacagtaagagcaaagctgaacaacttgcctcctctactcctccaaagcttttcttcaggcagccggtgcacagtggactttttcacttctatactttgtatgcggccttccacacttccagagaatgtcagtgtgcaatgtgtctggagggtggggagaggaattctgtgagccttttcatttcggtgacagaagagatgggcagagcaacttattttccacattaaattgtgcatttgggaagcaagtagccatagtacacacacaacacgctatcagcttgggtaaggacagtgggatttatgtgaacatcaggcaaagccatgagatcaaaccatcccaagcctttcaccaatgaggtacaaccacctgggggctagctaatcttgaatgttttcctgagacaggagcgtatgtgaaaacatcaaacactgcacatgacaggatgggtcctctcatacagatgggatggggttagaaagccagagccagtttttccatctggcgtttcctgtgtcctccaggtttatatgggaatcgaaacagtttgttaatctgattgggagagttccatgggcagatttcccttcctgaaggccaaaacggagaactgctctctttaattatttcaagagtcaagaccaaaagtttgctcagcatcacactacatctcaaaattaatgttgccaacttaattttgtgcatttgtgtcagaatgtttagtttacaaggttgggggctctctttgcttcgagaagtaaacctaataccatttttttattgtttaaagctgcattcaacgtcaaaattaccttgggtaacttttgataacttacatgtgtggacaaagctaatagtggttttttaaacagcaccttgcctgaacatgactttaaagaaattaatatattgaaaacatgtttgaacccttattttaattgcaccattaaaacatttgacttaaattgtttgaccattccagttggtgtactgttctgatttttcgttgtgtaggccgatctgcctgtcagagtccacgtgtcctggtcactggtctttataattgttgtgcaataactaaaggctaaggactagatgcactatcgtgtaaagagattacacatgactgtaccatgttgcacttaatcaaatagtatgtggggatttaaaatcgcttgcattgtttcacaaaataaatatctcaatgtcaaatactagataagcatctaagtcatttctacggaatcctgttcagataggggcacaataaaatgagtacagagcaccggggccctcacctggcaatcgcagctttcatttactgcgttgatcactgcccagtcctaaggctacaaagccatcctcactacatccttca

SEQ ID NO: 299766 - DNA, 5190 bp, Homo sapiens
cggggcggcgtgtgcccgggggcgggcgggcggcagggcagcaggaccgcggccggtgccccagccgaagccggagtcgcgcggccgggagcacgggcgccggcatagtacaatgaggcagccagcggatcttggagcctgagcccttgtgaagccggcaatgacaagtctgtatggtcgccatgccgagaaaaccactgacatgccaaaaccatcagcccctaaagtgcacgtgcagaggtccgtgtcccgagataccatcgccattcacttctcggcatccggcgaggaggaggaggaagaggaggaggagttcagggagtactttgaggaggggctggatgaccaaagcattgtaacagggctggaagccaaggaagacctctatcttgaaccccaagttggccatgaccccgccggccctgctgcctcgcctgtcctggcagatggactgtccgtgtcccaggcccctgccattattgcccgtctccaagaacactgtaaagctgttggagtcccctgttccagcagcacaagtattaagtacagtgccattgggctgtgtccccagggtcgtcttcgtcggggcccttagctagctctcccagatgtgtcatcccatttctgagcagaaaaccagttcttcctccccattgtcctctccttctaagtctcccatcctctcatccagtgcctcaagctccaccctttccagtgcaaaaaccttcatgagccttgtgaagtccctgtcgaccgaggtggagccaaaagaatccccacaccccgcaaggcacaggcacttgatgaagacattagtcaagtctctgtccacggacacttcccggcaggagtcggatacagtgtcctataagccacctgattccaaactgaacttacacctgttcaagcagttcacacagccccgaaacacaggtggagattccaaaactgcaccttcttccccactgacttctccctctgatactcgttccttttttaaagtgcccgaaatggaggctaaaattgaagatactaaacgacgcctttcagaagtcatctatgagccttttcagctccttagtaaaattataggggaagaaagtggcagccataggcccaaagccttatcttcaagtgcttcagaactctccaatctgtccagcttgaatgggcacttggaaagcaataacaactacagcatcaaggaggaggagtgtgattctgagggggatggctacggaagtgattccaacatccccagaagtgaccacccaaagtccactggtgagcccacaagagagatagaactgaaaagttcccaggggagcagtctgaaggatttaggcctgaagacaagttctctagttctggagaaatgttctttgtctgccttagtgagcaaagaagatgaagagttttgtgaactgtacactgaggacttcgatttggaaacggagggggagagtaaagttgataagctctcagatattcctctcaagccagaggtgctcgcggaagatggtgtggtccttgacagtgaggacgaggtggactcggccgtgcagcacccggaattgccagtgaagacgttgggcttctttataatgtgtgtctatgtgtacctcatcctccccctcccccactatgtgagtggactctttctgggaattggccttggattcatgactgcagtttgcgtgatttggttttttacaccaccaagtgctcataaatatcacaagttacacaaaaatctgcgacactggaacacaagatctctggatatcaaagaacctgaaatactgaagggatggatgaatgagatttacaactatgatccagaaacctaccatgcgactttgacacattcagtctttgttcgacttgagggtggaaccttaagactttcaaagcccaataaaaatatatccaggagggccagctacaatgaacccaagccagaggtcacctacatcagccagaaaatctatgacctctcagacagcaagatttatcttgtacctaaaactttggctcgaaagcgaatctggaataaaaagtaccccatttgtatcgagcttggtcagcaagatgactttatgtctaaagctcagactgataaggagacttcagaagagaagccgccagctgagggaagtgaggaccctaagaagccaccccgccctcaggagggaacaagatctagccagcgagatcagatactctatctctttgggagaactggccgagaaaaagaggaatggtttaggagatttattctggcatctaagctaaagtcggaaatcaagaagtcatcgggtgtctctggaggtaaaccagggcttttgcctgcacacagcagacacaacagtccgtccgggcacctgacccacagccgcagcagcagcaaaggcagtgtggaggagatcatgtcacagccaaagcagaaggagctggcaggcagcgtgcggcagaagatgcttctcgactacagcgtgtacatgggcaggtgtgtcccccaggaaagccgaagcccccagaggagccccctgcagagtgcggagagcagccccacagctgggaagaagttgccagaggttccaccctctgaggaggaagaacaggaagcctgggtgaatgccttgcttggaagaatattttgggacttcttaggagagaaatactggtctgatctggtgtctaagaagatccaaatgaaactcagcaaaataaagctcccctactttatgaatgagctcactctgacggaacttgacatgggcgtggctgtgccaaaaatcctccaggccttcaagccttacgttgatcaccaaggactctggattgatttggaaatgtcctacaatgggtcctttctgatgactctcgagaccaaaatgaatttgaccaaactaggtaaagagcctcttgttgaagccctgaaggttggagaaattggcaaagaaggttgcaggccccgggcattctgtctggcggacagcgatgaggaatcctccagcgctggctcctccgaggaagacgatgccccagagcccagcgggggagacaaacagctcctcccaggggctgaagggtacgttggaggtcatcgaacaagtaagattatgaggtttgttgataaaattaccaagtcaaaatatttccaaaaagcaacagagacagagtttattaaaaagaagatcgaagaagtctccaacacacccctgctgctcactgttgaagtacaagaatgtagaggaaccttggcggtcaacattccaccacccccgactgaccgagtatggtatggtttccgaaagccaccacatgtggagctgaaagctcggccaaaacttggagagagagaagtgactttagttcatgtgacagactggatagagaagaaactggagcaagagtttcagaaagtttttgtcatgccaaacatggatgatgtttatatcactataatgcactcagccatggaccctcgctctacttcctgcctcctgaaagacccacctgtggaggctgctgatcagccatgatgggtgatgtcagatgttccccatattgtgacatcgagctggatgtgtggggttcttggccgccatctgtactgtagcactggcctctgtgccacagctactgtttcttaaaggactgcttctgccctctgcctgccagtgcccattccactgtgaggtgtcattccctgcatctagtgacaactgtctggattgcctgctgcaaagctttgatttggcaaaggagaccatggaagaatcatggtggatccagaagttatacgtgacccacaccatggcttttaaaagtctacccatgtttgtggcagcaaatgagcacagtaagagcaaagctgaacaacttgcctcctctactcctccaaagcttttcttcaggcagccggtgcacagtggactttttcacttctatactttgtatgcggccttccacacttccagagaatgtcagtgtgcaatgtgtctggagggtggggagaggaattctgtgagccttttcatttcggtgacagaagagatgggcagagcaacttattttccacattaaattgtgcatttgggaagcaagtagccatagtacacacacaacacgctatcagcttgggtaaggacagtgggatttatgtgaacatcaggcaaagccatgagatcaaaccatcccaagcctttcaccaatgaggtacaaccacctgggggctagctaatcttgaatgttttcctgagacaggagcgtatgtggggttagaaagccagagccagtttttccatctggcgtttcctgtgtcctccaggtttatatgggaatcgaaacagtttgttaatctgattgggagagttccatgggcagatttcccttcctgaaggccaaaacggagaactgctctctttaattatttcaagagtcaagaccaaaagtttgctcagcatcacactacatctcaaaattaatgttgccaacttaattttgtgcatttgtgtcagaatgtttagtttacaaggttgggggctctctttgcttcgagaagtaaacctaataccatttttttattgtttaaagctgcattcaacgtcaaaattaccttgggtaacttttgataacttacatgtgtggacaaagctaatagtggttttttaaacagcaccttgcctgaacatgactttaaagaaattaatatattgaaaacatgtttgaacccttattttaattgcaccattaaaacatttgacttaaattgtttgaccattccagttggtgtactgttctgatttttcgttgtgtaggccgatctgcctgtcagagtccacgtgtcctggtcactggtctttataattgttgtgcaataactaaaggctaaggactagatgcactatcgtgtaaagagattacacatgactgtaccatgttgcacttaatcaaatagtatgtggggatttaaaatcgcttgcattgtttcacaaaataaatatctcaatgtcaaatactagataagcatctaagtcatttctacggaatcctgttcagataggggcacaataaaatgagtacagagcaccggggccctcacctggcaatcgcagctttcatttactgcgttgatcactgcccagtcctaaggctacaaagccatcctcactacatccttca

SEQ ID NO: 299767 - DNA, 5227 bp, Homo sapiens
cggggcggcgtgtgcccgggggcgggcgggcggcagggcagcaggaccgcggccggtgccccagccgaagccggagtcgcgcggccgggagcacgggcgccggcatagtacaatgaggcagccagcggatcttggagcctgagcccttgtgaagccggcaatgacaagtctgtatggtcgccatgccgagaaaaccactgacatgccaaaaccatcagcccctaaagtgcacgtgcagaggtccgtgtcccgagataccatcgccattcacttctcggcatccggcgaggaggaggaggaagaggaggaggagttcagggagtactttgaggaggggctggatgaccaaagcattgtaacagggctggaagccaaggaagacctctatcttgaaccccaagttggccatgaccccgccggccctgctgcctcgcctgtcctggcagatggactgtccgtgtcccaggcccctgccattattgcccgtctccaagaacactgtaaagctgttggagtcccctgttccagcagcacaagtattaagtacagtgccattgggctgtgtccccagggtcgtcttcgtcggggcccttagctagctctcccagatgtgtcatcccatttctgagcagaaaaccagttcttcctccccattgtcctctccttctaagtctcccatcctctcatccagtgcctcaagctccaccctttccagtgcaaaaaccttcatgagccttgtgaagtccctgtcgaccgaggtggagccaaaagaatccccacaccccgcaaggcacaggcacttgatgaagacattagtcaagtctctgtccacggacacttcccggcaggagtcggatacagtgtcctataagccacctgattccaaactgaacttacacctgttcaagcagttcacacagccccgaaacacaggtggagattccaaaactgcaccttcttccccactgacttctccctctgatactcgttccttttttaaagtgcccgaaatggaggctaaaattgaagatactaaacgacgcctttcagaagtcatctatgagccttttcagctccttagtaaaattataggggaagaaagtggcagccataggcccaaagccttatcttcaagtgcttcagaactctccaatctgtccagcttgaatgggcacttggaaagcaataacaactacagcatcaaggaggaggagtgtgattctgagggggatggctacggaagtgattccaacatccccagaagtgaccacccaaagtccactggtgagcccacaagagagatagaactgaaaagttcccaggggagcagtctgaaggatttaggcctgaagacaagttctctagttctggagaaatgttctttgtctgccttagtgagcaaagaagatgaagagttttgtgaactgtacactgaggacttcgatttggaaacggagggggagagtaaagttgataagctctcagatattcctctcaagccagaggtgctcgcggaagatggtgtggtccttgacagtgaggacgaggtggactcggccgtgcagcacccggaattgccagtgaagacgttgggcttctttataatgtgtgtctatgtgtacctcatcctccccctcccccactatgtgagtggactctttctgggaattggccttggattcatgactgcagtttgcgtgatttggttttttacaccaccaagtgctcataaatatcacaagttacacaaaaatctgcgacactggaacacaagatctctggatatcaaagaacctgaaatactgaagggatggatgaatgagatttacaactatgatccagaaacctaccatgcgactttgacacattcagtctttgttcgacttgagggtggaaccttaagactttcaaagcccaataaaaatatatccaggagggccagctacaatgaacccaagccagaggtcacctacatcagccagaaaatctatgacctctcagacagcaagatttatcttgtacctaaaactttggctcgaaagcgaatctggaataaaaagtaccccatttgtatcgagcttggtcagcaagatgactttatgtctaaagctcagactgataaggagacttcagaagagaagccgccagctgagggaagtgaggaccctaagaagccaccccgccctcaggagggaacaagatctagccagcgagatcagatactctatctctttgggagaactggccgagaaaaagaggaatggtttaggagatttattctggcatctaagctaaagtcggaaatcaagaagtcatcgggtgtctctggaggtaaaccagggcttttgcctgcacacagcagacacaacagtccgtccgggcacctgacccacagccgcagcagcagcaaaggcagtgtggaggagatcatgtcacagccaaagcagaaggagctggcaggcagcgtgcggcagaagatgcttctcgactacagcgtgtacatgggcaggtgtgtcccccaggaaagccgaagcccccagaggagccccctgcagagtgcggagagcagccccacagctgggaagaagttgccagaggttccaccctctgaggaggaagaacaggaagcctgggtgaatgccttgcttggaagaatattttgggacttcttaggagagaaatactggtctgatctggtgtctaagaagatccaaatgaaactcagcaaaataaagctcccctactttatgaatgagctcactctgacggaacttgacatgggcgtggctgtgccaaaaatcctccaggccttcaagccttacgttgatcaccaaggactctggattgatttggaaatgtcctacaatgggtcctttctgatgactctcgagaccaaaatgaatttgaccaaactaggtaaagagcctcttgttgaagccctgaaggttggagaaattggcaaagaaggttgcaggccccgggcattctgtctggcggacagcgatgaggaatcctccagcgctggctcctccgaggaagacgatgccccagagcccagcgggggagacaaacagctcctcccaggggctgaagggtacgttggaggtcatcgaacaagtaagattatgaggtttgttgataaaattaccaagtcaaaatatttccaaaaagcaacagagacagagtttattaaaaagaagatcgaagaagtctccaacacacccctgctgctcactgttgaagtacaagaatgtagaggaaccttggcggtcaacattccaccacccccgactgaccgagtatggtatggtttccgaaagccaccacatgtggagctgaaagctcggccaaaacttggagagagagaagtgactttagttcatgtgacagactggatagagaagaaactggagcaagagtttcagaaagtttttgtcatgccaaacatggatgatgtttatatcactataatgcactcagccatggaccctcgctctacttcctgcctcctgaaagacccacctgtggaggctgctgatcagccatgatgggtgatgtcagatgttccccatattgtgacatcgagctggatgtgtggggttcttggccgccatctgtactgtagcactggcctctgtgccacagctactgtttcttaaaggactgcttctgccctctgcctgccagtgcccattccactgtgaggtgtcattccctgcatctagtgacaactgtctggattgcctgctgcaaagctttgatttggcaaaggagaccatggaagaatcatggtggatccagaagttatacgtgacccacaccatggcttttaaaagtctacccatgtttgtggcagcaaatgagcacagtaagagcaaagctgaacaacttgcctcctctactcctccaaagcttttcttcaggcagccggtgcacagtggactttttcacttctatactttgtatgcggccttccacacttccagagaatgtcagtgtgcaatgtgtctggagggtggggagaggaattctgtgagccttttcatttcggtgacagaagagatgggcagagcaacttattttccacattaaattgtgcatttgggaagcaagtagccatagtacacacacaacacgctatcagcttgggtaaggacagtgggatttatgtgaacatcaggcaaagccatgagatcaaaccatcccaagcctttcaccaatgaggtacaaccacctgggggctagctaatcttgaatgttttcctgagacaggagcgtatgtgaaaacatcaaacactgcacatgacaggatgggtcctctcatacagatgggatggggttagaaagccagagccagtttttccatctggcgtttcctgtgtcctccaggtttatatgggaatcgaaacagtttgttaatctgattgggagagttccatgggcagatttcccttcctgaaggccaaaacggagaactgctctctttaattatttcaagagtcaagaccaaaagtttgctcagcatcacactacatctcaaaattaatgttgccaacttaattttgtgcatttgtgtcagaatgtttagtttacaaggttgggggctctctttgcttcgagaagtaaacctaataccatttttttattgtttaaagctgcattcaacgtcaaaattaccttgggtaacttttgataacttacatgtgtggacaaagctaatagtggttttttaaacagcaccttgcctgaacatgactttaaagaaattaatatattgaaaacatgtttgaacccttattttaattgcaccattaaaacatttgacttaaattgtttgaccattccagttggtgtactgttctgatttttcgttgtgtaggccgatctgcctgtcagagtccacgtgtcctggtcactggtctttataattgttgtgcaataactaaaggctaaggactagatgcactatcgtgtaaagagacatgttgcacttaatcaaatagtatgtggggatttaaaatcgcttgcattgtttcacaaaataaatatctcaatgtcaaatactagataagcatctaagtcatttctacggaatcctgttcagataggggcacaataaaatgagtacagagcaccggggccctcacctggcaatcgcagctttcatttactgcgttgatcactgcccagtcctaaggctacaaagccatcctcactacatccttca

SEQ ID NO: 299768 - DNA, 4799 bp, Homo sapiens
cggggcggcgtgtgcccgggggcgggcgggcggcagggcagcaggaccgcggccggtgccccagccgaagccggagtcgcgcggccgggagcacgggcgccggcatagtacaatgaggcagccagcggatcttggagcctgagcccttgtgaagccggcaatgacaagtctgtatggtcgccatgccgagaaaaccactgacatgccaaaaccatcagcccctaaagtgcacgtgcagaggtccgtgtcccgagataccatcgccattcacttctcggcatccggcgaggaggaggaggaagaggaggaggagttcagggagtactttgaggaggggctggatgaccaaagcattgtaacagggctggaagccaaggaagacctctatcttgaaccccaagttggccatgaccccgccggccctgctgcctcgcctgtcctggcagatggactgtccgtgtcccaggcccctgccattattgcccgtctccaagaacactgtaaagctgttggagtcccctgttccagcagcacaagtattaagtacagtgccattgggctgtgtccccagggtcgtcttcgtcggggcccttagctagctctcccagatgtgtcatcccatttctgagcagaaaaccagttcttcctccccattgtcctctccttctaagtctcccatcctctcatccagtgcctcaagctccaccctttccagtgcaaaaaccttcatgagccttgtgaagtccctgtcgaccgaggtggagccaaaagaatccccacaccccgcaaggcacaggcacttgatgaagacattagtcaagtctctgtccacggacacttcccggcaggagtcggatacagtgtcctataagccacctgattccaaactgaacttacacctgttcaagcagttcacacagccccgaaacacaggtggagattccaaaactgcaccttcttccccactgacttctccctctgatactcgttccttttttaaagtgcccgaaatggaggctaaaattgaagatactaaacgacgcctttcagaagtcatctatgagccttttcagctccttagtaaaattataggggaagaaagtggcagccataggcccaaagccttatcttcaagtgcttcagaactctccaatctgtccagcttgaatgggcacttggaaagcaataacaactacagcatcaaggaggaggagtgtgattctgagggggatggctacggaagtgattccaacatccccagaagtgaccacccaaagtccactggtgagcccacaagagagatagaactgaaaagttcccaggggagcagtctgaaggatttaggcctgaagacaagttctctagttctggagaaatgttctttgtctgccttagtgagcaaagaagatgaagagttttgtgaactgtacactgaggacttcgatttggaaacggagggggagagtaaagttgataagctctcagatattcctctcaagccagaggtgctcgcggaagatggtgtggtccttgacagtgaggacgaggtggactcggccgtgcagcacccggaattgccagtgaagacgttgggcttctttataatgtgtgtctatgtgtacctcatcctccccctcccccactatgtgagtggactctttctgggaattggccttggattcatgactgcagtttgcgtgatttggttttttacaccaccaagtgctcataaatatcacaagttacacaaaaatctgcgacactggaacacaagatctctggatatcaaagaacctgaaatactgaagggatggatgaatgagatttacaactatgatccagaaacctaccatgcgactttgacacattcagtctttgttcgacttgagggtggaaccttaagactttcaaagcccaataaaaatatatccaggagggccagctacaatgaacccaagccagaggtcacctacatcagccagaaaatctatgacctctcagacagcaagatttatcttgtacctaaaactttggctcgaaagcgaatctggaataaaaagtaccccatttgtatcgagcttggtcagcaagatgactttatgtctaaagctcagactgataaggagacttcagaagagaagccgccagctgagggaagtgaggaccctaagaagccaccccgccctcaggagggaacaagatctagccagcgagatcagatactctatctctttgggagaactggccgagaaaaagaggaatggtttaggagatttattctggcatctaagctaaagtcggaaatcaagaagtcatcgggtgtctctggaggtaaaccagggcttttgcctgcacacagcagacacaacagtccgtccgggcacctgacccacagccgcagcagcagcaaaggcagtgtggaggagatcatgtcacagccaaagcagaaggagctggcaggcagcgtgcggcagaagatgcttctcgactacagcgtgtacatgggcaggtgtgtcccccaggaaagccgaagcccccagaggagccccctgcagagtgcggagagcagccccacagctgggaagaagttgccagaggttccaccctctgaggaggaagaacaggaagcctgggtgaatgccttgcttggaagaatattttgggacttcttaggagagaaatactggtctgatctggtgtctaagaagatccaaatgaaactcagcaaaataaagctcccctactttatgaatgagctcactctgacggaacttgacatgggcgtggctgtgccaaaaatcctccaggccttcaagccttacgttgatcaccaaggactctggattgatttggaaatgtcctacaatgggtcctttctgatgactctcgagaccaaaatgaatttgaccaaactaggtaaagagcctcttgttgaagccctgaaggttggagaaattggcaaagaaggttgcaggccccgggcattctgtctggcggacagcgatgaggaatcctccagcgctggctcctccgaggaagacgatgccccagagcccagcgggggagacaaacagctcctcccaggggctgaagggtacgttggaggtcatcgaacaagtaagattatgaggtttgttgataaaattaccaagtcaaaatatttccaaaaagcaacagagacagagtttattaaaaagaagatcgaagaagtctccaacacacccctgctgctcactgttgaagtacaagaatgtagaggaaccttggcggtcaacattccaccacccccgactgaccgagtatggtatggtttccgaaagccaccacatgtggagctgaaagctcggccaaaacttggagagagagaagtgactttagttcatgtgacagactggatagagaagaaactggagcaagagtttcagaaagtttttgtcatgccaaacatggatgatgtttatatcactataatgcactcagccatggaccctcgctctacttcctgcctcctgaaagacccacctgtggaggctgctgatcagccatgatgggtgatgtcagatgttccccatattgtgacatcgagctggatgtgtggggttcttggccgccatctgtactgtagcactggcctctgtgccacagctactgtttcttaaaggactgcttctgccctctgcctgccagtgcccattccactgtgaggtgtcattccctgcatctagtgacaactgtctggattgcctgctgcaaagctttgatttggcaaaggagaccatggaagaatcatggtggatccagaagttatacgtgacccacaccatggcttttaaaagtctacccatgtttgtggcagcaaatgagcacagtaagagcaaagctgaacaacttgcctcctctactcctccaaagcttttcttcaggcagccggtgcacagtggactttttcacttctatactttgtatgcggccttccacacttccagagaatgtcagtgtgcaatgtgtctggagggtggggagaggaattctgtgagccttttcatttcggtgacagaagagatgggcagagcaacttattttccacattaaattgtgcatttgggaagcaagtagccatagtacacacacaacacgctatcagcttgggtaaggacagtgggatttatgtgaacatcaggcaaagccatgagatcaaaccatcccaagcctttcaccaatgaggtacaaccacctgggggctagctaatcttgaatgttttcctgagacaggagcgtatgtgaaaacatcaaacactgcacatgacaggatgggtcctctcatacagatgggatggggttagaaagccagagccagtttttccatctggcgtttcctgtgtcctccaggtttatatgggaatcgaaacagtttgttaatctgattgggagagttccatgggcagatttcccttcctgaaggccaaaacggagaactgctctctttaattatttcaagagtcaagaccaaaagtttgctcagcatcacactacatctcaaaattaatgttgccaacttaattttgtgcatttgtgtcagaatgtttagtttacaaggttgggggctctctttgcttcgagaagtaaacctaataccatttttttattgtttaaagctgcattcaacgtcaaaattaccttgggtaacttttgataacttacatgtgtggtgcttcggcgtgtgcagtggagactcggcgtggcaacaacttcgtccactgagatttcttcaagaagtgtctggagtctcggcgtgtgca

SEQ ID NO: 299769 - DNA, 1165 bp, Homo sapiens
gagatcaaaccatcccaagcctttcaccaatgaggtacaaccacctggggctagctaatctatcagcttgggtaaggacagtgggatttatgtgaacatcaggcaaagccatgagatcaaaccatcccaagcctttcaccaatgaggtacaaccacctgggggctagctaatcttgaatgttttcctgagacaggagcgtatgtgaaaacatcaaacactgcacatgacaggatgggtcctctcatacagatgggatggggttagaaagccagagccagtttttccatctggcgtttcctgtgtcctccaggtttatatgggaatcgaaacagtttgttaatctgattgggagagttccatgggcagatttcccttcctgaaggccaaaacggagaactgctctctttaattatttcaagagtcaagaccaaaagtttgctcagcatcacactacatctcaaaattaatgttgccaacttaattttgtgcatttgtgtcagaatgtttagtttacaaggttgggggctctctttgcttcgagaagtaaacctaataccatttttttattgtttaaagctgcattcaacgtcaaaattaccttgggtaacttttgataacttacatgtgtggacaaagctaatagtggttttttaaacagcaccttgcctgaacatgactttaaagaaattaatatattgaaaacatgtttgaacccttattttaattgcaccattaaaacatttgacttaaattgtttgaccattccagttggtgtactgttctgatttttcgttgtgtaggccgatctgcctgtcagagtccacgtgtcctggtcactggtctttataattgttgtgcaataactaaaggctaaggactagatgcactatcgtgtaaagagattacacatgactgtaccatgttgcacttaatcaaatagtatgtggggatttaaaatcgcttgcattgtttcacaaaataaatatctcaatgtcaaatactagataagcatctaagtcatttctacggaatcctgttcagataggggcacaataaaatgagtacagagcaccggggccctcacctggcaatcgcagctttcatttactgcgttgatcactgcccagtcctaaggctacaaagccatcctcactacatccttca

SEQ ID NO: 299770 - DNA, 3421 bp, Homo sapiens
  misc_feature (3262)..(3262): n is a, c, g, or t
cggggcggcgtgtgcccgggggcgggcgggcggcagggcagcaggaccgcggccggtgccccagccgaagccggagtcgcgcggccgggagcacgggcgccggcatagtacaatgaggcagccagcggatcttggagcctgagcccttgtgaagccggcaatgacaagtctgtatggtcgccatgccgagaaaaccactgacatgccaaaaccatcagcccctaaagtgcacgtgcagaggtccgtgtcccgagataccatcgccattcacttctcggcatccggcgaggaggaggaggaagaggaggaggagttcagggagtactttgaggaggggctggatgaccaaagcattgtaacagggctggaagccaaggaagacctctatcttgaaccccaagttggccatgaccccgccggccctgctgcctcgcctgtcctggcagatggactgtccgtgtcccaggcccctgccattattgcccgtctccaagaacactgtaaagctgttggagtcccctgttccagcagcacaagtattaagtacagtgccattgggctgtgtccccagggtcgtcttcgtcggggcccttagctagctctcccagatgtgtcatcccatttctgagcagaaaaccagttcttcctccccattgtcctctccttctaagtctcccatcctctcatccagtgcctcaagctccaccctttccagtgcaaaaaccttcatgagccttgtgaagtccctgtcgaccgaggtggagccaaaagaatccccacaccccgcaaggcacaggcacttgatgaagacattagtcaagtctctgtccacggacacttcccggcaggagtcggatacagtgtcctataagccacctgattccaaactgaacttacacctgttcaagcagttcacacagccccgaaacacaggtggagattccaaaactgcaccttcttccccactgacttctccctctgatactcgttccttttttaaagtgcccgaaatggaggctaaaattgaagatactaaacgacgcctttcagaagtcatctatgagccttttcagctccttagtaaaattataggggaagaaagtggcagccataggcccaaagccttatcttcaagtgcttcagaactctccaatctgtccagcttgaatgggcacttggaaagcaataacaactacagcatcaaggaggaggagtgtgattctgagggggatggctacggaagtgattccaacatccccagaagtgaccacccaaagtccactggtgagcccacaagagagatagaactgaaaagttcccaggggagcagtctgaaggatttaggcctgaagacaagttctctagttctggagaaatgttctttgtctgccttagtgagcaaagaagatgaagagttttgtgaactgtacactgaggacttcgatttggaaacggagggggagagtaaagttgataagctctcagatattcctctcaagccagaggtgctcgcggaagatggtgtggtccttgacagtgaggacgaggtggactcggccgtgcagcacccggaattgccagtgaagacgttgggcttctttataatgtgtgtctatgtgtacctcatcctccccctcccccactatgtgagtggactctttctgggaattggccttggattcatgactgcagtttgcgtgatttggttttttacaccaccaagtgctcataaatatcacaagttacacaaaaatctgcgacactggaacacaagatctctggatatcaaagaacctgaaatactgaagggatggatgaatgagatttacaactatgatccagaaacctaccatgcgactttgacacattcagtctttgttcgacttgagggtggaaccttaagactttcaaagcccaataaaaatatatccaggagggccagctacaatgaacccaagccagaggtcacctacatcagccagaaaatctatgacctctcagacagcaagatttatcttgtacctaaaactttggctcgaaagcgaatctggaataaaaagtaccccatttgtatcgagcttggtcagcaagatgactttatgtctaaagctcagactgataaggagacttcagaagagaagccgccagctgagggaagtgaggaccctaagaagccaccccgccctcaggagggaacaagatctagccagcgagatcagatactctatctctttgggagaactggccgagaaaaagaggaatggtttaggagatttattctggcatctaagctaaagtcggaaatcaagaagtcatcgggtgtctctggaggtaaaccagggcttttgcctgcacacagcagacacaacagtccgtccgggcacctgacccacagccgcagcagcagcaaaggcagtgtggaggagatcatgtcacagccaaagcagaaggagctggcaggcagcgtgcggcagaagatgcttctcgactacagcgtgtacatgggcaggtgtgtcccccaggaaagccgaagcccccagaggagccccctgcagagtgcggagagcagccccacagctgggaagaagttgccagaggttccaccctctgaggaggaagaacaggaagcctgggtgaatgccttgcttggaagaatattttgggacttcttaggagagaaatactggtctgatctggtgtctaagaagatccaaatgaaactcagcaaaataaagctcccctactttatgaatgagctcactctgacggaacttgacatgggcgtggctgtgccaaaaatcctccaggccttcaagccttacgttgatcaccaaggactctggattgatttggaaatgtcctacaatgggtcctttctgatgactctcgagaccaaaatgaatttgaccaaactaggtaaagagcctcttgttgaagccctgaaggttggagaaattggcaaagaaggttgcaggccccgggcattctgtctggcggacagcgatgaggaatcctccagcgctggctcctccgaggaagacgatgccccagagcccagcgggggagacaaacagctcctcccaggggctgaagggtacgttggaggtcatcgaacaagtaagattatgaggtttgttgataaaattaccaagtcaaaatatttccaaaaagcaacagagacagagtttattaaaaagaagatcgaagaagtctccaacgcagatgctccgtctttagcagacatagcaggagaagaagcttnccacttcagatctaactctgggctacacattccacctaaacatcttgagacagagtggccatgatgggcatgcatatacactctacagtgctggtagaccctttgggtggaagttcatggtaggggcctacagtgggaatgaacgtgcgcaactctacc

SEQ ID NO: 299771 - DNA, 2783 bp, Homo sapiens
cggggcggcgtgtgcccgggggcgggcgggcggcagggcagcaggaccgcggccggtgccccagccgaagccggagtcgcgcggccgggagcacgggcgccggcatagtacaatgaggcagccagcggatcttggagcctgagcccttgtgaagccggcaatgacaagtctgtatggtcgccatgccgagaaaaccactgacatgccaaaaccatcagcccctaaagtgcacgtgcagaggtccgtgtcccgagataccatcgccattcacttctcggcatccggcgaggaggaggaggaagaggaggaggagttcagggagtactttgaggaggggctggatgaccaaagcattgtaacagggctggaagccaaggaagacctctatcttgaaccccaagttggccatgaccccgccggccctgctgcctcgcctgtcctggcagatggactgtccgtgtcccaggcccctgccattattgcccgtctccaagaacactgtaaagctgttggagtcccctgttccagcagcacaagtattaagtacagtgccattgggctgtgtccccagggtcgtcttcgtcggggcccttagctagctctcccagatgtgtcatcccatttctgagcagaaaaccagttcttcctccccattgtcctctccttctaagtctcccatcctctcatccagtgcctcaagctccaccctttccagtgcaaaaaccttcatgagccttgtgaagtccctgtcgaccgaggtggagccaaaagaatccccacaccccgcaaggcacaggcacttgatgaagacattagtcaagtctctgtccacggacacttcccggcaggagtcggatacagtgtcctataagccacctgattccaaactgaacttacacctgttcaagcagttcacacagccccgaaacacaggtggagattccaaaactgcaccttcttccccactgacttctccctctgatactcgttccttttttaaagtgcccgaaatggaggctaaaattgaagatactaaacgacgcctttcagaagtcatctatgagccttttcagctccttagtaaaattataggggaagaaagtggcagccataggcccaaagccttatcttcaagtgcttcagaactctccaatctgtccagcttgaatgggcacttggaaagcaataacaactacagcatcaaggaggaggagtgtgattctgagggggatggctacggaagtgattccaacatccccagaagtgaccacccaaagtccactggtgagcccacaagagagatagaactgaaaagttcccaggggagcagtctgaaggatttaggcctgaagacaagttctctagttctggagaaatgttctttgtctgccttagtgagcaaagaagatgaagagttttgtgaactgtacactgaggacttcgatttggaaacggagggggagagtaaagttgataagctctcagatattcctctcaagccagaggtgctcgcggaagatggtgtggtccttgacagtgaggacgaggtggactcggccgtgcagcacccggaattgccagtgaagacgttgggcttctttataatgtgtgtctatgtgtacctcatcctccccctcccccactatgtgagtggactctttctgggaattggccttggattcatgactgcagtttgcgtgatttggttttttacaccaccaagtgctcataaatatcacaagttacacaaaaatctgcgacactggaacacaagatctctggatatcaaagaacctgaaatactgaagggatggatgaatgagatttacaactatgatccagaaacctaccatgcgactttgacacattcagtctttgttcgacttgagggtggaaccttaagactttcaaagcccaataaaaatatatccaggagggccagctacaatgaacccaagccagaggtcacctacatcagccagaaaatctatgacctctcagacagcaagatttatcttgtacctaaaactttggctcgaaagcgaatctggaataaaaagtaccccatttgtatcgagcttggtcagcaagatgactttatgtctaaagctcagactgataaggagacttcagaagagaagccgccagctgagggaagtgaggaccctaagaagccaccccgccctcaggagggaacaagatctagccagcgagatcagatactctatctctttgggagaactggccgagaaaaagaggaatggtttaggagatttattctggcatctaagctaaagtcggaaatcaagaagtcatcgggtgtctctggaggtaaaccagggcttttgcctgcacacagcagacacaacagtccgtccgggcacctgacccacagccgcagcagcagcaaaggcagtgtggaggagatcatgtcagagtccacgtgtcctggtcactggtctttataattgttgtgcaataactaaaggctaaggactagatgcactatcgtgtaaagagattacacatgactgtaccatgttgcacttaatcaaatagtatgtggggatttaaaatcgcttgcattgtttcacaaaataaatatctcaatgtcaaatactagataagcatctaagtcatttctacggaatcctgttcagataggggcacaataaaatgagtacagagcaccggggccctcacctggcaatcgcagctttcatttactgcgttgatcactgcccagtcctaaggctacaaagccatcctcactacatccttca

SEQ ID NO: 299772 - DNA, 4846 bp, Homo sapiens
cggggcggcgtgtgcccgggggcgggcgggcggcagggcagcaggaccgcggccggtgccccagccgaagccggagtcgcgcggccgggagcacgggcgccggcatagtacaatgaggcagccagcggatcttggagcctgagcccttgtgaagccggcaatgacaagtctgtatggtcgccatgccgagaaaaccactgacatgccaaaaccatcagcccctaaagtgcacgtgcagaggtccgtgtcccgagataccatcgccattcacttctcggcatccggcgaggaggaggaggaagaggaggaggagttcagggagtactttgaggaggggctggatgaccaaagcattgtaacagggctggaagccaaggaagacctctatcttgaaccccaagttggccatgaccccgccggccctgctgcctcgcctgtcctggcagatggactgtccgtgtcccaggcccctgccattattgcccgtctccaagaacactgtaaagctgttggagtcccctgttccagcagcacaagtattaagtacagtgccattgggctgtgtccccagggtcgtcttcgtcggggcccttagctagctctcccagatgtgtcatcccatttctgagcagaaaaccagttcttcctccccattgtcctctccttctaagtctcccatcctctcatccagtgcctcaagctccaccctttccagtgcaaaaaccttcatgagccttgtgaagtccctgtcgaccgaggtggagccaaaagaatccccacaccccgcaaggcacaggcacttgatgaagacattagtcaagtctctgtccacggacacttcccggcaggagtcggatacagtgtcctataagccacctgattccaaactgaacttacacctgttcaagcagttcacacagccccgaaacacaggtggagattccaaaactgcaccttcttccccactgacttctccctctgatactcgttccttttttaaagtgcccgaaatggaggctaaaattgaagatactaaacgacgcctttcagaagtcatctatgagccttttcagctccttagtaaaattataggggaagaaagtggcagccataggcccaaagccttatcttcaagtgcttcagaactctccaatctgtccagcttgaatgggcacttggaaagcaataacaactacagcatcaaggaggaggagtgtgattctgagggggatggctacggaagtgattccaacatccccagaagtgaccacccaaagtccactggtgagcccacaagagagatagaactgaaaagttcccaggggagcagtctgaaggatttaggcctgaagacaagttctctagttctggagaaatgttctttgtctgccttagtgagcaaagaagatgaagagttttgtgaactgtacactgaggacttcgatttggaaacggagggggagagtaaagttgataagctctcagatattcctctcaagccagaggtgctcgcggaagatggtgtggtccttgacagtgaggacgaggtggactcggccgtgcagcacccggaattgccagtgaagacgttgggcttctttataatgtgtgtctatgtgtacctcatcctccccctcccccactatgtgagtggactctttctgggaattggccttggattcatgactgcagtttgcgtgatttggttttttacaccaccaagtgctcataaatatcacaagttacacaaaaatctgcgacactggaacacaagatctctggatatcaaagaacctgaaatactgaagggatggatgaatgagatttacaactatgatccagaaacctaccatgcgactttgacacattcagtctttgttcgacttgagggtggaaccttaagactttcaaagcccaataaaaatatatccaggagggccagctacaatgaacccaagccagaggtcacctacatcagccagaaaatctatgacctctcagacagcaagatttatcttgtacctaaaactttggctcgaaagcgaatctggaataaaaagtaccccatttgtatcgagcttggtcagcaagatgactttatgtctaaagctcagactgataaggagacttcagaagagaagccgccagctgagggaagtgaggaccctaagaagccaccccgccctcaggagggaacaagatctagccagcgagatcagatactctatctctttgggagaactggccgagaaaaagaggaatggtttaggagatttattctggcatctaagctaaagtcggaaatcaagaagtcatcgggtgtctctggaggtaaaccagggcttttgcctgcacacagcagacacaacagtccgtccgggcacctgacccacagccgcagcagcagcaaaggcagtgtggaggagatcatgtcacagccaaagcagaaggagctggcaggcagcgtgcggcagaagatgcttctcgactacagcgtgtacatgggcaggtgtgtcccccaggaaagccgaagcccccagaggagccccctgcagagtgcggagagcagccccacagctgggaagaagttgccagaggttccaccctctgaggaggaagaacaggaagcctgggtgaatgccttgcttggaagaatattttgggacttcttaggagagaaatactggtctgatctggtgtctaagaagatccaaatgaaactcagcaaaataaagctcccctactttatgaatgagctcactctgacggaacttgacatgggcgtggctgtgccaaaaatcctccaggccttcaagccttacgttgatcaccaaggactctggattgatttggaaatgtcctacaatgggtcctttctgatgactctcgagaccaaaatgaatttgaccaaactaggtaaagagcctcttgttgaagccctgaaggttggagaaattggcaaagaaggttgcaggccccgggcattctgtctggcggacagcgatgaggaatcctccagcgctggctcctccgaggaagacgatgccccagagcccagcgggggagacaaacagctcctcccaggggctgaagggtacgttggaggtcatcgaacaagtaagattatgaggtttgttgataaaattaccaagtcaaaatatttccaaaaagcaacagagacagagtttattaaaaagaagatcgaagaagtctccaacacacccctgctgctcactgttgaagtacaagaatgtagaggaaccttggcggtcaacattccaccacccccgactgaccgagtatggtatggtttccgaaagccaccacatgtggagctgaaagctcggccaaaacttggagagagagaagtgactttagttcatgtgacagactggatagagaagaaactggagcaagagtttcagaaagtttttgtcatgccaaacatggatgatgtttatatcactataatgcactcagccatggaccctcgctctacttcctgcctcctgaaagacccacctgtggaggctgctgatcagccatgatgggtgatgtcagatgttccccatattgtgacatcgagctggatgtgtggggttcttggccgccatctgtactgtagcactggcctctgtgccacagctactgtttcttaaaggactgcttctgccctctgcctgccagtgcccattccactgtgaggtgtcattccctgcatctagtgacaactgtctggattgcctgctgcaaagctttgatttggcaaaggagaccatggaagaatcatggtggatccagaagttatacgtgacccacaccatggcttttaaaagtctacccatgtttgtggcagcaaatgagcacagtaagagcaaagctgaacaacttgcctcctctactcctccaaagcttttcttcaggcagccggtgcacagtggactttttcacttctatactttgtatgcggccttccacacttccagagaatgtcagtgtgcaatgtgtctggagggtggggagaggaattctgtgagccttttcatttcggtgacagaagagatgggcagagcaacttattttccacattaaattgtgcatttgggaagcaagtagccatagtacacacacaacacgctatcagcttgggtaaggacagtgggatttatgtgaacatcaggcaaagccatgagatcaaaccatcccaagcctttcaccaatgaggtacaaccacctgggggctagctaatcttgaatgttttcctgagacaggagcgtatgtgaaaacatcaaacactgcacatgacaggatgggtcctctcatacagatgggatggggttagaaagccagagccagtttttccatctggcgtttcctgtgtcctccaggtttatatgggaatcgaaacagtttgttaatctgattgggagagttccatgggcagatttcccttcctgaaggccaaaacggagaactgctctctttaattatttcaagagtcaagaccaaaagtttgctcagcatcacactacatctcaaaattaatgttgccaacttaattttgtgcatttgtgtcagaatgtttagtttacaaggttgggggctctctttgcttcgagaagtaaacctaataccatttttttattgtttaaagctgcattcaacgtcaaaattaccttgggtaacttttgataacttacatgtgtggacaaagctaatagtggttttttaaacagcaccttgcctgaacatgactttaaagaaattaatatattgaaaacatgtttgaacccttattttaattgcaccattaaaacatttgacttaaattgtttgaccattcca

SEQ ID NO: 299773 - DNA, 4086 bp, Homo sapiens
ggagaatgtatgagggcggtccctgttttaatttcaggtaccgggactggcgtttcacttgtctttgctcggccgtcgttgccaacataagtcggatacagtgtcctataagccacctgattccaaactgaacttacacctgttcaagcagttcacacagccccgaaacacaggtggagattccaaaactgcaccttcttccccactgacttctccctctgatactcgttccttttttaaagtgcccgaaatggaggctaaaattgaagatactaaacgacgcctttcagaagtcatctatgagccttttcagctccttagtaaaattataggggaagaaagtggcagccataggcccaaagccttatcttcaagtgcttcagaactctccaatctgtccagcttgaatgggcacttggaaagcaataacaactacagcatcaaggaggaggagtgtgattctgagggggatggctacggaagtgattccaacatccccagaagtgaccacccaaagtccactggtgagcccacaagagagatagaactgaaaagttcccaggggagcagtctgaaggatttaggcctgaagacaagttctctagttctggagaaatgttctttgtctgccttagtgagcaaagaagatgaagagttttgtgaactgtacactgaggacttcgatttggaaacggagggggagagtaaagttgataagctctcagatattcctctcaagccagaggtgctcgcggaagatggtgtggtccttgacagtgaggacgaggtggactcggccgtgcagcacccggaattgccagtgaagacgttgggcttctttataatgtgtgtctatgtgtacctcatcctccccctcccccactatgtgagtggactctttctgggaattggccttggattcatgactgcagtttgcgtgatttggttttttacaccaccaagtgctcataaatatcacaagttacacaaaaatctgcgacactggaacacaagatctctggatatcaaagaacctgaaatactgaagggatggatgaatgagatttacaactatgatccagaaacctaccatgcgactttgacacattcagtctttgttcgacttgagggtggaaccttaagactttcaaagcccaataaaaatatatccaggagggccagctacaatgaacccaagccagaggtcacctacatcagccagaaaatctatgacctctcagacagcaagatttatcttgtacctaaaactttggctcgaaagcgaatctggaataaaaagtaccccatttgtatcgagcttggtcagcaagatgactttatgtctaaagctcagactgataaggagacttcagaagagaagccgccagctgagggaagtgaggaccctaagaagccaccccgccctcaggagggaacaagatctagccagcgagatcagatactctatctctttgggagaactggccgagaaaaagaggaatggtttaggagatttattctggcatctaagctaaagtcggaaatcaagaagtcatcgggtgtctctggaggtaaaccagggcttttgcctgcacacagcagacacaacagtccgtccgggcacctgacccacagccgcagcagcagcaaaggcagtgtggaggagatcatgtcacagccaaagcagaaggagctggcaggcagcgtgcggcagaagatgcttctcgactacagcgtgtacatgggcaggtgtgtcccccaggaaagccgaagcccccagaggagccccctgcagagtgcggagagcagccccacagctgggaagaagttgccagaggttccaccctctgaggaggaagaacaggaagcctgggtgaatgccttgcttggaagaatattttgggacttcttaggagagaaatactggtctgatctggtgtctaagaagatccaaatgaaactcagcaaaataaagctcccctactttatgaatgagctcactctgacggaacttgacatgggcgtggctgtgccaaaaatcctccaggccttcaagccttacgttgatcaccaaggactctggattgatttggaaatgtcctacaatgggtcctttctgatgactctcgagaccaaaatgaatttgaccaaactaggtaaagagcctcttgttgaagccctgaaggttggagaaattggcaaagaaggttgcaggccccgggcattctgtctggcggacagcgatgaggaatcctccagcgctggctcctccgaggaagacgatgccccagagcccagcgggggagacaaacagctcctcccaggggctgaagggtacgttggaggtcatcgaacaagtaagattatgaggtttgttgataaaattaccaagtcaaaatatttccaaaaagcaacagagacagagtttattaaaaagaagatcgaagaagtctccaacacacccctgctgctcactgttgaagtacaagaatgtagaggaaccttggcggtcaacattccaccacccccgactgaccgagtatggtatggtttccgaaagccaccacatgtggagctgaaagctcggccaaaacttggagagagagaagtgactttagttcatgtgacagactggatagagaagaaactggagcaagagtttcagaaagtttttgtcatgccaaacatggatgatgtttatatcactataatgcactcagccatggaccctcgctctacttcctgcctcctgaaagacccacctgtggaggctgctgatcagccatgatgggtgatgtcagatgttccccatattgtgacatcgagctggatgtgtggggttcttggccgccatctgtactgtagcactggcctctgtgccacagctactgtttcttaaaggactgcttctgccctctgcctgccagtgcccattccactgtgaggtgtcattccctgcatctagtgacaactgtctggattgcctgctgcaaagctttgatttggcaaaggagaccatggaagaatcatggtggatccagaagttatacgtgacccacaccatggcttttaaaagtctacccatgtttgtggcagcaaatgagcacagtaagagcaaagctgaacaacttgcctcctctactcctccaaagcttttcttcaggcagccggtgcacagtggactttttcacttctatactttgtatgcggccttccacacttccagagaatgtcagtgtgcaatgtgtctggagggtggggagaggaattctgtgagccttttcatttcggtgacagaagagatgggcagagcaacttattttccacattaaattgtgcatttgggaagcaagtagccatagtacacacacaacacgctatcagcttgggtaaggacagtgggatttatgtgaacatcaggcaaagccatgagatcaaaccatcccaagcctttcaccaatgaggtacaaccacctgggggctagctaatcttgaatgttttcctgagacaggagcgtatgtgaaaacatcaaacactgcacatgacaggatgggtcctctcatacagatgggatggggttagaaagccagagccagtttttccatctggcgtttcctgtgtcctccaggtttatatgggaatcgaaacagtttgttaatctgattgggagagttccatgggcagatttcccttcctgaaggccaaaacggagaactgctctctttaattatttcaagagtcaagaccaaaagtttgctcagcatcacactacatctcaaaattaatgttgccaacttaattttgtgcatttgtgtcagaatgtttagtttacaaggttgggggctctctttgcttcgagaagtaaacctaataccatttttttattgtttaaagctgcattcaacgtcaaaattaccttgggtaacttttgataacttacatgtgtggacaaagctaatagtggttttttaaacagcaccttgcctgaacatgactttaaagaaattaatatattgaaaacatgtttgaacccttattttaattgcaccattaaaacatttgacttaaattgtttgaccattcca

SEQ ID NO: 299774 - DNA, 5548 bp, Homo sapiens
cggggcggcgtgtgcccgggggcgggcgggcggcagggcagcaggaccgcggccggtgccccagccgaagccggagtcgcgcggccgggagcacgggcgccggcatagtacaatgaggcagccagcggatcttggagcctgagcccttgtgaagccggcaatgacaagtctgtatggtcgccatgccgagaaaaccactgacatgccaaaaccatcagcccctaaagtgcacgtgcagaggtccgtgtcccgagataccatcgccattcacttctcggcatccggcgaggaggaggaggaagaggaggaggagttcagggagtactttgaggaggggctggatgaccaaagcattgtaacagggctggaagccaaggaagacctctatcttgaaccccaagttggccatgaccccgccggccctgctgcctcgcctgtcctggcagatggactgtccgtgtcccaggcccctgccattattgcccgtctccaagaacactgtaaagctgttggagtcccctgttccagcagcacaagtattaagtacagtgccattgggctgtgtccccagggtcgtcttcgtcggggcccttagctagctctcccagatgtgtcatcccatttctgagcagaaaaccagttcttcctccccattgtcctctccttctaagtctcccatcctctcatccagtgcctcaagctccaccctttccagtgcaaaaaccttcatgagccttgtgaagtccctgtcgaccgaggtggagccaaaagaatccccacaccccgcaaggcacaggcacttgatgaagacattagtcaagtctctgtccacggacacttcccggcaggagtcggatacagtgtcctataagccacctgattccaaactgaacttacacctgttcaagcagttcacacagccccgaaacacaggtggagattccaaaactgcaccttcttccccactgacttctccctctgatactcgttccttttttaaagtgcccgaaatggaggctaaaattgaagatactaaacgacgcctttcagaagtcatctatgagccttttcagctccttagtaaaattataggggaagaaagtggcagccataggcccaaagccttatcttcaagtgcttcagaactctccaatctgtccagcttgaatgggcacttggaaagcaataacaactacagcatcaaggaggaggagtgtgattctgagggggatggctacggaagtgattccaacatccccagaagtgaccacccaaagtccactggtgagcccacaagagagatagaactgaaaagttcccaggggagcagtctgaaggatttaggcctgaagacaagttctctagttctggagaaatgttctttgtctgccttagtgagcaaagaagatgaagagttttgtgaactgtacactgaggacttcgatttggaaacggagggggagagtaaagttgataagctctcagatattcctctcaagccagaggtgctcgcggaagatggtgtggtccttgacagtgaggacgaggtggactcggccgtgcagcacccggaattgccagtgaagacgttgggcttctttataatgtgtgtctatgtgtacctcatcctccccctcccccactatgtgagtggactctttctgggaattggccttggattcatgactgcagtttgcgtgatttggttttttacaccaccaagtgctcataaatatcacaagttacacaaaaatctgcgacactggaacacaagatctctggatatcaaagaacctgaaatactgaagggatggatgaatgagatttacaactatgatccagaaacctaccatgcgactttgacacattcagtctttgttcgacttgagggtggaaccttaagactttcaaagcccaataaaaatatatccaggagggccagctacaatgaacccaagccagaggtcacctacatcagccagaaaatctatgacctctcagacagcaagatttatcttgtacctaaaactttggctcgaaagcgaatctggaataaaaagtaccccatttgtatcgagcttggtcagcaagatgactttatgtctaaagctcagactgataaggagacttcagaagagaagccgccagctgagggaagtgaggaccctaagaagccaccccgccctcaggagggaacaagatctagccagcgagatcagatactctatctctttgggagaactggccgagaaaaagaggaatggtttaggagatttattctggcatctaagctaaagtcggaaatcaagaagtcatcgggtgtctctggaggtaaaccagggcttttgcctgcacacagcagacacaacagtccgtccgggcacctgacccacagccgcagcagcagcaaaggcagtgtggaggagatcatgtcacagccaaagcagaaggagctggcaggcagcgtgcggcagaagatgcttctcgactacagcgtgtacatgggcaggtgtgtcccccaggaaagccgaagcccccagaggagccccctgcagagtgcggagagcagccccacagctgggaagaagttgccagaggttccaccctctgaggaggaagaacaggaagcctgggtgaatgccttgcttggaagaatattttgggacttcttaggagagaaatactggtctgatctggtgtctaagaagatccaaatgaaactcagcaaaataaagctcccctactttatgaatgagctcactctgacggaacttgacatgggcgtggctgtgccaaaaatcctccaggccttcaagccttacgttgatcaccaaggactctggattgatttggaaatgtcctacaatgggtcctttctgatgactctcgagaccaaaatgaatttgaccaaactaggtaaagagcctcttgttgaagccctgaaggttggagaaattggcaaagaaggttgcaggccccgggcattctgtctggcggacagcgatgaggaatcctccagcgctggctcctccgaggaagacgatgccccagagcccagcgggggagacaaacagctcctcccaggggctgaagggtacgttggaggtcatcgaacaagtaagattatgaggtttgttgataaaattaccaagtcaaaatatttccaaaaagcaacagagacagagtttattaaaaagaagatcgaagaagtctccaacacacccctgctgctcactgttgaagtacaagaatgtagaggaaccttggcggtcaacattccaccacccccgactgaccgagtatggtatggtttccgaaagccaccacatgtggagctgaaagctcggccaaaacttggagagagagaagtgactttagttcatgtgacagactggatagagaagaaactggagcaagagtttcagaaagtttttgtcatgccaaacatggatgatgtttatatcactataatgcactcagccatggaccctcgctctacttcctgcctcctgaaagacccacctgtggaggctgctgatcagccatgatgggtgatgtcagatgttccccatattgtgacatcgagctggatgtgtggggttcttggccgccatctgtactgtagcactggcctctgtgccacagctactgtttcttaaaggactgcttctgccctctgcctgccagtgcccattccactgtgaggtgtcattccctgcatctagtgacaactgtctggattgcctgctgcaaagctttgatttggcaaaggagaccatggaagaatcatggtggatccagaagttatacgtgacccacaccatggcttttaaaagtctacccatgtttgtggcagcaaatgagcacagtaagagcaaagctgaacaacttgcctcctctactcctccaaagcttttcttcaggcagccggtgcacagtggactttttcacttctatactttgtatgcggccttccacacttccagagaatgtcagtgtgcaatgtgtctggagggtggggagaggaattctgtgagccttttcatttcggtgacagaagagatgggcagagcaacttattttccacattaaattgtgcatttgggaagcaagtagccatagtacacacacaacacgctatcagcttgggtaaggacagtgggatttatgtgaacatcaggcaaagccatgagatcaaaccatcccaagcctttcaccaatgaggtacaaccacctgggggctagctaatcttgaatgttttcctgagacaggagcgtatgtgaaaacatcaaacactgcacatgacaggatgggtcctctcatacagatgggatggggttagaaagccagagccagtttttccatctggcgtttcctgtgtcctccaggtttatatgggaatcgaaacagtttgttaatctgattgggagagttccatgggcagatttcccttcctgaaggccaaaacggagaactgctctctttaattatttcaagagtcaagaccaaaagtttgctcagcatcacactacatctcaaaattaatgttgccaacttaattttgtgcatttgtgtcagaatgtttagtttacaaggttgggggctctctttgcttcgagaagtaaacctaataccatttttttattgtttaaagctgcattcaacgtcaaaattaccttgggtaacttttgataacttacatgtgtggacaaagctaatagtggttttttaaacagcaccttgcctgaacatgactttaaagaaattaatatattgaaaacatgtttgaacccttattttaattgcaccattaaaacatttgacttaaattgtttgaccattccagttggtgtactgttctgatttttcgttgtgtaggccgatctgcctgtcagagtccacgtgtcctggtcactggtctttataattgttgtgcaataactaaaggctaaggactagatgcactatcgtgtaaagagattacacatgactgtaccatgttgcacttaatcaaatagtatgtggggatttaaaatcgcttgcattgtttcacaaaataaatatctcaatgtcaaataaaaaaaaaaaaaagaaaaaaaaaaaaaaaaaaaaaaaaaaaagggggggggccccaaaatcccccggggggccccttcggcgagcacccgggttttcctgtgaacaagggggcgcccctaataagggaggcgcctgtatataaacaagacagggagccctgggcgccgcgccgagtatcacaaacggggctcgtagatggtgtgggaaaaactctgtgtgtgacgctgggagggaatctttgtgggagaagagggaaccccttaatcttgtggggggggtgggacaatattgtgggggcacaaccttttcatcctacgaaagtattataacagggtctgtaggggggacaatctttctactctttttcaagtgttgtttatgtggttggttcacctagaggtgatataattgtatgggggcctgaaaaaattttggctcagggagtagtgtttgtgggacaaattattc

SEQ ID NO: 299775 - DNA, 5214 bp, Homo sapiens
cggggcggcgtgtgcccgggggcgggcgggcggcagggcagcaggaccgcggccggtgccccagccgaagccggagtcgcgcggccgggagcacgggcgccggcatagtacaatgaggcagccagcggatcttggagcctgagcccttgtgaagccggcaatgacaagtctgtatggtcgccatgccgagaaaaccactgacatgccaaaaccatcagcccctaaagtgcacgtgcagaggtccgtgtcccgagataccatcgccattcacttctcggcatccggcgaggaggaggaggaagaggaggaggagttcagggagtactttgaggaggggctggatgaccaaagcattgtaacagggctggaagccaaggaagacctctatcttgaaccccaagttggccatgaccccgccggccctgctgcctcgcctgtcctggcagatggactgtccgtgtcccaggcccctgccattattgcccgtctccaagaacactgtaaagctgttggagtcccctgttccagcagcacaagtattaagtacagtgccattgggctgtgtccccagggtcgtcttcgtcggggcccttagctagctctcccagatgtgtcatcccatttctgagcagaaaaccagttcttcctccccattgtcctctccttctaagtctcccatcctctcatccagtgcctcaagctccaccctttccagtgcaaaaaccttcatgagccttgtgaagtccctgtcgaccgaggtggagccaaaagaatccccacaccccgcaaggcacaggcacttgatgaagacattagtcaagtctctgtccacggacacttcccggcaggagtcggatacagtgtcctataagccacctgattccaaactgaacttacacctgttcaagcagttcacacagccccgaaacacaggtggagattccaaaactgcaccttcttccccactgacttctccctctgatactcgttccttttttaaagtgcccgaaatggaggctaaaattgaagatactaaacgacgcctttcagaagtcatctatgagccttttcagctccttagtaaaattataggggaagaaagtggcagccataggcccaaagccttatcttcaagtgcttcagaactctccaatctgtccagcttgaatgggcacttggaaagcaataacaactacagcatcaaggaggaggagtgtgattctgagggggatggctacggaagtgattccaacatccccagaagtgaccacccaaagtccactggtgagcccacaagagagatagaactgaaaagttcccaggggagcagtctgaaggatttaggcctgaagacaagttctctagttctggagaaatgttctttgtctgccttagtgagcaaagaagatgaagagttttgtgaactgtacactgaggacttcgatttggaaacggagggggagagtaaagttgataagctctcagatattcctctcaagccagaggtgctcgcggaagatggtgtggtccttgacagtgaggacgaggtggactcggccgtgcagcacccggaattgccagtgaagacgttgggcttctttataatgtgtgtctatgtgtacctcatcctccccctcccccactatgtgagtggactctttctgggaattggccttggattcatgactgcagtttgcgtgatttggttttttacaccaccaagtgctcataaatatcacaagttacacaaaaatctgcgacactggaacacaagatctctggatatcaaagaacctgaaatactgaagggatggatgaatgagatttacaactatgatccagaaacctaccatgcgactttgacacattcagtctttgttcgacttgagggtggaaccttaagactttcaaagcccaataaaaatatatccaggagggccagctacaatgaacccaagccagaggtcacctacatcagccagaaaatctatgacctctcagacagcaagatttatcttgtacctaaaactttggctcgaaagcgaatctggaataaaaagtaccccatttgtatcgagcttggtcagcaagatgactttatgtctaaagctcagactgataaggagacttcagaagagaagccgccagctgagggaagtgaggaccctaagaagccaccccgccctcaggagggaacaagatctagccagcgagatcagatactctatctctttgggagaactggccgagaaaaagaggaatggtttaggagatttattctggcatctaagctaaagtcggaaatcaagaagtcatcgggtgtctctggaggtaaaccagggcttttgcctgcacacagcagacacaacagtccgtccgggcacctgacccacagccgcagcagcagcaaaggcagtgtggaggagatcatgtcacagccaaagcagaaggagctggcaggcagcgtgcggcagaagatgcttctcgactacagcgtgtacatgggcaggtgtgtcccccaggaaagccgaagcccccagaggagccccctgcagagtgcggagagcagccccacagctgggaagaagttgccagaggttccaccctctgaggaggaagaacaggaagcctgggtgaatgccttgcttggaagaatattttgggacttcttaggagagaaatactggtctgatctggtgtctaagaagatccaaatgaaactcagcaaaataaagctcccctactttatgaatgagctcactctgacggaacttgacatgggcgtggctgtgccaaaaatcctccaggccttcaagccttacgttgatcaccaaggactctggattgatttggaaatgtcctacaatgggtcctttctgatgactctcgagaccaaaatgaatttgaccaaactaggtaaagagcctcttgttgaagccctgaaggttggagaaattggcaaagaaggttgcaggccccgggcattctgtctggcggacagcgatgaggaatcctccagcgctggctcctccgaggaagacgatgccccagagcccagcgggggagacaaacagctcctcccaggggctgaagggtacgttggaggtcatcgaacaagtaagattatgaggtttgttgataaaattaccaagtcaaaatatttccaaaaagcaacagagacagagtttattaaaaagaagatcgaagaagtctccaacacacccctgctgctcactgttgaagtacaagaatgtagaggaaccttggcggtcaacattccaccacccccgactgaccgagtatggtatggtttccgaaagccaccacatgtggagctgaaagctcggccaaaacttggagagagagaagtgactttagttcatgtgacagactggatagagaagaaactggagcaagagtttcagaaagtttttgtcatgccaaacatggatgatgtttatatcactataatgcactcagccatggaccctcgctctacttcctgcctcctgaaagacccacctgtggaggctgctgatcagccatgatgggtgatgtcagatgttccccatattgtgacatcgagctggatgtgtggggttcttggccgccatctctactgtttcttaaaggactgcttctgccctctgcctgccagtgcccattccactgtgaggtgtcattccctgcatctagtgacaactgtctggattgcctgctgcaaagctttgatttggcaaaggagaccatggaagaatcatggtggatccagaagttatacgtgacccacaccatggcttttaaaagtctacccatgtttgtggcagcaaatgagcacagtaagagcaaagctgaacaacttgcctcctctactcctccaaagcttttcttcaggcagccggtgcacagtggactttttcacttctatactttgtatgcggccttccacacttccagagaatgtcagtgtgcaatgtgtctggagggtggggagaggaattctgtgagccttttcatttcggtgacagaagagatgggcagagcaacttattttccacattaaattgtgcatttgggaagcaagtagccatagtacacacacaacacgctatcagcttgggtaaggacagtgggatttatgtgaacatcaggcaaagccatgagatcaaaccatcccaagcctttcaccaatgaggtacaaccacctgggggctagctaatcttgaatgttttcctgagacaggagcgtatgtgaaaacatcaaacactgcacatgacaggatgggtcctctcatacagatgggatggggttagaaagccagagccagtttttccatctggcgtttcctgtgtcctccaggtttatatgggaatcgaaacagtttgttaatctgattgggagagttccatgggcagatttcccttcctgaaggccaaaacggagaactgctctctttaattatttcaagagtcaagaccaaaagtttgctcagcatcacactacatctcaaaattaatgttgccaacttaattttgtgcatttgtgtcagaatgtttagtttacaaggttgggggctctctttgcttcgagaagtaaacctaataccatttttttattgtttaaagctgcattcaacgtcaaaattaccttgggtaacttttgataacttacatgtgtggacaaagctaatagtggttttttaaacagcaccttgcctgaacatgactttaaagaaattaatatattgaaaacatgtttgaacccttattttaattgcaccattaaaacatttgacttaaattgtttgaccattccagttggtgtactgttctgatttttcgttgtgtaggccgatctgcctgtcagagtccacgtgtcctggtcactggtctttataattgttgtgcaataactaaaggctaaggactagatgcactatcgtgtaaagagattacacatgactgtaccatgttgcacttaatcaaatagtatgtggggatttaaaatcgcttgcattgtttcacaaaataaatatctcaatgtcaaatactagataagcatctaagtcatttctacggaatcctgttcagataggggcacaataaaatgagtacagagcaccggggccctcacctggcaatcgcagctttcatttactgcgttgatcactgcccagtcctaaggctacaaagccatcctcactacatccttca

SEQ ID NO: 299776 - DNA, 2303 bp, Homo sapiens
cagtggtggtgactctctctctgtccagttgcaggccccgggcattctgtctggcggacagcgatgaggaatcctccagcgctggctcctccgaggaagacgatgccccagagcccagcgggggagacaaacagctcctcccaggggctgaagggtacgttggaggtcatcgaacaagtaagattatgaggtttgttgataaaattaccaagtcaaaatatttccaaaaagcaacagagacagagtttattaaaaagaagatcgaagaagtctccaacacacccctgctgctcactgttgaagtacaagaatgtagaggaaccttggcggtcaacattccaccacccccgactgaccgagtatggtatggtttccgaaagccaccacatgtggagctgaaagctcggccaaaacttggagagagagaagtgactttagttcatgtgacagactggatagagaagaaactggagcaagagtttcagaaagtttttgtcatgccaaacatggatgatgtttatatcactataatgcactcagccatggaccctcgctctacttcctgcctcctgaaagacccacctgtggaggctgctgatcagccatgatgggtgatgtcagatgttccccatattgtgacatcgagctggatgtgtggggttcttggccgccatctgtactgtagcactggcctctgtgccacagctactgtttcttaaaggactgcttctgccctctgcctgccagtgcccattccactgtgaggtgtcattccctgcatctagtgacaactgtctggattgcctgctgcaaagctttgatttggcaaaggagaccatggaagaatcatggtggatccagaagttatacgtgacccacaccatggcttttaaaagtctacccatgtttgtggcagcaaatgagcacagtaagagcaaagctgaacaacttgcctcctctactcctccaaagcttttcttcaggcagccggtgcacagtggactttttcacttctatactttgtatgcggccttccacacttccagagaatgtcagtgtgcaatgtgtctggagggtggggagaggaattctgtgagccttttcatttcggtgacagaagagatgggcagagcaacttattttccacattaaattgtgcatttgggaagcaagtagccatagtacacacacaacacgctatcagcttgggtaaggacagtgggatttatgtgaacatcaggcaaagccatgagatcaaaccatcccaagcctttcaccaatgaggtacaaccacctgggggctagctaatcttgaatgttttcctgagacaggagcgtatgtgaaaacatcaaacactgcacatgacaggatgggtcctctcatacagatgggatggggttagaaagccagagccagtttttccatctggcgtttcctgtgtcctccaggtttatatgggaatcgaaacagtttgttaatctgattgggagagttccatgggcagatttcccttcctgaaggccaaaacggagaactgctctctttaattatttcaagagtcaagaccaaaagtttgctcagcatcacactacatctcaaaattaatgttgccaacttaattttgtgcatttgtgtcagaatgtttagtttacaaggttgggggctctctttgcttcgagaagtaaacctaataccatttttttattgtttaaagctgcattcaacgtcaaaattaccttgggtaacttttgataacttacatgtgtggacaaagctaatagtggttttttaaacagcaccttgcctgaacatgactttaaagaaattaatatattgaaaacatgtttgaacccttattttaattgcaccattaaaacatttgacttaaattgtttgaccattccagttggtgtactgttctgatttttcgttgtgtaggccgatctgcctgtcagagtccacgtgtcctggtcactggtctttataattgttgtgcaataactaaaggctaaggactagatgcactatcgtgtaaagagattacacatgactgtaccatgttgcacttaatcaaatagtatgtggggatttaaaatcgcttgcattgtttcacaaaataaatatctcaatgtcaaatactagataagcatctaagtcatttctacggaatcctgttcagataggggcacaataaaatgagtacagagcaccggggccctcacctggcaatcgcagctttcatttactgcgttgatcactgcccagtcctaaggctacaaagccatcctcactacatccttca

SEQ ID NO: 299777 - DNA, 5315 bp, Homo sapiens
cggggcggcgtgtgcccgggggcgggcgggcggcagggcagcaggaccgcggccggtgccccagccgaagccggagtcgcgcggccgggagcacgggcgccggcatagtacaatgaggcagccagcggatcttggagcctgagcccttgtgaagccggcaatgacaagtctgtatggtcgccatgccgagaaaaccactgacatgccaaaaccatcagcccctaaagtgcacgtgcagaggtccgtgtcccgagataccatcgccattcacttctcggcatccggcgaggaggaggaggaagaggaggaggagttcagggagtactttgaggaggggctggatgaccaaagcattgtaacagggctggaagccaaggaagacctctatcttgaaccccaagttggccatgaccccgccggccctgctgcctcgcctgtcctggcagatggactgtccgtgtcccaggcccctgccattattgcccgtctccaagaacactgtaaagctgttggagtcccctgttccagcagcacaagtattaagtacagtgccattgggctgtgtccccagggtcgtcttcgtcggggcccttagctagctctcccagatgtgtcatcccatttctgagcagaaaaccagttcttcctccccattgtcctctccttctaagtctcccatcctctcatccagtgcctcaagctccaccctttccagtgcaaaaaccttcatgagccttgtgaagtccctgtcgaccgaggtggagccaaaagaatccccacaccccgcaaggcacaggcacttgatgaagacattagtcaagtctctgtccacggacacttcccggcaggagtcggatacagtgtcctataagccacctgattccaaactgaacttacacctgttcaagcagttcacacagccccgaaacacaggtggagattccaaaactgcaccttcttccccactgacttctccctctgatactcgttccttttttaaagtgcccgaaatggaggctaaaattgaagatactaaacgacgcctttcagaagtcatctatgagccttttcagctccttagtaaaattataggggaagaaagtggcagccataggcccaaagccttatcttcaagtgcttcagaactctccaatctgtccagcttgaatgggcacttggaaagcaataacaactacagcatcaaggaggaggagtgtgattctgagggggatggctacggaagtgattccaacatccccagaagtgaccacccaaagtccactggtgagcccacaagagagatagaactgaaaagttcccaggggagcagtctgaaggatttaggcctgaagacaagttctctagttctggagaaatgttctttgtctgccttagtgagcaaagaagatgaagagttttgtgaactgtacactgaggacttcgatttggaaacggagggggagagtaaagttgataagctctcagatattcctctcaagccagaggtgctcgcggaagatggtgtggtccttgacagtgaggacgaggtggactcggccgtgcagcacccggaattgccagtgaagacgttgggcttctttataatgtgtgtctatgtgtacctcatcctccccctcccccactatgtgagtggactctttctgggaattggccttggattcatgactgcagtttgcgtgatttggttttttacaccaccaagtgctcataaatatcacaagttacacaaaaatctgcgacactggaacacaagatctctggatatcaaagaacctgaaatactgaagggatggatgaatgagatttacaactatgatccagaaacctaccatgcgactttgacacattcagtctttgttcgacttgagggtggaaccttaagactttcaaagcccaataaaaatatatccaggagggccagctacaatgaacccaagccagaggtcacctacatcagccagaaaatctatgacctctcagacagcaagatttatcttgtacctaaaactttggctcgaaagcgaatctggaataaaaagtaccccatttgtatcgagcttggtcagcaagatgactttatgtctaaagctcagactgataaggagacttcagaagagaagccgccagctgagggaagtgaggaccctaagaagccaccccgccctcaggagggaacaagatctagccagcgagatcagatactctatctctttgggagaactggccgagaaaaagaggaatggtttaggagatttattctggcatctaagctaaagtcggaaatcaagaagtcatcgggtgtctctggaggtaaaccagggcttttgcctgcacacagcagacacaacagtccgtccgggcacctgacccacagccgcagcagcagcaaaggcagtgtggaggagatcatgtcacagccaaagcagaaggagctggcaggcagcgtgcggcagaagatgcttctcgactacagcgtgtacatgggcaggtgtgtcccccaggaaagccgaagcccccagaggagccccctgcagagtgcggagagcagccccacagctgggaagaagttgccagaggttccaccctctgaggaggaagaacaggaagcctgggtgaatgccttgcttggaagaatattttgggacttcttaggagagaaatactggtctgatctggtgtctaagaagatccaaatgaaactcagcaaaataaagctcccctactttatgaatgagctcactctgacggaacttgacatgggcgtggctgtgccaaaaatcctccaggccttcaagccttacgttgatcaccaaggactctggattgatttggaaatgtcctacaatgggtcctttctgatgactctcgagaccaaaatgaatttgaccaaactaggtaaagagcctcttgttgaagccctgaaggttggagaaattggcaaagaaggttgcaggccccgggcattctgtctggcggacagcgatgaggaatcctccagcgctggctcctccgaggaagacgatgccccagagcccagcgggggagacaaacagctcctcccaggggctgaagggtacgttggaggtcatcgaacaagtaagattatgaggtttgttgataaaattaccaagtcaaaatatttccaaaaagcaacagagacagagtttattaaaaagaagatcgaagaagtctccaacacacccctgctgctcactgttgaagtacaagaatgtagaggaaccttggcggtcaacattccaccacccccgactgaccgagtatggtatggtttccgaaagccaccacatgtggagctgaaagctcggccaaaacttggagagagagaagtgactttagttcatgtgacagactggatagagaagaaactggagcaagagtttcagaaagtttttgtcatgccaaacatggatgatgtttatatcactataatgcactcagccatggaccctcgctctacttcctgcctcctgaaagacccacctgtggaggctgctgatcagccatgatgggtgatgtcagatgttccccatattgtgacatcgagctggatgtgtggggttcttggccgccatctgtactgtagcactggcctctgtgccacagctactgtttcttaaaggactgcttctgccctctgcctgccagtgcccattccactgtgaggtgtcattccctgcatctagtgacaactgtctggattgcctgctgcaaagctttgatttggcaaaggagaccatggaagaatcatggtggatccagaagttatacgtgacccacaccatggcttttaaaagtctacccatgtttgtggcagcaaatgagcacagtaagagcaaagctgaacaacttgcctcctctactcctccaaagcttttcttcaggcagccggtgcacagtggactttttcacttctatactttgtatgcggccttccacacttccagagaatgtcagtgtgcaatgtgtctggagggtggggagaggaattctgtgagccttttcatttcggtgacagaagagatgggcagagcaacttattttccacattaaattgtgcatttgggaagcaagtagccatagtacacacacaacacgctatcagcttgggtaaggacagtgggatttatgtgaacatcaggcaaagccatgagatcaaaccatcccaagcctttcaccaatgaggtacaaccacctgggggctagctaatcttgaatgttttcctgagacaggagcgtatgtgaaaacatcaaacactgcacatgacaggatgggtcctctcatacagatgggatggggttagaaagccagagccagtttttccatctggcgtttcctgtgtcctccaggtttatatgggaatcgaaacagtttgttaatctgattgggagagttccatgggcagatttcccttcctgaaggccaaaacggagaactgctctctttaattatttcaagagtcaagaccaaaagtttgctcagcatcacactacatctcaaaattaatgttgccaacttaattttgtgcatttgtgtcagaatgtttagtttacaaggttgggggctctctttgcttcgagaagtaaacctaataccatttttttattgtttaaagctgcattcaacgtcaaaattaccttgggtaacttttgataacttacatgtgtggacaaagctaatagtggttttttaaacagcaccttgcctgaacatgactttaaagaaattaatatattgaaaacatgtttgaacccttattttaattgcaccattaaaacatttgacttaaattgtttgaccattccaaaaaaaaaaaaaagaaaaaaaaaaaaaaaaaaaaaaaaaaaagggggggggccccaaaatcccccggggggccccttcggcgagcacccgggttttcctgtgaacaagggggcgcccctaataagggaggcgcctgtatataaacaagacagggagccctgggcgccgcgccgagtatcacaaacggggctcgtagatggtgtgggaaaaactctgtgtgtgacgctgggagggaatctttgtgggagaagagggaaccccttaatcttgtggggggggtgggacaatattgtgggggcacaaccttttcatcctacgaaagtattataacagggtctgtaggggggacaatctttctactctttttcaagtgttgtttatgtggttggttcacctagaggtgatataattgtatgggggcctgaaaaaattttggctcagggagtagtgtttgtgggacaaattattc

SEQ ID NO: 299778 - DNA, 3126 bp, Homo sapiens
cggggcggcgtgtgcccgggggcgggcgggcggcagggcagcaggaccgcggccggtgccccagccgaagccggagtcgcgcggccgggagcacgggcgccggcatagtacaatgaggcagccagcggatcttggagcctgagcccttgtgaagccggcaatgacaagtctgtatggtcgccatgccgagaaaaccactgacatgccaaaaccatcagcccctaaagtgcacgtgcagaggtccgtgtcccgagataccatcgccattcacttctcggcatccggcgaggaggaggaggaagaggaggaggagttcagggagtactttgaggaggggctggatgaccaaagcattgtaacagggctggaagccaaggaagacctctatcttgaaccccaagttggccatgaccccgccggccctgctgcctcgcctgtcctggcagatggactgtccgtgtcccaggcccctgccattattgcccgtctccaagaacactgtaaagctgttggagtcccctgttccagcagcacaagtattaagtacagtgccattgggctgtgtccccagggtcgtcttcgtcggggcccttagctagctctcccagatgtgtcatcccatttctgagcagaaaaccagttcttcctccccattgtcctctccttctaagtctcccatcctctcatccagtgcctcaagctccaccctttccagtgcaaaaaccttcatgagccttgtgaagtccctgtcgaccgaggtggagccaaaagaatccccacaccccgcaaggcacaggcacttgatgaagacattagtcaagtctctgtccacggacacttcccggcaggagtcggatacagtgtcctataagccacctgattccaaactgaacttacacctgttcaagcagttcacacagccccgaaacacaggtggagattccaaaactgcaccttcttccccactgacttctccctctgatactcgttccttttttaaagtgcccgaaatggaggctaaaattgaagatactaaacgacgcctttcagaagtcatctatgagccttttcagctccttagtaaaattataggggaagaaagtggcagccataggcccaaagccttatcttcaagtgcttcagaactctccaatctgtccagcttgaatgggcacttggaaagcaataacaactacagcatcaaggaggaggagtgtgattctgagggggatggctacggaagtgattccaacatccccagaagtgaccacccaaagtccactggtgagcccacaagagagatagaactgaaaagttcccaggggagcagtctgaaggatttaggcctgaagacaagttctctagttctggagaaatgttctttgtctgccttagtgagcaaagaagatgaagagttttgtgaactgtacactgaggacttcgatttggaaacggagggggagagtaaagttgataagctctcagatattcctctcaagccagaggtgctcgcggaagatggtgtggtccttgacagtgaggacgaggtggactcggccgtgcagcacccggaattgccagtgaagacgttgggcttctttataatgtgtgtctatgtgtacctcatcctccccctcccccactatgtgagtggactctttctgggaattggccttggattcatgactgcagtttgcgtgatttggttttttacaccaccaagtgctcataaatatcacaagttacacaaaaatctgcgacactggaacacaagatctctggatatcaaagaacctgaaatactgaagggatggatgaatgagatttacaactatgatccagaaacctaccatgcgactttgacacattcagtctttgttcgacttgagggtggaaccttaagactttcaaagcccaataaaaatatatccaggagggccagctacaatgaacccaagccagaggtcacctacatcagccagaaaatctatgacctctcagacagcaagatttatcttgtacctaaaactttggctcgaaagcgaatctggaataaaaagtaccccatttgtatcgagcttggtcagcaagatgactttatgtctaaagctcagactgataaggagacttcagaagagaagccgccagctgagggaagtgaggaccctaagaagccaccccgccctcaggagggaacaagatctagccagcgagatcagatactctatctctttgggagaactggccgagaaaaagaggaatggtttaggagatttattctggcatctaagctaaagtcggaaatcaagaagtcatcgggtgtctctggaggtaaaccagggcttttgcctgcacacagcagacacaacagtccgtccgggcacctgacccacagccgcagcagcagcaaaggcagtgtggaggagatcatgtcacagccaaagcagaaggagctggcaggcagcgtgcggcagaagatgcttctcgactacagcgtgtacatgggcaggtgtgtcccccaggaaagccgaagcccccagaggagccccctgcagagtgcggagagcagccccacagctgggaagaagttgccagaggttccaccctctgaggaggaagaacaggaagcctgggtgaatgccttgcttggaagaatattttgggacttcttaggagagaaatactggtctgatctggtgtctaagaagatccaaatgaaactcagcaaaataaagctcccctactttatgaatgagctcactctgacggaacttgacatgggcgtggctgtgccaaaaatcctccaggccttcaagccttacgttgatcaccaaggtaactcctaactgaccattctatgagtgttaaaatatatcctttgctgcagattcagtaccatgatggctttctgtttggagggtgttgaggactttttaaatcatctgtttcatgttgagtgtctttctgttcttaccagtcatggccttaaaactgatttggggccgggcatggtggcttacgcctgtaatcccagcattttgggaggccaaggcaggcggatcacctgaggtcaggaattcgaggccagcctggccaacatggcaaaacaccgtctctactaaaaaa

SEQ ID NO: 299779 - DNA, 955 bp, Homo sapiens
ggtggtggcgagggaggcggaagtgcggtgttctagcaggtggctgctttctctgggctggctgtgggaggctcccgaggtggggacccggccgggatggctgcagcggcggccggggctgggagcgggccctcggcggcccaggagaagcagttcctgccggcgctgctgagtttcttcatctacaacccgcgcttctggccgcgggaaggagaggttgttcggaatcctataattgaaaaacagtaaagatggaaaaccagttattgaatatcaagaggaggagttgttggacaaggtttatagctcggtgctgcagcagtgctacagcatgtacaagaagtctcaggggatccagaactgcagccagtccttgctgggctgttcctgtccatgtgcctggtcacggtgctggggaacctgctcatcatcctggccatcagccctgactcccacctccacacccccatgtacttcttcctctccaacctgtccttgcctgacatcggtttcacctccaccacggtccccaagatgattgtggacatccagtctcacagcagagtcatctcctatgcaggctgcctgactcagatgtctctctttgccatttttggaggcatggaagagagacatgctcctgagtgtgatggcctatgactggtttgtagccatctgtcacccgctatatcattcaccatcatgaacccgtgtttctgtgcctttctagttttgtgtctttttttctcagtcttttagactcccagctgcacaacttgattgccttacaagtgacctgcttcaaggatgtggaaattcctaatttcttctgtgacccttctcaactctcccatcttgcatgttgtgacaccttcaccattaacataatcatgtatttccctgctgccatatttggttttcttcccatcttggggacccttttctctttctctaa

SEQ ID NO: 299780 - DNA, 892 bp, Homo sapiens
ggtggtggcgagggaggcggaagtgcggtgttctagcaggtggctgctttctctgggctggctgtgggaggctcccgaggtggggacccggccgggatggctgcagcggcggccggggctgggagcgggccctcggcggcccaggagaagcagttcctgccggcgctgctgagtttcttcatctacaacccgcgcttctggccgcgggaaggagaggttgttcggaatcctataattgaaaaacagtaaagatggaaaaccagttattgaatatcaagaggaggagttgttggacaaggtttatagctcggtgctgcagcagtgctacagcatgtacaagaagtctcaggggatccagaactgcagccagtccttgctgggctgttcctgtccatgtgcctggtcacggtgctggggaacctgctcatcatcctggccatcagccctgactcccacctccacacccccatgtacttcttcctctccaacctgtccttgcctgacatcggtttcacctccaccacggtccccaagatgattgtggacatccagtctcacagcagagtcatctcctatgcaggctgcctgactcagatgtctctctttgccatttttggaggcatggaagagagacatgctcctgagtgtgatggcctatgactggtttgtagccatctgtcacccgctatatcattcaccatcatgaacccgtgtttctgtgcctttcttaaaaaaaaaaaaaaaaaaaaaagaaaaaaaaaaaaagggggggcttttttggggggggaaaaaagagtttaaaagggcacgggtaaggttgttggagcgccttttttgaaaggggaaaactggggggcccccaaagagggggataaatggaaaggggggacta

SEQ ID NO: 299781 - DNA, 771 bp, Homo sapiens
agatgtgcaaacctttatttcttacaagcattggtgtattacagattagctctaggaaagaaatatggagacttgagttttcataaaaattacctggtgctacttcagatgtgacttattgactatcgaaattgccttctgactgttgggcagtatttgcacaatgatgagataattcctgttattattttaatagagacgaggtctcacggtgttgcccaggctggtcttgaactcctgagctcaggtgatcctctcacctcggcctctcaaagtgctaggattacaattcctgtttttctaaaaccggtttttctttggttttgtcattagcatgtgcgacacaagaggtcgacactgaacttagcgttttcaatagctaagatgaaatgtttctattcatgatgtgcttctgtttcctcatgtttcaggaggaaaataagattttattttatcatccaaatgaggtagaaaagaagaagaggccgggctcggtggctcaagcctgtaatcccagcactttgggaggctgaggcgggcggatcacgaggtcaggagatcgagaccatcctggctaacacaatgaaaccccgtcaatactaaaaatacaaaaaaattagccgggcgtggtggcgggcgcctgtagtcccagctactcgggaggctgaggcaggagaatggcgtgaacccgggaggcggagcttgcagtgagcggagatcgcaccactgcactccagcctgggcgacagagcgagactccgtctccaaaaa

SEQ ID NO: 299782 - DNA, 836 bp, Homo sapiens
ggtggtggcgagggaggcggaagtgcggtgttctagcaggtggctgctttctctgggctggctgtgggaggctcccgaggtggggacccggccgggatggctgcagcggcggccggggctgggagcgggccctcggcggcccaggagaagcagttcctgccggcgctgctgagtttcttcatctacaacccgcgcttctggccgcgggaaggagagacctcccagtgccaagtgtataagcgtgtccagaattggtgggtctcactgacttcaagaatgaagccgcggaccctcctggcggaattctccacgagttttgagcagcctcggttttcccaccacctccaaatcatgcaagacacagggtaagagcaaagacaaggtggctgtggccgatgtccaccctctcggggcgtcccttctcttctctcctccttgagcagggagaccatcggggtgcaacctggttggggcggggaggaggtgcagggcctggccagagcgggcctggccacgggcaagggacagcgacccccgggccaggacaggtgagagcggcgcaggcccgggccggcgtggcggaggtgcgcgtgagcggcagcagagggcgccagagagccaggagcgggccgagaggagcccgcgccggccccggtgcccacctccgcgccggcgagccctccgagcccgcgctcagacgccccagctccgccgagaggccgcttgctgccggggtccttcttccccaaatgcaggcagagccccggagccatggccagcccttccggcagctccaaagccactggcaagccccgaggcagggatggccggcccag

SEQ ID NO: 299783 - DNA, 788 bp, Homo sapiens
aattcttaaaactgctgctggagaattgtcccaaacatatttttttaacctttgtaggacctttagcccatcaaaacctgcaaaatctttacatacgcagaagaacagacagttctttaatgaaccagaagaaaatttctggatggtcatggtatttacatacacagtgtatctttctgaaattgtatggtgaagttatgggtgatctttactattcagaatttagcaaagttctctggctattgcatccaagtaaaattaaaataaaattcgttgcagttttaaaatcaagttcttcctgtttgctttattcgttcttggggctgctttaagaagctgtgtttctggtgctgtagcatgtgcaaagtttttaaactaaggcaaaataaacatggtctaatgaattcattgtataatttcagtttatcaaactttgtaggttgttcggaatcctataattgaaaaacagtaaagatggaaaaccagttattgaatatcaagaggaggagttgttggacaaggtttatagctcggtgctgcagcagtgctacagcatgtacaagaaatttgtttcaatgaagaaactgtggtatacacacccaatgaagtattattcagcctaaaaaggaagaaactcctctccgctgcagacaaaatggatgagattgcaggtctgtatattaaaggaaagaagccaggcacagaatgacaaatatttcatgtcctcacttctatgtaggaagaaaaaagacaccttggccaggtgtggtggctcaggcctggaatcc

SEQ ID NO: 299784 - DNA, 384 bp, Homo sapiens
caggtcctgggtcgatgtctgtctatggaataaagccccgtcaggaggaaaataagattttattttatcatccaaatgaggtagaaaagaagaagaggccgggctcggtggctcaagcctgtaatcccagcactttgggaggctgaggcgggcggatcacgaggtcaggagatcgagaccatcctggctaacacaatgaaaccccgtcaatactaaaaatacaaaaaaattagccgggcgtggtggcgggcgcctgtagtcccagctactcgggaggctgaggcaggagaatggcgtgaacccgggaggcggagcttgcagtgagcggagatcgcaccactgcactccagcctgggcgacagagcgagactccgtctccaaaaa

SEQ ID NO: 299785 - DNA, 368 bp, Homo sapiens
ggtggtggcgagggaggcggaagtgcggtgttctagcaggtggctgctttctctgggctggctgtgggaggctcccgaggtggggacccggccgggatggctgcagcggcggccggggctgggagcgggccctcggcggcccaggagaagcagttcctgccggcgctgctgagtttcttcatctacaacccgcgcttctggccgcgggaaggagaggaggaaaataagattttattttatcatccaaatgaggtagaaaagtgctgggattacagacgtgagccaccgcactcggcctacagaaaatttttttaaaaattagccatgtgtggtgatgcgcacctgtagtcccagctactctggaggct

SEQ ID NO: 299786 - DNA, 907 bp, Homo sapiens
ggtggtggcgagggaggcggaagtgcggtgttctagcaggtggctgctttctctgggctggctgtgggaggctcccgaggtggggacccggccgggatggctgcagcggcggccggggctgggagcgggccctcggcggcccaggagaagcagttcctgccggcgctgctgagtttcttcatctacaacccgcgcttctggccgcgggaaggagaggttgttcggaatcctataattgaaaaacagtaaagatggaaaaccagttattgaatatcaagaggaggagttgttgaagtctcaggggatccagaactgcagccagtccttgctgggctgttcctgtccatgtgcctggtcacggtgctggggaacctgctcatcatcctggccatcagccctgactcccacctccacacccccatgtacttcttcctctccaacctgtccttgcctgacatcggtttcacctccaccacggtccccaagatgattgtggacatccagtctcacagcagagtcatctcctatgcaggctgcctgactcagatgtctctctttgccatttttggaggcatggaagagagacatgctcctgagtgtgatggcctatgactggtttgtagccatctgtcacccgctatatcattcaccatcatgaacccgtgtttctgtgcctttctagttttgtgtctttttttctcagtcttttagactcccagctgcacaacttgattgccttacaagtgacctgcttcaaggatgtggaaattcctaatttcttctgtgacccttctcaactctcccatcttgcatgttgtgacaccttcaccattaacataatcatgtatttccctgctgccatatttggttttcttcccatcttggggacccttttctctttctctaa

SEQ ID NO: 299787 - DNA, 924 bp, Homo sapiens
aaaagataggctgtattttctagcagttacgaatttgttatgtatgatgatctggttcttggaacattcttgaatctagtgtctctaaggcaggtgtgtacagcaagaagtgaataacacagaaatcaatgatgaaagcattagaagacaattgagtctgtcagaactgcaaaatattgctgagtgtggattgctctgaaatctgaaaacattacttgtgaattgcttctattctcgtttctaggcaaaggtgtccaaattatgcagacccacagaatctaacagatgtctctatattcctcctcctagaagtctcaggggatccagaactgcagccagtccttgctgggctgttcctgtccatgtgcctggtcacggtgctggggaacctgctcatcatcctggccatcagccctgactcccacctccacacccccatgtacttcttcctctccaacctgtccttgcctgacatcggtttcacctccaccacggtccccaagatgattgtggacatccagtctcacagcagagtcatctcctatgcaggctgcctgactcagatgtctctctttgccatttttggaggcatggaagagagacatgctcctgagtgtgatggcctatgactggtttgtagccatctgtcacccgctatatcattcaccatcatgaacccgtgtttctgtgcctttctagttttgtgtctttttttctcagtcttttagactcccagctgcacaacttgattgccttacaagtgacctgcttcaaggatgtggaaattcctaatttcttctgtgacccttctcaactctcccatcttgcatgttgtgacaccttcaccattaacataatcatgtatttccctgctgccatatttggttttcttcccatcttggggacccttttctctttctctaa

SEQ ID NO: 299788 - DNA, 795 bp, Homo sapiens
ggtggtggcgagggaggcggaagtgcggtgttctagcaggtggctgctttctctgggctggctgtgggaggctcccgaggtggggacccggccgggatggctgcagcggcggccggggctgggagcgggccctcggcggcccaggagaagcagttcctgccggcgctgctgagtttcttcatctacaacccgcgcttctggccgcgggaaggagaggttgttcggaatcctataattgaaaaacagtaaagatggaaaacctgctcatcatcctggccatcagccctgactcccacctccacacccccatgtacttcttcctctccaacctgtccttgcctgacatcggtttcacctccaccacggtccccaagatgattgtggacatccagtctcacagcagagtcatctcctatgcaggctgcctgactcagatgtctctctttgccatttttggaggcatggaagagagacatgctcctgagtgtgatggcctatgactggtttgtagccatctgtcacccgctatatcattcaccatcatgaacccgtgtttctgtgcctttctagttttgtgtctttttttctcagtcttttagactcccagctgcacaacttgattgccttacaagtgacctgcttcaaggatgtggaaattcctaatttcttctgtgacccttctcaactctcccatcttgcatgttgtgacaccttcaccattaacataatcatgtatttccctgctgccatatttggttttcttcccatcttggggacccttttctctttctctaa

SEQ ID NO: 299789 - DNA, 245 bp, Homo sapiens
ctgaaatctgaaaacattacttgtgaattgcttctattcaaaatgcagacacaatgccaggtgttggtttacttgtttcccatttttcaaccctcgtttctaggcaaaggtgtccaaattatgcagacccacagaatctaacagatgtctctatattcctcctcctagaagtctcaggggatccagaactgcagccagtccttgctgggctgttcctgtccatgtgcctggtcacggtgctgggg

SEQ ID NO: 299790 - DNA, 506 bp, Homo sapiens
aattcgcggccgcgtcgacacgacagaagggcggggcccaagatggcggccagccggtaccggcgttttcttaagctctgtgaggaatggccagtggacgagaccaaacggggccgggacttgggcgcttacctgcgacagcgggtagcacaggcctttcgggagggagagaatacccaggttgcagagcctgaggcctgtgatcagatgtacgagagcttagcgcgactccattcaaactactacaaacacaagtaccctcgccccagagacaccagcttcagtggcctgtcgttggaagagtacaagctgatcctgtccacagacaccttggaagagcttaaggaaatagataaaggcatgtggaagaaactgcaggagaagtttgcccccaagggtcctgaggaggatcataaggcctgagctcaggccttacctcgtgcacatacctaggtgtggagtcttgtacattgccatcgtcaataaaactgccccagtttcccctt

SEQ ID NO: 299791 - DNA, 836 bp, Homo sapiens
catccagtaacctgtatttacatgcaaatatattggtttatgcaaaacagcggaggcctcgggggagggttttttagtctcaagcttgtgcagtcattgaaaaagagacgcaaagctgtctctggggtactccacgtccgccttgcccctgggagctgggccggttccaggaggacgaagactgaattagctcggcttgcagagaaaggcgagcagcgcccctacacggagagtagcggtgcgcctacaaagtcgcgcatgcccactccggcctcccgctccactcctaaggcaggcggcgaggcttagtgcgcaagcgccattcgtcggcgccgactcctcccgctaaggcgggaacacgcggggcccaagatggcggccagccggtaccggcgttttcttaagctctgtgaggaatggccagtggacgagaccaaacggggccgggacttgggcgcttacctgcgacagcgggtagcacaggcctttcgggagggagagaatacccaggttgcagagcctgaggcctgtgatcagatgtacgagagcttagcgcgactccattcaaactactacaaacacaagtaccctcgccccagagacaccagcttcagtggcctgtcgttggaagagtacaagctgatcctgtccacagacaccttggaagagcttaaggaaatagataaaggcatgtggaagaaactgcaggagaagtttgcccccaagggtcctgaggaggatcataaggcctgagctcaggccttacctcgtgcacatacctaggtgtggagtcttgtacattgccatcgtcaataaaactgccccagtttcccctt

SEQ ID NO: 299792 - DNA, 392 bp, Homo sapiens
gagcaacctactggtgacttctcactgctagagaagttggagcaggaagggaacttgagttgaaaggttgcagagcctgaggcctgtgatcagatgtacgagagcttagcgcgactccattcaaactactacaaacacaagtaccctcgccccagagacaccagcttcagtggcctgtcgttggaagagtacaagctgatcctgtccacagacaccttggaagagcttaaggaaatagataaaggcatgtggaagaaactgcaggagaagtttgcccccaagggtcctgaggaggatcataaggcctgagctcaggccttacctcgtgcacatacctaggtgtggagtcttgtacattgccatcgtcaataaaactgccccagtttcccctt

SEQ ID NO: 299793 - DNA, 1081 bp, Homo sapiens
ggcagcaacgaaggctgggagatagtcccgccattggtccgcgctgcagcttgttctggcagcgagtttagttcaggaaatttgctgagaatttgttttcacagcaagcctcatatttttgttgcaaattgtgtggcgtaacttaccaaatgtttcctctgacaggacaagaaaagacctgcagcaccttgtagtgagaggctttgagggcctggcaagtctgaaatgtgctgtgttctgggttatgtgtgtgtccaccctgggattggggtcatggaaagcgcctaagggaggcctcagtgtccacctggacactggaaacatgggacttctggaaaagctccagagcaggggcttttttctgttaccttttttggtcagaaaagatactctttttttctccagtagttttgttaacgtgaaaatttaggctggtaaagcaaaacaatattataagaatatctaaaatttaacatgcacgtaaaattagatttcatggaacattagccctagagactttagacaaatggttccgtactggggggatggttttgccccccaggggacatgtggcaatgtctggagacatttttagttgtcacaactggtggtgcgggcagcggtgctactggcattagtgggtagaggccaggatgctttgaaacagccttcagtgatgcacaggccagcccacgacgaaaaattatctggcccaaagtgttggtagtgccaaggccaagaaaccctgctttggttcctgggtgtagggacgtgtatgttcttaaacaagagcccctcccgcctgcattgtggtggatgatggctgccttttcattgagtgcgggctgtgtgccaagcgagttacctccatgcttttctttaatccttacaacttttgagacaccttggaagagcttaaggaaatagataaaggcatgtggaagaaactgcaggagaagtttgcccccaagggtcctgaggaggatcataaggcctgagctcaggccttacctcgtgcacatacctaggtgtggagtcttgtacattgccatcgtcaataaaactgccccagtttcccctt

SEQ ID NO: 299794 - DNA, 942 bp, Homo sapiens
  misc_feature (46)..(46): n is a, c, g, or t
tatataaaaacgtctcaagcaaactatagcacctgcgcgcgtgagnggttgcccatatgttgcagagcctgaggcctgtgatcagatgtacgagagcttagcgcgactccattcaaactactacaaacacaagtaccctcgccccagagacaccagcttcagtggcctgtcgttggaagagtacaagctgatcctgtccacagacaccttggaagagcttaaggaaatagataaaggcatgtggaagaaactgcaggagaagtttgcccccaagggtcctgaggaggatcataaggcctgagctcaggccttacctcgtgcacatacctaggtgtggagtcttgtacattgcccctatccatataattcccccagataaccattggaagcaaacactactcacgcccttatacgcccgcactagtggacctctaacgtaatattctcttgcagtgagggacacaccacgatctacaatcattaacttaattgtgttaggtccttttcagactacccctgcaaatacctactacatatgcaagccattcatattatacattacctaaggcgtaaatcatttcccctcgcatttcatactatcgacatatgtacccccccagaacacaacgatatatttattgtctatcgacatatccgaaatctgttacattactaccaccactcccatggatctctatgtttacaatcgcacgacaataacccgataaaaacaaccacgtttcctacacgaatacctctctactcctccctcgatccattccccgaccaacacccaccccccacttacccagctacactattctctcccacttaccgttctcccgccgccctccttcctattatatgatccatatgcccgcacccccgatatgctcaatttcgccgaatatgtcatttacattagtcttctttatacccact

SEQ ID NO: 299795 - DNA, 436 bp, Homo sapiens
gttggcgctgcagctctgggattcattcattcatatagctcgtatttattgagcacctaccatatgcctggaacggtgctagggaaacagcagtgttaaacaggtgaagtcctgcccgcatgaagttttacattgtagttcaggacacaataagcaggagcagcactctgcaagggtgacccgccccccatgcccctcctgtctgccctgctggctgaggacacacacagggtcacctcgttattccatggaaccttggctcttactgatattgagcatccttctctctggaaccgtgagggacagggctgggcccacagcggccctggtgggtacaaagtggaagtgggttcttaacctcgtctgtgtctagactcctcaggatgttctgaaatgcataaaataaaatcgacaggactgccgtagaaaccagtta

SEQ ID NO: 299796 - DNA, 395 bp, Homo sapiens
  misc_feature (354)..(354): n is a, c, g, or t
tttgtaggattagattgttatctcacaacttgtgcaactgagctttgtcgagtcgagagctacgcgactccattcaactactacttcacaagtaccctcgccccagagacaccagcttcagtggcctgtcgttggaagagtacaagctgatcctgtccacagacaccttggaagagcttaaggaaatagataaaggcatgtggaagaaactgcaggagaagtttgcccccaagggtcctgaggaggatcataaggcctgagctcaggccttacctcgtgcacatacctaggtgtggagtcttgtacattgccatcgtcaataaaactgccccagtttccccttaacagaatatntaaatcattaaaaaaaaataaattggccttctttggcctca

SEQ ID NO: 299797 - DNA, 1649 bp, Homo sapiens
catccagtaacctgtatttacatgcaaatatattggtttatgcaaaacagcggaggcctcgggggagggttttttagtctcaagcttgtgcagtcattgaaaaagagacgcaaagctgtctctggggtactccacgtccgccttgcccctgggagctgggccggttccaggaggacgaagactgaattagctcggcttgcagagaaaggcgagcagcgcccctacacggagagtagcggtgcgcctacaaagtcgcgcatgcccactccggcctcccgctccactcctaaggcaggcggcgaggcttagtgcgcaagcgccattcgtcggcgccgactcctcccgctaaggcgggaacacgcggggcccaagatggcggccagccggtaccggcgttttcttaagctctgtgaggaatggccagtggacgagaccaaacggggccgggacttgggcgcttacctgcgacagcgggtagcacaggcctttcgggagggagagaatacccaggttgcagagcctgaggcctgtgatcagatgtacgagagcttagcgcgactccattcaaactactacaaacacaagtaccctcgccccagagacaccagcttcagtggcctgtcgttggaagagtacaagctgatcctgtccacagacaccttggaagagcttaaggaaatagataaaggcatgtggaagaaactgcaggagaagtttgcccccaagggtcctgaggaggatcataaggcctgagctcaggccttacctcgtgcacatacctaggtgtggagtcttgtacattgccatcgtcaataaaactgccccagtttccccttgaccttacggtttgggaatctcctctagctttcccagaaaggaagcccttgctgctctaaagaaagtttcagcctgagaagggatggtgattgagctatctgctgtgactgctgctcagggtagggaaatctcctggggagaggaaatgcaggtttccctctgggcctgatgagggtaatggggcctcggcacaaggtgcttcctgcattgccacgggagcccccgcccctctggcacgggtctggtgtctcctggcaagatactcaggctcccttttgttgtaggagctcctgggaggaagccaaaaatagcagtaaatactgaaaagggcatcctgttgcaaagagaaagcagtagggaggtgtgaggccgagagaggcaaaaagcctgcttggccctcatccccactgactcagagaaggatggaccttaggcctctatccctgaccttgcaaaaacccacattgcccagttggcttaagggacagggaagctatagacaggccttggccaagcggggcctcagctgcagttggcttcagcactgtgggcaggttctgtaggtggccacaagtcagaggccctgctggctgaggacacacacagggtcacctcgttattccatggaaccttggctcttactgatattgagcatccttctctctggaaccgtgagggacagggctgggcccacagcggccctggtgggtacaaagtggaagtgggttcttaacctcgtctgtgtctagactcctcaggatgttctgaaatgcataaaataaaatcgacaggactgccgtagaaaccagtta

SEQ ID NO: 299798 - DNA, 1690 bp, Homo sapiens
tttttttttcttactttttcacctctccccaagttgtctgcagatgtgtgtttttatcttcattttacagatgaggaacccgaagcgtagagggttaagtaatttgcttgaggggacccagagtgggagatgatgggctcggattcaggcccaaggccatccccctcccagtgcctgctcaactccacagcatgtgctgagtccacacaccaggattcaaatccctgctccacttcccagctgtgcaacctgagcaagttacttcactgcctcctgcctcagtttccacacctgaaaactggggacaggaagggctgtgtggagcaggccaaattttgcgatgaagcatctgggtctgtgggttgcacagcggacagcgcagggccatttctttgccctcatacggagcagggcaacgagcagcacatcccgctttgatgccgagggtgaggagagggcaggagaccactgacagcgtgctgggcacagagtctggcacacagtgctcagtccccgcaagcggtcacttctgttacctgtttgatctgctcttcaggagctgggtctccacctttttcaggaacacactgtgtgaaaagcaagccatgcttgtgtcgggaaagcccagtgggtccaatctatgtcatcaagttttagacttcagtccctctctctttttgtcttccccttttgcagacaccttggaagagcttaaggaaatagataaaggcatgtggaagaaactgcaggagaagtttgcccccaagggtcctgaggaggatcataaggcctgagctcaggccttacctcgtgcacatacctaggtgtggagtcttgtacattgccatcgtcaataaaactgccccagtttccccttgaccttacggtttgggaatctcctctagctttcccagaaaggaagcccttgctgctctaaagaaagtttcagcctgagaagggatggtgattgagctatctgctgtgactgctgctcagggtagggaaatctcctggggagaggaaatgcaggtttccctctgggcctgatgagggtaatggggcctcggcacaaggtgcttcctgcattgccacgggagcccccgcccctctggcacgggtctggtgtctcctggcaagatactcaggctcccttttgttgtaggagctcctgggaggaagccaaaaatagcagtaaatactgaaaagggcatcctgttgcaaagagaaagcagtagggaggtgtgaggccgagagaggcaaaaagcctgcttggccctcatccccactgactcagagaaggatggaccttaggcctctatccctgaccttgcaaaaacccacattgcccagttggcttaagggacagggaagctatagacaggccttggccaagcggggcctcagctgcagttggcttcagcactgtgggcaggttctgtaggtggccacaagtcagaggccctgctggctgaggacacacacagggtcacctcgttattccatggaaccttggctcttactgatattgagcatccttctctctggaaccgtgagggacagggctgggcccacagcggccctggtgggtacaaagtggaagtgggttcttaacctcgtctgtgtctagactcctcaggatgttctgaaatgcataaaataaaatcgacaggactgccgtagaaaccagtta

SEQ ID NO: 299799 - DNA, 1388 bp, Homo sapiens
tctaaatcctccctgctaacatgtgatccatgagcagcagcatgggcatcacctgggaactggttagaaatgcagaatcaggggccccacccatacctgcgttttccagggaggactcacgggtacattatagttggagctgcctcctggagactgtactggttcttgcgaggccaagtcttgacctcgaggtggcgctgctcttctccttgctaggcctcctggcctctggttgcccagggcctaggtgaaatgcagttagagagcagggcttgtgtgctgatctctcccctcccttcacttcctttctgccccggtgaccagtaccctcgccccagagacaccagcttcagtggcctgtcgttggaagagtacaagctgatcctgtccacagacaccttggaagagcttaaggaaatagataaaggcatgtggaagaaactgcaggagaagtttgcccccaagggtcctgaggaggatcataaggcctgagctcaggccttacctcgtgcacatacctaggtgtggagtcttgtacattgccatcgtcaataaaactgccccagtttccccttgaccttacggtttgggaatctcctctagctttcccagaaaggaagcccttgctgctctaaagaaagtttcagcctgagaagggatggtgattgagctatctgctgtgactgctgctcagggtagggaaatctcctggggagaggaaatgcaggtttccctctgggcctgatgagggtaatggggcctcggcacaaggtgcttcctgcattgccacgggagcccccgcccctctggcacgggtctggtgtctcctggcaagatactcaggctcccttttgttgtaggagctcctgggaggaagccaaaaatagcagtaaatactgaaaagggcatcctgttgcaaagagaaagcagtagggaggtgtgaggccgagagaggcaaaaagcctgcttggccctcatccccactgactcagagaaggatggaccttaggcctctatccctgaccttgcaaaaacccacattgcccagttggcttaagggacagggaagctatagacaggccttggccaagcggggcctcagctgcagttggcttcagcactgtgggcaggttctgtaggtggccacaagtcagaggccctgctggctgaggacacacacagggtcacctcgttattccatggaaccttggctcttactgatattgagcatccttctctctggaaccgtgagggacagggctgggcccacagcggccctggtgggtacaaagtggaagtgggttcttaacctcgtctgtgtctagactcctcaggatgttctgaaatgcataaaataaaatcgacaggactgccgtagaaaccagtta

SEQ ID NO: 299800 - DNA, 1894 bp, Homo sapiens
ggcagcaacgaaggctgggagatagtcccgccattggtccgcgctgcagcttgttctggcagcgagtttagttcaggaaatttgctgagaatttgttttcacagcaagcctcatatttttgttgcaaattgtgtggcgtaacttaccaaatgtttcctctgacaggacaagaaaagacctgcagcaccttgtagtgagaggctttgagggcctggcaagtctgaaatgtgctgtgttctgggttatgtgtgtgtccaccctgggattggggtcatggaaagcgcctaagggaggcctcagtgtccacctggacactggaaacatgggacttctggaaaagctccagagcaggggcttttttctgttaccttttttggtcagaaaagatactctttttttctccagtagttttgttaacgtgaaaatttaggctggtaaagcaaaacaatattataagaatatctaaaatttaacatgcacgtaaaattagatttcatggaacattagccctagagactttagacaaatggttccgtactggggggatggttttgccccccaggggacatgtggcaatgtctggagacatttttagttgtcacaactggtggtgcgggcagcggtgctactggcattagtgggtagaggccaggatgctttgaaacagccttcagtgatgcacaggccagcccacgacgaaaaattatctggcccaaagtgttggtagtgccaaggccaagaaaccctgctttggttcctgggtgtagggacgtgtatgttcttaaacaagagcccctcccgcctgcattgtggtggatgatggctgccttttcattgagtgcgggctgtgtgccaagcgagttacctccatgcttttctttaatccttacaacttttgagacaccttggaagagcttaaggaaatagataaaggcatgtggaagaaactgcaggagaagtttgcccccaagggtcctgaggaggatcataaggcctgagctcaggccttacctcgtgcacatacctaggtgtggagtcttgtacattgccatcgtcaataaaactgccccagtttccccttgaccttacggtttgggaatctcctctagctttcccagaaaggaagcccttgctgctctaaagaaagtttcagcctgagaagggatggtgattgagctatctgctgtgactgctgctcagggtagggaaatctcctggggagaggaaatgcaggtttccctctgggcctgatgagggtaatggggcctcggcacaaggtgcttcctgcattgccacgggagcccccgcccctctggcacgggtctggtgtctcctggcaagatactcaggctcccttttgttgtaggagctcctgggaggaagccaaaaatagcagtaaatactgaaaagggcatcctgttgcaaagagaaagcagtagggaggtgtgaggccgagagaggcaaaaagcctgcttggccctcatccccactgactcagagaaggatggaccttaggcctctatccctgaccttgcaaaaacccacattgcccagttggcttaagggacagggaagctatagacaggccttggccaagcggggcctcagctgcagttggcttcagcactgtgggcaggttctgtaggtggccacaagtcagaggccctgctggctgaggacacacacagggtcacctcgttattccatggaaccttggctcttactgatattgagcatccttctctctggaaccgtgagggacagggctgggcccacagcggccctggtgggtacaaagtggaagtgggttcttaacctcgtctgtgtctagactcctcaggatgttctgaaatgcataaaataaaatcgacaggactgccgtagaaaccagtta

SEQ ID NO: 299801 - DNA, 1127 bp, Homo sapiens
catccagtaacctgtatttacatgcaaatatattggtttatgcaaaacagcggaggcctcgggggagggttttttagtctcaagcttgtgcagtcattgaaaaagagacgcaaagctgtctctggggtactccacgtccgccttgcccctgggagctgggccggttccaggaggacgaagactgaattagctcggcttgcagagaaaggcgagcagcgcccctacacggagagtagcggtgcgcctacaaagtcgcgcatgcccactccggcctcccgctccactcctaaggcaggcggcgaggcttagtgcgcaagcgccattcgtcggcgccgactcctcccgctaaggcgggaacacgcggggcccaagatggcggccagccggtaccggcgttttcttaagctctgtgaggaatggccagtggacgagaccaaacggggccgggacttgggcgcttacctgcgacagcgggtagcacaggcctttcgggagggagagaatacccaggttgcagagcctgaggcctgtgatcagatgtacgagagcttagcgcgactccattcaaactactacaaacacaagtaccctcgccccagagacaccagcttcagtggcctgtcgttggaagagtacaagctgatcctgtccacagacaccttggaagagcttaaggaaatagataaaggcatgtggaagaaactgcaggagaagtttgcccccaagggtcctgaggaggatcataaggcctgagctcaggccttacctcgtgcacatacctaggtgtggagtcttgtacattgccatcgtcaataaaactgccccagtttccccttaaaaaaaaaaaaaaaaaaaaaaaacaaaactgtgtggggaccctcgcgcacccggagaaaagattgtttacaacctttcgttgggggcgcggcgacccgaaggtttagatggaccaccggcccaaaacggctgccagagaaaacccgggcccagaacaggcgcctggctttcccacccaaaaaaaaagccgcggggcgacacggcgtctcggaagacaatccacggggactcggaggcatgacgggtcttccacagggtcaggcatcgtaaaccgcgcgaggcgcgcggga

SEQ ID NO: 299802 - DNA, 1086 bp, Homo sapiens
catccagtaacctgtatttacatgcaaatatattggtttatgcaaaacagcggaggcctcgggggagggttttttagtctcaagcttgtgcagtcattgaaaaagagacgcaaagctgtctctggggtactccacgtccgccttgcccctgggagctgggccggttccaggaggacgaagactgaattagctcggcttgcagagaaaggcgagcagcgcccctacacggagagtagcggtgcgcctacaaagtcgcgcatgcccactccggcctcccgctccactcctaaggcaggcggcgaggcttagtgcgcaagcgccattcgtcggcgccgactcctcccgctaaggcgggaacacgcggggcccaagatggcggccagccggtaccggcgttttcttaagctctgtgaggaatggccagtggacgagaccaaacggggccgggacttgggcgcttacctgcgacagcgggtagcacaggcctttcgggagggagagaatacccaggttgcagagcctgaggcctgtgatcagatgtacgagagcttagcgcgactccattcaaactactacaaacacaagacaccttggaagagcttaaggaaatagataaaggcatgtggaagaaactgcaggagaagtttgcccccaagggtcctgaggaggatcataaggcctgagctcaggccttacctcgtgcacatacctaggtgtggagtcttgtacattgccatcgtcaataaaactgccccagtttccccttcgaaaaaaaagatagcacaaaacaaaatttttgggggccggtgggggccacgaggaaaagagttttgaaagccccacctgcggttgtggggggcgcgcgcgacccaataagagcaatgtcgaacacggttgggacaacacgggggccccgagagagaaccggtgagcgacgagcagtgtggcgtgggtgctcccaccgataataaaaaacggcggggggggaacacacgacgcggttgtgaacactcaaaggggggccagggagacagcggggcccaacaaggggccaggggaggcaaaataaatcgaggcgggagagag

SEQ ID NO: 299803 - DNA, 693 bp, Homo sapiens
cgcccgttgtattcagcgctctcccccggctgcaccttggaattgccgaagaagctttttttaaactccagatgggccgggtgcggcggttcacacctataattccagcactctttgagaggccgaggcgggaggatcgcttgagcccaggatgacctcctgggcaacatagtgggactccgtctctacaaatcaaaaaacaaacaaaaacttcaaatgcagaatctctaggggtggggtcttgacctcagagttttaaaagctctccaggtgattcaaggtgcagagagagttgagacccacaccaccagtggcagctggtgacagcctcagctttttgcttccttgtcacggtagcattacctcattatttcgcagtgttgtgtattgactgagctaatccccagttaactctgcaggtccccgctaagcgtttgcgttcttcctgagcccctgtaagcctgtgcagcaggtttgggtcctcagctcacgcagctgtgtgtgagtagtaggcctatgttcttgctttcctccaggttggcgctgcagctctgggattcattcattcatatagctcgtatttattgagcacctaccatatgcctggaacggtgctagggaaacagcagtgttaaacaggtgaagtcctgcccgcatgaagttttacattgtagttcaggacacaataagcag

SEQ ID NO: 299804 - DNA, 296 bp, Homo sapiens
atgattcatatgcaatatcaattgtagtcatcttaaatattatatagaatttgaaagccaagaatatcaaagaaaataactttttctccaaagaaataatggtaggtggcccactctaacagtatatataaaaagaagtaagataatggcaaaattatggcatatataaatgttaaatcagggatgtccaatcttttggctttcctgggccacattggaagaaaaattgtcttgggccacacataaaatacactaacactaacgatagctgatgagcttaaaaaaaaaaaaattga

SEQ ID NO: 299805 - DNA, 228 bp, Homo sapiens
tcttttttttttacaggaacacagatttgatgctttaataaaaaaaaaaatacgatttctgcaaaaggtgcttaacacggcccaggacgggctgtccggtggagtcagccctaggacccctgaaggatgcataaagacagagccggctcgccagcacgctcctgccagcaccgggacccactgcgagccactgcggggtgtccttcattaaaaaaaagtctggattgt

SEQ ID NO: 299806 - DNA, 2711 bp, Homo sapiens
tccgctgtttttttctccgcccctaagaggttgactccaaacccggagttccgctaggtccaacaggagggcttacggcgtgagcggcgtacctggggagaggcttaggcagcggcaaccgctgattggcagtaaaggggttcactccccatctcctgctcgggcgaaaccgggacagccaatcagagagagtactgacggaaacggcccaatcctggagcagggctgagggagggggcggggacaaatggctcaggtggactccgggctggagctgtcctgggggagcttgtttgcggcagcggctgctgctgccactgctgtgctgggggcccggtcgccaggcaaaaagccctcccacgtttgaggggagtcatgagccgtttcctgaatgtgttaagaagttggctggttatggtgtccatcatagccatggggaacacgctgcagagcttccgagaccacacttttctctatgaaaagctctacactggcaagccaaaccttgtgaatggcctccaagctcggacctttgggatctggacgctgctctcatcagtgattcgctgcctctgtgccattgacattcacaacaagacgctctatcacatcacactctggaccttcctccttgccctggggcatttcctctctgagttgtttgtctatggaactgcagctcccacgattggcgtcctggcacccctgatggtggcaagtttctccatcctgggtatgctggtcgggctccggtatctagaagtagaaccagtatccagacagaagaagagaaactgaggccagcattatcacctccaggactttctcgttttccaccttggccatcttcttccttcgtcgtctctcctctttaatttcttttctattccatcatctgcccttttattcacttttagcctctttttttaatttttaaaatttaaagatatgcatactgaaaagtatataacatgtacgtacaatttaaagaataattttaaagtgaatactacgtaactccatccaagtcaagaaattgccagcttctcggaagcccactgtgtctccttcccctacctgcaacctcttccaggctcccttttccagccttcccctttttcccttttattttcatgccttgatttgacttgtgtggtgggaacatgtgaactatgaaacttaaacctgctgcccacccagagcagctgtgaccaagggctgcctcaaggggttgtccacgcaggttgggctcctctctgctgctggacccaagactctgaaccttccaagggacaggcagttcttctaagaagggctcccctgtgtgtgagcaagaccacagctctccttctatctacagatgcatgagggttggaagagtctgggctgtttttagaccttctggtcagctgtatttgtgtaacaacttttgtaataaatagaaaaaccctctgctctgatcagttcttgtactttgacctctgctaagacaagagcatggctgcctcctctgagccctaggagaatcacagctttatgcctgattgaatacaccatagtgagtaggacagctcatgacacaggtcagcctggctgcctccggctccttactgtcatttgctcattcctcttgtattcttgaagtcaaatcttcttttttctcaccttcaagagtctgcgttcacaactaaacactaagtgccctttcttatttcctcctaaagaagaaacagattcttgagagagcagagacaaaaaaatagaactaggcagcatagatgaaacaactgcatgacatgggaagaagacaactaaaccccgaggagaatgcactggaatggacagttgctcttaaaccctacccagagggcctcccccagctggaccctcatacacagtgtgtgtatccaaaaggccattgctatttcagcaaatatttgttgagtacttctccatgccggacacttgggaaagagaaatgaacgacacaggcaatgcccctgccctgtgggccttatattatagtcaaggtaacagaatcaacaagccaacacaaaaataaagaacttcaaatagggataagaactctaacaaacacaaggtattttggtcaagaaggaatgtggggtgggcagtggggaacgtaacttaaattagatcatcagaaagtcctccctgaggagatggatttttttttgtttttttagagacggggtttcactctgtcacccaggctggagtgcagtggcacaatcacacctcactgcagcctcaacttcctgggctcaagtgatcctcctgcatcagcttcccaagtagctgggactgcaagtgtgtaccaccacatccagctaacatttttgggggtgggaagagatggggtcttactatgttgtccaggctaagaggtgggatttgagctgagacttgaatgcccaggagttaaatgtcttaagatatggagcaggccgttagaaaggagggagcagcaactggaaggtagaatagtcttattcaaggaataagaactatgtaatcacagcatggtgaagagttaggaagtgaaagaaaaggtcagaaaaggaggcaaggggcttataagggtgtgataagaagcttgatgtttacacttaaatacattgggaattctcttatcagttaagtctctttaggtgaaaggacaaaacctaccttaaactagcttaaacaat

SEQ ID NO: 299807 - DNA, 788 bp, Homo sapiens
gagaagaaaggtaccgtatgtatgttagtcactagtctttcctctgtatttaaggtttctccatcctgggtatgctggtcgggctccggtatctagaagtagaaccagtatccagacagaagaagagaaactgaggccagcattatcacctccaggactttctcgttttccaccttggccatcttcttccttcgtcgtctctcctctttaatttcttttctattccatcatctgcccttttattcacttttagcctctttttttaatttttaaaatttaaagatatgcatactgaaaagtatataacatgtacgtacaatttaaagaataattttaaagtgaatactacgtaactccatccaagtcaagaaattgccagcttctcggaagcccactgtgtctccttcccctacctgcaacctcttccaggctcccttttccagccttcccctttttcccttttattttcatgccttgatttgacttgtgtggtgggaacatgtgaactatgaaacttaaacctgctgcccacccagagcagctgtgaccaagggctgcctcaaggggttgtccacgcaggttgggctcctctctgctgctggacccaagactctgaaccttccaagggacaggcagttcttctaagaagggctcccctgtgtgtgagcaagaccacagctctccttctatctacagatgcatgagggttggaagagtctgggctgtttttagaccttctggtcagctgtatttgtgtaacaacttttgtaataaatagaaaaaccctc

SEQ ID NO: 299808 - DNA, 424 bp, Homo sapiens
ctctacccgcttaatgagatcaccactttgctgagacctggacgttcattctggatgcctgaaccattctcctctcagtttagcagatgaaaccttcagttttgccctagatgagaatatcgttgtgatcaaataaccagctcttcctcaggaacaagtgtcctttcttttaagtcttaatgacatcctgggttcttatttgtctgtatgaagtctgatacttttcctctgttctgaacaaacagtaactttggttcccatttctgtctgcttccttataggctctatcacatcacactctggaccttcctccttgccctggggcatttcctctctgagttgtttgtctatggaactgcagctcccacgattggcgtcctggcacccctgatggtggcaagtaagcatccaaccaccctagacc

SEQ ID NO: 299809 - DNA, 312 bp, Homo sapiens
tcgacttttttttttgtttcataagggctatcgtagttttcatgcgttctacccagccagagcagctgtgaccaagggctgcctcaaggggttgtccacgcaggttgggctcctctctgctgctggacccaagactctgaaccttccaagggacaggcagttcttctaagaagggctcccctgtgtgtgagcaagaccacagctctccttctatctacagatgcatgagggttggaagagtctgggctgtttttagaccttctggtcagctgtatttgtgtaacaacttttgtaataaatagaaaaaccctc

SEQ ID NO: 299810 - DNA, 737 bp, Homo sapiens
aacctgcctggtactcatccctccccagtcgtgatcagcgagatgcgtgtcggttgaatatgctgctacttatacatctgtgtctgtacattctttccatagagagtcgtactgtgcctgtggtattctagcatcatatttatagcaactcgtagctggggaggaacaatattatgattctattttaaatgatctaggaagggacccaagcctgggctgttaagaaatctaatatccatagtgtctgctaaatactctaactgtacatctctttagatcctttgggtccctgccccctcaacttcctgggctcaagtgatcctcctgcatcagcttcccaagtagctgggactgcaagtgtgtaccaccacatccagctaacatttttgggggtgggaagagatggggtcttactatgttgtccaggctaagaggtgggatttgagctgagacttgaatgcccaggagttaaatgtcttaagatatggagcaggccgttagaaaggagggagcagcaactggaaggtagaatagtcttattcaaggaataagaactatgtaatcacagcatggtgaagagttaggaagtgaaagaaaaggtcagaaaaggaggcaaggggcttataagggtgtgataagaagcttgatgtttacacttaaatacattgggaattctcttatcagttaagtctctttaggtgaaaggacaaaacctaccttaaactagcttaaacaat

SEQ ID NO: 299811 - DNA, 336 bp, Homo sapiens
ggctgagccaggaagtcgagaccagcctgggcaacacagtgagactccatatctatcaacaaacaaacaaaaggaggccggcatggtggcaagtttctccatcctgggtatgctggtcgggctccggtatctagaagtagaaccagtatccagacagaagaagagaaactgaggccagcattatcacctccaggactttctcgttttccaccttggccatcttcttccttcgtcgtctctcctctttaatttcttttctattccatcttgagcctgtgtctagacacaggctccagatggcagcagcctgcagcctgaagattttgccacttatta

SEQ ID NO: 299812 - DNA, 1452 bp, Homo sapiens
tccgctgtttttttctccgcccctaagaggttgactccaaacccggagttccgctaggtccaacaggagggcttacggcgtgagcggcgtacctggggagaggcttaggcagcggcaaccgctgattggcagtaaaggggttcactccccatctcctgctcgggcgaaaccgggacagccaatcagagagagtactgacggaaacggcccaatcctggagcagggctgagggagggggcggggacaaatggctcaggtggactccgggctggagctgtcctgggggagcttgtttgcggcagcggctgctgctgccactgctgtgctgggggcccggtcgccaggcaaaaagccctcccacgtttgaggggagtcatgagccgtttcctgaatgtgttaagaagttggctggttatggtgtccatcatagccatggggaacacgctgcagagcttccgagaccacacttttctctatgaaaagctctacactggcaagccaaaccttgtgaatggcctccaagctcggacctttgggatctggacgctgctctcatcagtgattcgctgcctctgtgccattgacattcacaacaagacgctctatcacatcacactctggaccttcctccttgccctggggcatttcctctctgagttgtttgtctatggaactgcagctcccacgattggcgtcctggcacccctgatggtggcaagtttctccatcctgggtatgctggtcgggctccggtatctagaagtagaaccagtatccagacagaagaagagaaactgaggccagcattatcacctccaggactttctcgttttccaccttggccatcttcttccttcgtcgtctctcctctttaatttcttttctattccatcatctgcccttttattcacttttagcctctttttttaatttttaaaatttaaagatatgcatactgaaaagtatataacatgtacgtacaatttaaagaataattttaaagtgaatactacgtaactccatccaagtcaagaaattgccagcttctcggaagcccactgtgtctccttcccctacctgcaacctcttccaggctcccttttccagccttcccctttttcccttttattttcatgccttgatttgacttgtgtggtgggaacatgtgaactatgaaacttaaacctgctgcccacccagagcagctgtgaccaagggctgcctcaaggggttgtccacgcaggttgggctcctctctgctgctggacccaagactctgaaccttccaagggacaggcagttcttctaagaagggctcccctgtgtgtgagcaagaccacagctctccttctatctacagatgcatgagggttggaagagtctgggctgtttttagaccttctggtcagctgtatttgtgtaacaacttttgtaataaatagaaaaaccctc

SEQ ID NO: 299813 - DNA, 1477 bp, Homo sapiens
tccgctgtttttttctccgcccctaagaggttgactccaaacccggagttccgctaggtccaacaggagggcttacggcgtgagcggcgtacctggggagaggcttaggcagcggcaaccgctgattggcagtaaaggggttcactccccatctcctgctcgggcgaaaccgggacagccaatcagagagagtactgacggaaacggcccaatcctggagcagggctgagggagggggcggggacaaatggctcaggtggactccgggctggagctgtcctgggggagcttgtttgcggcagcggctgctgctgccactgctgtgctgggggcccggtcgccaggcaaaaagccctcccacgtttgaggggagtcatgagccgtttcctgaatgtgttaagaagttggctggttatggtgtccatcatagccatggggaacacgctgcagagcttccgagaccacacttttctctatgaaaagctctacactggcaagccaaaccttgtgaatggcctccaagctcggacctttgggatctggacgctgctctcatcagtgattcgctgcctctgtgccattgacattcacaacaagacgctctatcacatcacactctggaccttcctccttgccctggggcatttcctctctgagttgtttgtctatggaactgcagctcccacgattggcgtcctggcacccctgatggtggcaagtttctccatcctgggtatgctggtcgggctccggtatctagaagtagaaccagtatccagacagaagaagagaaactgaggccagcattatcacctccaggactttctcgttttccaccttggccatcttcttccttcgtcgtctctcctctttaatttcttttctattccatcatctgcccttttattcacttttagcctctttttttaatttttaaaatttaaagatatgcatactgaaaagtatataacatgtacgtacaatttaaagaataattttaaagtgaatactacgtaactccatccaagtcaagaaattgccagcttctcggaagcccactgtgtctccttcccctacctgcaacctcttccaggctcccttttccagccttcccctttttcccttttattttcatgccttgatttgacttgtgtggtgggaacatgtgaactatgaaacttaaacctgctgcccacccagagcagctgtgaccaagggctgcctcaaggggttgtccacgcaggttgggctcctctctgctgctggacccaagactctgaaccttccaagggacaggcagttcttctaagaagggctcccctgtgtgtgagcaagaccacagctctccttctatctacagatgcatgagggttggaagagtctgggctgtttttagaccttctggtcagctgtatttgtgtaacaacttttgtaataaatagaaaaaccctcaaaaaaaaaaacaaagggcggccgc

SEQ ID NO: 299814 - DNA, 1385 bp, Homo sapiens
tccgctgtttttttctccgcccctaagaggttgactccaaacccggagttccgctaggtccaacaggagggcttacggcgtgagcggcgtacctggggagaggcttaggcagcggcaaccgctgattggcagtaaaggggttcactccccatctcctgctcgggcgaaaccgggacagccaatcagagagagtactgacggaaacggcccaatcctggagcagggctgagggagggggcggggacaaatggctcaggtggactccgggctggagctgtcctgggggagcttgtttgcggcagcggctgctgctgccactgctgtgctgggggcccggtcgccaggcaaaaagccctcccacgtttgaggggaacacgctgcagagcttccgagaccacacttttctctatgaaaagctctacactggcaagccaaaccttgtgaatggcctccaagctcggacctttgggatctggacgctgctctcatcagtgattcgctgcctctgtgccattgacattcacaacaagacgctctatcacatcacactctggaccttcctccttgccctggggcatttcctctctgagttgtttgtctatggaactgcagctcccacgattggcgtcctggcacccctgatggtggcaagtttctccatcctgggtatgctggtcgggctccggtatctagaagtagaaccagtatccagacagaagaagagaaactgaggccagcattatcacctccaggactttctcgttttccaccttggccatcttcttccttcgtcgtctctcctctttaatttcttttctattccatcatctgcccttttattcacttttagcctctttttttaatttttaaaatttaaagatatgcatactgaaaagtatataacatgtacgtacaatttaaagaataattttaaagtgaatactacgtaactccatccaagtcaagaaattgccagcttctcggaagcccactgtgtctccttcccctacctgcaacctcttccaggctcccttttccagccttcccctttttcccttttattttcatgccttgatttgacttgtgtggtgggaacatgtgaactatgaaacttaaacctgctgcccacccagagcagctgtgaccaagggctgcctcaaggggttgtccacgcaggttgggctcctctctgctgctggacccaagactctgaaccttccaagggacaggcagttcttctaagaagggctcccctgtgtgtgagcaagaccacagctctccttctatctacagatgcatgagggttggaagagtctgggctgtttttagaccttctggtcagctgtatttgtgtaacaacttttgtaataaatagaaaaaccctc

SEQ ID NO: 299815 - DNA, 988 bp, Homo sapiens
cccatgttgccactaggacctccatcctgcccagccacagagagtgaatggcctccaagctcggacctttgggatctggacgctgctctcatcagtgattcgctgcctctgtgccattgacattcacaacaagacgctctatcacatcacactctggaccttcctccttgccctggggcatttcctctctgagttgtttgtctatggaactgcagctcccacgattggcgtcctggcacccctgatggtggcaagtttctccatcctgggtatgctggtcgggctccggtatctagaagtagaaccagtatccagacagaagaagagaaactgaggccagcattatcacctccaggactttctcgttttccaccttggccatcttcttccttcgtcgtctctcctctttaatttcttttctattccatcatctgcccttttattcacttttagcctctttttttaatttttaaaatttaaagatatgcatactgaaaagtatataacatgtacgtacaatttaaagaataattttaaagtgaatactacgtaactccatccaagtcaagaaattgccagcttctcggaagcccactgtgtctccttcccctacctgcaacctcttccaggctcccttttccagccttcccctttttcccttttattttcatgccttgatttgacttgtgtggtgggaacatgtgaactatgaaacttaaacctgctgcccacccagagcagctgtgaccaagggctgcctcaaggggttgtccacgcaggttgggctcctctctgctgctggacccaagactctgaaccttccaagggacaggcagttcttctaagaagggctcccctgtgtgtgagcaagaccacagctctccttctatctacagatgcatgagggttggaagagtctgggctgtttttagaccttctggtcagctgtatttgtgtaacaacttttgtaataaatagaaaaaccctc

SEQ ID NO: 299816 - DNA, 1398 bp, Homo sapiens
tccgctgtttttttctccgcccctaagaggttgactccaaacccggagttccgctaggtccaacaggagggcttacggcgtgagcggcgtacctggggagaggcttaggcagcggcaaccgctgattggcagtaaaggggttcactccccatctcctgctcgggcgaaaccgggacagccaatcagagagagtactgacggaaacggcccaatcctggagcagggctgagggagggggcggggacaaatggctcaggtggactccgggctggagctgtcctgggggagcttgtttgcggcagcggctgctgctgccactgctgtgctgggggcccggtcgccaggcaaaaagccctcccacgtttgaggggagtcatgagccgtttcctgaatgtgttaagaagttggctggttatggtgtccatcatagccatggggaacacgctgcagagcttccgagaccacacttttctctatgttgggatctggacgctgctctcatcagtgattcgctgcctctgtgccattgacattcacaacaagacgctctatcacatcacactctggaccttcctccttgccctggggcatttcctctctgagttgtttgtctatggaactgcagctcccacgattggcgtcctggcacccctgatggtggcaagtttctccatcctgggtatgctggtcgggctccggtatctagaagtagaaccagtatccagacagaagaagagaaactgaggccagcattatcacctccaggactttctcgttttccaccttggccatcttcttccttcgtcgtctctcctctttaatttcttttctattccatcatctgcccttttattcacttttagcctctttttttaatttttaaaatttaaagatatgcatactgaaaagtatataacatgtacgtacaatttaaagaataattttaaagtgaatactacgtaactccatccaagtcaagaaattgccagcttctcggaagcccactgtgtctccttcccctacctgcaacctcttccaggctcccttttccagccttcccctttttcccttttattttcatgccttgatttgacttgtgtggtgggaacatgtgaactatgaaacttaaacctgctgcccacccagagcagctgtgaccaagggctgcctcaaggggttgtccacgcaggttgggctcctctctgctgctggacccaagactctgaaccttccaagggacaggcagttcttctaagaagggctcccctgtgtgtgagcaagaccacagctctccttctatctacagatgcatgagggttggaagagtctgggctgtttttagaccttctggtcagctgtatttgtgtaacaacttttgtaataaatagaaaaaccctc

SEQ ID NO: 299817 - DNA, 1134 bp, Homo sapiens
ctctacccgcttaatgagatcaccactttgctgagacctggacgttcattctggatgcctgaaccattctcctctcagtttagcagatgaaaccttcagttttgccctagatgagaatatcgttgtgatcaaataaccagctcttcctcaggaacaagtgtcctttcttttaagtcttaatgacatcctgggttcttatttgtctgtatgaagtctgatacttttcctctgttctgaacaaacagtaactttggttcccatttctgtctgcttccttataggctctatcacatcacactctggaccttcctccttgccctggggcatttcctctctgagttgtttgtctatggaactgcagctcccacgattggcgtcctggcacccctgatggtggcaagtttctccatcctgggtatgctggtcgggctccggtatctagaagtagaaccagtatccagacagaagaagagaaactgaggccagcattatcacctccaggactttctcgttttccaccttggccatcttcttccttcgtcgtctctcctctttaatttcttttctattccatcatctgcccttttattcacttttagcctctttttttaatttttaaaatttaaagatatgcatactgaaaagtatataacatgtacgtacaatttaaagaataattttaaagtgaatactacgtaactccatccaagtcaagaaattgccagcttctcggaagcccactgtgtctccttcccctacctgcaacctcttccaggctcccttttccagccttcccctttttcccttttattttcatgccttgatttgacttgtgtggtgggaacatgtgaactatgaaacttaaacctgctgcccacccagagcagctgtgaccaagggctgcctcaaggggttgtccacgcaggttgggctcctctctgctgctggacccaagactctgaaccttccaagggacaggcagttcttctaagaagggctcccctgtgtgtgagcaagaccacagctctccttctatctacagatgcatgagggttggaagagtctgggctgtttttagaccttctggtcagctgtatttgtgtaacaacttttgtaataaatagaaaaaccctc

SEQ ID NO: 299818 - DNA, 475 bp, Homo sapiens
tgggtttccactcttggaacttcccttccaactgtagacatttgaagagaatctgagaagttctcattctggaattccttctattccttctagttcccatgttgccactaggacctccatcctgcccagccacagagaggtcaggtccagctccctatctcccatgaaccaccagtgaaataggaggagtttggaaggaacctcaagtctccccttctgaacactcttgcttttttctgctacacagtgaatggcctccaagctcggacctttgggatctggacgctgctctcatcagtgattcgctgcctctgtgccattgacattcacaacaagacgtatgtaagggaaggaagagctttagcatccttttgttggaaatcagatgcgaggcatacctgttaccttgagtaatgggaactgttaatcattttaatgcattagcttagaatgtgaataataaaaaactcacagg

SEQ ID NO: 299819 - DNA, 446 bp, Homo sapiens
  misc_feature (365)..(365): n is a, c, g, or t
atcagatgaaaagaagaacatgaactggaagcaacttcccaaaaagccgtgcaaaaatctacttagcaccttaaagaaattgtatccccagctgtcttcagttcaccaaaaaactcaagaaggctcagcgattgacatgactccaattgaagcagatttctcctggcaaaagaagatgacacagcttgagatggaaattcaagaggcatttttgcgctttatggcgtctattttaaaaggatatagaacatatctcagaccaatcacagaggctccttcaaataaagccacagctgctgattcattgtttgaccgacaggatgatctttccatttcagtggcaatgcccatatattcccctttgncctctttcactggctgcagtgcttagtgcacctttaccatttatagttggagttgactcaaggtattttgatcttcgtcga

SEQ ID NO: 299820 - DNA, 560 bp, Homo sapiens
ttttgttatttagaagagtatatattattgatatatggatgttacctctgagtagcagtaagggcagcaattagaatagtgatgtttctctttttattatagaaacttttttggtaatagttttattgatatataattcacataacatataattcacctaacatataattcacccacttaaagggtactatttagtggtttagcatatttgcagagttgtgcaaacatcatcacaatcagtattagaacatttttatcaccccctaaagaaaccccataccctttagccatccctctgtaattctcccaaagctcccagttctaggcaaccagtaatctacttagtgtctgtatagatttgcctgttgtgaattctggaatcatattatgcatgccttttgtgatgagcttcttttacatagcataatgtcttcaaggttcatccaacctgtagcgtgtatcaacccttcacttcttttatggccaaataatattcccttaaatggatataccacatttatttatccattcatcagttgatggacatttgggttgtttcc

SEQ ID NO: 299821 - DNA, 1743 bp, Homo sapiens
ttggaggtcagaagaccgcgagattctcgccctgagcaacgagcgacggcctgacgtcggcggagggaagccggcccaggctcggtgaggaggcaaggttctgaggggacaggctgacctggaggaccagaggcccccggaggagcactgaaggagaagatctgccagtgggtctccattgcccagctcctgcccacactcccgcctgttgccctgaccagagtcatcatgcctcttgagcagaggagtcagcactgcaagcctgaagaaggccttgaggcccgaggagaggccctgggcctggtgggtgcgcaggctcctgctactgaggagcaggaggctgcctcctcctcttctactctagttgaagtcaccctgggggaggtgcctgctgccgagtcaccagatcctccccagagtcctcagggagcctccagcctccccactaccatgaactaccctctctggagccaatcctatgaggactccagcaaccaagaagaggaggggccaagcaccttccctgacctggagtccgagttccaagcagcactcagtaggaaggtggccgagttggttcattttctgctcctcaagtatcgagccagggagccggtcacaaaggcagaaatgctggggagtgtcgtcggaaattggcagtatttctttcctgtgatcttcagcaaagcttccagttccttgcagctggtctttggcatcgagctgatggaagtggaccccatcggccacttgtacatctttgccacctgcctgggcctctcctacgatggcctgctgggtgacaatcagatcatgcccaaggcaggcctcctgataatcgtcctggccataatcgcaagagagggcgactgtgcccctgaggagaaaatctgggaggagctgagtgtgttagaggtgtttgaggggagggaagacagtatcttgggggatcccaagaagctgctcacccaacatttcgtgcaggaaaactacctggagtaccggcaggtccccggcagtgatcctgcatgttatgaattcctgtggggtccaagggccctcgttgaaaccagctatgtgaaagtcctgcaccatatggtaaagatcagtggaggacctcacatttcctacccacccctgcatgagtgggttttgagagagggggaagagtgagtctgagcacgagttgcagccagggccagtgggagggggtctgggccagtgcaccttccggggccgcatcccttagtttccactgcctcctgtgacgtgaggcccattcttcactctttgaagcgagcagtcagcattcttagtagtgggtttctgttctgttggatgactttgagattattctttgtttcctgttggagttgttcaaatgttccttttaacggatggttgaatgagcgtcagcatccaggtttatgaatgacagtagtcacacatagtgctgtttatatagtttaggagtaagagtcttgttttttactcaaattgggaaatccattccattttgtgaattgtgacataataatagcagtggtaaaagtatttgcttaaaattgtgagcgaattagcaataacatacatgagataactcaagaaatcaaaagatagttgattcttgccttgtacctcaatctattctgtaaaattaaacaaatatgcaaaccaggatttccttgacttctttgagaatgcaagcgaaattaaatctgaataaataattcttcctcttca

SEQ ID NO: 299822 - DNA, 400 bp, Homo sapiens
ttggaggtcagaagaccgcgagattctcgccctgagcaacgagcgacggcctgacgtcggcggagggaagccggcccaggctcggtgaggaggcaagtaagacgctgagggaggactgaggcgggcctcacctcagacagagggcctcaaataatccagtgctgcctctgctgccgggcctgggccaccccgcaggggaagacttccaggctgggtcgccactacctcaccccgccgacccccgccgctttagccacggggaactctggggacagagcttaatgtggccagggcagggctggttagaagaggtcagggcccacgctgtggcaggaatcaaggtcaggaccccgagagggaactgagggcagcctaaccaccaccctcaccaccattcccg

SEQ ID NO: 299823 - DNA, 2087 bp, Homo sapiens
ttggaggtcagaagaccgcgagattctcgccctgagcaacgagcgacggcctgacgtcggcggagggaagccggcccaggctcggtgaggaggcaaggttctgaggggacaggctgacctggaggaccagaggcccccggaggagcactgaaggagaagatctgccagtgggtctccattgcccagctcctgcccacactcccgcctgttgccctgaccagagtcatcatgcctcttgagcagaggagtcagcactgcaagcctgaagaaggccttgaggcccgaggagaggccctgggcctggtgggtgcgcaggctcctgctactgaggagcaggaggctgcctcctcctcttctactctagttgaagtcaccctgggggaggtgcctgctgccgagtcaccagatcctccccagagtcctcagggagcctccagcctccccactaccatgaactaccctctctggagccaatcctatgaggactccagcaaccaagaagaggaggggccaagcaccttccctgacctggagtccgagttccaagcagcactcagtaggaaggtggccgagttggttcattttctgctcctcaagtatcgagccagggagccggtcacaaaggcagaaatgctggggagtgtcgtcggaaattggcagtatttctttcctgtgatcttcagcaaagcttccagttccttgcagctggtctttggcatcgagctgatggaagtggaccccatcggccacttgtacatctttgccacctgcctgggcctctcctacgatggcctgctgggtgacaatcagatcatgcccaaggcaggcctcctgataatcgtcctggccataatcgcaagagagggcgactgtgcccctgaggagaaaatctgggaggagctgagtgtgttagaggtgtttgaggggagggaagacagtatcttgggggatcccaagaagctgctcacccaacatttcgtgcaggaaaactacctggagtaccggcaggtccccggcagtgatcctgcatgttatgaattcctgtggggtccaagggccctcgttgaaaccagctatgtgaaagtcctgcaccatatggtaaagatcagtggaggacctcacatttcctacccacccctgcatgagtgggttttgagagagggggaagagtgagtctgagcacgagttgcagccagggccagtgggagggggtctgggccagtgcaccttccggggccgcatcccttagtttccactgcctcctgtgacgtgaggcccattcttcactctttgaagcgagcagtcagcattcttagtagtgggtttctgttctgttggatgactttgagattattctttgtttcctgttggagttgttcaaatgttccttttaacggatggttgaatgagcgtcagcatccaggtttatgaatgacagtagtcacacatagtgctgtttatatagtttaggagtaagagtcttgttttttactcaaattgggaaatccattccattttgtgaattgtgacataataatagcagtggtaaaagtatttgcttaaaattgtgagcgaattagcaataacatacatgagataactcaagaaatcaaaagatagttgattcttgccttgtacctcaatctattctgtaaaattaaacaaatatgcaaaccaggatttccttgacttctttgagaatgcaagcgaaattaaatctgaataaataattcttcctcttcaaaaaaaaaaaaaaaaaaaaaaaaaaaaaaaaaaaaaaaaaaaaaaaaaaaaaaaaaaaaaaaaaaaaaaaaaacaaaaaaaaaaaaaaaaaaaaaaaaaaaaaaaaaaaaaaaacctaattaaagaaaattgggcaaaatgggccatattgccatatattgacactacattcgcacaacttggaacaagtttaacaactggaaaacccgtaaaaatccccgattttacccaattttaaagctcttgccccattatccaatttggcaagttgccgaaatagccaaaagtcccagacctttcaaacctttgaaacactttgaaagcctaaatgacttcggaacatt

SEQ ID NO: 299824 - DNA, 1666 bp, Homo sapiens
cgggaatggcggccaggcacgttctgaggggacaggctgacctggaggaccagaggcccccggaggagcactgaaggagaagatctgccagtgggtctccattgcccagctcctgcccacactcccgcctgttgccctgaccagagtcatcatgcctcttgagcagaggagtcagcactgcaagcctgaagaaggccttgaggcccgaggagaggccctgggcctggtgggtgcgcaggctcctgctactgaggagcaggaggctgcctcctcctcttctactctagttgaagtcaccctgggggaggtgcctgctgccgagtcaccagatcctccccagagtcctcagggagcctccagcctccccactaccatgaactaccctctctggagccaatcctatgaggactccagcaaccaagaagaggaggggccaagcaccttccctgacctggagtccgagttccaagcagcactcagtaggaaggtggccgagttggttcattttctgctcctcaagtatcgagccagggagccggtcacaaaggcagaaatgctggggagtgtcgtcggaaattggcagtatttctttcctgtgatcttcagcaaagcttccagttccttgcagctggtctttggcatcgagctgatggaagtggaccccatcggccacttgtacatctttgccacctgcctgggcctctcctacgatggcctgctgggtgacaatcagatcatgcccaaggcaggcctcctgataatcgtcctggccataatcgcaagagagggcgactgtgcccctgaggagaaaatctgggaggagctgagtgtgttagaggtgtttgaggggagggaagacagtatcttgggggatcccaagaagctgctcacccaacatttcgtgcaggaaaactacctggagtaccggcaggtccccggcagtgatcctgcatgttatgaattcctgtggggtccaagggccctcgttgaaaccagctatgtgaaagtcctgcaccatatggtaaagatcagtggaggacctcacatttcctacccacccctgcatgagtgggttttgagagagggggaagagtgagtctgagcacgagttgcagccagggccagtgggagggggtctgggccagtgcaccttccggggccgcatcccttagtttccactgcctcctgtgacgtgaggcccattcttcactctttgaagcgagcagtcagcattcttagtagtgggtttctgttctgttggatgactttgagattattctttgtttcctgttggagttgttcaaatgttccttttaacggatggttgaatgagcgtcagcatccaggtttatgaatgacagtagtcacacatagtgctgtttatatagtttaggagtaagagtcttgttttttactcaaattgggaaatccattccattttgtgaattgtgacataataatagcagtggtaaaagtatttgcttaaaattgtgagcgaattagcaataacatacatgagataactcaagaaatcaaaagatagttgattcttgccttgtacctcaatctattctgtaaaattaaacaaatatgcaaaccaggatttccttgacttctttgagaatgcaagcgaaattaaatctgaataaataattcttcctcttca

SEQ ID NO: 299825 - DNA, 1691 bp, Homo sapiens
gagacaaagtctcactcttgcccaggctggagtgcactggtgcgatctcggctccctgcaatgcctgactcccaggttcaagccattcttgtgcctcagcctcccaagtagctgggatttcaggcgtgagccactgcgcctgcccttgttacgatttttaaaagcttacctggttgtagtttaagcctcagatggtggttaccccagatattgcaagtgtcagctcttttggctgtttccagagaccagcctgtatttctgtgtccctgtctgtgttggtagggcatggagttgagtgtgggctgggtatccagttgtgggttgggaagctttgggggaaggaagataggttctttgaatacatacattagcttcattgttactaaaaccacccagattcagagagtagtggacacccaggatgttgattggctggtttgtaacgtgttttttcatgagaaacatcctttgggctactagggattgggcacatttgtgctgcttgccacctgatgtcttgagtcaccttttttgatcagacagttctcagtccatgggttagtgaaacaaataggctctcaagaatcttagtgtgggggttgttaactttcccgtgttggttttcagccgcctttgttgtatacacacatatcccaaacgccggaacaaggctctgtttccaagtgtgccgatgttgaattttgcattgggccctgaggtcactggtgggtgggggtgggtaggctgaagtggatagctgcaactcactaaacactcttttcctttgagggtcaaggtttgctaaataggggaaaactaagcttctttctcttttctttccaatggccttggtggtattggcatggggttaggaccaggagggcaacccattgatgccaatcacctgaataaaggcatcggaatgggaaacataggtcccgcaggtgagaatgacagtgcaccttgcttggtggtttggggaagtgaaaattattaattattggggcaactggactttgagtagtttaaatggaataaatatttaactgggacaaaattccctccttattcatctctgcctcattttgaataaaggcagtattttgtatttttatcaagttgagtcattttttaaaaagtcattatgctttttcattgtaacctcacaacaaccttctaagctgaaatagttgtgccatttgataagaggaggcaagccatagagttgatcttgctcaaggtcacactgtcagttactgacaggctgcaggtctcctgaccacgggaccatagcactgccgcagtgccctgaaaagtgtcttaccaagacccctttgggccctcctggtgtttgcacagctgctgctagagagctaggggcattgacagatgcaaaaaaggtggagaggccaggcacggtggctcacgcctgtaatcccagcactttgggaggccgaggtgggcggatcacaaggtcaggagtttgagaccatcctggccaacatggtgaaaccccatctctactaaaaataaaacaattagccgggcgtggtggcgcacgcctgtaatcccagttactcaagaggctgaggcaggagaattgcttgaacccgggaggcggaggttgcagtgagctgagatcacatgactgcacttcagcctggcaacagagcgagagtccgtctccagaa

SEQ ID NO: 299826 - DNA, 1007 bp, Homo sapiens
gaacttgcccctgaggacccctccaccctacctgccctgggccctctcttaggcactgagttcccacctctggcattgtggccctaccacctttggtactcctggagtagagcctttgccctctagggctctgtccacggcgttgacacatatctggatgcttaacgggtgctcaaatgaataagtgaaacctgctggctttcatttggacagtacagacgtgtccattggattgcggatggctttgtaaccaggggcggtggcatatcaaaaatgaagactttgtaaaatgtatgggaactttctgcctataaagctggctttacactgtgccttcttttttgaacttcctgaagcgtaaaggcgtgcattgaatccgccaggaaggcttttcatggggcaggggcaggctctgttagcagaagaatggcagtgtggctgagggggccgtagtcattggttctcgccattgtattctgagcctttgtgctctaggcttcagggcctctcctttttgactctgtccaccaaaatctaacaaaatcgggactgagtgtcgtctcttcttccctccctgtcctaggccacgtgctgtacgccgacatcaagatggagaatgggaagtccaaggggtgtggtgtggttaagttcgagtcgccagaggtggccgagagagcctgccggatgatgaatggcatgaagctgagtggccgagagattgacgttcgaattgatagaaacgcttaagcagttgccttttttaaacatcgatacgagacctctgaatttgtattttttcttgttaaccattttaatttgttggctggatgtataaagatgtttaaaaaattcagttgctttttggggtaatttgaattacttttttaatgactggggttccatttgactgtttgcattgagattgcaatgtgcgcaattttttttgtagttgtggcatcttgttgacatcgaatatgactttgataataaataccggttcctgaaaa

SEQ ID NO: 299827 - DNA, 2894 bp, Homo sapiens
aagacacaatgttttaagaaagtttacgaatcgtgtgccggaccgcgggttgaacaagcttcatctaaaacttccaggaatctctagacaggatcattgcttcccctctgctccagctctggttacagaaagctgagagtgactaggtctaggtgtttgtgtggggtggggtggggagatgcctcctctatcggactcagaggacgcgcgccgggaacagccagtcggtgcctaacgcgagtgtatctcgagagagaagcgatcaacagctgccggtctgcgcctgcgcggcggcgggggcgtggcccgcgggcgagtggggccaaggaggcagccgggagcggcgggcgcaggtgttactggttgcgtcgggtcacgtgggcgcgcaggcagcaccgcggtgcagcccgttcgctcacacaaagcccagacgcggagaaaatggcggcaggggtcgaagcggcggcggaggtggcggcgacggagatcaaaatggaggaagagagcggcgcgcccggcgtgccgagcggcaacggggctccgggccctaagggtgaaggagaacgacctgctcagaatgagaagaggaaggagaaaaacataaaaagaggaggcaatcgctttgagccatatgccaatccaactaaaagatacagagccttcattacaaacataccttttgatgtgaaatggcagtcacttaaagacctggttaaagaaaaagttggtgaggtaacatacgtggagctcttaatggacgctgaaggaaagtcaaggggatgtgctgttgttgaattcaagatggaagagagcatgaaaaaagctgcggaagtcctaaacaagcatagtctgagcggaagaccactgaaagtcaaagaagatcctgatggtgaacatgccaggagagcaatgcaaaaggtgatggctacgactggtgggatgggtatgggaccaggtggcccaggaatgattactatcccacccagtatcctaaataatcccaacatcccaaatgagattatccatgcattacaggctggaagacttggaagcacagtatttgtagcaaatctggattataaagttggctggaagaaactgaaggaagtatttagtatggctggtgtggtggtccgagcagacattcttgaagataaagatggaaaaagtcgtggaataggcactgttacttttgaacagtccattgaagctgtgcaagctatatctatgttcaatggccagctgctatttgatagaccaatgcacgtcaagatggatgagagggccttaccaaaaggagatttcttccctcctgagcgtccacaacaacttccccatggccttggtggtattggcatggggttaggaccaggagggcaacccattgatgccaatcacctgaataaaggcatcggaatgggaaacataggtcccgcaggaatgggaatggaaggcataggatttggaataaataaaatgggaggaatggaggggccctttggtggtggtatggaaaacatgggtcgatttggatctgggatgaacatgggcaggataaatgaaatcctaagtaatgcactgaagagaggagagatcattgcaaagcagggaggaggtggaggtggaggaagcgtccctgggatcgagaggatgggtcctggcattgaccgcctcgggggtgccggcatggagcgcatgggcgcgggcctgggccacggcatggatcgcgtgggctccgagatcgagcgcatgggcctggtcatggaccgcatgggctccgtggagcgcatgggctccggcattgagcgcatgggcccgctgggcctcgaccacatggcctccagcattgagcgcatgggccagaccatggagcgcattggctctggcgtggagcgcatgggtgccggcatgggcttcggccttgagcgcatggccgctcccatcgaccgtgtgggccagaccattgagcgcatgggctctggcgtggagcgcatgggccctgccatcgagcgcatgggcctgagcatggagcgcatggtgcccgcaggtatgggagctggcctggagcgcatgggccccgtgatggatcgcatggccaccggcctggagcgcatgggcgccaacaatctggagcggatgggcctggagcgcatgggcgccaacagcctcgagcgcatgggcctggagcgcatgggtgccaacagcctcgagcgcatgggccccgccatgggcccggccctgggcgctggcattgagcgcatgggcctggccatgggtggcggtggcggtgccagctttgaccgtgccatcgagatggagcgtggcaacttcggaggaagcttcgcaggttcctttggtggagctggaggccatgctcctggggtggccaggaaggcctgccagatatttgtgagaaatctgccattcgatttcacatggaagatgctaaaggacaaattcaacgagtgcggccacgtgctgtacgccgacatcaagatggagaatgggaagtccaaggggtgtggtgtggttaagttcgagtcgccagaggtggccgagagagcctgccggatgatgaatggcatgaagctgagtggccgagagattgacgttcgaattgatagaaacgcttaagcagttgccttttttaaacatcgatacgagacctctgaatttgtattttttcttgttaaccattttaatttgttggctggatgtataaagatgtttaaaaaattcagttgctttttggggtaatttgaattacttttttaatgactggggttccatttgactgtttgcattgagattgcaatgtgcgcaattttttttgtagttgtggcatcttgttgacatcgaatatgactttgataataaataccggttcctgaaaa

SEQ ID NO: 299828 - DNA, 2777 bp, Homo sapiens
aagacacaatgttttaagaaagtttacgaatcgtgtgccggaccgcgggttgaacaagcttcatctaaaacttccaggaatctctagacaggatcattgcttcccctctgctccagctctggttacagaaagctgagagtgactaggtctaggtgtttgtgtggggtggggtggggagatgcctcctctatcggactcagaggacgcgcgccgggaacagccagtcggtgcctaacgcgagtgtatctcgagagagaagcgatcaacagctgccggtctgcgcctgcgcggcggcgggggcgtggcccgcgggcgagtggggccaaggaggcagccgggagcggcgggcgcaggtgttactggttgcgtcgggtcacgtgggcgcgcaggcagcaccgcggtgcagcccgttcgctcacacaaagcccagacgcggagaaaatggcggcaggggtcgaagcggcggcggaggtggcggcgacggagatcaaaatggaggaagagagcggcgcgcccggcgtgccgagcggcaacggggctccgggccctaagggtgaaggagaacgacctgctcagaatgagaagaggaaggagaaaaacataaaaagaggaggcaatcgctttgagccatatgccaatccaactaaaagatacagagccttcattacaaacataccttttgatgtgaaatggcagtcacttaaagacctggttaaagaaaaagttggtgaggtaacatacgtggagctcttaatggacgctgaaggaaagtcaaggggatgtgctgttgttgaattcaagatggaagagagcatgaaaaaagctgcggaagtcctaaacaagcatagtctgagcggaagaccactgaaagtcaaagaagatcctgatggtgaacatgccaggagagcaatgcaaaaggctggaagacttggaagcacagtatttgtagcaaatctggattataaagttggctggaagaaactgaaggaagtatttagtatggctggtgtggtggtccgagcagacattcttgaagataaagatggaaaaagtcgtggaataggcactgttacttttgaacagtccattgaagctgtgcaagctatatctatgttcaatggccagctgctatttgatagaccaatgcacgtcaagatggatgagagggccttaccaaaaggagatttcttccctcctgagcgtccacaacaacttccccatggccttggtggtattggcatggggttaggaccaggagggcaacccattgatgccaatcacctgaataaaggcatcggaatgggaaacataggtcccgcaggaatgggaatggaaggcataggatttggaataaataaaatgggaggaatggaggggccctttggtggtggtatggaaaacatgggtcgatttggatctgggatgaacatgggcaggataaatgaaatcctaagtaatgcactgaagagaggagagatcattgcaaagcagggaggaggtggaggtggaggaagcgtccctgggatcgagaggatgggtcctggcattgaccgcctcgggggtgccggcatggagcgcatgggcgcgggcctgggccacggcatggatcgcgtgggctccgagatcgagcgcatgggcctggtcatggaccgcatgggctccgtggagcgcatgggctccggcattgagcgcatgggcccgctgggcctcgaccacatggcctccagcattgagcgcatgggccagaccatggagcgcattggctctggcgtggagcgcatgggtgccggcatgggcttcggccttgagcgcatggccgctcccatcgaccgtgtgggccagaccattgagcgcatgggctctggcgtggagcgcatgggccctgccatcgagcgcatgggcctgagcatggagcgcatggtgcccgcaggtatgggagctggcctggagcgcatgggccccgtgatggatcgcatggccaccggcctggagcgcatgggcgccaacaatctggagcggatgggcctggagcgcatgggcgccaacagcctcgagcgcatgggcctggagcgcatgggtgccaacagcctcgagcgcatgggccccgccatgggcccggccctgggcgctggcattgagcgcatgggcctggccatgggtggcggtggcggtgccagctttgaccgtgccatcgagatggagcgtggcaacttcggaggaagcttcgcaggttcctttggtggagctggaggccatgctcctggggtggccaggaaggcctgccagatatttgtgagaaatctgccattcgatttcacatggaagatgctaaaggacaaattcaacgagtgcggccacgtgctgtacgccgacatcaagatggagaatgggaagtccaaggggtgtggtgtggttaagttcgagtcgccagaggtggccgagagagcctgccggatgatgaatggcatgaagctgagtggccgagagattgacgttcgaattgatagaaacgcttaagcagttgccttttttaaacatcgatacgagacctctgaatttgtattttttcttgttaaccattttaatttgttggctggatgtataaagatgtttaaaaaattcagttgctttttggggtaatttgaattacttttttaatgactggggttccatttgactgtttgcattgagattgcaatgtgcgcaattttttttgtagttgtggcatcttgttgacatcgaatatgactttgataataaataccggttcctgaaaa

SEQ ID NO: 299829 - DNA, 918 bp, Homo sapiens
agcacacccagctcatttcaggcagggctggcatgctcaaggatttccgcgcagagctcatttgttagcgttgaggttgtccgtggagctgcagctttaatttgctctatgataatgagaggtgcctctgggtggataaatgtgggctccaagtgggtgatgctgggcggtcttctgaacaagaagttggctggggtgggggtgggggcttactttccagctcaggggaggcaaggaagcctcagtcctgagagcctggaccagctttagaaaactgccgctgagcgagacccgatggccctcttcttgctctggctctcagttcatgaatgcatatgactcctatctctgctgggcgcattcgcaggtgaccccgcacgctgggcctcagactctggagctacgtggggtcttggcatcgtgacccagcatcaaggactctcctagttctctgtaaaatgatcttgtctgtgcgtgtgtttctcaaacccctttccctttatcttgtcatttttattagtagtatttctactctggaatctgtaatgagcacatttctattgccatagaggaatttggctaatttttttttcttcctgatttccttagaaatcctaagtaatgcactgaagagaggagagatcattgcaaagcagggaggaggtaggaaccgcttagtttgatgtttagtttttttagaacaggctgttatcgctggggactgtagagcttagtggtgagacgtgcgggttctgacacagactgcccggggtgggagcagctctgcctttttctagctgtgtgacgtttggcaagtcactgaacctctctgtttctcatagcactcatttgtaaaatgggggtgtaatagtacctgcctcagggatgctgtggagagtgaatgcatgtgaaagagtg

SEQ ID NO: 299830 - DNA, 177 bp, Homo sapiens
aaagcctatgatcagtgcgcccgctcataaggggatggccatggctaggatttggaataaataaaatgggaggaatggaggggccctttggtggtggtatggaaaacatgggtcgatttggatctgggatgaacatgggcaggataaatgggtaagcatcgtgttttcttcctgctt

SEQ ID NO: 299831 - DNA, 3476 bp, Homo sapiens
ccttcttgccgatcctcctctgagggtcccgccctctcgcgctgctcagtcccaaatgtctcctttgataagcacccataacacaggcccacctgctctgacagactcctctgcaggccttccctctccgctgactcattccctgagaaggaccactattcatcacccatctgcctcatcccaatgtctcctttggccacgctctctccataggaccctaccatgattctggagagtgcattttacatgcatgtcttttgatgtgaaatggcagtcacttaaagacctggttaaagaaaaagttggtgaggtaacatacgtggagctcttaatggacgctgaaggaaagtcaaggggatgtgctctgagagaatttcttctgtggatttactacatgaaaaatgtaactgtatggtggcgtggaatcgaatgaaatcaggaaggcagtgagtgctcatgttacagtagctatgtttgattttgccaaacatttgagtggggtgggaggggatttgcaaatgggagtcccgcttttccaaatggctggccaaagagctttttggtattctgtttggatgcccaatttggataactggggaccaatagcagcattgtctctttgttaacagaggaattggctgtgtgtgaattatgcatggaattttagcggtggtataattaatgtaaaacgtgtgttcttgtctagaaaatgttactcttggttgtttgctgaatttgaaagttgtgtgaaccaaagattccgaaaagttgcctttgtgccagtaaattgtaaaccaaatattaaaaacctgaatgttcaaaattggcctagtttaaagagaacataaactattttctgtcgtgcaatagaatggcttagaataatcaaaaggatgagcttaacttacggaagggatggatttaggaggaatatggtaaggactcgattgagtacagagggaagcagatctaaagttggtgtgatttcttggagaccctgaatttaggtctgcttattaaatgtcagcagctctagtgcaatgctggtaacgcgtaggagaaggagatattaaggagcccagcttttaacaaggaaggcgaggcgaggcacttctgtcagcttccccttagaagggttcattttaaaagactaactttgtgacataaatcatatttttagtttgtttataactgtcattggtatttactatttttttcttttctttttccccttccttgctcttctgactggtctctggcttcctccaaagggatgtgcgtaagtatcgtctagttacttattggtatttgagccttctaacttgtaggactggtttcactcgactcgtttccttttgactctatagtgttgttgaattcaagatggaagagagcatgaaaaaagctgcggaagtcctaaacaagcatagtctgagcggaagaccactgaaagtcaaagaagatcctgatggtgaacatgccaggagagcaatgcaaaaggtgatggctacgactggtgggatgggtatgggaccaggtggcccaggaatgattactatcccacccagtatcctaaataatcccaacatcccaaatgagattatccatgcattacaggctggaagacttggaagcacagtatttgtagcaaatctggattataaagttggctggaagaaactgaaggaagtatttagtatggctggtgtggtggtccgagcagacattcttgaagataaagatggaaaaagtcgtggaataggcactgttacttttgaacagtccattgaagctgtgcaagctatatctatgttcaatggccagctgctatttgatagaccaatgcacgtcaagatggatgagagggccttaccaaaaggagatttcttccctcctgagcgtccacaacaacttccccatggccttggtggtattggcatggggttaggaccaggagggcaacccattgatgccaatcacctgaataaaggcatcggaatgggaaacataggtcccgcaggaatgggaatggaaggcataggatttggaataaataaaatgggaggaatggaggggccctttggtggtggtatggaaaacatgggtcgatttggatctgggatgaacatgggcaggataaatgaaatcctaagtaatgcactgaagagaggagagatcattgcaaagcagggaggaggtggaggtggaggaagcgtccctgggatcgagaggatgggtcctggcattgaccgcctcgggggtgccggcatggagcgcatgggcgcgggcctgggccacggcatggatcgcgtgggctccgagatcgagcgcatgggcctggtcatggaccgcatgggctccgtggagcgcatgggctccggcattgagcgcatgggcccgctgggcctcgaccacatggcctccagcattgagcgcatgggccagaccatggagcgcattggctctggcgtggagcgcatgggtgccggcatgggcttcggccttgagcgcatggccgctcccatcgaccgtgtgggccagaccattgagcgcatgggctctggcgtggagcgcatgggccctgccatcgagcgcatgggcctgagcatggagcgcatggtgcccgcaggtatgggagctggcctggagcgcatgggccccgtgatggatcgcatggccaccggcctggagcgcatgggcgccaacaatctggagcggatgggcctggagcgcatgggcgccaacagcctcgagcgcatgggcctggagcgcatgggtgccaacagcctcgagcgcatgggccccgccatgggcccggccctgggcgctggcattgagcgcatgggcctggccatgggtggcggtggcggtgccagctttgaccgtgccatcgagatggagcgtggcaacttcggaggaagcttcgcaggttcctttggtggagctggaggccatgctcctggggtggccaggaaggcctgccagatatttgtgagaaatctgccattcgatttcacatggaagatgctaaaggacaaattcaacgagtgcggccacgtgctgtacgccgacatcaagatggagaatgggaagtccaaggggtgtggtgtggttaagttcgagtcgccagaggtggccgagagagcctgccggatgatgaatggcatgaagctgagtggccgagagattgacgttcgaattgatagaaacgcttaagcagttgccttttttaaacatcgatacgagacctctgaatttgtattttttcttgttaaccattttaatttgttggctggatgtataaagatgtttaaaaaattcagttgctttttggggtaatttgaattacttttttaatgactggggttccatttgactgtttgcattgagattgcaatgtgcgcaattttttttgtagttgtggcatcttgttgacatcgaatatgactttgataataaataccggttcctgaaaa

SEQ ID NO: 299832 - DNA, 6977 bp, Homo sapiens
  misc_feature (2162)..(2162): n is a, c, g, or t
  misc_feature (2337)..(2337): n is a, c, g, or t
ccttcttgccgatcctcctctgagggtcccgccctctcgcgctgctcagtcccaaatgtctcctttgataagcacccataacacaggcccacctgctctgacagactcctctgcaggccttccctctccgctgactcattccctgagaaggaccactattcatcacccatctgcctcatcccaatgtctcctttggccacgctctctccataggaccctaccatgattctggagagtgcattttacatgcatgtcttttgatgtgaaatggcagtcacttaaagacctggttaaagaaaaagttggtgaggtaacatacgtggagctcttaatggacgctgaaggaaagtcaaggggatgtgctctgagagaatttcttctgtggatttactacatgaaaaatgtaactgtatggtggcgtggaatcgaatgaaatcaggaaggcagtgagtgctcatgttacagtagctatgtttgattttgccaaacatttgagtggggtgggaggggatttgcaaatgggagtcccgcttttccaaatggctggccaaagagctttttggtattctgtttggatgcccaatttggataactggggaccaatagcagcattgtctctttgttaacagaggaattggctgtgtgtgaattatgcatggaattttagcggtggtataattaatgtaaaacgtgtgttcttgtctagaaaatgttactcttggttgtttgctgaatttgaaagttgtgtgaaccaaagattccgaaaagttgcctttgtgccagtaaattgtaaaccaaatattaaaaacctgaatgttcaaaattggcctagtttaaagagaacataaactattttctgtcgtgcaatagaatggcttagaataatcaaaaggatgagcttaacttacggaagggatggatttaggaggaatatggtaaggactcgattgagtacagagggaagcagatctaaagttggtgtgatttcttggagaccctgaatttaggtctgcttattaaatgtcagcagctctagtgcaatgctggtaacgcgtaggagaaggagatattaaggagcccagcttttaacaaggaaggcgaggcgaggcacttctgtcagcttccccttagaagggttcattttaaaagactaactttgtgacataaatcatatttttagtttgtttataactgtcattggtatttactatttttttcttttctttttccccttccttgctcttctgactggtctctggcttcctccaaagggatgtgcgtaagtatcgtctagttacttattggtatttgagccttctaacttgtaggactggtttcactcgactcgtttccttttgactctatagtgttgttgaattcaagatggaagagagcatgaaaaaagctgcggaagtcctaaacaagcatagtctgagcggaagaccactgaaagtcaaagaagtaagctcttgcttaacactgcggatactgtgtgtaattgttgagtgatcctactttggaattagggaaagacggtcatggtcccagacggcatttacaaagcaagtgccagcctgttgtttctaatgaagagtgtcggtcatagcctacagcagccattccctgcaaggactttggggtggtggccaagcagatcctgagtggctgctgaccaccttctaatatctgtgatttgtctgaggccttgttgtctcagggactctcaaaccatgagcccgtgggtttgtgccattaagttttactccatctgacccttcttcttggcccatcttttttctttttttaaaaagtgagtttgttccagcctgggcaacatggtgaaaccccctctctacaaaaggtacaaaaattagccaggcatggtggcgcatgcctgtagtcctagctacttgggaggctgaggcaggaggatcatttgagcccaggatgtggaggttgcagtgagctgagattgcaccattgcactccagcccgggcaacagtgagaccctgtctaaaaaataaaaaataaagtgagtttgttattcctcaaacctgctttcacatctcatctgaatcaaatatattccttgaggaagaaggtttttttgttgattaaatccctcttggctgggcgcagtggctcacgcctgtaatccccngcactttgggaggctgaggtgggtggatcaaggtcatgagttcaagaccagcttgaccaacatggtgaaaccctgtctactaaaaatacaaaaaattagctgggcgtagtggggggtgcctgtaatccatctactcgggaggctgaggcaggagaatcgctggaacccaggaggnggaggttgcagtgagccgagatcgcgccattgaactccagcctgggcagtaagagcaaagctctgtctcaaaaaaacatccctcttaacttcttttcacctcttctcttggggaggaagatgagtagattcagagtgaagcttggtagggtctaaggtctctcatgtgttatgatgtcttttttagtgctgatggtggtaattgacaggacagagagttgaagaagagagtcagtacagagcttcacagaccttcccagatgttgttttactgcgcagccctcacacacacgcctccaacacctgaaggacttgaaggatgggggcgcttgtgtggtctagaactgtttctcaaacttctggaagccattgacggggtttgcagaagttacaaaaccccattgatgaattagtaagattcagctataccaagcccatgaagctctaatttcagtctggcggttctacattatatcagctaatcatgtttccctccctaccctgcttttcttttttacttagtgcaattgagagctgtgtttttagtgctacacttcatgccttttcttcctttcctatttctttagctggactcttctaagctggtagttgagttcatttgactttcttgttaatagatttgagagatgctttccaaacaacctttcagtttctaagtcttgagaatatcatttactgtgcaagcatggtttgcgttgtactgggtcagttaaacgtaacaccttttgtgcttgttttaggatcctgatggtgaacatgccaggagagcaatgcaaaaggtgatggctacgactggtgggatgggtatgggaccaggtggcccaggaatgattactatcccacccagtatcctaaataatcccaacatcccaaatgagattatccatgcattacaggctggaagacttggaagcacagtatttgtagcaaatgtaagtaaacagaaccatcgtctaaagtagaaaatcagaactttatgaaatgaccttgtcaatatgttataaaagtaattctcacatttgagaagaaaaatgtaaagaagggttttgttcttgatttctttaaaaatcagccttataggcgggctttgtctgcattcctaagtcacaggcttgaccgtggtctcgttggggctgtgattcctgagtttcgcaggtgtttccacaagcagtaaccgagtctgcattctccgttggtttattttatgcagttttggtgcagagtaagactgtacgagcagaagtgcactgacaccttcctcttgttgtgtctggggtgaatgataatacctccaccatctgcaaggggaaatatttagaataaagtaggttgggtggggtggggagtggtaaagcttatcagggaaacaattttttaaaaatgttcagaaaatgagtattaatttgaagtatgaggtgacttaagtttctgagaaaagagacaatatatttactataggtacagtttatttacagtgaaggccaggctttataatcctattttaaaatttccattgcagttgattagtttttgtgacattatttcctaatacttttttccaaccaaagcatgtatcattcatgtagtaaaaatgttgtgtttcttaagatgtttacattgaggtttttaccccgttctctctcgattagctggattataaagttggctggaagaaactgaaggaagtatttagtatggctggtgtggtggtccgagcagacattcttgaagataaagatggaaaaagtcgtggaataggcactgttacttttgaacagtccattgaagctgtgcaagctatatgtatccttctgcaggaattcaacttatgaacagtttgacctaaattgctgtgttagtaatgtaggtttgtgtgaggaagaggtgactgtgtgtattcatgttttttatgtgactagggggagtgcattactgtggaattaagaggttctctgggccggaccggtcacggtggctcacgcctgtaatcccagcacttcgggaggccaaggcgggcggatcacttgaggtcagttcgagaccagcctggccaacatggtgaaaccccggctctactaaaaaatgcaaaaattagctgggcgcagtggtgggtgcctgtaatcccagctactcgggaggctgaggcacaagaatcgcttgaacccgggaggtggaggttgcagtgagccgagattgcgccactgcacaccaccagcctgggtgatagagtgagactcagtctcaaaaaaaaaaaaaaaaaaaaaaaaaaaggttctctgggggtggaattgattcaatacagtgtggatagaggggatggttacaacatgggcatatgcccatgagtctttctactgttttcttttcagaagagtctaggtttgaaggaggaagtccaaagaatgtgctactagagagaaagtggggttgttgtttcatgtgtaatacatccttataggacctcactctttccagtgagtagacatcattttggagaggccacttctccttgaccctaggcttagcctagagtttttaatcccttggagagtaccccacaggagcacattcatacaactcagacaagaccgtcactgcatgtcttacccagaaaacatggtccttcagtttagatagtggtagatgcctggcccattggtcacattcagagaaccttgatgccactgcttaagaggatggtttggtgaaattgtaaggttacgaatgaagcttcacacctaaggaataagcagaagttgtcttgtcctccccgccagctttatttattgttccttttatgtttattgttgaaagtataatgaagaattgaaattgctcataaattcatcacttagagggactggtagcagttggagtatttttctttctttttgtatttctcttgtgcacatttttagaattgcaagaaatagccttaattgtaataccagctatgttcaatggccagctgctatttgatagaccaatgcacgtcaagatggatgagagggccttaccaaaaggagatttcttccctcctgagcgtccacaacaacttccccatggccttggtggtattggcatggggttaggaccaggagggcaacccattgatgccaatcacctgaataaaggcatcggaatgggaaacataggtcccgcaggaatgggaatggaaggcataggatttggaataaataaaatgggaggaatggaggggccctttggtggtggtatggaaaacatgggtcgatttggatctgggatgaacatgggcaggataaatgaaatcctaagtaatgcactgaagagaggagagatcattgcaaagcagggaggaggtggaggtggaggaagcgtccctgggatcgagaggatgggtcctggcattgaccgcctcgggggtgccggcatggagcgcatgggcgcgggcctgggccacggcatggatcgcgtgggctccgagatcgagcgcatgggcctggtcatggaccgcatgggctccgtggagcgcatgggctccggcattgagcgcatgggcccgctgggcctcgaccacatggcctccagcattgagcgcatgggccagaccatggagcgcattggctctggcgtggagcgcatgggtgccggcatgggcttcggccttgagcgcatggccgctcccatcgaccgtgtgggccagaccattgagcgcatgggctctggcgtggagcgcatgggccctgccatcgagcgcatgggcctgagcatggagcgcatggtgcccgcaggtatgggagctggcctggagcgcatgggccccgtgatggatcgcatggccaccggcctggagcgcatgggcgccaacaatctggagcggatgggcctggagcgcatgggcgccaacagcctcgagcgcatgggcctggagcgcatgggtgccaacagcctcgagcgcatgggccccgccatgggcccggccctgggcgctggcattgagcgcatgggcctggccatgggtggcggtggcggtgccagctttgaccgtgccatcgagatggagcgtggcaacttcggaggaagcttcgcaggttcctttggtggagctggaggccatgctcctggggtggccaggaaggcctgccagatatttgtgagaaatctgccattcgatttcacatggaagatgctaaaggacaaattcaacgagtgcggccacgtgctgtacgccgacatcaagatggagaatgggaagtccaaggggtgtggtgtggttaagttcgagtcgccagaggtggccgagagagcctgccggatgatgaatggcatgaagctgagtggccgagagattgacgttcgaattgatagaaacgcttaagcagttgccttttttaaacatcgatacgagacctctgaatttgtattttttcttgttaaccattttaatttgttggctggatgtataaagatgtttaaaaaattcagttgctttttggggtaatttgaattacttttttaatgactggggttccatttgactgtttgcattgagattgcaatgtgcgcaattttttttgtagttgtggcatcttgttgacatcgaatatgactttgataataaataccggttcctgaaaa

SEQ ID NO: 299833 - DNA, 3359 bp, Homo sapiens
ccttcttgccgatcctcctctgagggtcccgccctctcgcgctgctcagtcccaaatgtctcctttgataagcacccataacacaggcccacctgctctgacagactcctctgcaggccttccctctccgctgactcattccctgagaaggaccactattcatcacccatctgcctcatcccaatgtctcctttggccacgctctctccataggaccctaccatgattctggagagtgcattttacatgcatgtcttttgatgtgaaatggcagtcacttaaagacctggttaaagaaaaagttggtgaggtaacatacgtggagctcttaatggacgctgaaggaaagtcaaggggatgtgctctgagagaatttcttctgtggatttactacatgaaaaatgtaactgtatggtggcgtggaatcgaatgaaatcaggaaggcagtgagtgctcatgttacagtagctatgtttgattttgccaaacatttgagtggggtgggaggggatttgcaaatgggagtcccgcttttccaaatggctggccaaagagctttttggtattctgtttggatgcccaatttggataactggggaccaatagcagcattgtctctttgttaacagaggaattggctgtgtgtgaattatgcatggaattttagcggtggtataattaatgtaaaacgtgtgttcttgtctagaaaatgttactcttggttgtttgctgaatttgaaagttgtgtgaaccaaagattccgaaaagttgcctttgtgccagtaaattgtaaaccaaatattaaaaacctgaatgttcaaaattggcctagtttaaagagaacataaactattttctgtcgtgcaatagaatggcttagaataatcaaaaggatgagcttaacttacggaagggatggatttaggaggaatatggtaaggactcgattgagtacagagggaagcagatctaaagttggtgtgatttcttggagaccctgaatttaggtctgcttattaaatgtcagcagctctagtgcaatgctggtaacgcgtaggagaaggagatattaaggagcccagcttttaacaaggaaggcgaggcgaggcacttctgtcagcttccccttagaagggttcattttaaaagactaactttgtgacataaatcatatttttagtttgtttataactgtcattggtatttactatttttttcttttctttttccccttccttgctcttctgactggtctctggcttcctccaaagggatgtgcgtaagtatcgtctagttacttattggtatttgagccttctaacttgtaggactggtttcactcgactcgtttccttttgactctatagtgttgttgaattcaagatggaagagagcatgaaaaaagctgcggaagtcctaaacaagcatagtctgagcggaagaccactgaaagtcaaagaagatcctgatggtgaacatgccaggagagcaatgcaaaaggctggaagacttggaagcacagtatttgtagcaaatctggattataaagttggctggaagaaactgaaggaagtatttagtatggctggtgtggtggtccgagcagacattcttgaagataaagatggaaaaagtcgtggaataggcactgttacttttgaacagtccattgaagctgtgcaagctatatctatgttcaatggccagctgctatttgatagaccaatgcacgtcaagatggatgagagggccttaccaaaaggagatttcttccctcctgagcgtccacaacaacttccccatggccttggtggtattggcatggggttaggaccaggagggcaacccattgatgccaatcacctgaataaaggcatcggaatgggaaacataggtcccgcaggaatgggaatggaaggcataggatttggaataaataaaatgggaggaatggaggggccctttggtggtggtatggaaaacatgggtcgatttggatctgggatgaacatgggcaggataaatgaaatcctaagtaatgcactgaagagaggagagatcattgcaaagcagggaggaggtggaggtggaggaagcgtccctgggatcgagaggatgggtcctggcattgaccgcctcgggggtgccggcatggagcgcatgggcgcgggcctgggccacggcatggatcgcgtgggctccgagatcgagcgcatgggcctggtcatggaccgcatgggctccgtggagcgcatgggctccggcattgagcgcatgggcccgctgggcctcgaccacatggcctccagcattgagcgcatgggccagaccatggagcgcattggctctggcgtggagcgcatgggtgccggcatgggcttcggccttgagcgcatggccgctcccatcgaccgtgtgggccagaccattgagcgcatgggctctggcgtggagcgcatgggccctgccatcgagcgcatgggcctgagcatggagcgcatggtgcccgcaggtatgggagctggcctggagcgcatgggccccgtgatggatcgcatggccaccggcctggagcgcatgggcgccaacaatctggagcggatgggcctggagcgcatgggcgccaacagcctcgagcgcatgggcctggagcgcatgggtgccaacagcctcgagcgcatgggccccgccatgggcccggccctgggcgctggcattgagcgcatgggcctggccatgggtggcggtggcggtgccagctttgaccgtgccatcgagatggagcgtggcaacttcggaggaagcttcgcaggttcctttggtggagctggaggccatgctcctggggtggccaggaaggcctgccagatatttgtgagaaatctgccattcgatttcacatggaagatgctaaaggacaaattcaacgagtgcggccacgtgctgtacgccgacatcaagatggagaatgggaagtccaaggggtgtggtgtggttaagttcgagtcgccagaggtggccgagagagcctgccggatgatgaatggcatgaagctgagtggccgagagattgacgttcgaattgatagaaacgcttaagcagttgccttttttaaacatcgatacgagacctctgaatttgtattttttcttgttaaccattttaatttgttggctggatgtataaagatgtttaaaaaattcagttgctttttggggtaatttgaattacttttttaatgactggggttccatttgactgtttgcattgagattgcaatgtgcgcaattttttttgtagttgtggcatcttgttgacatcgaatatgactttgataataaataccggttcctgaaaa

SEQ ID NO: 299834 - DNA, 6923 bp, Homo sapiens
  misc_feature (2162)..(2162): n is a, c, g, or t
  misc_feature (2337)..(2337): n is a, c, g, or t
ccttcttgccgatcctcctctgagggtcccgccctctcgcgctgctcagtcccaaatgtctcctttgataagcacccataacacaggcccacctgctctgacagactcctctgcaggccttccctctccgctgactcattccctgagaaggaccactattcatcacccatctgcctcatcccaatgtctcctttggccacgctctctccataggaccctaccatgattctggagagtgcattttacatgcatgtcttttgatgtgaaatggcagtcacttaaagacctggttaaagaaaaagttggtgaggtaacatacgtggagctcttaatggacgctgaaggaaagtcaaggggatgtgctctgagagaatttcttctgtggatttactacatgaaaaatgtaactgtatggtggcgtggaatcgaatgaaatcaggaaggcagtgagtgctcatgttacagtagctatgtttgattttgccaaacatttgagtggggtgggaggggatttgcaaatgggagtcccgcttttccaaatggctggccaaagagctttttggtattctgtttggatgcccaatttggataactggggaccaatagcagcattgtctctttgttaacagaggaattggctgtgtgtgaattatgcatggaattttagcggtggtataattaatgtaaaacgtgtgttcttgtctagaaaatgttactcttggttgtttgctgaatttgaaagttgtgtgaaccaaagattccgaaaagttgcctttgtgccagtaaattgtaaaccaaatattaaaaacctgaatgttcaaaattggcctagtttaaagagaacataaactattttctgtcgtgcaatagaatggcttagaataatcaaaaggatgagcttaacttacggaagggatggatttaggaggaatatggtaaggactcgattgagtacagagggaagcagatctaaagttggtgtgatttcttggagaccctgaatttaggtctgcttattaaatgtcagcagctctagtgcaatgctggtaacgcgtaggagaaggagatattaaggagcccagcttttaacaaggaaggcgaggcgaggcacttctgtcagcttccccttagaagggttcattttaaaagactaactttgtgacataaatcatatttttagtttgtttataactgtcattggtatttactatttttttcttttctttttccccttccttgctcttctgactggtctctggcttcctccaaagggatgtgcgtaagtatcgtctagttacttattggtatttgagccttctaacttgtaggactggtttcactcgactcgtttccttttgactctatagtgttgttgaattcaagatggaagagagcatgaaaaaagctgcggaagtcctaaacaagcatagtctgagcggaagaccactgaaagtcaaagaagtaagctcttgcttaacactgcggatactgtgtgtaattgttgagtgatcctactttggaattagggaaagacggtcatggtcccagacggcatttacaaagcaagtgccagcctgttgtttctaatgaagagtgtcggtcatagcctacagcagccattccctgcaaggactttggggtggtggccaagcagatcctgagtggctgctgaccaccttctaatatctgtgatttgtctgaggccttgttgtctcagggactctcaaaccatgagcccgtgggtttgtgccattaagttttactccatctgacccttcttcttggcccatcttttttctttttttaaaaagtgagtttgttccagcctgggcaacatggtgaaaccccctctctacaaaaggtacaaaaattagccaggcatggtggcgcatgcctgtagtcctagctacttgggaggctgaggcaggaggatcatttgagcccaggatgtggaggttgcagtgagctgagattgcaccattgcactccagcccgggcaacagtgagaccctgtctaaaaaataaaaaataaagtgagtttgttattcctcaaacctgctttcacatctcatctgaatcaaatatattccttgaggaagaaggtttttttgttgattaaatccctcttggctgggcgcagtggctcacgcctgtaatccccngcactttgggaggctgaggtgggtggatcaaggtcatgagttcaagaccagcttgaccaacatggtgaaaccctgtctactaaaaatacaaaaaattagctgggcgtagtggggggtgcctgtaatccatctactcgggaggctgaggcaggagaatcgctggaacccaggaggnggaggttgcagtgagccgagatcgcgccattgaactccagcctgggcagtaagagcaaagctctgtctcaaaaaaacatccctcttaacttcttttcacctcttctcttggggaggaagatgagtagattcagagtgaagcttggtagggtctaaggtctctcatgtgttatgatgtcttttttagtgctgatggtggtaattgacaggacagagagttgaagaagagagtcagtacagagcttcacagaccttcccagatgttgttttactgcgcagccctcacacacacgcctccaacacctgaaggacttgaaggatgggggcgcttgtgtggtctagaactgtttctcaaacttctggaagccattgacggggtttgcagaagttacaaaaccccattgatgaattagtaagattcagctataccaagcccatgaagctctaatttcagtctggcggttctacattatatcagctaatcatgtttccctccctaccctgcttttcttttttacttagtgcaattgagagctgtgtttttagtgctacacttcatgccttttcttcctttcctatttctttagctggactcttctaagctggtagttgagttcatttgactttcttgttaatagatttgagagatgctttccaaacaacctttcagtttctaagtcttgagaatatcatttactgtgcaagcatggtttgcgttgtactgggtcagttaaacgtaacaccttttgtgcttgttttaggatcctgatggtgaacatgccaggagagcaatgcaaaaggtgatggctacgactggtgggatgggtatgggaccaggtggcccaggaatgattactatcccacccagtatcctaaataatcccaacatcccaaatgagattatccatgcattacaggctggaagacttggaagcacagtatttgtagcaaatgtaagtaaacagaaccatcgtctaaagtagaaaatcagaactttatgaaatgaccttgtcaatatgttataaaagtaattctcacatttgagaagaaaaatgtaaagaagggttttgttcttgatttctttaaaaatcagccttataggcgggctttgtctgcattcctaagtcacaggcttgaccgtggtctcgttggggctgtgattcctgagtttcgcaggtgtttccacaagcagtaaccgagtctgcattctccgttggtttattttatgcagttttggtgcagagtaagactgtacgagcagaagtgcactgacaccttcctcttgttgtgtctggggtgaatgataatacctccaccatctgcaaggggaaatatttagaataaagtaggttgggtggggtggggagtggtaaagcttatcagggaaacaattttttaaaaatgttcagaaaatgagtattaatttgaagtatgaggtgacttaagtttctgagaaaagagacaatatatttactataggtacagtttatttacagtgaaggccaggctttataatcctattttaaaatttccattgcagttgattagtttttgtgacattatttcctaatacttttttccaaccaaagcatgtatcattcatgtagtaaaaatgttgtgtttcttaagatgtttacattgaggtttttaccccgttctctctcgattagctggattataaagttggctggaagaaactgaaggaagtatttagtatggctggtgtggtggtccgagcagacattcttgaagataaagatggaaaaagtcgtggaataggcactgttacttttgaacagtccattgaagctgtgcaagctatatgtatccttctgcaggaattcaacttatgaacagtttgacctaaattgctgtgttagtaatgtaggtttgtgtgaggaagaggtgactgtgtgtattcatgttttttatgtgactagggggagtgcattactgtggaattaagaggttctctgggccggaccggtcacggtggctcacgcctgtaatcccagcacttcgggaggccaaggcgggcggatcacttgaggtcagttcgagaccagcctggccaacatggtgaaaccccggctctactaaaaaatgcaaaaattagctgggcgcagtggtgggtgcctgtaatcccagctactcgggaggctgaggcacaagaatcgcttgaacccgggaggtggaggttgcagtgagccgagattgcgccactgcacaccaccagcctgggtgatagagtgagactcagtctcaaaaaaaaaaaaaaaaaaaaaaaaaaaggttctctgggggtggaattgattcaatacagtgtggatagaggggatggttacaacatgggcatatgcccatgagtctttctactgttttcttttcagaagagtctaggtttgaaggaggaagtccaaagaatgtgctactagagagaaagtggggttgttgtttcatgtgtaatacatccttataggacctcactctttccagtgagtagacatcattttggagaggccacttctccttgaccctaggcttagcctagagtttttaatcccttggagagtaccccacaggagcacattcatacaactcagacaagaccgtcactgcatgtcttacccagaaaacatggtccttcagtttagatagtggtagatgcctggcccattggtcacattcagagaaccttgatgccactgcttaagaggatggtttggtgaaattgtaaggttacgaatgaagcttcacacctaaggaataagcagaagttgtcttgtcctccccgccagctttatttattgttccttttatgtttattgttgaaagtataatgaagaattgaaattgctcataaattcatcacttagagggactggtagcagttggagtatttttctttctttttgtatttctcttgtgcacatttttagaattgcaagaaatagccttaattgtaataccagctatgttcaatggccagctgctatttgatagaccaatgcacgtcaagatggatgagagggccttaccaaaaggagatttcttccctcctgagcgtccacaacaacttccccatggccttggtggtattggcatggggttaggaccaggagggcaacccattgatgccaatcacctgaataaaggcatcggaatgggaaacataggtcccgcaggaatgggaatggaaggcataggatttggaataaataaaatgggaggaatggaggggccctttggtggtggtatggaaaacatgggtcgatttggatctgggatgaacatgggcaggataaatggtggaggtggaggaagcgtccctgggatcgagaggatgggtcctggcattgaccgcctcgggggtgccggcatggagcgcatgggcgcgggcctgggccacggcatggatcgcgtgggctccgagatcgagcgcatgggcctggtcatggaccgcatgggctccgtggagcgcatgggctccggcattgagcgcatgggcccgctgggcctcgaccacatggcctccagcattgagcgcatgggccagaccatggagcgcattggctctggcgtggagcgcatgggtgccggcatgggcttcggccttgagcgcatggccgctcccatcgaccgtgtgggccagaccattgagcgcatgggctctggcgtggagcgcatgggccctgccatcgagcgcatgggcctgagcatggagcgcatggtgcccgcaggtatgggagctggcctggagcgcatgggccccgtgatggatcgcatggccaccggcctggagcgcatgggcgccaacaatctggagcggatgggcctggagcgcatgggcgccaacagcctcgagcgcatgggcctggagcgcatgggtgccaacagcctcgagcgcatgggccccgccatgggcccggccctgggcgctggcattgagcgcatgggcctggccatgggtggcggtggcggtgccagctttgaccgtgccatcgagatggagcgtggcaacttcggaggaagcttcgcaggttcctttggtggagctggaggccatgctcctggggtggccaggaaggcctgccagatatttgtgagaaatctgccattcgatttcacatggaagatgctaaaggacaaattcaacgagtgcggccacgtgctgtacgccgacatcaagatggagaatgggaagtccaaggggtgtggtgtggttaagttcgagtcgccagaggtggccgagagagcctgccggatgatgaatggcatgaagctgagtggccgagagattgacgttcgaattgatagaaacgcttaagcagttgccttttttaaacatcgatacgagacctctgaatttgtattttttcttgttaaccattttaatttgttggctggatgtataaagatgtttaaaaaattcagttgctttttggggtaatttgaattacttttttaatgactggggttccatttgactgtttgcattgagattgcaatgtgcgcaattttttttgtagttgtggcatcttgttgacatcgaatatgactttgataataaataccggttcctgaaaa

SEQ ID NO: 299835 - DNA, 6878 bp, Homo sapiens
  misc_feature (2162)..(2162): n is a, c, g, or t
  misc_feature (2337)..(2337): n is a, c, g, or t
ccttcttgccgatcctcctctgagggtcccgccctctcgcgctgctcagtcccaaatgtctcctttgataagcacccataacacaggcccacctgctctgacagactcctctgcaggccttccctctccgctgactcattccctgagaaggaccactattcatcacccatctgcctcatcccaatgtctcctttggccacgctctctccataggaccctaccatgattctggagagtgcattttacatgcatgtcttttgatgtgaaatggcagtcacttaaagacctggttaaagaaaaagttggtgaggtaacatacgtggagctcttaatggacgctgaaggaaagtcaaggggatgtgctctgagagaatttcttctgtggatttactacatgaaaaatgtaactgtatggtggcgtggaatcgaatgaaatcaggaaggcagtgagtgctcatgttacagtagctatgtttgattttgccaaacatttgagtggggtgggaggggatttgcaaatgggagtcccgcttttccaaatggctggccaaagagctttttggtattctgtttggatgcccaatttggataactggggaccaatagcagcattgtctctttgttaacagaggaattggctgtgtgtgaattatgcatggaattttagcggtggtataattaatgtaaaacgtgtgttcttgtctagaaaatgttactcttggttgtttgctgaatttgaaagttgtgtgaaccaaagattccgaaaagttgcctttgtgccagtaaattgtaaaccaaatattaaaaacctgaatgttcaaaattggcctagtttaaagagaacataaactattttctgtcgtgcaatagaatggcttagaataatcaaaaggatgagcttaacttacggaagggatggatttaggaggaatatggtaaggactcgattgagtacagagggaagcagatctaaagttggtgtgatttcttggagaccctgaatttaggtctgcttattaaatgtcagcagctctagtgcaatgctggtaacgcgtaggagaaggagatattaaggagcccagcttttaacaaggaaggcgaggcgaggcacttctgtcagcttccccttagaagggttcattttaaaagactaactttgtgacataaatcatatttttagtttgtttataactgtcattggtatttactatttttttcttttctttttccccttccttgctcttctgactggtctctggcttcctccaaagggatgtgcgtaagtatcgtctagttacttattggtatttgagccttctaacttgtaggactggtttcactcgactcgtttccttttgactctatagtgttgttgaattcaagatggaagagagcatgaaaaaagctgcggaagtcctaaacaagcatagtctgagcggaagaccactgaaagtcaaagaagtaagctcttgcttaacactgcggatactgtgtgtaattgttgagtgatcctactttggaattagggaaagacggtcatggtcccagacggcatttacaaagcaagtgccagcctgttgtttctaatgaagagtgtcggtcatagcctacagcagccattccctgcaaggactttggggtggtggccaagcagatcctgagtggctgctgaccaccttctaatatctgtgatttgtctgaggccttgttgtctcagggactctcaaaccatgagcccgtgggtttgtgccattaagttttactccatctgacccttcttcttggcccatcttttttctttttttaaaaagtgagtttgttccagcctgggcaacatggtgaaaccccctctctacaaaaggtacaaaaattagccaggcatggtggcgcatgcctgtagtcctagctacttgggaggctgaggcaggaggatcatttgagcccaggatgtggaggttgcagtgagctgagattgcaccattgcactccagcccgggcaacagtgagaccctgtctaaaaaataaaaaataaagtgagtttgttattcctcaaacctgctttcacatctcatctgaatcaaatatattccttgaggaagaaggtttttttgttgattaaatccctcttggctgggcgcagtggctcacgcctgtaatccccngcactttgggaggctgaggtgggtggatcaaggtcatgagttcaagaccagcttgaccaacatggtgaaaccctgtctactaaaaatacaaaaaattagctgggcgtagtggggggtgcctgtaatccatctactcgggaggctgaggcaggagaatcgctggaacccaggaggnggaggttgcagtgagccgagatcgcgccattgaactccagcctgggcagtaagagcaaagctctgtctcaaaaaaacatccctcttaacttcttttcacctcttctcttggggaggaagatgagtagattcagagtgaagcttggtagggtctaaggtctctcatgtgttatgatgtcttttttagtgctgatggtggtaattgacaggacagagagttgaagaagagagtcagtacagagcttcacagaccttcccagatgttgttttactgcgcagccctcacacacacgcctccaacacctgaaggacttgaaggatgggggcgcttgtgtggtctagaactgtttctcaaacttctggaagccattgacggggtttgcagaagttacaaaaccccattgatgaattagtaagattcagctataccaagcccatgaagctctaatttcagtctggcggttctacattatatcagctaatcatgtttccctccctaccctgcttttcttttttacttagtgcaattgagagctgtgtttttagtgctacacttcatgccttttcttcctttcctatttctttagctggactcttctaagctggtagttgagttcatttgactttcttgttaatagatttgagagatgctttccaaacaacctttcagtttctaagtcttgagaatatcatttactgtgcaagcatggtttgcgttgtactgggtcagttaaacgtaacaccttttgtgcttgttttaggatcctgatggtgaacatgccaggagagcaatgcaaaaggtgatggctacgactggtgggatgggtatgggaccaggtggcccaggaatgattactatcccacccagtatcctaaataatcccaacatcccaaatgagattatccatgcattacaggctggaagacttggaagcacagtatttgtagcaaatgtaagtaaacagaaccatcgtctaaagtagaaaatcagaactttatgaaatgaccttgtcaatatgttataaaagtaattctcacatttgagaagaaaaatgtaaagaagggttttgttcttgatttctttaaaaatcagccttataggcgggctttgtctgcattcctaagtcacaggcttgaccgtggtctcgttggggctgtgattcctgagtttcgcaggtgtttccacaagcagtaaccgagtctgcattctccgttggtttattttatgcagttttggtgcagagtaagactgtacgagcagaagtgcactgacaccttcctcttgttgtgtctggggtgaatgataatacctccaccatctgcaaggggaaatatttagaataaagtaggttgggtggggtggggagtggtaaagcttatcagggaaacaattttttaaaaatgttcagaaaatgagtattaatttgaagtatgaggtgacttaagtttctgagaaaagagacaatatatttactataggtacagtttatttacagtgaaggccaggctttataatcctattttaaaatttccattgcagttgattagtttttgtgacattatttcctaatacttttttccaaccaaagcatgtatcattcatgtagtaaaaatgttgtgtttcttaagatgtttacattgaggtttttaccccgttctctctcgattagctggattataaagttggctggaagaaactgaaggaagtatttagtatggctggtgtggtggtccgagcagacattcttgaagataaagatggaaaaagtcgtggaataggcactgttacttttgaacagtccattgaagctgtgcaagctatatgtatccttctgcaggaattcaacttatgaacagtttgacctaaattgctgtgttagtaatgtaggtttgtgtgaggaagaggtgactgtgtgtattcatgttttttatgtgactagggggagtgcattactgtggaattaagaggttctctgggccggaccggtcacggtggctcacgcctgtaatcccagcacttcgggaggccaaggcgggcggatcacttgaggtcagttcgagaccagcctggccaacatggtgaaaccccggctctactaaaaaatgcaaaaattagctgggcgcagtggtgggtgcctgtaatcccagctactcgggaggctgaggcacaagaatcgcttgaacccgggaggtggaggttgcagtgagccgagattgcgccactgcacaccaccagcctgggtgatagagtgagactcagtctcaaaaaaaaaaaaaaaaaaaaaaaaaaaggttctctgggggtggaattgattcaatacagtgtggatagaggggatggttacaacatgggcatatgcccatgagtctttctactgttttcttttcagaagagtctaggtttgaaggaggaagtccaaagaatgtgctactagagagaaagtggggttgttgtttcatgtgtaatacatccttataggacctcactctttccagtgagtagacatcattttggagaggccacttctccttgaccctaggcttagcctagagtttttaatcccttggagagtaccccacaggagcacattcatacaactcagacaagaccgtcactgcatgtcttacccagaaaacatggtccttcagtttagatagtggtagatgcctggcccattggtcacattcagagaaccttgatgccactgcttaagaggatggtttggtgaaattgtaaggttacgaatgaagcttcacacctaaggaataagcagaagttgtcttgtcctccccgccagctttatttattgttccttttatgtttattgttgaaagtataatgaagaattgaaattgctcataaattcatcacttagagggactggtagcagttggagtatttttctttctttttgtatttctcttgtgcacatttttagaattgcaagaaatagccttaattgtaataccagctatgttcaatggccagctgctatttgatagaccaatgcacgtcaagatggatgagagggccttaccaaaaggagatttcttccctcctgagcgtccacaacaacttccccatggccttggtggtattggcatggggttaggaccaggagggcaacccattgatgccaatcacctgaataaaggcatcggaatgggaaacataggtcccgcaggaatggaggggccctttggtggtggtatggaaaacatgggtcgatttggatctgggatgaacatgggcaggataaatggtggaggtggaggaagcgtccctgggatcgagaggatgggtcctggcattgaccgcctcgggggtgccggcatggagcgcatgggcgcgggcctgggccacggcatggatcgcgtgggctccgagatcgagcgcatgggcctggtcatggaccgcatgggctccgtggagcgcatgggctccggcattgagcgcatgggcccgctgggcctcgaccacatggcctccagcattgagcgcatgggccagaccatggagcgcattggctctggcgtggagcgcatgggtgccggcatgggcttcggccttgagcgcatggccgctcccatcgaccgtgtgggccagaccattgagcgcatgggctctggcgtggagcgcatgggccctgccatcgagcgcatgggcctgagcatggagcgcatggtgcccgcaggtatgggagctggcctggagcgcatgggccccgtgatggatcgcatggccaccggcctggagcgcatgggcgccaacaatctggagcggatgggcctggagcgcatgggcgccaacagcctcgagcgcatgggcctggagcgcatgggtgccaacagcctcgagcgcatgggccccgccatgggcccggccctgggcgctggcattgagcgcatgggcctggccatgggtggcggtggcggtgccagctttgaccgtgccatcgagatggagcgtggcaacttcggaggaagcttcgcaggttcctttggtggagctggaggccatgctcctggggtggccaggaaggcctgccagatatttgtgagaaatctgccattcgatttcacatggaagatgctaaaggacaaattcaacgagtgcggccacgtgctgtacgccgacatcaagatggagaatgggaagtccaaggggtgtggtgtggttaagttcgagtcgccagaggtggccgagagagcctgccggatgatgaatggcatgaagctgagtggccgagagattgacgttcgaattgatagaaacgcttaagcagttgccttttttaaacatcgatacgagacctctgaatttgtattttttcttgttaaccattttaatttgttggctggatgtataaagatgtttaaaaaattcagttgctttttggggtaatttgaattacttttttaatgactggggttccatttgactgtttgcattgagattgcaatgtgcgcaattttttttgtagttgtggcatcttgttgacatcgaatatgactttgataataaataccggttcctgaaaa

SEQ ID NO: 299836 - DNA, 2982 bp, Homo sapiens
ccttcttgccgatcctcctctgagggtcccgccctctcgcgctgctcagtcccaaatgtctcctttgataagcacccataacacaggcccacctgctctgacagactcctctgcaggccttccctctccgctgactcattccctgagaaggaccactattcatcacccatctgcctcatcccaatgtctcctttggccacgctctctccataggaccctaccatgattctggagagtgcattttacatgcatgtcttttgatgtgaaatggcagtcacttaaagacctggttaaagaaaaagttggtgaggtaacatacgtggagctcttaatggacgctgaaggaaagtcaaggggatgtgctctgagagaatttcttctgtggatttactacatgaaaaatgtaactgtatggtggcgtggaatcgaatgaaatcaggaaggcagtgagtgctcatgttacagtagctatgtttgattttgccaaacatttgagtggggtgggaggggatttgcaaatgggagtcccgcttttccaaatggctggccaaagagctttttggtattctgtttggatgcccaatttggataactggggaccaatagcagcattgtctctttgttaacagaggaattggctgtgtgtgaattatgcatggaattttagcggtggtataattaatgtaaaacgtgtgttcttgtctagaaaatgttactcttggttgtttgctgaatttgaaagttgtgtgaaccaaagattccgaaaagttgcctttgtgccagtaaattgtaaaccaaatattaaaaacctgaatgttcaaaattggcctagtttaaagagaacataaactattttctgtcgtgcaatagaatggcttagaataatcaaaaggatgagcttaacttacggaagggatggatttaggaggaatatggtaaggactcgattgagtacagagggaagcagatctaaagttggtgtgatttcttggagaccctgaatttaggtctgcttattaaatgtcagcagctctagtgcaatgctggtaacgcgtaggagaaggagatattaaggagcccagcttttaacaaggaaggcgaggcgaggcacttctgtcagcttccccttagaagggttcattttaaaagactaactttgtgacataaatcatatttttagtttgtttataactgtcattggtatttactatttttttcttttctttttccccttccttgctcttctgactggtctctggcttcctccaaagggatgtgcgtaagtatcgtctagttacttattggtatttgagccttctaacttgtaggactggtttcactcgactcgtttccttttgactctatagtgttgttgaattcaagatggaagagagcatgaaaaaagctgcggaagtcctaaacaaatggccttggtggtattggcatggggttaggaccaggagggcaacccattgatgccaatcacctgaataaaggcatcggaatgggaaacataggtcccgcaggaatgggaatggaaggcataggatttggaataaataaaatgggaggaatggaggggccctttggtggtggtatggaaaacatgggtcgatttggatctgggatgaacatgggcaggataaatgaaatcctaagtaatgcactgaagagaggagagatcattgcaaagcagggaggaggtggaggtggaggaagcgtccctgggatcgagaggatgggtcctggcattgaccgcctcgggggtgccggcatggagcgcatgggcgcgggcctgggccacggcatggatcgcgtgggctccgagatcgagcgcatgggcctggtcatggaccgcatgggctccgtggagcgcatgggctccggcattgagcgcatgggcccgctgggcctcgaccacatggcctccagcattgagcgcatgggccagaccatggagcgcattggctctggcgtggagcgcatgggtgccggcatgggcttcggccttgagcgcatggccgctcccatcgaccgtgtgggccagaccattgagcgcatgggctctggcgtggagcgcatgggccctgccatcgagcgcatgggcctgagcatggagcgcatggtgcccgcaggtatgggagctggcctggagcgcatgggccccgtgatggatcgcatggccaccggcctggagcgcatgggcgccaacaatctggagcggatgggcctggagcgcatgggcgccaacagcctcgagcgcatgggcctggagcgcatgggtgccaacagcctcgagcgcatgggccccgccatgggcccggccctgggcgctggcattgagcgcatgggcctggccatgggtggcggtggcggtgccagctttgaccgtgccatcgagatggagcgtggcaacttcggaggaagcttcgcaggttcctttggtggagctggaggccatgctcctggggtggccaggaaggcctgccagatatttgtgagaaatctgccattcgatttcacatggaagatgctaaaggacaaattcaacgagtgcggccacgtgctgtacgccgacatcaagatggagaatgggaagtccaaggggtgtggtgtggttaagttcgagtcgccagaggtggccgagagagcctgccggatgatgaatggcatgaagctgagtggccgagagattgacgttcgaattgatagaaacgcttaagcagttgccttttttaaacatcgatacgagacctctgaatttgtattttttcttgttaaccattttaatttgttggctggatgtataaagatgtttaaaaaattcagttgctttttggggtaatttgaattacttttttaatgactggggttccatttgactgtttgcattgagattgcaatgtgcgcaattttttttgtagttgtggcatcttgttgacatcgaatatgactttgataataaataccggttcctgaaaa

SEQ ID NO: 299837 - DNA, 1623 bp, Homo sapiens
cactattttcttgagatccgtatggacgaagttgttgcaacaacttcgtccatcgcgacttccccatggccttggtggtattggcatggggttaggaccaggagggcaacccattgatgccaatcacctgaataaaggcatcggaatgggaaacataggtcccgcaggaatgggaatggaaggcataggatttggaataaataaaatgggaggaatggaggggccctttggtggtggtatggaaaacatgggtcgatttggatctgggatgaacatgggcaggataaatgaaatcctaagtaatgcactgaagagaggagagatcattgcaaagcagggaggaggtggaggtggaggaagcgtccctgggatcgagaggatgggtcctggcattgaccgcctcgggggtgccggcatggagcgcatgggcgcgggcctgggccacggcatggatcgcgtgggctccgagatcgagcgcatgggcctggtcatggaccgcatgggctccgtggagcgcatgggctccggcattgagcgcatgggcccgctgggcctcgaccacatggcctccagcattgagcgcatgggccagaccatggagcgcattggctctggcgtggagcgcatgggtgccggcatgggcttcggccttgagcgcatggccgctcccatcgaccgtgtgggccagaccattgagcgcatgggctctggcgtggagcgcatgggccctgccatcgagcgcatgggcctgagcatggagcgcatggtgcccgcaggtatgggagctggcctggagcgcatgggccccgtgatggatcgcatggccaccggcctggagcgcatgggcgccaacaatctggagcggatgggcctggagcgcatgggcgccaacagcctcgagcgcatgggcctggagcgcatgggtgccaacagcctcgagcgcatgggccccgccatgggcccggccctgggcgctggcattgagcgcatgggcctggccatgggtggcggtggcggtgccagctttgaccgtgccatcgagatggagcgtggcaacttcggaggaagcttcgcaggttcctttggtggagctggaggccatgctcctggggtggccaggaaggcctgccagatatttgtgagaaatctgccattcgatttcacatggaagatgctaaaggacaaattcaacgagtgcggccacgtgctgtacgccgacatcaagatggagaatgggaagtccaaggggtgtggtgtggttaagttcgagtcgccagaggtggccgagagagcctgccggatgatgaatggcatgaagctgagtggccgagagattgacgttcgaattgatagaaacgcttaagcagttgccttttttaaacatcgatacgagacctctgaatttgtattttttcttgttaaccattttaatttgttggctggatgtataaagatgtttaaaaaattcagttgctttttggggtaatttgaattacttttttaatgactggggttccatttgactgtttgcattgagattgcaatgtgcgcaattttttttgtagttgtggcatcttgttgacatcgaatatgactttgataataaataccggttcctgaaaa

SEQ ID NO: 299838 - DNA, 3422 bp, Homo sapiens
ccttcttgccgatcctcctctgagggtcccgccctctcgcgctgctcagtcccaaatgtctcctttgataagcacccataacacaggcccacctgctctgacagactcctctgcaggccttccctctccgctgactcattccctgagaaggaccactattcatcacccatctgcctcatcccaatgtctcctttggccacgctctctccataggaccctaccatgattctggagagtgcattttacatgcatgtcttttgatgtgaaatggcagtcacttaaagacctggttaaagaaaaagttggtgaggtaacatacgtggagctcttaatggacgctgaaggaaagtcaaggggatgtgctctgagagaatttcttctgtggatttactacatgaaaaatgtaactgtatggtggcgtggaatcgaatgaaatcaggaaggcagtgagtgctcatgttacagtagctatgtttgattttgccaaacatttgagtggggtgggaggggatttgcaaatgggagtcccgcttttccaaatggctggccaaagagctttttggtattctgtttggatgcccaatttggataactggggaccaatagcagcattgtctctttgttaacagaggaattggctgtgtgtgaattatgcatggaattttagcggtggtataattaatgtaaaacgtgtgttcttgtctagaaaatgttactcttggttgtttgctgaatttgaaagttgtgtgaaccaaagattccgaaaagttgcctttgtgccagtaaattgtaaaccaaatattaaaaacctgaatgttcaaaattggcctagtttaaagagaacataaactattttctgtcgtgcaatagaatggcttagaataatcaaaaggatgagcttaacttacggaagggatggatttaggaggaatatggtaaggactcgattgagtacagagggaagcagatctaaagttggtgtgatttcttggagaccctgaatttaggtctgcttattaaatgtcagcagctctagtgcaatgctggtaacgcgtaggagaaggagatattaaggagcccagcttttaacaaggaaggcgaggcgaggcacttctgtcagcttccccttagaagggttcattttaaaagactaactttgtgacataaatcatatttttagtttgtttataactgtcattggtatttactatttttttcttttctttttccccttccttgctcttctgactggtctctggcttcctccaaagggatgtgcgtaagtatcgtctagttacttattggtatttgagccttctaacttgtaggactggtttcactcgactcgtttccttttgactctatagtgttgttgaattcaagatggaagagagcatgaaaaaagctgcggaagtcctaaacaagcatagtctgagcggaagaccactgaaagtcaaagaagatcctgatggtgaacatgccaggagagcaatgcaaaaggtgatggctacgactggtgggatgggtatgggaccaggtggcccaggaatgattactatcccacccagtatcctaaataatcccaacatcccaaatgagattatccatgcattacaggctggaagacttggaagcacagtatttgtagcaaatctggattataaagttggctggaagaaactgaaggaagtatttagtatggctggtgtggtggtccgagcagacattcttgaagataaagatggaaaaagtcgtggaataggcactgttacttttgaacagtccattgaagctgtgcaagctatatctatgttcaatggccagctgctatttgatagaccaatgcacgtcaagatggatgagagggccttaccaaaaggagatttcttccctcctgagcgtccacaacaacttccccatggccttggtggtattggcatggggttaggaccaggagggcaacccattgatgccaatcacctgaataaaggcatcggaatgggaaacataggtcccgcaggaatgggaatggaaggcataggatttggaataaataaaatgggaggaatggaggggccctttggtggtggtatggaaaacatgggtcgatttggatctgggatgaacatgggcaggataaatggtggaggtggaggaagcgtccctgggatcgagaggatgggtcctggcattgaccgcctcgggggtgccggcatggagcgcatgggcgcgggcctgggccacggcatggatcgcgtgggctccgagatcgagcgcatgggcctggtcatggaccgcatgggctccgtggagcgcatgggctccggcattgagcgcatgggcccgctgggcctcgaccacatggcctccagcattgagcgcatgggccagaccatggagcgcattggctctggcgtggagcgcatgggtgccggcatgggcttcggccttgagcgcatggccgctcccatcgaccgtgtgggccagaccattgagcgcatgggctctggcgtggagcgcatgggccctgccatcgagcgcatgggcctgagcatggagcgcatggtgcccgcaggtatgggagctggcctggagcgcatgggccccgtgatggatcgcatggccaccggcctggagcgcatgggcgccaacaatctggagcggatgggcctggagcgcatgggcgccaacagcctcgagcgcatgggcctggagcgcatgggtgccaacagcctcgagcgcatgggccccgccatgggcccggccctgggcgctggcattgagcgcatgggcctggccatgggtggcggtggcggtgccagctttgaccgtgccatcgagatggagcgtggcaacttcggaggaagcttcgcaggttcctttggtggagctggaggccatgctcctggggtggccaggaaggcctgccagatatttgtgagaaatctgccattcgatttcacatggaagatgctaaaggacaaattcaacgagtgcggccacgtgctgtacgccgacatcaagatggagaatgggaagtccaaggggtgtggtgtggttaagttcgagtcgccagaggtggccgagagagcctgccggatgatgaatggcatgaagctgagtggccgagagattgacgttcgaattgatagaaacgcttaagcagttgccttttttaaacatcgatacgagacctctgaatttgtattttttcttgttaaccattttaatttgttggctggatgtataaagatgtttaaaaaattcagttgctttttggggtaatttgaattacttttttaatgactggggttccatttgactgtttgcattgagattgcaatgtgcgcaattttttttgtagttgtggcatcttgttgacatcgaatatgactttgataataaataccggttcctgaaaa

SEQ ID NO: 299839 - DNA, 3377 bp, Homo sapiens
ccttcttgccgatcctcctctgagggtcccgccctctcgcgctgctcagtcccaaatgtctcctttgataagcacccataacacaggcccacctgctctgacagactcctctgcaggccttccctctccgctgactcattccctgagaaggaccactattcatcacccatctgcctcatcccaatgtctcctttggccacgctctctccataggaccctaccatgattctggagagtgcattttacatgcatgtcttttgatgtgaaatggcagtcacttaaagacctggttaaagaaaaagttggtgaggtaacatacgtggagctcttaatggacgctgaaggaaagtcaaggggatgtgctctgagagaatttcttctgtggatttactacatgaaaaatgtaactgtatggtggcgtggaatcgaatgaaatcaggaaggcagtgagtgctcatgttacagtagctatgtttgattttgccaaacatttgagtggggtgggaggggatttgcaaatgggagtcccgcttttccaaatggctggccaaagagctttttggtattctgtttggatgcccaatttggataactggggaccaatagcagcattgtctctttgttaacagaggaattggctgtgtgtgaattatgcatggaattttagcggtggtataattaatgtaaaacgtgtgttcttgtctagaaaatgttactcttggttgtttgctgaatttgaaagttgtgtgaaccaaagattccgaaaagttgcctttgtgccagtaaattgtaaaccaaatattaaaaacctgaatgttcaaaattggcctagtttaaagagaacataaactattttctgtcgtgcaatagaatggcttagaataatcaaaaggatgagcttaacttacggaagggatggatttaggaggaatatggtaaggactcgattgagtacagagggaagcagatctaaagttggtgtgatttcttggagaccctgaatttaggtctgcttattaaatgtcagcagctctagtgcaatgctggtaacgcgtaggagaaggagatattaaggagcccagcttttaacaaggaaggcgaggcgaggcacttctgtcagcttccccttagaagggttcattttaaaagactaactttgtgacataaatcatatttttagtttgtttataactgtcattggtatttactatttttttcttttctttttccccttccttgctcttctgactggtctctggcttcctccaaagggatgtgcgtaagtatcgtctagttacttattggtatttgagccttctaacttgtaggactggtttcactcgactcgtttccttttgactctatagtgttgttgaattcaagatggaagagagcatgaaaaaagctgcggaagtcctaaacaagcatagtctgagcggaagaccactgaaagtcaaagaagatcctgatggtgaacatgccaggagagcaatgcaaaaggtgatggctacgactggtgggatgggtatgggaccaggtggcccaggaatgattactatcccacccagtatcctaaataatcccaacatcccaaatgagattatccatgcattacaggctggaagacttggaagcacagtatttgtagcaaatctggattataaagttggctggaagaaactgaaggaagtatttagtatggctggtgtggtggtccgagcagacattcttgaagataaagatggaaaaagtcgtggaataggcactgttacttttgaacagtccattgaagctgtgcaagctatatctatgttcaatggccagctgctatttgatagaccaatgcacgtcaagatggatgagagggccttaccaaaaggagatttcttccctcctgagcgtccacaacaacttccccatggccttggtggtattggcatggggttaggaccaggagggcaacccattgatgccaatcacctgaataaaggcatcggaatgggaaacataggtcccgcaggaatggaggggccctttggtggtggtatggaaaacatgggtcgatttggatctgggatgaacatgggcaggataaatggtggaggtggaggaagcgtccctgggatcgagaggatgggtcctggcattgaccgcctcgggggtgccggcatggagcgcatgggcgcgggcctgggccacggcatggatcgcgtgggctccgagatcgagcgcatgggcctggtcatggaccgcatgggctccgtggagcgcatgggctccggcattgagcgcatgggcccgctgggcctcgaccacatggcctccagcattgagcgcatgggccagaccatggagcgcattggctctggcgtggagcgcatgggtgccggcatgggcttcggccttgagcgcatggccgctcccatcgaccgtgtgggccagaccattgagcgcatgggctctggcgtggagcgcatgggccctgccatcgagcgcatgggcctgagcatggagcgcatggtgcccgcaggtatgggagctggcctggagcgcatgggccccgtgatggatcgcatggccaccggcctggagcgcatgggcgccaacaatctggagcggatgggcctggagcgcatgggcgccaacagcctcgagcgcatgggcctggagcgcatgggtgccaacagcctcgagcgcatgggccccgccatgggcccggccctgggcgctggcattgagcgcatgggcctggccatgggtggcggtggcggtgccagctttgaccgtgccatcgagatggagcgtggcaacttcggaggaagcttcgcaggttcctttggtggagctggaggccatgctcctggggtggccaggaaggcctgccagatatttgtgagaaatctgccattcgatttcacatggaagatgctaaaggacaaattcaacgagtgcggccacgtgctgtacgccgacatcaagatggagaatgggaagtccaaggggtgtggtgtggttaagttcgagtcgccagaggtggccgagagagcctgccggatgatgaatggcatgaagctgagtggccgagagattgacgttcgaattgatagaaacgcttaagcagttgccttttttaaacatcgatacgagacctctgaatttgtattttttcttgttaaccattttaatttgttggctggatgtataaagatgtttaaaaaattcagttgctttttggggtaatttgaattacttttttaatgactggggttccatttgactgtttgcattgagattgcaatgtgcgcaattttttttgtagttgtggcatcttgttgacatcgaatatgactttgataataaataccggttcctgaaaa

SEQ ID NO: 299840 - DNA, 6909 bp, Homo sapiens
  misc_feature (2162)..(2162): n is a, c, g, or t
  misc_feature (2337)..(2337): n is a, c, g, or t
ccttcttgccgatcctcctctgagggtcccgccctctcgcgctgctcagtcccaaatgtctcctttgataagcacccataacacaggcccacctgctctgacagactcctctgcaggccttccctctccgctgactcattccctgagaaggaccactattcatcacccatctgcctcatcccaatgtctcctttggccacgctctctccataggaccctaccatgattctggagagtgcattttacatgcatgtcttttgatgtgaaatggcagtcacttaaagacctggttaaagaaaaagttggtgaggtaacatacgtggagctcttaatggacgctgaaggaaagtcaaggggatgtgctctgagagaatttcttctgtggatttactacatgaaaaatgtaactgtatggtggcgtggaatcgaatgaaatcaggaaggcagtgagtgctcatgttacagtagctatgtttgattttgccaaacatttgagtggggtgggaggggatttgcaaatgggagtcccgcttttccaaatggctggccaaagagctttttggtattctgtttggatgcccaatttggataactggggaccaatagcagcattgtctctttgttaacagaggaattggctgtgtgtgaattatgcatggaattttagcggtggtataattaatgtaaaacgtgtgttcttgtctagaaaatgttactcttggttgtttgctgaatttgaaagttgtgtgaaccaaagattccgaaaagttgcctttgtgccagtaaattgtaaaccaaatattaaaaacctgaatgttcaaaattggcctagtttaaagagaacataaactattttctgtcgtgcaatagaatggcttagaataatcaaaaggatgagcttaacttacggaagggatggatttaggaggaatatggtaaggactcgattgagtacagagggaagcagatctaaagttggtgtgatttcttggagaccctgaatttaggtctgcttattaaatgtcagcagctctagtgcaatgctggtaacgcgtaggagaaggagatattaaggagcccagcttttaacaaggaaggcgaggcgaggcacttctgtcagcttccccttagaagggttcattttaaaagactaactttgtgacataaatcatatttttagtttgtttataactgtcattggtatttactatttttttcttttctttttccccttccttgctcttctgactggtctctggcttcctccaaagggatgtgcgtaagtatcgtctagttacttattggtatttgagccttctaacttgtaggactggtttcactcgactcgtttccttttgactctatagtgttgttgaattcaagatggaagagagcatgaaaaaagctgcggaagtcctaaacaagcatagtctgagcggaagaccactgaaagtcaaagaagtaagctcttgcttaacactgcggatactgtgtgtaattgttgagtgatcctactttggaattagggaaagacggtcatggtcccagacggcatttacaaagcaagtgccagcctgttgtttctaatgaagagtgtcggtcatagcctacagcagccattccctgcaaggactttggggtggtggccaagcagatcctgagtggctgctgaccaccttctaatatctgtgatttgtctgaggccttgttgtctcagggactctcaaaccatgagcccgtgggtttgtgccattaagttttactccatctgacccttcttcttggcccatcttttttctttttttaaaaagtgagtttgttccagcctgggcaacatggtgaaaccccctctctacaaaaggtacaaaaattagccaggcatggtggcgcatgcctgtagtcctagctacttgggaggctgaggcaggaggatcatttgagcccaggatgtggaggttgcagtgagctgagattgcaccattgcactccagcccgggcaacagtgagaccctgtctaaaaaataaaaaataaagtgagtttgttattcctcaaacctgctttcacatctcatctgaatcaaatatattccttgaggaagaaggtttttttgttgattaaatccctcttggctgggcgcagtggctcacgcctgtaatccccngcactttgggaggctgaggtgggtggatcaaggtcatgagttcaagaccagcttgaccaacatggtgaaaccctgtctactaaaaatacaaaaaattagctgggcgtagtggggggtgcctgtaatccatctactcgggaggctgaggcaggagaatcgctggaacccaggaggnggaggttgcagtgagccgagatcgcgccattgaactccagcctgggcagtaagagcaaagctctgtctcaaaaaaacatccctcttaacttcttttcacctcttctcttggggaggaagatgagtagattcagagtgaagcttggtagggtctaaggtctctcatgtgttatgatgtcttttttagtgctgatggtggtaattgacaggacagagagttgaagaagagagtcagtacagagcttcacagaccttcccagatgttgttttactgcgcagccctcacacacacgcctccaacacctgaaggacttgaaggatgggggcgcttgtgtggtctagaactgtttctcaaacttctggaagccattgacggggtttgcagaagttacaaaaccccattgatgaattagtaagattcagctataccaagcccatgaagctctaatttcagtctggcggttctacattatatcagctaatcatgtttccctccctaccctgcttttcttttttacttagtgcaattgagagctgtgtttttagtgctacacttcatgccttttcttcctttcctatttctttagctggactcttctaagctggtagttgagttcatttgactttcttgttaatagatttgagagatgctttccaaacaacctttcagtttctaagtcttgagaatatcatttactgtgcaagcatggtttgcgttgtactgggtcagttaaacgtaacaccttttgtgcttgttttaggatcctgatggtgaacatgccaggagagcaatgcaaaaggtgatggctacgactggtgggatgggtatgggaccaggtggcccaggaatgattactatcccacccagtatcctaaataatcccaacatcccaaatgagattatccatgcattacaggctggaagacttggaagcacagtatttgtagcaaatgtaagtaaacagaaccatcgtctaaagtagaaaatcagaactttatgaaatgaccttgtcaatatgttataaaagtaattctcacatttgagaagaaaaatgtaaagaagggttttgttcttgatttctttaaaaatcagccttataggcgggctttgtctgcattcctaagtcacaggcttgaccgtggtctcgttggggctgtgattcctgagtttcgcaggtgtttccacaagcagtaaccgagtctgcattctccgttggtttattttatgcagttttggtgcagagtaagactgtacgagcagaagtgcactgacaccttcctcttgttgtgtctggggtgaatgataatacctccaccatctgcaaggggaaatatttagaataaagtaggttgggtggggtggggagtggtaaagcttatcagggaaacaattttttaaaaatgttcagaaaatgagtattaatttgaagtatgaggtgacttaagtttctgagaaaagagacaatatatttactataggtacagtttatttacagtgaaggccaggctttataatcctattttaaaatttccattgcagttgattagtttttgtgacattatttcctaatacttttttccaaccaaagcatgtatcattcatgtagtaaaaatgttgtgtttcttaagatgtttacattgaggtttttaccccgttctctctcgattagctggattataaagttggctggaagaaactgaaggaagtatttagtatggctggtgtggtggtccgagcagacattcttgaagataaagatggaaaaagtcgtggaataggcactgttacttttgaacagtccattgaagctgtgcaagctatatgtatccttctgcaggaattcaacttatgaacagtttgacctaaattgctgtgttagtaatgtaggtttgtgtgaggaagaggtgactgtgtgtattcatgttttttatgtgactagggggagtgcattactgtggaattaagaggttctctgggccggaccggtcacggtggctcacgcctgtaatcccagcacttcgggaggccaaggcgggcggatcacttgaggtcagttcgagaccagcctggccaacatggtgaaaccccggctctactaaaaaatgcaaaaattagctgggcgcagtggtgggtgcctgtaatcccagctactcgggaggctgaggcacaagaatcgcttgaacccgggaggtggaggttgcagtgagccgagattgcgccactgcacaccaccagcctgggtgatagagtgagactcagtctcaaaaaaaaaaaaaaaaaaaaaaaaaaaggttctctgggggtggaattgattcaatacagtgtggatagaggggatggttacaacatgggcatatgcccatgagtctttctactgttttcttttcagaagagtctaggtttgaaggaggaagtccaaagaatgtgctactagagagaaagtggggttgttgtttcatgtgtaatacatccttataggacctcactctttccagtgagtagacatcattttggagaggccacttctccttgaccctaggcttagcctagagtttttaatcccttggagagtaccccacaggagcacattcatacaactcagacaagaccgtcactgcatgtcttacccagaaaacatggtccttcagtttagatagtggtagatgcctggcccattggtcacattcagagaaccttgatgccactgcttaagaggatggtttggtgaaattgtaaggttacgaatgaagcttcacacctaaggaataagcagaagttgtcttgtcctccccgccagctttatttattgttccttttatgtttattgttgaaagtataatgaagaattgaaattgctcataaattcatcacttagagggactggtagcagttggagtatttttctttctttttgtatttctcttgtgcacatttttagaattgcaagaaatagccttaattgtaataccagctatgttcaatggccagctgctatttgatagaccaatgcacgtcaagatggatgagagggccttaccaaaaggagatttcttccctcctgagcgtccacaacaacttccccatggccttggtggtattggcatggggttaggaccaggagggcaacccattgatgccaatcacctgaataaaggcatcggaatgggaaacataggtcccgcaggaatgggaatggaaggcataggatttggaataaataaaatgggaggaatggaggggccctttggtggtggtatggaaaacatgggtcgatttggatctgggatgaacatgggcaggataaatgaaatcctaagtaatgcactgaagagaggagagatcattgcaaagcagggaggaggtggaggtggaggaagcgtccctgggatcgagaggatgggtcctggcattgaccgcctcgggggtgccggcatggagcgcatgggcgcgggcctgggccacggcatggatcgcgtgggctccgagatcgagcgcatgggcctggtcatggaccgcatgggctccgtggagcgcatgggctccggcattgagcgcatgggcccgctgggcctcgaccacatggcctccagcattgagcgcatggcgcatggccgctcccatcgaccgtgtgggccagaccattgagcgcatgggctctggcgtggagcgcatgggccctgccatcgagcgcatgggcctgagcatggagcgcatggtgcccgcaggtatgggagctggcctggagcgcatgggccccgtgatggatcgcatggccaccggcctggagcgcatgggcgccaacaatctggagcggatgggcctggagcgcatgggcgccaacagcctcgagcgcatgggcctggagcgcatgggtgccaacagcctcgagcgcatgggccccgccatgggcccggccctgggcgctggcattgagcgcatgggcctggccatgggtggcggtggcggtgccagctttgaccgtgccatcgagatggagcgtggcaacttcggaggaagcttcgcaggttcctttggtggagctggaggccatgctcctggggtggccaggaaggcctgccagatatttgtgagaaatctgccattcgatttcacatggaagatgctaaaggacaaattcaacgagtgcggccacgtgctgtacgccgacatcaagatggagaatgggaagtccaaggggtgtggtgtggttaagttcgagtcgccagaggtggccgagagagcctgccggatgatgaatggcatgaagctgagtggccgagagattgacgttcgaattgatagaaacgcttaagcagttgccttttttaaacatcgatacgagacctctgaatttgtattttttcttgttaaccattttaatttgttggctggatgtataaagatgtttaaaaaattcagttgctttttggggtaatttgaattacttttttaatgactggggttccatttgactgtttgcattgagattgcaatgtgcgcaattttttttgtagttgtggcatcttgttgacatcgaatatgactttgataataaataccggttcctgaaaa

SEQ ID NO: 299841 - DNA, 6884 bp, Homo sapiens
  misc_feature (2162)..(2162): n is a, c, g, or t
  misc_feature (2337)..(2337): n is a, c, g, or t
ccttcttgccgatcctcctctgagggtcccgccctctcgcgctgctcagtcccaaatgtctcctttgataagcacccataacacaggcccacctgctctgacagactcctctgcaggccttccctctccgctgactcattccctgagaaggaccactattcatcacccatctgcctcatcccaatgtctcctttggccacgctctctccataggaccctaccatgattctggagagtgcattttacatgcatgtcttttgatgtgaaatggcagtcacttaaagacctggttaaagaaaaagttggtgaggtaacatacgtggagctcttaatggacgctgaaggaaagtcaaggggatgtgctctgagagaatttcttctgtggatttactacatgaaaaatgtaactgtatggtggcgtggaatcgaatgaaatcaggaaggcagtgagtgctcatgttacagtagctatgtttgattttgccaaacatttgagtggggtgggaggggatttgcaaatgggagtcccgcttttccaaatggctggccaaagagctttttggtattctgtttggatgcccaatttggataactggggaccaatagcagcattgtctctttgttaacagaggaattggctgtgtgtgaattatgcatggaattttagcggtggtataattaatgtaaaacgtgtgttcttgtctagaaaatgttactcttggttgtttgctgaatttgaaagttgtgtgaaccaaagattccgaaaagttgcctttgtgccagtaaattgtaaaccaaatattaaaaacctgaatgttcaaaattggcctagtttaaagagaacataaactattttctgtcgtgcaatagaatggcttagaataatcaaaaggatgagcttaacttacggaagggatggatttaggaggaatatggtaaggactcgattgagtacagagggaagcagatctaaagttggtgtgatttcttggagaccctgaatttaggtctgcttattaaatgtcagcagctctagtgcaatgctggtaacgcgtaggagaaggagatattaaggagcccagcttttaacaaggaaggcgaggcgaggcacttctgtcagcttccccttagaagggttcattttaaaagactaactttgtgacataaatcatatttttagtttgtttataactgtcattggtatttactatttttttcttttctttttccccttccttgctcttctgactggtctctggcttcctccaaagggatgtgcgtaagtatcgtctagttacttattggtatttgagccttctaacttgtaggactggtttcactcgactcgtttccttttgactctatagtgttgttgaattcaagatggaagagagcatgaaaaaagctgcggaagtcctaaacaagcatagtctgagcggaagaccactgaaagtcaaagaagtaagctcttgcttaacactgcggatactgtgtgtaattgttgagtgatcctactttggaattagggaaagacggtcatggtcccagacggcatttacaaagcaagtgccagcctgttgtttctaatgaagagtgtcggtcatagcctacagcagccattccctgcaaggactttggggtggtggccaagcagatcctgagtggctgctgaccaccttctaatatctgtgatttgtctgaggccttgttgtctcagggactctcaaaccatgagcccgtgggtttgtgccattaagttttactccatctgacccttcttcttggcccatcttttttctttttttaaaaagtgagtttgttccagcctgggcaacatggtgaaaccccctctctacaaaaggtacaaaaattagccaggcatggtggcgcatgcctgtagtcctagctacttgggaggctgaggcaggaggatcatttgagcccaggatgtggaggttgcagtgagctgagattgcaccattgcactccagcccgggcaacagtgagaccctgtctaaaaaataaaaaataaagtgagtttgttattcctcaaacctgctttcacatctcatctgaatcaaatatattccttgaggaagaaggtttttttgttgattaaatccctcttggctgggcgcagtggctcacgcctgtaatccccngcactttgggaggctgaggtgggtggatcaaggtcatgagttcaagaccagcttgaccaacatggtgaaaccctgtctactaaaaatacaaaaaattagctgggcgtagtggggggtgcctgtaatccatctactcgggaggctgaggcaggagaatcgctggaacccaggaggnggaggttgcagtgagccgagatcgcgccattgaactccagcctgggcagtaagagcaaagctctgtctcaaaaaaacatccctcttaacttcttttcacctcttctcttggggaggaagatgagtagattcagagtgaagcttggtagggtctaaggtctctcatgtgttatgatgtcttttttagtgctgatggtggtaattgacaggacagagagttgaagaagagagtcagtacagagcttcacagaccttcccagatgttgttttactgcgcagccctcacacacacgcctccaacacctgaaggacttgaaggatgggggcgcttgtgtggtctagaactgtttctcaaacttctggaagccattgacggggtttgcagaagttacaaaaccccattgatgaattagtaagattcagctataccaagcccatgaagctctaatttcagtctggcggttctacattatatcagctaatcatgtttccctccctaccctgcttttcttttttacttagtgcaattgagagctgtgtttttagtgctacacttcatgccttttcttcctttcctatttctttagctggactcttctaagctggtagttgagttcatttgactttcttgttaatagatttgagagatgctttccaaacaacctttcagtttctaagtcttgagaatatcatttactgtgcaagcatggtttgcgttgtactgggtcagttaaacgtaacaccttttgtgcttgttttaggatcctgatggtgaacatgccaggagagcaatgcaaaaggtgatggctacgactggtgggatgggtatgggaccaggtggcccaggaatgattactatcccacccagtatcctaaataatcccaacatcccaaatgagattatccatgcattacaggctggaagacttggaagcacagtatttgtagcaaatgtaagtaaacagaaccatcgtctaaagtagaaaatcagaactttatgaaatgaccttgtcaatatgttataaaagtaattctcacatttgagaagaaaaatgtaaagaagggttttgttcttgatttctttaaaaatcagccttataggcgggctttgtctgcattcctaagtcacaggcttgaccgtggtctcgttggggctgtgattcctgagtttcgcaggtgtttccacaagcagtaaccgagtctgcattctccgttggtttattttatgcagttttggtgcagagtaagactgtacgagcagaagtgcactgacaccttcctcttgttgtgtctggggtgaatgataatacctccaccatctgcaaggggaaatatttagaataaagtaggttgggtggggtggggagtggtaaagcttatcagggaaacaattttttaaaaatgttcagaaaatgagtattaatttgaagtatgaggtgacttaagtttctgagaaaagagacaatatatttactataggtacagtttatttacagtgaaggccaggctttataatcctattttaaaatttccattgcagttgattagtttttgtgacattatttcctaatacttttttccaaccaaagcatgtatcattcatgtagtaaaaatgttgtgtttcttaagatgtttacattgaggtttttaccccgttctctctcgattagctggattataaagttggctggaagaaactgaaggaagtatttagtatggctggtgtggtggtccgagcagacattcttgaagataaagatggaaaaagtcgtggaataggcactgttacttttgaacagtccattgaagctgtgcaagctatatgtatccttctgcaggaattcaacttatgaacagtttgacctaaattgctgtgttagtaatgtaggtttgtgtgaggaagaggtgactgtgtgtattcatgttttttatgtgactagggggagtgcattactgtggaattaagaggttctctgggccggaccggtcacggtggctcacgcctgtaatcccagcacttcgggaggccaaggcgggcggatcacttgaggtcagttcgagaccagcctggccaacatggtgaaaccccggctctactaaaaaatgcaaaaattagctgggcgcagtggtgggtgcctgtaatcccagctactcgggaggctgaggcacaagaatcgcttgaacccgggaggtggaggttgcagtgagccgagattgcgccactgcacaccaccagcctgggtgatagagtgagactcagtctcaaaaaaaaaaaaaaaaaaaaaaaaaaaggttctctgggggtggaattgattcaatacagtgtggatagaggggatggttacaacatgggcatatgcccatgagtctttctactgttttcttttcagaagagtctaggtttgaaggaggaagtccaaagaatgtgctactagagagaaagtggggttgttgtttcatgtgtaatacatccttataggacctcactctttccagtgagtagacatcattttggagaggccacttctccttgaccctaggcttagcctagagtttttaatcccttggagagtaccccacaggagcacattcatacaactcagacaagaccgtcactgcatgtcttacccagaaaacatggtccttcagtttagatagtggtagatgcctggcccattggtcacattcagagaaccttgatgccactgcttaagaggatggtttggtgaaattgtaaggttacgaatgaagcttcacacctaaggaataagcagaagttgtcttgtcctccccgccagctttatttattgttccttttatgtttattgttgaaagtataatgaagaattgaaattgctcataaattcatcacttagagggactggtagcagttggagtatttttctttctttttgtatttctcttgtgcacatttttagaattgcaagaaatagccttaattgtaataccagctatgttcaatggccagctgctatttgatagaccaatgcacgtcaagatggatgagagggccttaccaaaaggagatttcttccctcctgagcgtccacaacaacttccccatggccttggtggtattggcatggggttaggaccaggagggcaacccattgatgccaatcacctgaataaaggcatcggaatgggaaacataggtcccgcaggaatgggaatggaaggcataggatttggaataaataaaatgggaggaatggaggggccctttggtggtggtatggaaaacatgggtcgatttggatctgggatgaacatgggcaggataaatggtggaggtggaggaagcgtccctgggatcgagaggatgggtcctggcattgaccgcctcgggggtgccggcatggagcgcatgggcgcgggcctgggccacggcatggatcgcgtgggctccgagatcgagcgcatgggcctggtcatggaccgcatgggctccgtggagcgcatgggctccggcattgagcgcatgggcccgctgggcctcgaccacatggcctccagcattgagcgcatgggccagaccatggagcgcattggctctggcgtggagcgcatgggtgccggcatgggcttcggccttgagcgcatggccgctcccatcgaccgtgtgggccagaccattgagcgcatgggctctggcgtggagcgcatgggccctgccatcgagcgcatgggcctgagcatggagcgcatggtgcccgcaggtatgggagctggcctggagcgcatgggccccgtgatggatcgcatggccaccggcctggagcgcatgggcgccaacagcctcgagcgcatgggcctggagcgcatgggtgccaacagcctcgagcgcatgggccccgccatgggcccggccctgggcgctggcattgagcgcatgggcctggccatgggtggcggtggcggtgccagctttgaccgtgccatcgagatggagcgtggcaacttcggaggaagcttcgcaggttcctttggtggagctggaggccatgctcctggggtggccaggaaggcctgccagatatttgtgagaaatctgccattcgatttcacatggaagatgctaaaggacaaattcaacgagtgcggccacgtgctgtacgccgacatcaagatggagaatgggaagtccaaggggtgtggtgtggttaagttcgagtcgccagaggtggccgagagagcctgccggatgatgaatggcatgaagctgagtggccgagagattgacgttcgaattgatagaaacgcttaagcagttgccttttttaaacatcgatacgagacctctgaatttgtattttttcttgttaaccattttaatttgttggctggatgtataaagatgtttaaaaaattcagttgctttttggggtaatttgaattacttttttaatgactggggttccatttgactgtttgcattgagattgcaatgtgcgcaattttttttgtagttgtggcatcttgttgacatcgaatatgactttgataataaataccggttcctgaaaa

SEQ ID NO: 299842 - DNA, 6884 bp, Homo sapiens
  misc_feature (2162)..(2162): n is a, c, g, or t
  misc_feature (2337)..(2337): n is a, c, g, or t
ccttcttgccgatcctcctctgagggtcccgccctctcgcgctgctcagtcccaaatgtctcctttgataagcacccataacacaggcccacctgctctgacagactcctctgcaggccttccctctccgctgactcattccctgagaaggaccactattcatcacccatctgcctcatcccaatgtctcctttggccacgctctctccataggaccctaccatgattctggagagtgcattttacatgcatgtcttttgatgtgaaatggcagtcacttaaagacctggttaaagaaaaagttggtgaggtaacatacgtggagctcttaatggacgctgaaggaaagtcaaggggatgtgctctgagagaatttcttctgtggatttactacatgaaaaatgtaactgtatggtggcgtggaatcgaatgaaatcaggaaggcagtgagtgctcatgttacagtagctatgtttgattttgccaaacatttgagtggggtgggaggggatttgcaaatgggagtcccgcttttccaaatggctggccaaagagctttttggtattctgtttggatgcccaatttggataactggggaccaatagcagcattgtctctttgttaacagaggaattggctgtgtgtgaattatgcatggaattttagcggtggtataattaatgtaaaacgtgtgttcttgtctagaaaatgttactcttggttgtttgctgaatttgaaagttgtgtgaaccaaagattccgaaaagttgcctttgtgccagtaaattgtaaaccaaatattaaaaacctgaatgttcaaaattggcctagtttaaagagaacataaactattttctgtcgtgcaatagaatggcttagaataatcaaaaggatgagcttaacttacggaagggatggatttaggaggaatatggtaaggactcgattgagtacagagggaagcagatctaaagttggtgtgatttcttggagaccctgaatttaggtctgcttattaaatgtcagcagctctagtgcaatgctggtaacgcgtaggagaaggagatattaaggagcccagcttttaacaaggaaggcgaggcgaggcacttctgtcagcttccccttagaagggttcattttaaaagactaactttgtgacataaatcatatttttagtttgtttataactgtcattggtatttactatttttttcttttctttttccccttccttgctcttctgactggtctctggcttcctccaaagggatgtgcgtaagtatcgtctagttacttattggtatttgagccttctaacttgtaggactggtttcactcgactcgtttccttttgactctatagtgttgttgaattcaagatggaagagagcatgaaaaaagctgcggaagtcctaaacaagcatagtctgagcggaagaccactgaaagtcaaagaagtaagctcttgcttaacactgcggatactgtgtgtaattgttgagtgatcctactttggaattagggaaagacggtcatggtcccagacggcatttacaaagcaagtgccagcctgttgtttctaatgaagagtgtcggtcatagcctacagcagccattccctgcaaggactttggggtggtggccaagcagatcctgagtggctgctgaccaccttctaatatctgtgatttgtctgaggccttgttgtctcagggactctcaaaccatgagcccgtgggtttgtgccattaagttttactccatctgacccttcttcttggcccatcttttttctttttttaaaaagtgagtttgttccagcctgggcaacatggtgaaaccccctctctacaaaaggtacaaaaattagccaggcatggtggcgcatgcctgtagtcctagctacttgggaggctgaggcaggaggatcatttgagcccaggatgtggaggttgcagtgagctgagattgcaccattgcactccagcccgggcaacagtgagaccctgtctaaaaaataaaaaataaagtgagtttgttattcctcaaacctgctttcacatctcatctgaatcaaatatattccttgaggaagaaggtttttttgttgattaaatccctcttggctgggcgcagtggctcacgcctgtaatccccngcactttgggaggctgaggtgggtggatcaaggtcatgagttcaagaccagcttgaccaacatggtgaaaccctgtctactaaaaatacaaaaaattagctgggcgtagtggggggtgcctgtaatccatctactcgggaggctgaggcaggagaatcgctggaacccaggaggnggaggttgcagtgagccgagatcgcgccattgaactccagcctgggcagtaagagcaaagctctgtctcaaaaaaacatccctcttaacttcttttcacctcttctcttggggaggaagatgagtagattcagagtgaagcttggtagggtctaaggtctctcatgtgttatgatgtcttttttagtgctgatggtggtaattgacaggacagagagttgaagaagagagtcagtacagagcttcacagaccttcccagatgttgttttactgcgcagccctcacacacacgcctccaacacctgaaggacttgaaggatgggggcgcttgtgtggtctagaactgtttctcaaacttctggaagccattgacggggtttgcagaagttacaaaaccccattgatgaattagtaagattcagctataccaagcccatgaagctctaatttcagtctggcggttctacattatatcagctaatcatgtttccctccctaccctgcttttcttttttacttagtgcaattgagagctgtgtttttagtgctacacttcatgccttttcttcctttcctatttctttagctggactcttctaagctggtagttgagttcatttgactttcttgttaatagatttgagagatgctttccaaacaacctttcagtttctaagtcttgagaatatcatttactgtgcaagcatggtttgcgttgtactgggtcagttaaacgtaacaccttttgtgcttgttttaggatcctgatggtgaacatgccaggagagcaatgcaaaaggtgatggctacgactggtgggatgggtatgggaccaggtggcccaggaatgattactatcccacccagtatcctaaataatcccaacatcccaaatgagattatccatgcattacaggctggaagacttggaagcacagtatttgtagcaaatgtaagtaaacagaaccatcgtctaaagtagaaaatcagaactttatgaaatgaccttgtcaatatgttataaaagtaattctcacatttgagaagaaaaatgtaaagaagggttttgttcttgatttctttaaaaatcagccttataggcgggctttgtctgcattcctaagtcacaggcttgaccgtggtctcgttggggctgtgattcctgagtttcgcaggtgtttccacaagcagtaaccgagtctgcattctccgttggtttattttatgcagttttggtgcagagtaagactgtacgagcagaagtgcactgacaccttcctcttgttgtgtctggggtgaatgataatacctccaccatctgcaaggggaaatatttagaataaagtaggttgggtggggtggggagtggtaaagcttatcagggaaacaattttttaaaaatgttcagaaaatgagtattaatttgaagtatgaggtgacttaagtttctgagaaaagagacaatatatttactataggtacagtttatttacagtgaaggccaggctttataatcctattttaaaatttccattgcagttgattagtttttgtgacattatttcctaatacttttttccaaccaaagcatgtatcattcatgtagtaaaaatgttgtgtttcttaagatgtttacattgaggtttttaccccgttctctctcgattagctggattataaagttggctggaagaaactgaaggaagtatttagtatggctggtgtggtggtccgagcagacattcttgaagataaagatggaaaaagtcgtggaataggcactgttacttttgaacagtccattgaagctgtgcaagctatatgtatccttctgcaggaattcaacttatgaacagtttgacctaaattgctgtgttagtaatgtaggtttgtgtgaggaagaggtgactgtgtgtattcatgttttttatgtgactagggggagtgcattactgtggaattaagaggttctctgggccggaccggtcacggtggctcacgcctgtaatcccagcacttcgggaggccaaggcgggcggatcacttgaggtcagttcgagaccagcctggccaacatggtgaaaccccggctctactaaaaaatgcaaaaattagctgggcgcagtggtgggtgcctgtaatcccagctactcgggaggctgaggcacaagaatcgcttgaacccgggaggtggaggttgcagtgagccgagattgcgccactgcacaccaccagcctgggtgatagagtgagactcagtctcaaaaaaaaaaaaaaaaaaaaaaaaaaaggttctctgggggtggaattgattcaatacagtgtggatagaggggatggttacaacatgggcatatgcccatgagtctttctactgttttcttttcagaagagtctaggtttgaaggaggaagtccaaagaatgtgctactagagagaaagtggggttgttgtttcatgtgtaatacatccttataggacctcactctttccagtgagtagacatcattttggagaggccacttctccttgaccctaggcttagcctagagtttttaatcccttggagagtaccccacaggagcacattcatacaactcagacaagaccgtcactgcatgtcttacccagaaaacatggtccttcagtttagatagtggtagatgcctggcccattggtcacattcagagaaccttgatgccactgcttaagaggatggtttggtgaaattgtaaggttacgaatgaagcttcacacctaaggaataagcagaagttgtcttgtcctccccgccagctttatttattgttccttttatgtttattgttgaaagtataatgaagaattgaaattgctcataaattcatcacttagagggactggtagcagttggagtatttttctttctttttgtatttctcttgtgcacatttttagaattgcaagaaatagccttaattgtaataccagctatgttcaatggccagctgctatttgatagaccaatgcacgtcaagatggatgagagggccttaccaaaaggagatttcttccctcctgagcgtccacaacaacttccccatggccttggtggtattggcatggggttaggaccaggagggcaacccattgatgccaatcacctgaataaaggcatcggaatgggaaacataggtcccgcaggaatgggaatggaaggcataggatttggaataaataaaatgggaggaatggaggggccctttggtggtggtatggaaaacatgggtcgatttggatctgggatgaacatgggcaggataaatgaaatcctaagtaatgcactgaagagaggagagatcattgcaaagcagggaggaggtggaggtggaggaagcgtccctgggatcgagaggatgggtcctggcattgaccgcctcgggggtgccggcatggagcgcatgggcgcgggcctgggccacggcatggatcgcgtgggctccgagatcgagcgcatgggcctggtcatggaccgcatgggctccgtggagcgcatgggctccggcattgagcgcatgggcccgctgggcctcgaccacatggcctccagcattgagcgcatgggccagaccatggagcgcattggctctggcgtggagcgcatgggtgccggcatgggcttcggccttgagcgcatggccgctcccatcgaccgtgtgggccagaccattgagcgcatgggctctggcgtggagcgcatgggccctgccatcgagcgcatgggcctgagcatggagcgcatggtgcccgcaggtatgggagctggcctggagcgcatgggccccgtgatggatcgcatggccaccggcctggagcgcatgggcgccaacaatctggagcggatgggcctggagcgcatgggcgccaacagcctcgagcgcatgggcctggagcgcatgggtgccagctttgaccgtgccatcgagatggagcgtggcaacttcggaggaagcttcgcaggttcctttggtggagctggaggccatgctcctggggtggccaggaaggcctgccagatatttgtgagaaatctgccattcgatttcacatggaagatgctaaaggacaaattcaacgagtgcggccacgtgctgtacgccgacatcaagatggagaatgggaagtccaaggggtgtggtgtggttaagttcgagtcgccagaggtggccgagagagcctgccggatgatgaatggcatgaagctgagtggccgagagattgacgttcgaattgatagaaacgcttaagcagttgccttttttaaacatcgatacgagacctctgaatttgtattttttcttgttaaccattttaatttgttggctggatgtataaagatgtttaaaaaattcagttgctttttggggtaatttgaattacttttttaatgactggggttccatttgactgtttgcattgagattgcaatgtgcgcaattttttttgtagttgtggcatcttgttgacatcgaatatgactttgataataaataccggttcctgaaaa

SEQ ID NO: 299843 - DNA, 7065 bp, Homo sapiens
  misc_feature (2162)..(2162): n is a, c, g, or t
  misc_feature (2337)..(2337): n is a, c, g, or t
ccttcttgccgatcctcctctgagggtcccgccctctcgcgctgctcagtcccaaatgtctcctttgataagcacccataacacaggcccacctgctctgacagactcctctgcaggccttccctctccgctgactcattccctgagaaggaccactattcatcacccatctgcctcatcccaatgtctcctttggccacgctctctccataggaccctaccatgattctggagagtgcattttacatgcatgtcttttgatgtgaaatggcagtcacttaaagacctggttaaagaaaaagttggtgaggtaacatacgtggagctcttaatggacgctgaaggaaagtcaaggggatgtgctctgagagaatttcttctgtggatttactacatgaaaaatgtaactgtatggtggcgtggaatcgaatgaaatcaggaaggcagtgagtgctcatgttacagtagctatgtttgattttgccaaacatttgagtggggtgggaggggatttgcaaatgggagtcccgcttttccaaatggctggccaaagagctttttggtattctgtttggatgcccaatttggataactggggaccaatagcagcattgtctctttgttaacagaggaattggctgtgtgtgaattatgcatggaattttagcggtggtataattaatgtaaaacgtgtgttcttgtctagaaaatgttactcttggttgtttgctgaatttgaaagttgtgtgaaccaaagattccgaaaagttgcctttgtgccagtaaattgtaaaccaaatattaaaaacctgaatgttcaaaattggcctagtttaaagagaacataaactattttctgtcgtgcaatagaatggcttagaataatcaaaaggatgagcttaacttacggaagggatggatttaggaggaatatggtaaggactcgattgagtacagagggaagcagatctaaagttggtgtgatttcttggagaccctgaatttaggtctgcttattaaatgtcagcagctctagtgcaatgctggtaacgcgtaggagaaggagatattaaggagcccagcttttaacaaggaaggcgaggcgaggcacttctgtcagcttccccttagaagggttcattttaaaagactaactttgtgacataaatcatatttttagtttgtttataactgtcattggtatttactatttttttcttttctttttccccttccttgctcttctgactggtctctggcttcctccaaagggatgtgcgtaagtatcgtctagttacttattggtatttgagccttctaacttgtaggactggtttcactcgactcgtttccttttgactctatagtgttgttgaattcaagatggaagagagcatgaaaaaagctgcggaagtcctaaacaagcatagtctgagcggaagaccactgaaagtcaaagaagtaagctcttgcttaacactgcggatactgtgtgtaattgttgagtgatcctactttggaattagggaaagacggtcatggtcccagacggcatttacaaagcaagtgccagcctgttgtttctaatgaagagtgtcggtcatagcctacagcagccattccctgcaaggactttggggtggtggccaagcagatcctgagtggctgctgaccaccttctaatatctgtgatttgtctgaggccttgttgtctcagggactctcaaaccatgagcccgtgggtttgtgccattaagttttactccatctgacccttcttcttggcccatcttttttctttttttaaaaagtgagtttgttccagcctgggcaacatggtgaaaccccctctctacaaaaggtacaaaaattagccaggcatggtggcgcatgcctgtagtcctagctacttgggaggctgaggcaggaggatcatttgagcccaggatgtggaggttgcagtgagctgagattgcaccattgcactccagcccgggcaacagtgagaccctgtctaaaaaataaaaaataaagtgagtttgttattcctcaaacctgctttcacatctcatctgaatcaaatatattccttgaggaagaaggtttttttgttgattaaatccctcttggctgggcgcagtggctcacgcctgtaatccccngcactttgggaggctgaggtgggtggatcaaggtcatgagttcaagaccagcttgaccaacatggtgaaaccctgtctactaaaaatacaaaaaattagctgggcgtagtggggggtgcctgtaatccatctactcgggaggctgaggcaggagaatcgctggaacccaggaggnggaggttgcagtgagccgagatcgcgccattgaactccagcctgggcagtaagagcaaagctctgtctcaaaaaaacatccctcttaacttcttttcacctcttctcttggggaggaagatgagtagattcagagtgaagcttggtagggtctaaggtctctcatgtgttatgatgtcttttttagtgctgatggtggtaattgacaggacagagagttgaagaagagagtcagtacagagcttcacagaccttcccagatgttgttttactgcgcagccctcacacacacgcctccaacacctgaaggacttgaaggatgggggcgcttgtgtggtctagaactgtttctcaaacttctggaagccattgacggggtttgcagaagttacaaaaccccattgatgaattagtaagattcagctataccaagcccatgaagctctaatttcagtctggcggttctacattatatcagctaatcatgtttccctccctaccctgcttttcttttttacttagtgcaattgagagctgtgtttttagtgctacacttcatgccttttcttcctttcctatttctttagctggactcttctaagctggtagttgagttcatttgactttcttgttaatagatttgagagatgctttccaaacaacctttcagtttctaagtcttgagaatatcatttactgtgcaagcatggtttgcgttgtactgggtcagttaaacgtaacaccttttgtgcttgttttaggatcctgatggtgaacatgccaggagagcaatgcaaaaggtgatggctacgactggtgggatgggtatgggaccaggtggcccaggaatgattactatcccacccagtatcctaaataatcccaacatcccaaatgagattatccatgcattacaggctggaagacttggaagcacagtatttgtagcaaatgtaagtaaacagaaccatcgtctaaagtagaaaatcagaactttatgaaatgaccttgtcaatatgttataaaagtaattctcacatttgagaagaaaaatgtaaagaagggttttgttcttgatttctttaaaaatcagccttataggcgggctttgtctgcattcctaagtcacaggcttgaccgtggtctcgttggggctgtgattcctgagtttcgcaggtgtttccacaagcagtaaccgagtctgcattctccgttggtttattttatgcagttttggtgcagagtaagactgtacgagcagaagtgcactgacaccttcctcttgttgtgtctggggtgaatgataatacctccaccatctgcaaggggaaatatttagaataaagtaggttgggtggggtggggagtggtaaagcttatcagggaaacaattttttaaaaatgttcagaaaatgagtattaatttgaagtatgaggtgacttaagtttctgagaaaagagacaatatatttactataggtacagtttatttacagtgaaggccaggctttataatcctattttaaaatttccattgcagttgattagtttttgtgacattatttcctaatacttttttccaaccaaagcatgtatcattcatgtagtaaaaatgttgtgtttcttaagatgtttacattgaggtttttaccccgttctctctcgattagctggattataaagttggctggaagaaactgaaggaagtatttagtatggctggtgtggtggtccgagcagacattcttgaagataaagatggaaaaagtcgtggaataggcactgttacttttgaacagtccattgaagctgtgcaagctatatgtatccttctgcaggaattcaacttatgaacagtttgacctaaattgctgtgttagtaatgtaggtttgtgtgaggaagaggtgactgtgtgtattcatgttttttatgtgactagggggagtgcattactgtggaattaagaggttctctgggccggaccggtcacggtggctcacgcctgtaatcccagcacttcgggaggccaaggcgggcggatcacttgaggtcagttcgagaccagcctggccaacatggtgaaaccccggctctactaaaaaatgcaaaaattagctgggcgcagtggtgggtgcctgtaatcccagctactcgggaggctgaggcacaagaatcgcttgaacccgggaggtggaggttgcagtgagccgagattgcgccactgcacaccaccagcctgggtgatagagtgagactcagtctcaaaaaaaaaaaaaaaaaaaaaaaaaaaggttctctgggggtggaattgattcaatacagtgtggatagaggggatggttacaacatgggcatatgcccatgagtctttctactgttttcttttcagaagagtctaggtttgaaggaggaagtccaaagaatgtgctactagagagaaagtggggttgttgtttcatgtgtaatacatccttataggacctcactctttccagtgagtagacatcattttggagaggccacttctccttgaccctaggcttagcctagagtttttaatcccttggagagtaccccacaggagcacattcatacaactcagacaagaccgtcactgcatgtcttacccagaaaacatggtccttcagtttagatagtggtagatgcctggcccattggtcacattcagagaaccttgatgccactgcttaagaggatggtttggtgaaattgtaaggttacgaatgaagcttcacacctaaggaataagcagaagttgtcttgtcctccccgccagctttatttattgttccttttatgtttattgttgaaagtataatgaagaattgaaattgctcataaattcatcacttagagggactggtagcagttggagtatttttctttctttttgtatttctcttgtgcacatttttagaattgcaagaaatagccttaattgtaataccagctatgttcaatggccagctgctatttgatagaccaatgcacgtcaagatggatgagagggccttaccaaaaggagatttcttccctcctgagcgtccacaacaacttccccatggccttggtggtattggcatggggttaggaccaggagggcaacccattgatgccaatcacctgaataaaggcatcggaatgggaaacataggtcccgcaggaatgggaatggaaggcataggatttggaataaataaaatgggaggaatggaggggccctttggtggtggtatggaaaacatgggtcgatttggatctgggatgaacatgggcaggataaatgaaatcctaagtaatgcactgaagagaggagagatcattgcaaagcagggaggaggtggaggtggaggaagcgtccctgggatcgagaggatgggtcctggcattgaccgcctcgggggtgccggcatggagcgcatgggcgcgggcctgggccacggcatggatcgcgtgggctccgagatcgagcgcatgggcctggtcatggaccgcatgggctccgtggagcgcatgggctccggcattgagcgcatgggcccgctgggcctcgaccacatggcctccagcattgagcgcatgggccagaccatggagcgcattggctctggcgtggagcgcatgggtgccggcatgggcttcggccttgagcgcatggccgctcccatcgaccgtgtgggccagaccattgagcgcatgggctctggcgtggagcgcatgggccctgccatcgagcgcatgggcctgagcatggagcgcatggtgcccgcaggtatgggagctggcctggagcgcatgggccccgtgatggatcgcatggccaccggcctggagcgcatgggcgccaacaatctggagcggatgggcctggagcgcatgggcgccaacagcctcgagcgcatgggcctggagcgcatgggtgccaacagcctcgagcgcatgggccccgccatgggcccggccctgggcgctggcattgagcgcatgggcctggccatgggtggcggtggcggtgccagctttgaccgtgccatcgagatggagcgtggcaacttcggaggaagcttcgcaggttcctttggtggagctggaggccatgctcctggggtggccaggaaggcctgccagatatttgtgagaaatctgccattcgatttcacatggaagatgctaaaggacaaattcaacgagtgcggccacgtgctgtacgccgacatcaagatggagaatgggaagtccaaggggtgtggtgtggttaagttcgagtcgccagaggtggccgagagagcctgccggatgatgaatggcatgaagctgagtggccgagagattgacgttcgaattgatagaaacgcttaagcagttgccttttttaaacatcgatacgagacctctgaatttgtattttttcttgttaaccattttaatttgttggctggatgtataaagatgtttaaaaaattcagttgctttttggggtaatttgaattacttttttaatgactggggttccatttgactgtttgcattgagattgcaatgtgcgcaattttttttgtagttgtggcatcttgttgacatcgaatatgactttgataataaataccggttcctgaaaaaaaaaaaagggggcggcaaaatatactcggggggcccagtagggtcccgcttttttacaaggggccagagaggggtaaaaaagagggg

SEQ ID NO: 299844 - DNA, 7308 bp, Homo sapiens
  misc_feature (2162)..(2162): n is a, c, g, or t
  misc_feature (2337)..(2337): n is a, c, g, or t
ccttcttgccgatcctcctctgagggtcccgccctctcgcgctgctcagtcccaaatgtctcctttgataagcacccataacacaggcccacctgctctgacagactcctctgcaggccttccctctccgctgactcattccctgagaaggaccactattcatcacccatctgcctcatcccaatgtctcctttggccacgctctctccataggaccctaccatgattctggagagtgcattttacatgcatgtcttttgatgtgaaatggcagtcacttaaagacctggttaaagaaaaagttggtgaggtaacatacgtggagctcttaatggacgctgaaggaaagtcaaggggatgtgctctgagagaatttcttctgtggatttactacatgaaaaatgtaactgtatggtggcgtggaatcgaatgaaatcaggaaggcagtgagtgctcatgttacagtagctatgtttgattttgccaaacatttgagtggggtgggaggggatttgcaaatgggagtcccgcttttccaaatggctggccaaagagctttttggtattctgtttggatgcccaatttggataactggggaccaatagcagcattgtctctttgttaacagaggaattggctgtgtgtgaattatgcatggaattttagcggtggtataattaatgtaaaacgtgtgttcttgtctagaaaatgttactcttggttgtttgctgaatttgaaagttgtgtgaaccaaagattccgaaaagttgcctttgtgccagtaaattgtaaaccaaatattaaaaacctgaatgttcaaaattggcctagtttaaagagaacataaactattttctgtcgtgcaatagaatggcttagaataatcaaaaggatgagcttaacttacggaagggatggatttaggaggaatatggtaaggactcgattgagtacagagggaagcagatctaaagttggtgtgatttcttggagaccctgaatttaggtctgcttattaaatgtcagcagctctagtgcaatgctggtaacgcgtaggagaaggagatattaaggagcccagcttttaacaaggaaggcgaggcgaggcacttctgtcagcttccccttagaagggttcattttaaaagactaactttgtgacataaatcatatttttagtttgtttataactgtcattggtatttactatttttttcttttctttttccccttccttgctcttctgactggtctctggcttcctccaaagggatgtgcgtaagtatcgtctagttacttattggtatttgagccttctaacttgtaggactggtttcactcgactcgtttccttttgactctatagtgttgttgaattcaagatggaagagagcatgaaaaaagctgcggaagtcctaaacaagcatagtctgagcggaagaccactgaaagtcaaagaagtaagctcttgcttaacactgcggatactgtgtgtaattgttgagtgatcctactttggaattagggaaagacggtcatggtcccagacggcatttacaaagcaagtgccagcctgttgtttctaatgaagagtgtcggtcatagcctacagcagccattccctgcaaggactttggggtggtggccaagcagatcctgagtggctgctgaccaccttctaatatctgtgatttgtctgaggccttgttgtctcagggactctcaaaccatgagcccgtgggtttgtgccattaagttttactccatctgacccttcttcttggcccatcttttttctttttttaaaaagtgagtttgttccagcctgggcaacatggtgaaaccccctctctacaaaaggtacaaaaattagccaggcatggtggcgcatgcctgtagtcctagctacttgggaggctgaggcaggaggatcatttgagcccaggatgtggaggttgcagtgagctgagattgcaccattgcactccagcccgggcaacagtgagaccctgtctaaaaaataaaaaataaagtgagtttgttattcctcaaacctgctttcacatctcatctgaatcaaatatattccttgaggaagaaggtttttttgttgattaaatccctcttggctgggcgcagtggctcacgcctgtaatccccngcactttgggaggctgaggtgggtggatcaaggtcatgagttcaagaccagcttgaccaacatggtgaaaccctgtctactaaaaatacaaaaaattagctgggcgtagtggggggtgcctgtaatccatctactcgggaggctgaggcaggagaatcgctggaacccaggaggnggaggttgcagtgagccgagatcgcgccattgaactccagcctgggcagtaagagcaaagctctgtctcaaaaaaacatccctcttaacttcttttcacctcttctcttggggaggaagatgagtagattcagagtgaagcttggtagggtctaaggtctctcatgtgttatgatgtcttttttagtgctgatggtggtaattgacaggacagagagttgaagaagagagtcagtacagagcttcacagaccttcccagatgttgttttactgcgcagccctcacacacacgcctccaacacctgaaggacttgaaggatgggggcgcttgtgtggtctagaactgtttctcaaacttctggaagccattgacggggtttgcagaagttacaaaaccccattgatgaattagtaagattcagctataccaagcccatgaagctctaatttcagtctggcggttctacattatatcagctaatcatgtttccctccctaccctgcttttcttttttacttagtgcaattgagagctgtgtttttagtgctacacttcatgccttttcttcctttcctatttctttagctggactcttctaagctggtagttgagttcatttgactttcttgttaatagatttgagagatgctttccaaacaacctttcagtttctaagtcttgagaatatcatttactgtgcaagcatggtttgcgttgtactgggtcagttaaacgtaacaccttttgtgcttgttttaggatcctgatggtgaacatgccaggagagcaatgcaaaaggtgatggctacgactggtgggatgggtatgggaccaggtggcccaggaatgattactatcccacccagtatcctaaataatcccaacatcccaaatgagattatccatgcattacaggctggaagacttggaagcacagtatttgtagcaaatgtaagtaaacagaaccatcgtctaaagtagaaaatcagaactttatgaaatgaccttgtcaatatgttataaaagtaattctcacatttgagaagaaaaatgtaaagaagggttttgttcttgatttctttaaaaatcagccttataggcgggctttgtctgcattcctaagtcacaggcttgaccgtggtctcgttggggctgtgattcctgagtttcgcaggtgtttccacaagcagtaaccgagtctgcattctccgttggtttattttatgcagttttggtgcagagtaagactgtacgagcagaagtgcactgacaccttcctcttgttgtgtctggggtgaatgataatacctccaccatctgcaaggggaaatatttagaataaagtaggttgggtggggtggggagtggtaaagcttatcagggaaacaattttttaaaaatgttcagaaaatgagtattaatttgaagtatgaggtgacttaagtttctgagaaaagagacaatatatttactataggtacagtttatttacagtgaaggccaggctttataatcctattttaaaatttccattgcagttgattagtttttgtgacattatttcctaatacttttttccaaccaaagcatgtatcattcatgtagtaaaaatgttgtgtttcttaagatgtttacattgaggtttttaccccgttctctctcgattagctggattataaagttggctggaagaaactgaaggaagtatttagtatggctggtgtggtggtccgagcagacattcttgaagataaagatggaaaaagtcgtggaataggcactgttacttttgaacagtccattgaagctgtgcaagctatatgtatccttctgcaggaattcaacttatgaacagtttgacctaaattgctgtgttagtaatgtaggtttgtgtgaggaagaggtgactgtgtgtattcatgttttttatgtgactagggggagtgcattactgtggaattaagaggttctctgggccggaccggtcacggtggctcacgcctgtaatcccagcacttcgggaggccaaggcgggcggatcacttgaggtcagttcgagaccagcctggccaacatggtgaaaccccggctctactaaaaaatgcaaaaattagctgggcgcagtggtgggtgcctgtaatcccagctactcgggaggctgaggcacaagaatcgcttgaacccgggaggtggaggttgcagtgagccgagattgcgccactgcacaccaccagcctgggtgatagagtgagactcagtctcaaaaaaaaaaaaaaaaaaaaaaaaaaaggttctctgggggtggaattgattcaatacagtgtggatagaggggatggttacaacatgggcatatgcccatgagtctttctactgttttcttttcagaagagtctaggtttgaaggaggaagtccaaagaatgtgctactagagagaaagtggggttgttgtttcatgtgtaatacatccttataggacctcactctttccagtgagtagacatcattttggagaggccacttctccttgaccctaggcttagcctagagtttttaatcccttggagagtaccccacaggagcacattcatacaactcagacaagaccgtcactgcatgtcttacccagaaaacatggtccttcagtttagatagtggtagatgcctggcccattggtcacattcagagaaccttgatgccactgcttaagaggatggtttggtgaaattgtaaggttacgaatgaagcttcacacctaaggaataagcagaagttgtcttgtcctccccgccagctttatttattgttccttttatgtttattgttgaaagtataatgaagaattgaaattgctcataaattcatcacttagagggactggtagcagttggagtatttttctttctttttgtatttctcttgtgcacatttttagaattgcaagaaatagccttaattgtaataccagctatgttcaatggccagctgctatttgatagaccaatgcacgtcaagatggatgagagggccttaccaaaaggagatttcttccctcctgagcgtccacaacaacttccccatggccttggtggtattggcatggggttaggaccaggagggcaacccattgatgccaatcacctgaataaaggcatcggaatgggaaacataggtcccgcaggaatgggaatggaaggcataggatttggaataaataaaatgggaggaatggaggggccctttggtggtggtatggaaaacatgggtcgatttggatctgggatgaacatgggcaggataaatgaaatcctaagtaatgcactgaagagaggagagatcattgcaaagcagggaggaggtggaggtggaggaagcgtccctgggatcgagaggatgggtcctggcattgaccgcctcgggggtgccggcatggagcgcatgggcgcgggcctgggccacggcatggatcgcgtgggctccgagatcgagcgcatgggcctggtcatggaccgcatgggctccgtggagcgcatgggctccggcattgagcgcatgggcccgctgggcctcgaccacatggcctccagcattgagcgcatgggccagaccatggagcgcattggctctggcgtggagcgcatgggtgccggcatgggcttcggccttgagcgcatggccgctcccatcgaccgtgtgggccagaccattgagcgcatgggctctggcgtggagcgcatgggccctgccatcgagcgcatgggcctgagcatggagcgcatggtgcccgcaggtatgggagctggcctggagcgcatgggccccgtgatggatcgcatggccaccggcctggagcgcatgggcgccaacaatctggagcggatgggcctggagcgcatgggcgccaacagcctcgagcgcatgggcctggagcgcatgggtgccaacagcctcgagcgcatgggccccgccatgggcccggccctgggcgctggcattgagcgcatgggcctggccatgggtggcggtggcggtgccagctttgaccgtgccatcgagatggagcgtggcaacttcggaggaagcttcgcaggttcctttggtggagctggaggccatgctcctggggtggccaggaaggcctgccagatatttgtgagaaatctgccattcgatttcacatggaagatgctaaaggacaaattcaacgagtgcggccacgtgctgtacgccgacatcaagatggagaatgggaagtccaaggggtgtggtgtggttaagttcgagtcgccagaggtggccgagagagcctgccggatgatgaatggcatgaagctgagtggccgagagattgacgttcgaattgatagaaacgcttaagcagttgccttttttaaacatcgatacgagacctctgaatttgtattttttcttgttaaccattttaatttgttggctggatgtataaagatgtttaaaaaattcagttgctttttggggtaatttgaattacttttttaatgactggggttccatttgactgtttgcattgagattgcaatgtgcgcaattttttttgtagttgtggcatcttgttgacatcgaatatgactttgataataaataccggttcctgaaaacaaaaaaaacaaaagggggagcaggcacaaagaagaatacccactaggggtgacacaacacaaacgagcaccacaaatacaacggcaaacaggtcgcccccaaataggcaaccagaccataaaagcaagacactgacgcggcgacaaaacacacgcaggatggagcgaaacacggaagctggacaatatggagcagacacaacacactgggggggagaccacagggcgacacacgagagagaaagagcacaggaacgatcaataacgcgaaggtgcccccagctaacggacacaaaacaagaggaagacaacctacccgagatcatagcgc

SEQ ID NO: 299845 - DNA, 7168 bp, Homo sapiens
  misc_feature (2162)..(2162): n is a, c, g, or t
  misc_feature (2337)..(2337): n is a, c, g, or t
ccttcttgccgatcctcctctgagggtcccgccctctcgcgctgctcagtcccaaatgtctcctttgataagcacccataacacaggcccacctgctctgacagactcctctgcaggccttccctctccgctgactcattccctgagaaggaccactattcatcacccatctgcctcatcccaatgtctcctttggccacgctctctccataggaccctaccatgattctggagagtgcattttacatgcatgtcttttgatgtgaaatggcagtcacttaaagacctggttaaagaaaaagttggtgaggtaacatacgtggagctcttaatggacgctgaaggaaagtcaaggggatgtgctctgagagaatttcttctgtggatttactacatgaaaaatgtaactgtatggtggcgtggaatcgaatgaaatcaggaaggcagtgagtgctcatgttacagtagctatgtttgattttgccaaacatttgagtggggtgggaggggatttgcaaatgggagtcccgcttttccaaatggctggccaaagagctttttggtattctgtttggatgcccaatttggataactggggaccaatagcagcattgtctctttgttaacagaggaattggctgtgtgtgaattatgcatggaattttagcggtggtataattaatgtaaaacgtgtgttcttgtctagaaaatgttactcttggttgtttgctgaatttgaaagttgtgtgaaccaaagattccgaaaagttgcctttgtgccagtaaattgtaaaccaaatattaaaaacctgaatgttcaaaattggcctagtttaaagagaacataaactattttctgtcgtgcaatagaatggcttagaataatcaaaaggatgagcttaacttacggaagggatggatttaggaggaatatggtaaggactcgattgagtacagagggaagcagatctaaagttggtgtgatttcttggagaccctgaatttaggtctgcttattaaatgtcagcagctctagtgcaatgctggtaacgcgtaggagaaggagatattaaggagcccagcttttaacaaggaaggcgaggcgaggcacttctgtcagcttccccttagaagggttcattttaaaagactaactttgtgacataaatcatatttttagtttgtttataactgtcattggtatttactatttttttcttttctttttccccttccttgctcttctgactggtctctggcttcctccaaagggatgtgcgtaagtatcgtctagttacttattggtatttgagccttctaacttgtaggactggtttcactcgactcgtttccttttgactctatagtgttgttgaattcaagatggaagagagcatgaaaaaagctgcggaagtcctaaacaagcatagtctgagcggaagaccactgaaagtcaaagaagtaagctcttgcttaacactgcggatactgtgtgtaattgttgagtgatcctactttggaattagggaaagacggtcatggtcccagacggcatttacaaagcaagtgccagcctgttgtttctaatgaagagtgtcggtcatagcctacagcagccattccctgcaaggactttggggtggtggccaagcagatcctgagtggctgctgaccaccttctaatatctgtgatttgtctgaggccttgttgtctcagggactctcaaaccatgagcccgtgggtttgtgccattaagttttactccatctgacccttcttcttggcccatcttttttctttttttaaaaagtgagtttgttccagcctgggcaacatggtgaaaccccctctctacaaaaggtacaaaaattagccaggcatggtggcgcatgcctgtagtcctagctacttgggaggctgaggcaggaggatcatttgagcccaggatgtggaggttgcagtgagctgagattgcaccattgcactccagcccgggcaacagtgagaccctgtctaaaaaataaaaaataaagtgagtttgttattcctcaaacctgctttcacatctcatctgaatcaaatatattccttgaggaagaaggtttttttgttgattaaatccctcttggctgggcgcagtggctcacgcctgtaatccccngcactttgggaggctgaggtgggtggatcaaggtcatgagttcaagaccagcttgaccaacatggtgaaaccctgtctactaaaaatacaaaaaattagctgggcgtagtggggggtgcctgtaatccatctactcgggaggctgaggcaggagaatcgctggaacccaggaggnggaggttgcagtgagccgagatcgcgccattgaactccagcctgggcagtaagagcaaagctctgtctcaaaaaaacatccctcttaacttcttttcacctcttctcttggggaggaagatgagtagattcagagtgaagcttggtagggtctaaggtctctcatgtgttatgatgtcttttttagtgctgatggtggtaattgacaggacagagagttgaagaagagagtcagtacagagcttcacagaccttcccagatgttgttttactgcgcagccctcacacacacgcctccaacacctgaaggacttgaaggatgggggcgcttgtgtggtctagaactgtttctcaaacttctggaagccattgacggggtttgcagaagttacaaaaccccattgatgaattagtaagattcagctataccaagcccatgaagctctaatttcagtctggcggttctacattatatcagctaatcatgtttccctccctaccctgcttttcttttttacttagtgcaattgagagctgtgtttttagtgctacacttcatgccttttcttcctttcctatttctttagctggactcttctaagctggtagttgagttcatttgactttcttgttaatagatttgagagatgctttccaaacaacctttcagtttctaagtcttgagaatatcatttactgtgcaagcatggtttgcgttgtactgggtcagttaaacgtaacaccttttgtgcttgttttaggatcctgatggtgaacatgccaggagagcaatgcaaaaggtgatggctacgactggtgggatgggtatgggaccaggtggcccaggaatgattactatcccacccagtatcctaaataatcccaacatcccaaatgagattatccatgcattacaggctggaagacttggaagcacagtatttgtagcaaatgtaagtaaacagaaccatcgtctaaagtagaaaatcagaactttatgaaatgaccttgtcaatatgttataaaagtaattctcacatttgagaagaaaaatgtaaagaagggttttgttcttgatttctttaaaaatcagccttataggcgggctttgtctgcattcctaagtcacaggcttgaccgtggtctcgttggggctgtgattcctgagtttcgcaggtgtttccacaagcagtaaccgagtctgcattctccgttggtttattttatgcagttttggtgcagagtaagactgtacgagcagaagtgcactgacaccttcctcttgttgtgtctggggtgaatgataatacctccaccatctgcaaggggaaatatttagaataaagtaggttgggtggggtggggagtggtaaagcttatcagggaaacaattttttaaaaatgttcagaaaatgagtattaatttgaagtatgaggtgacttaagtttctgagaaaagagacaatatatttactataggtacagtttatttacagtgaaggccaggctttataatcctattttaaaatttccattgcagttgattagtttttgtgacattatttcctaatacttttttccaaccaaagcatgtatcattcatgtagtaaaaatgttgtgtttcttaagatgtttacattgaggtttttaccccgttctctctcgattagctggattataaagttggctggaagaaactgaaggaagtatttagtatggctggtgtggtggtccgagcagacattcttgaagataaagatggaaaaagtcgtggaataggcactgttacttttgaacagtccattgaagctgtgcaagctatatgtatccttctgcaggaattcaacttatgaacagtttgacctaaattgctgtgttagtaatgtaggtttgtgtgaggaagaggtgactgtgtgtattcatgttttttatgtgactagggggagtgcattactgtggaattaagaggttctctgggccggaccggtcacggtggctcacgcctgtaatcccagcacttcgggaggccaaggcgggcggatcacttgaggtcagttcgagaccagcctggccaacatggtgaaaccccggctctactaaaaaatgcaaaaattagctgggcgcagtggtgggtgcctgtaatcccagctactcgggaggctgaggcacaagaatcgcttgaacccgggaggtggaggttgcagtgagccgagattgcgccactgcacaccaccagcctgggtgatagagtgagactcagtctcaaaaaaaaaaaaaaaaaaaaaaaaaaaggttctctgggggtggaattgattcaatacagtgtggatagaggggatggttacaacatgggcatatgcccatgagtctttctactgttttcttttcagaagagtctaggtttgaaggaggaagtccaaagaatgtgctactagagagaaagtggggttgttgtttcatgtgtaatacatccttataggacctcactctttccagtgagtagacatcattttggagaggccacttctccttgaccctaggcttagcctagagtttttaatcccttggagagtaccccacaggagcacattcatacaactcagacaagaccgtcactgcatgtcttacccagaaaacatggtccttcagtttagatagtggtagatgcctggcccattggtcacattcagagaaccttgatgccactgcttaagaggatggtttggtgaaattgtaaggttacgaatgaagcttcacacctaaggaataagcagaagttgtcttgtcctccccgccagctttatttattgttccttttatgtttattgttgaaagtataatgaagaattgaaattgctcataaattcatcacttagagggactggtagcagttggagtatttttctttctttttgtatttctcttgtgcacatttttagaattgcaagaaatagccttaattgtaataccagctatgttcaatggccagctgctatttgatagaccaatgcacgtcaagatggatgagagggccttaccaaaaggagatttcttccctcctgagcgtccacaacaacttccccatggccttggtggtattggcatggggttaggaccaggagggcaacccattgatgccaatcacctgaataaaggcatcggaatgggaaacataggtcccgcaggaatgggaatggaaggcataggatttggaataaataaaatgggaggaatggaggggccctttggtggtggtatggaaaacatgggtcgatttggatctgggatgaacatgggcaggataaatgaaatcctaagtaatgcactgaagagaggagagatcattgcaaagcagggaggaggtggaggtggaggaagcgtccctgggatcgagaggatgggtcctggcattgaccgcctcgggggtgccggcatggagcgcatgggcgcgggcctgggccacggcatggatcgcgtgggctccgagatcgagcgcatgggcctggtcatggaccgcatgggctccgtggagcgcatgggctccggcattgagcgcatgggcccgctgggcctcgaccacatggcctccagcattgagcgcatgggccagaccatggagcgcattggctctggcgtggagcgcatgggtgccggcatgggcttcggccttgagcgcatggccgctcccatcgaccgtgtgggccagaccattgagcgcatgggctctggcgtggagcgcatgggccctgccatcgagcgcatgggcctgagcatggagcgcatggtgcccgcaggtatgggagctggcctggagcgcatgggccccgtgatggatcgcatggccaccggcctggagcgcatgggcgccaacaatctggagcggatgggcctggagcgcatgggcgccaacagcctcgagcgcatgggcctggagcgcatgggtgccaacagcctcgagcgcatgggccccgccatgggcccggccctgggcgctggcattgagcgcatgggcctggccatgggtggcggtggcggtgccagctttgaccgtgccatcgagatggagcgtggcaacttcggaggaagcttcgcaggttcctttggtggagctggaggccatgctcctggggtggccaggaaggcctgccagatatttgtgagaaatctgccattcgatttcacatggaagatgctaaaggacaaattcaacgagtgcggccacgtgctgtacgccgacatcaagatggagaatgggaagtccaaggggtgtggtgtggttaagttcgagtcgccagaggtggccgagagagcctgccggatgatgaatggcatgaagctgagtggccgagagattgacgttcgaattgatagaaacgcttaagcagttgccttttttaaacatcgatacgagacctctgaatttgtattttttcttgttaaccattttaatttgttggctggatgtataaagatgtttaaaaaattcagttgctttttggggtaatttgaattacttttttaatgactggggttccatttgactgtttgcattgagattgcaatgtgcgcaattttttttgtagttgtggcatcttgttgacatcgaatatgactttgataataaataccggttcctgaaaaaaaaaaaaaatactcacgcgactcatacgctatgcggtcgacgaacaccaaggtactcaaacgggacccatggggcaaaaatcggggtcccatgaaccaacattcttctggtcacacgtggtgaaaattctgccggacacccctattgataagtcgaacaacttacgaaaaagcggagtacccgtctcaaa

SEQ ID NO: 299846 - DNA, 7290 bp, Homo sapiens
  misc_feature (2162)..(2162): n is a, c, g, or t
  misc_feature (2337)..(2337): n is a, c, g, or t
ccttcttgccgatcctcctctgagggtcccgccctctcgcgctgctcagtcccaaatgtctcctttgataagcacccataacacaggcccacctgctctgacagactcctctgcaggccttccctctccgctgactcattccctgagaaggaccactattcatcacccatctgcctcatcccaatgtctcctttggccacgctctctccataggaccctaccatgattctggagagtgcattttacatgcatgtcttttgatgtgaaatggcagtcacttaaagacctggttaaagaaaaagttggtgaggtaacatacgtggagctcttaatggacgctgaaggaaagtcaaggggatgtgctctgagagaatttcttctgtggatttactacatgaaaaatgtaactgtatggtggcgtggaatcgaatgaaatcaggaaggcagtgagtgctcatgttacagtagctatgtttgattttgccaaacatttgagtggggtgggaggggatttgcaaatgggagtcccgcttttccaaatggctggccaaagagctttttggtattctgtttggatgcccaatttggataactggggaccaatagcagcattgtctctttgttaacagaggaattggctgtgtgtgaattatgcatggaattttagcggtggtataattaatgtaaaacgtgtgttcttgtctagaaaatgttactcttggttgtttgctgaatttgaaagttgtgtgaaccaaagattccgaaaagttgcctttgtgccagtaaattgtaaaccaaatattaaaaacctgaatgttcaaaattggcctagtttaaagagaacataaactattttctgtcgtgcaatagaatggcttagaataatcaaaaggatgagcttaacttacggaagggatggatttaggaggaatatggtaaggactcgattgagtacagagggaagcagatctaaagttggtgtgatttcttggagaccctgaatttaggtctgcttattaaatgtcagcagctctagtgcaatgctggtaacgcgtaggagaaggagatattaaggagcccagcttttaacaaggaaggcgaggcgaggcacttctgtcagcttccccttagaagggttcattttaaaagactaactttgtgacataaatcatatttttagtttgtttataactgtcattggtatttactatttttttcttttctttttccccttccttgctcttctgactggtctctggcttcctccaaagggatgtgcgtaagtatcgtctagttacttattggtatttgagccttctaacttgtaggactggtttcactcgactcgtttccttttgactctatagtgttgttgaattcaagatggaagagagcatgaaaaaagctgcggaagtcctaaacaagcatagtctgagcggaagaccactgaaagtcaaagaagtaagctcttgcttaacactgcggatactgtgtgtaattgttgagtgatcctactttggaattagggaaagacggtcatggtcccagacggcatttacaaagcaagtgccagcctgttgtttctaatgaagagtgtcggtcatagcctacagcagccattccctgcaaggactttggggtggtggccaagcagatcctgagtggctgctgaccaccttctaatatctgtgatttgtctgaggccttgttgtctcagggactctcaaaccatgagcccgtgggtttgtgccattaagttttactccatctgacccttcttcttggcccatcttttttctttttttaaaaagtgagtttgttccagcctgggcaacatggtgaaaccccctctctacaaaaggtacaaaaattagccaggcatggtggcgcatgcctgtagtcctagctacttgggaggctgaggcaggaggatcatttgagcccaggatgtggaggttgcagtgagctgagattgcaccattgcactccagcccgggcaacagtgagaccctgtctaaaaaataaaaaataaagtgagtttgttattcctcaaacctgctttcacatctcatctgaatcaaatatattccttgaggaagaaggtttttttgttgattaaatccctcttggctgggcgcagtggctcacgcctgtaatccccngcactttgggaggctgaggtgggtggatcaaggtcatgagttcaagaccagcttgaccaacatggtgaaaccctgtctactaaaaatacaaaaaattagctgggcgtagtggggggtgcctgtaatccatctactcgggaggctgaggcaggagaatcgctggaacccaggaggnggaggttgcagtgagccgagatcgcgccattgaactccagcctgggcagtaagagcaaagctctgtctcaaaaaaacatccctcttaacttcttttcacctcttctcttggggaggaagatgagtagattcagagtgaagcttggtagggtctaaggtctctcatgtgttatgatgtcttttttagtgctgatggtggtaattgacaggacagagagttgaagaagagagtcagtacagagcttcacagaccttcccagatgttgttttactgcgcagccctcacacacacgcctccaacacctgaaggacttgaaggatgggggcgcttgtgtggtctagaactgtttctcaaacttctggaagccattgacggggtttgcagaagttacaaaaccccattgatgaattagtaagattcagctataccaagcccatgaagctctaatttcagtctggcggttctacattatatcagctaatcatgtttccctccctaccctgcttttcttttttacttagtgcaattgagagctgtgtttttagtgctacacttcatgccttttcttcctttcctatttctttagctggactcttctaagctggtagttgagttcatttgactttcttgttaatagatttgagagatgctttccaaacaacctttcagtttctaagtcttgagaatatcatttactgtgcaagcatggtttgcgttgtactgggtcagttaaacgtaacaccttttgtgcttgttttaggatcctgatggtgaacatgccaggagagcaatgcaaaaggtgatggctacgactggtgggatgggtatgggaccaggtggcccaggaatgattactatcccacccagtatcctaaataatcccaacatcccaaatgagattatccatgcattacaggctggaagacttggaagcacagtatttgtagcaaatgtaagtaaacagaaccatcgtctaaagtagaaaatcagaactttatgaaatgaccttgtcaatatgttataaaagtaattctcacatttgagaagaaaaatgtaaagaagggttttgttcttgatttctttaaaaatcagccttataggcgggctttgtctgcattcctaagtcacaggcttgaccgtggtctcgttggggctgtgattcctgagtttcgcaggtgtttccacaagcagtaaccgagtctgcattctccgttggtttattttatgcagttttggtgcagagtaagactgtacgagcagaagtgcactgacaccttcctcttgttgtgtctggggtgaatgataatacctccaccatctgcaaggggaaatatttagaataaagtaggttgggtggggtggggagtggtaaagcttatcagggaaacaattttttaaaaatgttcagaaaatgagtattaatttgaagtatgaggtgacttaagtttctgagaaaagagacaatatatttactataggtacagtttatttacagtgaaggccaggctttataatcctattttaaaatttccattgcagttgattagtttttgtgacattatttcctaatacttttttccaaccaaagcatgtatcattcatgtagtaaaaatgttgtgtttcttaagatgtttacattgaggtttttaccccgttctctctcgattagctggattataaagttggctggaagaaactgaaggaagtatttagtatggctggtgtggtggtccgagcagacattcttgaagataaagatggaaaaagtcgtggaataggcactgttacttttgaacagtccattgaagctgtgcaagctatatgtatccttctgcaggaattcaacttatgaacagtttgacctaaattgctgtgttagtaatgtaggtttgtgtgaggaagaggtgactgtgtgtattcatgttttttatgtgactagggggagtgcattactgtggaattaagaggttctctgggccggaccggtcacggtggctcacgcctgtaatcccagcacttcgggaggccaaggcgggcggatcacttgaggtcagttcgagaccagcctggccaacatggtgaaaccccggctctactaaaaaatgcaaaaattagctgggcgcagtggtgggtgcctgtaatcccagctactcgggaggctgaggcacaagaatcgcttgaacccgggaggtggaggttgcagtgagccgagattgcgccactgcacaccaccagcctgggtgatagagtgagactcagtctcaaaaaaaaaaaaaaaaaaaaaaaaaaaggttctctgggggtggaattgattcaatacagtgtggatagaggggatggttacaacatgggcatatgcccatgagtctttctactgttttcttttcagaagagtctaggtttgaaggaggaagtccaaagaatgtgctactagagagaaagtggggttgttgtttcatgtgtaatacatccttataggacctcactctttccagtgagtagacatcattttggagaggccacttctccttgaccctaggcttagcctagagtttttaatcccttggagagtaccccacaggagcacattcatacaactcagacaagaccgtcactgcatgtcttacccagaaaacatggtccttcagtttagatagtggtagatgcctggcccattggtcacattcagagaaccttgatgccactgcttaagaggatggtttggtgaaattgtaaggttacgaatgaagcttcacacctaaggaataagcagaagttgtcttgtcctccccgccagctttatttattgttccttttatgtttattgttgaaagtataatgaagaattgaaattgctcataaattcatcacttagagggactggtagcagttggagtatttttctttctttttgtatttctcttgtgcacatttttagaattgcaagaaatagccttaattgtaataccagctatgttcaatggccagctgctatttgatagaccaatgcacgtcaagatggatgagagggccttaccaaaaggagatttcttccctcctgagcgtccacaacaacttccccatggccttggtggtattggcatggggttaggaccaggagggcaacccattgatgccaatcacctgaataaaggcatcggaatgggaaacataggtcccgcaggaatgggaatggaaggcataggatttggaataaataaaatgggaggaatggaggggccctttggtggtggtatggaaaacatgggtcgatttggatctgggatgaacatgggcaggataaatgaaatcctaagtaatgcactgaagagaggagagatcattgcaaagcagggaggaggtggaggtggaggaagcgtccctgggatcgagaggatgggtcctggcattgaccgcctcgggggtgccggcatggagcgcatgggcgcgggcctgggccacggcatggatcgcgtgggctccgagatcgagcgcatgggcctggtcatggaccgcatgggctccgtggagcgcatgggctccggcattgagcgcatgggcccgctgggcctcgaccacatggcctccagcattgagcgcatgggccagaccatggagcgcattggctctggcgtggagcgcatgggtgccggcatgggcttcggccttgagcgcatggccgctcccatcgaccgtgtgggccagaccattgagcgcatgggctctggcgtggagcgcatgggccctgccatcgagcgcatgggcctgagcatggagcgcatggtgcccgcaggtatgggagctggcctggagcgcatgggccccgtgatggatcgcatggccaccggcctggagcgcatgggcgccaacaatctggagcggatgggcctggagcgcatgggcgccaacagcctcgagcgcatgggcctggagcgcatgggtgccaacagcctcgagcgcatgggccccgccatgggcccggccctgggcgctggcattgagcgcatgggcctggccatgggtggcggtggcggtgccagctttgaccgtgccatcgagatggagcgtggcaacttcggaggaagcttcgcaggttcctttggtggagctggaggccatgctcctggggtggccaggaaggcctgccagatatttgtgagaaatctgccattcgatttcacatggaagatgctaaaggacaaattcaacgagtgcggccacgtgctgtacgccgacatcaagatggagaatgggaagtccaaggggtgtggtgtggttaagttcgagtcgccagaggtggccgagagagcctgccggatgatgaatggcatgaagctgagtggccgagagattgacgttcgaattgatagaaacgcttaagcagttgccttttttaaacatcgatacgagacctctgaatttgtattttttcttgttaaccattttaatttgttggctggatgtataaagatgtttaaaaaattcagttgctttttggggtaatttgaattacttttttaatgactggggttccatttgactgtttgcattgagattgcaatgtgcgcaattttttttgtagttgtggcatcttgttgacatcgaatatgactttgataataaataccggttcctgaaaaaaacacggacaagacaccacccaccacagagacgacagacaaaaacaggacccaaagagaacagcccagcgaccaacgccaaacaaacactactgcaaaaaaaggagcccacaaaagggcacagcctctaacccgcacaaacgatggcaggacgtaaacaagccacacaacggcacacaccgcccacccgcccatccgagacacaacccaaacgaggcaggcgagaacgggcaacacgcacagagagaaaggcagggacaacacaccagagcaacaagcgacacaccaatcaacaggaaaaggcgagccagta

SEQ ID NO: 299847 - DNA, 7122 bp, Homo sapiens
  misc_feature (2162)..(2162): n is a, c, g, or t
  misc_feature (2337)..(2337): n is a, c, g, or t
ccttcttgccgatcctcctctgagggtcccgccctctcgcgctgctcagtcccaaatgtctcctttgataagcacccataacacaggcccacctgctctgacagactcctctgcaggccttccctctccgctgactcattccctgagaaggaccactattcatcacccatctgcctcatcccaatgtctcctttggccacgctctctccataggaccctaccatgattctggagagtgcattttacatgcatgtcttttgatgtgaaatggcagtcacttaaagacctggttaaagaaaaagttggtgaggtaacatacgtggagctcttaatggacgctgaaggaaagtcaaggggatgtgctctgagagaatttcttctgtggatttactacatgaaaaatgtaactgtatggtggcgtggaatcgaatgaaatcaggaaggcagtgagtgctcatgttacagtagctatgtttgattttgccaaacatttgagtggggtgggaggggatttgcaaatgggagtcccgcttttccaaatggctggccaaagagctttttggtattctgtttggatgcccaatttggataactggggaccaatagcagcattgtctctttgttaacagaggaattggctgtgtgtgaattatgcatggaattttagcggtggtataattaatgtaaaacgtgtgttcttgtctagaaaatgttactcttggttgtttgctgaatttgaaagttgtgtgaaccaaagattccgaaaagttgcctttgtgccagtaaattgtaaaccaaatattaaaaacctgaatgttcaaaattggcctagtttaaagagaacataaactattttctgtcgtgcaatagaatggcttagaataatcaaaaggatgagcttaacttacggaagggatggatttaggaggaatatggtaaggactcgattgagtacagagggaagcagatctaaagttggtgtgatttcttggagaccctgaatttaggtctgcttattaaatgtcagcagctctagtgcaatgctggtaacgcgtaggagaaggagatattaaggagcccagcttttaacaaggaaggcgaggcgaggcacttctgtcagcttccccttagaagggttcattttaaaagactaactttgtgacataaatcatatttttagtttgtttataactgtcattggtatttactatttttttcttttctttttccccttccttgctcttctgactggtctctggcttcctccaaagggatgtgcgtaagtatcgtctagttacttattggtatttgagccttctaacttgtaggactggtttcactcgactcgtttccttttgactctatagtgttgttgaattcaagatggaagagagcatgaaaaaagctgcggaagtcctaaacaagcatagtctgagcggaagaccactgaaagtcaaagaagtaagctcttgcttaacactgcggatactgtgtgtaattgttgagtgatcctactttggaattagggaaagacggtcatggtcccagacggcatttacaaagcaagtgccagcctgttgtttctaatgaagagtgtcggtcatagcctacagcagccattccctgcaaggactttggggtggtggccaagcagatcctgagtggctgctgaccaccttctaatatctgtgatttgtctgaggccttgttgtctcagggactctcaaaccatgagcccgtgggtttgtgccattaagttttactccatctgacccttcttcttggcccatcttttttctttttttaaaaagtgagtttgttccagcctgggcaacatggtgaaaccccctctctacaaaaggtacaaaaattagccaggcatggtggcgcatgcctgtagtcctagctacttgggaggctgaggcaggaggatcatttgagcccaggatgtggaggttgcagtgagctgagattgcaccattgcactccagcccgggcaacagtgagaccctgtctaaaaaataaaaaataaagtgagtttgttattcctcaaacctgctttcacatctcatctgaatcaaatatattccttgaggaagaaggtttttttgttgattaaatccctcttggctgggcgcagtggctcacgcctgtaatccccngcactttgggaggctgaggtgggtggatcaaggtcatgagttcaagaccagcttgaccaacatggtgaaaccctgtctactaaaaatacaaaaaattagctgggcgtagtggggggtgcctgtaatccatctactcgggaggctgaggcaggagaatcgctggaacccaggaggnggaggttgcagtgagccgagatcgcgccattgaactccagcctgggcagtaagagcaaagctctgtctcaaaaaaacatccctcttaacttcttttcacctcttctcttggggaggaagatgagtagattcagagtgaagcttggtagggtctaaggtctctcatgtgttatgatgtcttttttagtgctgatggtggtaattgacaggacagagagttgaagaagagagtcagtacagagcttcacagaccttcccagatgttgttttactgcgcagccctcacacacacgcctccaacacctgaaggacttgaaggatgggggcgcttgtgtggtctagaactgtttctcaaacttctggaagccattgacggggtttgcagaagttacaaaaccccattgatgaattagtaagattcagctataccaagcccatgaagctctaatttcagtctggcggttctacattatatcagctaatcatgtttccctccctaccctgcttttcttttttacttagtgcaattgagagctgtgtttttagtgctacacttcatgccttttcttcctttcctatttctttagctggactcttctaagctggtagttgagttcatttgactttcttgttaatagatttgagagatgctttccaaacaacctttcagtttctaagtcttgagaatatcatttactgtgcaagcatggtttgcgttgtactgggtcagttaaacgtaacaccttttgtgcttgttttaggatcctgatggtgaacatgccaggagagcaatgcaaaaggtgatggctacgactggtgggatgggtatgggaccaggtggcccaggaatgattactatcccacccagtatcctaaataatcccaacatcccaaatgagattatccatgcattacaggctggaagacttggaagcacagtatttgtagcaaatgtaagtaaacagaaccatcgtctaaagtagaaaatcagaactttatgaaatgaccttgtcaatatgttataaaagtaattctcacatttgagaagaaaaatgtaaagaagggttttgttcttgatttctttaaaaatcagccttataggcgggctttgtctgcattcctaagtcacaggcttgaccgtggtctcgttggggctgtgattcctgagtttcgcaggtgtttccacaagcagtaaccgagtctgcattctccgttggtttattttatgcagttttggtgcagagtaagactgtacgagcagaagtgcactgacaccttcctcttgttgtgtctggggtgaatgataatacctccaccatctgcaaggggaaatatttagaataaagtaggttgggtggggtggggagtggtaaagcttatcagggaaacaattttttaaaaatgttcagaaaatgagtattaatttgaagtatgaggtgacttaagtttctgagaaaagagacaatatatttactataggtacagtttatttacagtgaaggccaggctttataatcctattttaaaatttccattgcagttgattagtttttgtgacattatttcctaatacttttttccaaccaaagcatgtatcattcatgtagtaaaaatgttgtgtttcttaagatgtttacattgaggtttttaccccgttctctctcgattagctggattataaagttggctggaagaaactgaaggaagtatttagtatggctggtgtggtggtccgagcagacattcttgaagataaagatggaaaaagtcgtggaataggcactgttacttttgaacagtccattgaagctgtgcaagctatatgtatccttctgcaggaattcaacttatgaacagtttgacctaaattgctgtgttagtaatgtaggtttgtgtgaggaagaggtgactgtgtgtattcatgttttttatgtgactagggggagtgcattactgtggaattaagaggttctctgggccggaccggtcacggtggctcacgcctgtaatcccagcacttcgggaggccaaggcgggcggatcacttgaggtcagttcgagaccagcctggccaacatggtgaaaccccggctctactaaaaaatgcaaaaattagctgggcgcagtggtgggtgcctgtaatcccagctactcgggaggctgaggcacaagaatcgcttgaacccgggaggtggaggttgcagtgagccgagattgcgccactgcacaccaccagcctgggtgatagagtgagactcagtctcaaaaaaaaaaaaaaaaaaaaaaaaaaaggttctctgggggtggaattgattcaatacagtgtggatagaggggatggttacaacatgggcatatgcccatgagtctttctactgttttcttttcagaagagtctaggtttgaaggaggaagtccaaagaatgtgctactagagagaaagtggggttgttgtttcatgtgtaatacatccttataggacctcactctttccagtgagtagacatcattttggagaggccacttctccttgaccctaggcttagcctagagtttttaatcccttggagagtaccccacaggagcacattcatacaactcagacaagaccgtcactgcatgtcttacccagaaaacatggtccttcagtttagatagtggtagatgcctggcccattggtcacattcagagaaccttgatgccactgcttaagaggatggtttggtgaaattgtaaggttacgaatgaagcttcacacctaaggaataagcagaagttgtcttgtcctccccgccagctttatttattgttccttttatgtttattgttgaaagtataatgaagaattgaaattgctcataaattcatcacttagagggactggtagcagttggagtatttttctttctttttgtatttctcttgtgcacatttttagaattgcaagaaatagccttaattgtaataccagctatgttcaatggccagctgctatttgatagaccaatgcacgtcaagatggatgagagggccttaccaaaaggagatttcttccctcctgagcgtccacaacaacttccccatggccttggtggtattggcatggggttaggaccaggagggcaacccattgatgccaatcacctgaataaaggcatcggaatgggaaacataggtcccgcaggaatgggaatggaaggcataggatttggaataaataaaatgggaggaatggaggggccctttggtggtggtatggaaaacatgggtcgatttggatctgggatgaacatgggcaggataaatgaaatcctaagtaatgcactgaagagaggagagatcattgcaaagcagggaggaggtggaggtggaggaagcgtccctgggatcgagaggatgggtcctggcattgaccgcctcgggggtgccggcatggagcgcatgggcgcgggcctgggccacggcatggatcgcgtgggctccgagatcgagcgcatgggcctggtcatggaccgcatgggctccgtggagcgcatgggctccggcattgagcgcatgggcccgctgggcctcgaccacatggcctccagcattgagcgcatgggccagaccatggagcgcattggctctggcgtggagcgcatgggtgccggcatgggcttcggccttgagcgcatggccgctcccatcgaccgtgtgggccagaccattgagcgcatgggctctggcgtggagcgcatgggccctgccatcgagcgcatgggcctgagcatggagcgcatggtgcccgcaggtatgggagctggcctggagcgcatgggccccgtgatggatcgcatggccaccggcctggagcgcatgggcgccaacaatctggagcggatgggcctggagcgcatgggcgccaacagcctcgagcgcatgggcctggagcgcatgggtgccaacagcctcgagcgcatgggccccgccatgggcccggccctgggcgctggcattgagcgcatgggcctggccatgggtggcggtggcggtgccagctttgaccgtgccatcgagatggagcgtggcaacttcggaggaagcttcgcaggttcctttggtggagctggaggccatgctcctggggtggccaggaaggcctgccagatatttgtgagaaatctgccattcgatttcacatggaagatgctaaaggacaaattcaacgagtgcggccacgtgctgtacgccgacatcaagatggagaatgggaagtccaaggggtgtggtgtggttaagttcgagtcgccagaggtggccgagagagcctgccggatgatgaatggcatgaagctgagtggccgagagattgacgttcgaattgatagaaacgcttaagcagttgccttttttaaacatcgatacgagacctctgaatttgtattttttcttgttaaccattttaatttgttggctggatgtataaagatgtttaaaaaattcagttgctttttggggtaatttgaattacttttttaatgactggggttccatttgactgtttgcattgagattgcaatgtgcgcaattttttttgtagttgtggcatcttgttgacatcgaatatgactttgataataaataccggttcctgaaaaaaaaaaaaaaacaaaaaaaaaaaaaaaaaaacaaaaaaactatttaaaaacaaaaacaaaacaaacaaacaaaaaaaaccaacaactcaacacacaaaacaaaaaccacaaaaaacaacacaacaaacaactatacaaaccgatg

SEQ ID NO: 299848 - DNA, 6998 bp, Homo sapiens
  misc_feature (2162)..(2162): n is a, c, g, or t
  misc_feature (2337)..(2337): n is a, c, g, or t
ccttcttgccgatcctcctctgagggtcccgccctctcgcgctgctcagtcccaaatgtctcctttgataagcacccataacacaggcccacctgctctgacagactcctctgcaggccttccctctccgctgactcattccctgagaaggaccactattcatcacccatctgcctcatcccaatgtctcctttggccacgctctctccataggaccctaccatgattctggagagtgcattttacatgcatgtcttttgatgtgaaatggcagtcacttaaagacctggttaaagaaaaagttggtgaggtaacatacgtggagctcttaatggacgctgaaggaaagtcaaggggatgtgctctgagagaatttcttctgtggatttactacatgaaaaatgtaactgtatggtggcgtggaatcgaatgaaatcaggaaggcagtgagtgctcatgttacagtagctatgtttgattttgccaaacatttgagtggggtgggaggggatttgcaaatgggagtcccgcttttccaaatggctggccaaagagctttttggtattctgtttggatgcccaatttggataactggggaccaatagcagcattgtctctttgttaacagaggaattggctgtgtgtgaattatgcatggaattttagcggtggtataattaatgtaaaacgtgtgttcttgtctagaaaatgttactcttggttgtttgctgaatttgaaagttgtgtgaaccaaagattccgaaaagttgcctttgtgccagtaaattgtaaaccaaatattaaaaacctgaatgttcaaaattggcctagtttaaagagaacataaactattttctgtcgtgcaatagaatggcttagaataatcaaaaggatgagcttaacttacggaagggatggatttaggaggaatatggtaaggactcgattgagtacagagggaagcagatctaaagttggtgtgatttcttggagaccctgaatttaggtctgcttattaaatgtcagcagctctagtgcaatgctggtaacgcgtaggagaaggagatattaaggagcccagcttttaacaaggaaggcgaggcgaggcacttctgtcagcttccccttagaagggttcattttaaaagactaactttgtgacataaatcatatttttagtttgtttataactgtcattggtatttactatttttttcttttctttttccccttccttgctcttctgactggtctctggcttcctccaaagggatgtgcgtaagtatcgtctagttacttattggtatttgagccttctaacttgtaggactggtttcactcgactcgtttccttttgactctatagtgttgttgaattcaagatggaagagagcatgaaaaaagctgcggaagtcctaaacaagcatagtctgagcggaagaccactgaaagtcaaagaagtaagctcttgcttaacactgcggatactgtgtgtaattgttgagtgatcctactttggaattagggaaagacggtcatggtcccagacggcatttacaaagcaagtgccagcctgttgtttctaatgaagagtgtcggtcatagcctacagcagccattccctgcaaggactttggggtggtggccaagcagatcctgagtggctgctgaccaccttctaatatctgtgatttgtctgaggccttgttgtctcagggactctcaaaccatgagcccgtgggtttgtgccattaagttttactccatctgacccttcttcttggcccatcttttttctttttttaaaaagtgagtttgttccagcctgggcaacatggtgaaaccccctctctacaaaaggtacaaaaattagccaggcatggtggcgcatgcctgtagtcctagctacttgggaggctgaggcaggaggatcatttgagcccaggatgtggaggttgcagtgagctgagattgcaccattgcactccagcccgggcaacagtgagaccctgtctaaaaaataaaaaataaagtgagtttgttattcctcaaacctgctttcacatctcatctgaatcaaatatattccttgaggaagaaggtttttttgttgattaaatccctcttggctgggcgcagtggctcacgcctgtaatccccngcactttgggaggctgaggtgggtggatcaaggtcatgagttcaagaccagcttgaccaacatggtgaaaccctgtctactaaaaatacaaaaaattagctgggcgtagtggggggtgcctgtaatccatctactcgggaggctgaggcaggagaatcgctggaacccaggaggnggaggttgcagtgagccgagatcgcgccattgaactccagcctgggcagtaagagcaaagctctgtctcaaaaaaacatccctcttaacttcttttcacctcttctcttggggaggaagatgagtagattcagagtgaagcttggtagggtctaaggtctctcatgtgttatgatgtcttttttagtgctgatggtggtaattgacaggacagagagttgaagaagagagtcagtacagagcttcacagaccttcccagatgttgttttactgcgcagccctcacacacacgcctccaacacctgaaggacttgaaggatgggggcgcttgtgtggtctagaactgtttctcaaacttctggaagccattgacggggtttgcagaagttacaaaaccccattgatgaattagtaagattcagctataccaagcccatgaagctctaatttcagtctggcggttctacattatatcagctaatcatgtttccctccctaccctgcttttcttttttacttagtgcaattgagagctgtgtttttagtgctacacttcatgccttttcttcctttcctatttctttagctggactcttctaagctggtagttgagttcatttgactttcttgttaatagatttgagagatgctttccaaacaacctttcagtttctaagtcttgagaatatcatttactgtgcaagcatggtttgcgttgtactgggtcagttaaacgtaacaccttttgtgcttgttttaggatcctgatggtgaacatgccaggagagcaatgcaaaaggtgatggctacgactggtgggatgggtatgggaccaggtggcccaggaatgattactatcccacccagtatcctaaataatcccaacatcccaaatgagattatccatgcattacaggctggaagacttggaagcacagtatttgtagcaaatgtaagtaaacagaaccatcgtctaaagtagaaaatcagaactttatgaaatgaccttgtcaatatgttataaaagtaattctcacatttgagaagaaaaatgtaaagaagggttttgttcttgatttctttaaaaatcagccttataggcgggctttgtctgcattcctaagtcacaggcttgaccgtggtctcgttggggctgtgattcctgagtttcgcaggtgtttccacaagcagtaaccgagtctgcattctccgttggtttattttatgcagttttggtgcagagtaagactgtacgagcagaagtgcactgacaccttcctcttgttgtgtctggggtgaatgataatacctccaccatctgcaaggggaaatatttagaataaagtaggttgggtggggtggggagtggtaaagcttatcagggaaacaattttttaaaaatgttcagaaaatgagtattaatttgaagtatgaggtgacttaagtttctgagaaaagagacaatatatttactataggtacagtttatttacagtgaaggccaggctttataatcctattttaaaatttccattgcagttgattagtttttgtgacattatttcctaatacttttttccaaccaaagcatgtatcattcatgtagtaaaaatgttgtgtttcttaagatgtttacattgaggtttttaccccgttctctctcgattagctggattataaagttggctggaagaaactgaaggaagtatttagtatggctggtgtggtggtccgagcagacattcttgaagataaagatggaaaaagtcgtggaataggcactgttacttttgaacagtccattgaagctgtgcaagctatatgtatccttctgcaggaattcaacttatgaacagtttgacctaaattgctgtgttagtaatgtaggtttgtgtgaggaagaggtgactgtgtgtattcatgttttttatgtgactagggggagtgcattactgtggaattaagaggttctctgggccggaccggtcacggtggctcacgcctgtaatcccagcacttcgggaggccaaggcgggcggatcacttgaggtcagttcgagaccagcctggccaacatggtgaaaccccggctctactaaaaaatgcaaaaattagctgggcgcagtggtgggtgcctgtaatcccagctactcgggaggctgaggcacaagaatcgcttgaacccgggaggtggaggttgcagtgagccgagattgcgccactgcacaccaccagcctgggtgatagagtgagactcagtctcaaaaaaaaaaaaaaaaaaaaaaaaaaaggttctctgggggtggaattgattcaatacagtgtggatagaggggatggttacaacatgggcatatgcccatgagtctttctactgttttcttttcagaagagtctaggtttgaaggaggaagtccaaagaatgtgctactagagagaaagtggggttgttgtttcatgtgtaatacatccttataggacctcactctttccagtgagtagacatcattttggagaggccacttctccttgaccctaggcttagcctagagtttttaatcccttggagagtaccccacaggagcacattcatacaactcagacaagaccgtcactgcatgtcttacccagaaaacatggtccttcagtttagatagtggtagatgcctggcccattggtcacattcagagaaccttgatgccactgcttaagaggatggtttggtgaaattgtaaggttacgaatgaagcttcacacctaaggaataagcagaagttgtcttgtcctccccgccagctttatttattgttccttttatgtttattgttgaaagtataatgaagaattgaaattgctcataaattcatcacttagagggactggtagcagttggagtatttttctttctttttgtatttctcttgtgcacatttttagaattgcaagaaatagccttaattgtaataccagctatgttcaatggccagctgctatttgatagaccaatgcacgtcaagatggatgagagggccttaccaaaaggagatttcttccctcctgagcgtccacaacaacttccccatggccttggtggtattggcatggggttaggaccaggagggcaacccattgatgccaatcacctgaataaaggcatcggaatgggaaacataggtcccgcaggaatgggaatggaaggcataggatttggaataaataaaatgggaggaatggaggggccctttggtggtggtatggaaaacatgggtcgatttggatctgggatgaacatgggcaggataaatgaaatcctaagtaatgcactgaagagaggagagatcattgcaaagcagggaggaggtggaggtggaggaagcgtccctgggatcgagaggatgggtcctggcattgaccgcctcgggggtgccggcatggagcgcatgggcgcgggcctgggccacggcatggatcgcgtgggctccgagatcgagcgcatgggcctggtcatggaccgcatgggctccgtggagcgcatgggctccggcattgagcgcatgggcccgctgggcctcgaccacatggcctccagcattgagcgcatgggccagaccatggagcgcattggctctggcgtggagcgcatgggtgccggcatgggcttcggccttgagcgcatggccgctcccatcgaccgtgtgggccagaccattgagcgcatgggctctggcgtggagcgcatgggccctgccatcgagcgcatgggcctgagcatggagcgcatggtgcccgcaggtatgggagctggcctggagcgcatgggccccgtgatggatcgcatggccaccggcctggagcgcatgggcgccaacaatctggagcggatgggcctggagcgcatgggcgccaacagcctcgagcgcatgggcctggagcgcatgggtgccaacagcctcgagcgcatgggccccgccatgggcccggccctgggcgctggcattgagcgcatgggcctggccatgggtggcggtggcggtgccagctttgaccgtgccatcgagatggagcgtggcaacttcggaggaagcttcgcaggttcctttggtggagctggaggccatgctcctggggtggccaggaaggcctgccagatatttgtgagaaatctgccattcgatttcacatggaagatgctaaaggacaaattcaacgagtgcggccacgtgctgtacgccgacatcaagatggagaatgggaagtccaaggggtgtggtgtggttaagttcgagtcgccagaggtggccgagagagcctgccggatgatgaatggcatgaagctgagtggccgagagattgacgttcgaattgatagaaacgcttaagcagttgccttttttaaacatcgatacgagacctctgaatttgtattttttcttgttaaccattttaatttgttggctggatgtataaagatgtttaaaaaattcagttgctttttggggtaatttgaattacttttttaatgactggggttccatttgactgtttgcattgagattgcaatgtgcgcaattttttttgtagttgtggcatcttgttgactacatcacccccgacaccatcacctgtaaccccggccgacgcgcgcggcgtgggcgcggcg

SEQ ID NO: 299849 - DNA, 7022 bp, Homo sapiens
  misc_feature (2162)..(2162): n is a, c, g, or t
  misc_feature (2337)..(2337): n is a, c, g, or t
ccttcttgccgatcctcctctgagggtcccgccctctcgcgctgctcagtcccaaatgtctcctttgataagcacccataacacaggcccacctgctctgacagactcctctgcaggccttccctctccgctgactcattccctgagaaggaccactattcatcacccatctgcctcatcccaatgtctcctttggccacgctctctccataggaccctaccatgattctggagagtgcattttacatgcatgtcttttgatgtgaaatggcagtcacttaaagacctggttaaagaaaaagttggtgaggtaacatacgtggagctcttaatggacgctgaaggaaagtcaaggggatgtgctctgagagaatttcttctgtggatttactacatgaaaaatgtaactgtatggtggcgtggaatcgaatgaaatcaggaaggcagtgagtgctcatgttacagtagctatgtttgattttgccaaacatttgagtggggtgggaggggatttgcaaatgggagtcccgcttttccaaatggctggccaaagagctttttggtattctgtttggatgcccaatttggataactggggaccaatagcagcattgtctctttgttaacagaggaattggctgtgtgtgaattatgcatggaattttagcggtggtataattaatgtaaaacgtgtgttcttgtctagaaaatgttactcttggttgtttgctgaatttgaaagttgtgtgaaccaaagattccgaaaagttgcctttgtgccagtaaattgtaaaccaaatattaaaaacctgaatgttcaaaattggcctagtttaaagagaacataaactattttctgtcgtgcaatagaatggcttagaataatcaaaaggatgagcttaacttacggaagggatggatttaggaggaatatggtaaggactcgattgagtacagagggaagcagatctaaagttggtgtgatttcttggagaccctgaatttaggtctgcttattaaatgtcagcagctctagtgcaatgctggtaacgcgtaggagaaggagatattaaggagcccagcttttaacaaggaaggcgaggcgaggcacttctgtcagcttccccttagaagggttcattttaaaagactaactttgtgacataaatcatatttttagtttgtttataactgtcattggtatttactatttttttcttttctttttccccttccttgctcttctgactggtctctggcttcctccaaagggatgtgcgtaagtatcgtctagttacttattggtatttgagccttctaacttgtaggactggtttcactcgactcgtttccttttgactctatagtgttgttgaattcaagatggaagagagcatgaaaaaagctgcggaagtcctaaacaagcatagtctgagcggaagaccactgaaagtcaaagaagtaagctcttgcttaacactgcggatactgtgtgtaattgttgagtgatcctactttggaattagggaaagacggtcatggtcccagacggcatttacaaagcaagtgccagcctgttgtttctaatgaagagtgtcggtcatagcctacagcagccattccctgcaaggactttggggtggtggccaagcagatcctgagtggctgctgaccaccttctaatatctgtgatttgtctgaggccttgttgtctcagggactctcaaaccatgagcccgtgggtttgtgccattaagttttactccatctgacccttcttcttggcccatcttttttctttttttaaaaagtgagtttgttccagcctgggcaacatggtgaaaccccctctctacaaaaggtacaaaaattagccaggcatggtggcgcatgcctgtagtcctagctacttgggaggctgaggcaggaggatcatttgagcccaggatgtggaggttgcagtgagctgagattgcaccattgcactccagcccgggcaacagtgagaccctgtctaaaaaataaaaaataaagtgagtttgttattcctcaaacctgctttcacatctcatctgaatcaaatatattccttgaggaagaaggtttttttgttgattaaatccctcttggctgggcgcagtggctcacgcctgtaatccccngcactttgggaggctgaggtgggtggatcaaggtcatgagttcaagaccagcttgaccaacatggtgaaaccctgtctactaaaaatacaaaaaattagctgggcgtagtggggggtgcctgtaatccatctactcgggaggctgaggcaggagaatcgctggaacccaggaggnggaggttgcagtgagccgagatcgcgccattgaactccagcctgggcagtaagagcaaagctctgtctcaaaaaaacatccctcttaacttcttttcacctcttctcttggggaggaagatgagtagattcagagtgaagcttggtagggtctaaggtctctcatgtgttatgatgtcttttttagtgctgatggtggtaattgacaggacagagagttgaagaagagagtcagtacagagcttcacagaccttcccagatgttgttttactgcgcagccctcacacacacgcctccaacacctgaaggacttgaaggatgggggcgcttgtgtggtctagaactgtttctcaaacttctggaagccattgacggggtttgcagaagttacaaaaccccattgatgaattagtaagattcagctataccaagcccatgaagctctaatttcagtctggcggttctacattatatcagctaatcatgtttccctccctaccctgcttttcttttttacttagtgcaattgagagctgtgtttttagtgctacacttcatgccttttcttcctttcctatttctttagctggactcttctaagctggtagttgagttcatttgactttcttgttaatagatttgagagatgctttccaaacaacctttcagtttctaagtcttgagaatatcatttactgtgcaagcatggtttgcgttgtactgggtcagttaaacgtaacaccttttgtgcttgttttaggatcctgatggtgaacatgccaggagagcaatgcaaaaggtgatggctacgactggtgggatgggtatgggaccaggtggcccaggaatgattactatcccacccagtatcctaaataatcccaacatcccaaatgagattatccatgcattacaggctggaagacttggaagcacagtatttgtagcaaatgtaagtaaacagaaccatcgtctaaagtagaaaatcagaactttatgaaatgaccttgtcaatatgttataaaagtaattctcacatttgagaagaaaaatgtaaagaagggttttgttcttgatttctttaaaaatcagccttataggcgggctttgtctgcattcctaagtcacaggcttgaccgtggtctcgttggggctgtgattcctgagtttcgcaggtgtttccacaagcagtaaccgagtctgcattctccgttggtttattttatgcagttttggtgcagagtaagactgtacgagcagaagtgcactgacaccttcctcttgttgtgtctggggtgaatgataatacctccaccatctgcaaggggaaatatttagaataaagtaggttgggtggggtggggagtggtaaagcttatcagggaaacaattttttaaaaatgttcagaaaatgagtattaatttgaagtatgaggtgacttaagtttctgagaaaagagacaatatatttactataggtacagtttatttacagtgaaggccaggctttataatcctattttaaaatttccattgcagttgattagtttttgtgacattatttcctaatacttttttccaaccaaagcatgtatcattcatgtagtaaaaatgttgtgtttcttaagatgtttacattgaggtttttaccccgttctctctcgattagctggattataaagttggctggaagaaactgaaggaagtatttagtatggctggtgtggtggtccgagcagacattcttgaagataaagatggaaaaagtcgtggaataggcactgttacttttgaacagtccattgaagctgtgcaagctatatgtatccttctgcaggaattcaacttatgaacagtttgacctaaattgctgtgttagtaatgtaggtttgtgtgaggaagaggtgactgtgtgtattcatgttttttatgtgactagggggagtgcattactgtggaattaagaggttctctgggccggaccggtcacggtggctcacgcctgtaatcccagcacttcgggaggccaaggcgggcggatcacttgaggtcagttcgagaccagcctggccaacatggtgaaaccccggctctactaaaaaatgcaaaaattagctgggcgcagtggtgggtgcctgtaatcccagctactcgggaggctgaggcacaagaatcgcttgaacccgggaggtggaggttgcagtgagccgagattgcgccactgcacaccaccagcctgggtgatagagtgagactcagtctcaaaaaaaaaaaaaaaaaaaaaaaaaaaggttctctgggggtggaattgattcaatacagtgtggatagaggggatggttacaacatgggcatatgcccatgagtctttctactgttttcttttcagaagagtctaggtttgaaggaggaagtccaaagaatgtgctactagagagaaagtggggttgttgtttcatgtgtaatacatccttataggacctcactctttccagtgagtagacatcattttggagaggccacttctccttgaccctaggcttagcctagagtttttaatcccttggagagtaccccacaggagcacattcatacaactcagacaagaccgtcactgcatgtcttacccagaaaacatggtccttcagtttagatagtggtagatgcctggcccattggtcacattcagagaaccttgatgccactgcttaagaggatggtttggtgaaattgtaaggttacgaatgaagcttcacacctaaggaataagcagaagttgtcttgtcctccccgccagctttatttattgttccttttatgtttattgttgaaagtataatgaagaattgaaattgctcataaattcatcacttagagggactggtagcagttggagtatttttctttctttttgtatttctcttgtgcacatttttagaattgcaagaaatagccttaattgtaataccagctatgttcaatggccagctgctatttgatagaccaatgcacgtcaagatggatgagagggccttaccaaaaggagatttcttccctcctgagcgtccacaacaacttccccatggccttggtggtattggcatggggttaggaccaggagggcaacccattgatgccaatcacctgaataaaggcatcggaatgggaaacataggtcccgcaggaatgggaatggaaggcataggatttggaataaataaaatgggaggaatggaggggccctttggtggtggtatggaaaacatgggtcgatttggatctgggatgaacatgggcaggataaatgaaatcctaagtaatgcactgaagagaggagagatcattgcaaagcagggaggaggtggaggtggaggaagcgtccctgggatcgagaggatgggtcctggcattgaccgcctcgggggtgccggcatggagcgcatgggcgcgggcctgggccacggcatggatcgcgtgggctccgagatcgagcgcatgggcctggtcatggaccgcatgggctccgtggagcgcatgggctccggcattgagcgcatgggcccgctgggcctcgaccacatggcctccagcattgagcgcatgggccagaccatggagcgcattggctctggcgtggagcgcatgggtgccggcatgggcttcggccttgagcgcatggccgctcccatcgaccgtgtgggccagaccattgagcgcatgggctctggcgtggagcgcatgggccctgccatcgagcgcatgggcctgagcatggagcgcatggtgcccgcaggtatgggagctggcctggagcgcatgggccccgtgatggatcgcatggccaccggcctggagcgcatgggcgccaacaatctggagcggatgggcctggagcgcatgggcgccaacagcctcgagcgcatgggcctggagcgcatgggtgccaacagcctcgagcgcatgggccccgccatgggcccggccctgggcgctggcattgagcgcatgggcctggccatgggtggcggtggcggtgccagctttgaccgtgccatcgagatggagcgtggcaacttcggaggaagcttcgcaggttcctttggtggagctggaggccatgctcctggggtggccaggaaggcctgccagatatttgtgagaaatctgccattcgatttcacatggaagatgctaaaggacaaattcaacgagtgcggccacgtgctgtacgccgacatcaagatggagaatgggaagtccaaggggtgtggtgtggttaagttcgagtcgccagaggtggccgagagagcctgccggatgatgaatggcatgaagctgagtggccgagagattgacgttcgaattgatagaaacgcttaagcagttgccttttttaaacatcgatacgagacctctgaatttgtattttttcttgttaaccattttaatttgttggctggatgtataaagatgtttaaaaaattcagttgctttttggggtaatttgaattacttttttaatgactggggttccatttgactgtttgcattgagattgcaatgtgcgcaattttttttgtagttgtggcatcttgttgacgtcctccccccccccgggttagtgctgagtgggggttgcggcggggggagaagggtagggacggcaaagacagacggcggccgct

SEQ ID NO: 299850 - DNA, 6798 bp, Homo sapiens
  misc_feature (2162)..(2162): n is a, c, g, or t
  misc_feature (2337)..(2337): n is a, c, g, or t
ccttcttgccgatcctcctctgagggtcccgccctctcgcgctgctcagtcccaaatgtctcctttgataagcacccataacacaggcccacctgctctgacagactcctctgcaggccttccctctccgctgactcattccctgagaaggaccactattcatcacccatctgcctcatcccaatgtctcctttggccacgctctctccataggaccctaccatgattctggagagtgcattttacatgcatgtcttttgatgtgaaatggcagtcacttaaagacctggttaaagaaaaagttggtgaggtaacatacgtggagctcttaatggacgctgaaggaaagtcaaggggatgtgctctgagagaatttcttctgtggatttactacatgaaaaatgtaactgtatggtggcgtggaatcgaatgaaatcaggaaggcagtgagtgctcatgttacagtagctatgtttgattttgccaaacatttgagtggggtgggaggggatttgcaaatgggagtcccgcttttccaaatggctggccaaagagctttttggtattctgtttggatgcccaatttggataactggggaccaatagcagcattgtctctttgttaacagaggaattggctgtgtgtgaattatgcatggaattttagcggtggtataattaatgtaaaacgtgtgttcttgtctagaaaatgttactcttggttgtttgctgaatttgaaagttgtgtgaaccaaagattccgaaaagttgcctttgtgccagtaaattgtaaaccaaatattaaaaacctgaatgttcaaaattggcctagtttaaagagaacataaactattttctgtcgtgcaatagaatggcttagaataatcaaaaggatgagcttaacttacggaagggatggatttaggaggaatatggtaaggactcgattgagtacagagggaagcagatctaaagttggtgtgatttcttggagaccctgaatttaggtctgcttattaaatgtcagcagctctagtgcaatgctggtaacgcgtaggagaaggagatattaaggagcccagcttttaacaaggaaggcgaggcgaggcacttctgtcagcttccccttagaagggttcattttaaaagactaactttgtgacataaatcatatttttagtttgtttataactgtcattggtatttactatttttttcttttctttttccccttccttgctcttctgactggtctctggcttcctccaaagggatgtgcgtaagtatcgtctagttacttattggtatttgagccttctaacttgtaggactggtttcactcgactcgtttccttttgactctatagtgttgttgaattcaagatggaagagagcatgaaaaaagctgcggaagtcctaaacaagcatagtctgagcggaagaccactgaaagtcaaagaagtaagctcttgcttaacactgcggatactgtgtgtaattgttgagtgatcctactttggaattagggaaagacggtcatggtcccagacggcatttacaaagcaagtgccagcctgttgtttctaatgaagagtgtcggtcatagcctacagcagccattccctgcaaggactttggggtggtggccaagcagatcctgagtggctgctgaccaccttctaatatctgtgatttgtctgaggccttgttgtctcagggactctcaaaccatgagcccgtgggtttgtgccattaagttttactccatctgacccttcttcttggcccatcttttttctttttttaaaaagtgagtttgttccagcctgggcaacatggtgaaaccccctctctacaaaaggtacaaaaattagccaggcatggtggcgcatgcctgtagtcctagctacttgggaggctgaggcaggaggatcatttgagcccaggatgtggaggttgcagtgagctgagattgcaccattgcactccagcccgggcaacagtgagaccctgtctaaaaaataaaaaataaagtgagtttgttattcctcaaacctgctttcacatctcatctgaatcaaatatattccttgaggaagaaggtttttttgttgattaaatccctcttggctgggcgcagtggctcacgcctgtaatccccngcactttgggaggctgaggtgggtggatcaaggtcatgagttcaagaccagcttgaccaacatggtgaaaccctgtctactaaaaatacaaaaaattagctgggcgtagtggggggtgcctgtaatccatctactcgggaggctgaggcaggagaatcgctggaacccaggaggnggaggttgcagtgagccgagatcgcgccattgaactccagcctgggcagtaagagcaaagctctgtctcaaaaaaacatccctcttaacttcttttcacctcttctcttggggaggaagatgagtagattcagagtgaagcttggtagggtctaaggtctctcatgtgttatgatgtcttttttagtgctgatggtggtaattgacaggacagagagttgaagaagagagtcagtacagagcttcacagaccttcccagatgttgttttactgcgcagccctcacacacacgcctccaacacctgaaggacttgaaggatgggggcgcttgtgtggtctagaactgtttctcaaacttctggaagccattgacggggtttgcagaagttacaaaaccccattgatgaattagtaagattcagctataccaagcccatgaagctctaatttcagtctggcggttctacattatatcagctaatcatgtttccctccctaccctgcttttcttttttacttagtgcaattgagagctgtgtttttagtgctacacttcatgccttttcttcctttcctatttctttagctggactcttctaagctggtagttgagttcatttgactttcttgttaatagatttgagagatgctttccaaacaacctttcagtttctaagtcttgagaatatcatttactgtgcaagcatggtttgcgttgtactgggtcagttaaacgtaacaccttttgtgcttgttttaggatcctgatggtgaacatgccaggagagcaatgcaaaaggtgatggctacgactggtgggatgggtatgggaccaggtggcccaggaatgattactatcccacccagtatcctaaataatcccaacatcccaaatgagattatccatgcattacaggctggaagacttggaagcacagtatttgtagcaaatgtaagtaaacagaaccatcgtctaaagtagaaaatcagaactttatgaaatgaccttgtcaatatgttataaaagtaattctcacatttgagaagaaaaatgtaaagaagggttttgttcttgatttctttaaaaatcagccttataggcgggctttgtctgcattcctaagtcacaggcttgaccgtggtctcgttggggctgtgattcctgagtttcgcaggtgtttccacaagcagtaaccgagtctgcattctccgttggtttattttatgcagttttggtgcagagtaagactgtacgagcagaagtgcactgacaccttcctcttgttgtgtctggggtgaatgataatacctccaccatctgcaaggggaaatatttagaataaagtaggttgggtggggtggggagtggtaaagcttatcagggaaacaattttttaaaaatgttcagaaaatgagtattaatttgaagtatgaggtgacttaagtttctgagaaaagagacaatatatttactataggtacagtttatttacagtgaaggccaggctttataatcctattttaaaatttccattgcagttgattagtttttgtgacattatttcctaatacttttttccaaccaaagcatgtatcattcatgtagtaaaaatgttgtgtttcttaagatgtttacattgaggtttttaccccgttctctctcgattagctggattataaagttggctggaagaaactgaaggaagtatttagtatggctggtgtggtggtccgagcagacattcttgaagataaagatggaaaaagtcgtggaataggcactgttacttttgaacagtccattgaagctgtgcaagctatatgtatccttctgcaggaattcaacttatgaacagtttgacctaaattgctgtgttagtaatgtaggtttgtgtgaggaagaggtgactgtgtgtattcatgttttttatgtgactagggggagtgcattactgtggaattaagaggttctctgggccggaccggtcacggtggctcacgcctgtaatcccagcacttcgggaggccaaggcgggcggatcacttgaggtcagttcgagaccagcctggccaacatggtgaaaccccggctctactaaaaaatgcaaaaattagctgggcgcagtggtgggtgcctgtaatcccagctactcgggaggctgaggcacaagaatcgcttgaacccgggaggtggaggttgcagtgagccgagattgcgccactgcacaccaccagcctgggtgatagagtgagactcagtctcaaaaaaaaaaaaaaaaaaaaaaaaaaaggttctctgggggtggaattgattcaatacagtgtggatagaggggatggttacaacatgggcatatgcccatgagtctttctactgttttcttttcagaagagtctaggtttgaaggaggaagtccaaagaatgtgctactagagagaaagtggggttgttgtttcatgtgtaatacatccttataggacctcactctttccagtgagtagacatcattttggagaggccacttctccttgaccctaggcttagcctagagtttttaatcccttggagagtaccccacaggagcacattcatacaactcagacaagaccgtcactgcatgtcttacccagaaaacatggtccttcagtttagatagtggtagatgcctggcccattggtcacattcagagaaccttgatgccactgcttaagaggatggtttggtgaaattgtaaggttacgaatgaagcttcacacctaaggaataagcagaagttgtcttgtcctccccgccagctttatttattgttccttttatgtttattgttgaaagtataatgaagaattgaaattgctcataaattcatcacttagagggactggtagcagttggagtatttttctttctttttgtatttctcttgtgcacatttttagaattgcaagaaatagccttaattgtaataccagctatgttcaatggccagctgctatttgatagaccaatgcacgtcaagatggatgagagggccttaccaaaaggagatttcttccctcctgagcgtccacaacaacttccccatggccttggtggtattggcatggggttaggaccaggagggcaacccattgatgccaatcacctgaataaaggcatcggaatgggaaacataggtcccgcaggaatgggaatggaaggcataggatttggaataaataaaatgggaggaatggaggggccctttggtggtggtatggaaaacatgggtcgatttggatctgggatgaacatgggcaggataaatgaaatcctaagtaatgcactgaagagaggagagatcattgcaaagcagggaggaggtggaggtggaggaagcgtccctgggatcgagaggatgggtcctggcattgaccgcctcgggggtgccggcatggagcgcatgggcgcgggcctgggccacggcatggatcgcgtgggctccgagatcgagcgcatgggcctggtcatggaccgcatgggctccgtggagcgcatgggctccggcattgagcgcatgggcccgctgggcctcgaccacatggcctccagcattgagcgcatgggccagaccatggagcgcattggctctggcgtggagcgcatgggtgccggcatgggcttcggccttgagcgcatggccgctcccatcgaccgtgtgggccagaccattgagcgcatgggctctggcgtggagcgcatgggccctgccatcgagcgcatgggcctgagcatggagcgcatggtgcccgcaggtatgggagctggcctggagcgcatgggccccgtgatggatcgcatggccaccggcctggagcgcatgggcgccaacaatctggagcggatgggcctggagcgcatgggcgccaacagcctcgagcgcatgggcctggagcgcatgggtgccaacagcctcgagcgcatgggccccgccatgggcccggccctgggcgctggcattgagcgcatgggcctggccatgggtggcggtggcggtgccagctttgaccgtgccatcgagatggagcgtggcaacttcggaggaagcttcgcaggttcctttggtggagctggaggccatgctcctggggtggccaggaaggcctgccagatatttgtgagaaatctgccattcgatttcacatggaagatgctaaaggacaaattcaacgagtgcggccacgtgctgtacgccgacatcaagatggagaatgggaagtccaaggggtgtggtgtggttaagttcgagtcgccagaggtggccgagagagcctgccggatgatgaatggcatgaagctgagtggccgagagattgacgttcgaattgatagaaacgcttaagcagttgccttttttaaacatcgatacggaggacccctcttggaaaatttttgggttaaatttttttttttttctttgtta

SEQ ID NO: 299851 - DNA, 7197 bp, Homo sapiens
  misc_feature (2162)..(2162): n is a, c, g, or t
  misc_feature (2337)..(2337): n is a, c, g, or t
ccttcttgccgatcctcctctgagggtcccgccctctcgcgctgctcagtcccaaatgtctcctttgataagcacccataacacaggcccacctgctctgacagactcctctgcaggccttccctctccgctgactcattccctgagaaggaccactattcatcacccatctgcctcatcccaatgtctcctttggccacgctctctccataggaccctaccatgattctggagagtgcattttacatgcatgtcttttgatgtgaaatggcagtcacttaaagacctggttaaagaaaaagttggtgaggtaacatacgtggagctcttaatggacgctgaaggaaagtcaaggggatgtgctctgagagaatttcttctgtggatttactacatgaaaaatgtaactgtatggtggcgtggaatcgaatgaaatcaggaaggcagtgagtgctcatgttacagtagctatgtttgattttgccaaacatttgagtggggtgggaggggatttgcaaatgggagtcccgcttttccaaatggctggccaaagagctttttggtattctgtttggatgcccaatttggataactggggaccaatagcagcattgtctctttgttaacagaggaattggctgtgtgtgaattatgcatggaattttagcggtggtataattaatgtaaaacgtgtgttcttgtctagaaaatgttactcttggttgtttgctgaatttgaaagttgtgtgaaccaaagattccgaaaagttgcctttgtgccagtaaattgtaaaccaaatattaaaaacctgaatgttcaaaattggcctagtttaaagagaacataaactattttctgtcgtgcaatagaatggcttagaataatcaaaaggatgagcttaacttacggaagggatggatttaggaggaatatggtaaggactcgattgagtacagagggaagcagatctaaagttggtgtgatttcttggagaccctgaatttaggtctgcttattaaatgtcagcagctctagtgcaatgctggtaacgcgtaggagaaggagatattaaggagcccagcttttaacaaggaaggcgaggcgaggcacttctgtcagcttccccttagaagggttcattttaaaagactaactttgtgacataaatcatatttttagtttgtttataactgtcattggtatttactatttttttcttttctttttccccttccttgctcttctgactggtctctggcttcctccaaagggatgtgcgtaagtatcgtctagttacttattggtatttgagccttctaacttgtaggactggtttcactcgactcgtttccttttgactctatagtgttgttgaattcaagatggaagagagcatgaaaaaagctgcggaagtcctaaacaagcatagtctgagcggaagaccactgaaagtcaaagaagtaagctcttgcttaacactgcggatactgtgtgtaattgttgagtgatcctactttggaattagggaaagacggtcatggtcccagacggcatttacaaagcaagtgccagcctgttgtttctaatgaagagtgtcggtcatagcctacagcagccattccctgcaaggactttggggtggtggccaagcagatcctgagtggctgctgaccaccttctaatatctgtgatttgtctgaggccttgttgtctcagggactctcaaaccatgagcccgtgggtttgtgccattaagttttactccatctgacccttcttcttggcccatcttttttctttttttaaaaagtgagtttgttccagcctgggcaacatggtgaaaccccctctctacaaaaggtacaaaaattagccaggcatggtggcgcatgcctgtagtcctagctacttgggaggctgaggcaggaggatcatttgagcccaggatgtggaggttgcagtgagctgagattgcaccattgcactccagcccgggcaacagtgagaccctgtctaaaaaataaaaaataaagtgagtttgttattcctcaaacctgctttcacatctcatctgaatcaaatatattccttgaggaagaaggtttttttgttgattaaatccctcttggctgggcgcagtggctcacgcctgtaatccccngcactttgggaggctgaggtgggtggatcaaggtcatgagttcaagaccagcttgaccaacatggtgaaaccctgtctactaaaaatacaaaaaattagctgggcgtagtggggggtgcctgtaatccatctactcgggaggctgaggcaggagaatcgctggaacccaggaggnggaggttgcagtgagccgagatcgcgccattgaactccagcctgggcagtaagagcaaagctctgtctcaaaaaaacatccctcttaacttcttttcacctcttctcttggggaggaagatgagtagattcagagtgaagcttggtagggtctaaggtctctcatgtgttatgatgtcttttttagtgctgatggtggtaattgacaggacagagagttgaagaagagagtcagtacagagcttcacagaccttcccagatgttgttttactgcgcagccctcacacacacgcctccaacacctgaaggacttgaaggatgggggcgcttgtgtggtctagaactgtttctcaaacttctggaagccattgacggggtttgcagaagttacaaaaccccattgatgaattagtaagattcagctataccaagcccatgaagctctaatttcagtctggcggttctacattatatcagctaatcatgtttccctccctaccctgcttttcttttttacttagtgcaattgagagctgtgtttttagtgctacacttcatgccttttcttcctttcctatttctttagctggactcttctaagctggtagttgagttcatttgactttcttgttaatagatttgagagatgctttccaaacaacctttcagtttctaagtcttgagaatatcatttactgtgcaagcatggtttgcgttgtactgggtcagttaaacgtaacaccttttgtgcttgttttaggatcctgatggtgaacatgccaggagagcaatgcaaaaggtgatggctacgactggtgggatgggtatgggaccaggtggcccaggaatgattactatcccacccagtatcctaaataatcccaacatcccaaatgagattatccatgcattacaggctggaagacttggaagcacagtatttgtagcaaatgtaagtaaacagaaccatcgtctaaagtagaaaatcagaactttatgaaatgaccttgtcaatatgttataaaagtaattctcacatttgagaagaaaaatgtaaagaagggttttgttcttgatttctttaaaaatcagccttataggcgggctttgtctgcattcctaagtcacaggcttgaccgtggtctcgttggggctgtgattcctgagtttcgcaggtgtttccacaagcagtaaccgagtctgcattctccgttggtttattttatgcagttttggtgcagagtaagactgtacgagcagaagtgcactgacaccttcctcttgttgtgtctggggtgaatgataatacctccaccatctgcaaggggaaatatttagaataaagtaggttgggtggggtggggagtggtaaagcttatcagggaaacaattttttaaaaatgttcagaaaatgagtattaatttgaagtatgaggtgacttaagtttctgagaaaagagacaatatatttactataggtacagtttatttacagtgaaggccaggctttataatcctattttaaaatttccattgcagttgattagtttttgtgacattatttcctaatacttttttccaaccaaagcatgtatcattcatgtagtaaaaatgttgtgtttcttaagatgtttacattgaggtttttaccccgttctctctcgattagctggattataaagttggctggaagaaactgaaggaagtatttagtatggctggtgtggtggtccgagcagacattcttgaagataaagatggaaaaagtcgtggaataggcactgttacttttgaacagtccattgaagctgtgcaagctatatgtatccttctgcaggaattcaacttatgaacagtttgacctaaattgctgtgttagtaatgtaggtttgtgtgaggaagaggtgactgtgtgtattcatgttttttatgtgactagggggagtgcattactgtggaattaagaggttctctgggccggaccggtcacggtggctcacgcctgtaatcccagcacttcgggaggccaaggcgggcggatcacttgaggtcagttcgagaccagcctggccaacatggtgaaaccccggctctactaaaaaatgcaaaaattagctgggcgcagtggtgggtgcctgtaatcccagctactcgggaggctgaggcacaagaatcgcttgaacccgggaggtggaggttgcagtgagccgagattgcgccactgcacaccaccagcctgggtgatagagtgagactcagtctcaaaaaaaaaaaaaaaaaaaaaaaaaaaggttctctgggggtggaattgattcaatacagtgtggatagaggggatggttacaacatgggcatatgcccatgagtctttctactgttttcttttcagaagagtctaggtttgaaggaggaagtccaaagaatgtgctactagagagaaagtggggttgttgtttcatgtgtaatacatccttataggacctcactctttccagtgagtagacatcattttggagaggccacttctccttgaccctaggcttagcctagagtttttaatcccttggagagtaccccacaggagcacattcatacaactcagacaagaccgtcactgcatgtcttacccagaaaacatggtccttcagtttagatagtggtagatgcctggcccattggtcacattcagagaaccttgatgccactgcttaagaggatggtttggtgaaattgtaaggttacgaatgaagcttcacacctaaggaataagcagaagttgtcttgtcctccccgccagctttatttattgttccttttatgtttattgttgaaagtataatgaagaattgaaattgctcataaattcatcacttagagggactggtagcagttggagtatttttctttctttttgtatttctcttgtgcacatttttagaattgcaagaaatagccttaattgtaataccagctatgttcaatggccagctgctatttgatagaccaatgcacgtcaagatggatgagagggccttaccaaaaggagatttcttccctcctgagcgtccacaacaacttccccatggccttggtggtattggcatggggttaggaccaggagggcaacccattgatgccaatcacctgaataaaggcatcggaatgggaaacataggtcccgcaggaatgggaatggaaggcataggatttggaataaataaaatgggaggaatggaggggccctttggtggtggtatggaaaacatgggtcgatttggatctgggatgaacatgggcaggataaatgaaatcctaagtaatgcactgaagagaggagagatcattgcaaagcagggaggaggtggaggtggaggaagcgtccctgggatcgagaggatgggtcctggcattgaccgcctcgggggtgccggcatggagcgcatgggcgcgggcctgggccacggcatggatcgcgtgggctccgagatcgagcgcatgggcctggtcatggaccgcatgggctccgtggagcgcatgggctccggcattgagcgcatgggcccgctgggcctcgaccacatggcctccagcattgagcgcatgggccagaccatggagcgcattggctctggcgtggagcgcatgggtgccggcatgggcttcggccttgagcgcatggccgctcccatcgaccgtgtgggccagaccattgagcgcatgggctctggcgtggagcgcatgggccctgccatcgagcgcatgggcctgagcatggagcgcatggtgcccgcaggtatgggagctggcctggagcgcatgggccccgtgatggatcgcatggccaccggcctggagcgcatgggcgccaacaatctggagcggatgggcctggagcgcatgggcgccaacagcctcgagcgcatgggcctggagcgcatgggtgccagctttgaccgtgccatcgagatggagcgtggcaacttcggaggaagcttcgcaggttcctttggtggagctggaggccatgctcctggggtggccaggaaggcctgccagatatttgtgagaaatctgccattcgatttcacatggaagatgctaaaggacaaattcaacgagtgcggccacgtgctgtacgccgacatcaagatggagaatgggaagtccaaggggtgtggtgtggttaagttcgagtcgccagaggtggccgagagagcctgccggatgatgaatggcatgaagctgagtggccgagagattgacgttcgaattgatagaaacgcttaagcagttgccttttttaaacatcgatacgagacctctgaatttgtattttttcttgttaaccattttaatttgttggctggatgtataaagatgtttaaaaaattcagttgctttttggggtaatttgaattacttttttaatgactggggttccatttgactgtttgcattgagattgcaatgtgcgcaattttttttgtagttgtggcatcttgttgacatcgaatatgactttgataataaataccggttcctgaaaaaaacacggacaagacaccacccaccacagagacgacagacaaaaacaggacccaaagagaacagcccagcgaccaacgccaaacaaacactactgcaaaaaaaggagcccacaaaagggcacagcctctaacccgcacaaacgatggcaggacgtaaacaagccacacaacggcacacaccgcccacccgcccatccgagacacaacccaaacgaggcaggcgagaacgggcaacacgcacagagagaaaggcagggacaacacaccagagcaacaagcgacacaccaatcaacaggaaaaggcgagccagta

SEQ ID NO: 299852 - DNA, 7460 bp, Homo sapiens
  misc_feature (2162)..(2162): n is a, c, g, or t
  misc_feature (2337)..(2337): n is a, c, g, or t
ccttcttgccgatcctcctctgagggtcccgccctctcgcgctgctcagtcccaaatgtctcctttgataagcacccataacacaggcccacctgctctgacagactcctctgcaggccttccctctccgctgactcattccctgagaaggaccactattcatcacccatctgcctcatcccaatgtctcctttggccacgctctctccataggaccctaccatgattctggagagtgcattttacatgcatgtcttttgatgtgaaatggcagtcacttaaagacctggttaaagaaaaagttggtgaggtaacatacgtggagctcttaatggacgctgaaggaaagtcaaggggatgtgctctgagagaatttcttctgtggatttactacatgaaaaatgtaactgtatggtggcgtggaatcgaatgaaatcaggaaggcagtgagtgctcatgttacagtagctatgtttgattttgccaaacatttgagtggggtgggaggggatttgcaaatgggagtcccgcttttccaaatggctggccaaagagctttttggtattctgtttggatgcccaatttggataactggggaccaatagcagcattgtctctttgttaacagaggaattggctgtgtgtgaattatgcatggaattttagcggtggtataattaatgtaaaacgtgtgttcttgtctagaaaatgttactcttggttgtttgctgaatttgaaagttgtgtgaaccaaagattccgaaaagttgcctttgtgccagtaaattgtaaaccaaatattaaaaacctgaatgttcaaaattggcctagtttaaagagaacataaactattttctgtcgtgcaatagaatggcttagaataatcaaaaggatgagcttaacttacggaagggatggatttaggaggaatatggtaaggactcgattgagtacagagggaagcagatctaaagttggtgtgatttcttggagaccctgaatttaggtctgcttattaaatgtcagcagctctagtgcaatgctggtaacgcgtaggagaaggagatattaaggagcccagcttttaacaaggaaggcgaggcgaggcacttctgtcagcttccccttagaagggttcattttaaaagactaactttgtgacataaatcatatttttagtttgtttataactgtcattggtatttactatttttttcttttctttttccccttccttgctcttctgactggtctctggcttcctccaaagggatgtgcgtaagtatcgtctagttacttattggtatttgagccttctaacttgtaggactggtttcactcgactcgtttccttttgactctatagtgttgttgaattcaagatggaagagagcatgaaaaaagctgcggaagtcctaaacaagcatagtctgagcggaagaccactgaaagtcaaagaagtaagctcttgcttaacactgcggatactgtgtgtaattgttgagtgatcctactttggaattagggaaagacggtcatggtcccagacggcatttacaaagcaagtgccagcctgttgtttctaatgaagagtgtcggtcatagcctacagcagccattccctgcaaggactttggggtggtggccaagcagatcctgagtggctgctgaccaccttctaatatctgtgatttgtctgaggccttgttgtctcagggactctcaaaccatgagcccgtgggtttgtgccattaagttttactccatctgacccttcttcttggcccatcttttttctttttttaaaaagtgagtttgttccagcctgggcaacatggtgaaaccccctctctacaaaaggtacaaaaattagccaggcatggtggcgcatgcctgtagtcctagctacttgggaggctgaggcaggaggatcatttgagcccaggatgtggaggttgcagtgagctgagattgcaccattgcactccagcccgggcaacagtgagaccctgtctaaaaaataaaaaataaagtgagtttgttattcctcaaacctgctttcacatctcatctgaatcaaatatattccttgaggaagaaggtttttttgttgattaaatccctcttggctgggcgcagtggctcacgcctgtaatccccngcactttgggaggctgaggtgggtggatcaaggtcatgagttcaagaccagcttgaccaacatggtgaaaccctgtctactaaaaatacaaaaaattagctgggcgtagtggggggtgcctgtaatccatctactcgggaggctgaggcaggagaatcgctggaacccaggaggnggaggttgcagtgagccgagatcgcgccattgaactccagcctgggcagtaagagcaaagctctgtctcaaaaaaacatccctcttaacttcttttcacctcttctcttggggaggaagatgagtagattcagagtgaagcttggtagggtctaaggtctctcatgtgttatgatgtcttttttagtgctgatggtggtaattgacaggacagagagttgaagaagagagtcagtacagagcttcacagaccttcccagatgttgttttactgcgcagccctcacacacacgcctccaacacctgaaggacttgaaggatgggggcgcttgtgtggtctagaactgtttctcaaacttctggaagccattgacggggtttgcagaagttacaaaaccccattgatgaattagtaagattcagctataccaagcccatgaagctctaatttcagtctggcggttctacattatatcagctaatcatgtttccctccctaccctgcttttcttttttacttagtgcaattgagagctgtgtttttagtgctacacttcatgccttttcttcctttcctatttctttagctggactcttctaagctggtagttgagttcatttgactttcttgttaatagatttgagagatgctttccaaacaacctttcagtttctaagtcttgagaatatcatttactgtgcaagcatggtttgcgttgtactgggtcagttaaacgtaacaccttttgtgcttgttttaggatcctgatggtgaacatgccaggagagcaatgcaaaaggtgatggctacgactggtgggatgggtatgggaccaggtggcccaggaatgattactatcccacccagtatcctaaataatcccaacatcccaaatgagattatccatgcattacaggctggaagacttggaagcacagtatttgtagcaaatgtaagtaaacagaaccatcgtctaaagtagaaaatcagaactttatgaaatgaccttgtcaatatgttataaaagtaattctcacatttgagaagaaaaatgtaaagaagggttttgttcttgatttctttaaaaatcagccttataggcgggctttgtctgcattcctaagtcacaggcttgaccgtggtctcgttggggctgtgattcctgagtttcgcaggtgtttccacaagcagtaaccgagtctgcattctccgttggtttattttatgcagttttggtgcagagtaagactgtacgagcagaagtgcactgacaccttcctcttgttgtgtctggggtgaatgataatacctccaccatctgcaaggggaaatatttagaataaagtaggttgggtggggtggggagtggtaaagcttatcagggaaacaattttttaaaaatgttcagaaaatgagtattaatttgaagtatgaggtgacttaagtttctgagaaaagagacaatatatttactataggtacagtttatttacagtgaaggccaggctttataatcctattttaaaatttccattgcagttgattagtttttgtgacattatttcctaatacttttttccaaccaaagcatgtatcattcatgtagtaaaaatgttgtgtttcttaagatgtttacattgaggtttttaccccgttctctctcgattagctggattataaagttggctggaagaaactgaaggaagtatttagtatggctggtgtggtggtccgagcagacattcttgaagataaagatggaaaaagtcgtggaataggcactgttacttttgaacagtccattgaagctgtgcaagctatatgtatccttctgcaggaattcaacttatgaacagtttgacctaaattgctgtgttagtaatgtaggtttgtgtgaggaagaggtgactgtgtgtattcatgttttttatgtgactagggggagtgcattactgtggaattaagaggttctctgggccggaccggtcacggtggctcacgcctgtaatcccagcacttcgggaggccaaggcgggcggatcacttgaggtcagttcgagaccagcctggccaacatggtgaaaccccggctctactaaaaaatgcaaaaattagctgggcgcagtggtgggtgcctgtaatcccagctactcgggaggctgaggcacaagaatcgcttgaacccgggaggtggaggttgcagtgagccgagattgcgccactgcacaccaccagcctgggtgatagagtgagactcagtctcaaaaaaaaaaaaaaaaaaaaaaaaaaaggttctctgggggtggaattgattcaatacagtgtggatagaggggatggttacaacatgggcatatgcccatgagtctttctactgttttcttttcagaagagtctaggtttgaaggaggaagtccaaagaatgtgctactagagagaaagtggggttgttgtttcatgtgtaatacatccttataggacctcactctttccagtgagtagacatcattttggagaggccacttctccttgaccctaggcttagcctagagtttttaatcccttggagagtaccccacaggagcacattcatacaactcagacaagaccgtcactgcatgtcttacccagaaaacatggtccttcagtttagatagtggtagatgcctggcccattggtcacattcagagaaccttgatgccactgcttaagaggatggtttggtgaaattgtaaggttacgaatgaagcttcacacctaaggaataagcagaagttgtcttgtcctccccgccagctttatttattgttccttttatgtttattgttgaaagtataatgaagaattgaaattgctcataaattcatcacttagagggactggtagcagttggagtatttttctttctttttgtatttctcttgtgcacatttttagaattgcaagaaatagccttaattgtaataccagctatgttcaatggccagctgctatttgatagaccaatgcacgtcaagatggatgagagggccttaccaaaaggagatttcttccctcctgagcgtccacaacaacttccccatggccttggtggtattggcatggggttaggaccaggagggcaacccattgatgccaatcacctgaataaaggcatcggaatgggaaacataggtcccgcaggaatgggaatggaaggcataggatttggaataaataaaatgggaggaatggaggggccctttggtggtggtatggaaaacatgggtcgatttggatctgggatgaacatgggcaggataaatgaaatcctaagtaatgcactgaagagaggagagatcattgcaaagcagggaggaggtggaggtggaggaagcgtccctgggatcgagaggatgggtcctggcattgaccgcctcgggggtgccggcatggagcgcatgggcgcgggcctgggccacggcatggatcgcgtgggctccgagatcgagcgcatgggcctggtcatggaccgcatgggctccgtggagcgcatgggctccggcattgagcgcatgggcccgctgggcctcgaccacatggcctccagcattgagcgcatgggccagaccatggagcgcattggctctggcgtggagcgcatgggtgccggcatgggcttcggccttgagcgcatggccgctcccatcgaccgtgtgggccagaccattgagcgcatgggctctggcgtggagcgcatgggccctgccatcgagcgcatgggcctgagcatggagcgcatggtgcccgcaggtatgggagctggcctggagcgcatgggccccgtgatggatcgcatggccaccggcctggagcgcatgggcgccaacaatctggagcggatgggcctggagcgcatgggcgccaacagcctcgagcgcatgggcctggagcgcatgggtgccaacagcctcgagcgcatgggccccgccatgggcccggccctgggcgctggcattgagcgcatgggcctggccatgggtggcggtggcggtgccagctttgaccgtgccatcgagatggagcgtggcaacttcggaggaagcttcgcaggttcctttggtggagctggaggccatgctcctggggtggccaggaaggcctgccagatatttgtgagaaatctgccattcgatttcacatggaagatgctaaaggacaaattcaacgagtgcggtaagtgttgggaacggctttgtaggtgcttccctcgtgcttgttggtgacgcagccgagtcagcagcaaaacctccctcccagccccctccgtcggctcaggacccatggccttgccatgttctgcccacgccaatgctcaggcaggttgttgagtgtcctgtgatgtgtcacatgtttttcagctgtgttctcatttcatccttatttccttttttctttttgagtctttgaaacaaggtagtagtgtccccatttcacagatgagtcaggcagagtcttccttctgaggttacctggcttctaggtggcaaggctaaataaatacatcccagacgaggtcgctttcccctcagcacagctggtgtggggcctcggagagaacacagcccagcaggtgccatggggaggcggtgcaggctctgggcacacagcagctcctgtgagggtgaggctaaggtcttgtggtttcctggcacatcgggcaactcttctggagggctctgtctgtggctgaaagcaagttgtcttccttccctgccctccagggtgagcccccaccccgcatgcaccacctctgttctttttagctagaggggcctgagctagaggtctgggcagctgcttccgcactgtcctcccgcttcctgtttcagcagtggctccgatttcaccaccattgctgcttctccatggttcttggggcaagccgttgagtcatgatctgcctctttgctccattcttcacctctttccccactcctgagttcccatgttgtagctagatattctgaaaaggccagtgggatcagagcgcccccagcccccacttttgcaatgcctggagcggccctgtgccttcaagaggaagtccagactcacaagccccttgaagacctggtcctat

SEQ ID NO: 299853 - DNA, 6268 bp, Homo sapiens
  misc_feature (2162)..(2162): n is a, c, g, or t
  misc_feature (2337)..(2337): n is a, c, g, or t
ccttcttgccgatcctcctctgagggtcccgccctctcgcgctgctcagtcccaaatgtctcctttgataagcacccataacacaggcccacctgctctgacagactcctctgcaggccttccctctccgctgactcattccctgagaaggaccactattcatcacccatctgcctcatcccaatgtctcctttggccacgctctctccataggaccctaccatgattctggagagtgcattttacatgcatgtcttttgatgtgaaatggcagtcacttaaagacctggttaaagaaaaagttggtgaggtaacatacgtggagctcttaatggacgctgaaggaaagtcaaggggatgtgctctgagagaatttcttctgtggatttactacatgaaaaatgtaactgtatggtggcgtggaatcgaatgaaatcaggaaggcagtgagtgctcatgttacagtagctatgtttgattttgccaaacatttgagtggggtgggaggggatttgcaaatgggagtcccgcttttccaaatggctggccaaagagctttttggtattctgtttggatgcccaatttggataactggggaccaatagcagcattgtctctttgttaacagaggaattggctgtgtgtgaattatgcatggaattttagcggtggtataattaatgtaaaacgtgtgttcttgtctagaaaatgttactcttggttgtttgctgaatttgaaagttgtgtgaaccaaagattccgaaaagttgcctttgtgccagtaaattgtaaaccaaatattaaaaacctgaatgttcaaaattggcctagtttaaagagaacataaactattttctgtcgtgcaatagaatggcttagaataatcaaaaggatgagcttaacttacggaagggatggatttaggaggaatatggtaaggactcgattgagtacagagggaagcagatctaaagttggtgtgatttcttggagaccctgaatttaggtctgcttattaaatgtcagcagctctagtgcaatgctggtaacgcgtaggagaaggagatattaaggagcccagcttttaacaaggaaggcgaggcgaggcacttctgtcagcttccccttagaagggttcattttaaaagactaactttgtgacataaatcatatttttagtttgtttataactgtcattggtatttactatttttttcttttctttttccccttccttgctcttctgactggtctctggcttcctccaaagggatgtgcgtaagtatcgtctagttacttattggtatttgagccttctaacttgtaggactggtttcactcgactcgtttccttttgactctatagtgttgttgaattcaagatggaagagagcatgaaaaaagctgcggaagtcctaaacaagcatagtctgagcggaagaccactgaaagtcaaagaagtaagctcttgcttaacactgcggatactgtgtgtaattgttgagtgatcctactttggaattagggaaagacggtcatggtcccagacggcatttacaaagcaagtgccagcctgttgtttctaatgaagagtgtcggtcatagcctacagcagccattccctgcaaggactttggggtggtggccaagcagatcctgagtggctgctgaccaccttctaatatctgtgatttgtctgaggccttgttgtctcagggactctcaaaccatgagcccgtgggtttgtgccattaagttttactccatctgacccttcttcttggcccatcttttttctttttttaaaaagtgagtttgttccagcctgggcaacatggtgaaaccccctctctacaaaaggtacaaaaattagccaggcatggtggcgcatgcctgtagtcctagctacttgggaggctgaggcaggaggatcatttgagcccaggatgtggaggttgcagtgagctgagattgcaccattgcactccagcccgggcaacagtgagaccctgtctaaaaaataaaaaataaagtgagtttgttattcctcaaacctgctttcacatctcatctgaatcaaatatattccttgaggaagaaggtttttttgttgattaaatccctcttggctgggcgcagtggctcacgcctgtaatccccngcactttgggaggctgaggtgggtggatcaaggtcatgagttcaagaccagcttgaccaacatggtgaaaccctgtctactaaaaatacaaaaaattagctgggcgtagtggggggtgcctgtaatccatctactcgggaggctgaggcaggagaatcgctggaacccaggaggnggaggttgcagtgagccgagatcgcgccattgaactccagcctgggcagtaagagcaaagctctgtctcaaaaaaacatccctcttaacttcttttcacctcttctcttggggaggaagatgagtagattcagagtgaagcttggtagggtctaaggtctctcatgtgttatgatgtcttttttagtgctgatggtggtaattgacaggacagagagttgaagaagagagtcagtacagagcttcacagaccttcccagatgttgttttactgcgcagccctcacacacacgcctccaacacctgaaggacttgaaggatgggggcgcttgtgtggtctagaactgtttctcaaacttctggaagccattgacggggtttgcagaagttacaaaaccccattgatgaattagtaagattcagctataccaagcccatgaagctctaatttcagtctggcggttctacattatatcagctaatcatgtttccctccctaccctgcttttcttttttacttagtgcaattgagagctgtgtttttagtgctacacttcatgccttttcttcctttcctatttctttagctggactcttctaagctggtagttgagttcatttgactttcttgttaatagatttgagagatgctttccaaacaacctttcagtttctaagtcttgagaatatcatttactgtgcaagcatggtttgcgttgtactgggtcagttaaacgtaacaccttttgtgcttgttttaggatcctgatggtgaacatgccaggagagcaatgcaaaaggtgatggctacgactggtgggatgggtatgggaccaggtggcccaggaatgattactatcccacccagtatcctaaataatcccaacatcccaaatgagattatccatgcattacaggctggaagacttggaagcacagtatttgtagcaaatgtaagtaaacagaaccatcgtctaaagtagaaaatcagaactttatgaaatgaccttgtcaatatgttataaaagtaattctcacatttgagaagaaaaatgtaaagaagggttttgttcttgatttctttaaaaatcagccttataggcgggctttgtctgcattcctaagtcacaggcttgaccgtggtctcgttggggctgtgattcctgagtttcgcaggtgtttccacaagcagtaaccgagtctgcattctccgttggtttattttatgcagttttggtgcagagtaagactgtacgagcagaagtgcactgacaccttcctcttgttgtgtctggggtgaatgataatacctccaccatctgcaaggggaaatatttagaataaagtaggttgggtggggtggggagtggtaaagcttatcagggaaacaattttttaaaaatgttcagaaaatgagtattaatttgaagtatgaggtgacttaagtttctgagaaaagagacaatatatttactataggtacagtttatttacagtgaaggccaggctttataatcctattttaaaatttccattgcagttgattagtttttgtgacattatttcctaatacttttttccaaccaaagcatgtatcattcatgtagtaaaaatgttgtgtttcttaagatgtttacattgaggtttttaccccgttctctctcgattagctggattataaagttggctggaagaaactgaaggaagtatttagtatggctggtgtggtggtccgagcagacattcttgaagataaagatggaaaaagtcgtggaataggcactgttacttttgaacagtccattgaagctgtgcaagctatatgtatccttctgcaggaattcaacttatgaacagtttgacctaaattgctgtgttagtaatgtaggtttgtgtgaggaagaggtgactgtgtgtattcatgttttttatgtgactagggggagtgcattactgtggaattaagaggttctctgggccggaccggtcacggtggctcacgcctgtaatcccagcacttcgggaggccaaggcgggcggatcacttgaggtcagttcgagaccagcctggccaacatggtgaaaccccggctctactaaaaaatgcaaaaattagctgggcgcagtggtgggtgcctgtaatcccagctactcgggaggctgaggcacaagaatcgcttgaacccgggaggtggaggttgcagtgagccgagattgcgccactgcacaccaccagcctgggtgatagagtgagactcagtctcaaaaaaaaaaaaaaaaaaaaaaaaaaaggttctctgggggtggaattgattcaatacagtgtggatagaggggatggttacaacatgggcatatgcccatgagtctttctactgttttcttttcagaagagtctaggtttgaaggaggaagtccaaagaatgtgctactagagagaaagtggggttgttgtttcatgtgtaatacatccttataggacctcactctttccagtgagtagacatcattttggagaggccacttctccttgaccctaggcttagcctagagtttttaatcccttggagagtaccccacaggagcacattcatacaactcagacaagaccgtcactgcatgtcttacccagaaaacatggtccttcagtttagatagtggtagatgcctggcccattggtcacattcagagaaccttgatgccactgcttaagaggatggtttggtgaaattgtaaggttacgaatgaagcttcacacctaaggaataagcagaagttgtcttgtcctccccgccagctttatttattgttccttttatgtttattgttgaaagtataatgaagaattgaaattgctcataaattcatcacttagagggactggtagcagttggagtatttttctttctttttgtatttctcttgtgcacatttttagaattgcaagaaatagccttaattgtaataccagctatgttcaatggccagctgctatttgatagaccaatgcacgtcaagatggatgagagggccttaccaaaaggagatttcttccctcctgagcgtccacaacaacttccccatggccttggtggtattggcatggggttaggaccaggagggcaacccattgatgccaatcacctgaataaaggcatcggaatgggaaacataggtcccgcaggtgagaatgacagtgcaccttgcttggtggtttggggaagtgaaaattattaattattggggcaactggactttgagtagtttaaatggaataaatatttaactgggacaaaattccctccttattcatctctgcctcattttgaataaaggcagtattttgtatttttatcaagttgagtcattttttaaaaagtcattatgctttttcattgtaacctcacaacaaccttctaagctgaaatagttgtgccatttgataagaggaggcaagccatagagttgatcttgctcaaggtcacactgtcagttactgacaggctgcaggtctcctgaccacgggaccatagcactgccgcagtgccctgaaaagtgtcttaccaagacccctttgggccctcctggtgtttgcacagctgctgctagagagctaggggcattgacagatgcaaaaaaggtggagaggccaggcacggtggctcacgcctgtaatcccagcactttgggaggccgaggtgggcggatcacaaggtcaggagtttgagaccatcctggccaacatggtgaaaccccatctctactaaaaataaaacaattagccgggcgtggtggcgcacgcctgtaatcccagttactcaagaggctgaggcaggagaattgcttgaacccgggaggcggaggttgcagtgagctgagatcacatgactgcacttcagcctggcaacagagcgagagtccgtctccagaa

SEQ ID NO: 299854 - DNA, 2287 bp, Homo sapiens
ccttcttgccgatcctcctctgagggtcccgccctctcgcgctgctcagtcccaaatgtctcctttgataagcacccataacacaggcccacctgctctgacagactcctctgcaggccttccctctccgctgactcattccctgagaaggaccactattcatcacccatctgcctcatcccaatgtctcctttggccacgctctctccataggaccctaccatgattctggagagtgcattttacatgcatgtcttttgatgtgaaatggcagtcacttaaagacctggttaaagaaaaagttggtgaggtaacatacgtggagctcttaatggacgctgaaggaaagtcaaggggatgtgctctgagagaatttcttctgtggatttactacatgaaaaatgtaactgtatggtggcgtggaatcgaatgaaatcaggaaggcagtgagtgctcatgttacagtagctatgtttgattttgccaaacatttgagtggggtgggaggggatttgcaaatgggagtcccgcttttccaaatggctggccaaagagctttttggtattctgtttggatgcccaatttggataactggggaccaatagcagcattgtctctttgttaacagaggaattggctgtgtgtgaattatgcatggaattttagcggtggtataattaatgtaaaacgtgtgttcttgtctagaaaatgttactcttggttgtttgctgaatttgaaagttgtgtgaaccaaagattccgaaaagttgcctttgtgccagtaaattgtaaaccaaatattaaaaacctgaatgttcaaaattggcctagtttaaagagaacataaactattttctgtcgtgcaatagaatggcttagaataatcaaaaggatgagcttaacttacggaagggatggatttaggaggaatatggtaaggactcgattgagtacagagggaagcagatctaaagttggtgtgatttcttggagaccctgaatttaggtctgcttattaaatgtcagcagctctagtgcaatgctggtaacgcgtaggagaaggagatattaaggagcccagcttttaacaaggaaggcgaggcgaggcacttctgtcagcttccccttagaagggttcattttaaaagactaactttgtgacataaatcatatttttagtttgtttataactgtcattggtatttactatttttttcttttctttttccccttccttgctcttctgactggtctctggcttcctccaaagggatgtgcgtaagtatcgtctagttacttattggtatttgagccttctaacttgtaggactggtttcactcgactcgtttccttttgactctatagtgttgttgaattcaagatggaagagagcatgaaaaaagctgcggaagtcctaaacaagcatagtctgagcggaagaccactgaaagtcaaagaagatcctgatggtgaacatgccaggagagcaatgcaaaaggtgatggctacgactggtgggatgggtatgggaccaggtggcccaggaatgattactatcccacccagtatcctaaataatcccaacatcccaaatgagattatccatgcattacaggctggaagacttggaagcacagtatttgtagcaaatctggattataaagttggctggaagaaactgaaggaagtatttagtatggctggtgtggtggtccgagcagacattcttgaagataaagatggaaaaagtcgtggaataggcactgttacttttgaacagtccattgaagctgtgcaagctatatctatgttcaatggccagctgctatttgatagaccaatgcacgtcaagatggatgagagggccttaccaaaaggagatttcttccctcctgagcgtccacaacaacttccccatggccttggtggtattggcatggggttaggaccaggagggcaacccattgatgccaatcacctgaataaaggcatcggaatgggaaacataggtcccgcaggaatgggaatggaaggcataggatttggaataaataaaatgggaggaatggaggggccctttggtggtggtatggaaaacatgggtcgatttggatctgggatgaacatgggcaggataaatgcggggtcgaaacggcggcggaggtggcggcgacggagatccaaatggaggaagagagcggcgcgcccggcgtgccgagcggcaacggggctccgggccctaagggtgaaggagaacgacctgctccgaatgagaagaggaagga

SEQ ID NO: 299855 - DNA, 3586 bp, Homo sapiens
  misc_feature (2162)..(2162): n is a, c, g, or t
  misc_feature (2337)..(2337): n is a, c, g, or t
ccttcttgccgatcctcctctgagggtcccgccctctcgcgctgctcagtcccaaatgtctcctttgataagcacccataacacaggcccacctgctctgacagactcctctgcaggccttccctctccgctgactcattccctgagaaggaccactattcatcacccatctgcctcatcccaatgtctcctttggccacgctctctccataggaccctaccatgattctggagagtgcattttacatgcatgtcttttgatgtgaaatggcagtcacttaaagacctggttaaagaaaaagttggtgaggtaacatacgtggagctcttaatggacgctgaaggaaagtcaaggggatgtgctctgagagaatttcttctgtggatttactacatgaaaaatgtaactgtatggtggcgtggaatcgaatgaaatcaggaaggcagtgagtgctcatgttacagtagctatgtttgattttgccaaacatttgagtggggtgggaggggatttgcaaatgggagtcccgcttttccaaatggctggccaaagagctttttggtattctgtttggatgcccaatttggataactggggaccaatagcagcattgtctctttgttaacagaggaattggctgtgtgtgaattatgcatggaattttagcggtggtataattaatgtaaaacgtgtgttcttgtctagaaaatgttactcttggttgtttgctgaatttgaaagttgtgtgaaccaaagattccgaaaagttgcctttgtgccagtaaattgtaaaccaaatattaaaaacctgaatgttcaaaattggcctagtttaaagagaacataaactattttctgtcgtgcaatagaatggcttagaataatcaaaaggatgagcttaacttacggaagggatggatttaggaggaatatggtaaggactcgattgagtacagagggaagcagatctaaagttggtgtgatttcttggagaccctgaatttaggtctgcttattaaatgtcagcagctctagtgcaatgctggtaacgcgtaggagaaggagatattaaggagcccagcttttaacaaggaaggcgaggcgaggcacttctgtcagcttccccttagaagggttcattttaaaagactaactttgtgacataaatcatatttttagtttgtttataactgtcattggtatttactatttttttcttttctttttccccttccttgctcttctgactggtctctggcttcctccaaagggatgtgcgtaagtatcgtctagttacttattggtatttgagccttctaacttgtaggactggtttcactcgactcgtttccttttgactctatagtgttgttgaattcaagatggaagagagcatgaaaaaagctgcggaagtcctaaacaagcatagtctgagcggaagaccactgaaagtcaaagaagtaagctcttgcttaacactgcggatactgtgtgtaattgttgagtgatcctactttggaattagggaaagacggtcatggtcccagacggcatttacaaagcaagtgccagcctgttgtttctaatgaagagtgtcggtcatagcctacagcagccattccctgcaaggactttggggtggtggccaagcagatcctgagtggctgctgaccaccttctaatatctgtgatttgtctgaggccttgttgtctcagggactctcaaaccatgagcccgtgggtttgtgccattaagttttactccatctgacccttcttcttggcccatcttttttctttttttaaaaagtgagtttgttccagcctgggcaacatggtgaaaccccctctctacaaaaggtacaaaaattagccaggcatggtggcgcatgcctgtagtcctagctacttgggaggctgaggcaggaggatcatttgagcccaggatgtggaggttgcagtgagctgagattgcaccattgcactccagcccgggcaacagtgagaccctgtctaaaaaataaaaaataaagtgagtttgttattcctcaaacctgctttcacatctcatctgaatcaaatatattccttgaggaagaaggtttttttgttgattaaatccctcttggctgggcgcagtggctcacgcctgtaatccccngcactttgggaggctgaggtgggtggatcaaggtcatgagttcaagaccagcttgaccaacatggtgaaaccctgtctactaaaaatacaaaaaattagctgggcgtagtggggggtgcctgtaatccatctactcgggaggctgaggcaggagaatcgctggaacccaggaggnggaggttgcagtgagccgagatcgcgccattgaactccagcctgggcagtaagagcaaagctctgtctcaaaaaaacatccctcttaacttcttttcacctcttctcttggggaggaagatgagtagattcagagtgaagcttggtagggtctaaggtctctcatgtgttatgatgtcttttttagtgctgatggtggtaattgacaggacagagagttgaagaagagagtcagtacagagcttcacagaccttcccagatgttgttttactgcgcagccctcacacacacgcctccaacacctgaaggacttgaaggatgggggcgcttgtgtggtctagaactgtttctcaaacttctggaagccattgacggggtttgcagaagttacaaaaccccattgatgaattagtaagattcagctataccaagcccatgaagctctaatttcagtctggcggttctacattatatcagctaatcatgtttccctccctaccctgcttttcttttttacttagtgcaattgagagctgtgtttttagtgctacacttcatgccttttcttcctttcctatttctttagctggactcttctaagctggtagttgagttcatttgactttcttgttaatagatttgagagatgctttccaaacaacctttcagtttctaagtcttgagaatatcatttactgtgcaagcatggtttgcgttgtactgggtcagttaaacgtaacaccttttgtgcttgttttaggatcctgatggtgaacatgccaggagagcaatgcaaaaggtgatggctacgactggtgggatgggtatgggaccaggtggcccaggaatgattactatcccacccagtatcctaaataatcccaacatcccaaatgagattatccatgcattacaggctggaagacttggaagcacagtatttgtagcaaatctggattataaagttggctggaagaaactgaaggaagtatttagtatggctggtgtggtggtccgagcagacattcttgaagataaagatggaaaaagtcgtggaataggcactgttacttttgaacagtccattgaagctgtgcaagctatatgtatccttctgcaggaattcaacttatgaacagtttgacctaaattgctgtgttagtaatgtaggtttgtgtgaggaagaggtgactgtgtgagccactgcgctggccaagggcaccatcttttagtagttatgtagatatag

SEQ ID NO: 299856 - DNA, 441 bp, Homo sapiens
gaagaattgaaattgctcataaattcatcacttagagggactggtagcagttggagtatttttctttctttttgtatttctcttgtgcacatttttagaattgcaagaaatagccttaattgtaataccagctatgttcaatggccagctgctatttgatagaccaatgcacgtcaagatggtaagtcagtaggatctttctctgtgatatactcaagtctagcaaaaacatggaattaataagagtgtacatatagccactatgaaatatttgtggattagtctaagttaaatagggtgcagtatgttgagcaaaattgtgagagaaataacattttgctggtcaggcgtggtggttcacgcctgtaatcccagcactttgggagtctgaggcaggcggatcatgaggtcagtagttcgacaccagcctgaccaacgtgg

SEQ ID NO: 299857 - DNA, 1232 bp, Homo sapiens
gaaatgagttttctaaggtgtggagattttgacttgatcttttagtcttagaaaaactaagatcctaaacctgtagtttcagaatgcaaaagaagaagctagtgtgctaccttatgttgagacagtatttctttttggtggtggtatctttgccatggccctgtgtcttatttcagatgcattatcctcgtaccgtgactcccacactaacagagtactgacctctccaccgtttcgcctcatgcctttccctccttcctctcctagactgctggttaccttggctgggagagaggatgtagtgggacattcctgtaacactttatccgcacatctactggaaatcgttaccatgttaataacttggttttgaattcatgttaacatgtgtacccatgaacatttttcattttcttttcatagtgcgatacataggtgcatgacagcattaacctggggacgtagaatatgatcaaggcagcattactgctttaactttagaatgacttactatttattaatttaaacagactgctgtttccacaaccttagcattgaaggtctttcattttctcccatcaagctatgttagtttaggtaatgtagaaatatttaccctctggcttaagctggtttagagtaactaactagagctatagtttgcatgggaaagtctgcacgagcttcttgtcagatatttcttgctcttctgtcgcattacttactaaacctcccaactctcatcatattcttcatttaaccacctcctacatgttttcttttggaccatggcctaaaatttaattgtttgtgttttacttgcgttggatttcaaatattatttgatgcttatttttgttttgtgtcttcttgtttctgatttttactctgtcacggctccatctcttacatgtagcttatgtctatgtccttttaacatccccccatcagcctccccctccccctcctgcctctgcctcaccctctgctgttcccaacggcccccagtctcccaagcagcaaaaggaacccctctcccaccgcttcaacgagttcatgacctccaaacccaaaatccactgcttcaggagcctaaagcgtggggtaagttctgctccggaatcctgtctctctggcgtgctttggttgcatgtttggttctgcataactaattttgtttgtgaatgaatccattgtgttttcccataacatataaaaaagttaaaaaaaaa

SEQ ID NO: 299858 - DNA, 757 bp, Homo sapiens
tgagacgggagtccgctctattgttcagactgcattccagcctgggtgacagagtgagactccgtctaaaaaaaaaagattaacacttaaaacagtgaaatgggaatcggaaactggttcttttgatgatttaaaggaaaatctctgttttaccataatcagcagtatgaattttatttcttactcctcaaacgtgtgctcagcaaatctttgttaaaaaaaatttcccaaatgatgtgtttattttcctgaggttaaaccacatacatatacccactagaagcaatcgtaaagaaatagagaaatagttttgcttccctcacttttggtcattctgttcttagggtcagaattaatgttccttcctctaggacatagcagtgcaaaaaaagaggaagcacaagctcaaaaagcaaatctaaagtttggagaaatagatttcatttttaagcagtctcaacatggatcttgcatgggacatccatggcatggctgacagcttccgtgaccaacatgactcagtctttctgttttcacaaagaactcatgaagaggacgatagggaaacccacgtatgcctttgaggctagggactatgttgtaagttcacctgtgatggccaggtcatacagtcatggcacagccactaaccccattcacagcaccaagactggggacccagaggcacttgttatgcttccacactacgaaatgaaattcttaattgagagaactggacaccaggaaaaaaaaaaaa

SEQ ID NO: 299859 - DNA, 809 bp, Homo sapiens
ataatttaactagaaaaagttcctgagagaataacaaatctgtgattttattatgtcttttatcatgttttgcagctttcagattcagatgtcaataatttgtttctatgatcagagtatataaatcccatgcaaacatatctcagcataactgattttgtttctaaataattaaacaggataaaatgttatttgttgtaagctgttgacatttgtaaggaaattttgtttcactgaatatgtttagagatgccgccagaacattaaccattgtttcatttttatgtaagttgaagaaaaatgaagctagatagcatgttctccatttgcagtctacaaaggggaattttattgcttaaattaaagtttcattttctggcctgtgcaagagacttttatatctaaaatatggatgtacgtttttcatattttagagttcattgtatggaaaaataccatcaaagttgaccaaaagattttgaaaatccttaccagttgtttgtcatatgttaaagtcttatggttaattttatttattttatcttgttctcttgctggttattggcagactcagtctttctgttttcacaaagaactcatgaagaggacgatagggaaacccacgtatgcctttgaggctagggactatgttgtaagttcacctgtgatggccaggtcatacagtcatggcacagccactaaccccattcacagcaccaagactggggacccagaggcacttgttatgcttccacactacgaaatgaaattcttaattgagagaactggacaccaggaaaaaaaaaaaa

SEQ ID NO: 299860 - DNA, 566 bp, Homo sapiens
catggaaaatattagtactactttgatcagtttgacaacttagaaaaacacacacagtggggaattgatattcttgagaaatatatcaagtttgtgaaagaaaggacagagattgaactcagctatgcaaagcaactcaggaatctttcaaagaagtaccaacctaaaaagaactcgaaggaggaagaagaatacaagtatacgtcatgtaaagctttcatttccaacctgaacgaaatgaatgattacgcagggcaatcacttgaggtcagaagttcgagaccagcctggcaacgtgatgaaaccccttctctactaaaaatataaaatacattttaaaaaattagctgggcatgatggtgcatgcctgtaatcccagctactcaggaggctgaggtacaagaattgctcgaacctgggaggcggaggttgcagtgagctgagatggcaccactgcactctagcctgggtgacagagtgagaccctgtctcaaaaaaaaaaagaaaaaaaaagaagaggccaggcgcggtggctcatgcctgtaatcccagcactttgggaggcc

SEQ ID NO: 299861 - DNA, 5883 bp, Homo sapiens
  misc_feature (5427)..(5427): n is a, c, g, or t
  misc_feature (5431)..(5432): n is a, c, g, or t
  misc_feature (5434)..(5434): n is a, c, g, or t
  misc_feature (5440)..(5440): n is a, c, g, or t
  misc_feature (5442)..(5442): n is a, c, g, or t
  misc_feature (5445)..(5445): n is a, c, g, or t
  misc_feature (5448)..(5448): n is a, c, g, or t
  misc_feature (5451)..(5451): n is a, c, g, or t
  misc_feature (5453)..(5453): n is a, c, g, or t
  misc_feature (5456)..(5456): n is a, c, g, or t
  misc_feature (5460)..(5460): n is a, c, g, or t
  misc_feature (5465)..(5465): n is a, c, g, or t
  misc_feature (5471)..(5471): n is a, c, g, or t
  misc_feature (5473)..(5473): n is a, c, g, or t
  misc_feature (5477)..(5477): n is a, c, g, or t
  misc_feature (5481)..(5481): n is a, c, g, or t
  misc_feature (5486)..(5486): n is a, c, g, or t
  misc_feature (5490)..(5490): n is a, c, g, or t
  misc_feature (5493)..(5493): n is a, c, g, or t
  misc_feature (5497)..(5498): n is a, c, g, or t
  misc_feature (5501)..(5501): n is a, c, g, or t
  misc_feature (5511)..(5511): n is a, c, g, or t
  misc_feature (5517)..(5517): n is a, c, g, or t
cggccgcggctgctgcttcctcgggccattttgctgtggagcggcggggaggaggagccgccgaggagaccccgggcgaggagctgcgagccggaggaggccgcgcggactccgggctttccgccgtcgcggggatctcggggggcaaagggatcgccggggagggggaccagagagccgcgcccgccgcgcggagcgccccttcgcgtcccctgcaccatgagctggggcaccgagctctgggatcagtttgacaacttagaaaaacacacacagtggggaattgatattcttgagaaatatatcaagtttgtgaaagaaaggacagagattgaactcagctatgcaaagcaactcaggaatctttcaaagaagtaccaacctaaaaagaactcgaaggaggaagaagaatacaagtatacgtcatgtaaagctttcatttccaacctgaacgaaatgaatgattacgcagggcagcatgaagttatctccgagaacatggcatcacagatcattgtggacttggcacgctatgttcaggaactgaaacaggagaggaaatcaaactttcacgatggccgtaaagcacagcagcacatcgagacttgctggaagcagcttgaatctagtaaaaggcgatttgaacgcgattgcaaagaggcggacagggcgcagcagtactttgagaaaatggacgctgacatcaatgtcacaaaagcggatgttgaaaaggcccgacaacaagctcaaatacgtcaccaaatggcagaggacagcaaagcagattactcatccattctccagaaattcaaccatgagcagcatgaatattaccatactcacatccccaacatcttccagaaaatacaagagatggaggaaaggaggattgtgagaatgggagagtccatgaagacatatgcagaggttgatcggcaggtgatcccaatcattgggaagtgcctggatggaatagtaaaagcagccgaatcaattgatcagaaaaatgattcacagctggtaatagaagcttataaatcagggtttgagcctcctggagacattgaatttgaggattacactcagccaatgaagcgcactgtgtcagataacagcctttcaaattccagaggagaaggcaaaccagacctcaaatttggtggcaaatccaaaggaaagttatggccgttcatcaaaaaaaataagctatgtccttttaacatccccccatcagcctccccctccccctcctgcctctgcctcaccctctgctgttcccaacggcccccagtctcccaagcagcaaaaggaacccctctcccaccgcttcaacgagttcatgacctccaaacccaaaatccactgcttcaggagcctaaagcgtgggggtgcaacaccggaggatttcagcaacctcccacctgaacaaagaaggaaaaagctgcagcagaaagtcgatgagttaaataaagaaattcagaaggagatggatcaaagagatgccataacaaaaatgaaagatgtctacctaaagaatcctcagatgggagacccagccagtttggatcacaaattagcagaagtcagccaaaatatagagaaactgcgagtagagacccagaaatttgaggcctggctggctgaggttgaaggccggctcccagcacgcaacgagcaggcgcgccggcagagcggactgtacgacagccagaacccacccacagtcaacaactgcgcccaggaccgtgagagcccagatggcagttacacagaggagcagagtcaggagagtgagatgaaggtgctggccacggattttgacgacgagtttgatgatgaggagcccctccctgccatagggacgtgcaaagctctctacacatttgaaggtcagaatgaaggaacgatttccgtagttgaaggagaaacattgtatgtcatagaggaagacaaaggcgatggctggacccgcattcggagaaatgaagatgaagagggttatgtccccacttcatatgtcgaagtctgtttggacaaaaatgccaaagattcctagaggggagtgcctgcgagcctcgggtgagccttcctggaggagcctccgtctgcttgttcccacaggcctccagcgccctgccctgtggacagcccacccctccgcagccccatccctgcggggcggtctctctctctctctccagcatgctccctgcggccctgccctcccgcccagcccgggccacctcgtgggggacaagtctcgccagcgcccacccccatggctcgggtcagtcctcatcgctccccctccccaccccgcgcaggccactgagacggtgggacacacgcccccacctgctccttcctgggccctcagtccacccgggctcgtcctggcagcccttccgcgcttcacacagtgccttttgtgaaagtgtcatcacgggtcccctgaggagacaaggcaggtccagcgcacatcaggcggactgagcactcgatgtcatccgtgtcgatgtcatccgtgtgtcccagactgcctgctgtagaaaacacttcctcctctcctgagtctgtgaagtcctcagtggtcctttttggattctaggcttgcacctcatactaaacattgaccctttcactatgccctcaacctgggagcatctggcaggcaggggggcaggtacacacacacccacaggcacacccaccagtacacacgcgtgcgcatacacacattttggtttgacgccctgttttcagtggcctggggaggtccacactggaagtcgaattccagctcgccttgttgactcgcctgtgtccaccggccatgaggagcccacgcctgtcctccccatcactttcctgtccctgagaactgtagatcatgcgcttgtgagcgaggccctcccctctgcaccagctcattgcaaagcgaacatcctctcctttccaggagccccaggattagcatctgaaaagggtagcacttccttttttgttgttgttttttttttttttttgagacgggagtctcgctctattgttcagactggagtgcagtggcatgatctcggctcactacaacctccacctcctgggttccagcgattctcctgcctcagcctcccaaatagctgtgattacaggcgtgcaccaccacgcccggctaatgtttgtatttttagtagagacagggtttcaccgtgttggtcaggctggtctcaaactcctgacctcaggtgatccgcccgcctcagcctcccaaagtgctgagattacaggtgtgagctaccgcaccccgccgaggttagcactttcatcaccaaagaccccgtgcctctcgtggtcctttgagggatcccgccgccaccacccttgtattttatcacgtgctcttcagggcatgtggaattcgttgagtttgcttttagagccaagtttctttccctgtgtgggtttttgaggaaaacctgaggtcccctaatctgtggccaccaccccccccccgccgccacgccttagagcagagcagcccctcctctcatttggtgcagaaacagtcaagaggaaccattggcctagagctcctgtgaccgagagcgccacggaagcctggggatgatgtcgggcagctttattctttgcttggctttggtaactaggtggtcccctcaagcatcctcagttcctcttgctgtttatgaatctaagacaaggaagtcctatagaagccaaagggacagggacggaaaggacaggtcccaagggatggggctgtctttacttgtggaaaccaggaaattgctcctctcagccaaccaaggttgaccacacaccacccttccggagcagctcagtcagccctcggggacgagaaaccacaagcgcagagacgctgaggcccaggcaggtgaagaggaagtggctttgggtttttaaagtaggtgagcgtgagcctctctgactgcttcttccccgggggggactgcaaaccgctcagggttgcggcagagccatggacttccggtccctgcaacgggtgacctaagcgtggtgcacccatcagtcacgcaggaggactgacttgacagacgaaagacaagcccggatgacacagggtgagaagagtcagggccgcacctctgtccctgcaaaccaacaggtgcatggtgagtgtggcagtccccacagctccacaatgggctcccccgccaacggggacgacagggatcttcaggaacttctgacctcaccaagtcaagtggaccactctccactccacgaggatgtgaaacggttctttaaaatgggattttagagcctcgggaatgcatgtgcgtcgcatctttcatattatgggtcaggatagattcatttcttgcaacatagtggaaaagatataagctgcagtaatttgctctttgaatgaccgtcacccccagtataggatatgcttgtatccccccgtcactcctccgcctgttttttaaacttttccaccacctgcgtccaaaaagaatgttatagcgagtgctcttaaatgttgaacctgggtgttgcttccgggccagtctgcgtggctccatgaaaagctcactgctgccccagccgggcttcttagaggaggtcagttgtcctatgtatcatcatttactctgggaatcctactgtgaaatcatgtctgtatttttctggagcagttcacatagagtagaatgtggaatttcccgtgaacgtctccttcctcccccgtatctgccgcctgtcacttcgccaccgtgctagaatactgttgtgttgtaagatgactaattttaaaagaacctgccctgaaaagttcttagaaacgcaatgaaagggaggaacttgtcctttacccagtttttcctttgtaggatgggaaagtataaaaaggcacagaaggttgtcatgggctgttccttgggggtttttatcctgctcaccgtggagataagcctgcggcttgtctaaccagcgcagcgcaaaggtctcaatgccttttggtaacatccgtcattgcagaagaaagtttacacgacgtcaaaaagtgacgttcatgctaagtgtttttccagaaatattggtttcatgtttcttattggctctgcctcctgtgcttatatcatccaaaaactttttaaaaaggtccagaattctattttaacctgatgttgagcacctttaaaacgttcgtatgtgtgttgcactaattctaaactttggaggcattttgctgtgtgaggccgatcgccactgtaaaggtcctagagttgcctgtttgtctctggagatggaattaaaccaaataaagagcttccactggaggcttgtattgaccttgtaactatatgttaatctcgtgttaaaataaaatataacttgtgaaaaaaaaaaaaaaanaaannanaaaaananaanaanaananaanaaanaaaanaaaaananaaanaaanaaaanaaanaanaaannaanaaaaaaaaanaacaanaaaaatttaaattaaataaaatttatttatacattcaaatttaaatctcatcttccaatttacccctataaaaacccatttaacaatcaactgactcgccttttacaacattcccaattgtaaaaaccttccctttaccaacctaaatcaccttgttcaaatcccccttattcacctgctaatacttaaaaacccccccgacgactttctaacaatttgcaccaaatggctatggaaatttaagctcacttttgttaccgctaaattttgtaaacactaatttttaccataagccgaactgcaatcccttatagtaacgtggctcccacgcccgggcacttttttaggggggccccccctgacctc

SEQ ID NO: 299862 - DNA, 5306 bp, Homo sapiens
attttcttctagctgctgtcaagtcagtgctgcagcagttcatgtgatagtgagagcgtgggggcatcctcaggtttcacagagcatcaaaagaactctgctatagtcacaaacaagcaccagctcatttgttactgagatcagtttgacaacttagaaaaacacacacagtggggaattgatattcttgagaaatatatcaagtttgtgaaagaaaggacagagattgaactcagctatgcaaagcaactcaggaatctttcaaagaagtaccaacctaaaaagaactcgaaggaggaagaagaatacaagtatacgtcatgtaaagctttcatttccaacctgaacgaaatgaatgattacgcagggcagcatgaagttatctccgagaacatggcatcacagatcattgtggacttggcacgctatgttcaggaactgaaacaggagaggaaatcaaactttcacgatggccgtaaagcacagcagcacatcgagacttgctggaagcagcttgaatctagtaaaaggcgatttgaacgcgattgcaaagaggcggacagggcgcagcagtactttgagaaaatggacgctgacatcaatgtcacaaaagcggatgttgaaaaggcccgacaacaagctcaaatacgtcaccaaatggcagaggacagcaaagcagattactcatccattctccagaaattcaaccatgagcagcatgaatattaccatactcacatccccaacatcttccagaaaatacaagagatggaggaaaggaggattgtgagaatgggagagtccatgaagacatatgcagaggttgatcggcaggtgatcccaatcattgggaagtgcctggatggaatagtaaaagcagccgaatcaattgatcagaaaaatgattcacagctggtaatagaagcttataaatcagggtttgagcctcctggagacattgaatttgaggattacactcagccaatgaagcgcactgtgtcagataacagcctttcaaattccagaggagaaggcaaaccagacctcaaatttggtggcaaatccaaaggaaagttatggccgttcatcaaaaaaaataagctatgtccttttaacatccccccatcagcctccccctccccctcctgcctctgcctcaccctctgctgttcccaacggcccccagtctcccaagcagcaaaaggaacccctctcccaccgcttcaacgagttcatgacctccaaacccaaaatccactgcttcaggagcctaaagcgtgggggtgcaacaccggaggatttcagcaacctcccacctgaacaaagaaggaaaaagctgcagcagaaagtcgatgagttaaataaagaaattcagaaggagatggatcaaagagatgccataacaaaaatgaaagatgtctacctaaagaatcctcagatgggagacccagccagtttggatcacaaattagcagaagtcagccaaaatatagagaaactgcgagtagagacccagaaatttgaggcctggctggctgaggttgaaggccggctcccagcacgcaacgagcaggcgcgccggcagagcggactgtacgacagccagaacccacccacagtcaacaactgcgcccaggaccgtgagagcccagatggcagttacacagaggagcagagtcaggagagtgagatgaaggtgctggccacggattttgacgacgagtttgatgatgaggagcccctccctgccatagggacgtgcaaagctctctacacatttgaaggtcagaatgaaggaacgatttccgtagttgaaggagaaacattgtatgtcatagaggaagacaaaggcgatggctggacccgcattcggagaaatgaagatgaagagggttatgtccccacttcatatgtcgaagtctgtttggacaaaaatgccaaagattcctagaggggagtgcctgcgagcctcgggtgagccttcctggaggagcctccgtctgcttgttcccacaggcctccagcgccctgccctgtggacagcccacccctccgcagccccatccctgcggggcggtctctctctctctctccagcatgctccctgcggccctgccctcccgcccagcccgggccacctcgtgggggacaagtctcgccagcgcccacccccatggctcgggtcagtcctcatcgctccccctccccaccccgcgcaggccactgagacggtgggacacacgcccccacctgctccttcctgggccctcagtccacccgggctcgtcctggcagcccttccgcgcttcacacagtgccttttgtgaaagtgtcatcacgggtcccctgaggagacaaggcaggtccagcgcacatcaggcggactgagcactcgatgtcatccgtgtcgatgtcatccgtgtgtcccagactgcctgctgtagaaaacacttcctcctctcctgagtctgtgaagtcctcagtggtcctttttggattctaggcttgcacctcatactaaacattgaccctttcactatgccctcaacctgggagcatctggcaggcaggggggcaggtacacacacacccacaggcacacccaccagtacacacgcgtgcgcatacacacattttggtttgacgccctgttttcagtggcctggggaggtccacactggaagtcgaattccagctcgccttgttgactcgcctgtgtccaccggccatgaggagcccacgcctgtcctccccatcactttcctgtccctgagaactgtagatcatgcgcttgtgagcgaggccctcccctctgcaccagctcattgcaaagcgaacatcctctcctttccaggagccccaggattagcatctgaaaagggtagcacttccttttttgttgttgttttttttttttttttgagacgggagtctcgctctattgttcagactggagtgcagtggcatgatctcggctcactacaacctccacctcctgggttccagcgattctcctgcctcagcctcccaaatagctgtgattacaggcgtgcaccaccacgcccggctaatgtttgtatttttagtagagacagggtttcaccgtgttggtcaggctggtctcaaactcctgacctcaggtgatccgcccgcctcagcctcccaaagtgctgagattacaggtgtgagctaccgcaccccgccgaggttagcactttcatcaccaaagaccccgtgcctctcgtggtcctttgagggatcccgccgccaccacccttgtattttatcacgtgctcttcagggcatgtggaattcgttgagtttgcttttagagccaagtttctttccctgtgtgggtttttgaggaaaacctgaggtcccctaatctgtggccaccaccccccccccgccgccacgccttagagcagagcagcccctcctctcatttggtgcagaaacagtcaagaggaaccattggcctagagctcctgtgaccgagagcgccacggaagcctggggatgatgtcgggcagctttattctttgcttggctttggtaactaggtggtcccctcaagcatcctcagttcctcttgctgtttatgaatctaagacaaggaagtcctatagaagccaaagggacagggacggaaaggacaggtcccaagggatggggctgtctttacttgtggaaaccaggaaattgctcctctcagccaaccaaggttgaccacacaccacccttccggagcagctcagtcagccctcggggacgagaaaccacaagcgcagagacgctgaggcccaggcaggtgaagaggaagtggctttgggtttttaaagtaggtgagcgtgagcctctctgactgcttcttccccgggggggactgcaaaccgctcagggttgcggcagagccatggacttccggtccctgcaacgggtgacctaagcgtggtgcacccatcagtcacgcaggaggactgacttgacagacgaaagacaagcccggatgacacagggtgagaagagtcagggccgcacctctgtccctgcaaaccaacaggtgcatggtgagtgtggcagtccccacagctccacaatgggctcccccgccaacggggacgacagggatcttcaggaacttctgacctcaccaagtcaagtggaccactctccactccacgaggatgtgaaacggttctttaaaatgggattttagagcctcgggaatgcatgtgcgtcgcatctttcatattatgggtcaggatagattcatttcttgcaacatagtggaaaagatataagctgcagtaatttgctctttgaatgaccgtcacccccagtataggatatgcttgtatccccccgtcactcctccgcctgttttttaaacttttccaccacctgcgtccaaaaagaatgttatagcgagtgctcttaaatgttgaacctgggtgttgcttccgggccagtctgcgtggctccatgaaaagctcactgctgccccagccgggcttcttagaggaggtcagttgtcctatgtatcatcatttactctgggaatcctactgtgaaatcatgtctgtatttttctggagcagttcacatagagtagaatgtggaatttcccgtgaacgtctccttcctcccccgtatctgccgcctgtcacttcgccaccgtgctagaatactgttgtgttgtaagatgactaattttaaaagaacctgccctgaaaagttcttagaaacgcaatgaaagggaggaacttgtcctttacccagtttttcctttgtaggatgggaaagtataaaaaggcacagaaggttgtcatgggctgttccttgggggtttttatcctgctcaccgtggagataagcctgcggcttgtctaaccagcgcagcgcaaaggtctcaatgccttttggtaacatccgtcattgcagaagaaagtttacacgacgtcaaaaagtgacgttcatgctaagtgtttttccagaaatattggtttcatgtttcttattggctctgcctcctgtgcttatatcatccaaaaactttttaaaaaggtccagaattctattttaacctgatgttgagcacctttaaaacgttcgtatgtgtgttgcactaattctaaactttggaggcattttgctgtgtgaggccgatcgccactgtaaaggtcctagagttgcctgtttgtctctggagatggaattaaaccaaataaagagcttccactggaggcttgtattgaccttgtaactatatgttaatctcgtgttaaaataaaatataacttgtg

SEQ ID NO: 299863 - DNA, 4263 bp, Homo sapiens
cagaaaccctccttttctatctgatctttggctctggcaatgtggagcctaagaaaaatgttattagggagcagcccttcttgtgaacttttgcacagatctgctacaagtcatttttataaatcagcgggtagacgtgtgtgttattttaatatggcggaactgaccaagttcctcttcttctgatgtgttgttgtttttttttctctttctctctctctttctctctatttttcccatacctctccaatttttacatgaagctttctctcaagctgggtgcaacaccggaggatttcagcaacctcccacctgaacaaagaaggaaaaagctgcagcagaaagtcgatgagttaaataaagaaattcagaaggagatggatcaaagagatgccataacaaaaatgaaagatgtctacctaaagaatcctcagatgggagacccagccagtttggatcacaaattagcagaagtcagccaagcctggctggctgaggttgaaggccggctcccagcacgcaacgagcaggcgcgccggcagagcggactgtacgacagccagaacccacccacagtcaacaactgcgcccaggaccgtgagagcccagatggcagttacacagaggagcagagtcaggagagtgagatgaaggtgctggccacggattttgacgacgagtttgatgatgaggagcccctccctgccatagggacgtgcaaagctctctacacatttgaaggtcagaatgaaggaacgatttccgtagttgaaggagaaacattgtatgtcatagaggaagacaaaggcgatggctggacccgcattcggagaaatgaagatgaagagggttatgtccccacttcatatgtcgaagtctgtttggacaaaaatgccaaagattcctagaggggagtgcctgcgagcctcgggtgagccttcctggaggagcctccgtctgcttgttcccacaggcctccagcgccctgccctgtggacagcccacccctccgcagccccatccctgcggggcggtctctctctctctctccagcatgctccctgcggccctgccctcccgcccagcccgggccacctcgtgggggacaagtctcgccagcgcccacccccatggctcgggtcagtcctcatcgctccccctccccaccccgcgcaggccactgagacggtgggacacacgcccccacctgctccttcctgggccctcagtccacccgggctcgtcctggcagcccttccgcgcttcacacagtgccttttgtgaaagtgtcatcacgggtcccctgaggagacaaggcaggtccagcgcacatcaggcggactgagcactcgatgtcatccgtgtcgatgtcatccgtgtgtcccagactgcctgctgtagaaaacacttcctcctctcctgagtctgtgaagtcctcagtggtcctttttggattctaggcttgcacctcatactaaacattgaccctttcactatgccctcaacctgggagcatctggcaggcaggggggcaggtacacacacacccacaggcacacccaccagtacacacgcgtgcgcatacacacattttggtttgacgccctgttttcagtggcctggggaggtccacactggaagtcgaattccagctcgccttgttgactcgcctgtgtccaccggccatgaggagcccacgcctgtcctccccatcactttcctgtccctgagaactgtagatcatgcgcttgtgagcgaggccctcccctctgcaccagctcattgcaaagcgaacatcctctcctttccaggagccccaggattagcatctgaaaagggtagcacttccttttttgttgttgttttttttttttttttgagacgggagtctcgctctattgttcagactggagtgcagtggcatgatctcggctcactacaacctccacctcctgggttccagcgattctcctgcctcagcctcccaaatagctgtgattacaggcgtgcaccaccacgcccggctaatgtttgtatttttagtagagacagggtttcaccgtgttggtcaggctggtctcaaactcctgacctcaggtgatccgcccgcctcagcctcccaaagtgctgagattacaggtgtgagctaccgcaccccgccgaggttagcactttcatcaccaaagaccccgtgcctctcgtggtcctttgagggatcccgccgccaccacccttgtattttatcacgtgctcttcagggcatgtggaattcgttgagtttgcttttagagccaagtttctttccctgtgtgggtttttgaggaaaacctgaggtcccctaatctgtggccaccaccccccccccgccgccacgccttagagcagagcagcccctcctctcatttggtgcagaaacagtcaagaggaaccattggcctagagctcctgtgaccgagagcgccacggaagcctggggatgatgtcgggcagctttattctttgcttggctttggtaactaggtggtcccctcaagcatcctcagttcctcttgctgtttatgaatctaagacaaggaagtcctatagaagccaaagggacagggacggaaaggacaggtcccaagggatggggctgtctttacttgtggaaaccaggaaattgctcctctcagccaaccaaggttgaccacacaccacccttccggagcagctcagtcagccctcggggacgagaaaccacaagcgcagagacgctgaggcccaggcaggtgaagaggaagtggctttgggtttttaaagtaggtgagcgtgagcctctctgactgcttcttccccgggggggactgcaaaccgctcagggttgcggcagagccatggacttccggtccctgcaacgggtgacctaagcgtggtgcacccatcagtcacgcaggaggactgacttgacagacgaaagacaagcccggatgacacagggtgagaagagtcagggccgcacctctgtccctgcaaaccaacaggtgcatggtgagtgtggcagtccccacagctccacaatgggctcccccgccaacggggacgacagggatcttcaggaacttctgacctcaccaagtcaagtggaccactctccactccacgaggatgtgaaacggttctttaaaatgggattttagagcctcgggaatgcatgtgcgtcgcatctttcatattatgggtcaggatagattcatttcttgcaacatagtggaaaagatataagctgcagtaatttgctctttgaatgaccgtcacccccagtataggatatgcttgtatccccccgtcactcctccgcctgttttttaaacttttccaccacctgcgtccaaaaagaatgttatagcgagtgctcttaaatgttgaacctgggtgttgcttccgggccagtctgcgtggctccatgaaaagctcactgctgccccagccgggcttcttagaggaggtcagttgtcctatgtatcatcatttactctgggaatcctactgtgaaatcatgtctgtatttttctggagcagttcacatagagtagaatgtggaatttcccgtgaacgtctccttcctcccccgtatctgccgcctgtcacttcgccaccgtgctagaatactgttgtgttgtaagatgactaattttaaaagaacctgccctgaaaagttcttagaaacgcaatgaaagggaggaacttgtcctttacccagtttttcctttgtaggatgggaaagtataaaaaggcacagaaggttgtcatgggctgttccttgggggtttttatcctgctcaccgtggagataagcctgcggcttgtctaaccagcgcagcgcaaaggtctcaatgccttttggtaacatccgtcattgcagaagaaagtttacacgacgtcaaaaagtgacgttcatgctaagtgtttttccagaaatattggtttcatgtttcttattggctctgcctcctgtgcttatatcatccaaaaactttttaaaaaggtccagaattctattttaacctgatgttgagcacctttaaaacgttcgtatgtgtgttgcactaattctaaactttggaggcattttgctgtgtgaggccgatcgccactgtaaaggtcctagagttgcctgtttgtctctggagatggaattaaaccaaataaagagcttccactggaggcttgtattgaccttgtaactatatgttaatctcgtgttaaaataaaatataacttgtg

SEQ ID NO: 299864 - DNA, 3507 bp, Homo sapiens
tgagcagcccagatggcagttacacagaggagcagagtcaggagagtgagatgaaggtgctggccacggattttgacgacgagtttgatgatgaggagcccctccctgccatagggacgtgcaaagctctctacacatttgaagattcctagaggggagtgcctgcgagcctcgggtgagccttcctggaggagcctccgtctgcttgttcccacaggcctccagcgccctgccctgtggacagcccacccctccgcagccccatccctgcggggcggtctctctctctctctccagcatgctccctgcggccctgccctcccgcccagcccgggccacctcgtgggggacaagtctcgccagcgcccacccccatggctcgggtcagtcctcatcgctccccctccccaccccgcgcaggccactgagacggtgggacacacgcccccacctgctccttcctgggccctcagtccacccgggctcgtcctggcagcccttccgcgcttcacacagtgccttttgtgaaagtgtcatcacgggtcccctgaggagacaaggcaggtccagcgcacatcaggcggactgagcactcgatgtcatccgtgtcgatgtcatccgtgtgtcccagactgcctgctgtagaaaacacttcctcctctcctgagtctgtgaagtcctcagtggtcctttttggattctaggcttgcacctcatactaaacattgaccctttcactatgccctcaacctgggagcatctggcaggcaggggggcaggtacacacacacccacaggcacacccaccagtacacacgcgtgcgcatacacacattttggtttgacgccctgttttcagtggcctggggaggtccacactggaagtcgaattccagctcgccttgttgactcgcctgtgtccaccggccatgaggagcccacgcctgtcctccccatcactttcctgtccctgagaactgtagatcatgcgcttgtgagcgaggccctcccctctgcaccagctcattgcaaagcgaacatcctctcctttccaggagccccaggattagcatctgaaaagggtagcacttccttttttgttgttgttttttttttttttttgagacgggagtctcgctctattgttcagactggagtgcagtggcatgatctcggctcactacaacctccacctcctgggttccagcgattctcctgcctcagcctcccaaatagctgtgattacaggcgtgcaccaccacgcccggctaatgtttgtatttttagtagagacagggtttcaccgtgttggtcaggctggtctcaaactcctgacctcaggtgatccgcccgcctcagcctcccaaagtgctgagattacaggtgtgagctaccgcaccccgccgaggttagcactttcatcaccaaagaccccgtgcctctcgtggtcctttgagggatcccgccgccaccacccttgtattttatcacgtgctcttcagggcatgtggaattcgttgagtttgcttttagagccaagtttctttccctgtgtgggtttttgaggaaaacctgaggtcccctaatctgtggccaccaccccccccccgccgccacgccttagagcagagcagcccctcctctcatttggtgcagaaacagtcaagaggaaccattggcctagagctcctgtgaccgagagcgccacggaagcctggggatgatgtcgggcagctttattctttgcttggctttggtaactaggtggtcccctcaagcatcctcagttcctcttgctgtttatgaatctaagacaaggaagtcctatagaagccaaagggacagggacggaaaggacaggtcccaagggatggggctgtctttacttgtggaaaccaggaaattgctcctctcagccaaccaaggttgaccacacaccacccttccggagcagctcagtcagccctcggggacgagaaaccacaagcgcagagacgctgaggcccaggcaggtgaagaggaagtggctttgggtttttaaagtaggtgagcgtgagcctctctgactgcttcttccccgggggggactgcaaaccgctcagggttgcggcagagccatggacttccggtccctgcaacgggtgacctaagcgtggtgcacccatcagtcacgcaggaggactgacttgacagacgaaagacaagcccggatgacacagggtgagaagagtcagggccgcacctctgtccctgcaaaccaacaggtgcatggtgagtgtggcagtccccacagctccacaatgggctcccccgccaacggggacgacagggatcttcaggaacttctgacctcaccaagtcaagtggaccactctccactccacgaggatgtgaaacggttctttaaaatgggattttagagcctcgggaatgcatgtgcgtcgcatctttcatattatgggtcaggatagattcatttcttgcaacatagtggaaaagatataagctgcagtaatttgctctttgaatgaccgtcacccccagtataggatatgcttgtatccccccgtcactcctccgcctgttttttaaacttttccaccacctgcgtccaaaaagaatgttatagcgagtgctcttaaatgttgaacctgggtgttgcttccgggccagtctgcgtggctccatgaaaagctcactgctgccccagccgggcttcttagaggaggtcagttgtcctatgtatcatcatttactctgggaatcctactgtgaaatcatgtctgtatttttctggagcagttcacatagagtagaatgtggaatttcccgtgaacgtctccttcctcccccgtatctgccgcctgtcacttcgccaccgtgctagaatactgttgtgttgtaagatgactaattttaaaagaacctgccctgaaaagttcttagaaacgcaatgaaagggaggaacttgtcctttacccagtttttcctttgtaggatgggaaagtataaaaaggcacagaaggttgtcatgggctgttccttgggggtttttatcctgctcaccgtggagataagcctgcggcttgtctaaccagcgcagcgcaaaggtctcaatgccttttggtaacatccgtcattgcagaagaaagtttacacgacgtcaaaaagtgacgttcatgctaagtgtttttccagaaatattggtttcatgtttcttattggctctgcctcctgtgcttatatcatccaaaaactttttaaaaaggtccagaattctattttaacctgatgttgagcacctttaaaacgttcgtatgtgtgttgcactaattctaaactttggaggcattttgctgtgtgaggccgatcgccactgtaaaggtcctagagttgcctgtttgtctctggagatggaattaaaccaaataaagagcttccactggaggcttgtattgaccttgtaactatatgttaatctcgtgttaaaataaaatataacttgtg

SEQ ID NO: 299865 - DNA, 3142 bp, Homo sapiens
cggccgcggctgctgcttcctcgggccattttgctgtggagcggcggggaggaggagccgccgaggagaccccgggcgaggagctgcgagccggaggaggccgcgcggactccgggctttccgccgtcgcggggatctcggggggcaaagggatcgccggggagggggaccagagagccgcgcccgccgcgcggagcgccccttcgcgtcccctgcaccatgagctggggcaccgagctctgggatcagtttgacaacttagaaaaacacacacagtggggaattgatattcttgagaaatatatcaagtttgtgaaagaaaggacagagattgaactcagctatgcaaagcaactcaggaatctttcaaagaagtaccaacctaaaaagaactcgaaggaggaagaagaatacaagtatacgtcatgtaaagctttcatttccaacctgaacgaaatgaatgattacgcagggcagcatgaagttatctccgagaacatggcatcacagatcattgtggacttggcacgctatgttcaggaactgaaacaggagaggaaatcaaactttcacgatggccgtaaagcacagcagcacatcgagacttgctggaagcagcttgaatctagtaaaaggcgatttgaacgcgattgcaaagaggcggacagggcgcagcagtactttgagaaaatggacgctgacatcaatgtcacaaaagcggatgttgaaaaggcccgacaacaagctcaaatacgtcaccaaatggcagaggacagcaaagcagattactcatccattctccagaaattcaaccatgagcagcatgaatattaccatactcacatccccaacatcttccagaaaatacaagagatggaggaaaggaggattgtgagaatgggagagtccatgaagacatatgcagaggttgatcggcaggtgatcccaatcattgggaagtgcctggatggaatagtaaaagcagccgaatcaattgatcagaaaaatgattcacagctggtaatagaagcttataaatcagggtttgagcctcctggagacattgaatttgaggattacactcagccaatgaagcgcactgtgtcagataacagcctttcaaattccagaggagaaggcaaaccagacctcaaatttggtggcaaatccaaaggaaagttatggccgttcatcaaaaaaaataagctatgtccttttaacatccccccatcagcctccccctccccctcctgcctctgcctcaccctctgctgttcccaacggcccccagtctcccaagcagcaaaaggaacccctctcccaccgcttcaacgagttcatgacctccaaacccaaaatccactgcttcaggagcctaaagcgtgggggtgcaacaccggaggatttcagcaacctcccacctgaacaaagaaggaaaaagctgcagcagaaagtcgatgagttaaataaagaaattcagaaggagatggatcaaagagatgccataacaaaaatgaaagatgtctacctaaagaatcctcagatgggagacccagccagtttggatcacaaattagcagaagtcagccaaaatatagagaaactgcgagtagagacccagaaatttgaggcctggctggctgaggttgaaggccggctcccagcacgcaacgagcaggcgcgccggcagagcggactgtacgacagccagaacccacccacagtcaacaactgcgcccaggaccgtgagagcccagatggcagttacacagaggagcagagtcaggagagtgagatgaaggtgctggccacggattttgacgacgagtttgatgatgaggagcccctccctgccatagggacgtgcaaagctctctacacatttgaaggtcagaatgaaggaacgatttccgtagttgaaggagaaacattgtatgtcatagaggaagacaaaggcgatggctggacccgcattcggagaaatgaagatgaagagggttatgtccccacttcatatgtcgaagtctgtttggacaaaaatgccaaaggtgctaagacttatatttaataccataaaaaaaaaaaacttaaaaaaaatggagttgtttctccccacaaccgtgactgttacaggcagttcctcaagagactggctggcaagcaccataatgcacgttctcctgtagtctcacgtggacttcagggtccgggcacctgaattgccttgtctagtttgggctgtaatcaagtttcacttgctgatgaaattttatgtggaaagctgccaaccgccaacttacagctatgtcattcaaaatctgataaacatttcttcttttggcggtatctgtagattaaaaaaaaagttgcattgtagcttctcatctttctgaatttaaaagccggcacgcatcatgcaggtgccaaagacttccctactcttgtttatatctagtatccaccatacactgagctacattaggtggttacagattgtaacttaataaactgaactgtgttagtttgttaaattgtatactcattcacttgggaggaagtcacaagtgaaataacatctccttcttgactaaagcagtaaataagattcttatattggcaccaaaagtgtgtgtttttacttaaacctggtcagcatccttggtagggcatcacgagtaccctgttccatctacatgatcccagacaaccagctgaaatctggaaaagtttggtgaattgaccacttgatttttacattgcattgctgattttccaagtgtcatcaaattgacaggtttttgttgttgtgtaagagtaaaaggtggtagatggtggtttggagacagagtctgggcaacaagagcaagactccatcccccaaaaaccccccaaaaaataacagacaaaagagaagcagttggagccacgagggtaccttgctcctgagagagatccaagtgagacagaagaagactagagagagagaccaaagatttatcccagtgagaaaatacttacattctgggagggaggagaaagaggcctggaggacttagagaggtcctagagagacagaggtaaacctggacattctgtgcagaaggagatggtttgaagcagaggagtgagggtcgggctttga

SEQ ID NO: 299866 - DNA, 5001 bp, Homo sapiens
  misc_feature (4336)..(4336): n is a, c, g, or t
  misc_feature (4340)..(4341): n is a, c, g, or t
  misc_feature (4343)..(4343): n is a, c, g, or t
  misc_feature (4349)..(4349): n is a, c, g, or t
  misc_feature (4351)..(4351): n is a, c, g, or t
  misc_feature (4354)..(4354): n is a, c, g, or t
  misc_feature (4357)..(4357): n is a, c, g, or t
  misc_feature (4360)..(4360): n is a, c, g, or t
  misc_feature (4362)..(4362): n is a, c, g, or t
  misc_feature (4365)..(4365): n is a, c, g, or t
  misc_feature (4369)..(4369): n is a, c, g, or t
  misc_feature (4374)..(4374): n is a, c, g, or t
  misc_feature (4380)..(4380): n is a, c, g, or t
  misc_feature (4382)..(4382): n is a, c, g, or t
  misc_feature (4386)..(4386): n is a, c, g, or t
  misc_feature (4390)..(4390): n is a, c, g, or t
  misc_feature (4395)..(4395): n is a, c, g, or t
  misc_feature (4399)..(4399): n is a, c, g, or t
  misc_feature (4402)..(4402): n is a, c, g, or t
  misc_feature (4406)..(4407): n is a, c, g, or t
  misc_feature (4410)..(4410): n is a, c, g, or t
  misc_feature (4420)..(4420): n is a, c, g, or t
  misc_feature (4426)..(4426): n is a, c, g, or t
cggccgcggctgctgcttcctcgggccattttgctgtggagcggcggggaggaggagccgccgaggagaccccgggcgaggagctgcgagccggaggaggccgcgcggactccgggctttccgccgtcgcggggatctcggggggcaaagggatcgccggggagggggaccagagagccgcgcccgccgcgcggagcgccccttcgcgtcccctgcaccatgagctggggcaccgagctctgggatcagtttgacaacttagaaaaacacacacagtggggaattgatattcttgagaaatatatcaagtttgtgaaagaaaggacagagattgaactcagctatgcaaagcaactcaggaatctttcaaagaagtaccaacctaaaaagaactcgaaggaggaagaagaatacaagtatacgtcatgtaaagctttcatttccaacctgaacgaaatgaatgattacgcagggcagcatgaagttatctccgagaacatggcatcacagatcattgtggacttggcacgctatgttcaggaactgaaacaggagaggaaatcaaactttcacgatggccgtaaagcacagcagcacatcgagacttgctggaagcagcttgaatctagtaaaaggcgatttgaacgcgattgcaaagaggcggacagggcgcagcagtactttgagaaaatggacgctgacatcaatgtcacaaaagcggatgttgaaaaggcccgacaacaagctcaaatacgtcaccaaatggcagaggacagcaaagcagattactcatccattctccagaaattcaaccatgagcagcatgaatattaccatactcacatccccaacatcttccagaaaatacaagagatggaggaaaggaggattgtgagaatgggagagtccatgaagacatatgcagaggttgatcggcaggtgatcccaatcattgggaagtgcctggatggaatagtaaaagcagccgaatcaattgatcagaaaaatgattcacagctggtaatagaagcttataaatcagggtttgagcctcctggagacattgaatttgaggattacactcagccaatgaagcgcactgtgtcagataacagcctttcaaattccagaggagaaggcaaaccagacctcaaatttggtggcaaatccaaaggaaagttatggccgttcatcaaaaaaaataagctatgtccttttaacatccccccatcagcctccccctccccctcctgcctctgcctcaccctctgctgttcccaacggcccccagtctcccaagcagcaaaaggaacccctctcccaccgcttcaacgagttcatgacctccaaacccaaaatccactgcttcaggagcctaaagcgtgggggtgcaacaccggaggatttcagcaacctcccacctgaacaaagaaggaaaaagctgcagcagaaagtcgatgagttaaataaagaaattcagaaggagatggatcaaagagatgccataacaaaaatgaaagatgtctacctaaagaatcctcagatgggagacccagccagtttggatcacaaattagcagaagtcagccaaaatatagagaaactgcgagtagagacccagaaatttgaggcctggctggctgaggttgaaggccggctcccagcacgcaacgagcaggcgcgccggcagagcggactgtacgacagccagaacccacccacagtcaacaactgcgcccaggaccgtgagagcccagatggcagttacacagaggagcagagtcaggagagtgagatgaaggtgctggccacggattttgacgacgagtttgatgatgaggagcccctccctgccatagggacgtgcaaagctctctacacatttgaaggtcagaatgaaggaacgatttccgtagttgaaggagaaacattgtatgtcatagaggaagacaaaggcgatggctggacccgcattcggagaaatgaagatgaagagggttatgtccccacttcatatgtcgaagtctgtttggacaaaaatgccaaagattcctagaggggagtgcctgcgagcctcgggtgagccttcctggaggagcctccgtctgcttgttcccacaggcctccagcgccctgccctgtggacagcccacccctccgcagccccatccctgcggggcggtctctctctctctctccagcatgctccctgcggccctgccctcccgcccagcccgggccacctcgtgggggacaagtctcgccagcgcccacccccatggctcgggtcagtcctcatcgctccccctccccaccccgcgcaggccactgagacggtgggacacacgcccccacctgctccttcctgggccctcagtccacccgggctcgtcctggcagcccttccgcgcttcacacagtgccttttgtgaaagtgtcatcacgggtcccctgaggagacaaggcaggtccagcgcacatcaggcggactgagcactcgatgtcatccgtgtcgatgtcatccgtgtgtcccagactgcctgctgtagaaaacacttcctcctctcctgagtctgtgaagtcctcagtggtcctttttggattctaggcttgcacctcatactaaacattgaccctttcactatgccctcaacctgggagcatctggcaggcaggggggcaggtacacacacacccacaggcacacccaccagtacacacgcgtgcgcatacacacattttggtttgacgccctgttttcagtggcctggggaggtccacactggaagtcgaattccagctcgccttgttgactcgcctgtgtccaccggccatgaggagcccacgcctgtcctccccatcactttcctgtccctgagaactgtagatcatgcgcttgtgagcgaggccctcccctctgcaccagctcattgcaaagcgaacatcctctcctttccaggagccccaggattagcatctgaaaagggtagcacttccttttttgttgttgttttttttttttttttgagacgggagtctcgctctattgttcagactggagtgcagtggcatgatctcggctcactacaacctccacctcctgggttccagcgattctcctgcctcagcctcccaaatagctgtgattacaggcgtgcaccaccacgcccggctaatgtttgtatttttagtagagacagggtttcaccgtgttggtcaggctggtctcaaactcctgacctcaggtgatccgcccgcctcagcctcccaaagtgctgagattacaggtgtgagctaccgcaccccgccgaggttagcactttcatcaccaaagaccccgtgcctctcgtggtcctttgagggatcccgccgccaccacccttgtattttatcacgtgctcttcagggcatgtggaattcgttgagtttgcttttagagccaagtttctttccctgtgtgggtttttgaggaaaacctgaggtcccctaatctgtggccaccaccccccccccgccgccacgccttagagcagagcagcccctcctctcatttggtgcagaaacagtcaagaggaaccattggcctagagctcctgtgaccgagagcgccacggaagcctggggatgatgtcgggcagctttattctttgcttggctttggtaactaggtggtcccctcaagcatcctcagttcctcttgctgtttatgaatctaagacaaggaagtcctatagaagccaaagggacagggacggaaaggacaggtcccaagggatggggctgtctttacttgtggaaaccaggaaattgctcctctcagccaaccaaggttgaccacacaccacccttccggagcagctcagtcagccctcggggacgagaaaccacaagcgcagagacgctgaggcccaggcaggtgaagaggaagtggctttgggtttttaaagtaggtgagcgtgagcctctctgactgcttcttccccgggggggactgcaaaccgctcagggttgcggcagagccatggacttccggtccctgcaacgggtgacctaagcgtggtgcacccatcagtcacgcaggaggactgacttgacagacgaaagacaagcccggatgacacagggtgagaagagtcagggccgcacctctgtccctgcaaaccaacaggtgcatggtgagtgtggcagtccccacagctccacaataaagacacccccaccaacaagagagacgaacagggggatactacaaaaacaacaaaccacaccaaagacaaagaaaccacacaccacaccacagaggatgtagaaacaagtatcaaaaaaaaaaaaaaanaaannanaaaaananaanaanaananaanaaanaaaanaaaaananaaanaaanaaaanaaanaanaaannaanaaaaaaaaanaacaanaaaattggctcttttgaaaaagaccagtcacccccagtataaggatatagctaagaatccccccgtacactacctccggtctggttttttaagacttttccatcctacctatcgtaccaataagaatagaacaatcaaatactacgagaaagaaagaaaccaaagagaaagacaaccaatagcagtgcaacaaagctaccaagaaaatcacacaataaccccaaccagacaacaaaaaagaagtaacatgataccaaatagacaacagatagacgaggaaaccgacggaggagagcggacgagggggtcgggagcggggaggagagggaggggtggtgccggaaacggtgcgaggagcgtggaaggtcgcgggggggtgcgcgtagtagaatactgagtagaggtttgaggagagattaatgttgacgtataaccaggccgtagatatgtgcggaaaattgctgtaactgttggtgctcgatgcggggccgtggtgtcctttgtattggttgcggttgtgggtgtgggtgagtggtggtgtggagtcgaagttgtgttgcgattctctttataat

SEQ ID NO: 299867 - DNA, 2752 bp, Homo sapiens
cggccgcggctgctgcttcctcgggccattttgctgtggagcggcggggaggaggagccgccgaggagaccccgggcgaggagctgcgagccggaggaggccgcgcggactccgggctttccgccgtcgcggggatctcggggggcaaagggatcgccggggagggggaccagagagccgcgcccgccgcgcggagcgccccttcgcgtcccctgcaccatgagctggggcaccgagctctgggatcagtttgacaacttagaaaaacacacacagtggggaattgatattcttgagaaatatatcaagtttgtgaaagaaaggacagagattgaactcagctatgcaaagcaactcaggaatctttcaaagaagtaccaacctaaaaagaactcgaaggaggaagaagaatacaagtatacgtcatgtaaagctttcatttccaacctgaacgaaatgaatgattacgcagggcagcatgaagttatctccgagaacatggcatcacagatcattgtggacttggcacgctatgttcaggaactgaaacaggagaggaaatcaaactttcacgatggccgtaaagcacagcagcacatcgagacttgctggaagcagcttgaatctagtaaaaggcgatttgaacgcgattgcaaagaggcggacagggcgcagcagtactttgagaaaatggacgctgacatcaatgtcacaaaagcggatgttgaaaaggcccgacaacaagctcaaatacgtcaccaaatggcagaggacagcaaagcagattactcatccattctccagaaattcaaccatgagcagcatgaatattaccatactcacatccccaacatcttccagaaaatacaagagatggaggaaaggaggattgtgagaatgggagagtccatgaagacatatgcagaggttgatcggcaggtgatcccaatcattgggaagtgcctggatggaatagtaaaagcagccgaatcaattgatcagaaaaatgattcacagctggtaatagaagcttataaatcagggtttgagcctcctggagacattgaatttgaggattacactcagccaatgaagcgcactgtgtcagataacagcctttcaaattccagaggagaaggcaaaccagacctcaaatttggtggcaaatccaaaggaaagttatggccgttcatcaaaaaaaataagctatgtccttttaacatccccccatcagcctccccctccccctcctgcctctgcctcaccctctgctgttcccaacggcccccagtctcccaagcagcaaaaggaacccctctcccaccgcttcaacgagttcatgacctccaaacccaaaatccactgcttcaggagcctaaagcgtgggggtgcaacaccggaggatttcagcaacctcccacctgaacaaagaaggaaaaagctgcagcagaaagtcgatgagttaaataaagaaattcagaaggagatggatcaaagagatgccataacaaaaatgaaagatgtctacctaaagaatcctcagatgggagacccagccagtttggatcacaaattagcagaagtcagccaaaatatagagaaactgcgagtagagacccagaaatttgaggcctggctggctgaggttgaaggccggctcccagcacgcaacgagcaggcgcgccggcagagcggactgtacgacagccagaacccacccacagtcaacaactgcgcccaggaccgtgagagcccagatggcagttacacagaggagcagagtcaggagagtgagatgaaggtgctggccacggattttgacgacgagtttgatgatgaggagcccctccctgccatagggacgtgcaaagctctctacacatttgaaggtcagaatgaaggaacgatttccgtagttgaaggagaaacattgtatgtcatagaggaagacaaaggcgatggctggacccgcattcggagaaatgaagatgaagagggttatgtccccacttcatatgtcgaagtctgtttggacaaaaatgccaaagattcctagaggggagtgcctgcgagcctcgggtgagccttcctggaggagcctccgtctgcttgttcccacaggcctccagcgccctgccctgtggacagcccacccctccgcagccccatccctgcggggcggtctctctctctctctccagcatgctccctgcggccctgccctcccgcccagcccgggccacctcgtgggggacaagtctcgccagcgcccacccccatggctcgggtcagtcctcatcgctccccctccccaccccgcgcaggccactgagacggtgggacacacgcccccacctgctccttcctgggccctcagtccacccgggctcgtcctggcagcccttccgcgcttcacacagtgccttttgtgaaagtgtcatcacgggtcccctgaggagacaaggcaggtccagcgcacatcaggcggactgagcactcgatgtcatccgtgtcgatgtcatccgtgtgtcccagactgcctgctgtagaaaacacttcctcctctcctgagtctgtgaagtcctcagtggtcctttttggattctaggcttgcacctcatactaaacattgaccctttcactatgccctcaacctgggagcatctggcaggcaggggggcaggtacacacacacccacaggcacaccctcctacgtcgacgcggccgttaattttagtagtagtactccga

SEQ ID NO: 299868 - DNA, 2789 bp, Homo sapiens
cggccgcggctgctgcttcctcgggccattttgctgtggagcggcggggaggaggagccgccgaggagaccccgggcgaggagctgcgagccggaggaggccgcgcggactccgggctttccgccgtcgcggggatctcggggggcaaagggatcgccggggagggggaccagagagccgcgcccgccgcgcggagcgccccttcgcgtcccctgcaccatgagctggggcaccgagctctgggatcagtttgacaacttagaaaaacacacacagtggggaattgatattcttgagaaatatatcaagtttgtgaaagaaaggacagagattgaactcagctatgcaaagcaactcaggaatctttcaaagaagtaccaacctaaaaagaactcgaaggaggaagaagaatacaagtatacgtcatgtaaagctttcatttccaacctgaacgaaatgaatgattacgcagggcagcatgaagttatctccgagaacatggcatcacagatcattgtggacttggcacgctatgttcaggaactgaaacaggagaggaaatcaaactttcacgatggccgtaaagcacagcagcacatcgagacttgctggaagcagcttgaatctagtaaaaggcgatttgaacgcgattgcaaagaggcggacagggcgcagcagtactttgagaaaatggacgctgacatcaatgtcacaaaagcggatgttgaaaaggcccgacaacaagctcaaatacgtcaccaaatggcagaggacagcaaagcagattactcatccattctccagaaattcaaccatgagcagcatgaatattaccatactcacatccccaacatcttccagaaaatacaagagatggaggaaaggaggattgtgagaatgggagagtccatgaagacatatgcagaggttgatcggcaggtgatcccaatcattgggaagtgcctggatggaatagtaaaagcagccgaatcaattgatcagaaaaatgattcacagctggtaatagaagcttataaatcagggtttgagcctcctggagacattgaatttgaggattacactcagccaatgaagcgcactgtgtcagataacagcctttcaaattccagaggagaaggcaaaccagacctcaaatttggtggcaaatccaaaggaaagttatggccgttcatcaaaaaaaataagctatgtccttttaacatccccccatcagcctccccctccccctcctgcctctgcctcaccctctgctgttcccaacggcccccagtctcccaagcagcaaaaggaacccctctcccaccgcttcaacgagttcatgacctccaaacccaaaatccactgcttcaggagcctaaagcgtgggggtgcaacaccggaggatttcagcaacctcccacctgaacaaagaaggaaaaagctgcagcagaaagtcgatgagttaaataaagaaattcagaaggagatggatcaaagagatgccataacaaaaatgaaagatgtctacctaaagaatcctcagatgggagacccagccagtttggatcacaaattagcagaagtcagccaaaatatagagaaactgcgagtagagacccagaaatttgaggcctggctggctgaggttgaaggccggctcccagcacgcaacgagcaggcgcgccggcagagcggactgtacgacagccagaacccacccacagtcaacaactgcgcccaggaccgtgagagcccagatggcagttacacagaggagcagagtcaggagagtgagatgaaggtgctggccacggattttgacgacgagtttgatgatgaggagcccctccctgccatagggacgtgcaaagctctctacacatttgaaggtcagaatgaaggaacgatttccgtagttgaaggagaaacattgtatgtcatagaggaagacaaaggcgatggctggacccgcattcggagaaatgaagatgaagagggttatgtccccacttcatatgtcgaagtctgtttggacaaaaatgccaaagattcctagaggggagtgcctgcgagcctcgggtgagccttcctggaggagcctccgtctgcttgttcccacaggcctccagcgccctgccctgtggacagcccacccctccgcagccccatccctgcggggcggtctctctctctctctccagcatgctccctgcggccctgccctcccgcccagcccgggccacctcgtgggggacaagtctcgccagcgcccacccccatggctcgggtcagtcctcatcgctccccctccccaccccgcgcaggccactgagacggtgggacacacgcccccacctgctccttcctgggccctcagtccacccgggctcgtcctggcagcccttccgcgcttcacacagtgccttttgtgaaagtgtcatcacgggtcccctgaggagacaaggcaggtccagcgcacatcaggcggactgagcactcgatgtcatccgtgtcgatgtcatccgtgtgtcccagactgcctgctgtagaaaacacttcctcctctcctgagtctgtgaagtcctcagtggtcctttttggattctaggcttgcacctcatactaaacattgaccctttcactatgccctgtggacagcccacccctccgcagccccatccctgcggggcggtctctctctctctccagcatgctccctgcggccctgccctcccgcccagcccgggccacctcgtgggggacaagtctcgccagcgcccacccccatg

SEQ ID NO: 299869 - DNA, 1515 bp, Homo sapiens
cggccgcggctgctgcttcctcgggccattttgctgtggagcggcggggaggaggagccgccgaggagaccccgggcgaggagctgcgagccggaggaggccgcgcggactccgggctttccgccgtcgcggggatctcggggggcaaagggatcgccggggagggggaccagagagccgcgcccgccgcgcggagcgccccttcgcgtcccctgcaccatgagctggggcaccgagctctgggatcagtttgacaacttagaaaaacacacacagtggggaattgatattcttgagaaatatatcaagtttgtgaaagaaaggacagagattgaactcagctatgcaaagcaactcaggaatctttcaaagaagtaccaacctaaaaagaactcgaaggaggaagaagaatacaagtatacgtcatgtaaagctttcatttccaacctgaacgaaatgaatgattacgcagggcagcatgaagttatctccgagaacatggcatcacagatcattgtggacttggcacgctatgttcaggaactgaaacaggagaggaaatcaaactttcacgatggccgtaaagcacagcagcacatcgagacttgctggaagcagcttgaatctagtaaaaggcgatttgaacgcgattgcaaagaggcggacagggcgcagcagtactttgagaaaatggacgctgacatcaatgtcacaaaagcggatgttgaaaaggcccgacaacaagctcaaatacgtcaccaaatggcagaggacagcaaagcagattactcatccattctccagaaattcaaccatgagcagcatgaatattaccatactcacatccccaacatcttccagaaaatacaagagatggaggaaaggaggattgtgagaatgggagagtccatgaagacatatgcagaggttgatcggcaggtgatcccaatcattgggaagtgcctggatggaatagtaaaagcagccgaatcaattgatcagaaaaatgattcacagctggtaatagaagcttataaatcagggtttgagcctcctggagacattgaatttgaggattacactcagccaatgaagcgcactgtgtcagataacagcctttcaaattccagaggagaaggcaaaccagacctcaaatttggtggcaaatccaaaggaaagttatggccgttcatcaaaaaaaataagctatgtccttttaacatccccccatcagcctccccctccccctcctgcctctgcctcaccctctgctgttcccaacggcccccagtctcccaagcagcaaaaggaacccctctcccaccgcttcaacgagttcatgacctccaaacccaaaatccactgcttcaggagcctaaagcgtggggtaagttctgctccggaatcctgtctctctggcgtgctttggttgcatgtttggttctgcataactaattttgtttgtgaatgaatccattgtgttttcccataacatataaaaaagttaaaaaaaaa

SEQ ID NO: 299870 - DNA, 682 bp, Homo sapiens
cggccgcggctgctgcttcctcgggccattttgctgtggagcggcggggaggaggagccgccgaggagaccccgggcgaggagctgcgagccggaggaggccgcgcggactccgggctttccgccgtcgcggggatctcggggggcaaagggatcgccggggagggggaccagagagccgcgcccgccgcgcggagcgccccttcgcgtcccctgcaccatgagctggggcaccgagctctgggatcagtttgacaacttagaaaaacacacacagtggggaattgatattcttgagaaatatatcaagtttgtgaaagaaaggacagagattgaactcagctatgcaaagcaactcaggaatctttcaaagaagtaccaacctaaaaagaactcgaaggaggaagaagaatacaagtatacgtcatgtaaagctttcatttccaacctgaacgaaatgaatgattacgcagggcagcatgaagttatctccgagaacatggcatcacagatcattgtggacttggcacgctatgttcaggaactgaaacaggagaggaaatcagtaagcaaaactttattctttttcttcctaaaagatggaccaaacacagtgggaatatccctagaagattaaaattaaataaaaccatataagactatgggtcttaaactcatacctt

SEQ ID NO: 299871 - DNA, 549 bp, Homo sapiens
gatggccttaggttggagtctctcattgcttttgtctccaggcgcctggctggctgaggttgaaggccggctcccagcacgcaacgagcaggcgcgccggcagagcggactgtacgacagccagaacccacccacagtcaacaactgcgcccaggaccgtgagaggtacagtatctgcacagcgcctgcctctggcaagggagcctgttggctttgtatttatttctaaattttggaatctggaatgaccataaggcacttgttcaatgccaaaatgtctgttgcgattgacctgtcactttttccatgatgcagatttataattccacatgggatgggtgatctgagcgtgcgatgatttaccatggcctcagttacagcactcgctgaggggcggggttgcaagtgctctccagtcgcagggactcaatctgagtcctccctggggtcagtcgctttagttgctttgtgttttcctttcttgagcagcccagatggcagttacacagaggagcagagtcaggagagtgagatgaaggtgctggccac

SEQ ID NO: 299872 - DNA, 352 bp, Homo sapiens
actgtgttgcccaggctgtcttgaactccttggctcaagcgattcttcttcctcagcctcccagggttctgggattacagatgtgagccaccgcacccggctacccctttcaactcttaaatttctttggagcatacatactagaggttcaatatttagatgttgtttaagtggatgaaaatgtttcctcctgggttcataagagaagcagagggtactaatcaccagtgtgttttcccctttgcagaactttcacgatggccgtaaagcacagcagcacatcgagacttgctggaagcagcttgaatctgtaagtgaacaatgcacagcaaaagaaacggctttatagatt

SEQ ID NO: 299873 - DNA, 5411 bp, Homo sapiens
cggccgcggctgctgcttcctcgggccattttgctgtggagcggcggggaggaggagccgccgaggagaccccgggcgaggagctgcgagccggaggaggccgcgcggactccgggctttccgccgtcgcggggatctcggggggcaaagggatcgccggggagggggaccagagagccgcgcccgccgcgcggagcgccccttcgcgtcccctgcaccatgagctggggcaccgagctctgggatcagtttgacaacttagaaaaacacacacagtggggaattgatattcttgagaaatatatcaagtttgtgaaagaaaggacagagattgaactcagctatgcaaagcaactcaggaatctttcaaagaagtaccaacctaaaaagaactcgaaggaggaagaagaatacaagtatacgtcatgtaaagctttcatttccaacctgaacgaaatgaatgattacgcagggcagcatgaagttatctccgagaacatggcatcacagatcattgtggacttggcacgctatgttcaggaactgaaacaggagaggaaatcaaactttcacgatggccgtaaagcacagcagcacatcgagacttgctggaagcagcttgaatctagtaaaaggcgatttgaacgcgattgcaaagaggcggacagggcgcagcagtactttgagaaaatggacgctgacatcaatgtcacaaaagcggatgttgaaaaggcccgacaacaagctcaaatacgtcaccaaatggcagaggacagcaaagcagattactcatccattctccagaaattcaaccatgagcagcatgaatattaccatactcacatccccaacatcttccagaaaatacaagagatggaggaaaggaggattgtgagaatgggagagtccatgaagacatatgcagaggttgatcggcaggtgatcccaatcattgggaagtgcctggatggaatagtaaaagcagccgaatcaattgatcagaaaaatgattcacagctggtaatagaagcttataaatcagggtttgagcctcctggagacattgaatttgaggattacactcagccaatgaagcgcactgtgtcagataacagcctttcaaattccagaggagaaggcaaaccagacctcaaatttggtggcaaatccaaaggaaagttatggccgttcatcaaaaaaaataagctatgtccttttaacatccccccatcagcctccccctccccctcctgcctctgcctcaccctctgctgttcccaacggcccccagtctcccaagcagcaaaaggaacccctctcccaccgcttcaacgagttcatgacctccaaacccaaaatccactgcttcaggagcctaaagcgtgggggtgcaacaccggaggatttcagcaacctcccacctgaacaaagaaggaaaaagctgcagcagaaagtcgatgagttaaataaagaaattcagaaggagatggatcaaagagatgccataacaaaaatgaaagatgtctacctaaagaatcctcagatgggagacccagccagtttggatcacaaattagcagaagtcagccaaaatatagagaaactgcgagtagagacccagaaatttgaggcctggctggctgaggttgaaggccggctcccagcacgcaacgagcaggcgcgccggcagagcggactgtacgacagccagaacccacccacagtcaacaactgcgcccaggaccgtgagagcccagatggcagttacacagaggagcagagtcaggagagtgagatgaaggtgctggccacggattttgacgacgagtttgatgatgaggagcccctccctgccatagggacgtgcaaagctctctacacatttgaaggtcagaatgaaggaacgatttccgtagttgaaggagaaacattgtatgtcatagaggaagacaaaggcgatggctggacccgcattcggagaaatgaagatgaagagggttatgtccccacttcatatgtcgaagtctgtttggacaaaaatgccaaagattcctagaggggagtgcctgcgagcctcgggtgagccttcctggaggagcctccgtctgcttgttcccacaggcctccagcgccctgccctgtggacagcccacccctccgcagccccatccctgcggggcggtctctctctctctctccagcatgctccctgcggccctgccctcccgcccagcccgggccacctcgtgggggacaagtctcgccagcgcccacccccatggctcgggtcagtcctcatcgctccccctccccaccccgcgcaggccactgagacggtgggacacacgcccccacctgctccttcctgggccctcagtccacccgggctcgtcctggcagcccttccgcgcttcacacagtgccttttgtgaaagtgtcatcacgggtcccctgaggagacaaggcaggtccagcgcacatcaggcggactgagcactcgatgtcatccgtgtcgatgtcatccgtgtgtcccagactgcctgctgtagaaaacacttcctcctctcctgagtctgtgaagtcctcagtggtcctttttggattctaggcttgcacctcatactaaacattgaccctttcactatgccctcaacctgggagcatctggcaggcaggggggcaggtacacacacacccacaggcacacccaccagtacacacgcgtgcgcatacacacattttggtttgacgccctgttttcagtggcctggggaggtccacactggaagtcgaattccagctcgccttgttgactcgcctgtgtccaccggccatgaggagcccacgcctgtcctccccatcactttcctgtccctgagaactgtagatcatgcgcttgtgagcgaggccctcccctctgcaccagctcattgcaaagcgaacatcctctcctttccaggagccccaggattagcatctgaaaagggtagcacttccttttttgttgttgttttttttttttttttgagacgggagtctcgctctattgttcagactggagtgcagtggcatgatctcggctcactacaacctccacctcctgggttccagcgattctcctgcctcagcctcccaaatagctgtgattacaggcgtgcaccaccacgcccggctaatgtttgtatttttagtagagacagggtttcaccgtgttggtcaggctggtctcaaactcctgacctcaggtgatccgcccgcctcagcctcccaaagtgctgagattacaggtgtgagctaccgcaccccgccgaggttagcactttcatcaccaaagaccccgtgcctctcgtggtcctttgagggatcccgccgccaccacccttgtattttatcacgtgctcttcagggcatgtggaattcgttgagtttgcttttagagccaagtttctttccctgtgtgggtttttgaggaaaacctgaggtcccctaatctgtggccaccaccccccccccgccgccacgccttagagcagagcagcccctcctctcatttggtgcagaaacagtcaagaggaaccattggcctagagctcctgtgaccgagagcgccacggaagcctggggatgatgtcgggcagctttattctttgcttggctttggtaactaggtggtcccctcaagcatcctcagttcctcttgctgtttatgaatctaagacaaggaagtcctatagaagccaaagggacagggacggaaaggacaggtcccaagggatggggctgtctttacttgtggaaaccaggaaattgctcctctcagccaaccaaggttgaccacacaccacccttccggagcagctcagtcagccctcggggacgagaaaccacaagcgcagagacgctgaggcccaggcaggtgaagaggaagtggctttgggtttttaaagtaggtgagcgtgagcctctctgactgcttcttccccgggggggactgcaaaccgctcagggttgcggcagagccatggacttccggtccctgcaacgggtgacctaagcgtggtgcacccatcagtcacgcaggaggactgacttgacagacgaaagacaagcccggatgacacagggtgagaagagtcagggccgcacctctgtccctgcaaaccaacaggtgcatggtgagtgtggcagtccccacagctccacaatgggctcccccgccaacggggacgacagggatcttcaggaacttctgacctcaccaagtcaagtggaccactctccactccacgaggatgtgaaacggttctttaaaatgggattttagagcctcgggaatgcatgtgcgtcgcatctttcatattatgggtcaggatagattcatttcttgcaacatagtggaaaagatataagctgcagtaatttgctctttgaatgaccgtcacccccagtataggatatgcttgtatccccccgtcactcctccgcctgttttttaaacttttccaccacctgcgtccaaaaagaatgttatagcgagtgctcttaaatgttgaacctgggtgttgcttccgggccagtctgcgtggctccatgaaaagctcactgctgccccagccgggcttcttagaggaggtcagttgtcctatgtatcatcatttactctgggaatcctactgtgaaatcatgtctgtatttttctggagcagttcacatagagtagaatgtggaatttcccgtgaacgtctccttcctcccccgtatctgccgcctgtcacttcgccaccgtgctagaatactgttgtgttgtaagatgactaattttaaaagaacctgccctgaaaagttcttagaaacgcaatgaaagggaggaacttgtcctttacccagtttttcctttgtaggatgggaaagtataaaaaggcacagaaggttgtcatgggctgttccttgggggtttttatcctgctcaccgtggagataagcctgcggcttgtctaaccagcgcagcgcaaaggtctcaatgccttttggtaacatccgtcattgcagaagaaagtttacacgacgtcaaaaagtgacgttcatgctaagtgtttttccagaaatattggtttcatgtttcttattggctctgcctcctgtgcttatatcatccaaaaactttttaaaaaggtccagaattctattttaacctgatgttgagcacctttaaaacgttcgtatgtgtgttgcactaattctaaactttggaggcattttgctgtgtgaggccgatcgccactgtaaaggtcctagagttgcctgtttgtctctggagatggaattaaaccaaataaagagcttccactggaggcttgtattgaccttgtaactatatgttaatctcgtgttaaaataaaatataacttgtg

SEQ ID NO: 299874 - DNA, 6430 bp, Homo sapiens
  misc_feature (2082)..(2082): n is a, c, g, or t
  misc_feature (2264)..(2264): n is a, c, g, or t
  misc_feature (2460)..(2460): n is a, c, g, or t
  misc_feature (2597)..(2597): n is a, c, g, or t
  misc_feature (3009)..(3009): n is a, c, g, or t
tgagacagagtctcactctgtcacctagactcaagggcaatgatacaatcctggctcactacaacctctgcctcccgagttcaagtaattcttgtgcctcagcctccccagtagctgggattacaggtgcctgccaccacacccggctaatctttgtatttttttttttttttagtaaagacaggttttcaccatgttggccaggcttgtctcaaactcttgggctcaagtgatccgcccacctcagcctcccaaagtgctgggattacagggtgagccaccgtgccaggcccaaatttcttttggatacttttgctggcatagtatcaataaagccacccatcccaaccccaggcctctttgtaaatattgcagcaagaaaatcagctgacccttcaaccacaaggatctgtttaaatgagcagtaggaagtttccagctttacccagtaaacaagtgaatgggaaacctaaggtattaaaatctgacctttctatccgatgacaaactcatttccagtctgtgaactcctggacaaagcaaactaaccactgaaaaactcgaaaatagggcaagacgacattaaccttgtgaaagtctgctttgaaaaaaggcattctgtcaagctgtgtatttttttcttgattattcaaatttatttcgttattcaaatttaattcagaaaatagctcagttggtttcagggggaatggggtgggaggggtttgggcacataaatttatgatgataattttaaatgtacgatcattaagttgtatgcctcagtactataacaggtgaatctctgtaatattgactaaacagttaaaagatattttgtaaatttcaggtccatcgcatcaatgcatgaaatattagaaaaccaaattccaaagaatcaggaatttccatttccacccaaagtatactttattatcttctagcagttgtctgttaatataaaagcagcaaaatctcagctacttatataattttctccttttatttgaaagttacacttagagattaataatatgtacagagaagcttttcctgcctactctgtttataactctgtccaacttgcccacaaacactgccctccttcaacccatctgatgtgggcaaagccactgttttcttaggcccataactcagtgcagctgttttatttttataatgccggtcaacctttttgtgtgtgtgtgtgtgtgtgtgtgtgtgtgtgtgtgtgtgtgtgtgtgtgtctacgatgtgcttatttaataattgccaaaatatttagactagagtaacttccggtgggtcaattggattgtgactttcttttgtggttttttggttcttcgattgctctctgttaaatattttcataattccccccacagaatacgtgtgtatatactgcaacttaaaaactaaaagcagtactcgaatgagttgttttaatgttgtacttttatctgtttgttttatgggttctcctgctgcctaatgacctttctgtttttataactgccggaaagccgcgaagcctctcgcatggggagctaggtccccgctgcggctccgcacttgagtttattataaactctggggttctgagtaagttttgtttgaatacagcaacatgattgtctctttctattcttatcctaaaagactctgtctggcatcttttagttgtaccctcgtatctgcttctctaataaatgttatattttttctcagtattgtgtattttaagtgacttttcatgtttccaagaaaattattctgtgtaatatgaatatttaactctttcatctccagtaataggggattttctagcccaatgcttttttaaaaattctgcctcccacccctacctcctcctttaaatgatggcacctcccctgtttctgatcttgcgtgcactcagggcctgagaagtctgtgtttcttttgtttcttttctctctccttgagatgaagagcttttcacggtttattgcggaatgaatacagaacaacaggttttccttttcaccaaagattttacattgtactgctgaagagccaagagtttccttctgagagaantggaccttcatgttccttgtaccattctaggaaattgatgcatttcttttcttttcttttttttctggagttgaattctcactctgttgcccaagctgaagtgcagtggtgtgatcctggctcgctgcagcctcgacctccctgggctcaagccatccttccaactcatcttcccgaatagncgggactacaggcgcatgccaacatgctggttaatttttttttaattttttgtagagatgaggtctggctatgttgtggcccaggctggtcttgaactcctgagctcatgcatcctccctcttcagcctctcaaagtgctgggattacaggtatgagccactgcacccaacctccgtttccttttttttttttttnagacggagtcttgctctgttgtccaggctggagtgcagtggcccgatctcagctcactgcaacctccgcctcctgggttgaagcgattcttctgcctcagcctcccaagtagctgggattacaggcacctgccaccncgccaggctaattgttgtatttttaatagagatgggttttcaccatgttagccaggctggtcttgaactcctgacctcgtgatctgcctgcctcaggctcccaaagtgctgggattacaggcatgagccacggcgcccagccccggcctccgtttcttactttctctcaaaactaaacttatgagaaagacgagttggggcggatggcctcatcagtctcctgtttgggcttctcttaactctgaaggaaagaccagctaaaggctagagagaaaaccgtgaaagttcctcatctcagacccgccctgtggtaaccgattgctctaagacgccccctcccatccctcccctcccactaccctcccctcccagggcggtgcagtttgtagccaagagcaaaatgcccgcctgnaacccgcgccttcctctctaacagagagtttctctttctgtttctctttgtgttgtagattcctagaggggagtgcctgcgagcctcgggtgagccttcctggaggagcctccgtctgcttgttcccacaggcctccagcgccctgccctgtggacagcccacccctccgcagccccatccctgcggggcggtctctctctctctctccagcatgctccctgcggccctgccctcccgcccagcccgggccacctcgtgggggacaagtctcgccagcgcccacccccatggctcgggtcagtcctcatcgctccccctccccaccccgcgcaggccactgagacggtgggacacacgcccccacctgctccttcctgggccctcagtccacccgggctcgtcctggcagcccttccgcgcttcacacagtgccttttgtgaaagtgtcatcacgggtcccctgaggagacaaggcaggtccagcgcacatcaggcggactgagcactcgatgtcatccgtgtcgatgtcatccgtgtgtcccagactgcctgctgtagaaaacacttcctcctctcctgagtctgtgaagtcctcagtggtcctttttggattctaggcttgcacctcatactaaacattgaccctttcactatgccctcaacctgggagcatctggcaggcaggggggcaggtacacacacacccacaggcacacccaccagtacacacgcgtgcgcatacacacattttggtttgacgccctgttttcagtggcctggggaggtccacactggaagtcgaattccagctcgccttgttgactcgcctgtgtccaccggccatgaggagcccacgcctgtcctccccatcactttcctgtccctgagaactgtagatcatgcgcttgtgagcgaggccctcccctctgcaccagctcattgcaaagcgaacatcctctcctttccaggagccccaggattagcatctgaaaagggtagcacttccttttttgttgttgttttttttttttttttgagacgggagtctcgctctattgttcagactggagtgcagtggcatgatctcggctcactacaacctccacctcctgggttccagcgattctcctgcctcagcctcccaaatagctgtgattacaggcgtgcaccaccacgcccggctaatgtttgtatttttagtagagacagggtttcaccgtgttggtcaggctggtctcaaactcctgacctcaggtgatccgcccgcctcagcctcccaaagtgctgagattacaggtgtgagctaccgcaccccgccgaggttagcactttcatcaccaaagaccccgtgcctctcgtggtcctttgagggatcccgccgccaccacccttgtattttatcacgtgctcttcagggcatgtggaattcgttgagtttgcttttagagccaagtttctttccctgtgtgggtttttgaggaaaacctgaggtcccctaatctgtggccaccaccccccccccgccgccacgccttagagcagagcagcccctcctctcatttggtgcagaaacagtcaagaggaaccattggcctagagctcctgtgaccgagagcgccacggaagcctggggatgatgtcgggcagctttattctttgcttggctttggtaactaggtggtcccctcaagcatcctcagttcctcttgctgtttatgaatctaagacaaggaagtcctatagaagccaaagggacagggacggaaaggacaggtcccaagggatggggctgtctttacttgtggaaaccaggaaattgctcctctcagccaaccaaggttgaccacacaccacccttccggagcagctcagtcagccctcggggacgagaaaccacaagcgcagagacgctgaggcccaggcaggtgaagaggaagtggctttgggtttttaaagtaggtgagcgtgagcctctctgactgcttcttccccgggggggactgcaaaccgctcagggttgcggcagagccatggacttccggtccctgcaacgggtgacctaagcgtggtgcacccatcagtcacgcaggaggactgacttgacagacgaaagacaagcccggatgacacagggtgagaagagtcagggccgcacctctgtccctgcaaaccaacaggtgcatggtgagtgtggcagtccccacagctccacaatgggctcccccgccaacggggacgacagggatcttcaggaacttctgacctcaccaagtcaagtggaccactctccactccacgaggatgtgaaacggttctttaaaatgggattttagagcctcgggaatgcatgtgcgtcgcatctttcatattatgggtcaggatagattcatttcttgcaacatagtggaaaagatataagctgcagtaatttgctctttgaatgaccgtcacccccagtataggatatgcttgtatccccccgtcactcctccgcctgttttttaaacttttccaccacctgcgtccaaaaagaatgttatagcgagtgctcttaaatgttgaacctgggtgttgcttccgggccagtctgcgtggctccatgaaaagctcactgctgccccagccgggcttcttagaggaggtcagttgtcctatgtatcatcatttactctgggaatcctactgtgaaatcatgtctgtatttttctggagcagttcacatagagtagaatgtggaatttcccgtgaacgtctccttcctcccccgtatctgccgcctgtcacttcgccaccgtgctagaatactgttgtgttgtaagatgactaattttaaaagaacctgccctgaaaagttcttagaaacgcaatgaaagggaggaacttgtcctttacccagtttttcctttgtaggatgggaaagtataaaaaggcacagaaggttgtcatgggctgttccttgggggtttttatcctgctcaccgtggagataagcctgcggcttgtctaaccagcgcagcgcaaaggtctcaatgccttttggtaacatccgtcattgcagaagaaagtttacacgacgtcaaaaagtgacgttcatgctaagtgtttttccagaaatattggtttcatgtttcttattggctctgcctcctgtgcttatatcatccaaaaactttttaaaaaggtccagaattctattttaacctgatgttgagcacctttaaaacgttcgtatgtgtgttgcactaattctaaactttggaggcattttgctgtgtgaggccgatcgccactgtaaaggtcctagagttgcctgtttgtctctggagatggaattaaaccaaataaagagcttccactggaggcttgtattgaccttgtaactatatgttaatctcgtgttaaaataaaatataacttgtg

SEQ ID NO: 299875 - DNA, 409 bp, Homo sapiens
gttttaaatacgatcacaaaaattttatgtttgagttaaatcatttgataattacccaatacataggaacctcaggcaccaatatatattttgtaaatatctatgtccttttaacatccccccatcagcctccccctccccctcctgcctctgcctcaccctctgctgttcccaacggcccccagtctcccaagcagcaaaaggaacccctctcccaccgcttcaacgagttcatgacctccaaacccaaaatccactgcttcaggagcctaaagcgtggggtaagttctgctccggaatcctgtctctctggcgtgctttggttgcatgtttggttctgcataactaattttgtttgtgaatgaatccattgtgttttcccataacatataaaaaagttaaaaaaaaa

SEQ ID NO: 299876 - DNA, 5230 bp, Homo sapiens
cggccgcggctgctgcttcctcgggccattttgctgtggagcggcggggaggaggagccgccgaggagaccccgggcgaggagctgcgagccggaggaggccgcgcggactccgggctttccgccgtcgcggggatctcggggggcaaagggatcgccggggagggggaccagagagccgcgcccgccgcgcggagcgccccttcgcgtcccctgcaccatgagctggggcaccgagctctgggatcagtttgacaacttagaaaaacacacacagtggggaattgatattcttgagaaatatatcaagtttgtgaaagaaaggacagagattgaactcagctatgcaaagcaactcaggaatctttcaaagaagtaccaacctaaaaagaactcgaaggaggaagaagaatacaagtatacgtcatgtaaagctttcatttccaacctgaacgaaatgaatgattacgcagggcagcatgaagttatctccgagaacatggcatcacagatcattgtggacttggcacgctatgttcaggaactgaaacaggagaggaaatcaaactttcacgatggccgtaaagcacagcagcacatcgagacttgctggaagcagcttgaatctagtaaaaggcgatttgaacgcgattgcaaagaggcggacagggcgcagcagtactttgagaaaatggacgctgacatcaatgtcacaaaagcggatgttgaaaaggcccgacaacaagctcaaatacgtcaccaaatggcagaggacagcaaagcagattactcatccattctccagaaattcaaccatgagcagcatgaatattaccatactcacatccccaacatcttccagaaaatacaagagatggaggaaaggaggattgtgagaatgggagagtccatgaagacatatgcagaggttgatcggcaggtgatcccaatcattgggaagtgcctggatggaatagtaaaagcagccgaatcaattgatcagaaaaatgattcacagctggtaatagaagcttataaatcagggtttgagcctcctggagacattgaatttgaggattacactcagccaatgaagcgcactgtgtcagataacagcctttcaaattccagaggagaaggcaaaccagacctcaaatttggtggcaaatccaaaggaaagttatggccgttcatcaaaaaaaataagggtgcaacaccggaggatttcagcaacctcccacctgaacaaagaaggaaaaagctgcagcagaaagtcgatgagttaaataaagaaattcagaaggagatggatcaaagagatgccataacaaaaatgaaagatgtctacctaaagaatcctcagatgggagacccagccagtttggatcacaaattagcagaagtcagccaaaatatagagaaactgcgagtagagacccagaaatttgaggcctggctggctgaggttgaaggccggctcccagcacgcaacgagcaggcgcgccggcagagcggactgtacgacagccagaacccacccacagtcaacaactgcgcccaggaccgtgagagcccagatggcagttacacagaggagcagagtcaggagagtgagatgaaggtgctggccacggattttgacgacgagtttgatgatgaggagcccctccctgccatagggacgtgcaaagctctctacacatttgaaggtcagaatgaaggaacgatttccgtagttgaaggagaaacattgtatgtcatagaggaagacaaaggcgatggctggacccgcattcggagaaatgaagatgaagagggttatgtccccacttcatatgtcgaagtctgtttggacaaaaatgccaaagattcctagaggggagtgcctgcgagcctcgggtgagccttcctggaggagcctccgtctgcttgttcccacaggcctccagcgccctgccctgtggacagcccacccctccgcagccccatccctgcggggcggtctctctctctctctccagcatgctccctgcggccctgccctcccgcccagcccgggccacctcgtgggggacaagtctcgccagcgcccacccccatggctcgggtcagtcctcatcgctccccctccccaccccgcgcaggccactgagacggtgggacacacgcccccacctgctccttcctgggccctcagtccacccgggctcgtcctggcagcccttccgcgcttcacacagtgccttttgtgaaagtgtcatcacgggtcccctgaggagacaaggcaggtccagcgcacatcaggcggactgagcactcgatgtcatccgtgtcgatgtcatccgtgtgtcccagactgcctgctgtagaaaacacttcctcctctcctgagtctgtgaagtcctcagtggtcctttttggattctaggcttgcacctcatactaaacattgaccctttcactatgccctcaacctgggagcatctggcaggcaggggggcaggtacacacacacccacaggcacacccaccagtacacacgcgtgcgcatacacacattttggtttgacgccctgttttcagtggcctggggaggtccacactggaagtcgaattccagctcgccttgttgactcgcctgtgtccaccggccatgaggagcccacgcctgtcctccccatcactttcctgtccctgagaactgtagatcatgcgcttgtgagcgaggccctcccctctgcaccagctcattgcaaagcgaacatcctctcctttccaggagccccaggattagcatctgaaaagggtagcacttccttttttgttgttgttttttttttttttttgagacgggagtctcgctctattgttcagactggagtgcagtggcatgatctcggctcactacaacctccacctcctgggttccagcgattctcctgcctcagcctcccaaatagctgtgattacaggcgtgcaccaccacgcccggctaatgtttgtatttttagtagagacagggtttcaccgtgttggtcaggctggtctcaaactcctgacctcaggtgatccgcccgcctcagcctcccaaagtgctgagattacaggtgtgagctaccgcaccccgccgaggttagcactttcatcaccaaagaccccgtgcctctcgtggtcctttgagggatcccgccgccaccacccttgtattttatcacgtgctcttcagggcatgtggaattcgttgagtttgcttttagagccaagtttctttccctgtgtgggtttttgaggaaaacctgaggtcccctaatctgtggccaccaccccccccccgccgccacgccttagagcagagcagcccctcctctcatttggtgcagaaacagtcaagaggaaccattggcctagagctcctgtgaccgagagcgccacggaagcctggggatgatgtcgggcagctttattctttgcttggctttggtaactaggtggtcccctcaagcatcctcagttcctcttgctgtttatgaatctaagacaaggaagtcctatagaagccaaagggacagggacggaaaggacaggtcccaagggatggggctgtctttacttgtggaaaccaggaaattgctcctctcagccaaccaaggttgaccacacaccacccttccggagcagctcagtcagccctcggggacgagaaaccacaagcgcagagacgctgaggcccaggcaggtgaagaggaagtggctttgggtttttaaagtaggtgagcgtgagcctctctgactgcttcttccccgggggggactgcaaaccgctcagggttgcggcagagccatggacttccggtccctgcaacgggtgacctaagcgtggtgcacccatcagtcacgcaggaggactgacttgacagacgaaagacaagcccggatgacacagggtgagaagagtcagggccgcacctctgtccctgcaaaccaacaggtgcatggtgagtgtggcagtccccacagctccacaatgggctcccccgccaacggggacgacagggatcttcaggaacttctgacctcaccaagtcaagtggaccactctccactccacgaggatgtgaaacggttctttaaaatgggattttagagcctcgggaatgcatgtgcgtcgcatctttcatattatgggtcaggatagattcatttcttgcaacatagtggaaaagatataagctgcagtaatttgctctttgaatgaccgtcacccccagtataggatatgcttgtatccccccgtcactcctccgcctgttttttaaacttttccaccacctgcgtccaaaaagaatgttatagcgagtgctcttaaatgttgaacctgggtgttgcttccgggccagtctgcgtggctccatgaaaagctcactgctgccccagccgggcttcttagaggaggtcagttgtcctatgtatcatcatttactctgggaatcctactgtgaaatcatgtctgtatttttctggagcagttcacatagagtagaatgtggaatttcccgtgaacgtctccttcctcccccgtatctgccgcctgtcacttcgccaccgtgctagaatactgttgtgttgtaagatgactaattttaaaagaacctgccctgaaaagttcttagaaacgcaatgaaagggaggaacttgtcctttacccagtttttcctttgtaggatgggaaagtataaaaaggcacagaaggttgtcatgggctgttccttgggggtttttatcctgctcaccgtggagataagcctgcggcttgtctaaccagcgcagcgcaaaggtctcaatgccttttggtaacatccgtcattgcagaagaaagtttacacgacgtcaaaaagtgacgttcatgctaagtgtttttccagaaatattggtttcatgtttcttattggctctgcctcctgtgcttatatcatccaaaaactttttaaaaaggtccagaattctattttaacctgatgttgagcacctttaaaacgttcgtatgtgtgttgcactaattctaaactttggaggcattttgctgtgtgaggccgatcgccactgtaaaggtcctagagttgcctgtttgtctctggagatggaattaaaccaaataaagagcttccactggaggcttgtattgaccttgtaactatatgttaatctcgtgttaaaataaaatataacttgtg

SEQ ID NO: 299877 - DNA, 5106 bp, Homo sapiens
ggaggtggatgccaattaacctgattttaattaatattttcttggtgtaaagcagaatatgaatgaatgtggccttgtgtgaaacagagtggcgtgtgttctgttccataggtatacgtcatgtaaagctttcatttccaacctgaacgaaatgaatgattacgcagggcagcatgaagttatctccgagaacatggcatcacagatcattgtggacttggcacgctatgttcaggaactgaaacaggagaggaaatcaaactttcacgatggccgtaaagcacagcagcacatcgagacttgctggaagcagcttgaatctagtaaaaggcgatttgaacgcgattgcaaagaggcggacagggcgcagcagtactttgagaaaatggacgctgacatcaatgtcacaaaagcggatgttgaaaaggcccgacaacaagctcaaatacgtcaccaaatggcagaggacagcaaagcagattactcatccattctccagaaattcaaccatgagcagcatgaatattaccatactcacatccccaacatcttccagaaaatacaagagatggaggaaaggaggattgtgagaatgggagagtccatgaagacatatgcagaggttgatcggcaggtgatcccaatcattgggaagtgcctggatggaatagtaaaagcagccgaatcaattgatcagaaaaatgattcacagctggtaatagaagcttataaatcagggtttgagcctcctggagacattgaatttgaggattacactcagccaatgaagcgcactgtgtcagataacagcctttcaaattccagaggagaaggcaaaccagacctcaaatttggtggcaaatccaaaggaaagttatggccgttcatcaaaaaaaataagctatgtccttttaacatccccccatcagcctccccctccccctcctgcctctgcctcaccctctgctgttcccaacggcccccagtctcccaagcagcaaaaggaacccctctcccaccgcttcaacgagttcatgacctccaaacccaaaatccactgcttcaggagcctaaagcgtgggggtgcaacaccggaggatttcagcaacctcccacctgaacaaagaaggaaaaagctgcagcagaaagtcgatgagttaaataaagaaattcagaaggagatggatcaaagagatgccataacaaaaatgaaagatgtctacctaaagaatcctcagatgggagacccagccagtttggatcacaaattagcagaagtcagccaaaatatagagaaactgcgagtagagacccagaaatttgaggcctggctggctgaggttgaaggccggctcccagcacgcaacgagcaggcgcgccggcagagcggactgtacgacagccagaacccacccacagtcaacaactgcgcccaggaccgtgagagcccagatggcagttacacagaggagcagagtcaggagagtgagatgaaggtgctggccacggattttgacgacgagtttgatgatgaggagcccctccctgccatagggacgtgcaaagctctctacacatttgaaggtcagaatgaaggaacgatttccgtagttgaaggagaaacattgtatgtcatagaggaagacaaaggcgatggctggacccgcattcggagaaatgaagatgaagagggttatgtccccacttcatatgtcgaagtctgtttggacaaaaatgccaaagattcctagaggggagtgcctgcgagcctcgggtgagccttcctggaggagcctccgtctgcttgttcccacaggcctccagcgccctgccctgtggacagcccacccctccgcagccccatccctgcggggcggtctctctctctctctccagcatgctccctgcggccctgccctcccgcccagcccgggccacctcgtgggggacaagtctcgccagcgcccacccccatggctcgggtcagtcctcatcgctccccctccccaccccgcgcaggccactgagacggtgggacacacgcccccacctgctccttcctgggccctcagtccacccgggctcgtcctggcagcccttccgcgcttcacacagtgccttttgtgaaagtgtcatcacgggtcccctgaggagacaaggcaggtccagcgcacatcaggcggactgagcactcgatgtcatccgtgtcgatgtcatccgtgtgtcccagactgcctgctgtagaaaacacttcctcctctcctgagtctgtgaagtcctcagtggtcctttttggattctaggcttgcacctcatactaaacattgaccctttcactatgccctcaacctgggagcatctggcaggcaggggggcaggtacacacacacccacaggcacacccaccagtacacacgcgtgcgcatacacacattttggtttgacgccctgttttcagtggcctggggaggtccacactggaagtcgaattccagctcgccttgttgactcgcctgtgtccaccggccatgaggagcccacgcctgtcctccccatcactttcctgtccctgagaactgtagatcatgcgcttgtgagcgaggccctcccctctgcaccagctcattgcaaagcgaacatcctctcctttccaggagccccaggattagcatctgaaaagggtagcacttccttttttgttgttgttttttttttttttttgagacgggagtctcgctctattgttcagactggagtgcagtggcatgatctcggctcactacaacctccacctcctgggttccagcgattctcctgcctcagcctcccaaatagctgtgattacaggcgtgcaccaccacgcccggctaatgtttgtatttttagtagagacagggtttcaccgtgttggtcaggctggtctcaaactcctgacctcaggtgatccgcccgcctcagcctcccaaagtgctgagattacaggtgtgagctaccgcaccccgccgaggttagcactttcatcaccaaagaccccgtgcctctcgtggtcctttgagggatcccgccgccaccacccttgtattttatcacgtgctcttcagggcatgtggaattcgttgagtttgcttttagagccaagtttctttccctgtgtgggtttttgaggaaaacctgaggtcccctaatctgtggccaccaccccccccccgccgccacgccttagagcagagcagcccctcctctcatttggtgcagaaacagtcaagaggaaccattggcctagagctcctgtgaccgagagcgccacggaagcctggggatgatgtcgggcagctttattctttgcttggctttggtaactaggtggtcccctcaagcatcctcagttcctcttgctgtttatgaatctaagacaaggaagtcctatagaagccaaagggacagggacggaaaggacaggtcccaagggatggggctgtctttacttgtggaaaccaggaaattgctcctctcagccaaccaaggttgaccacacaccacccttccggagcagctcagtcagccctcggggacgagaaaccacaagcgcagagacgctgaggcccaggcaggtgaagaggaagtggctttgggtttttaaagtaggtgagcgtgagcctctctgactgcttcttccccgggggggactgcaaaccgctcagggttgcggcagagccatggacttccggtccctgcaacgggtgacctaagcgtggtgcacccatcagtcacgcaggaggactgacttgacagacgaaagacaagcccggatgacacagggtgagaagagtcagggccgcacctctgtccctgcaaaccaacaggtgcatggtgagtgtggcagtccccacagctccacaatgggctcccccgccaacggggacgacagggatcttcaggaacttctgacctcaccaagtcaagtggaccactctccactccacgaggatgtgaaacggttctttaaaatgggattttagagcctcgggaatgcatgtgcgtcgcatctttcatattatgggtcaggatagattcatttcttgcaacatagtggaaaagatataagctgcagtaatttgctctttgaatgaccgtcacccccagtataggatatgcttgtatccccccgtcactcctccgcctgttttttaaacttttccaccacctgcgtccaaaaagaatgttatagcgagtgctcttaaatgttgaacctgggtgttgcttccgggccagtctgcgtggctccatgaaaagctcactgctgccccagccgggcttcttagaggaggtcagttgtcctatgtatcatcatttactctgggaatcctactgtgaaatcatgtctgtatttttctggagcagttcacatagagtagaatgtggaatttcccgtgaacgtctccttcctcccccgtatctgccgcctgtcacttcgccaccgtgctagaatactgttgtgttgtaagatgactaattttaaaagaacctgccctgaaaagttcttagaaacgcaatgaaagggaggaacttgtcctttacccagtttttcctttgtaggatgggaaagtataaaaaggcacagaaggttgtcatgggctgttccttgggggtttttatcctgctcaccgtggagataagcctgcggcttgtctaaccagcgcagcgcaaaggtctcaatgccttttggtaacatccgtcattgcagaagaaagtttacacgacgtcaaaaagtgacgttcatgctaagtgtttttccagaaatattggtttcatgtttcttattggctctgcctcctgtgcttatatcatccaaaaactttttaaaaaggtccagaattctattttaacctgatgttgagcacctttaaaacgttcgtatgtgtgttgcactaattctaaactttggaggcattttgctgtgtgaggccgatcgccactgtaaaggtcctagagttgcctgtttgtctctggagatggaattaaaccaaataaagagcttccactggaggcttgtattgaccttgtaactatatgttaatctcgtgttaaaataaaatataacttgtg

SEQ ID NO: 299878 - DNA, 4720 bp, Homo sapiens
  misc_feature (34)..(34): n is a, c, g, or t
  misc_feature (39)..(39): n is a, c, g, or t
taggtgcctagaggatcccggaaacaaagcggangtganaagcccgacaacaagctcaaatacgtcaccaaatggcagaggacagcaaagcagattactcatccattctccagaaattcaaccatgagcagcatgaatattaccatactcacatccccaacatcttccagaaaatacaagagatggaggaaaggaggattgtgagaatgggagagtccatgaagacatatgcagaggttgatcggcaggtgatcccaatcattgggaagtgcctggatggaatagtaaaagcagccgaatcaattgatcagaaaaatgattcacagctggtaatagaagcttataaatcagggtttgagcctcctggagacattgaatttgaggattacactcagccaatgaagcgcactgtgtcagataacagcctttcaaattccagaggagaaggcaaaccagacctcaaatttggtggcaaatccaaaggaaagttatggccgttcatcaaaaaaaataagctatgtccttttaacatccccccatcagcctccccctccccctcctgcctctgcctcaccctctgctgttcccaacggcccccagtctcccaagcagcaaaaggaacccctctcccaccgcttcaacgagttcatgacctccaaacccaaaatccactgcttcaggagcctaaagcgtgggggtgcaacaccggaggatttcagcaacctcccacctgaacaaagaaggaaaaagctgcagcagaaagtcgatgagttaaataaagaaattcagaaggagatggatcaaagagatgccataacaaaaatgaaagatgtctacctaaagaatcctcagatgggagacccagccagtttggatcacaaattagcagaagtcagccaaaatatagagaaactgcgagtagagacccagaaatttgaggcctggctggctgaggttgaaggccggctcccagcacgcaacgagcaggcgcgccggcagagcggactgtacgacagccagaacccacccacagtcaacaactgcgcccaggaccgtgagagcccagatggcagttacacagaggagcagagtcaggagagtgagatgaaggtgctggccacggattttgacgacgagtttgatgatgaggagcccctccctgccatagggacgtgcaaagctctctacacatttgaaggtcagaatgaaggaacgatttccgtagttgaaggagaaacattgtatgtcatagaggaagacaaaggcgatggctggacccgcattcggagaaatgaagatgaagagggttatgtccccacttcatatgtcgaagtctgtttggacaaaaatgccaaagattcctagaggggagtgcctgcgagcctcgggtgagccttcctggaggagcctccgtctgcttgttcccacaggcctccagcgccctgccctgtggacagcccacccctccgcagccccatccctgcggggcggtctctctctctctctccagcatgctccctgcggccctgccctcccgcccagcccgggccacctcgtgggggacaagtctcgccagcgcccacccccatggctcgggtcagtcctcatcgctccccctccccaccccgcgcaggccactgagacggtgggacacacgcccccacctgctccttcctgggccctcagtccacccgggctcgtcctggcagcccttccgcgcttcacacagtgccttttgtgaaagtgtcatcacgggtcccctgaggagacaaggcaggtccagcgcacatcaggcggactgagcactcgatgtcatccgtgtcgatgtcatccgtgtgtcccagactgcctgctgtagaaaacacttcctcctctcctgagtctgtgaagtcctcagtggtcctttttggattctaggcttgcacctcatactaaacattgaccctttcactatgccctcaacctgggagcatctggcaggcaggggggcaggtacacacacacccacaggcacacccaccagtacacacgcgtgcgcatacacacattttggtttgacgccctgttttcagtggcctggggaggtccacactggaagtcgaattccagctcgccttgttgactcgcctgtgtccaccggccatgaggagcccacgcctgtcctccccatcactttcctgtccctgagaactgtagatcatgcgcttgtgagcgaggccctcccctctgcaccagctcattgcaaagcgaacatcctctcctttccaggagccccaggattagcatctgaaaagggtagcacttccttttttgttgttgttttttttttttttttgagacgggagtctcgctctattgttcagactggagtgcagtggcatgatctcggctcactacaacctccacctcctgggttccagcgattctcctgcctcagcctcccaaatagctgtgattacaggcgtgcaccaccacgcccggctaatgtttgtatttttagtagagacagggtttcaccgtgttggtcaggctggtctcaaactcctgacctcaggtgatccgcccgcctcagcctcccaaagtgctgagattacaggtgtgagctaccgcaccccgccgaggttagcactttcatcaccaaagaccccgtgcctctcgtggtcctttgagggatcccgccgccaccacccttgtattttatcacgtgctcttcagggcatgtggaattcgttgagtttgcttttagagccaagtttctttccctgtgtgggtttttgaggaaaacctgaggtcccctaatctgtggccaccaccccccccccgccgccacgccttagagcagagcagcccctcctctcatttggtgcagaaacagtcaagaggaaccattggcctagagctcctgtgaccgagagcgccacggaagcctggggatgatgtcgggcagctttattctttgcttggctttggtaactaggtggtcccctcaagcatcctcagttcctcttgctgtttatgaatctaagacaaggaagtcctatagaagccaaagggacagggacggaaaggacaggtcccaagggatggggctgtctttacttgtggaaaccaggaaattgctcctctcagccaaccaaggttgaccacacaccacccttccggagcagctcagtcagccctcggggacgagaaaccacaagcgcagagacgctgaggcccaggcaggtgaagaggaagtggctttgggtttttaaagtaggtgagcgtgagcctctctgactgcttcttccccgggggggactgcaaaccgctcagggttgcggcagagccatggacttccggtccctgcaacgggtgacctaagcgtggtgcacccatcagtcacgcaggaggactgacttgacagacgaaagacaagcccggatgacacagggtgagaagagtcagggccgcacctctgtccctgcaaaccaacaggtgcatggtgagtgtggcagtccccacagctccacaatgggctcccccgccaacggggacgacagggatcttcaggaacttctgacctcaccaagtcaagtggaccactctccactccacgaggatgtgaaacggttctttaaaatgggattttagagcctcgggaatgcatgtgcgtcgcatctttcatattatgggtcaggatagattcatttcttgcaacatagtggaaaagatataagctgcagtaatttgctctttgaatgaccgtcacccccagtataggatatgcttgtatccccccgtcactcctccgcctgttttttaaacttttccaccacctgcgtccaaaaagaatgttatagcgagtgctcttaaatgttgaacctgggtgttgcttccgggccagtctgcgtggctccatgaaaagctcactgctgccccagccgggcttcttagaggaggtcagttgtcctatgtatcatcatttactctgggaatcctactgtgaaatcatgtctgtatttttctggagcagttcacatagagtagaatgtggaatttcccgtgaacgtctccttcctcccccgtatctgccgcctgtcacttcgccaccgtgctagaatactgttgtgttgtaagatgactaattttaaaagaacctgccctgaaaagttcttagaaacgcaatgaaagggaggaacttgtcctttacccagtttttcctttgtaggatgggaaagtataaaaaggcacagaaggttgtcatgggctgttccttgggggtttttatcctgctcaccgtggagataagcctgcggcttgtctaaccagcgcagcgcaaaggtctcaatgccttttggtaacatccgtcattgcagaagaaagtttacacgacgtcaaaaagtgacgttcatgctaagtgtttttccagaaatattggtttcatgtttcttattggctctgcctcctgtgcttatatcatccaaaaactttttaaaaaggtccagaattctattttaacctgatgttgagcacctttaaaacgttcgtatgtgtgttgcactaattctaaactttggaggcattttgctgtgtgaggccgatcgccactgtaaaggtcctagagttgcctgtttgtctctggagatggaattaaaccaaataaagagcttccactggaggcttgtattgaccttgtaactatatgttaatctcgtgttaaaataaaatataacttgtg

SEQ ID NO: 299879 - DNA, 5128 bp, Homo sapiens
gaaatgagttttctaaggtgtggagattttgacttgatcttttagtcttagaaaaactaagatcctaaacctgtagtttcagaatgcaaaagaagaagctagtgtgctaccttatgttgagacagtatttctttttggtggtggtatctttgccatggccctgtgtcttatttcagatgcattatcctcgtaccgtgactcccacactaacagagtactgacctctccaccgtttcgcctcatgcctttccctccttcctctcctagactgctggttaccttggctgggagagaggatgtagtgggacattcctgtaacactttatccgcacatctactggaaatcgttaccatgttaataacttggttttgaattcatgttaacatgtgtacccatgaacatttttcattttcttttcatagtgcgatacataggtgcatgacagcattaacctggggacgtagaatatgatcaaggcagcattactgctttaactttagaatgacttactatttattaatttaaacagactgctgtttccacaaccttagcattgaaggtctttcattttctcccatcaagctatgttagtttaggtaatgtagaaatatttaccctctggcttaagctggtttagagtaactaactagagctatagtttgcatgggaaagtctgcacgagcttcttgtcagatatttcttgctcttctgtcgcattacttactaaacctcccaactctcatcatattcttcatttaaccacctcctacatgttttcttttggaccatggcctaaaatttaattgtttgtgttttacttgcgttggatttcaaatattatttgatgcttatttttgttttgtgtcttcttgtttctgatttttactctgtcacggctccatctcttacatgtagcttatgtctatgtccttttaacatccccccatcagcctccccctccccctcctgcctctgcctcaccctctgctgttcccaacggcccccagtctcccaagcagcaaaaggaacccctctcccaccgcttcaacgagttcatgacctccaaacccaaaatccactgcttcaggagcctaaagcgtgggggtgcaacaccggaggatttcagcaacctcccacctgaacaaagaaggaaaaagctgcagcagaaagtcgatgagttaaataaagaaattcagaaggagatggatcaaagagatgccataacaaaaatgaaagatgtctacctaaagaatcctcagatgggagacccagccagtttggatcacaaattagcagaagtcagccaaaatatagagaaactgcgagtagagacccagaaatttgaggcctggctggctgaggttgaaggccggctcccagcacgcaacgagcaggcgcgccggcagagcggactgtacgacagccagaacccacccacagtcaacaactgcgcccaggaccgtgagagcccagatggcagttacacagaggagcagagtcaggagagtgagatgaaggtgctggccacggattttgacgacgagtttgatgatgaggagcccctccctgccatagggacgtgcaaagctctctacacatttgaaggtcagaatgaaggaacgatttccgtagttgaaggagaaacattgtatgtcatagaggaagacaaaggcgatggctggacccgcattcggagaaatgaagatgaagagggttatgtccccacttcatatgtcgaagtctgtttggacaaaaatgccaaagattcctagaggggagtgcctgcgagcctcgggtgagccttcctggaggagcctccgtctgcttgttcccacaggcctccagcgccctgccctgtggacagcccacccctccgcagccccatccctgcggggcggtctctctctctctctccagcatgctccctgcggccctgccctcccgcccagcccgggccacctcgtgggggacaagtctcgccagcgcccacccccatggctcgggtcagtcctcatcgctccccctccccaccccgcgcaggccactgagacggtgggacacacgcccccacctgctccttcctgggccctcagtccacccgggctcgtcctggcagcccttccgcgcttcacacagtgccttttgtgaaagtgtcatcacgggtcccctgaggagacaaggcaggtccagcgcacatcaggcggactgagcactcgatgtcatccgtgtcgatgtcatccgtgtgtcccagactgcctgctgtagaaaacacttcctcctctcctgagtctgtgaagtcctcagtggtcctttttggattctaggcttgcacctcatactaaacattgaccctttcactatgccctcaacctgggagcatctggcaggcaggggggcaggtacacacacacccacaggcacacccaccagtacacacgcgtgcgcatacacacattttggtttgacgccctgttttcagtggcctggggaggtccacactggaagtcgaattccagctcgccttgttgactcgcctgtgtccaccggccatgaggagcccacgcctgtcctccccatcactttcctgtccctgagaactgtagatcatgcgcttgtgagcgaggccctcccctctgcaccagctcattgcaaagcgaacatcctctcctttccaggagccccaggattagcatctgaaaagggtagcacttccttttttgttgttgttttttttttttttttgagacgggagtctcgctctattgttcagactggagtgcagtggcatgatctcggctcactacaacctccacctcctgggttccagcgattctcctgcctcagcctcccaaatagctgtgattacaggcgtgcaccaccacgcccggctaatgtttgtatttttagtagagacagggtttcaccgtgttggtcaggctggtctcaaactcctgacctcaggtgatccgcccgcctcagcctcccaaagtgctgagattacaggtgtgagctaccgcaccccgccgaggttagcactttcatcaccaaagaccccgtgcctctcgtggtcctttgagggatcccgccgccaccacccttgtattttatcacgtgctcttcagggcatgtggaattcgttgagtttgcttttagagccaagtttctttccctgtgtgggtttttgaggaaaacctgaggtcccctaatctgtggccaccaccccccccccgccgccacgccttagagcagagcagcccctcctctcatttggtgcagaaacagtcaagaggaaccattggcctagagctcctgtgaccgagagcgccacggaagcctggggatgatgtcgggcagctttattctttgcttggctttggtaactaggtggtcccctcaagcatcctcagttcctcttgctgtttatgaatctaagacaaggaagtcctatagaagccaaagggacagggacggaaaggacaggtcccaagggatggggctgtctttacttgtggaaaccaggaaattgctcctctcagccaaccaaggttgaccacacaccacccttccggagcagctcagtcagccctcggggacgagaaaccacaagcgcagagacgctgaggcccaggcaggtgaagaggaagtggctttgggtttttaaagtaggtgagcgtgagcctctctgactgcttcttccccgggggggactgcaaaccgctcagggttgcggcagagccatggacttccggtccctgcaacgggtgacctaagcgtggtgcacccatcagtcacgcaggaggactgacttgacagacgaaagacaagcccggatgacacagggtgagaagagtcagggccgcacctctgtccctgcaaaccaacaggtgcatggtgagtgtggcagtccccacagctccacaatgggctcccccgccaacggggacgacagggatcttcaggaacttctgacctcaccaagtcaagtggaccactctccactccacgaggatgtgaaacggttctttaaaatgggattttagagcctcgggaatgcatgtgcgtcgcatctttcatattatgggtcaggatagattcatttcttgcaacatagtggaaaagatataagctgcagtaatttgctctttgaatgaccgtcacccccagtataggatatgcttgtatccccccgtcactcctccgcctgttttttaaacttttccaccacctgcgtccaaaaagaatgttatagcgagtgctcttaaatgttgaacctgggtgttgcttccgggccagtctgcgtggctccatgaaaagctcactgctgccccagccgggcttcttagaggaggtcagttgtcctatgtatcatcatttactctgggaatcctactgtgaaatcatgtctgtatttttctggagcagttcacatagagtagaatgtggaatttcccgtgaacgtctccttcctcccccgtatctgccgcctgtcacttcgccaccgtgctagaatactgttgtgttgtaagatgactaattttaaaagaacctgccctgaaaagttcttagaaacgcaatgaaagggaggaacttgtcctttacccagtttttcctttgtaggatgggaaagtataaaaaggcacagaaggttgtcatgggctgttccttgggggtttttatcctgctcaccgtggagataagcctgcggcttgtctaaccagcgcagcgcaaaggtctcaatgccttttggtaacatccgtcattgcagaagaaagtttacacgacgtcaaaaagtgacgttcatgctaagtgtttttccagaaatattggtttcatgtttcttattggctctgcctcctgtgcttatatcatccaaaaactttttaaaaaggtccagaattctattttaacctgatgttgagcacctttaaaacgttcgtatgtgtgttgcactaattctaaactttggaggcattttgctgtgtgaggccgatcgccactgtaaaggtcctagagttgcctgtttgtctctggagatggaattaaaccaaataaagagcttccactggaggcttgtattgaccttgtaactatatgttaatctcgtgttaaaataaaatataacttgtg

SEQ ID NO: 299880 - DNA, 4682 bp, Homo sapiens
acaaaagcgcagtgagcctcacccttctttcctccttgtctgagaccccttgtatgtccccctacggatggacacctcagcagttgctgggtcattgtgttgtcatggtccccatcctcagagagcatctttgaaggccaagtgcagtacacgtgtgcgtacacacacacacacacacacacacacacacacacacacacacacacacgggggagtgagagtggtcgcttgtgtgctccgggtattctagagaggcgacctgcacacacgctcgcttgactctgcacatcttttacaaaagcttataaatcagggtttgagcctcctggagacattgaatttgaggattacactcagccaatgaagcgcactgtgtcagataacagcctttcaaattccagaggagaaggcaaaccagacctcaaatttggtggcaaatccaaaggaaagttatggccgttcatcaaaaaaaataagctatgtccttttaacatccccccatcagcctccccctccccctcctgcctctgcctcaccctctgctgttcccaacggcccccagtctcccaagcagcaaaaggaacccctctcccaccgcttcaacgagttcatgacctccaaacccaaaatccactgcttcaggagcctaaagcgtgggggtgcaacaccggaggatttcagcaacctcccacctgaacaaagaaggaaaaagctgcagcagaaagtcgatgagttaaataaagaaattcagaaggagatggatcaaagagatgccataacaaaaatgaaagatgtctacctaaagaatcctcagatgggagacccagccagtttggatcacaaattagcagaagtcagccaaaatatagagaaactgcgagtagagacccagaaatttgaggcctggctggctgaggttgaaggccggctcccagcacgcaacgagcaggcgcgccggcagagcggactgtacgacagccagaacccacccacagtcaacaactgcgcccaggaccgtgagagcccagatggcagttacacagaggagcagagtcaggagagtgagatgaaggtgctggccacggattttgacgacgagtttgatgatgaggagcccctccctgccatagggacgtgcaaagctctctacacatttgaaggtcagaatgaaggaacgatttccgtagttgaaggagaaacattgtatgtcatagaggaagacaaaggcgatggctggacccgcattcggagaaatgaagatgaagagggttatgtccccacttcatatgtcgaagtctgtttggacaaaaatgccaaagattcctagaggggagtgcctgcgagcctcgggtgagccttcctggaggagcctccgtctgcttgttcccacaggcctccagcgccctgccctgtggacagcccacccctccgcagccccatccctgcggggcggtctctctctctctctccagcatgctccctgcggccctgccctcccgcccagcccgggccacctcgtgggggacaagtctcgccagcgcccacccccatggctcgggtcagtcctcatcgctccccctccccaccccgcgcaggccactgagacggtgggacacacgcccccacctgctccttcctgggccctcagtccacccgggctcgtcctggcagcccttccgcgcttcacacagtgccttttgtgaaagtgtcatcacgggtcccctgaggagacaaggcaggtccagcgcacatcaggcggactgagcactcgatgtcatccgtgtcgatgtcatccgtgtgtcccagactgcctgctgtagaaaacacttcctcctctcctgagtctgtgaagtcctcagtggtcctttttggattctaggcttgcacctcatactaaacattgaccctttcactatgccctcaacctgggagcatctggcaggcaggggggcaggtacacacacacccacaggcacacccaccagtacacacgcgtgcgcatacacacattttggtttgacgccctgttttcagtggcctggggaggtccacactggaagtcgaattccagctcgccttgttgactcgcctgtgtccaccggccatgaggagcccacgcctgtcctccccatcactttcctgtccctgagaactgtagatcatgcgcttgtgagcgaggccctcccctctgcaccagctcattgcaaagcgaacatcctctcctttccaggagccccaggattagcatctgaaaagggtagcacttccttttttgttgttgttttttttttttttttgagacgggagtctcgctctattgttcagactggagtgcagtggcatgatctcggctcactacaacctccacctcctgggttccagcgattctcctgcctcagcctcccaaatagctgtgattacaggcgtgcaccaccacgcccggctaatgtttgtatttttagtagagacagggtttcaccgtgttggtcaggctggtctcaaactcctgacctcaggtgatccgcccgcctcagcctcccaaagtgctgagattacaggtgtgagctaccgcaccccgccgaggttagcactttcatcaccaaagaccccgtgcctctcgtggtcctttgagggatcccgccgccaccacccttgtattttatcacgtgctcttcagggcatgtggaattcgttgagtttgcttttagagccaagtttctttccctgtgtgggtttttgaggaaaacctgaggtcccctaatctgtggccaccaccccccccccgccgccacgccttagagcagagcagcccctcctctcatttggtgcagaaacagtcaagaggaaccattggcctagagctcctgtgaccgagagcgccacggaagcctggggatgatgtcgggcagctttattctttgcttggctttggtaactaggtggtcccctcaagcatcctcagttcctcttgctgtttatgaatctaagacaaggaagtcctatagaagccaaagggacagggacggaaaggacaggtcccaagggatggggctgtctttacttgtggaaaccaggaaattgctcctctcagccaaccaaggttgaccacacaccacccttccggagcagctcagtcagccctcggggacgagaaaccacaagcgcagagacgctgaggcccaggcaggtgaagaggaagtggctttgggtttttaaagtaggtgagcgtgagcctctctgactgcttcttccccgggggggactgcaaaccgctcagggttgcggcagagccatggacttccggtccctgcaacgggtgacctaagcgtggtgcacccatcagtcacgcaggaggactgacttgacagacgaaagacaagcccggatgacacagggtgagaagagtcagggccgcacctctgtccctgcaaaccaacaggtgcatggtgagtgtggcagtccccacagctccacaatgggctcccccgccaacggggacgacagggatcttcaggaacttctgacctcaccaagtcaagtggaccactctccactccacgaggatgtgaaacggttctttaaaatgggattttagagcctcgggaatgcatgtgcgtcgcatctttcatattatgggtcaggatagattcatttcttgcaacatagtggaaaagatataagctgcagtaatttgctctttgaatgaccgtcacccccagtataggatatgcttgtatccccccgtcactcctccgcctgttttttaaacttttccaccacctgcgtccaaaaagaatgttatagcgagtgctcttaaatgttgaacctgggtgttgcttccgggccagtctgcgtggctccatgaaaagctcactgctgccccagccgggcttcttagaggaggtcagttgtcctatgtatcatcatttactctgggaatcctactgtgaaatcatgtctgtatttttctggagcagttcacatagagtagaatgtggaatttcccgtgaacgtctccttcctcccccgtatctgccgcctgtcacttcgccaccgtgctagaatactgttgtgttgtaagatgactaattttaaaagaacctgccctgaaaagttcttagaaacgcaatgaaagggaggaacttgtcctttacccagtttttcctttgtaggatgggaaagtataaaaaggcacagaaggttgtcatgggctgttccttgggggtttttatcctgctcaccgtggagataagcctgcggcttgtctaaccagcgcagcgcaaaggtctcaatgccttttggtaacatccgtcattgcagaagaaagtttacacgacgtcaaaaagtgacgttcatgctaagtgtttttccagaaatattggtttcatgtttcttattggctctgcctcctgtgcttatatcatccaaaaactttttaaaaaggtccagaattctattttaacctgatgttgagcacctttaaaacgttcgtatgtgtgttgcactaattctaaactttggaggcattttgctgtgtgaggccgatcgccactgtaaaggtcctagagttgcctgtttgtctctggagatggaattaaaccaaataaagagcttccactggaggcttgtattgaccttgtaactatatgttaatctcgtgttaaaataaaatataacttgtg

SEQ ID NO: 299881 - DNA, 5309 bp, Homo sapiens
cggccgcggctgctgcttcctcgggccattttgctgtggagcggcggggaggaggagccgccgaggagaccccgggcgaggagctgcgagccggaggaggccgcgcggactccgggctttccgccgtcgcggggatctcggggggcaaagggatcgccggggagggggaccagagagccgcgcccgccgcgcggagcgccccttcgcgtcccctgcaccatgagctggggcaccgagctctgggatcagtttgacaacttagaaaaacacacacagtggggaattgatattcttgagaaatatatcaagtttgtgaaagaaaggacagagattgaactcagctatgcaaagcaactcaggaatctttcaaagaagtaccaacctaaaaagaactcgaaggaggaagaagaatacaagtatacgtcatgtaaagctttcatttccaacctgaacgaaatgaatgattacgcagggcagcatgaagttatctccgagaacatggcatcacagatcattgtggacttggcacgctatgttcaggaactgaaacaggagaggaaatcaaactttcacgatggccgtaaagcacagcagcacatcgagacttgctggaagcagcttgaatctagtaaaaggcgatttgaacgcgattgcaaagaggcggacagggcgcagcagtactttgagaaaatggacgctgacatcaatgtcacaaaagcggatgttgaaaaggcccgacaacaagctcaaatacgtcaccaaatggcagaggacagcaaagcagattactcatccattctccagaaattcaaccatgagcagcatgaatattaccatactcacatccccaacatcttccagaaaatacaagagatggaggaaaggaggattgtgagaatgggagagtccatgaagacatatgcagaggttgatcggcaggtgatcccaatcattgggaagtgcctggatggaatagtaaaagcagccgaatcaattgatcagaaaaatgattcacagctggtaatagaagcttataaatcagggtttgagcctcctggagacattgaatttgaggattacactcagccaatgaagcgcactgtgtcagataacagcctttcaaattccagaggagaaggcaaaccagacctcaaatttggtggcaaatccaaaggaaagttatggccgttcatcaaaaaaaataagctatgtccttttaacatccccccatcagcctccccctccccctcctgcctctgcctcaccctctgctgttcccaacggcccccagtctcccaagcagcaaaaggaacccctctcccaccgcttcaacgagttcatgacctccaaacccaaaatccactgcttcaggagcctaaagcgtgggggtgcaacaccggaggatttcagcaacctcccacctgaacaaagaaggaaaaagctgcagcagaaagtcgatgagttaaataaagaaattcagaaggagatggatcaaagagatgccataacaaaaatgaaagatgtctacctaaagaatcctcagatgggagacccagccagtttggatcacaaattagcagaagtcagccaaaatatagagaaactgcgagtagagacccagaaatttgaggcctggctggctgaggttgaaggccggctcccagcacgcaacgagcaggcgcgccggcagagcggactgtacgacagccagaacccacccacagtcaacaactgcgcccaggaccgtgagagcccagatggcagttacacagaggagcagagtcaggagagtgagatgaaggtgctggccacggattttgacgacgagtttgatgatgaggagcccctccctgccatagggacgtgcaaagctctctacacatttgaaggtcagaatgaaggaacgatttccgtagttgaaggagaaacattgtatgtcatagaggaagacaaaggcgatggctggacccgcattcggagaaatgaagatgaagagggttatgtccccacttcatatgtcgaagtctgtttggacaaaaatgccaaagattcctagaggggagtgcctgcgagcctcgggtgagccttcctggaggagcctccgtctgcttgttcccacaggcctccagcgccctgccctgtggacagcccacccctccgcagccccatccctgcggggcggtctctctctctctctccagcatgctccctgcggccctgccctcccgcccagcccgggccacctcgtgggggacaagtctcgccagcgcccacccccatggctcgggtcagtcctcatcgctccccctccccaccccgcgcaggccactgagacggtgggacacacgcccccacctgctccttcctgggccctcagtccacccgggctcgtcctggcagcccttccgcgcttcacacagtgccttttgtgaaagtgtcatcacgggtcccctgaggagacaaggcaggtccagcgcacatcaggcggactgagcactcgatgtcatccgtgtcgatgtcatccgtgtgtcccagactgcctgctgtagaaaacacttcctcctctcctgagtctgtgaagtcctcagtggtcctttttggattctaggcttgcacctcatactaaacattgaccctttcactatgccctcaacctgggagcatctggcaggcaggggggcaggtacacacacacccacaggcacacccaccagtacacacgcgtgcgcatacacacattttggtttgacgccctgttttcagtggcctggggaggtccacactggaagtcgaattccagctcgccttgttgactcgcctgtgtccaccggccatgaggagcccacgcctgtcctccccatcactttcctgtccctgagaactgtagatcatgcgcttgtgagcgaggccctcccctctgcaccagctcattgcaaagcgaacatcctctcctttccaggagccccaggattagcatctgaaaagggtagcacttccttttttgttgttgttttttttttttttttgagacgggagtctcgctctattgttcagactggagtgcagtggcatgatctcggctcactacaacctccacctcctgggttccagcgattctcctgcctcagcctcccaaatagctgtgattacaggcgtgcaccaccacgcccggctaatgtttgtatttttagtagagacagggtttcaccgtgttggtcaggctggtctcaaactcctgacctcaggtgatccgcccgcctcagcctcccaaagtgctgagattacaggtgtgagctaccgcaccccgccgaggttagcactttcatcaccaaagaccccgtgcctctcgtggtcctttgagggatcccgccgccaccacccttgtattttatcacgtgctcttcagggcatgtggaattcgttgagtttgcttttagagccaagtttctttccctgtgtgggtttttgaggaaaacctgaggtcccctaatctgtggccaccaccccccccccgccgccacgccttagagcagagcagcccctcctctcatttggtgcagaaacagtcaagaggaaccattggcctagagctcctgtgaccgagagcgccacggaagcctggggatgatgtcgggcagctttattctttgcttggctttggtaactaggtggtcccctcaagcatcctcagttcctcttgctgtttatgaatctaagacaaggaagtcctatagaagccaaagggacagggacggaaaggacaggtcccaagggatggggctgtctttacttgtggaaaccaggaaattgctcctctcagccaaccaaggttgaccacacaccacccttccggagcagctcagtcagccctcggggacgagaaaccacaagcgcagagacgctgaggcccaggcaggtgaagaggaagtggctttgggtttttaaagtaggtgagcgtgagcctctctgactgcttcttccccgggggggactgcaaaccgctcagggttgcggcagagccatggacttccggtccctgcaacgggtgacctaagcgtggtgcacccatcagtcacgcaggaggactgacttgacagacgaaagacaagcccggatgacacagggtgagaagagtcagggccgcacctctgtccctgcaaaccaacaggtgcatggtgagtgtggcagtccccacagctccacaatgggctcccccgccaacggggacgacagggatcttcaggaacttctgacctcaccaagtcaagtggaccactctccactccacgaggatgtgaaacggttctttaaaatgggattttagagcctcgggaatgcatgtgcgtcgcatctttcatattatgggtcaggatagattcatttcttgcaacatagtggaaaagatataagctgcagtaatttgctctttgaatgaccgtcacccccagtataggatatgcttgtatccccccgtcactcctccgcctgttttttaaacttttccaccacctgcgtccaaaaagaatgttatagcgagtgctcttaaatgttgaacctgggtgttgcttccgggccagtctgcgtggctccatgaaaagctcactgctgccccagccgggcttcttagaggaggtcagttgtcctatgtatcatcatttactctgggaatcctactgtgaaatcatgtctgtatttttctggagcagttcacatagagtagaatgtggaatttcccgtgaacgtctccttcctcccccgtatctgccgcctgtcacttcgccaccgtgctagaatactgttgtgttgtaagatgactaattttaaaagaacctgccctgaaaagttcttagaaacgcaatgaaagggaggaacttgtcctttacccagtttttcctttgtaggatgggaaagtataaaaaggcacagaaggttgtcatgggctgttccttgggggtttttatcctgctcaccgtggagataagcctgcggcttgtctaaccagcgcagcgcaaaggtctcaatgccttttggtaacatccgtcattgcagaagaaagtttacacgacgtcaaaaagtgacgttcatgctaagtgtttttccagaaatattggtttcatgtttcttattggctctgcctcctgtgcttatatcatccaaaaactttttaaaaaggtccagaattctattttaacctgatgttgagcacctttaaaacgttcgttccagttctttgaccccatggggtagtactttgccacaggaagtgctagatgctttggtcagcctctgggatgtggatgagttagtgt

SEQ ID NO: 299882 - DNA, 2973 bp, Homo sapiens
cggccgcggctgctgcttcctcgggccattttgctgtggagcggcggggaggaggagccgccgaggagaccccgggcgaggagctgcgagccggaggaggccgcgcggactccgggctttccgccgtcgcggggatctcggggggcaaagggatcgccggggagggggaccagagagccgcgcccgccgcgcggagcgccccttcgcgtcccctgcaccatgagctggggcaccgagctctgggatcagtttgacaacttagaaaaacacacacagtggggaattgatattcttgagaaatatatcaagtttgtgaaagaaaggacagagattgaactcagctatgcaaagcaactcaggaatctttcaaagaagtaccaacctaaaaagaactcgaaggaggaagaagaatacaagtatacgtcatgtaaagctttcatttccaacctgaacgaaatgaatgattacgcagggcagcatgaagttatctccgagaacatggcatcacagatcattgtggacttggcacgctatgttcaggaactgaaacaggagaggaaatcaaactttcacgatggccgtaaagcacagcagcacatcgagacttgctggaagcagcttgaatctagtaaaaggcgatttgaacgcgattgcaaagaggcggacagggcgcagcagtactttgagaaaatggacgctgacatcaatgtcacaaaagcggatgttgaaaaggcccgacaacaagctcaaatacgtcaccaaatggcagaggacagcaaagcagattactcatccattctccagaaattcaaccatgagcagcatgaatattaccatactcacatccccaacatcttccagaaaatacaagagatggaggaaaggaggattgtgagaatgggagagtccatgaagacatatgcagaggttgatcggcaggtgatcccaatcattgggaagtgcctggatggaatagtaaaagcagccgaatcaattgatcagaaaaatgattcacagctggtaatagaagcttataaatcagggtttgagcctcctggagacattgaatttgaggattacactcagccaatgaagcgcactgtgtcagataacagcctttcaaattccagaggagaaggcaaaccagacctcaaatttggtggcaaatccaaaggaaagttatggccgttcatcaaaaaaaataagctatgtccttttaacatccccccatcagcctccccctccccctcctgcctctgcctcaccctctgctgttcccaacggcccccagtctcccaagcagcaaaaggaacccctctcccaccgcttcaacgagttcatgacctccaaacccaaaatccactgcttcaggagcctaaagcgtgggggtgcaacaccggaggatttcagcaacctcccacctgaacaaagaaggaaaaagctgcagcagaaagtcgatgagttaaataaagaaattcagaaggagatggatcaaagagatgccataacaaaaatgaaagatgtctacctaaagaatcctcagatgggagacccagccagtttggatcacaaattagcagaagtcagccaaaatatagagaaactgcgagtagagacccagaaatttgaggcctggctggctgaggttgaaggccggctcccagcacgcaacgagcaggcgcgccggcagagcggactgtacgacagccagaacccacccacagtcaacaactgcgcccaggaccgtgagagcccagatggcagttacacagaggagcagagtcaggagagtgagatgaaggtgctggccacggattttgacgacgagtttgatgatgaggagcccctccctgccatagggacgtgcaaagctctctacacatttgaaggtcagaatgaaggaacgatttccgtagttgaaggagaaacattgtatgtcatagaggaagacaaaggcgatggctggacccgcattcggagaaatgaagatgaagagggttatgtccccacttcatatgtcgaagtctgtttggacaaaaatgccaaaggtgctaagacttatatttaataccataaaaaaaaaaaacttaaaaaaaatggagttgtttctccccacaaccgtgactgttacaggcagttcctcaagagactggctggcaagcaccataatgcacgttctcctgtagtctcacgtggacttcagggtccgggcacctgaattgccttgtctagtttgggctgtaatcaagtttcacttgctgatgaaattttatgtggaaagctgccaaccgccaacttacagctatgtcattcaaaatctgataaacatttcttcttttggcggtatctgtagattaaaaaaaaagttgcattgtagcttctcatctttctgaatttaaaagccggcacgcatcatgcaggtgccaaagacttccctactcttgtttatatctagtatccaccatacactgagctacattaggtggttacagattgtaacttaataaactgaactgtgttagtttgttaaattgtatactcattcacttgggaggaagtcacaagtgaaataacatctccttcttgactaaagcagtaaataagattcttatattggcaccaaaagtgtgtgtttttacttaaacctggtcagcatccttggtagggcatcacgagtaccctgttccatctacatgatcccagacaaccagctgaaatctggaaaagtttggtgaattgaccacttgatttttacattgcattgctgattttccaagtgtcatcaaattgacaggtttttgttgttgtgtttgtgtttttgttgttgttgttgttttgagacagagtctggctctgttgcccaggctggagtacagtggctcactgcaacctccgcctcccccaggagaatcacttgaacctggaggcaaaggttgcagtgagctgagatcatgccactgcattccagcctgc

SEQ ID NO: 299883 - DNA, 3057 bp, Homo sapiens
cggccgcggctgctgcttcctcgggccattttgctgtggagcggcggggaggaggagccgccgaggagaccccgggcgaggagctgcgagccggaggaggccgcgcggactccgggctttccgccgtcgcggggatctcggggggcaaagggatcgccggggagggggaccagagagccgcgcccgccgcgcggagcgccccttcgcgtcccctgcaccatgagctggggcaccgagctctgggatcagtttgacaacttagaaaaacacacacagtggggaattgatattcttgagaaatatatcaagtttgtgaaagaaaggacagagattgaactcagctatgcaaagcaactcaggaatctttcaaagaagtaccaacctaaaaagaactcgaaggaggaagaagaatacaagtatacgtcatgtaaagctttcatttccaacctgaacgaaatgaatgattacgcagggcagcatgaagttatctccgagaacatggcatcacagatcattgtggacttggcacgctatgttcaggaactgaaacaggagaggaaatcaaactttcacgatggccgtaaagcacagcagcacatcgagacttgctggaagcagcttgaatctagtaaaaggcgatttgaacgcgattgcaaagaggcggacagggcgcagcagtactttgagaaaatggacgctgacatcaatgtcacaaaagcggatgttgaaaaggcccgacaacaagctcaaatacgtcaccaaatggcagaggacagcaaagcagattactcatccattctccagaaattcaaccatgagcagcatgaatattaccatactcacatccccaacatcttccagaaaatacaagagatggaggaaaggaggattgtgagaatgggagagtccatgaagacatatgcagaggttgatcggcaggtgatcccaatcattgggaagtgcctggatggaatagtaaaagcagccgaatcaattgatcagaaaaatgattcacagctggtaatagaagcttataaatcagggtttgagcctcctggagacattgaatttgaggattacactcagccaatgaagcgcactgtgtcagataacagcctttcaaattccagaggagaaggcaaaccagacctcaaatttggtggcaaatccaaaggaaagttatggccgttcatcaaaaaaaataagtctcccaagcagcaaaaggaacccctctcccaccgcttcaacgagttcatgacctccaaacccaaaatccactgcttcaggagcctaaagcgtgggggtgcaacaccggaggatttcagcaacctcccacctgaacaaagaaggaaaaagctgcagcagaaagtcgatgagttaaataaagaaattcagaaggagatggatcaaagagatgccataacaaaaatgaaagatgtctacctaaagaatcctcagatgggagacccagccagtttggatcacaaattagcagaagtcagccaaaatatagagaaactgcgagtagagacccagaaatttgaggcctggctggctgaggttgaaggccggctcccagcacgcaacgagcaggcgcgccggcagagcggactgtacgacagccagaacccacccacagtcaacaactgcgcccaggaccgtgagagcccagatggcagttacacagaggagcagagtcaggagagtgagatgaaggtgctggccacggattttgacgacgagtttgatgatgaggagcccctccctgccatagggacgtgcaaagctctctacacatttgaaggtcagaatgaaggaacgatttccgtagttgaaggagaaacattgtatgtcatagaggaagacaaaggcgatggctggacccgcattcggagaaatgaagatgaagagggttatgtccccacttcatatgtcgaagtctgtttggacaaaaatgccaaaggtgctaagacttatatttaataccataaaaaaaaaaaacttaaaaaaaatggagttgtttctccccacaaccgtgactgttacaggcagttcctcaagagactggctggcaagcaccataatgcacgttctcctgtagtctcacgtggacttcagggtccgggcacctgaattgccttgtctagtttgggctgtaatcaagtttcacttgctgatgaaattttatgtggaaagctgccaaccgccaacttacagctatgtcattcaaaatctgataaacatttcttcttttggcggtatctgtagattaaaaaaaaagttgcattgtagcttctcatctttctgaatttaaaagccggcacgcatcatgcaggtgccaaagacttccctactcttgtttatatctagtatccaccatacactgagctacattaggtggttacagattgtaacttaataaactgaactgtgttagtttgttaaattgtatactcattcacttgggaggaagtcacaagtgaaataacatctccttcttgactaaagcagtaaataagattcttatattggcaccaaaagtgtgtgtttttacttaaacctggtcagcatccttggtagggcatcacgagtaccctgttccatctacatgatcccagacaaccagctgaaatctggaaaagtttggtgaattgaccacttgatttttacattgcattgctgattttccaagtgtcatcaaattgacaggtttttgttgttgtgtaagagtaaaaggtggtagatggtggtttggagacagagtctgggcaacaagagcaagactccatcccccaaaaaccccccaaaaaataacagacaaaagagaagcagttggagccacgagggtaccttgctcctgagagagatccaagtgagacagaagaagactagagagagagaccaaagatttatcccagtgagaaaatacttacattctgggagggaggagaaagaggcctggaggacttagagaggtcctagagagacagaggtaaacctggacattctgtgcagaaggagatggtttgaagcagaggagtgagggtcgggctttga

SEQ ID NO: 299884 - DNA, 2750 bp, Homo sapiens
cggccgcggctgctgcttcctcgggccattttgctgtggagcggcggggaggaggagccgccgaggagaccccgggcgaggagctgcgagccggaggaggccgcgcggactccgggctttccgccgtcgcggggatctcggggggcaaagggatcgccggggagggggaccagagagccgcgcccgccgcgcggagcgccccttcgcgtcccctgcaccatgagctggggcaccgagctctgggatcagtttgacaacttagaaaaacacacacagtggggaattgatattcttgagaaatatatcaagtttgtgaaagaaaggacagagattgaactcagctatgcaaagcaactcaggaatctttcaaagaagtaccaacctaaaaagaactcgaaggaggaagaagaatacaagtatacgtcatgtaaagctttcatttccaacctgaacgaaatgaatgattacgcagggcagcatgaagttatctccgagaacatggcatcacagatcattgtggacttggcacgctatgttcaggaactgaaacaggagaggaaatcaaactttcacgatggccgtaaagcacagcagcacatcgagacttgctggaagcagcttgaatctagtaaaaggcgatttgaacgcgattgcaaagaggcggacagggcgcagcagtactttgagaaaatggacgctgacatcaatgtcacaaaagcggatgttgaaaaggcccgacaacaagctcaaatacgtcaccaaatggcagaggacagcaaagcagattactcatccattctccagaaattcaaccatgagcagcatgaatattaccatactcacatccccaacatcttccagaaaatacaagagatggaggaaaggaggattgtgagaatgggagagtccatgaagacatatgcagaggttgatcggcaggtgatcccaatcattgggaagtgcctggatggaatagtaaaagcagccgaatcaattgatcagaaaaatgattcacagctggtaatagaagcttataaatcagggtttgagcctcctggagacattgaatttgaggattacactcagccaatgaagcgcactgtgtcagataacagcctttcaaattccagaggagaaggcaaaccagacctcaaatttggtggcaaatccaaaggaaagttatggccgttcatcaaaaaaaataagctatgtccttttaacatccccccatcagcctccccctccccctcctgcctctgcctcaccctctgctgttcccaacggcccccagtctcccaagcagcaaaaggaacccctctcccaccgcttcaacgagttcatgacctccaaacccaaaatccactgcttcaggagcctaaagcgtgggggtgcaacaccggaggatttcagcaacctcccacctgaacaaagaaggaaaaagctgcagcagaaagtcgatgagttaaataaagaaattcagaaggagatggatcaaaggtcagaatgaaggaacgatttccgtagttgaaggagaaacattgtatgtcatagaggaagacaaaggcgatggctggacccgcattcggagaaatgaagatgaagagggttatgtccccacttcatatgtcgaagtctgtttggacaaaaatgccaaaggtgctaagacttatatttaataccataaaaaaaaaaaacttaaaaaaaatggagttgtttctccccacaaccgtgactgttacaggcagttcctcaagagactggctggcaagcaccataatgcacgttctcctgtagtctcacgtggacttcagggtccgggcacctgaattgccttgtctagtttgggctgtaatcaagtttcacttgctgatgaaattttatgtggaaagctgccaaccgccaacttacagctatgtcattcaaaatctgataaacatttcttcttttggcggtatctgtagattaaaaaaaaagttgcattgtagcttctcatctttctgaatttaaaagccggcacgcatcatgcaggtgccaaagacttccctactcttgtttatatctagtatccaccatacactgagctacattaggtggttacagattgtaacttaataaactgaactgtgttagtttgttaaattgtatactcattcacttgggaggaagtcacaagtgaaataacatctccttcttgactaaagcagtaaataagattcttatattggcaccaaaagtgtgtgtttttacttaaacctggtcagcatccttggtagggcatcacgagtaccctgttccatctacatgatcccagacaaccagctgaaatctggaaaagtttggtgaattgaccacttgatttttacattgcattgctgattttccaagtgtcatcaaattgacaggtttttgttgttgtgtaagagtaaaaggtggtagatggtggtttggagacagagtctgggcaacaagagcaagactccatcccccaaaaaccccccaaaaaataacagacaaaagagaagcagttggagccacgagggtaccttgctcctgagagagatccaagtgagacagaagaagactagagagagagaccaaagatttatcccagtgagaaaatacttacattctgggagggaggagaaagaggcctggaggacttagagaggtcctagagagacagaggtaaacctggacattctgtgcagaaggagatggtttgaagcagaggagtgagggtcgggctttga

SEQ ID NO: 299885 - DNA, 1447 bp, Homo sapiens
cggccgcggctgctgcttcctcgggccattttgctgtggagcggcggggaggaggagccgccgaggagaccccgggcgaggagctgcgagccggaggaggccgcgcggactccgggctttccgccgtcgcggggatctcggggggcaaagggatcgccggggagggggaccagagagccgcgcccgccgcgcggagcgccccttcgcgtcccctgcaccatgagctggggcaccgagctctgggatcagtttgacaacttagaaaaacacacacagtggggaattgatattcttgagaaatatatcaagtttgtgaaagaaaggacagagattgaactcagctatgcaaagcaactcaggaatctttcaaagaagtaccaacctaaaaagaactcgaaggaggaagaagaatacaagtatacgtcatgtaaagctttcatttccaacctgaacgaaatgaatgattacgcagggcagcatgaagttatctccgagaacatggcatcacagatcattgtggacttggcacgctatgttcaggaactgaaacaggagaggaaatcaaactttcacgatggccgtaaagcacagcagcacatcgagacttgctggaagcagcttgaatctagtaaaaggcgatttgaacgcgattgcaaagaggcggacagggcgcagcagtactttgagaaaatggacgctgacatcaatgtcacaaaagcggatgttgaaaaggcccgacaacaagctcaaatacgtcaccaaatggcagaggacagcaaagcagattactcatccattctccagaaattcaaccatgagcagcatgaatattaccatactcacatccccaacatcttccagaaaatacaagagatggaggaaaggaggattgtgagaatgggagagtccatgaagacatatgcagaggttgatcggcaggtgatcccaatcattgggaagtgcctggatggaatagtaaaagcagccgaatcaattgatcagaaaaatgattcacagctggtaatagaagcttataaatcagggtttgagcctcctggagacattgaatttgaggattacactcagccaatgaagcgcactgtgtcagataacagcctttcaaattccagaggagaaggcaaaccagacctcaaatttggtggcaaatccaaaggaaagttatggccgttcatcaaaaaaaataagactcagtctttctgttttcacaaagaactcatgaagaggacgatagggaaacccacgtatgcctttgaggctagggactatgttgtaagttcacctgtgatggccaggtcatacagtcatggcacagccactaaccccattcacagcaccaagactggggacccagaggcacttgttatgcttccacactacgaaatgaaattcttaattgagagaactggacaccaggaaaaaaaaaaaa

SEQ ID NO: 299886 - DNA, 393 bp, Homo sapiens
aacctggacatttctgtgcagaaggagatggttttgaggcagtgggtgaggggtccgtgcatctgagaaggtccgagtggggtgaattttgtgtggacttcatcttcgacgacacttgtttcattgcgaaggccactgtttgcttcctccctgcatttgccaagacatctaacatatcctgatattgctttttcaggtcagaatgaaggaacgatttccgtagttgaaggagaaacattgtatgtcatagaggaagacaaaggcgatggctggacccgcattcggagaaatgaagatgaagagggttatgtccccacttcatatgtcgaagtctgtttggacaaaaatgccaaaggtgctaagacttatatttaataccataaaaaaaaaaaa

SEQ ID NO: 299887 - DNA, 1633 bp, Homo sapiens
  misc_feature (196)..(196): n is a, c, g, or t
tggggcttctgactgtggaattggattctagctgtgtgtgttatatcctgttactgttgagacacagaggcgggagtcggcgggggaagatatgtgctgagattagtcagcctgccctccctctcccccaagaaactcaggccccatctggggagagtgagaacttaagaaacttgagacagggaaggagagccgngagcagccaaaacctgctaagtctcagaagactggtttctgcacaagggaatggaagaagtgactggaggtggctgtggattcaactctggcctgagattgattcccttgagataagttgttttctggtgggtgtgtctgggagcattgtgttgggaagggaattcctttctttgggaaacacttttttttttacttgaagtgaaaggtattcagacttgtgtatttcttgtaccaaggagtgggtgtttattgataactgtttctttgggttcatctgaagtgggaatcagactggtaaatatcaagaaaaactgggcatggtggtgtgggcctatagtcctagctactcaggaggtgggaagattgtttgagcccagcagtttgcagccagcctggcaaacatagtgagaccctgtctctttaaaaagagagagaacgtaaggaagtaaaggtgttacacctgttttggctgtctgccatattctcttcctttcctctgaaaaaggagtgggtgagggtagaatctgtagaagaaaaaataaattaaccagaaaatatgtgtgaaaaagggattagaaaagatgtaggaatcttgaaaagtgttctgacacactatgcttagtaatgatgatcttgttaaaatatctagttttttattgttactttttttttgctcagttgctaagaaatatgctgaccataatttctaaacagaaaaatctctgcacacaatatgctaggacagacaatgggacagaatatataaatttaggaatgtcccagagaatcagtagtgtaccaaaagagggatcctagcccttcaaataattctctgcagtaagaaagactgctctgctcacttctacattacactttcttaatgatttgttttcctagtaattgttgtttatctttgaatctagttcttgacacttaggaagaaacctttttgaggaaattaaaagctgttagattggtatttgaaataacgaatttgacaagatgtctaagttaaacctaagttaaacaatatccagataaggctgtgaagactataatatctggcatgttcctcatggagcagtgaaattccatgccaaagccacttacattactatactgtgggtcaaaacatgtctacagattttaagggaccgtgtttccttgcatagaactttcctggagtagcactggatacttagttggtgcctagcaaatgtgatgactaaagaatataatgcatcacagatattatcctgatcaccatttcttggctaaaatgttgtagtggaattctggtggctgttaattctttctcattcaggagatagcaggcaaaattgggtgggccctgggaaggagtgtagctgggctatttaacatctgagaatataggatgtgtgtttatgaaagtaaactcagcttctaatggtaa

SEQ ID NO: 299888 - DNA, 469 bp, Homo sapiens
cttgatatcttgcctgtgtatgtatgtgtatgtgtgtgcttaactgttttgtacttacttcccagtaaaaaaaatgtagttgaccctgttcatcagtgaactcactcataattctcaagttccttccatgccacttcctctacaaaggctgggaaagctaaacaattattttgtatcacctactgcagctcgtgccgaattcggcacgaccctactagtaagtgggatttcaaacttcctgtacaatcaactttaagtaaaaatcttcatgtagtgctatcaggtggtgttaccagtgatgcttgttctttgtatgccaagagttcaacaaaaatggtttgtaaaatatttagatcagtgatattctagcagtgatatatattgacggagtctcgctctgttgcccaggcgggagtgcagtggcatgatctcagctcactgcaacctctgcctcccaggttcaagcgat

SEQ ID NO: 299889 - DNA, 3959 bp, Homo sapiens
taagcgggctttgcgtgcgtgtttgcgtacagcggaggtggcggcgcgggcaggtcggagctcggagctgctgcttctggttctcttgtggccgccgtcgctgtccggctgccttgggctgccgaacagacaaggcgtgggccacagcacctcagaagccgacgcagctcgacgcaggggccggcaggagggtgggcgatcgcgtgtcggagggcgccgcgcgggcaggcgggcgggcgccagagggggaaagaggcgggggcggcgggtcagccgctggccgggccggccggggaatgtcgatgcctgacgcgatgccgctgcccggggtcggggaggagctgaagcaggccaaggagatcgaggacgccgagaagtactccttcatggccaccgtcaccaaggcgcccaagaagcaaatccagtttgctgatgacatgcaggagttcaccaaattccccaccaaaactggccgaagatctttgtctcgctcgatctcacagtcctccactgacagctacagttcagctgcatcctacacagatagctctgatgatgaggtttctccccgagagaagcagcaaaccaactccaagggcagcagcaatttctgtgtgaagaacatcaagcaggcagaatttggacgccgggagattgagattgcagagcaagacatgtctgctctgatttcactcaggaaacgtgctcagggggagaagcccttggctggtgctaaaatagtgggctgtacacacatcacagcccagacagcggtgttgattgagacactctgtgccctgggggctcagtgccgctggtctgcttgtaacatctactcaactcagaatgaagtagctgcagcactggctgaggctggagttgcagtgttcgcttggaagggcgagtcagaagatgacttctggtggtgtattgaccgctgtgtgaacatggatgggtggcaggccaacatgatcctggatgatgggggagacttaacccactgggtttataagaagtatccaaacgtgtttaagaagatccgaggcattgtggaagagagcgtgactggtgttcacaggctgtatcagctctccaaagctgggaagctctgtgttccggccatgaacgtcaatgattctgttaccaaacagaagtttgataacttgtactgctgccgagaatccattttggatggcctgaagaggaccacagatgtgatgtttggtgggaaacaagtggtggtgtgtggctatggtgaggtaggcaagggctgctgtgctgctctcaaagctcttggagcaattgtctacattaccgaaatcgaccccatctgtgctctgcaggcctgcatggatgggttcagggtggtaaagctaaatgaagtcatccggcaagtcgatgtcgtaataacttgcacaggaaataagaatgtagtgacacgggagcacttggatcgcatgaaaaacagttgtatcgtatgcaatatgggccactccaacacagaaatcgatgtgaccagcctccgcactccggagctgacgtgggagcgagtacgttctcaggtggaccatgtcatctggccagatggcaaacgagttgtcctcctggcagagggtcgtctactcaatttgagctgctccacagttcccacctttgttctgtccatcacagccacaacacaggctttggcactgatagaactctataatgcacccgaggggcgatacaagcaggatgtgtacttgcttcctaagaaaatggatgaatacgttgccagcttgcatctgccatcatttgatgcccaccttacagagctgacagatgaccaagcaaaatatctgggactcaacaaaaatgggccattcaaacctaattattacagatactaatggaccatactaccaaggaccagtccacctgaaccacacactctaaagaaatattttttaagataacttttattttcttcttactcctttcctcttgatttttttcctataatttcattcttgttttttcatctcattatccaagttctgcagaccacacaggaacttgcttcatggctctttagatgaaatagaagttcagggttcctcactctagtcactaaagaaggattttactctcccagcccagaaaggtgattctttctttaccatttctggggactttagtcttaattaggtaccttattaacaggaaatgctaaggtaccttctctgtggaacaatctgcaatgtctaaatcgccttaaaagagcccatttcttagctgctgaaatcagtgctctttcacttcttcagagaagcagggatggtacctacccggcaggtaggttagatgtgggtggtgcatgttaatttcccttagaagttccaagccctgtttcctgcgtaaaggtggtatgtccagttcagagatgtgtataatgagcatggcttgttaagatcaggaggcccacttggatttatagtatagcccttcctccactcccaccagacttgctcatttttcgagtttttaactagactacactctattgagtttaattttgtcctctaggatttatttctgttgtccaaaaaaaaaaaaaagaaaagaaaaattaaggagaatttttggtgttaatgctgaggaattgcttgagtggttagttgttaccaatttctcttttgaacctttggagctaaggatgctgagtctagagaaatgctagtctcaagccctgttaagtccctctgtttctagcccgtagttcatagcatcagtgaactggagccacaacagcaaattctatcagctgtgtaccatacagcttgtgctgaaggcgaatttcttgagccattactcagtataaagcactgagttctatctttaggatttatctttaagagcaaatttctggtcagctgtgcttctgcaacctaaaatatttaaagggaggtaggtgtgggcaggaggaggaatgataaattgggccagggcaagaaaaatctagcttcatataatttgtctgggactatacaccctatataatgttagttttacagaagtaatatgacttttgattgctacataccacaaagagtttatgaactgagatcataaagggcaactgatgtgtgaagaaagtagtcagtacatcctggctcatgctctgaaagaatatccagagaggctctctcaaagatcagggagatgtattcccatgccatgcaccctgcttcccagcatttctgcatggtcaagtgagctttatgctcatgagctttaagtatataattatccaggattttaaatcctcaacttgttctagcttgtgatccctcaaagttgggtcatacgttagtgctagatactagaaattttcacttttccactgatcagagagacagacattaaaaacaaaaatagaagaaaggaaagctttcaccctgcagcttcttagcagggaacaattgtcttgccaaaacttttttcccttttctctcccattttcttttacccaatcccttcttactccttgccagtgtgaccatgctttcttctctgtagatgttaacagttaaggcctattttcctcgggcacttaaccaaccaatcagaacaccacatctgttaggggaggtaacctggccaacagtgtatccatcacgttagccctgctggagggaagggacccacattcacctgccctctgacctgccccttgatcccatatctattaccgtgtccataggaataataggtaagggctctgtctctgtcaagccatgtaacaaaggacactgttaaaaaaaaaaaaaagtctggcatcagagggagcatgtggagagcaacttgggaagaacaagttcattttgtattgaatgatttttaatgaatgcaatattaatccttgcagatgagcaataatcattaaaatcgattaaaatgataagaccttaaaagaagac

SEQ ID NO: 299890 - DNA, 4548 bp, Homo sapiens
taagcgggctttgcgtgcgtgtttgcgtacagcggaggtggcggcgcgggcaggtcggagctcggagctgctgcttctggttctcttgtggccgccgtcgctgtccggctgccttgggctgccgaacagacaaggcgtgggccacagcacctcagaagccgacgcagctcgacgcaggggccggcaggagggtgggcgatcgcgtgtcggagggcgccgcgcgggcaggcgggcgggcgccagagggggaaagaggcgggggcggcgggtcagccgctggccgggccggccggggaatgtcgatgcctgacgcgatgccgctgcccggggtcggggaggagctgaagcaggccaaggagatcgaggacgccgagaagtactccttcatggccaccgtcaccaaggcgcccaagaagcaaatccagtttgctgatgacatgcaggagttcaccaaattccccaccaaaactggccgaagatctttgtctcgctcgatctcacagtcctccactgacagctacagttcagctgcatcctacacagatagctctgatgatgaggtttctccccgagagaagcagcaaaccaactccaagggcagcagcaatttctgtgtgaagaacatcaagcaggcagaatttggacgccgggagattgagattgcagagcaagacatgtctgctctgatttcactcaggaaacgtgctcagggggagaagcccttggctggtgctaaaatagtgggctgtacacacatcacagcccagacagcggtgttgattgagacactctgtgccctgggggctcagtgccgctggtctgcttgtaacatctactcaactcagaatgaagtagctgcagcactggctgaggctggagttgcagtgttcgcttggaagggcgagtcagaagatgacttctggtggtgtattgaccgctgtgtgaacatggatgggtggcaggccaacatgatcctggatgatgggggagacttaacccactgggtttataagaagtatccaaacgtgtttaagaagatccgaggcattgtggaagagagcgtgactggtgttcacaggctgtatcagctctccaaagctgggaagctctgtgttccggccatgaacgtcaatgattctgttaccaaacagaagtttgataacttgtactgctgccgagaatccattttggatggcctgaagaggaccacagatgtgatgtttggtgggaaacaagtggtggtgtgtggctatggtgaggtaggcaagggctgctgtgctgctctcaaagctcttggagcaattgtctacattaccgaaatcgaccccatctgtgctctgcaggcctgcatggatgggttcagggtggtaaagctaaatgaagtcatccggcaagtcgatgtcgtaataacttgcacaggaaataagaatgtagtgacacgggagcacttggatcgcatgaaaaacagttgtatcgtatgcaatatgggccactccaacacagaaatcgatgtgaccagcctccgcactccggagctgacgtgggagcgagtacgttctcaggtggaccatgtcatctggccagatggcaaacgagttgtcctcctggcagagggtcgtctactcaatttgagctgctccacagttcccacctttgttctgtccatcacagccacaacacaggctttggcactgatagaactctataatgcacccgaggggcgatacaagcaggatgtgtacttgcttcctaagaaaatggatgaatacgttgccagcttgcatctgccatcatttgatgcccaccttacagagctgacagatgaccaagcaaaatatctgggactcaacaaaaatgggccattcaaacctaattattacagatactaatggaccatactaccaaggaccagtccacctgaaccacacactctaaagaaatattttttaagataacttttattttcttcttactcctttcctcttgatttttttcctataatttcattcttgttttttcatctcattatccaagttctgcagaccacacaggaacttgcttcatggctctttagatgaaatagaagttcagggttcctcactctagtcactaaagaaggattttactctcccagcccagaaaggtgattctttctttaccatttctggggactttagtcttaattaggtaccttattaacaggaaatgctaaggtaccttctctgtggaacaatctgcaatgtctaaatcgccttaaaagagcccatttcttagctgctgaaatcagtgctctttcacttcttcagagaagcagggatggtacctacccggcaggtaggttagatgtgggtggtgcatgttaatttcccttagaagttccaagccctgtttcctgcgtaaaggtggtatgtccagttcagagatgtgtataatgagcatggcttgttaagatcaggaggcccacttggatttatagtatagcccttcctccactcccaccagacttgctcatttttcgagtttttaactagactacactctattgagtttaattttgtcctctaggatttatttctgttgtccaaaaaaaaaaaaaagaaaagaaaaattaaggagaatttttggtgttaatgctgaggaattgcttgagtggttagttgttaccaatttctcttttgaacctttggagctaaggatgctgagtctagagaaatgctagtctcaagccctgttaagtccctctgtttctagcccgtagttcatagcatcagtgaactggagccacaacagcaaattctatcagctgtgtaccatacagcttgtgctgaaggcgaatttcttgagccattactcagtataaagcactgagttctatctttaggatttatctttaagagcaaatttctggtcagctgtgcttctgcaacctaaaatatttaaagggaggtaggtgtgggcaggaggaggaatgataaattgggccagggcaagaaaaatctagcttcatataatttgtctgggactatacaccctatataatgttagttttacagaagtaatatgacttttgattgctacataccacaaagagtttatgaactgagatcataaagggcaactgatgtgtgaagaaagtagtcagtacatcctggctcatgctctgaaagaatatccagagaggctctctcaaagatcagggagatgtattcccatgccatgcaccctgcttcccagcatttctgcatggtcaagtgagctttatgctcatgagctttaagtatataattatccaggattttaaatcctcaacttgttctagcttgtgatccctcaaagttgggtcatacgttagtgctagatactagaaattttcacttttccactgatcagagagacagacattaaaaacaaaaatagaagaaaggaaagctttcaccctgcagcttcttagcagggaacaattgtcttgccaaaacttttttcccttttctctcccattttcttttacccaatcccttcttactccttgccagtgtgaccatgctttcttctctgtagatgttaacagttaaggcctattttcctcgggcacttaaccaaccaatcagaacaccacatctgttaggggaggtaacctggccaacagtgtatccatcacgttagccctgctggagggaagggacccacattcacctgccctctgacctgccccttgatcccatatctattaccgtgtccataggaataataggtaagggctctgtctctgtcaagccatgtaacaaaggacactgttaaaaaaaaaaaaaagtctggcatcagagggagcatgtggagagcaacttgggaagaacaagttcattttgtattgaatgatttttaatgaatgcaatattaatccttgcagatgagcaataatcattaaaatcgattaaaatggttaagaaaaaaaaaaaaaaaaaaaaaaaaaaaaaaacaagaaaagacaaaaaaaaaaaaaaaaaaaaaaaacaagcaaacaaaaacaacaaaagcacgaagcagacgaacacgcgaagagacaagagtaaggctagaccactcttgatggagcacacacgaacaagaagtaaaagcagccgggcagcagcggcccccacaggaagaagagtagtacacgcaacacatagtgggcacactgaccaacaacataagacacgaggctaaactgacaaggaaaacgaacacacgagcaaagagagaggataaccgacgaacacaaaaagagggagaggagggcggaacgcagtatacaacacacaccgcgaggggatagaagaagcctcaccgcagactagataagaaagaacatagaataaatccccgcgcgaggcgataaagcagcgacacacagaacacgaaaaacaacacgaagcacaagagaaccaaacaagaaggagcaaagaaagaagaagaatacgaagagaaacacacaacagcgaacagaacagaaagcagacaagcgaaaacactcgagacaaagagcaacagccaggcgatcacctcagc

SEQ ID NO: 299891 - DNA, 3761 bp, Homo sapiens
  misc_feature (3599)..(3599): n is a, c, g, or t
taagcgggctttgcgtgcgtgtttgcgtacagcggaggtggcggcgcgggcaggtcggagctcggagctgctgcttctggttctcttgtggccgccgtcgctgtccggctgccttgggctgccgaacagacaaggcgtgggccacagcacctcagaagccgacgcagctcgacgcaggggccggcaggagggtgggcgatcgcgtgtcggagggcgccgcgcgggcaggcgggcgggcgccagagggggaaagaggcgggggcggcgggtcagccgctggccgggccggccggggaatgtcgatgcctgacgcgatgccgctgcccggggtcggggaggagctgaagcaggccaaggagatcgaggacgccgagaagtactccttcatggccaccgtcaccaaggcgcccaagaagcaaatccagtttgctgatgacatgcaggagttcaccaaattccccaccaaaactggccgaagatctttgtctcgctcgatctcacagtcctccactgacagctacagttcagctgcatcctacacagatagctctgatgatgaggtttctccccgagagaagcagcaaaccaactccaagggcagcagcaatttctgtgtgaagaacatcaagcaggcagaatttggacgccgggagattgagattgcagagcaagacatgtctgctctgatttcactcaggaaacgtgctcagggggagaagcccttggctggtgctaaaatagtgggctgtacacacatcacagcccagacagcggtgttgattgagacactctgtgccctgggggctcagtgccgctggtctgcttgtaacatctactcaactcagaatgaagtagctgcagcactggctgaggctggagttgcagtgttcgcttggaagggcgagtcagaagatgacttctggtggtgtattgaccgctgtgtgaacatggatgggtggcaggccaacatgatcctggatgatgggggagacttaacccactgggtttataagaagtatccaaacgtgtttaagaagatccgaggcattgtggaagagagcgtgactggtgttcacaggctgtatcagctctccaaagctgggaagctctgtgttccggccatgaacgtcaatgattctgttaccaaacagaagtttgataacttgtactgctgccgagaatccattttggatggcctgaagaggaccacagatgtgatgtttggtgggaaacaagtggtggtgtgtggctatggtgaggtaggcaagggctgctgtgctgctctcaaagctcttggagcaattgtctacattaccgaaatcgaccccatctgtgctctgcaggcctgcatggatgggttcagggtggtaaagctaaatgaagtcatccggcaagtcgatgtcgtaataacttgcacaggaaataagaatgtagtgacacgggagcacttggatcgcatgaaaaacagttgtatcgtatgcaatatgggccactccaacacagaaatcgatgtgaccagcctccgcactccggagctgacgtgggagcgagtacgttctcaggtggaccatgtcatctggccagatggcaaacgagttgtcctcctggcagagggtcgtctactcaatttgagctgctccacagttcccacctttgttctgtccatcacagccacaacacaggctttggcactgatagaactctataatgcacccgaggggcgatacaagcaggatgtgtacttgcttcctaagaaaatggatgaatacgttgccagcttgcatctgccatcatttgatgcccaccttacagagctgacagatgaccaagcaaaatatctgggactcaacaaaaatgggccattcaaacctaattattacagatactaatggaccatactaccaaggaccagtccacctgaaccacacactctaaagaaatattttttaagataacttttattttcttcttactcctttcctcttgatttttttcctataatttcattcttgttttttcatctcattatccaagttctgcagaccacacaggaacttgcttcatggctctttagatgaaatagaagttcagggttcctcactctagtcactaaagaaggattttactctcccagcccagaaaggtgattctttctttaccatttctggggactttagtcttaattaggtaccttattaacaggaaatgctaaggtaccttctctgtggaacaatctgcaatgtctaaatcgccttaaaagagcccatttcttagctgctgaaatcagtgctctttcacttcttcagagaagcagggatggtacctacccggcaggtaggttagatgtgggtggtgcatgttaatttcccttagaagttccaagccctgtttcctgcgtaaaggtggtatgtccagttcagagatgtgtataatgagcatggcttgttaagatcaggaggcccacttggatttatagtatagcccttcctccactcccaccagacttgctcatttttcgagtttttaactagactacactctattgagtttaattttgtcctctaggatttatttctgttgtccaaaaaaaaaaaaaagaaaagaaaaattaaggagaatttttggtgttaatgctgaggaattgcttgagtggttagttgttaccaatttctcttttgaacctttggagctaaggatgctgagtctagagaaatgctagtctcaagccctgttaagtccctctgtttctagcccgtagttcatagcatcagtgaactggagccacaacagcaaattctatcagctgtgtaccatacagcttgtgctgaaggcgaatttcttgagccattactcagtataaagcactgagttctatctttaggatttatctttaagagcaaatttctggtcagctgtgcttctgcaacctaaaatatttaaagggaggtaggtgtgggcaggaggaggaatgataaattgggccagggcaagaaaaatctagcttcatataatttgtctgggactatacaccctatataatgttagttttacagaagtaatatgacttttgattgctacataccacaaagagtttatgaactgagatcataaagggcaactgatgtgtgaagaaagtagtcagtacatcctggctcatgctctgaaagaatatccagagaggctctctcaaagatcagggagatgtattcccatgccatgcaccctgcttcccagcatttctgcatggtcaagtgagctttatgctcatgagctttaagtatataattatccaggattttaaatcctcaacttgttctagcttgtgatccctcaaagttgggtcatacgttagtgctagatactagaaattttcacttttccactgatcagagagacagacattaaaaacaaaaatagaagaaaggaaagctttcaccctgcagcttcttagcagggaacaattgtcttgccaaaacttttttcccttttctctcccattttcttttacccaatcccttcttactccttgccagtgtgaccatgctttcttctctgtagatgttaacagttaaggcctattttcctcgggcacttaacancattgaacccttgtgggggggggccgcccaggttcccccgtgccgttggggggggccctcagggcgggccggccattaggccgagaggaggggccgcccgaggcggaaacgctgggggggggacttttttctgcattaaagggggccctgcggtttgtttcc

SEQ ID NO: 299892 - DNA, 3715 bp, Homo sapiens
taagcgggctttgcgtgcgtgtttgcgtacagcggaggtggcggcgcgggcaggtcggagctcggagctgctgcttctggttctcttgtggccgccgtcgctgtccggctgccttgggctgccgaacagacaaggcgtgggccacagcacctcagaagccgacgcagctcgacgcaggggccggcaggagggtgggcgatcgcgtgtcggagggcgccgcgcgggcaggcgggcgggcgccagagggggaaagaggcgggggcggcgggtcagccgctggccgggccggccggggaatgtcgatgcctgacgcgatgccgctgcccggggtcggggaggagctgaagcaggccaaggagatcgaggacgccgagaagtactccttcatggccaccgtcaccaaggcgcccaagaagcaaatccagtttgctgatgacatgcaggagttcaccaaattccccaccaaaactggccgaagatctttgtctcgctcgatctcacagtcctccactgacagctacagttcagctgcatcctacacagatagctctgatgatgaggtttctccccgagagaagcagcaaaccaactccaagggcagcagcaatttctgtgtgaagaacatcaagcaggcagaatttggacgccgggagattgagattgcagagcaagacatgtctgctctgatttcactcaggaaacgtgctcagggggagaagcccttggctggtgctaaaatagtgggctgtacacacatcacagcccagacagcggtgttgattgagacactctgtgccctgggggctcagtgccgctggtctgcttgtaacatctactcaactcagaatgaagtagctgcagcactggctgaggctggagttgcagtgttcgcttggaagggcgagtcagaagatgacttctggtggtgtattgaccgctgtgtgaacatggatgggtggcaggccaacatgatcctggatgatgggggagacttaacccactgggtttataagaagtatccaaacgtgtttaagaagatccgaggcattgtggaagagagcgtgactggtgttcacaggctgtatcagctctccaaagctgggaagctctgtgttccggccatgaacgtcaatgattctgttaccaaacagaagtttgataacttgtactgctgccgagaatccattttggatggcctgaagaggaccacagatgtgatgtttggtgggaaacaagtggtggtgtgtggctatggtgaggtaggcaagggctgctgtgctgctctcaaagctcttggagcaattgtctacattaccgaaatcgaccccatctgtgctctgcaggcctgcatggatgggttcagggtggtaaagctaaatgaagtcatccggcaagtcgatgtcgtaataacttgcacaggaaataagaatgtagtgacacgggagcacttggatcgcatgaaaaacagttgtatcgtatgcaatatgggccactccaacacagaaatcgatgtgaccagcctccgcactccggagctgacgtgggagcgagtacgttctcaggtggaccatgtcatctggccagatggcaaacgagttgtcctcctggcagagggtcgtctactcaatttgagctgctccacagttcccacctttgttctgtccatcacagccacaacacaggctttggcactgatagaactctataatgcacccgaggggcgatacaagcaggatgtgtacttgcttcctaagaaaatggatgaatacgttgccagcttgcatctgccatcatttgatgcccaccttacagagctgacagatgaccaagcaaaatatctgggactcaacaaaaatgggccattcaaacctaattattacagatactaatggaccatactaccaaggaccagtccacctgaaccacacactctaaagaaatattttttaagataacttttattttcttcttactcctttcctcttgatttttttcctataatttcattcttgttttttcatctcattatccaagttctgcagaccacacaggaacttgcttcatggctctttagatgaaatagaagttcagggttcctcactctagtcactaaagaaggattttactctcccagcccagaaaggtgattctttctttaccatttctggggactttagtcttaattaggtaccttattaacaggaaatgctaaggtaccttctctgtggaacaatctgcaatgtctaaatcgccttaaaagagcccatttcttagctgctgaaatcagtgctctttcacttcttcagagaagcagggatggtacctacccggcaggtaggttagatgtgggtggtgcatgttaatttcccttagaagttccaagccctgtttcctgcgtaaaggtggtatgtccagttcagagatgtgtataatgagcatggcttgttaagatcaggaggcccacttggatttatagtatagcccttcctccactcccaccagacttgctcatttttcgagtttttaactagactacactctattgagtttaattttgtcctctaggatttatttctgttgtccaaaaaaaaaaaaaagaaaagaaaaattaaggagaatttttggtgttaatgctgaggaattgcttgagtggttagttgttaccaatttctcttttgaacctttggagctaaggatgctgagtctagagaaatgctagtctcaagccctgttaagtccctctgtttctagcccgtagttcatagcatcagtgaactggagccacaacagcaaattctatcagctgtgtaccatacagcttgtgctgaaggcgaatttcttgagccattactcagtataaagcactgagttctatctttaggatttatctttaagagcaaatttctggtcagctgtgcttctgcaacctaaaatatttaaagggaggtaggtgtgggcaggaggaggaatgataaattgggccagggcaagaaaaatctagcttcatataatttgtctgggactatacaccctatataatgttagttttacagaagtaatatgacttttgattgctacataccacaaagagtttatgaactgagatcataaagggcaactgatgtgtgaagaaagtagtcagtacatcctggctcatgctctgaaagaatatccagagaggctctctcaaagatcagggagatgtattcccatgccatgcaccctgcttcccagcatttctgcatggtcaagtgagctttatgctcatgagctttaagtatataattatccaggattttaaatcctcaacttgttctagcttgtgatccctcaaagttgggtcatacgttagtgctagatactagaaattttcacttttccactgatcagagagacagacattaaaaacaaaaatagaagaaaggaaagctttcaccctgcagcttcttagcagggaacaattgtcttgccaaaacttttttcccttttctctcccattttcttttacccaatcccttcttactccttgccagtgtgaccatgctttcttctctgtagatgttaacagttaagatcaggaggcccacttggatttatagtatagcccttcctccactcccaccagacttgctcatttttcgagtttttaactagactacactctattgagtttaattttgtcctctaggatttatttctgttgtccaaaaaaaaa

SEQ ID NO: 299893 - DNA, 3898 bp, Homo sapiens
taagcgggctttgcgtgcgtgtttgcgtacagcggaggtggcggcgcgggcaggtcggagctcggagctgctgcttctggttctcttgtggccgccgtcgctgtccggctgccttgggctgccgaacagacaaggcgtgggccacagcacctcagaagccgacgcagctcgacgcaggggccggcaggagggtgggcgatcgcgtgtcggagggcgccgcgcgggcaggcgggcgggcgccagagggggaaagaggcgggggcggcgggtcagccgctggccgggccggccggggaatgtcgatgcctgacgcgatgccgctgcccggggtcggggaggagctgaagcaggccaaggagatcgaggacgccgagaagtactccttcatggccaccgtcaccaaggcgcccaagaagcaaatccagtttgctgatgacatgcaggagttcaccaaattccccaccaaaactggccgaagatctttgtctcgctcgatctcacagtcctccactgacagctacagttcagctgcatcctacacagatagctctgatgatgaggtttctccccgagagaagcagcaaaccaactccaagggcagcagcaatttctgtgtgaagaacatcaagcaggcagaatttggacgccgggagattgagattgcagagcaagacatgtctgctctgatttcactcaggaaacgtgctcagggggagaagcccttggctggtgctaaaatagtgggctgtacacacatcacagcccagacagcggtgttgattgagacactctgtgccctgggggctcagtgccgctggtctgcttgtaacatctactcaactcagaatgaagtagctgcagcactggctgaggctggagttgcagtgttcgcttggaagggcgagtcagaagatgacttctggtggtgtattgaccgctgtgtgaacatggatgggtggcaggccaacatgatcctggatgatgggggagacttaacccactgggtttataagaagtatccaaacgtgtttaagaagatccgaggcattgtggaagagagcgtgactggtgttcacaggctgtatcagctctccaaagctgggaagctctgtgttccggccatgaacgtcaatgattctgttaccaaacagaagtttgataacttgtactgctgccgagaatccattttggatggcctgaagaggaccacagatgtgatgtttggtgggaaacaagtggtggtgtgtggctatggtgaggtaggcaagggctgctgtgctgctctcaaagctcttggagcaattgtctacattaccgaaatcgaccccatctgtgctctgcaggcctgcatggatgggttcagggtggtaaagctaaatgaagtcatccggcaagtcgatgtcgtaataacttgcacaggaaataagaatgtagtgacacgggagcacttggatcgcatgaaaaacagttgtatcgtatgcaatatgggccactccaacacagaaatcgatgtgaccagcctccgcactccggagctgacgtgggagcgagtacgttctcaggtggaccatgtcatctggccagatggcaaacgagttgtcctcctggcagagggtcgtctactcaatttgagctgctccacagttcccacctttgttctgtccatcacagccacaacacaggctttggcactgatagaactctataatgcacccgaggggcgatacaagcaggatgtgtacttgcttcctaagaaaatggatgaatacgttgccagcttgcatctgccatcatttgatgcccaccttacagagctgacagatgaccaagcaaaatatctgggactcaacaaaaatgggccattcaaacctaattattacagatactaatggaccatactaccaaggaccagtccacctgaaccacacactctaaagaaatattttttaagataacttttattttcttcttactcctttcctcttgatttttttcctataatttcattcttgttttttcatctcattatccaagttctgcagaccacacaggaacttgcttcatggctctttagatgaaatagaagttcagggttcctcactctagtcactaaagaaggattttactctcccagcccagaaaggtgattctttctttaccatttctggggactttagtcttaattaggtaccttattaacaggaaatgctaaggtaccttctctgtggaacaatctgcaatgtctaaatcgccttaaaagagcccatttcttagctgctgaaatcagtgctctttcacttcttcagagaagcagggatggtacctacccggcaggtaggttagatgtgggtggtgcatgttaatttcccttagaagttccaagccctgtttcctgcgtaaaggtggtatgtccagttcagagatgtgtataatgagcatggcttgttaagatcaggaggcccacttggatttatagtatagcccttcctccactcccaccagacttgctcatttttcgagtttttaactagactacactctattgagtttaattttgtcctctaggatttatttctgttgtccaaagagtggttagttgttaccaatttctcttttgaacctttggagctaaggatgctgagtctagagaaatgctagtctcaagccctgttaagtccctctgtttctagcccgtagttcatagcatcagtgaactggagccacaacagcaaattctatcagctgtgtaccatacagcttgtgctgaaggcgaatttcttgagccattactcagtataaagcactgagttctatctttaggatttatctttaagagcaaatttctggtcagctgtgcttctgcaacctaaaatatttaaagggaggtaggtgtgggcaggaggaggaatgataaattgggccagggcaagaaaaatctagcttcatataatttgtctgggactatacaccctatataatgttagttttacagaagtaatatgacttttgattgctacataccacaaagagtttatgaactgagatcataaagggcaactgatgtgtgaagaaagtagtcagtacatcctggctcatgctctgaaagaatatccagagaggctctctcaaagatcagggagatgtattcccatgccatgcaccctgcttcccagcatttctgcatggtcaagtgagctttatgctcatgagctttaagtatataattatccaggattttaaatcctcaacttgttctagcttgtgatccctcaaagttgggtcatacgttagtgctagatactagaaattttcacttttccactgatcagagagacagacattaaaaacaaaaatagaagaaaggaaagctttcaccctgcagcttcttagcagggaacaattgtcttgccaaaacttttttcccttttctctcccattttcttttacccaatcccttcttactccttgccagtgtgaccatgctttcttctctgtagatgttaacagttaaggcctattttcctcgggcacttaaccaaccaatcagaacaccacatctgttaggggaggtaacctggccaacagtgtatccatcacgttagccctgctggagggaagggacccacattcacctgccctctgacctgccccttgatcccatatctattaccgtgtccataggaataataggtaagggctctgtctctgtcaagccatgtaacaaaggacactgttaaaaaaaaaaaaaagtctggcatcagagggagcatgtggagagcaacttgggaagaacaagttcattttgtattgaatgatttttaatgaatgcaatattaatccttgcagatgagcaataatcattaaaatcgattaaaatgataagaccttaaaagaagac

SEQ ID NO: 299894 - DNA, 3692 bp, Homo sapiens
taagcgggctttgcgtgcgtgtttgcgtacagcggaggtggcggcgcgggcaggtcggagctcggagctgctgcttctggttctcttgtggccgccgtcgctgtccggctgccttgggctgccgaacagacaaggcgtgggccacagcacctcagaagccgacgcagctcgacgcaggggccggcaggagggtgggcgatcgcgtgtcggagggcgccgcgcgggcaggcgggcgggcgccagagggggaaagaggcgggggcggcgggtcagccgctggccgggccggccggggaatgtcgatgcctgacgcgatgccgctgcccggggtcggggaggagctgaagcaggccaaggagatcgaggacgccgagaagtactccttcatggccaccgtcaccaaggcgcccaagaagcaaatccagtttgctgatgacatgcaggagttcaccaaattccccaccaaaactggccgaagatctttgtctcgctcgatctcacagtcctccactgacagctacagttcagctgcatcctacacagatagctctgatgatgaggtttctccccgagagaagcagcaaaccaactccaagggcagcagcaatttctgtgtgaagaacatcaagcaggcagaatttggacgccgggagattgagattgcagagcaagacatgtctgctctgatttcactcaggaaacgtgctcagggggagaagcccttggctggtgctaaaatagtgggctgtacacacatcacagcccagacagcggtgttgattgagacactctgtgccctgggggctcagtgccgctggtctgcttgtaacatctactcaactcagaatgaagtagctgcagcactggctgaggctggagttgcagtgttcgcttggaagggcgagtcagaagatgacttctggtggtgtattgaccgctgtgtgaacatggatgggtggcaggccaacatgatcctggatgatgggggagacttaacccactgggtttataagaagtatccaaacgtgtttaagaagatccgaggcattgtggaagagagcgtgactggtgttcacaggctgtatcagctctccaaagctgggaagctctgtgttccggccatgaacgtcaatgattctgttaccaaacagaagtttgataacttgtactgctgccgagaatccattttggatggcctgaagaggaccacagatgtgatgtttggtgggaaacaagtggtggtgtgtggctatggtgaggtaggcaagggctgctgtgctgctctcaaagctcttggagcaattgtctacattaccgaaatcgaccccatctgtgctctgcaggcctgcatggatgggttcagggtggtaaagctaaatgaagtcatccggcaagtcgatgtcgtaataacttgcacaggaaataagaatgtagtgacacgggagcacttggatcgcatgaaaaacagttgtatcgtatgcaatatgggccactccaacacagaaatcgatgtgaccagcctccgcactccggagctgacgtgggagcgagtacgttctcaggtggaccatgtcatctggccagatggcaaacgagttgtcctcctggcagagggtcgtctactcaatttgagctgctccacagttcccacctttgttctgtccatcacagccacaacacaggctttggcactgatagaactctataatgcacccgaggggcgatacaagcaggatgtgtacttgcttcctaagaaaatggatgaatacgttgccagcttgcatctgccatcatttgatgcccaccttacagagctgacagatgaccaagcaaaatatctgggactcaacaaaaatgggccattcaaacctaattattacagatactaatggaccatactaccaaggaccagtccacctgaaccacacactctaaagaaatattttttaagataacttttattttcttcttactcctttcctcttgatttttttcctataatttcattcttgttttttcatctcattatccaagttctgcagaccacacaggaacttgcttcatggctctttagatgaaatagaagttcagggttcctcactctagtcactaaagaaggattttactctcccagcccagaaaggtgattctttctttaccatttctggggactttagtcttaattaggtaccttattaacaggaaatgctaaggtaccttctctgtggaacaatctgcaatgtctaaatcgccttaaaagagcccatttcttagctgctgaaatcagtgctctttcacttcttcagagaagcagggatggtacctacccggcaggtaggttagatgtgggtggtgcatgttaatttcccttagaagttccaagccctgtttcctgcgtaaaggtggtatgtccagttcagagatgtgtataatgagcatggcttgttaagatcaggaggcccacttggatttatagtatagcccttcctccactcccaccagacttgctcatttttcgagtttttaactagactacactctattgagtttaattttgtcctctaggatttatttctgttgtccaaaaaaaaaaaaaagaaaagaaaaattaaggagaatttttggtgttaatgctgaggaattgcttgagtggttagttgttaccaatttctcttttgaacctttggagctaaggatgctgagtctagagaaatgctagtctcaagccctgttaagtccctctgtttctagcccgtagttcatagcatcagtgaactggagccacaacagcaaattctatcagctgtgtaccatacagcttgtgctgaaggcgaatttcttgagccattactcagtataaagcactgagttctatctttaggatttatctttaagagcaaatttctggtcagctgtgcttctgcaacctaaaatatttaaagggaggtaggtgtgggcaggaggaggaatgataaattgggccagggcaagaaaaatctagcttcatataatttgtctgggactatacaccctatataatgttagttttacagaagtaatatgacttttgattgctacataccacaaagagtttatgaactgagatcataaagggcaactgatgtgtgaagaaagtagtcagtacatcctggctcatgctctgaaagaatatccagagagacagacattaaaaacaaaaatagaagaaaggaaagctttcaccctgcagcttcttagcagggaacaattgtcttgccaaaacttttttcccttttctctcccattttcttttacccaatcccttcttactccttgccagtgtgaccatgctttcttctctgtagatgttaacagttaaggcctattttcctcgggcacttaaccaaccaatcagaacaccacatctgttaggggaggtaacctggccaacagtgtatccatcacgttagccctgctggagggaagggacccacattcacctgccctctgacctgccccttgatcccatatctattaccgtgtccataggaataataggtaagggctctgtctctgtcaagccatgtaacaaaggacactgttaaaaaaaaaaaattttgtattgaatgatttttaatgaatgcaatattaatccttgcagatgagcaataatcattaaaatcgattaaaatgataagaccttaaaagaagac

SEQ ID NO: 299895 - DNA, 3866 bp, Homo sapiens
  misc_feature (196)..(196): n is a, c, g, or t
tggggcttctgactgtggaattggattctagctgtgtgtgttatatcctgttactgttgagacacagaggcgggagtcggcgggggaagatatgtgctgagattagtcagcctgccctccctctcccccaagaaactcaggccccatctggggagagtgagaacttaagaaacttgagacagggaaggagagccgngagcagccaaaacctgctaagtctcagaagactggtttctgcacaagggaatggaagaagtgactggaggtggctgtggattcaactctggcctgagattgattcccttgagataagttgttttctgcaaatccagtttgctgatgacatgcaggagttcaccaaattccccaccaaaactggccgaagatctttgtctcgctcgatctcacagtcctccactgacagctacagttcagctgcatcctacacagatagctctgatgatgaggtttctccccgagagaagcagcaaaccaactccaagggcagcagcaatttctgtgtgaagaacatcaagcaggcagaatttggacgccgggagattgagattgcagagcaagacatgtctgctctgatttcactcaggaaacgtgctcagggggagaagcccttggctggtgctaaaatagtgggctgtacacacatcacagcccagacagcggtgttgattgagacactctgtgccctgggggctcagtgccgctggtctgcttgtaacatctactcaactcagaatgaagtagctgcagcactggctgaggctggagttgcagtgttcgcttggaagggcgagtcagaagatgacttctggtggtgtattgaccgctgtgtgaacatggatgggtggcaggccaacatgatcctggatgatgggggagacttaacccactgggtttataagaagtatccaaacgtgtttaagaagatccgaggcattgtggaagagagcgtgactggtgttcacaggctgtatcagctctccaaagctgggaagctctgtgttccggccatgaacgtcaatgattctgttaccaaacagaagtttgataacttgtactgctgccgagaatccattttggatggcctgaagaggaccacagatgtgatgtttggtgggaaacaagtggtggtgtgtggctatggtgaggtaggcaagggctgctgtgctgctctcaaagctcttggagcaattgtctacattaccgaaatcgaccccatctgtgctctgcaggcctgcatggatgggttcagggtggtaaagctaaatgaagtcatccggcaagtcgatgtcgtaataacttgcacaggaaataagaatgtagtgacacgggagcacttggatcgcatgaaaaacagttgtatcgtatgcaatatgggccactccaacacagaaatcgatgtgaccagcctccgcactccggagctgacgtgggagcgagtacgttctcaggtggaccatgtcatctggccagatggcaaacgagttgtcctcctggcagagggtcgtctactcaatttgagctgctccacagttcccacctttgttctgtccatcacagccacaacacaggctttggcactgatagaactctataatgcacccgaggggcgatacaagcaggatgtgtacttgcttcctaagaaaatggatgaatacgttgccagcttgcatctgccatcatttgatgcccaccttacagagctgacagatgaccaagcaaaatatctgggactcaacaaaaatgggccattcaaacctaattattacagatactaatggaccatactaccaaggaccagtccacctgaaccacacactctaaagaaatattttttaagataacttttattttcttcttactcctttcctcttgatttttttcctataatttcattcttgttttttcatctcattatccaagttctgcagaccacacaggaacttgcttcatggctctttagatgaaatagaagttcagggttcctcactctagtcactaaagaaggattttactctcccagcccagaaaggtgattctttctttaccatttctggggactttagtcttaattaggtaccttattaacaggaaatgctaaggtaccttctctgtggaacaatctgcaatgtctaaatcgccttaaaagagcccatttcttagctgctgaaatcagtgctctttcacttcttcagagaagcagggatggtacctacccggcaggtaggttagatgtgggtggtgcatgttaatttcccttagaagttccaagccctgtttcctgcgtaaaggtggtatgtccagttcagagatgtgtataatgagcatggcttgttaagatcaggaggcccacttggatttatagtatagcccttcctccactcccaccagacttgctcatttttcgagtttttaactagactacactctattgagtttaattttgtcctctaggatttatttctgttgtccaaaaaaaaaaaaaagaaaagaaaaattaaggagaatttttggtgttaatgctgaggaattgcttgagtggttagttgttaccaatttctcttttgaacctttggagctaaggatgctgagtctagagaaatgctagtctcaagccctgttaagtccctctgtttctagcccgtagttcatagcatcagtgaactggagccacaacagcaaattctatcagctgtgtaccatacagcttgtgctgaaggcgaatttcttgagccattactcagtataaagcactgagttctatctttaggatttatctttaagagcaaatttctggtcagctgtgcttctgcaacctaaaatatttaaagggaggtaggtgtgggcaggaggaggaatgataaattgggccagggcaagaaaaatctagcttcatataatttgtctgggactatacaccctatataatgttagttttacagaagtaatatgacttttgattgctacataccacaaagagtttatgaactgagatcataaagggcaactgatgtgtgaagaaagtagtcagtacatcctggctcatgctctgaaagaatatccagagaggctctctcaaagatcagggagatgtattcccatgccatgcaccctgcttcccagcatttctgcatggtcaagtgagctttatgctcatgagctttaagtatataattatccaggattttaaatcctcaacttgttctagcttgtgatccctcaaagttgggtcatacgttagtgctagatactagaaattttcacttttccactgatcagagagacagacattaaaaacaaaaatagaagaaaggaaagctttcaccctgcagcttcttagcagggaacaattgtcttgccaaaacttttttcccttttctctcccattttcttttacccaatcccttcttactccttgccagtgtgaccatgctttcttctctgtagatgttaacagttaaggcctattttcctcgggcacttaaccaaccaatcagaacaccacatctgttaggggaggtaacctggccaacagtgtatccatcacgttagccctgctggagggaagggacccacattcacctgccctctgacctgccccttgatcccatatctattaccgtgtccataggaataataggtaagggctctgtctctgtcaagccatgtaacaaaggacactgttaaaaaaaaaaaaaagtctggcatcagagggagcatgtggagagcaacttgggaagaacaagttcattttgtattgaatgatttttaatgaatgcaatattaatccttgcagatgagcaataatcattaaaatcgattaaaatgataagaccttaaaagaagac

SEQ ID NO: 299896 - DNA, 3703 bp, Homo sapiens
cacaggtgttgaggcaaagcacttaaagtcatataaatctaggcattcaggatcttggtgtccaccctactagtattagcttctaaatactactcccttctaaaagaaaggctcctgagagaaatggttgattccaggtttggagaagaggaagaacaagcaaatccagtttgctgatgacatgcaggagttcaccaaattccccaccaaaactggccgaagatctttgtctcgctcgatctcacagtcctccactgacagctacagttcagctgcatcctacacagatagctctgatgatgaggtttctccccgagagaagcagcaaaccaactccaagggcagcagcaatttctgtgtgaagaacatcaagcaggcagaatttggacgccgggagattgagattgcagagcaagacatgtctgctctgatttcactcaggaaacgtgctcagggggagaagcccttggctggtgctaaaatagtgggctgtacacacatcacagcccagacagcggtgttgattgagacactctgtgccctgggggctcagtgccgctggtctgcttgtaacatctactcaactcagaatgaagtagctgcagcactggctgaggctggagttgcagtgttcgcttggaagggcgagtcagaagatgacttctggtggtgtattgaccgctgtgtgaacatggatgggtggcaggccaacatgatcctggatgatgggggagacttaacccactgggtttataagaagtatccaaacgtgtttaagaagatccgaggcattgtggaagagagcgtgactggtgttcacaggctgtatcagctctccaaagctgggaagctctgtgttccggccatgaacgtcaatgattctgttaccaaacagaagtttgataacttgtactgctgccgagaatccattttggatggcctgaagaggaccacagatgtgatgtttggtgggaaacaagtggtggtgtgtggctatggtgaggtaggcaagggctgctgtgctgctctcaaagctcttggagcaattgtctacattaccgaaatcgaccccatctgtgctctgcaggcctgcatggatgggttcagggtggtaaagctaaatgaagtcatccggcaagtcgatgtcgtaataacttgcacaggaaataagaatgtagtgacacgggagcacttggatcgcatgaaaaacagttgtatcgtatgcaatatgggccactccaacacagaaatcgatgtgaccagcctccgcactccggagctgacgtgggagcgagtacgttctcaggtggaccatgtcatctggccagatggcaaacgagttgtcctcctggcagagggtcgtctactcaatttgagctgctccacagttcccacctttgttctgtccatcacagccacaacacaggctttggcactgatagaactctataatgcacccgaggggcgatacaagcaggatgtgtacttgcttcctaagaaaatggatgaatacgttgccagcttgcatctgccatcatttgatgcccaccttacagagctgacagatgaccaagcaaaatatctgggactcaacaaaaatgggccattcaaacctaattattacagatactaatggaccatactaccaaggaccagtccacctgaaccacacactctaaagaaatattttttaagataacttttattttcttcttactcctttcctcttgatttttttcctataatttcattcttgttttttcatctcattatccaagttctgcagaccacacaggaacttgcttcatggctctttagatgaaatagaagttcagggttcctcactctagtcactaaagaaggattttactctcccagcccagaaaggtgattctttctttaccatttctggggactttagtcttaattaggtaccttattaacaggaaatgctaaggtaccttctctgtggaacaatctgcaatgtctaaatcgccttaaaagagcccatttcttagctgctgaaatcagtgctctttcacttcttcagagaagcagggatggtacctacccggcaggtaggttagatgtgggtggtgcatgttaatttcccttagaagttccaagccctgtttcctgcgtaaaggtggtatgtccagttcagagatgtgtataatgagcatggcttgttaagatcaggaggcccacttggatttatagtatagcccttcctccactcccaccagacttgctcatttttcgagtttttaactagactacactctattgagtttaattttgtcctctaggatttatttctgttgtccaaaaaaaaaaaaaagaaaagaaaaattaaggagaatttttggtgttaatgctgaggaattgcttgagtggttagttgttaccaatttctcttttgaacctttggagctaaggatgctgagtctagagaaatgctagtctcaagccctgttaagtccctctgtttctagcccgtagttcatagcatcagtgaactggagccacaacagcaaattctatcagctgtgtaccatacagcttgtgctgaaggcgaatttcttgagccattactcagtataaagcactgagttctatctttaggatttatctttaagagcaaatttctggtcagctgtgcttctgcaacctaaaatatttaaagggaggtaggtgtgggcaggaggaggaatgataaattgggccagggcaagaaaaatctagcttcatataatttgtctgggactatacaccctatataatgttagttttacagaagtaatatgacttttgattgctacataccacaaagagtttatgaactgagatcataaagggcaactgatgtgtgaagaaagtagtcagtacatcctggctcatgctctgaaagaatatccagagaggctctctcaaagatcagggagatgtattcccatgccatgcaccctgcttcccagcatttctgcatggtcaagtgagctttatgctcatgagctttaagtatataattatccaggattttaaatcctcaacttgttctagcttgtgatccctcaaagttgggtcatacgttagtgctagatactagaaattttcacttttccactgatcagagagacagacattaaaaacaaaaatagaagaaaggaaagctttcaccctgcagcttcttagcagggaacaattgtcttgccaaaacttttttcccttttctctcccattttcttttacccaatcccttcttactccttgccagtgtgaccatgctttcttctctgtagatgttaacagttaaggcctattttcctcgggcacttaaccaaccaatcagaacaccacatctgttaggggaggtaacctggccaacagtgtatccatcacgttagccctgctggagggaagggacccacattcacctgccctctgacctgccccttgatcccatatctattaccgtgtccataggaataataggtaagggctctgtctctgtcaagccatgtaacaaaggacactgttaaaaaaaaaaaaaagtctggcatcagagggagcatgtggagagcaacttgggaagaacaagttcattttgtattgaatgatttttaatgaatgcaatattaatccttgcagatgagcaataatcattaaaatcgattaaaatgataagaccttaaaagaagac

SEQ ID NO: 299897 - DNA, 3775 bp, Homo sapiens
taagcgggctttgcgtgcgtgtttgcgtacagcggaggtggcggcgcgggcaggtcggagctcggagctgctgcttctggttctcttgtggccgccgtcgctgtccggctgccttgggctgccgaacagacaaggcgtgggccacagcacctcagaagccgacgcagctcgacgcaggggccggcaggagggtgggcgatcgcgtgtcggagggcgccgcgcgggcaggcggcaaatccagtttgctgatgacatgcaggagttcaccaaattccccaccaaaactggccgaagatctttgtctcgctcgatctcacagtcctccactgacagctacagttcagctgcatcctacacagatagctctgatgatgaggtttctccccgagagaagcagcaaaccaactccaagggcagcagcaatttctgtgtgaagaacatcaagcaggcagaatttggacgccgggagattgagattgcagagcaagacatgtctgctctgatttcactcaggaaacgtgctcagggggagaagcccttggctggtgctaaaatagtgggctgtacacacatcacagcccagacagcggtgttgattgagacactctgtgccctgggggctcagtgccgctggtctgcttgtaacatctactcaactcagaatgaagtagctgcagcactggctgaggctggagttgcagtgttcgcttggaagggcgagtcagaagatgacttctggtggtgtattgaccgctgtgtgaacatggatgggtggcaggccaacatgatcctggatgatgggggagacttaacccactgggtttataagaagtatccaaacgtgtttaagaagatccgaggcattgtggaagagagcgtgactggtgttcacaggctgtatcagctctccaaagctgggaagctctgtgttccggccatgaacgtcaatgattctgttaccaaacagaagtttgataacttgtactgctgccgagaatccattttggatggcctgaagaggaccacagatgtgatgtttggtgggaaacaagtggtggtgtgtggctatggtgaggtaggcaagggctgctgtgctgctctcaaagctcttggagcaattgtctacattaccgaaatcgaccccatctgtgctctgcaggcctgcatggatgggttcagggtggtaaagctaaatgaagtcatccggcaagtcgatgtcgtaataacttgcacaggaaataagaatgtagtgacacgggagcacttggatcgcatgaaaaacagttgtatcgtatgcaatatgggccactccaacacagaaatcgatgtgaccagcctccgcactccggagctgacgtgggagcgagtacgttctcaggtggaccatgtcatctggccagatggcaaacgagttgtcctcctggcagagggtcgtctactcaatttgagctgctccacagttcccacctttgttctgtccatcacagccacaacacaggctttggcactgatagaactctataatgcacccgaggggcgatacaagcaggatgtgtacttgcttcctaagaaaatggatgaatacgttgccagcttgcatctgccatcatttgatgcccaccttacagagctgacagatgaccaagcaaaatatctgggactcaacaaaaatgggccattcaaacctaattattacagatactaatggaccatactaccaaggaccagtccacctgaaccacacactctaaagaaatattttttaagataacttttattttcttcttactcctttcctcttgatttttttcctataatttcattcttgttttttcatctcattatccaagttctgcagaccacacaggaacttgcttcatggctctttagatgaaatagaagttcagggttcctcactctagtcactaaagaaggattttactctcccagcccagaaaggtgattctttctttaccatttctggggactttagtcttaattaggtaccttattaacaggaaatgctaaggtaccttctctgtggaacaatctgcaatgtctaaatcgccttaaaagagcccatttcttagctgctgaaatcagtgctctttcacttcttcagagaagcagggatggtacctacccggcaggtaggttagatgtgggtggtgcatgttaatttcccttagaagttccaagccctgtttcctgcgtaaaggtggtatgtccagttcagagatgtgtataatgagcatggcttgttaagatcaggaggcccacttggatttatagtatagcccttcctccactcccaccagacttgctcatttttcgagtttttaactagactacactctattgagtttaattttgtcctctaggatttatttctgttgtccaaaaaaaaaaaaaagaaaagaaaaattaaggagaatttttggtgttaatgctgaggaattgcttgagtggttagttgttaccaatttctcttttgaacctttggagctaaggatgctgagtctagagaaatgctagtctcaagccctgttaagtccctctgtttctagcccgtagttcatagcatcagtgaactggagccacaacagcaaattctatcagctgtgtaccatacagcttgtgctgaaggcgaatttcttgagccattactcagtataaagcactgagttctatctttaggatttatctttaagagcaaatttctggtcagctgtgcttctgcaacctaaaatatttaaagggaggtaggtgtgggcaggaggaggaatgataaattgggccagggcaagaaaaatctagcttcatataatttgtctgggactatacaccctatataatgttagttttacagaagtaatatgacttttgattgctacataccacaaagagtttatgaactgagatcataaagggcaactgatgtgtgaagaaagtagtcagtacatcctggctcatgctctgaaagaatatccagagaggctctctcaaagatcagggagatgtattcccatgccatgcaccctgcttcccagcatttctgcatggtcaagtgagctttatgctcatgagctttaagtatataattatccaggattttaaatcctcaacttgttctagcttgtgatccctcaaagttgggtcatacgttagtgctagatactagaaattttcacttttccactgatcagagagacagacattaaaaacaaaaatagaagaaaggaaagctttcaccctgcagcttcttagcagggaacaattgtcttgccaaaacttttttcccttttctctcccattttcttttacccaatcccttcttactccttgccagtgtgaccatgctttcttctctgtagatgttaacagttaaggcctattttcctcgggcacttaaccaaccaatcagaacaccacatctgttaggggaggtaacctggccaacagtgtatccatcacgttagccctgctggagggaagggacccacattcacctgccctctgacctgccccttgatcccatatctattaccgtgtccataggaataataggtaagggctctgtctctgtcaagccatgtaacaaaggacactgttaaaaaaaaaaaaaagtctggcatcagagggagcatgtggagagcaacttgggaagaacaagttcattttgtattgaatgatttttaatgaatgcaatattaatccttgcagatgagcaataatcattaaaatcgattaaaatgataagaccttaaaagaagac

SEQ ID NO: 299898 - DNA, 3710 bp, Homo sapiens
taagcgggctttgcgtgcgtgtttgcgtacagcggaggtggcggcgcgggcaggtcggagctcggagctgctgcttctggttctcttgtggccgccgtcgctgtccggctgccttgggctgccgaacagacaaggcgtgggccacagcacctcagaagccgacgcagcaaatccagtttgctgatgacatgcaggagttcaccaaattccccaccaaaactggccgaagatctttgtctcgctcgatctcacagtcctccactgacagctacagttcagctgcatcctacacagatagctctgatgatgaggtttctccccgagagaagcagcaaaccaactccaagggcagcagcaatttctgtgtgaagaacatcaagcaggcagaatttggacgccgggagattgagattgcagagcaagacatgtctgctctgatttcactcaggaaacgtgctcagggggagaagcccttggctggtgctaaaatagtgggctgtacacacatcacagcccagacagcggtgttgattgagacactctgtgccctgggggctcagtgccgctggtctgcttgtaacatctactcaactcagaatgaagtagctgcagcactggctgaggctggagttgcagtgttcgcttggaagggcgagtcagaagatgacttctggtggtgtattgaccgctgtgtgaacatggatgggtggcaggccaacatgatcctggatgatgggggagacttaacccactgggtttataagaagtatccaaacgtgtttaagaagatccgaggcattgtggaagagagcgtgactggtgttcacaggctgtatcagctctccaaagctgggaagctctgtgttccggccatgaacgtcaatgattctgttaccaaacagaagtttgataacttgtactgctgccgagaatccattttggatggcctgaagaggaccacagatgtgatgtttggtgggaaacaagtggtggtgtgtggctatggtgaggtaggcaagggctgctgtgctgctctcaaagctcttggagcaattgtctacattaccgaaatcgaccccatctgtgctctgcaggcctgcatggatgggttcagggtggtaaagctaaatgaagtcatccggcaagtcgatgtcgtaataacttgcacaggaaataagaatgtagtgacacgggagcacttggatcgcatgaaaaacagttgtatcgtatgcaatatgggccactccaacacagaaatcgatgtgaccagcctccgcactccggagctgacgtgggagcgagtacgttctcaggtggaccatgtcatctggccagatggcaaacgagttgtcctcctggcagagggtcgtctactcaatttgagctgctccacagttcccacctttgttctgtccatcacagccacaacacaggctttggcactgatagaactctataatgcacccgaggggcgatacaagcaggatgtgtacttgcttcctaagaaaatggatgaatacgttgccagcttgcatctgccatcatttgatgcccaccttacagagctgacagatgaccaagcaaaatatctgggactcaacaaaaatgggccattcaaacctaattattacagatactaatggaccatactaccaaggaccagtccacctgaaccacacactctaaagaaatattttttaagataacttttattttcttcttactcctttcctcttgatttttttcctataatttcattcttgttttttcatctcattatccaagttctgcagaccacacaggaacttgcttcatggctctttagatgaaatagaagttcagggttcctcactctagtcactaaagaaggattttactctcccagcccagaaaggtgattctttctttaccatttctggggactttagtcttaattaggtaccttattaacaggaaatgctaaggtaccttctctgtggaacaatctgcaatgtctaaatcgccttaaaagagcccatttcttagctgctgaaatcagtgctctttcacttcttcagagaagcagggatggtacctacccggcaggtaggttagatgtgggtggtgcatgttaatttcccttagaagttccaagccctgtttcctgcgtaaaggtggtatgtccagttcagagatgtgtataatgagcatggcttgttaagatcaggaggcccacttggatttatagtatagcccttcctccactcccaccagacttgctcatttttcgagtttttaactagactacactctattgagtttaattttgtcctctaggatttatttctgttgtccaaaaaaaaaaaaaagaaaagaaaaattaaggagaatttttggtgttaatgctgaggaattgcttgagtggttagttgttaccaatttctcttttgaacctttggagctaaggatgctgagtctagagaaatgctagtctcaagccctgttaagtccctctgtttctagcccgtagttcatagcatcagtgaactggagccacaacagcaaattctatcagctgtgtaccatacagcttgtgctgaaggcgaatttcttgagccattactcagtataaagcactgagttctatctttaggatttatctttaagagcaaatttctggtcagctgtgcttctgcaacctaaaatatttaaagggaggtaggtgtgggcaggaggaggaatgataaattgggccagggcaagaaaaatctagcttcatataatttgtctgggactatacaccctatataatgttagttttacagaagtaatatgacttttgattgctacataccacaaagagtttatgaactgagatcataaagggcaactgatgtgtgaagaaagtagtcagtacatcctggctcatgctctgaaagaatatccagagaggctctctcaaagatcagggagatgtattcccatgccatgcaccctgcttcccagcatttctgcatggtcaagtgagctttatgctcatgagctttaagtatataattatccaggattttaaatcctcaacttgttctagcttgtgatccctcaaagttgggtcatacgttagtgctagatactagaaattttcacttttccactgatcagagagacagacattaaaaacaaaaatagaagaaaggaaagctttcaccctgcagcttcttagcagggaacaattgtcttgccaaaacttttttcccttttctctcccattttcttttacccaatcccttcttactccttgccagtgtgaccatgctttcttctctgtagatgttaacagttaaggcctattttcctcgggcacttaaccaaccaatcagaacaccacatctgttaggggaggtaacctggccaacagtgtatccatcacgttagccctgctggagggaagggacccacattcacctgccctctgacctgccccttgatcccatatctattaccgtgtccataggaataataggtaagggctctgtctctgtcaagccatgtaacaaaggacactgttaaaaaaaaaaaaaagtctggcatcagagggagcatgtggagagcaacttgggaagaacaagttcattttgtattgaatgatttttaatgaatgcaatattaatccttgcagatgagcaataatcattaaaatcgattaaaatgataagaccttaaaagaagac

SEQ ID NO: 299899 - DNA, 3838 bp, Homo sapiens
taagcgggctttgcgtgcgtgtttgcgtacagcggaggtggcggcgcgggcaggtcggagctcggagctgctgcttctggttctcttgtggccgccgtcgctgtccggctgccttgggctgccgaacagacaaggcgtgggccacagcacctcagaagccgacgcagctcgacgcaggggccggcaggagggtgggcgatcgcgtgtcggagggcgccgcgcgggcaggcgggcgggcgccagagggggaaagaggcgggggcggcgggtcagccgctggccgggccggccggggaatgtcgatgcctgacgcgatgccgctgcccggggtcggggaggagctgaagcaggccaaggagatcgaggacgccgagaagtactccttcatggccaccgtcaccaaggcgcccaagaagcaaatccagtttgctgatgacatgcaggagttcaccaaattccccaccaaaactggccgaagatctttgtctcgctcgatctcacagtcctccactgacagctacagttcagctgcatcctacacagatagctctgatgatgaggtttctccccgagagaagcagcaaaccaactccaagggcagcagcaatttctgtgtgaagaacatcaagcaggcagaatttggacgccgggagattgagattgcagagcaagacatgtctgctctgatttcactcaggaaacgtgctcagggggagaagcccttggctggtgctaaaatagtgggctgtacacacatcacagcccagacagcggtgttgattgagacactctgtgccctgggggctcagtgccgctggtctgcttgtaacatctactcaactcagaatgaagtagctgcagcactggctgaggctggagttgcagtgttcgcttggaagggcgagtcagaagatgacttctggtggtgtattgaccgctgtgtgaacatggatgggtggcaggccaacatgatcctggatgatgggggagacttaacccactgggtttataagaagtatccaaacgtgtttaagaagatccgaggcattgtggaagagagcgtgactggtgttcacaggctgtatcagctctccaaagctgggaagctctgtgttccggccatgaacgtcaatgattctgttaccaaacagaagtttgataacttgtactgctgccgagaatccattttggatggcctgaagaggaccacagatgtgatgtttggtgggaaacaagtggtggtgtgtggctatggtgaggtaggcaagggctgctgtgctgctctcaaagctcttggagcaattgtctacattaccgaaatcgaccccatctgtgctctgcaggcctgcatggatgggttcagggtggtaaagctaaatgaagtcatccggcaagtcgatgtcgtaataacttgcacaggaaataagaatgtagtgacacgggagcacttggatcgcatgaaaaacagttgtatcgtatgcaatatgggccactccaacacagaaatcgatgtgaccagcctccgcactccggagctgacgtgggagcgagtacgttctcaggtggaccatgtcatctggccagatggcaaacgagttgtcctcctggcagagggtcgtctactcaatttgagctgctccacagttcccacctttgttctgtccatcacagccacaacacaggctttggcactgatagaactctataatgcacccgaggggcgatacaagcaggatgtgtacttgcttcctaagaaaatggatactaatggaccatactaccaaggaccagtccacctgaaccacacactctaaagaaatattttttaagataacttttattttcttcttactcctttcctcttgatttttttcctataatttcattcttgttttttcatctcattatccaagttctgcagaccacacaggaacttgcttcatggctctttagatgaaatagaagttcagggttcctcactctagtcactaaagaaggattttactctcccagcccagaaaggtgattctttctttaccatttctggggactttagtcttaattaggtaccttattaacaggaaatgctaaggtaccttctctgtggaacaatctgcaatgtctaaatcgccttaaaagagcccatttcttagctgctgaaatcagtgctctttcacttcttcagagaagcagggatggtacctacccggcaggtaggttagatgtgggtggtgcatgttaatttcccttagaagttccaagccctgtttcctgcgtaaaggtggtatgtccagttcagagatgtgtataatgagcatggcttgttaagatcaggaggcccacttggatttatagtatagcccttcctccactcccaccagacttgctcatttttcgagtttttaactagactacactctattgagtttaattttgtcctctaggatttatttctgttgtccaaaaaaaaaaaaaagaaaagaaaaattaaggagaatttttggtgttaatgctgaggaattgcttgagtggttagttgttaccaatttctcttttgaacctttggagctaaggatgctgagtctagagaaatgctagtctcaagccctgttaagtccctctgtttctagcccgtagttcatagcatcagtgaactggagccacaacagcaaattctatcagctgtgtaccatacagcttgtgctgaaggcgaatttcttgagccattactcagtataaagcactgagttctatctttaggatttatctttaagagcaaatttctggtcagctgtgcttctgcaacctaaaatatttaaagggaggtaggtgtgggcaggaggaggaatgataaattgggccagggcaagaaaaatctagcttcatataatttgtctgggactatacaccctatataatgttagttttacagaagtaatatgacttttgattgctacataccacaaagagtttatgaactgagatcataaagggcaactgatgtgtgaagaaagtagtcagtacatcctggctcatgctctgaaagaatatccagagaggctctctcaaagatcagggagatgtattcccatgccatgcaccctgcttcccagcatttctgcatggtcaagtgagctttatgctcatgagctttaagtatataattatccaggattttaaatcctcaacttgttctagcttgtgatccctcaaagttgggtcatacgttagtgctagatactagaaattttcacttttccactgatcagagagacagacattaaaaacaaaaatagaagaaaggaaagctttcaccctgcagcttcttagcagggaacaattgtcttgccaaaacttttttcccttttctctcccattttcttttacccaatcccttcttactccttgccagtgtgaccatgctttcttctctgtagatgttaacagttaaggcctattttcctcgggcacttaaccaaccaatcagaacaccacatctgttaggggaggtaacctggccaacagtgtatccatcacgttagccctgctggagggaagggacccacattcacctgccctctgacctgccccttgatcccatatctattaccgtgtccataggaataataggtaagggctctgtctctgtcaagccatgtaacaaaggacactgttaaaaaaaaaaaaaagtctggcatcagagggagcatgtggagagcaacttgggaagaacaagttcattttgtattgaatgatttttaatgaatgcaatattaatccttgcagatgagcaataatcattaaaatcgattaaaatgataagaccttaaaagaagac

SEQ ID NO: 299900 - DNA, 3890 bp, Homo sapiens
taagcgggctttgcgtgcgtgtttgcgtacagcggaggtggcggcgcgggcaggtcggagctcggagctgctgcttctggttctcttgtggccgccgtcgctgtccggctgccttgggctgccgaacagacaaggcgtgggccacagcacctcagaagccgacgcagctcgacgcaggggccggcaggagggtgggcgatcgcgtgtcggagggcgccgcgcgggcaggcgggcgggcgccagagggggaaagaggcgggggcggcgggtcagccgctggccgggccggccggggaatgtcgatgcctgacgcgatgccgctgcccggggtcggggaggagctgaagcaggccaaggagatcgaggacgccgagaagtactccttcatggccaccgtcaccaaggcgcccaagaagcaaatccagtttgctgatgacatgcaggagttcaccaaattccccaccaaaactggccgaagatctttgtctcgctcgatctcacagtcctccactgacagctacagttcagctgcatcctacacagatagctctgatgatgaggtttctccccgagagaagcagcaaaccaactccaagggcagcagcaatttctgtgtgaagaacatcaagcaggcagaatttggacgccgggagattgagattgcagagcaagacatgtctgctctgatttcactcaggaaacgtgctcagggggagaagcccttggctggtgctaaaatagtgggctgtacacacatcacagcccagacagcggtgttgattgagacactctgtgccctgggggctcagtgccgctggtctgcttgtaacatctactcaactcagaatgaagtagctgcagcactggctgaggctggagttgcagtgttcgcttggaagggcgagtcagaagatgacttctggtggtgtattgaccgctgtgtgaacatggatgggtggcaggccaacatgatcctggatgatgggggagacttaacccactgggtttataagaagtatccaaacgtgtttaagaagatccgaggcattgtggaagagagcgtgactggtgttcacaggctgtatcagctctccaaagctgggaagctctgtgttccggccatgaacgtcaatgattctgttaccaaacagaagtttgataacttgtactgctgccgagaatccattttggatggcctgaagaggaccacagatgtgatgtttggtgggaaacaagtggtggtgtgtggctatggtgaggtaggcaagggctgctgtgctgctctcaaagctcttggagcaattgtctacattaccgaaatcgaccccatctgtgctctgcaggcctgcatggatgggttcagggtggtaaagctaaatgaagtcatccggcaagtcgatgtcgtaataacttgcacaggaaataagaatgtagtgacacgggagcacttggatcgcatgaaaaacagttgtatcgtatgcaatatgggccactccaacacagaaatcgatgtgaccagcctccgcactccggagctgacgtgggagcgagtacgttctcaggtggaccatgtcatctggccagatggcaaacgagttgtcctcctggcagaggctttggcactgatagaactctataatgcacccgaggggcgatacaagcaggatgtgtacttgcttcctaagaaaatggatgaatacgttgccagcttgcatctgccatcatttgatgcccaccttacagagctgacagatgaccaagcaaaatatctgggactcaacaaaaatgggccattcaaacctaattattacagatactaatggaccatactaccaaggaccagtccacctgaaccacacactctaaagaaatattttttaagataacttttattttcttcttactcctttcctcttgatttttttcctataatttcattcttgttttttcatctcattatccaagttctgcagaccacacaggaacttgcttcatggctctttagatgaaatagaagttcagggttcctcactctagtcactaaagaaggattttactctcccagcccagaaaggtgattctttctttaccatttctggggactttagtcttaattaggtaccttattaacaggaaatgctaaggtaccttctctgtggaacaatctgcaatgtctaaatcgccttaaaagagcccatttcttagctgctgaaatcagtgctctttcacttcttcagagaagcagggatggtacctacccggcaggtaggttagatgtgggtggtgcatgttaatttcccttagaagttccaagccctgtttcctgcgtaaaggtggtatgtccagttcagagatgtgtataatgagcatggcttgttaagatcaggaggcccacttggatttatagtatagcccttcctccactcccaccagacttgctcatttttcgagtttttaactagactacactctattgagtttaattttgtcctctaggatttatttctgttgtccaaaaaaaaaaaaaagaaaagaaaaattaaggagaatttttggtgttaatgctgaggaattgcttgagtggttagttgttaccaatttctcttttgaacctttggagctaaggatgctgagtctagagaaatgctagtctcaagccctgttaagtccctctgtttctagcccgtagttcatagcatcagtgaactggagccacaacagcaaattctatcagctgtgtaccatacagcttgtgctgaaggcgaatttcttgagccattactcagtataaagcactgagttctatctttaggatttatctttaagagcaaatttctggtcagctgtgcttctgcaacctaaaatatttaaagggaggtaggtgtgggcaggaggaggaatgataaattgggccagggcaagaaaaatctagcttcatataatttgtctgggactatacaccctatataatgttagttttacagaagtaatatgacttttgattgctacataccacaaagagtttatgaactgagatcataaagggcaactgatgtgtgaagaaagtagtcagtacatcctggctcatgctctgaaagaatatccagagaggctctctcaaagatcagggagatgtattcccatgccatgcaccctgcttcccagcatttctgcatggtcaagtgagctttatgctcatgagctttaagtatataattatccaggattttaaatcctcaacttgttctagcttgtgatccctcaaagttgggtcatacgttagtgctagatactagaaattttcacttttccactgatcagagagacagacattaaaaacaaaaatagaagaaaggaaagctttcaccctgcagcttcttagcagggaacaattgtcttgccaaaacttttttcccttttctctcccattttcttttacccaatcccttcttactccttgccagtgtgaccatgctttcttctctgtagatgttaacagttaaggcctattttcctcgggcacttaaccaaccaatcagaacaccacatctgttaggggaggtaacctggccaacagtgtatccatcacgttagccctgctggagggaagggacccacattcacctgccctctgacctgccccttgatcccatatctattaccgtgtccataggaataataggtaagggctctgtctctgtcaagccatgtaacaaaggacactgttaaaaaaaaaaaaaagtctggcatcagagggagcatgtggagagcaacttgggaagaacaagttcattttgtattgaatgatttttaatgaatgcaatattaatccttgcagatgagcaataatcattaaaatcgattaaaatgataagaccttaaaagaagac

SEQ ID NO: 299901 - DNA, 3724 bp, Homo sapiens
ttaatggtcgatgtcctgacgcgaattccggctgccatgtggttcgggtacaggatgctgatgactagagctcaggttaatgaatcgtagtgcatgactcgcagaaagttacttccgttcagtggtccatcgctcacctgaaggtcgcccgaagcaacgcaaagtccaggtttgctgataacattgcaggcgagtttcaccgaagattctccttaccaaaatacgtggtggcgcacgttcttttggatcatcgctcgatctcacagtcctcctactgacagctactagttcagctgcatcctacacagatagctctgatgatgaggtttctccccgagagaagcagcaaaccaactccaagggcagcagcaatttctgtgtgaagaacatcaagcaggcagaatttggacgccgggagattgagattgcagagcaagacatgtctgctctgatttcactcaggaaacgtgctcagggggagaagcccttggctggtgctaaaatagtgggctgtacacacatcacagcccagacagcggtgttgattgagacactctgtgccctgggggctcagtgccgctggtctgcttgtaacatctactcaactcagaatgaagtagctgcagcactggctgaggctggagttgcagtgttcgcttggaagggcgagtcagaagatgacttctggtggtgtattgaccgctgtgtgaacatggatgggtggcaggccaacatgatcctggatgatgggggagacttaacccactgggtttataagaagtatccaaacgtgtttaagaagatccgaggcattgtggaagagagcgtgactggtgttcacaggctgtatcagctctccaaagctgggaagctctgtgttccggccatgaacgtcaatgattctgttaccaaacagaagtttgataacttgtactgctgccgagaatccattttggatggcctgaagaggaccacagatgtgatgtttggtgggaaacaagtggtggtgtgtggctatggtgaggtaggcaagggctgctgtgctgctctcaaagctcttggagcaattgtctacattaccgaaatcgaccccatctgtgctctgcaggcctgcatggatgggttcagggtggtaaagctaaatgaagtcatccggcaagtcgatgtcgtaataacttgcacaggaaataagaatgtagtgacacgggagcacttggatcgcatgaaaaacagttgtatcgtatgcaatatgggccactccaacacagaaatcgatgtgaccagcctccgcactccggagctgacgtgggagcgagtacgttctcaggtggaccatgtcatctggccagatggcaaacgagttgtcctcctggcagagggtcgtctactcaatttgagctgctccacagttcccacctttgttctgtccatcacagccacaacacaggctttggcactgatagaactctataatgcacccgaggggcgatacaagcaggatgtgtacttgcttcctaagaaaatggatgaatacgttgccagcttgcatctgccatcatttgatgcccaccttacagagctgacagatgaccaagcaaaatatctgggactcaacaaaaatgggccattcaaacctaattattacagatactaatggaccatactaccaaggaccagtccacctgaaccacacactctaaagaaatattttttaagataacttttattttcttcttactcctttcctcttgatttttttcctataatttcattcttgttttttcatctcattatccaagttctgcagaccacacaggaacttgcttcatggctctttagatgaaatagaagttcagggttcctcactctagtcactaaagaaggattttactctcccagcccagaaaggtgattctttctttaccatttctggggactttagtcttaattaggtaccttattaacaggaaatgctaaggtaccttctctgtggaacaatctgcaatgtctaaatcgccttaaaagagcccatttcttagctgctgaaatcagtgctctttcacttcttcagagaagcagggatggtacctacccggcaggtaggttagatgtgggtggtgcatgttaatttcccttagaagttccaagccctgtttcctgcgtaaaggtggtatgtccagttcagagatgtgtataatgagcatggcttgttaagatcaggaggcccacttggatttatagtatagcccttcctccactcccaccagacttgctcatttttcgagtttttaactagactacactctattgagtttaattttgtcctctaggatttatttctgttgtccaaaaaaaaaaaaaagaaaagaaaaattaaggagaatttttggtgttaatgctgaggaattgcttgagtggttagttgttaccaatttctcttttgaacctttggagctaaggatgctgagtctagagaaatgctagtctcaagccctgttaagtccctctgtttctagcccgtagttcatagcatcagtgaactggagccacaacagcaaattctatcagctgtgtaccatacagcttgtgctgaaggcgaatttcttgagccattactcagtataaagcactgagttctatctttaggatttatctttaagagcaaatttctggtcagctgtgcttctgcaacctaaaatatttaaagggaggtaggtgtgggcaggaggaggaatgataaattgggccagggcaagaaaaatctagcttcatataatttgtctgggactatacaccctatataatgttagttttacagaagtaatatgacttttgattgctacataccacaaagagtttatgaactgagatcataaagggcaactgatgtgtgaagaaagtagtcagtacatcctggctcatgctctgaaagaatatccagagaggctctctcaaagatcagggagatgtattcccatgccatgcaccctgcttcccagcatttctgcatggtcaagtgagctttatgctcatgagctttaagtatataattatccaggattttaaatcctcaacttgttctagcttgtgatccctcaaagttgggtcatacgttagtgctagatactagaaattttcacttttccactgatcagagagacagacattaaaaacaaaaatagaagaaaggaaagctttcaccctgcagcttcttagcagggaacaattgtcttgccaaaacttttttcccttttctctcccattttcttttacccaatcccttcttactccttgccagtgtgaccatgctttcttctctgtagatgttaacagttaaggcctattttcctcgggcacttaaccaaccaatcagaacaccacatctgttaggggaggtaacctggccaacagtgtatccatcacgttagccctgctggagggaagggacccacattcacctgccctctgacctgccccttgatcccatatctattaccgtgtccataggaataataggtaagggctctgtctctgtcaagccatgtaacaaaggacactgttaaaaaaaaaaaaaagtctggcatcagagggagcatgtggagagcaacttgggaagaacaagttcattttgtattgaatgatttttaatgaatgcaatattaatccttgcagatgagcaataatcattaaaatcgattaaaatgataagaccttaaaagaagac

SEQ ID NO: 299902 - DNA, 3657 bp, Homo sapiens
aagataggactaggtagcgtcggtcagtgtattagacattcgtgcactaggcctttagtggcgccctgtcatcaaggtcgcccataaaagccatactccagttatgttgactaacactgcgagcgacgttcaccaaagttaccccaccaaaactgtgccgccgtttttattataatggctcgattctcagatgatcctctatctgacatgcctacaggagtcacgtctgcatcctacacagatagctctgatgatgaggtttctccccgagagaagcagcaaaccaactccaagggcagcagcaatttctgtgtgaagaacatcaagcaggcagaatttggacgccgggagattgagattgcagagcaagacatgtctgctctgatttcactcaggaaacgtgctcagggggagaagcccttggctggtgctaaaatagtgggctgtacacacatcacagcccagacagcggtgttgattgagacactctgtgccctgggggctcagtgccgctggtctgcttgtaacatctactcaactcagaatgaagtagctgcagcactggctgaggctggagttgcagtgttcgcttggaagggcgagtcagaagatgacttctggtggtgtattgaccgctgtgtgaacatggatgggtggcaggccaacatgatcctggatgatgggggagacttaacccactgggtttataagaagtatccaaacgtgtttaagaagatccgaggcattgtggaagagagcgtgactggtgttcacaggctgtatcagctctccaaagctgggaagctctgtgttccggccatgaacgtcaatgattctgttaccaaacagaagtttgataacttgtactgctgccgagaatccattttggatggcctgaagaggaccacagatgtgatgtttggtgggaaacaagtggtggtgtgtggctatggtgaggtaggcaagggctgctgtgctgctctcaaagctcttggagcaattgtctacattaccgaaatcgaccccatctgtgctctgcaggcctgcatggatgggttcagggtggtaaagctaaatgaagtcatccggcaagtcgatgtcgtaataacttgcacaggaaataagaatgtagtgacacgggagcacttggatcgcatgaaaaacagttgtatcgtatgcaatatgggccactccaacacagaaatcgatgtgaccagcctccgcactccggagctgacgtgggagcgagtacgttctcaggtggaccatgtcatctggccagatggcaaacgagttgtcctcctggcagagggtcgtctactcaatttgagctgctccacagttcccacctttgttctgtccatcacagccacaacacaggctttggcactgatagaactctataatgcacccgaggggcgatacaagcaggatgtgtacttgcttcctaagaaaatggatgaatacgttgccagcttgcatctgccatcatttgatgcccaccttacagagctgacagatgaccaagcaaaatatctgggactcaacaaaaatgggccattcaaacctaattattacagatactaatggaccatactaccaaggaccagtccacctgaaccacacactctaaagaaatattttttaagataacttttattttcttcttactcctttcctcttgatttttttcctataatttcattcttgttttttcatctcattatccaagttctgcagaccacacaggaacttgcttcatggctctttagatgaaatagaagttcagggttcctcactctagtcactaaagaaggattttactctcccagcccagaaaggtgattctttctttaccatttctggggactttagtcttaattaggtaccttattaacaggaaatgctaaggtaccttctctgtggaacaatctgcaatgtctaaatcgccttaaaagagcccatttcttagctgctgaaatcagtgctctttcacttcttcagagaagcagggatggtacctacccggcaggtaggttagatgtgggtggtgcatgttaatttcccttagaagttccaagccctgtttcctgcgtaaaggtggtatgtccagttcagagatgtgtataatgagcatggcttgttaagatcaggaggcccacttggatttatagtatagcccttcctccactcccaccagacttgctcatttttcgagtttttaactagactacactctattgagtttaattttgtcctctaggatttatttctgttgtccaaaaaaaaaaaaaagaaaagaaaaattaaggagaatttttggtgttaatgctgaggaattgcttgagtggttagttgttaccaatttctcttttgaacctttggagctaaggatgctgagtctagagaaatgctagtctcaagccctgttaagtccctctgtttctagcccgtagttcatagcatcagtgaactggagccacaacagcaaattctatcagctgtgtaccatacagcttgtgctgaaggcgaatttcttgagccattactcagtataaagcactgagttctatctttaggatttatctttaagagcaaatttctggtcagctgtgcttctgcaacctaaaatatttaaagggaggtaggtgtgggcaggaggaggaatgataaattgggccagggcaagaaaaatctagcttcatataatttgtctgggactatacaccctatataatgttagttttacagaagtaatatgacttttgattgctacataccacaaagagtttatgaactgagatcataaagggcaactgatgtgtgaagaaagtagtcagtacatcctggctcatgctctgaaagaatatccagagaggctctctcaaagatcagggagatgtattcccatgccatgcaccctgcttcccagcatttctgcatggtcaagtgagctttatgctcatgagctttaagtatataattatccaggattttaaatcctcaacttgttctagcttgtgatccctcaaagttgggtcatacgttagtgctagatactagaaattttcacttttccactgatcagagagacagacattaaaaacaaaaatagaagaaaggaaagctttcaccctgcagcttcttagcagggaacaattgtcttgccaaaacttttttcccttttctctcccattttcttttacccaatcccttcttactccttgccagtgtgaccatgctttcttctctgtagatgttaacagttaaggcctattttcctcgggcacttaaccaaccaatcagaacaccacatctgttaggggaggtaacctggccaacagtgtatccatcacgttagccctgctggagggaagggacccacattcacctgccctctgacctgccccttgatcccatatctattaccgtgtccataggaataataggtaagggctctgtctctgtcaagccatgtaacaaaggacactgttaaaaaaaaaaaaaagtctggcatcagagggagcatgtggagagcaacttgggaagaacaagttcattttgtattgaatgatttttaatgaatgcaatattaatccttgcagatgagcaataatcattaaaatcgattaaaatgataagaccttaaaagaagac

SEQ ID NO: 299903 - DNA, 3696 bp, Homo sapiens
taagcgggctttgcgtgcgtgtttgcgtacagcggaggtggcggcgcgggcaggtcggagctcggagctgctgcttctggttctcttgtggccgccgtcgctgtccggctgccttgggctgccgaacagacaaggcgtgggccacagcacctcagaagccgacgcagctcgacgcaggggccggcaggagggtgggcgatcgcgtgtcggagggcgccgcgcgggcaggcgggcgggcgccagagggggaaagaggcgggggcggcgggtcagccgctggccgggccggccggggaatgtcgatgcctgacgcgatgccgctgcccggggtcggggaggagctgaagcaggccaaggagatcgaggacgccgagaagtactccttcatggccaccgtcaccaaggcgcccaagaagcaaatccagtttgctgatgacatgcaggagttcaccaaattccccaccaaaactggccgaagatctttgtctcgctcgatctcacagtcctccactgacagctacagttcagctgcatcctacacagatagctctgatgatgaggtttctccccgagagaagcagcaaaccaactccaagggcagcagcaatttctgtgtgaagaacatcaagcaggcagaatttggacgccgggagattgagattgcagagcaagacatgtctgctctgatttcactcaggaaacgtgctcagggggagaagcccttggctggtgctaaaatagtgggctgtacacacatcacagcccagacagcggtgttgattgagacactctgtgccctgggggctcagtgccgctggtctgcttgtaacatctactcaactcagaatgaagtagctgcagcactggctgaggctggagttgcagtgttcgcttggaagggcgagtcagaagatgacttctggtggtgtattgaccgctgtgtgaacatggatgggtggcaggccaacatgatcctggatgatgggggagacttaacccactgggtttataagaagtatccaaacgtgtttaagaagatccgaggcattgtggaagagagcgtgactggtgttcacaggctgtatcagctctccaaagctgggaagctctgtgttccggccatgaacgtcaatgattctgttaccaaacagaagtttgataacttgtactgctgccgagaatccattttggatggcctgaagaggaccacagatgtgatgtttggtgggaaacaagtggtggtgtgtggctatggtgaggtaggcaagggctgctgtgctgctctcaaagctcttggagcaattgtctacattaccgaaatcgaccccatctgtgctctgcaggcctgcatggatgggttcagggtggtaaagctaaatgaagtcatccggcaagtcgatgtcgtaataacttgcacaggctttggcactgatagaactctataatgcacccgaggggcgatacaagcaggatgtgtacttgcttcctaagaaaatggatgaatacgttgccagcttgcatctgccatcatttgatgcccaccttacagagctgacagatgaccaagcaaaatatctgggactcaacaaaaatgggccattcaaacctaattattacagatactaatggaccatactaccaaggaccagtccacctgaaccacacactctaaagaaatattttttaagataacttttattttcttcttactcctttcctcttgatttttttcctataatttcattcttgttttttcatctcattatccaagttctgcagaccacacaggaacttgcttcatggctctttagatgaaatagaagttcagggttcctcactctagtcactaaagaaggattttactctcccagcccagaaaggtgattctttctttaccatttctggggactttagtcttaattaggtaccttattaacaggaaatgctaaggtaccttctctgtggaacaatctgcaatgtctaaatcgccttaaaagagcccatttcttagctgctgaaatcagtgctctttcacttcttcagagaagcagggatggtacctacccggcaggtaggttagatgtgggtggtgcatgttaatttcccttagaagttccaagccctgtttcctgcgtaaaggtggtatgtccagttcagagatgtgtataatgagcatggcttgttaagatcaggaggcccacttggatttatagtatagcccttcctccactcccaccagacttgctcatttttcgagtttttaactagactacactctattgagtttaattttgtcctctaggatttatttctgttgtccaaaaaaaaaaaaaagaaaagaaaaattaaggagaatttttggtgttaatgctgaggaattgcttgagtggttagttgttaccaatttctcttttgaacctttggagctaaggatgctgagtctagagaaatgctagtctcaagccctgttaagtccctctgtttctagcccgtagttcatagcatcagtgaactggagccacaacagcaaattctatcagctgtgtaccatacagcttgtgctgaaggcgaatttcttgagccattactcagtataaagcactgagttctatctttaggatttatctttaagagcaaatttctggtcagctgtgcttctgcaacctaaaatatttaaagggaggtaggtgtgggcaggaggaggaatgataaattgggccagggcaagaaaaatctagcttcatataatttgtctgggactatacaccctatataatgttagttttacagaagtaatatgacttttgattgctacataccacaaagagtttatgaactgagatcataaagggcaactgatgtgtgaagaaagtagtcagtacatcctggctcatgctctgaaagaatatccagagaggctctctcaaagatcagggagatgtattcccatgccatgcaccctgcttcccagcatttctgcatggtcaagtgagctttatgctcatgagctttaagtatataattatccaggattttaaatcctcaacttgttctagcttgtgatccctcaaagttgggtcatacgttagtgctagatactagaaattttcacttttccactgatcagagagacagacattaaaaacaaaaatagaagaaaggaaagctttcaccctgcagcttcttagcagggaacaattgtcttgccaaaacttttttcccttttctctcccattttcttttacccaatcccttcttactccttgccagtgtgaccatgctttcttctctgtagatgttaacagttaaggcctattttcctcgggcacttaaccaaccaatcagaacaccacatctgttaggggaggtaacctggccaacagtgtatccatcacgttagccctgctggagggaagggacccacattcacctgccctctgacctgccccttgatcccatatctattaccgtgtccataggaataataggtaagggctctgtctctgtcaagccatgtaacaaaggacactgttaaaaaaaaaaaaaagtctggcatcagagggagcatgtggagagcaacttgggaagaacaagttcattttgtattgaatgatttttaatgaatgcaatattaatccttgcagatgagcaataatcattaaaatcgattaaaatgataagaccttaaaagaagac

SEQ ID NO: 299904 - DNA, 4204 bp, Homo sapiens
caaatattaggcctatgtttccctgaattttatctttggagagagagatatttcacaaattggtccccaaaataaaaccactttaaaaaaatctactttttactaagtaacactatttcctaaccacagctgattctttaacctttcagactcagatggatttgcagaaaataggaaaaagcctagagtcctgatctggaactgtaattcttcctcttccaactgagtctagaggggtgtaaagtcctctcccgctttggcttgacttgtatgccattggaatctgagacagagctcatcccagggctctctcttacctttccagggtcgtctactcaatttgagctgctccacagttcccacctttgttctgtccatcacagccacaacacaggtatgtggcaaaatgcctgcttacactgcactgcaatttgtggaactgggcgtagatcagttccagtgagggtgtactgtactatgttctcatcatcctattcttttttgatgtaataaattatggaaacaggtattcttaagtatagaaaagagtcactaagtcagtattcgttgaattggctgttttagttgagaatataatgttccagcttagttttatttgatttgttctttcgttaggaactaaacaaaaacaacaaatcctcttaggatgtgtgctgccctttagtataggcaaagtcctaggtactgtgactgtggtagatcactgtagtacttacccaaatgctgtttaacctggttttatttttatgtgcctgtctaagaaatatttttgtgctttctggccttcttttcccaccttaggctttggcactgatagaactctataatgcacccgaggggcgatacaagcaggatgtgtacttgcttcctaagaaaatgggtgagtgaaaaacagtggaaatctatgcagacagctgcatagtttggtaaaatgactgccatgaaaggcattggatttagagtcagagttccaattcctgttcctgtgcttactggttgtttgacctcaggacaagttctaatctctatgatcctcagtttcttgattggtaaaatgaaaataatactacatacattgtagaattgtgtgagaatcacagctaatgagtaacagtgcttaacacaatggtttagggagatgttcttactctaagtagccttatgaagttcagtaaacttcccagtgcagctgagtacatacagccttggaacaaaatgagagaaacaaacacaggttttattgtccattttctgtgaggatatgcaaaccatccaatctcttgtaagcaacccatgctgtgttcatgtgacataatacatcatctctagtcctttgcctttctgcacggtgtacccatctcccatatctccttggctagcccaaatccctgacttcttaatgctaaaatacttcttgctctcctctcctccaatagcttacttcagactttttttttcagtgtataattataaaagggaagcttatctatggaaaagtaaaaattctgtgccgactaccttagaaattcatgatcctaagatccatggatcttatcctaaatgagtgttattgacacagggtctttctagcttactggtgtccactttgattgctaatttgactataatctagttaaggaggttgctgcaggaaggtaggagtagcatgtgacatgtgggccactgcagggaagccccctgctttgccagagaaggatagagaggtaaaagcccactcccttttgttaccctggtaagtggcttttctgaacgcactgtacatgtgctgagagaagcatcctgcccagaaaggcagctttgaggttttttttttaattaagcaaatatttcaagttgtggattctttcagagttattccatcccttgtctgctttcttaaaaaagcttcaaatgaaaatgggaagttataacttgagagacattttgaaaaggagtctgctctcctgccactttgctcttcctagatgaatacgttgccagcttgcatctgccatcatttgatgcccaccttacagagctgacagatgaccaagcaaaatatctgggactcaacaaaaatgggccattcaaacctaattattacagatactaatggaccatactaccaaggaccagtccacctgaaccacacactctaaagaaatattttttaagataacttttattttcttcttactcctttcctcttgatttttttcctataatttcattcttgttttttcatctcattatccaagttctgcagaccacacaggaacttgcttcatggctctttagatgaaatagaagttcagggttcctcactctagtcactaaagaaggattttactctcccagcccagaaaggtgattctttctttaccatttctggggactttagtcttaattaggtaccttattaacaggaaatgctaaggtaccttctctgtggaacaatctgcaatgtctaaatcgccttaaaagagcccatttcttagctgctgaaatcagtgctctttcacttcttcagagaagcagggatggtacctacccggcaggtaggttagatgtgggtggtgcatgttaatttcccttagaagttccaagccctgtttcctgcgtaaaggtggtatgtccagttcagagatgtgtataatgagcatggcttgttaagatcaggaggcccacttggatttatagtatagcccttcctccactcccaccagacttgctcatttttcgagtttttaactagactacactctattgagtttaattttgtcctctaggatttatttctgttgtccaaaaaaaaaaaaaagaaaagaaaaattaaggagaatttttggtgttaatgctgaggaattgcttgagtggttagttgttaccaatttctcttttgaacctttggagctaaggatgctgagtctagagaaatgctagtctcaagccctgttaagtccctctgtttctagcccgtagttcatagcatcagtgaactggagccacaacagcaaattctatcagctgtgtaccatacagcttgtgctgaaggcgaatttcttgagccattactcagtataaagcactgagttctatctttaggatttatctttaagagcaaatttctggtcagctgtgcttctgcaacctaaaatatttaaagggaggtaggtgtgggcaggaggaggaatgataaattgggccagggcaagaaaaatctagcttcatataatttgtctgggactatacaccctatataatgttagttttacagaagtaatatgacttttgattgctacataccacaaagagtttatgaactgagatcataaagggcaactgatgtgtgaagaaagtagtcagtacatcctggctcatgctctgaaagaatatccagagaggctctctcaaagatcagggagatgtattcccatgccatgcaccctgcttcccagcatttctgcatggtcaagtgagctttatgctcatgagctttaagtatataattatccaggattttaaatcctcaacttgttctagcttgtgatccctcaaagttgggtcatacgttagtgctagatactagaaattttcacttttccactgatcagagagacagacattaaaaacaaaaatagaagaaaggaaagctttcaccctgcagcttcttagcagggaacaattgtcttgccaaaacttttttcccttttctctcccattttcttttacccaatcccttcttactccttgccagtgtgaccatgctttcttctctgtagatgttaacagttaaggcctattttcctcgggcacttaaccaaccaatcagaacaccacatctgttaggggaggtaacctggccaacagtgtatccatcacgttagccctgctggagggaagggacccacattcacctgccctctgacctgccccttgatcccatatctattaccgtgtccataggaataataggtaagggctctgtctctgtcaagccatgtaacaaaggacactgttaaaaaaaaaaaaaagtctggcatcagagggagcatgtggagagcaacttgggaagaacaagttcattttgtattgaatgatttttaatgaatgcaatattaatccttgcagatgagcaataatcattaaaatcgattaaaatgataagaccttaaaagaagac

SEQ ID NO: 299905 - DNA, 2529 bp, Homo sapiens
taattcttcagctaaaacagcggaagaggtgatttattatatggttgttacactcggccacaaataaacacagaaatcgatgtgaccagcctccgcactccggagctgacgtgggagcgagtacgttctcaggtggaccatgtcatctggccagatggcaaacgagttgtcctcctggcagagggtcgtctactcaatttgagctgctccacagttcccacctttgttctgtccatcacagccacaacacaggctttggcactgatagaactctataatgcacccgaggggcgatacaagcaggatgtgtacttgcttcctaagaaaatggatgaatacgttgccagcttgcatctgccatcatttgatgcccaccttacagagctgacagatgaccaagcaaaatatctgggactcaacaaaaatgggccattcaaacctaattattacagatactaatggaccatactaccaaggaccagtccacctgaaccacacactctaaagaaatattttttaagataacttttattttcttcttactcctttcctcttgatttttttcctataatttcattcttgttttttcatctcattatccaagttctgcagaccacacaggaacttgcttcatggctctttagatgaaatagaagttcagggttcctcactctagtcactaaagaaggattttactctcccagcccagaaaggtgattctttctttaccatttctggggactttagtcttaattaggtaccttattaacaggaaatgctaaggtaccttctctgtggaacaatctgcaatgtctaaatcgccttaaaagagcccatttcttagctgctgaaatcagtgctctttcacttcttcagagaagcagggatggtacctacccggcaggtaggttagatgtgggtggtgcatgttaatttcccttagaagttccaagccctgtttcctgcgtaaaggtggtatgtccagttcagagatgtgtataatgagcatggcttgttaagatcaggaggcccacttggatttatagtatagcccttcctccactcccaccagacttgctcatttttcgagtttttaactagactacactctattgagtttaattttgtcctctaggatttatttctgttgtccaaaaaaaaaaaaaagaaaagaaaaattaaggagaatttttggtgttaatgctgaggaattgcttgagtggttagttgttaccaatttctcttttgaacctttggagctaaggatgctgagtctagagaaatgctagtctcaagccctgttaagtccctctgtttctagcccgtagttcatagcatcagtgaactggagccacaacagcaaattctatcagctgtgtaccatacagcttgtgctgaaggcgaatttcttgagccattactcagtataaagcactgagttctatctttaggatttatctttaagagcaaatttctggtcagctgtgcttctgcaacctaaaatatttaaagggaggtaggtgtgggcaggaggaggaatgataaattgggccagggcaagaaaaatctagcttcatataatttgtctgggactatacaccctatataatgttagttttacagaagtaatatgacttttgattgctacataccacaaagagtttatgaactgagatcataaagggcaactgatgtgtgaagaaagtagtcagtacatcctggctcatgctctgaaagaatatccagagaggctctctcaaagatcagggagatgtattcccatgccatgcaccctgcttcccagcatttctgcatggtcaagtgagctttatgctcatgagctttaagtatataattatccaggattttaaatcctcaacttgttctagcttgtgatccctcaaagttgggtcatacgttagtgctagatactagaaattttcacttttccactgatcagagagacagacattaaaaacaaaaatagaagaaaggaaagctttcaccctgcagcttcttagcagggaacaattgtcttgccaaaacttttttcccttttctctcccattttcttttacccaatcccttcttactccttgccagtgtgaccatgctttcttctctgtagatgttaacagttaaggcctattttcctcgggcacttaaccaaccaatcagaacaccacatctgttaggggaggtaacctggccaacagtgtatccatcacgttagccctgctggagggaagggacccacattcacctgccctctgacctgccccttgatcccatatctattaccgtgtccataggaataataggtaagggctctgtctctgtcaagccatgtaacaaaggacactgttaaaaaaaaaaaaaagtctggcatcagagggagcatgtggagagcaacttgggaagaacaagttcattttgtattgaatgatttttaatgaatgcaatattaatccttgcagatgagcaataatcattaaaatcgattaaaatgataagaccttaaaagaagac

SEQ ID NO: 299906 - DNA, 2594 bp, Homo sapiens
taagcgggctttgcgtgcgtgtttgcgtacagcggaggtggcggcgcgggcaggtcggagctcggagctgctgcttctggttctcttgtggccgccgtcgctgtccggctgccttgggctgccgaacagacaaggcgtgggccacagcacctcagaagccgacgcagctcgacgcaggggccggcaggagggtgggcgatcgcgtgtcggagggcgccgcgcgggcaggcgggcgggcgccagagggggaaagaggcgggggcggcgggtcagccgctggccgggccggccggggaatgtcgatgcctgacgcgatgccgctgcccggggtcggggaggagctgaagcaggccaaggagatcgaggacgccgagaagtactccttcatggccaccgtcaccaaggcgcccaagaagcaaatccagtttgctgatgacatgcaggagttcaccaaattccccaccaaaactggccgaagatctttgtctcgctcgatctcacagtcctccactgacagctacagttcagctgcatcctacacagatagctctgatgatgaggtttctccccgagagaagcagcaaaccaactccaagggcagcagcaatttctgtgtgaagaacatcaagcaggcagaatttggacgccgggagattgagattgcagagcaagacatgtctgctctgatttcactcaggaaacgtgctcagggggagaagcccttggctggtgctaaaatagtgggctgtacacacatcacagcccagacagcggtgttgattgagacactctgtgccctgggggctcagtgccgctggtctgcttgtaacatctactcaactcagaatgaagtagctgcagcactggctgaggctggagttgcagtgttcgcttggaagggcgagtcagaagatgacttctggtggtgtattgaccgctgtgtgaacatggatgggtggcaggccaacatgatcctggatgatgggggagacttaacccactgggtttataagaagtatccaaacgtgtttaagaagatccgaggcattgtggaagagagcgtgactggtgttcacaggctgtatcagctctccaaagctgggaagctctgtgttccggccatgaacgtcaatgattctgttaccaaacagaagtttgataacttgtactgctgccgagaatccattttggatggcctgaagaggaccacagatgtgatgtttggtgggaaacaagtggtggtgtgtggctatggtgaggtaggcaagggctgctgtgctgctctcaaagctcttggagcaattgtctacattaccgaaatcgaccccatctgtgctctgcaggcctgcatggatgggttcagggtggtaaagctaaatgaagtcatccggcaagtcgatgtcgtaataacttgcacaggaaataagaatgtagtgacacgggagcacttggatcgcatgaaaaacagttgtatcgtatgcaatatgggccactccaacacagaaatcgatgtgaccagcctccgcactccggagctgacgtgggagcgagtacgttctcaggtggaccatgtcatctggccagatggcaaacgagttgtcctcctggcagagggtcgtctactcaatttgagctgctccacagttcccacctttgttctgtccatcacagccacaacacaggctttggcactgatagaactctataatgcacccgaggggcgatacaagcaggatgtgtacttgcttcctaagaaaatggatgaatacgttgccagcttgcatctgccatcatttgatgcccaccttacagagctgacagatgaccaagcaaaatatctgggactcaacaaaaatgggccattcaaacctaattattacagatactaatggaccatactaccaaggaccagtccacctgaaccacacactctaaagaaatattttttaagataacttttattttcttcttactcctttcctcttgatttttttcctataatttcattcttgttttttcatctcattatccaagttctgcagaccacacaggaacttgcttcatggctctttagatgaaatagaagttcagggttcctcactctagtcactaaagaaggattttactctcccagcccagaaaggtgattctttctttaccatttctggggactttagtcttaattaggtaccttattaacaggaaatgctaaggtaccttctctgtggaacaatctgcaatgtctaaatcgccttaaaagagcccatttcttagctgctgaaatcagtgctctttcacttcttcagagaagcagggatggtacctacccggcaggtaggttagatgtgggtggtgcatgttaatttcccttagaagttccaagccctgtttcctgcgtaaaggtggtatgtccagttcagagatgtgtataatgagcatggcttgttaagatcaggaggcccacttggatttatagtatagcccttcctccactcccaccagacttgctcatttttcgagtttttaactagtaacatatcaacttcataattatacaacctaatgggtgtcgcttcctaggtttagttgctgtt

SEQ ID NO: 299907 - DNA, 2473 bp, Homo sapiens
taagcgggctttgcgtgcgtgtttgcgtacagcggaggtggcggcgcgggcaggtcggagctcggagctgctgcttctggttctcttgtggccgccgtcgctgtccggctgccttgggctgccgaacagacaaggcgtgggccacagcacctcagaagccgacgcagctcgacgcaggggccggcaggagggtgggcgatcgcgtgtcggagggcgccgcgcgggcaggcgggcgggcgccagagggggaaagaggcgggggcggcgggtcagccgctggccgggccggccggggaatgtcgatgcctgacgcgatgccgctgcccggggtcggggaggagctgaagcaggccaaggagatcgaggacgccgagaagtactccttcatggccaccgtcaccaaggcgcccaagaagcaaatccagtttgctgatgacatgcaggagttcaccaaattccccaccaaaactggccgaagatctttgtctcgctcgatctcacagtcctccactgacagctacagttcagctgcatcctacacagatagctctgatgatgaggtttctccccgagagaagcagcaaaccaactccaagggcagcagcaatttctgtgtgaagaacatcaagcaggcagaatttggacgccgggagattgagattgcagagcaagacatgtctgctctgatttcactcaggaaacgtgctcagggggagaagcccttggctggtgctaaaatagtgggctgtacacacatcacagcccagacagcggtgttgattgagacactctgtgccctgggggctcagtgccgctggtctgcttgtaacatctactcaactcagaatgaagtagctgcagcactggctgaggctggagttgcagtgttcgcttggaagggcgagtcagaagatgacttctggtggtgtattgaccatgtgtataatgagcatggcttgttaagatcaggaggcccacttggatttatagtatagcccttcctccactcccaccagacttgctcatttttcgagtttttaactagactacactctattgagtttaattttgtcctctaggatttatttctgttgtccaaaaaaaaaaaaaagaaaagaaaaattaaggagaatttttggtgttaatgctgaggaattgcttgagtggttagttgttaccaatttctcttttgaacctttggagctaaggatgctgagtctagagaaatgctagtctcaagccctgttaagtccctctgtttctagcccgtagttcatagcatcagtgaactggagccacaacagcaaattctatcagctgtgtaccatacagcttgtgctgaaggcgaatttcttgagccattactcagtataaagcactgagttctatctttaggatttatctttaagagcaaatttctggtcagctgtgcttctgcaacctaaaatatttaaagggaggtaggtgtgggcaggaggaggaatgataaattgggccagggcaagaaaaatctagcttcatataatttgtctgggactatacaccctatataatgttagttttacagaagtaatatgacttttgattgctacataccacaaagagtttatgaactgagatcataaagggcaactgatgtgtgaagaaagtagtcagtacatcctggctcatgctctgaaagaatatccagagaggctctctcaaagatcagggagatgtattcccatgccatgcaccctgcttcccagcatttctgcatggtcaagtgagctttatgctcatgagctttaagtatataattatccaggattttaaatcctcaacttgttctagcttgtgatccctcaaagttgggtcatacgttagtgctagatactagaaattttcacttttccactgatcagagagacagacattaaaaacaaaaatagaagaaaggaaagctttcaccctgcagcttcttagcagggaacaattgtcttgccaaaacttttttcccttttctctcccattttcttttacccaatcccttcttactccttgccagtgtgaccatgctttcttctctgtagatgttaacagttaaggcctattttcctcgggcacttaaccaaccaatcagaacaccacatctgttaggggaggtaacctggccaacagtgtatccatcacgttagccctgctggagggaagggacccacattcacctgccctctgacctgccccttgatcccatatctattaccgtgtccataggaataataggtaagggctctgtctctgtcaagccatgtaacaaaggacactgttaaaaaaaaaaaaaagtctggcatcagagggagcatgtggagagcaacttgggaagaacaagttcattttgtattgaatgatttttaatgaatgcaatattaatccttgcagatgagcaataatcattaaaatcgattaaaatgataagaccttaaaagaagac

SEQ ID NO: 299908 - DNA, 3386 bp, Homo sapiens
taagcgggctttgcgtgcgtgtttgcgtacagcggaggtggcggcgcgggcaggtcggagctcggagctgctgcttctggttctcttgtggccgccgtcgctgtccggctgccttgggctgccgaacagacaaggcgtgggccacagcacctcagaagccgacgcagctcgacgcaggggccggcaggagggtgggcgatcgcgtgtcggagggcgccgcgcgggcaggcgggcgggcgccagagggggaaagaggcgggggcggcgggtcagccgctggccgggccggccggggaatgtcgatgcctgacgcgatgccgctgcccggggtcggggaggagctgaagcaggccaaggagatcgaggacgccgagaagtactccttcatggccaccgtcaccaaggcgcccaagaagcaaatccagtttgctgatgacatgcaggagttcaccaaattccccaccaaaactggccgaagatctttgtctcgctcgatctcacagtcctccactgacagctacagttcagctgcatcctacacagatagctctgatgatgaggtttctccccgagagaagcagcaaaccaactccaagggcagcagcaatttctgtgtgaagaacatcaagcaggcagaatttggacgccgggagattgagattgcagagcaagacatgtctgctctgatttcactcaggaaacgtgctcagggggagaagcccttggctggtgctaaaatagtgggctgtacacacatcacagcccagacagcggtgttgattgagacactctgtgccctgggggctcagtgccgctggtctgcttgtaacatctactcaactcagaatgaagtagctgcagcactggctgaggctggagttgcagtgttcgcttggaagggcgagtcagaagatgacttctggtggtgtattgaccgctgtgtgaacatggatgggtggcaggccaacatgatcctggatgatgggggagacttaacccactgggtttataagaagtatccaaacgtgtttaagaagatccgaggcattgtggaagagagcgtgactggtgttcacaggctgtatcagctctccaaagctgggaagctctgtgttccggccatgaacgtcaatgattctgttaccaaacagaagtttgataacttgtactgctgccgagaatccattttggatggcctgaagaggaccacagatgtgatgtttggtgggaaacaagtggtggtgtgtggctatggtgaggtaggcaagggctgctgtgctgctctcaaagctcttggagcaattgtctacattaccgaaatcgaccccatctgtgctctgcaggcctgcatggatgggttcagggtggtaaagctaaatgaagtcatccggcaagtcgatgtcgtaataacttgcacaggaaataagaatgtagtgacacgggagcacttggatcgcatgaaaaacagttgtatcgtatgcaatatgggccactccaacacagaaatcgatgtgaccagcctccgcactccggagctgacgtgggagcgagtacgttctcaggtggaccatgtcatctggccagatggcaaacgagttgtcctcctggcagagggtcgtctactcaatttgagctgctccacagttcccacctttgttctgtccatcacagccacaacacaggctttggcactgatagaactctataatgcacccgaggggcgatacaagcaggatgtgtacttgcttcctaagaaaatgggtgagtgaaaaacagtggaaatctatgcagacagctgcatagtttggtaaaatgactgccatgaaaggcattggatttagagtcagagttccaattcctgttcctgtgcttactggttgtttgacctcaggacaagttctaatctctatgatcctcagtttcttgattggtaaaatgaaaataatactacatacattgtagaattgtgtgagaatcacagctaatgagtaacagtgcttaacacaatggtttagggagatgttcttactctaagtagccttatgaagttcagtaaacttcccagtgcagctgagtacatacagccttggaacaaaatgagagaaacaaacacaggttttattgtccattttctgtgaggatatgcaaaccatccaatctcttgtaagcaacccatgctgtgttcatgtgacataatacatcatctctagtcctttgcctttctgcacggtgtacccatctcccatatctccttggctagcccaaatccctgacttcttaatgctaaaatacttcttgctctcctctcctccaatagcttacttcagactttttttttcagtgtataattataaaagggaagcttatctatggaaaagtaaaaattctgtgccgactaccttagaaattcatgatcctaagatccatggatcttatcctaaatgagtgttattgacacagggtctttctagcttactggtgtccactttgattgctaatttgactataatctagttaaggaggttgctgcaggaaggtaggagtagcatgtgacatgtgggccactgcagggaagccccctgctttgccagagaaggatagagaggtaaaagcccactcccttttgttaccctggtaagtggcttttctgaacgcactgtacatgtgctgagagaagcatcctgcccagaaaggcagctttgaggttttttttttaattaagcaaatatttcaagttgtggattctttcagagttattccatcccttgtctgctttcttaaaaaagcttcaaatgaaaatgggaagttataacttgagagacattttgaaaaggagtctgctctcctgccactttgctcttcctagatgaatacgttgccagcttgcatctgccatcatttgatgcccaccttacagagctgacagatgaccaagcaaaatatctgggactcaacaaaaatgggccattcaaacctaattattacaggtaacctggggagaagcaagtgaaaagctctttttcccagtattaaaccaagcaggctagcctgcttctgacataaagatcaaatgttgtacctgattttgaagaatacaagaaatctgttccaggccaggcacggtggctcacgcctgtaatcccagcactttgagaggcctaggcggatggatcacttgaggtcaggagttcaagaccagcctggccaacatggcgaaaccctatctcttagccgggtgtggtggcgggcacctgtcatcccagttactcaggtggctgaggcacgagaatcacttgaacctgggaggcggaggttgcagtgagctgggatcatgccactgcactccagcctgggtgatggagtgagactctgtcttaaaaacaaac

SEQ ID NO: 299909 - DNA, 1542 bp, Homo sapiens
taagcgggctttgcgtgcgtgtttgcgtacagcggaggtggcggcgcgggcaggtcggagctcggagctgctgcttctggttctcttgtggccgccgtcgctgtccggctgccttgggctgccgaacagacaaggcgtgggccacagcacctcagaagccgacgcagctcgacgcaggggccggcaggagggtgggcgatcgcgtgtcggagggcgccgcgcgggcaggcgggcgggcgccagagggggaaagaggcgggggcggcgggtcagccgctggccgggccggccggggaatgtcgatgcctgacgcgatgccgctgcccggggtcggggaggagctgaagcaggccaaggagatcgaggacgccgagaagtactccttcatggccaccgtcaccaaggcgcccaagaagcaaatccagtttgctgatgacatgcaggagttcaccaaattccccaccaaaactggccgaagatctttgtctcgctcgatctcacagtcctccactgacagctacagttcagctgcatcctacacagatagctctgatgatgaggtttctccccgagagaagcagcaaaccaactccaagggcagcagcaatttctgtgtgaagaacatcaagcaggcagaatttggacgccgggagattgagattgcagagcaagacatgtctgctctgatttcactcaggaaacgtgctcagggggagaagcccttggctggtgctaaaatagtgggctgtacacacatcacagcccagacagcggtgttgattgagacactctgtgccctgggggctcagtgccgctggtctgcttgtaacatctactcaactcagaatgaagtagctgcagcactggctgaggctggagttgcagtgttcgcttggaagggcgagtcagaagatgacttctggtggtgtattgaccgctgtgtgaacatggatgggtggcaggccaacatgatcctggatgatgggggagacttaacccactgggtttataagaagtatccaaacgtgtttaagaagatccgaggcattgtggaagagagcgtgactggtgttcacaggctgtatcagctctccaaagctgggaagctctgtgttccggccatgaacgtcaatgattctgttaccaaacagaagtttgataacttgtactgctgccgagaatccattttggatggcctgaagaggaccacagatgtgatgtttggtgggaaacaagtggtggtgtgtggctatggtgaggtaggcaagggctgctgtgctgctctcaaagctcttggagcaattgtctacattaccgaaatcgaccccatctgtgctctgcaggcctgcatggatgggttcagggtggtaaagctaaatgaagtcatccggcaagtcgatgtcgtaataacttgcacaggaaataagaatgtagtgacacgggagcacttggatcgcatgaaaaacagttgtatcgtatgcaatatgggccactccaacacagaaatcgatgtggtaaggcttctctcatttgttgctaggc

SEQ ID NO: 299910 - DNA, 1331 bp, Homo sapiens
taagcgggctttgcgtgcgtgtttgcgtacagcggaggtggcggcgcgggcaggtcggagctcggagctgctgcttctggttctcttgtggccgccgtcgctgtccggctgccttgggctgccgaacagacaaggcgtgggccacagcacctcagaagccgacgcagctcgacgcaggggccggcaggagggtgggcgatcgcgtgtcggagggcgccgcgcgggcaggcgggcgggcgccagagggggaaagaggcgggggcggcgggtcagccgctggccgggccggccggggaatgtcgatgcctgacgcgatgccgctgcccggggtcggggaggagctgaagcaggccaaggagatcgaggacgccgagaagtactccttcatggccaccgtcaccaaggcgcccaagaagcaaatccagtttgctgatgacatgcaggagttcaccaaattccccaccaaaactggccgaagatctttgtctcgctcgatctcacagtcctccactgacagctacagttcagctgcatcctacacagatagctctgatgatgaggtttctccccgagagaagcagcaaaccaactccaagggcagcagcaatttctgtgtgaagaacatcaagcaggcagaatttggacgccgggagattgagattgcagagcaagacatgtctgctctgatttcactcaggaaacgtgctcagggggagaagcccttggctggtgctaaaatagtgggctgtacacacatcacagcccagacagcggtgttgattgagacactctgtgccctgggggctcagtgccgctggtctgcttgtaacatctactcaactcagaatgaagtagctgcagcactggctgaggctggagttgcagtgttcgcttggaagggcgagtcagaagatgacttctggtggtgtattgaccgctgtgtgaacatggatgggtggcaggccaacatgatcctggatgatgggggagacttaacccactgggtttataagaagtatccaaacgtgtttaagaagatccgaggcattgtggaagagagcgtgactggtgttcacaggctgtatcagctctccaaagctgggaagctctgtgttccggccatgaacgtcaatgattctgttaccaaacagaagtttgataacttgtactgctgccgagaatccattttggatggcctgaagaggaccacagatgtgatgtttggtgggaaacaagtggtggtgtgtggctatggtgaggtaaatagctgggtctcagtgtctctttctttttgtgtacttattagaaatattgggtaaaggaggcttgtg

SEQ ID NO: 299911 - DNA, 1740 bp, Homo sapiens
gtatttacaagccagaattgtgcaactcttctggatcattaataaagtagcaagatcctcaaaaaacccaaaaacaccattctctaatagtcatgacaaatggcttcagtagggcttgttttttattttccagaaggctttttctcttattttttgaagccccagtctttgattttacaggtaactttcaaaacatcatgatgctgccaaatgtacttttgtaaacttaaacattatgattccggttggatttatagtatagcccttcctccactcccaccagacttgctcatttttcgagtttttaactagactacactctattgagtttaattttgtcctctaggatttatttctgttgtccaaaaaaaaaaaaaagaaaagaaaaattaaggagaatttttggtgttaatgctgaggaattgcttgagtggttagttgttaccaatttctcttttgaacctttggagctaaggatgctgagtctagagaaatgctagtctcaagccctgttaagtccctctgtttctagcccgtagttcatagcatcagtgaactggagccacaacagcaaattctatcagctgtgtaccatacagcttgtgctgaaggcgaatttcttgagccattactcagtataaagcactgagttctatctttaggatttatctttaagagcaaatttctggtcagctgtgcttctgcaacctaaaatatttaaagggaggtaggtgtgggcaggaggaggaatgataaattgggccagggcaagaaaaatctagcttcatataatttgtctgggactatacaccctatataatgttagttttacagaagtaatatgacttttgattgctacataccacaaagagtttatgaactgagatcataaagggcaactgatgtgtgaagaaagtagtcagtacatcctggctcatgctctgaaagaatatccagagaggctctctcaaagatcagggagatgtattcccatgccatgcaccctgcttcccagcatttctgcatggtcaagtgagctttatgctcatgagctttaagtatataattatccaggattttaaatcctcaacttgttctagcttgtgatccctcaaagttgggtcatacgttagtgctagatactagaaattttcacttttccactgatcagagagacagacattaaaaacaaaaatagaagaaaggaaagctttcaccctgcagcttcttagcagggaacaattgtcttgccaaaacttttttcccttttctctcccattttcttttacccaatcccttcttactccttgccagtgtgaccatgctttcttctctgtagatgttaacagttaaggcctattttcctcgggcacttaaccaaccaatcagaacaccacatctgttaggggaggtaacctggccaacagtgtatccatcacgttagccctgctggagggaagggacccacattcacctgccctctgacctgccccttgatcccatatctattaccgtgtccataggaataataggtaagggctctgtctctgtcaagccatgtaacaaaggacactgttaaaaaaaaaaaaaagtctggcatcagagggagcatgtggagagcaacttgggaagaacaagttcattttgtattgaatgatttttaatgaatgcaatattaatccttgcagatgagcaataatcattaaaatcgattaaaatgataagaccttaaaagaagac

SEQ ID NO: 299912 - DNA, 1050 bp, Homo sapiens
  misc_feature (9)..(9): n is a, c, g, or t
ggtccaacngccagcagtcatggtcagaggtcatgaggtaggtgtgggcaggaggaggaatgataaattgggccagggcaagaaaaatctagcttcatataatttgtctgggactatacaccctatataatgttagttttacagaagtaatatgacttttgattgctacataccacaaagagtttatgaactgagatcataaagggcaactgatgtgtgaagaaagtagtcagtacatcctggctcatgctctgaaagaatatccagagaggctctctcaaagatcagggagatgtattcccatgccatgcaccctgcttcccagcatttctgcatggtcaagtgagctttatgctcatgagctttaagtatataattatccaggattttaaatcctcaacttgttctagcttgtgatccctcaaagttgggtcatacgttagtgctagatactagaaattttcacttttccactgatcagagagacagacattaaaaacaaaaatagaagaaaggaaagctttcaccctgcagcttcttagcagggaacaattgtcttgccaaaacttttttcccttttctctcccattttcttttacccaatcccttcttactccttgccagtgtgaccatgctttcttctctgtagatgttaacagttaaggcctattttcctcgggcacttaaccaaccaatcagaacaccacatctgttaggggaggtaacctggccaacagtgtatccatcacgttagccctgctggagggaagggacccacattcacctgccctctgacctgccccttgatcccatatctattaccgtgtccataggaataataggtaagggctctgtctctgtcaagccatgtaacaaaggacactgttaaaaaaaaaaaaaagtctggcatcagagggagcatgtggagagcaacttgggaagaacaagttcattttgtattgaatgatttttaatgaatgcaatattaatccttgcagatgagcaataatcattaaaatcgattaaaatgataagaccttaaaagaagac

SEQ ID NO: 299913 - DNA, 879 bp, Homo sapiens
tcatgtaatgtaagaagaatctacaagcattaaaaaagatatgttaaggaaaaagtagtcagtacatcctggctcatgctctgaaagaatatccagagaggctctctcaaagatcagggagatgtattcccatgccatgcaccctgcttcccagcatttctgcatggtcaagtgagctttatgctcatgagctttaagtatataattatccaggattttaaatcctcaacttgttctagcttgtgatccctcaaagttgggtcatacgttagtgctagatactagaaattttcacttttccactgatcagagagacagacattaaaaacaaaaatagaagaaaggaaagctttcaccctgcagcttcttagcagggaacaattgtcttgccaaaacttttttcccttttctctcccattttcttttacccaatcccttcttactccttgccagtgtgaccatgctttcttctctgtagatgttaacagttaaggcctattttcctcgggcacttaaccaaccaatcagaacaccacatctgttaggggaggtaacctggccaacagtgtatccatcacgttagccctgctggagggaagggacccacattcacctgccctctgacctgccccttgatcccatatctattaccgtgtccataggaataataggtaagggctctgtctctgtcaagccatgtaacaaaggacactgttaaaaaaaaaaaaaagtctggcatcagagggagcatgtggagagcaacttgggaagaacaagttcattttgtattgaatgatttttaatgaatgcaatattaatccttgcagatgagcaataatcattaaaatcgattaaaatgataagaccttaaaagaagac

SEQ ID NO: 299914 - DNA, 844 bp, Homo sapiens
cacaggtgttgaggcaaagcacttaaagtcatataaatctaggcattcaggatcttggtgtccaccctactagtattagcttctaaatactactcccttctaaaagaaaggctcctgagagaaatggttgattccaggtttggagaagaggaagaacaagcaaatccagtttgctgatgacatgcaggagttcaccaaattccccaccaaaactggccgaagatctttgtctcgctcgatctcacagtcctccactgacagctacagttcagctgcatcctacacagatagctctgatgatgaggtttctccccgagagaagcagcaaaccaactccaagggcagcagcaatttctgtgtgaagaacatcaagcaggcagaatttggacgccgggagattgagattgcagagcaagacatgtctgctctgatttcactcaggaaacgtgctcagggggagaagcccttggctggtgctaaaatagtgggctgtacacacatcacagcccagacagcggtgttgattgagacactctgtgccctgggggctcagtgccgctggtctgcttgtaacatctactcaactcagaatgaagtagctgcagcactggctgaggctggagttgcagtgttcgcttggaagggcgagtcagaagatgacttctggtggtgtattgaccgctgtgtgaacatggatgggtggcaggccaacatgatcctggatgatgggggagacttaacccactgggtttataagaagtatccaaacgtgtttaagaagatccgaggcattgtggaagtcctcgacttggtggttacagggctgtattcgctcttcccgctg

SEQ ID NO: 299915 - DNA, 360 bp, Homo sapiens
aaaaggccccttgttacagggctgacagagcagagccttacctattattcctatgacacggtaatagatatgggatcaagggacccacattcacctgccctctgacctgccccttgatcccatatctattaccgtgtccataggaataataggtaagggctctgtctctgtcaagccatgtaacaaaggacactgttaaaaaaaaaaaaaagtctggcatcagagggagcatgtggagagcaacttgggaagaacaagttcattttgtattgaatgatttttaatgaatgcaatattaatccttgcagatgagcaataatcattaaaatcgattaaaatgataagaccttaaaagaagac

SEQ ID NO: 299916 - DNA, 564 bp, Homo sapiens
gataatactattagattcactctaggtgctttatgttattgagagttcataattgagtatattaatcatttttgcagaaatcacctaggggaagagaaggctaggactgctctgttcttctcactctaaccctagggctctctgagagcctcttggcatttttccttcctagagggagtcttggggactctgaagaggccagtgtatatagtttagcagagcttatcactcaccattcctgtgaggtggcactggatccaactagaaggggatcttgtctcatttcatgaccatcttccctcccactgccttcttgctttactcatagtgttcctttcttttcttccagcatggatgggttcagggtggtaaagctaaatgaagtcatccggcaagtcgatgtcgtaataacttgcacaggtaaataacttgcatagagaagtgtttattcagaggctaaatcttgaaagtagtctgagtgactttcatacaaaggaggtgagacctctgttcagtataaaggtctcagaactagaataagctatcagaaccttaacatgtttt

SEQ ID NO: 299917 - DNA, 2602 bp, Homo sapiens
cccctcccccggccgctggctcgctcggctcgcgacgctgcagaggctccgaggcggcggcggcgactccctctttccctccctcctcctccgtccgcccgtccgtccgcgcgtctgtccgttcggcccggtccggcccgaagcatggccggcgtcagcttcagcggccaccgcctggagctgctggcggcttacgaggaggtgatccgagaggagagcgcggccgactgggctctgtacacatatgaagatggctccgatgacctcaagcttgcagcatcaggagaagggggcttgcaggagctttcgggacactttgagaaccagaaggtgatgtacggcttctgcagtgtcaaggactcccaagctgctctgccaaaatacgtgctcatcaactgggtgggcgaagatgtgcctgatgcccgcaagtgcgcttgtgccagccacgtggctaaggtggcagagttcttccagggtgtcgacgtgatcgtgaacgccagcagcgtggaagacatagacgcgggtgccatcgggcagcggctctctaacgggctggcgcgactctccagccctgtgctgcaccgactgcggctgcgagaggatgagaacgcagagcccgtgggcaccacctaccagaagacggatgcagctgtggaaatgaagcggattaaccgagagcagttctgggagcaggccaagaaggaagaagagctgcggaaggaggaggagcggaagaaggccctggatgagaggctcaggttcgagcaggagcggatggagcaggagcggcaggagcaagaggagcgcgagcggcgctaccgggagcgggagcagcagatcgaggagcacaggaggaaacagcagactttagaagcggaagaggccaagaggcggttgaaggagcagtctatctttggtgaccatcgggatgaggaggaagagacccacatgaagaagtcagagtcggaggtggaggaggcagcagctattattgcccagcggcctgacaacccaagggagttcttcaagcagcaggaaagagtcgcatcggcctctgcgggcagctgtgatgtaccctcgcccttcaaccatcgaccaggcagccacctggacagccaccggaggatggcgcccactcccatccccacgcggagcccgtctgactccagcaccgcctccacccctgtcgctgagcagatagagcgggccctggatgaggtcacctcctcgcagcctccaccactgccaccgccacccccaccagcccaagagacccaggagcccagccccatcctagacagtgaggagaccagagcagcagcccctcaggcctgggccggccccatggaggagccccctcaggcacaggcgcctccccgggggccaggcagccctgcagaggacttgatgttcatggagtctgcagagcaggctgtcctggctgctcccgtggagcctgccacagctgacgccacggaggtccacgatgcagctgacaccattgaaactgacactgccactgctgacaccactgttgccaacaacgtaccccccgccgccaccagcctcattgacctatggcctggcaacggggaaggggcctccacactccagggtgagcccagggcccccacgccaccctcgggtactgaggtcaccctggcagaggtgcccctgctggatgaggtggctccggagccactgctgccagcaggcgaaggctgtgccacccttctcaactttgatgagctgcctgagccgccagccaccttctgtgacccagaggaagtggaaggggagcccctggctgccccccagaccccaactctgccctcagcccttgaggagctggagcaagagcaggagccggagccccacctgctaaccaatggcgagaccacccagaaggaggggacccaggccagtgaggggtacttcagtcaatcacaggaggaggagtttgcccaatcggaagagctctgtgccaaggctccgcctcctgtgttctacaacaagcctccagagatcgacatcacatgctgggatgcagacccagttccagaagaggaggagggcttcgagggtggtgattagcggtggcgccagccctaggctacccttgccaaggccgcccacctgcatcagcctctggccagacggcccgccgtgcctgcattcgcagcagctccgcctggcacccactccggattccggccctggctggggacttggccgcttccctacccacagggcctgacttttacagcttttctctttttttaaaaagttgataggagacttgtacagttgactggctttcctctcgttggtagttgagacgctgttgcaaattccacccctccttccctggtccagattgtagctcttagtcctccctgctcagctggccgggttggaggcctcaccctgcttggggcctggcgtggggggagctctggtgggaaaatgtcccccacctcttttcctagttttatgtttcttgggaaaatatcactttgtattctctgtccagggcttcagatattttgcacgaattttaaaacatggcaataaatggctcgtgggctctggctccctggga

SEQ ID NO: 299918 - DNA, 873 bp, Homo sapiens
  misc_feature (713)..(713): n is a, c, g, or t
  misc_feature (746)..(746): n is a, c, g, or t
  misc_feature (750)..(750): n is a, c, g, or t
  misc_feature (785)..(785): n is a, c, g, or t
  misc_feature (797)..(797): n is a, c, g, or t
  misc_feature (821)..(821): n is a, c, g, or t
  misc_feature (856)..(856): n is a, c, g, or t
  misc_feature (873)..(873): n is a, c, g, or t
cccctcccccggccgctggctcgctcggctcgcgacgctgcagaggctccgaggcggcggcggcgactccctctttccctccctcctcctccgtccgcccgtccgtccgcgcgtctgtccgttcggcccggtccggcccgaagcatggccggcgtcagcttcagcggccaccgcctggagctgctggcggcttacgaggaggtgatccgagaggagagcgcggccgactgggctctgtacacatatgaagatggctccgatgacctcaagcttgcagcatcaggagaagggggcttgcaggagctttcgggacactttgagaaccagaaggtgatgtacggcttctgcagtgtcaaggactcccaagctgctctgccaaaatacgtgctcatcaactgggtgggcgaagatgtgcctgatgcccgcaagtgcgcttgtgccagccacgtggctaaggtggcagagttcttccagggtgtcgacgtgatcgtgaacgccagcagcgtggaagacatagacgcgggtgccatcgggcagcggctctctaacgggctggcgcgactctccagccctgtgctgcaccgactgcggctgcgagaggatgagaacgcagagcccgtgggcaccacctaccagaagacggatgcagctgtggaaatgaagcggattaaccgagagcagttctgggagcaggccaagagaaggaagaaganctgcggaaaggaagaaggaaccggaaaaaaggncctnggaattaaaaggctcaaggtttcgaagcaaggaanccggattggaancaaggaaccggcaaggagcaaagnaaggaagccccgaagcgggggcctaaccggggaancggggaagcaaccaagn

SEQ ID NO: 299919 - DNA, 249 bp, Homo sapiens
  misc_feature (15)..(15): n is a, c, g, or t
  misc_feature (20)..(20): n is a, c, g, or t
  misc_feature (170)..(171): n is a, c, g, or t
aggaacggcggcaanaggancagtctatctttggtgaccatcgggatgaggaggaagagacccacatgaagaagtcagagtcggaggtggaggaggcagcagctattattgcccagcggcctgacaacccaagggagttcttcaagcagcaggaaagagtcgcaattcgnnatcagccaccacgtgttttcttgctgaatggccgtttctggaggtggcctggccgtcccgttttcctgagcccctcgg

SEQ ID NO: 299920 - DNA, 2909 bp, Homo sapiens
cccctcccccggccgctggctcgctcggctcgcgacgctgcagaggctccgaggcggcggcggcgactccctctttccctccctcctcctccgtccgcccgtccgtccgcgcgtctgtccgttcggcccggtccggcccgaagcatggccggcgtcagcttcagcggccaccgcctggagctgctggcggcttacgaggaggtgatccgagaggagagcgcggccgactgggctctgtacacatatgaagatggctccgatgacctcaagcttgcagcatcaggagaagggggcttgcaggagctttcgggacactttgagaaccagaaggtgatgtacggcttctgcagtgtcaaggactcccaagctgctctgccaaaatacgtgctcatcaactgggtgggcgaagatgtgcctgatgcccgcaagtgcgcttgtgccagccacgtggctaaggtggcagagttcttccagggtgtcgacgtgatcgtgaacgccagcagcgtggaagacatagacgcgggtgccatcgggcagcggctctctaacgggctggcgcgactctccagccctgtgctgcaccgactgcggctgcgagaggatgagaacgcagagcccgtgggcaccacctaccagaagacggatgcagctgtggaaatgaagcggattaaccgagagcagttctgggagcaggccaagaaggaagaagagctgcggaaggaggaggagcggaagaaggccctggatgagaggctcaggttcgagcaggagcggatggagcaggagcggcaggagcaagaggagcgcgagcggcgctaccgggagcgggagcagcagatcgaggagcacaggaggaaacagcagactttagaagcggaagaggccaagaggcggttgaaggagcagtctatctttggtgaccatcgggatgaggaggaagagacccacatgaagaagtcagagtcggaggtggaggaggcagcagctattattgcccagcggcctgacaacccaagggagttcttcaagcagcaggaaagagtcgcatcggcctctgcgggcagctgtgatgtaccctcgcccttcaaccatcgaccaggcagccacctggacagccaccggaggatggcgcccactcccatccccacgcggagcccgtctgactccagcaccgcctccacccctgtcgctgagcagatagagcgggccctggatgaggtcacctcctcgcagcctccaccactgccaccgccacccccaccagcccaagagacccaggagcccagccccatcctagacagtgaggagaccagagcagcagcccctcaggcctgggccggccccatggaggagccccctcaggcacaggcgcctccccgggggccaggcagccctgcagaggacttgatgttcatggagtctgcagagcaggctgtcctggctgctcccgtggagcctgccacagctgacgccacggaggtccacgatgcagctgacaccattgaaactgacactgccactgctgacaccactgttgccaacaacgtaccccccgccgccaccagcctcattgacctatggcctggcaacggggaaggggcctccacactccagggtgagcccagggcccccacgccaccctcgggtactgaggtcaccctggcagaggtgcccctgctggatgaggtggctccggagccactgctgccagcaggcgaaggctgtgccacccttctcaactttgatgagctgcctgagccgccagccaccttctgtgacccagaggaagtggaaggggagcccctggctgccccccagaccccaactctgccctcagcccttgaggagctggagcaagagcaggagccggagccccacctgctaaccaatggcgagaccacccagaaggaggggacccaggccagtgaggggtacttcagtcaatcacaggaggaggagtttgcccaatcggaagagctctgtgccaaggctccgcctcctgtgttctacaacaagcctccagagatcgacatcacatgctgggatgcagacccagttccagaagaggaggagggcttcgagggtggtgattagcggtggcgccagccctaggctacccttgccaaggccgcccacctgcatcagcctctggccagacggcccgccgtgcctgcattcgcagcagctccgcctggcacccactccggattccggccctggctggggacttggccgcttccctacccacagggcctgacttttacagcttttctctttttttaaaaagttgataggagacttgtacagttgactggctttcctctcgttggtagttgagacgctgttgcaaattccacccctccttccctggtccagattgtagctcttagtcctccctgctcagctggccgggttggaggcctcaccctgcttggggcctggcgtggggggagctctggtgggaaaatgtcccccacctcttttcctagttttatgtttcttgggaaaatatcactttgtattctctgtccagggcttcagatattttgcacgaattttaaaacatggcaataaatggctcgtgggctctggctccctgggaccccctccccgcccttcttttgaccccttcctgtctggcccaaaggaagtagcaggcccagctggggcccctcggctaccccccgtctcctgccgggcaggtcccaggttggaggccctaggcgcggttcaggtcagggctatggatggggcccaggggctttggtggcccctccccaactccttcctctttgcttgggttcctttttcacgtttagtaactgttttttttttttttttttttttggaaagcacaaacttctgtaacgggtcgtgctcatgtctgttaataaagaaatccagatccc

SEQ ID NO: 299921 - DNA, 2626 bp, Homo sapiens
cccctcccccggccgctggctcgctcggctcgcgacgctgcagaggctccgaggcggcggcggcgactccctctttccctccctcctcctccgtccgcccgtccgtccgcgcgtctgtccgttcggcccggtccggcccgaagcatggccggcgtcagcttcagcggccaccgcctggagctgctggcggcttacgaggaggtgatccgagaggagagcgcggccgactgggctctgtacacatatgaagatggctccgatgacctcaagcttgcagcatcaggagaagggggcttgcaggagctttcgggacactttgagaaccagaaggtgatgtacggcttctgcagtgtcaaggactcccaagctgctctgccaaaatacgtgctcatcaactgggtgggcgaagatgtgcctgatgcccgcaagtgcgcttgtgccagccacgtggctaaggtggcagagttcttccagggtgtcgacgtgatcgtgaacgccagcagcgtggaagacatagacgcgggtgccatcgggcagcggctctctaacgggctggcgcgactctccagccctgtgctgcaccgactgcggctgcgagaggatgagaacgcagagcccgtgggcaccacctaccagaagacggatgcagctgtggaaatgaagcggattaaccgagagcagttctgggagcaggccaagaaggaagaagagctgcggaaggaggaggagcggaagaaggccctggatgagaggctcaggttcgagcaggagcggatggagcaggagcggcaggagcaagaggagcgcgagcggcgctaccgggagcgggagcagcagatcgaggagcacaggaggaaacagcagactttagaagcggaagaggccaagaggcggttgaaggagcagtctatctttggtgaccatcgggatgaggaggaagagacccacatgaagaagtcagagtcggaggtggaggaggcagcagctattattgcccagcggcctgacaacccaagggagttcttcaagcagcaggaaagagtcgcatcggcctctgcgggcagctgtgatgtaccctcgcccttcaaccatcgaccaggcagccacctggacagccaccggaggatggcgcccactcccatccccacgcggagcccgtctgactccagcaccgcctccacccctgtcgctgagcagatagagcgggccctggatgaggtcacctcctcgcagcctccaccactgccaccgccacccccaccagcccaagagacccaggagcccagccccatcctagacagtgaggagaccagagcagcagcccctcaggcctgggccggccccatggaggagccccctcaggcacaggcgcctccccgggggccaggcagccctgcagaggacttgatgttcatggagtctgcagagcaggctgtcctggctgctcccgtggagcctgccacagctgacgccacggaggtccacgatgcagctgacaccattgaaactgacactgccactgctgacaccactgttgccaacaacgtaccccccgccgccaccagcctcattgacctatggcctggcaacggggaaggggcctccacactccagggtgagcccagggcccccacgccaccctcgggtactgaggtcaccctggcagaggtgcccctgctggatgaggtggctccggagccactgctgccagcaggcgaaggctgtgccacccttctcaactttgatgagctgcctgagccgccagccaccttctgtgacccagaggaagtggaaggggagcccctggctgccccccagaccccaactctgccctcagcccttgaggagctggagcaagagcaggagccggagccccacctgctaaccaatggcgagaccacccagaaggaggggacccaggccagtgaggggtacttcagtcaatcacaggaggaggagtttgcccaatcggaagagctctgtgccaaggctccgcctcctgtgttctacaacaagcctccagagatcgacatcacatgctgggatgcagacccagttccagaagaggaggagggcttcgagggtggtgattagcggtggcgccagccctaggctacccttgccaaggccgcccacctgcatcagcctctggccagacggcccgccgtgcctgcattcgcagcagctccgcctggcacccactccggattccggccctggctggggacttggccgcttccctacccacagggcctgacttttacagcttttctctttttttaaaaagttgataggagacttgtacagttgactggctttcctctcgttggtagttgagacgctgttgcaaattccacccctccttccctggtccagattgtagctcttagtcctccctgctcagctggccgggttggaggcctcaccctgcttggggcctggcgtggggggagctctggtgggaaaatgtcccccacctcttttcctagttttatgtttcttgggaaaatatcactttgtattctctgtccagggcttcagatattttgcacgaattttaaaacatggcaataaatggctcgtgggctctggctccctgggaaaaaaaagtcgtgccgaatcttgg

SEQ ID NO: 299922 - DNA, 2740 bp, Homo sapiens
cccctcccccggccgctggctcgctcggctcgcgacgctgcagaggctccgaggcggcggcggcgactccctctttccctccctcctcctccgtccgcccgtccgtccgcgcgtctgtccgttcggcccggtccggcccgaagcatggccggcgtcagcttcagcggccaccgcctggagctgctggcggcttacgaggaggtgatccgagaggagagcgcggccgactgggctctgtacacatatgaagatggctccgatgacctcaagcttgcagcatcaggagaagggggcttgcaggagctttcgggacactttgagaaccagaaggtgatgtacggcttctgcagtgtcaaggactcccaagctgctctgccaaaatacgtgctcatcaactgggtgggcgaagatgtgcctgatgcccgcaagtgcgcttgtgccagccacgtggctaaggtggcagagttcttccagggtgtcgacgtgatcgtgaacgccagcagcgtggaagacatagacgcgggtgccatcgggcagcggctctctaacgggctggcgcgactctccagccctgtgctgcaccgactgcggctgcgagaggatgagaacgcagagcccgtgggcaccacctaccagaagacggatgcagctgtggaaatgaagcggattaaccgagagcagttctgggagcaggccaagaaggaagaagagctgcggaaggaggaggagcggaagaaggccctggatgagaggctcaggttcgagcaggagcggatggagcaggagcggcaggagcaagaggagcgcgagcggcgctaccgggagcgggagcagcagatcgaggagcacaggaggaaacagcagactttagaagcggaagaggccaagaggcggttgaaggagcagtctatctttggtgaccatcgggatgaggaggaagagacccacatgaagaagtcagagtcggaggtggaggaggcagcagctattattgcccagcggcctgacaacccaagggagttcttcaagcagcaggaaagagtcgcatcggcctctgcgggcagctgtgatgtaccctcgcccttcaaccatcgaccaggtcgtccgtactgccctttcataaaggcatcggacagtgggccttcctcctcctcctcttcctcctcctcccctccacggactccctttccctatatcacctgccaccgcaccccaaacctctcttcctccctcccatgcagccacctggacagccaccggaggatggcgcccactcccatccccacgcggagcccgtctgactccagcaccgcctccacccctgtcgctgagcagatagagcgggccctggatgaggtcacctcctcgcagcctccaccactgccaccgccacccccaccagcccaagagacccaggagcccagccccatcctagacagtgaggagaccagagcagcagcccctcaggcctgggccggccccatggaggagccccctcaggcacaggcgcctccccgggggccaggcagccctgcagaggacttgatgttcatggagtctgcagagcaggctgtcctggctgctcccgtggagcctgccacagctgacgccacggaggtccacgatgcagctgacaccattgaaactgacactgccactgctgacaccactgttgccaacaacgtaccccccgccgccaccagcctcattgacctatggcctggcaacggggaaggggcctccacactccagggtgagcccagggcccccacgccaccctcgggtactgaggtcaccctggcagaggtgcccctgctggatgaggtggctccggagccactgctgccagcaggcgaaggctgtgccacccttctcaactttgatgagctgcctgagccgccagccaccttctgtgacccagaggaagtggaaggggagcccctggctgccccccagaccccaactctgccctcagcccttgaggagctggagcaagagcaggagccggagccccacctgctaaccaatggcgagaccacccagaaggaggggacccaggccagtgaggggtacttcagtcaatcacaggaggaggagtttgcccaatcggaagagctctgtgccaaggctccgcctcctgtgttctacaacaagcctccagagatcgacatcacatgctgggatgcagacccagttccagaagaggaggagggcttcgagggtggtgattagcggtggcgccagccctaggctacccttgccaaggccgcccacctgcatcagcctctggccagacggcccgccgtgcctgcattcgcagcagctccgcctggcacccactccggattccggccctggctggggacttggccgcttccctacccacagggcctgacttttacagcttttctctttttttaaaaagttgataggagacttgtacagttgactggctttcctctcgttggtagttgagacgctgttgcaaattccacccctccttccctggtccagattgtagctcttagtcctccctgctcagctggccgggttggaggcctcaccctgcttggggcctggcgtggggggagctctggtgggaaaatgtcccccacctcttttcctagttttatgtttcttgggaaaatatcactttgtattctctgtccagggcttcagatattttgcacgaattttaaaacatggcaataaatggctcgtgggctctggctccctggga

SEQ ID NO: 299923 - DNA, 3074 bp, Homo sapiens
  misc_feature (20)..(20): n is a, c, g, or t
gggcggccggacgcggcccngaggcgcggggtcccgatgtggggcccggggccgcgtggcctgcgggagcccatcccccaccctaccccccgggcccgggggacaggtgtgcacggggcggccaagggcaccttcgccaccttcgagcgggcgaggtccgggcggggacggggcggggaccgagctagcggagccagcgcagcctgcccggctcagcccggcccggccacagcacaaaggaaagcgagggcgggggaggagcggagcgggctgggggccgggcgccccgcccaccggggggcctctcggagtgggccgccctccccccgaaacctgggctggagtgaggtggaaggatgtttgctgccacatggcgaccgcgaagtgactcccttaccgccgcgggtcgcggaggaggcagggggaaggtgcccatctggttcctaggcctcctctccctgctggcagatgggaacaggttcttcttgaggaaactgaggcaaagaggagggcaggtctgagggaccccgcttgggctggcctcacccgcacactgggagggcagccaggtggggactctgacctgggggcttctggaggagaggatgagatggctgggcatccatggcatggtactgcagcactggccagcagccaggcctggagggatggacgcgagagacaagctctcgtgtcctgcagggctctgtacacatatgaagatggctccgatgacctcaagcttgcagcatcaggagaagggggcttgcaggagctttcgggacactttgagaaccagaaggtgatgtacggcttctgcagtgtcaaggactcccaagctgctctgccaaaatacgtgctcatcaactgggtgggcgaagatgtgcctgatgcccgcaagtgcgcttgtgccagccacgtggctaaggtggcagagttcttccagggtgtcgacgtgatcgtgaacgccagcagcgtggaagacatagacgcgggtgccatcgggcagcggctctctaacgggctggcgcgactctccagccctgtgctgcaccgactgcggctgcgagaggatgagaacgcagagcccgtgggcaccacctaccagaagacggatgcagctgtggaaatgaagcggattaaccgagagcagttctgggagcaggccaagaaggaagaagagctgcggaaggaggaggagcggaagaaggccctggatgagaggctcaggttcgagcaggagcggatggagcaggagcggcaggagcaagaggagcgcgagcggcgctaccgggagcgggagcagcagatcgaggagcacaggaggaaacagcagactttagaagcggaagaggccaagaggcggttgaaggagcagtctatctttggtgaccatcgggatgaggaggaagagacccacatgaagaagtcagagtcggaggtggaggaggcagcagctattattgcccagcggcctgacaacccaagggagttcttcaagcagcaggaaagagtcgcatcggcctctgcgggcagctgtgatgtaccctcgcccttcaaccatcgaccaggcagccacctggacagccaccggaggatggcgcccactcccatccccacgcggagcccgtctgactccagcaccgcctccacccctgtcgctgagcagatagagcgggccctggatgaggtcacctcctcgcagcctccaccactgccaccgccacccccaccagcccaagagacccaggagcccagccccatcctagacagtgaggagaccagagcagcagcccctcaggcctgggccggccccatggaggagccccctcaggcacaggcgcctccccgggggccaggcagccctgcagaggacttgatgttcatggagtctgcagagcaggctgtcctggctgctcccgtggagcctgccacagctgacgccacggaggtccacgatgcagctgacaccattgaaactgacactgccactgctgacaccactgttgccaacaacgtaccccccgccgccaccagcctcattgacctatggcctggcaacggggaaggggcctccacactccagggtgagcccagggcccccacgccaccctcgggtactgaggtcaccctggcagaggtgcccctgctggatgaggtggctccggagccactgctgccagcaggcgaaggctgtgccacccttctcaactttgatgagctgcctgagccgccagccaccttctgtgacccagaggaagtggaaggggagcccctggctgccccccagaccccaactctgccctcagcccttgaggagctggagcaagagcaggagccggagccccacctgctaaccaatggcgagaccacccagaaggaggggacccaggccagtgaggggtacttcagtcaatcacaggaggaggagtttgcccaatcggaagagctctgtgccaaggctccgcctcctgtgttctacaacaagcctccagagatcgacatcacatgctgggatgcagacccagttccagaagaggaggagggcttcgagggtggtgattagcggtggcgccagccctaggctacccttgccaaggccgcccacctgcatcagcctctggccagacggcccgccgtgcctgcattcgcagcagctccgcctggcacccactccggattccggccctggctggggacttggccgcttccctacccacagggcctgacttttacagcttttctctttttttaaaaagttgataggagacttgtacagttgactggctttcctctcgttggtagttgagacgctgttgcaaattccacccctccttccctggtccagattgtagctcttagtcctccctgctcagctggccgggttggaggcctcaccctgcttggggcctggcgtggggggagctctggtgggaaaatgtcccccacctcttttcctagttttatgtttcttgggaaaatatcactttgtattctctgtccagggcttcagatattttgcacgaattttaaaacatggcaataaatggctcgtgggctctggctccctggga

SEQ ID NO: 299924 - DNA, 2677 bp, Homo sapiens
cccctcccccggccgctggctcgctcggctcgcgacgctgcagaggctccgaggcggcggcggcgactccctctttccctccctcctcctccgtccgcccgtccgtccgcgcgtctgtccgttcggcccggtccggcccgaagcatggccggcgtcagcttcagcggccaccgcctggagctgctggcggcttacgaggaggtgatccgagaggagagcgcggccgactgggctctgtacacatatgaagatggctccgatgacctcaagcttgcagcatcaggagaagggggcttgcaggagctttcgggacactttgagaaccagaaggtgatgtacggcttctgcagtgtcaaggactcccaagctgctctgccaaaatacgtgctcatcaactgggtgggcgaagatgtgcctgatgcccgcaagtgcgcttgtgccagccacgtggctaaggtggcagagttcttccagggtgtcgacgtgatcgtgaacgccagcagcgtggaagacatagacgcgggtgccatcgggcagcggctctctaacgggctggcgcgactctccagccctgtgctgcaccgactgcggctgcgagaggatgagaacgcagagcccgtgggcaccacctaccagaagacggatgcagctgtggaaatgaagcggattaaccgagagcagttctgggagcaggccaagaaggaagaagagctgcggaaggaggaggagcggaagaaggccctggatgagaggctcaggttcgagcaggagcggatggagcaggagcggcaggagcaagaggagcgcgagcggcgctaccgggagcgggagcagcagatcgaggagcacaggtgagcctgcccgcccggagcgctccaggggcccccgggcgcaccctgacgggtgctggctgcttatcgttccaggaggaaacagcagactttagaagcggaagaggccaagaggcggttgaaggagcagtctatctttggtgaccatcgggatgaggaggaagagacccacatgaagaagtcagagtcggaggtggaggaggcagcagctattattgcccagcggcctgacaacccaagggagttcttcaagcagcaggaaagagtcgcatcggcctctgcgggcagctgtgatgtaccctcgcccttcaaccatcgaccaggcagccacctggacagccaccggaggatggcgcccactcccatccccacgcggagcccgtctgactccagcaccgcctccacccctgtcgctgagcagatagagcgggccctggatgaggtcacctcctcgcagcctccaccactgccaccgccacccccaccagcccaagagacccaggagcccagccccatcctagacagtgaggagaccagagcagcagcccctcaggcctgggccggccccatggaggagccccctcaggcacaggcgcctccccgggggccaggcagccctgcagaggacttgatgttcatggagtctgcagagcaggctgtcctggctgctcccgtggagcctgccacagctgacgccacggaggtccacgatgcagctgacaccattgaaactgacactgccactgctgacaccactgttgccaacaacgtaccccccgccgccaccagcctcattgacctatggcctggcaacggggaaggggcctccacactccagggtgagcccagggcccccacgccaccctcgggtactgaggtcaccctggcagaggtgcccctgctggatgaggtggctccggagccactgctgccagcaggcgaaggctgtgccacccttctcaactttgatgagctgcctgagccgccagccaccttctgtgacccagaggaagtggaaggggagcccctggctgccccccagaccccaactctgccctcagcccttgaggagctggagcaagagcaggagccggagccccacctgctaaccaatggcgagaccacccagaaggaggggacccaggccagtgaggggtacttcagtcaatcacaggaggaggagtttgcccaatcggaagagctctgtgccaaggctccgcctcctgtgttctacaacaagcctccagagatcgacatcacatgctgggatgcagacccagttccagaagaggaggagggcttcgagggtggtgattagcggtggcgccagccctaggctacccttgccaaggccgcccacctgcatcagcctctggccagacggcccgccgtgcctgcattcgcagcagctccgcctggcacccactccggattccggccctggctggggacttggccgcttccctacccacagggcctgacttttacagcttttctctttttttaaaaagttgataggagacttgtacagttgactggctttcctctcgttggtagttgagacgctgttgcaaattccacccctccttccctggtccagattgtagctcttagtcctccctgctcagctggccgggttggaggcctcaccctgcttggggcctggcgtggggggagctctggtgggaaaatgtcccccacctcttttcctagttttatgtttcttgggaaaatatcactttgtattctctgtccagggcttcagatattttgcacgaattttaaaacatggcaataaatggctcgtgggctctggctccctggga

SEQ ID NO: 299925 - DNA, 2795 bp, Homo sapiens
  misc_feature (20)..(20): n is a, c, g, or t
gggcggccggacgcggcccngaggcgcggggtcccgatgtggggcccggggccgcgtggcctgcgggagcccatcccccaccctaccccccgggcccgggggacaggtgtgcacggggcggccaagggcaccttcgccaccttcgagcgggcgaggtccgggcggggacggggcggggaccgagctagcggagccagcgcagcctgcccggctcagcccggcccggccacagcacaaaggaaagcgagggcgggggaggagcggagcgggctgggggccgggcgccccgcccaccggggggcctctcggagtgggccgccctccccccgaaacctgggctggagtgaggtggaaggatgtttgctgccacatggcgaccgcgaagtgactcccttaccgccgcgggtcgcggaggaggcagggggctctgtacacatatgaagatggctccgatgacctcaagcttgcagcatcaggagaagggggcttgcaggagctttcgggacactttgagaaccagaaggtgatgtacggcttctgcagtgtcaaggactcccaagctgctctgccaaaatacgtgctcatcaactgggtgggcgaagatgtgcctgatgcccgcaagtgcgcttgtgccagccacgtggctaaggtggcagagttcttccagggtgtcgacgtgatcgtgaacgccagcagcgtggaagacatagacgcgggtgccatcgggcagcggctctctaacgggctggcgcgactctccagccctgtgctgcaccgactgcggctgcgagaggatgagaacgcagagcccgtgggcaccacctaccagaagacggatgcagctgtggaaatgaagcggattaaccgagagcagttctgggagcaggccaagaaggaagaagagctgcggaaggaggaggagcggaagaaggccctggatgagaggctcaggttcgagcaggagcggatggagcaggagcggcaggagcaagaggagcgcgagcggcgctaccgggagcgggagcagcagatcgaggagcacaggaggaaacagcagactttagaagcggaagaggccaagaggcggttgaaggagcagtctatctttggtgaccatcgggatgaggaggaagagacccacatgaagaagtcagagtcggaggtggaggaggcagcagctattattgcccagcggcctgacaacccaagggagttcttcaagcagcaggaaagagtcgcatcggcctctgcgggcagctgtgatgtaccctcgcccttcaaccatcgaccaggcagccacctggacagccaccggaggatggcgcccactcccatccccacgcggagcccgtctgactccagcaccgcctccacccctgtcgctgagcagatagagcgggccctggatgaggtcacctcctcgcagcctccaccactgccaccgccacccccaccagcccaagagacccaggagcccagccccatcctagacagtgaggagaccagagcagcagcccctcaggcctgggccggccccatggaggagccccctcaggcacaggcgcctccccgggggccaggcagccctgcagaggacttgatgttcatggagtctgcagagcaggctgtcctggctgctcccgtggagcctgccacagctgacgccacggaggtccacgatgcagctgacaccattgaaactgacactgccactgctgacaccactgttgccaacaacgtaccccccgccgccaccagcctcattgacctatggcctggcaacggggaaggggcctccacactccagggtgagcccagggcccccacgccaccctcgggtactgaggtcaccctggcagaggtgcccctgctggatgaggtggctccggagccactgctgccagcaggcgaaggctgtgccacccttctcaactttgatgagctgcctgagccgccagccaccttctgtgacccagaggaagtggaaggggagcccctggctgccccccagaccccaactctgccctcagcccttgaggagctggagcaagagcaggagccggagccccacctgctaaccaatggcgagaccacccagaaggaggggacccaggccagtgaggggtacttcagtcaatcacaggaggaggagtttgcccaatcggaagagctctgtgccaaggctccgcctcctgtgttctacaacaagcctccagagatcgacatcacatgctgggatgcagacccagttccagaagaggaggagggcttcgagggtggtgattagcggtggcgccagccctaggctacccttgccaaggccgcccacctgcatcagcctctggccagacggcccgccgtgcctgcattcgcagcagctccgcctggcacccactccggattccggccctggctggggacttggccgcttccctacccacagggcctgacttttacagcttttctctttttttaaaaagttgataggagacttgtacagttgactggctttcctctcgttggtagttgagacgctgttgcaaattccacccctccttccctggtccagattgtagctcttagtcctccctgctcagctggccgggttggaggcctcaccctgcttggggcctggcgtggggggagctctggtgggaaaatgtcccccacctcttttcctagttttatgtttcttgggaaaatatcactttgtattctctgtccagggcttcagatattttgcacgaattttaaaacatggcaataaatggctcgtgggctctggctccctggga

SEQ ID NO: 299926 - DNA, 1154 bp, Homo sapiens
cccctcccccggccgctggctcgctcggctcgcgacgctgcagaggctccgaggcggcggcggcgactccctctttccctccctcctcctccgtccgcccgtccgtccgcgcgtctgtccgttcggcccggtccggcccgaagcatggccggcgtcagcttcagcggccaccgcctggagctgctggcggcttacgaggaggtgatccgagaggagagcgcggccgactgggctctgtacacatatgaagatggctccgatgacctcaagcttgcagcatcaggagaagggggcttgcaggagctttcgggacactttgagaaccagaaggtgatgtacggcttctgcagtgtcaaggactcccaagctgctctgccaaaatacgtgctcatcaactgggtgggcgaagatgtgcctgatgcccgcaagtgcgcttgtgccagccacgtggctaaggtggcagagttcttccagggtgtcgacgtgatcgtgaacgccagcagcgtggaagacatagacgcgggtgccatcgggcagcggctctctaacgggctggcgcgactctccagccctgtgctgcaccgactgcggctgcgagaggatgagaacgcagagcccgtgggcaccacctaccagaagacggatgcagctgtggaaatgaagcggattaaccgagagcagttctgggagcaggccaagaaggaagaagagctgcggaaggaggaggagcggaagaaggccctggatgagaggctcaggttcgagcaggagcggatggagcaggagcggcaggagcaagaggagcgcgagcggcgctaccgggagcgggagcagcagatcgaggagcacaggaggaaacagcagactttagaagcggaagaggccaagaggcggttgaaggagcagtctatctttggtgaccatcgggatgaggaggaagagacccacatgaagaagtcagagtcggaggtggaggaggcagcagctattattgcccagcggcctgacaacccaagggagttcttcaagcagcaggaaagagtcgcatcggcctctgcgggcagctgtgatgtaccctcgcccttcaaccatcgaccagctgagctgcagctcgccccaactcaggggcgagctgcaggagggaaagcatgtcc

SEQ ID NO: 299927 - DNA, 2308 bp, Homo sapiens
cccctcccccggccgctggctcgctcggctcgcgacgctgcagaggctccgaggcggcggcggcgactccctctttccctccctcctcctccgtccgcccgtccgtccgcgcgtctgtccgttcggcccggtccggcccgaagcatggccggcgtcagcttcagcggccaccgcctggagctgctggcggcttacgaggaggtgatccgagaggagagcgcggccgactgggctctgtacacatatgaagatggctccgatgacctcaagcttgcagcatcaggagaagggggcttgcaggagctttcgggacactttgagaaccagaaggtgatgtacggcttctgcagtgtcaaggactcccaagctgctctgccaaaatacgtgctcatcaactgggtgggcgaagatgtgcctgatgcccgcaagtgcgcttgtgccagccacgtggctaaggtggcagagttcttccagggtgtcgacgtgatcgtgaacgccagcagcgtggaagacatagacgcgggtgccatcgggcagcggctctctaacgggctggcgcgactctccagccctgtgctgcaccgactgcggctgcgagaggatgagaacgcagagcccgtgggcaccacctaccagaagacggatgcagctgtggaaatgaagcggattaaccgagagcagttctgggagcaggccaagaaggaagaagagctgcggaaggaggaggagcggaagcagcaggaaagagtcgcatcggcctctgcgggcagctgtgatgtaccctcgcccttcaaccatcgaccaggcagccacctggacagccaccggaggatggcgcccactcccatccccacgcggagcccgtctgactccagcaccgcctccacccctgtcgctgagcagatagagcgggccctggatgaggtcacctcctcgcagcctccaccactgccaccgccacccccaccagcccaagagacccaggagcccagccccatcctagacagtgaggagaccagagcagcagcccctcaggcctgggccggccccatggaggagccccctcaggcacaggcgcctccccgggggccaggcagccctgcagaggacttgatgttcatggagtctgcagagcaggctgtcctggctgctcccgtggagcctgccacagctgacgccacggaggtccacgatgcagctgacaccattgaaactgacactgccactgctgacaccactgttgccaacaacgtaccccccgccgccaccagcctcattgacctatggcctggcaacggggaaggggcctccacactccagggtgagcccagggcccccacgccaccctcgggtactgaggtcaccctggcagaggtgcccctgctggatgaggtggctccggagccactgctgccagcaggcgaaggctgtgccacccttctcaactttgatgagctgcctgagccgccagccaccttctgtgacccagaggaagtggaaggggagcccctggctgccccccagaccccaactctgccctcagcccttgaggagctggagcaagagcaggagccggagccccacctgctaaccaatggcgagaccacccagaaggaggggacccaggccagtgaggggtacttcagtcaatcacaggaggaggagtttgcccaatcggaagagctctgtgccaaggctccgcctcctgtgttctacaacaagcctccagagatcgacatcacatgctgggatgcagacccagttccagaagaggaggagggcttcgagggtggtgattagcggtggcgccagccctaggctacccttgccaaggccgcccacctgcatcagcctctggccagacggcccgccgtgcctgcattcgcagcagctccgcctggcacccactccggattccggccctggctggggacttggccgcttccctacccacagggcctgacttttacagcttttctctttttttaaaaagttgataggagacttgtacagttgactggctttcctctcgttggtagttgagacgctgttgcaaattccacccctccttccctggtccagattgtagctcttagtcctccctgctcagctggccgggttggaggcctcaccctgcttggggcctggcgtggggggagctctggtgggaaaatgtcccccacctcttttcctagttttatgtttcttgggaaaatatcactttgtattctctgtccagggcttcagatattttgcacgaattttaaaacatggcaataaatggctcgtgggctctggctccctggga

SEQ ID NO: 299928 - DNA, 2324 bp, Homo sapiens
ctacttgtaccatggagtcagagtttgaatcccagtttacctggtttccaaacccaccgttgtctattgcaacaggcttttttcatttcacccaatatccacaatgaatagaacccctgtgaaataagtattattagtaggctgtgcacacgtggaagacatagacgcgggtgccatcgggcagcggctctctaacgggctggcgcgactctccagccctgtgctgcaccgactgcggctgcgagaggatgagaacgcagagcccgtgggcaccacctaccagaagacggatgcagctgtggaaatgaagcggattaaccgagagcagttctgggagcaggccaagaaggaagaagagctgcggaaggaggaggagcggaagaaggccctggatgagaggctcaggttcgagcaggagcggatggagcaggagcggcaggagcaagaggagcgcgagcggcgctaccgggagcgggagcagcagatcgaggagcacaggtgagcctgcccgcccggagcgctccaggggcccccgggcgcaccctgacgggtgctggctgcttatcgttccaggaggaaacagcagactttagaagcggaagaggccaagaggcggttgaaggagcagtctatctttggtgaccatcgggatgaggaggaagagacccacatgaagaagtcagagtcggaggtggaggaggcagcagctattattgcccagcggcctgacaacccaagggagttcttcaagcagcaggaaagagtcgcatcggcctctgcgggcagctgtgatgtaccctcgcccttcaaccatcgaccaggcagccacctggacagccaccggaggatggcgcccactcccatccccacgcggagcccgtctgactccagcaccgcctccacccctgtcgctgagcagatagagcgggccctggatgaggtcacctcctcgcagcctccaccactgccaccgccacccccaccagcccaagagacccaggagcccagccccatcctagacagtgaggagaccagagcagcagcccctcaggcctgggccggccccatggaggagccccctcaggcacaggcgcctccccgggggccaggcagccctgcagaggacttgatgttcatggagtctgcagagcaggctgtcctggctgctcccgtggagcctgccacagctgacgccacggaggtccacgatgcagctgacaccattgaaactgacactgccactgctgacaccactgttgccaacaacgtaccccccgccgccaccagcctcattgacctatggcctggcaacggggaaggggcctccacactccagggtgagcccagggcccccacgccaccctcgggtactgaggtcaccctggcagaggtgcccctgctggatgaggtggctccggagccactgctgccagcaggcgaaggctgtgccacccttctcaactttgatgagctgcctgagccgccagccaccttctgtgacccagaggaagtggaaggggagcccctggctgccccccagaccccaactctgccctcagcccttgaggagctggagcaagagcaggagccggagccccacctgctaaccaatggcgagaccacccagaaggaggggacccaggccagtgaggggtacttcagtcaatcacaggaggaggagtttgcccaatcggaagagctctgtgccaaggctccgcctcctgtgttctacaacaagcctccagagatcgacatcacatgctgggatgcagacccagttccagaagaggaggagggcttcgagggtggtgattagcggtggcgccagccctaggctacccttgccaaggccgcccacctgcatcagcctctggccagacggcccgccgtgcctgcattcgcagcagctccgcctggcacccactccggattccggccctggctggggacttggccgcttccctacccacagggcctgacttttacagcttttctctttttttaaaaagttgataggagacttgtacagttgactggctttcctctcgttggtagttgagacgctgttgcaaattccacccctccttccctggtccagattgtagctcttagtcctccctgctcagctggccgggttggaggcctcaccctgcttggggcctggcgtggggggagctctggtgggaaaatgtcccccacctcttttcctagttttatgtttcttgggaaaatatcactttgtattctctgtccagggcttcagatattttgcacgaattttaaaacatggcaataaatggctcgtgggctctggctccctggga

SEQ ID NO: 299929 - DNA, 1083 bp, Homo sapiens
cccctcccccggccgctggctcgctcggctcgcgacgctgcagaggctccgaggcggcggcggcgactccctctttccctccctcctcctccgtccgcccgtccgtccgcgcgtctgtccgttcggcccggtccggcccgaagcatggccggcgtcagcttcagcggccaccgcctggagctgctggcggcttacgaggaggtgatccgagaggagagcgcggccgactgggctctgtacacatatgaagatggctccgatgacctcaagcttgcagcatcaggagaagggggcttgcaggagctttcgggacactttgagaaccagaaggtgatgtacggcttctgcagtgtcaaggactcccaagctgctctgccaaaatacgtgctcatcaactgggtgggcgaagatgtgcctgatgcccgcaagtgcgcttgtgccagccacgtggctaaggtggcagagttcttccagggtgtcgacgtgatcgtgaacgccagcagcgtggaagacatagacgcgggtgccatcgggcagcggctctctaacgggctggcgcgactctccagccctgtgctgcaccgactgcggctgcgagaggatgagaacgcagagcccgtgggcaccacctaccagaagacggatgcagctgtggaaatgaagcggattaaccgagagcagttctgggagcaggccaagaaggaagaagagctgcggaaggaggaggagcggaagaaggccctggatgagaggctcaggttcgagcaggagcggatggagcaggagcggcaggagcaagaggagcgcgagcggcgctaccgggagcgggagcagcagatcgaggagcacaggaggacccctgcagactttagaagcggaagaggcatgagaagggtgtagggaagattcttttgatgtgtgtgggcaggaggagggagagagttaggaaccagtctgctccttccacagccctagatagggctacggcccctcagtgggggctctgacccagcaggtgggcaaagatccagggtagctgagggatggaggggcccctaaacccagagctcaccccaaaatgca

SEQ ID NO: 299930 - DNA, 1519 bp, Homo sapiens
agacagacagaacagacagacagacagacagacagacagaacagacagacagacagacagacagacagaacagacagacagacagacagacagacagaacagacagacagacagacagacagacagaacagacagacagacagacagacagacagaacagacagacagacagacagacagacagaacagacagacagacagacagacagacagaacagacagacagacagacagacagacagaacagacagacagacagacagacagacagaacagacagacagacagacagacagacagaacagacagacagacagacagacagacagacacagacagacagacagacagacagacagacacagacagacagacagacagacagacagacacagacagacagacagacagacagacagacacagacagacagacagacagacagacagacacagacagacagacagacagacagacagacacagacagacagacagacagacagacagacacagacagacagacagacagacagacagacacagacagacagacagacagacagacagacacagacagacagacagacagacagacagacacagacagacagacagacagacagacagacacagacagacagacagacagacagacagacacagacagacagacagacagacagacagacacagacagacagacagacagacagacagacacagacagacagacagacagacagacagacacagacagacagacagacagacagagcaggagccggagccccacctgctaaccaatggcgagaccacccagaaggaggggacccaggccagtgaggggtacttcagtcaatcacaggaggaggagtttgcccaatcggaagagctctgtgccaaggctccgcctcctgtgttctacaacaagcctccagagatcgacatcacatgctgggatgcagacccagttccagaagaggaggagggcttcgagggtggtgattagcggtggcgccagccctaggctacccttgccaaggccgcccacctgcatcagcctctggccagacggcccgccgtgcctgcattcgcagcagctccgcctggcacccactccggattccggccctggctggggacttggccgcttccctacccacagggcctgacttttacagcttttctctttttttaaaaagttgataggagacttgtacagttgactggctttcctctcgttggtagttgagacgctgttgcaaattccacccctccttccctggtccagattgtagctcttagtcctccctgctcagctggccgggttggaggcctcaccctgcttggggcctggcgtggggggagctctggtgggaaaatgtcccccacctcttttcctagttttatgtttcttgggaaaatatcactttgtattctctgtccagggcttcagatattttgcacgaattttaaaacatggcaataaatggctcgtgggctctggctccctggga

SEQ ID NO: 299931 - DNA, 1199 bp, Homo sapiens
cccctcccccggccgctggctcgctcggctcgcgacgctgcagaggctccgaggcggcggcggcgactccctctttccctccctcctcctccgtccgcccgtccgtccgcgcgtctgtccgttcggcccggtccggcccgaagcatggccggcgtcagcttcagcggccaccgcctggagctgctggcggcttacgaggaggtgatccgagaggagagcgcggccgactgggctctgtacacatatgaagatggctccgatgacctcaagcttgcagcatcaggagaagggggcttgcaggagctttcgggacactttgagaaccagaaggtgatgtacggcttctgcagtgtcaaggactcccaagctgctctgccaaaatacgtgctcatcaactgggtgggcgaagatgtgcctgatgcccgcaagtgcgcttgtgccagccacgtggctaaggtggcagagttcttccagggtgtcgacgtgatcgtgaacgccagcagcgtggaagacatagacgcgggtgccatcgggcagcggctctctaacgggctggcgcgactctccagccctgtgctgcaccgactgcggctgcgagaggatgagaacgcagagcccgtgggcaccacctaccagaagacggatgcagctgtggaaatgaagcggattaaccgagagcagttctgggagcaggccaagagacccaggagcccagccccatcctagacagtgaggagaccagagcagcagcccctcaggcctgggccggccccatggaggagccccctcaggcacaggcgcctccccgggggccaggcagccctgcagaggacttgatgttcatggagtctgcagagcaggctgtcctgggtgtccgggagctgcgaagtggaccagaggtcacagcgtgcacctgaatgactggctgtggcctgtgcgaataccggcggcactagtaggggaggaggcccacgggagccccccgtaggctagacgctaagatgccgtccaaggtctgggcgctgcggggagacgacgagagaaggacggagacatgagacaaaacacaaaaacaaaaacaccagaaacaagcaaacgaaaacaaacaaaacgacaaacaacgaacacaacagaacacaaacataacaaacatataaatagacacacaaaacacaacaaaaacaaaacagcaacaacac

SEQ ID NO: 299932 - DNA, 309 bp, Homo sapiens
ttttttggaaagcacaaacttctgtaacgggtcgtgctcatgtctgttaataaagaaatccagatcccttcgggctgccgcctgccctgacccaggttcccaactcctcccacctccgaggccgcagcacctccttgccaccagggggcgtcctcaccctaattccaaggcccgccaggcgggggcggggtgggggggcggtgctaggggctaaggctcccaggggaagccgcttggcacctacaaccaccggagaagggttggtcttagacttagtgctgtacccttaggttctgttgtggcggaaac

SEQ ID NO: 299933 - DNA, 3127 bp, Homo sapiens
gcctcgggagcccggtgtggtgctcgcggacaggaagcaggagagtttgccaatagggatgtgacagcggttcccattaagcggtgatggtggttttgggacctgataatcgagctgggagtcagaggcgggatgtgtgcggtgaaggatgttttgatacccccatataaaataatctgtctgtcatgggagcccccacgtcctctgaaatagttcagctctgtctgcatgacttgtcctgggactgaggaaaatttaccagtcatctggccttttggaagagcaaaaaatgatgaagtcccaggggttagtatcattcaaggatgtggctgtggatttcacccaggaggagtggcagcaacttgacccttctcagaggaccctgtacagggatgtgatgctggagaactacagccacctggtctcaatggggtatccagtttccaaaccagatgtcatctccaagttggaacaaggagaagagccatggatcataaagggagacatatcaaattggatctatccagatgaatatcaggcagatgggagacaagacaggaagagtaaccttcacaactcccagtcatgtattttggggacagtttccttccatcataagatactgaaaggagtcacaagggatggttcattgtgctccattttaaaagtctgtcaaggtgatggtcagctgcagagatttctagagaatcaagacaaactcttcaggcaggtcacatttgttaacagcaaaacagtgactgaggcatcagggcataaatataatccactggggaaaatatttcaagagtgcatagaaacagatatatcaatacagagattccataaatatgatgcttttaaaaagaacttaaaaccaaatattgacctaccgagttgttataagagcaattcaagaaaaaaacctgatcagagttttggaggtggaaaatcatctagccagagtgagcccaattctaatcttgagaagattcacaatggagtaataccttttgatgataatcagtgtggaaacgtttttagaaatacacaatcccttattcaatatcagaatgtggaaactaaagagaaaagctgtgtatgtgttacatgtggaaaagcctttgctaagaagtcacaactcattgtacatcaaagaattcatactggaaagaaaccatatgattgtggtgcatgcggaaaagccttcagtgagaagtttcatcttgttgtacatcagagaactcatactggggagaaaccttatgattgttctgaatgtggaaaagccttctctcagaaatcgtcccttattatacatcagagagttcacactggggaaaaaccctatgaatgtagtgaatgcgggaaagccttctcccagaaatcacccctcattatacatcagagaatacatactggggaaaaaccctatgaatgtagagagtgtgggaaggccttttcccagaagtcacagctgattatacaccacagagctcatactggagagaagccgtatgagtgtaccgaatgtgggaaagccttctgtgagaagtcccacctcattatacataaaagaattcacactggtgagaaaccctacaaatgtgctcaatgtgaggaagccttcagcaggaagacagaactcattacacatcagttagttcatactggggaaaaaccttatgaatgtactgaatgtggaaagacattctcccgcaagtcacagctcatcatacatcagagaacacatactggagaaaaaccctataaatgtagtgaatgtggcaaagccttctgccagaagtcacatctcattggacatcagagaattcacacaggagaaaaaccttatatatgtactgaatgtgggaaagccttctctcagaagtcccaccttccgggacaccagcgaattcatacaggagagaaaccttacatatgtgctgaatgtggaaaggccttttctcagaagtcagaccttgttttacatcagaggattcatactggggaaagaccctatcaatgtgctatatgtgggaaggccttcatccagaagtcacaactaactgtacaccagagaattcacacagtggtaaaatcataatgaactggccacagaaaagccttagtattagctcaagccttaataattactagaaacccaattaatttgataagcttggggacaacatcccaatagataaaaatttttaagggaatttgtttctagtttggtgatgcctaacttttccagcaaagatgatggaaaatagttatataaatgaagaacatttttaatatggcatgtaaagcttttaaagttatgaactcagtgatcagcacagcaagttaagcatacagaatattgtcaagttgcatattccttatactacaaaatgataatcagccattgtgaaactgctaatattagcttgtcataattatggccataaactaatttttctataaaagacgtggaagaaagcttaagtaaacaataaaataaaacctatacactattttaagaaggggcttgagcatgacccctaaagctacatgtaaagttcttgtacaaaaaatggaatgataggttgatcagattcagtaaagttgatctgtatgcattttcccatctcaagcatataagttgacctgcatctctggaaggaccttgagattgatgcattttgagcaggtctcccttttactcttcccaactgggaacttggagctgaaaaacattggcactgaggccagatggccttgggtttaatcctggctcagtgcctcacagattgtgtgactttaggcaaacatacttctcctagctgagtattttttatcagtaagtacaaatacaatgcagagctcattttcagttaatattagtactttttaaatctttactctctatcttgaagcattagatgttaagactaatgtgtaaaaaccacgtctgagcttgcttttccctctggacactctgcttttgattgcctatccctataagtggctcattttactgtcttctgatcctggtggccttatttttgctatgttaaggttgtgttttttaatacttggatttattttcatatacttacataaaccgtggtgattgcacata

SEQ ID NO: 299934 - DNA, 551 bp, Homo sapiens
gaattccgtaaccgccaccgtccggcagcgatgaagcggctggtggatatcgccgcgatctccaagttggaacaaggagaagagccatggatcataaagggagacatatcaaattggatctatccagatgaatatcaggcagatgggagacaagacaggaagagtaaccttcacaactcccagtcatgtattttggggacagtttccttccatcataagatactgaaaggagtcacaagggatggttcattgtgctccattttaaaagtctgtcaaggtgatggtcagctgcagagatttctagagaatcaagacaaactcttcaggcaggtcacatttgttaacagcaaaacagtgactgaggcatcagggcataaatataatccactggggaaaatatttcaagagtgcatagaaacagatatatcaatacagagattccataaatatgatgcttttaaaaagaacttaaaaccaaatattgacctaccgagttgttataagagccagagagagagtcttgctatgttgaccaggctggtcttgaattc

SEQ ID NO: 299935 - DNA, 3112 bp, Homo sapiens
atccaattataaaaccttggtcaacttctatgtgatcatattataggtacaagaggagtaaagaatgatccctcctccacatggtgcctgctgagacttctgtaaggctcaaacaaccttatcccacagggtagcccattagttacttgacttctgatgttagttgttgcaagattggtgaatgtgaaagctgcagtctgggtttggactatgaaaaacattctgatcaccagttttgctttttcagtcatctggccttttggaagagcaaaaaatgatgaagtcccaggggttagtatcattcaaggatgtggctgtggatttcacccaggaggagtggcagcaacttgacccttctcagaggaccctgtacagggatgtgatgctggagaactacagccacctggtctcaatggggtatccagtttccaaaccagatgtcatctccaagttggaacaaggagaagagccatggatcataaagggagacatatcaaattggatctatccagatgaatatcaggcagatgggagacaagacaggaagagtaaccttcacaactcccagtcatgtattttggggacagtttccttccatcataagatactgaaaggagtcacaagggatggttcattgtgctccattttaaaagtctgtcaaggtgatggtcagctgcagagatttctagagaatcaagacaaactcttcaggcaggtcacatttgttaacagcaaaacagtgactgaggcatcagggcataaatataatccactggggaaaatatttcaagagtgcatagaaacagatatatcaatacagagattccataaatatgatgcttttaaaaagaacttaaaaccaaatattgacctaccgagttgttataagagcaattcaagaaaaaaacctgatcagagttttggaggtggaaaatcatctagccagagtgagcccaattctaatcttgagaagattcacaatggagtaataccttttgatgataatcagtgtggaaacgtttttagaaatacacaatcccttattcaatatcagaatgtggaaactaaagagaaaagctgtgtatgtgttacatgtggaaaagcctttgctaagaagtcacaactcattgtacatcaaagaattcatactggaaagaaaccatatgattgtggtgcatgcggaaaagccttcagtgagaagtttcatcttgttgtacatcagagaactcatactggggagaaaccttatgattgttctgaatgtggaaaagccttctctcagaaatcgtcccttattatacatcagagagttcacactggggaaaaaccctatgaatgtagtgaatgcgggaaagccttctcccagaaatcacccctcattatacatcagagaatacatactggggaaaaaccctatgaatgtagagagtgtgggaaggccttttcccagaagtcacagctgattatacaccacagagctcatactggagagaagccgtatgagtgtaccgaatgtgggaaagccttctgtgagaagtcccacctcattatacataaaagaattcacactggtgagaaaccctacaaatgtgctcaatgtgaggaagccttcagcaggaagacagaactcattacacatcagttagttcatactggggaaaaaccttatgaatgtactgaatgtggaaagacattctcccgcaagtcacagctcatcatacatcagagaacacatactggagaaaaaccctataaatgtagtgaatgtggcaaagccttctgccagaagtcacatctcattggacatcagagaattcacacaggagaaaaaccttatatatgtactgaatgtgggaaagccttctctcagaagtcccaccttccgggacaccagcgaattcatacaggagagaaaccttacatatgtgctgaatgtggaaaggccttttctcagaagtcagaccttgttttacatcagaggattcatactggggaaagaccctatcaatgtgctatatgtgggaaggccttcatccagaagtcacaactaactgtacaccagagaattcacacagtggtaaaatcataatgaactggccacagaaaagccttagtattagctcaagccttaataattactagaaacccaattaatttgataagcttggggacaacatcccaatagataaaaatttttaagggaatttgtttctagtttggtgatgcctaacttttccagcaaagatgatggaaaatagttatataaatgaagaacatttttaatatggcatgtaaagcttttaaagttatgaactcagtgatcagcacagcaagttaagcatacagaatattgtcaagttgcatattccttatactacaaaatgataatcagccattgtgaaactgctaatattagcttgtcataattatggccataaactaatttttctataaaagacgtggaagaaagcttaagtaaacaataaaataaaacctatacactattttaagaaggggcttgagcatgacccctaaagctacatgtaaagttcttgtacaaaaaatggaatgataggttgatcagattcagtaaagttgatctgtatgcattttcccatctcaagcatataagttgacctgcatctctggaaggaccttgagattgatgcattttgagcaggtctcccttttactcttcccaactgggaacttggagctgaaaaacattggcactgaggccagatggccttgggtttaatcctggctcagtgcctcacagattgtgtgactttaggcaaacatacttctcctagctgagtattttttatcagtaagtacaaatacaatgcagagctcattttcagttaatattagtactttttaaatctttactctctatcttgaagcattagatgttaagactaatgtgtaaaaaccacgtctgagcttgcttttccctctggacactctgcttttgattgcctatccctataagtggctcattttactgtcttctgatcctggtggccttatttttgctatgttaaggttgtgttttttaatacttggatttattttcatatacttacataaaccgtggtgattgcacata

SEQ ID NO: 299936 - DNA, 3877 bp, Homo sapiens
gcctcgggagcccggtgtggtgctcgcggacaggaagcaggagagtttgccaatagggatgtgacagcggttcccattaagcggtgatggtggttttgggacctgataatcgagctgggagtcagaggcgggatgtgtgcggtgaaggatgttttgatacccccatataaaataatctgtctgtcatgggagcccccacgtcctctgaaatagttcagctctgtctgcatgacttgtcctgggactgaggaaaatttaccagtcatctggccttttggaagagcaaaaaatgatgaagtcccaggggttagtatcattcaaggatgtggctgtggatttcacccaggaggagtggcagcaacttgacccttctcagaggaccctgtacagggatgtgatgctggagaactacagccacctggtctcaatggggtatccagtttccaaaccagatgtcatctccaagttggaacaaggagaagagccatggatcataaagggagacatatcaaattggatctatccagatgaatatcaggcagatgggagacaagacaggaagagtaaccttcacaactcccagtcatgtattttggggacagtttccttccatcataagatactgaaaggagtcacaagggatggttcattgtgctccattttaaaagtctgtcaaggtgatggtcagctgcagagatttctagagaatcaagacaaactcttcaggcaggtcacatttgttaacagcaaaacagtgactgaggcatcagggcataaatataatccactggggaaaatatttcaagagtgcatagaaacagatatatcaatacagagattccataaatatgatgcttttaaaaagaacttaaaaccaaatattgacctaccgagttgttataagagcaattcaagaaaaaaacctgatcagagttttggaggtggaaaatcatctagccagagtgagcccaattctaatcttgagaagattcacaatggagtaataccttttgatgataatcagtgtggaaacgtttttagaaatacacaatcccttattcaatatcagaatgtggaaactaaagagaaaagctgtgtatgtgttacatgtggaaaagcctttgctaagaagtcacaactcattgtacatcaaagaattcatactggaaagaaaccatatgattgtggtgcatgcggaaaagccttcagtgagaagtttcatcttgttgtacatcagagaactcatactggggagaaaccttatgattgttctgaatgtggaaaagccttctctcagaaatcgtcccttattatacatcagagagttcacactggggaaaaaccctatgaatgtagtgaatgcgggaaagccttctcccagaaatcacccctcattatacatcagagaatacatactggggaaaaaccctatgaatgtagagagtgtgggaaggccttttcccagaagtcacagctgattatacaccacagagctcatactggagagaagccgtatgagtgtaccgaatgtgggaaagccttctgtgagaagtcccacctcattatacataaaagaattcacactggtgagaaaccctacaaatgtgctcaatgtgaggaagccttcagcaggaagacagaactcattacacatcagttagttcatactggggaaaaaccttatgaatgtactgaatgtggaaagacattctcccgcaagtcacagctcatcatacatcagagaacacatactggagaaaaaccctataaatgtagtgaatgtggcaaagccttctgccagaagtcacatctcattggacatcagagaattcacacaggagaaaaaccttatatatgtactgaatgtgggaaagccttctctcagaagtcccaccttccgggacaccagcgaattcatacaggagagaaaccttacatatgtgctgaatgtggaaaggccttttctcagaagtcagaccttgttttacatcagaggattcatactggggaaagaccctatcaatgtgctatatgtgggaaggccttcatccagaagtcacaactaactgtacaccagagaattcacacagtggtaaaatcataatgaactggccacagaaaagccttagtattagctcaagccttaataattactagaaacccaattaatttgataagcttggggacaacatcccaatagataaaaatttttaagggaatttgtttctagtttggtgatgcctaacttttccagcaaagatgatggaaaatagttatataaatgaagaacatttttaatatggcatgtaaagcttttaaagttatgaactcagtgatcagcacagcaagttaagcatacagaatattgtcaagttgcatattccttatactacaaaatgataatcagccattgtgaaactgctaatattagcttgtcataattatggccataaactaatttttctataaaagacgtggaagaaagcttaagtaaacaataaaataaaacctatacactattttaagaaggggcttgagcatgacccctaaagctacatgtaaagttcttgtacaaaaaatggaatgataggttgatcagattcagtaaagttgatctgtatgcattttcccatctcaagcatataagttgacctgcatctctggaaggaccttgagattgatgcattttgagcaggtctcccttttactcttcccaactgggaacttggagctgaaaaacattggcactgaggccagatggccttgggtttaatcctggctcagtgcctcacagattgtgtgactttaggcaaacatacttctcctagctgagtattttttatcagtaagtacaaatacaatgcagagctcattttcagttaatattagtactttttaaatctttactctctatcttgaagcattagatgttaagactaatgtgtaaaaaccacgtctgagcttgcttttccctctggacactctgcttttgattgcctatccctataagtggctcattttactgtcttctgatcctggtggccttatttttgctatgttaaggttgtgttttttaatacttggatttattttcatatacttacataaaccgtggtgattgcacataaagaccctgcctaatgtctcttcacttctttgtgatcctttccctgaagccccaactgtttgccctgaaaacttacaggggaaaactcttggtgtgagaagtaatgcctgtatagccttgagaactggaggcctctaagataacacctactatctgtcattccatccattcccccataagcatttttagatgagcacccttgctggaagtgacctgcaggagagcatacttggcaaggatgagaatacctgtgtgataaacacagcatctgcacatatttcctgcttgatttcctatccacttgatccccttcctgcttggctaaactgtctgttgtgaaaacatggggctcctctagttgagaacaactgtagagtagagggcacactggacagggatgtgggaactgagaattaaagatgccattcactggacagggatgtgggaactcaatgttaaagatatcactccccccacatcccaggtgatttatatattgttggggtgggaaaagagaaatccaaaagagcaaacccattcataaaatggatctgctaattttattgttgaataacagaaataaaaatactatgtagcatttgggtagctagcacatggctataaaactagtggatttttagctctatttatatggaactgaagctacagttgtgtggaactaagcttcccctctgttggtaaatggcagatacctagttttcatcaatagttacattgagcttactctga

SEQ ID NO: 299937 - DNA, 3084 bp, Homo sapiens
gcctcgggagcccggtgtggtgctcgcggacaggaagcaggagagtttgccaatagggatgtgacagcggttcccattaagcggtgatggtggttttgggacctgataatcgagctgggagtcagaggcgggatgtgtgcggtgaaggatgttttgatacccccatataaaataatctgtctgtcatgggagcccccacgtcctctgaaatagttcagctctgtctgcatgacttgtcctgggactgaggaaaatttaccagtcatctggccttttggaagagcaaaaaatgatgaagtcccaggggttagtatcattcaaggatgtggctgtggatttcacccaggaggagtggcagcaacttgacccttctcagaggaccctgtacagggatgtgatgctggagaactacagccacctggtctcaatggggtatccagtttccaaaccagatgtcatctccaagttggaacaaggagaagagccatggatcataaagggagacatatcaaattggatctatccagatgaatatcaggcagatgggagacaagacaggaagagtaaccttcacaactcccagtcatgtattttggggacagtttccttccatcataagatactgaaaggagtcacaagggatggttcattgtgctccattttaaaagtctgtcaaggtgatggtcagctgcagagatttctagagaatcaagacaaactcttcaggcaggtcacatttgttaacagcaaaacagtgactgaggcatcagggcataaatataatccactggggaaaatatttcaagagtgcatagaaacagatatatcaatacagagattccataaatatgatgcttttaaaaagaacttaaaaccaaatattgacctaccgagttgttataagagcaattcaagaaaaaaacctgatcagagttttggaggtggaaaatcatctagccagagtgagcccaattctaatcttgagaagattcacaatggagtaataccttttgatgataatcagtgtggaaacgtttttagaaatacacaatcccttattcaatatcagaatgtggaaactaaagagaaaagctgtgtatgtgttacatgtggaaaagcctttgctaagaagtcacaactcattgtacatcaaagaattcatactggaaagaaaccatatgattgtggtgcatgcggaaaagccttcagtgagaagtttcatcttgttgtacatcagagaactcatactggggagaaaccttatgattgttctgaatgtggaaaagccttctctcagaaatcgtcccttattatacatcagagagttcacactggggaaaaaccctatgaatgtagtgaatgcgggaaagccttctcccagaaatcacccctcattatacatcagagaatacatactggggaaaaaccctatgaatgtagagagtgtgggaaggccttttcccagaagtcacagctgattatacaccacagagctcatactggagagaagccgtatgagtgtaccgaatgtgggaaagccttctgtgagaagtcccacctcattatacataaaagaattcacactggtgagaaaccctacaaatgtgctcaatgtgaggaagccttcagcaggaagacagaactcattacacatcagttagttcatactggggaaaaaccttatgaatgtactgaatgtggaaagacattctcccgcaagtcacagctcatcatacatcagagaacacatactggagaaaaaccctataaatgtagtgaatgtggcaaagccttctgccagaagtcacatctcattggacatcagagaattcacacaggagaaaaaccttatatatgtactgaatgtgggaaagccttctctcagaagtcccaccttccgggacaccagcgaattcatacaggagagaaaccttacatatgtgctgaatgtggaaaggccttttctcagaagtcagaccttgttttacatcagaggattcatactggggaaagaccctatcaatgtgctatatgtgggaaggccttcatccagaagtcacaactaactgtacaccagagaattcacacagtggtaaaatcataatgaactggccacagaaaagccttagtattagctcaagccttaataattactagaaacccaattaatttgataagcttggggacaacatcccaatagataaaaatttttaagggaatttgtttctagtttggtgatgcctaacttttccagcaaagatgatggaaaatagttatataaatgaagaacatttttaatatggcatgtaaagcttttaaagttatgaactcagtgatcagcacagcaagttaagcatacagaatattgtcaagttgcatattccttatactacaaaatgataatcagccattgtgaaactgctaatattagcttgtcataattatggccataaactaatttttctataaaagacgtggaagaaagcttaagtaaacaataaaataaaacctatacactattttaagaaggggcttgagcatgacccctaaagctacatgtaaagttcttgtacaaaaaatggaatgataggttgatcagattcagtaaagttgatctgtatgcattttcccatctcaagcatataagttgacctgcatctctggaaggaccttgagattgatgcattttgagcaggtctcccttttactcttcccaactgggaacttggagctgaaaaacattggcactgaggccagatggccttgggtttaatcctggctcagtgcctcacagattgtgtgactttaggcaaacatacttctcctagctgagtattttttatcagtaagtacaaatacaatgcagagctcattttcagttaatattagtactttttaaatctttactctctatcttgaagcattagatgttaagactaatgtgtaaaaaccacgtctgagcttgcttttccctctggacactctgcttttgattgcctatccctataagggcaccaggatcagaagacagtaaaatgggccacttataggtcgacgcggccgcgaatttaatagtaggaggcg

SEQ ID NO: 299938 - DNA, 616 bp, Homo sapiens
atccaattataaaaccttggtcaacttctatgtgatcatattataggtacaagaggagtaaagaatgatccctcctccacatggtgcctgctgagacttctgtaaggctcaaacaaccttatcccacagggtagcccattagttacttgacttctgatgttagttgttgcaagattggtgaatgtgaaagctgcagtctgggtttggactatgaaaaacattctgatcaccagttttgctttttcagtcatctggccttttggaagagcaaaaaatgatgaagtcccaggggttagtatcattcaaggatgtggctgtggatttcacccaggaggagtggcagcaacttgacccttctcagaggaccctgtacagggatgtgatgctggagaactacagccacctggtctcaatggggtatccagtttccaaaccagatgtcatctccaagttggaacaaggagaagagccatggatcataaagggagacatatcaaattggatctatccagatgaatatcaggcagatgggagacaagggaagtgaaatatcaatttatgtttttttaattgattggtgcctgaggtttatgtttctatccttatcaaaatctcc

SEQ ID NO: 299939 - DNA, 459 bp, Homo sapiens
tccatttggtcattcccattcttactgccaaggagctccatcttcacttatatccttatatagctatccatgattattgcctcatgaaaatcttctataaatagaattgctgattcccaaggggaacagtaagttgttagtaaatcaactggaaacatatcttcacatctatccaattataaaaccttggtcaacttctatgtgatcatattataggtacaagaggagtaaagaatgatccctcctccacatggtgcctgctgagacttctgtaaggctcaaacaaccttatcccacagggtagcccattagttacttgacttctgatgttagttgttgcaagattggtgaatgtgaaagctgcagtctgggtttggactatgaaaaacattctgatcaccagttttgctttttcagtcatctggccttttggaagagcaaaaaatgatgaagtcccag

SEQ ID NO: 299940 - DNA, 377 bp, Homo sapiens
gttacttgatatttgattttctttctgtttgactttgtaaatttctgccaggtgcgccatttatatgatactggcgaaacaaaagatattcacctggaaatggagagcctggtgaattcccgaaccacccccaaattgactcgcaatgagtctgtagctcatcccagcatcatgaagcatttaccaacccagagctctccaatcctgccacttaggagtttttaacggagtttcattcagtagggatgattgcttaaatcactggccaactcatctccagccccctaccctccctggagattggaagccatcgaggagaccccagctgccagctatcttattaacatgcaaaatgaacccttatcacttagagatct

SEQ ID NO: 299941 - DNA, 4890 bp, Homo sapiens
ggggagcgacaggccccgggcgagcagacaacttaatggaggccccttccccctcagatcagaccaggagggcatcagtcaccaaatctgccacagccatcccacctccccctctggggagtgctgagagtgaggcagcatggaggagaggaagcatgagaccatgaacccagctcatgtcctctttgaccggtttgtccaggccaccacctgcaagggaaccctcaaggctttccaggagctctgtgaccacctggaactaaagccaaaggactaccgctccttctatcacaagctcaagtccaagcttaactactggaaagccaaagccctctgggcaaaattggacaaacggggcagtcacaaagactacaaaaagggaaaagcgtgcactatgtctcatcattggggctggcccctgtggtctccgtacagccatcgacttatccttactgggggccaaggtggttgttattgagaaacgagatgccttctcccgcaacaacgtcttgcatctctggccattcaccatacatgatctacgaggtctgggtgccaagaagttctatggcaagttctgtgctggagccatcgaccatatcagtatccgtcagctccaactaatacttttgaaagtagccttgatcctaggcattgaaatccacgtcaatgtggaattccaaggacttatacagcctcctgaggaccaagagaatgaacggataggctggcgggcactggtgcaccccaagactcatcctgtgtcagagtatgaatttgaagtgatcatcggtggggatggtcggaggaacaccttggaagggtttcgtcggaaagaattccgtggcaaactggccatcgccatcacggcaaattttatcaaccgaaatacaacagcagaagctaaagtggaagagatcagtggtgtggcttttatattcaaccaaaaatttttccaggaactgagggaagccacagcaggtattgacttggagaacatcgtttactacaaagatgacacacactatttcgttatgacagccaaaaagcagagtttgctggacaaaggagtgatactacatgactacgccgacacagagctcctgctttcccgagaaaacgtggaccaggaggctctgctcagctatgccagggaggcggcagacttctctacccagcagcagctgccgtctctggattttgccatcaatcactatgggcagcccgatgtggccatgtttgacttcacttgtatgtatgcctccgagaacgccgccttggtgcgggagcagaacggacaccagttactagtggctctggtcggggacagcctcctagagcctttctggccaatgggaacaggaatagcccggggctttctagctgctatggactctgcctggatggtccgaagttggtctctaggaacgagccctttggaagtgctggcagagagggaaagtatttacaggttgctgcctcagaccacccctgagaatgtgagtaagaacttcagccagtacagtatcgaccctgtcactcggtatcccaatatcaacgtcaacttcctccggccaagccaggtgcgccatttatatgatactggcgaaacaaaagatattcacctggaaatggagagcctggtgaattcccgaaccacccccaaattgactcgcaatgagtctgtagctcgttcaagcaaactgctgggttggtgccagaggcagacagatggctatgcaggggtaaacgtgacagatctcaccatgtcctggaaaagtggcttggccctttgtgcaattatccatagataccgccctgacctgatagattttgattctttggatgagcaaaatgtggagaagaataaccaactggcctttgacattgctgagaaggaattgggcatttctcccatcatgacaggcaaagaaatggcctccgtgggggagcctgataagctgtccatggtgatgtacctgactcagttctacgagatgtttaaggactccctcccctctagcgacaccttggacctaaatgccgaggagaaagcagtcctgatagccagcaccagatcccctatctccttcctaagcaaacttggccagaccatctctcggaagcgttctcccaaggataaaaaggaaaaggacttggatggtgctgggaagaggagaaagaccagtcaatcagaggaggaggaagctcctcggggccacagaggagaaagaccgaccctggtgagcactctgacagacaggaggatggacgttgccgttgggaaccagaacaaagtgaagtacatggcgacccagctgctggccaaatttgaagagaatgcgcccgcacagtccatcggcatacggagacagctgacacaagagcgtggggccagccagccgtcctgctgcctgcctgggcaggttcgccctgcccccaccccccggtggaaacagggctccatgaagaaggagttcccgcagaacctgggaggcagcgacacatgctacttctgccagaagcgggtctacgtgatggagaggctgagtgccgagggcaagttcttccaccggagctgcttcaagtgcgagtactgcgccaccaccctgcgcctctcggcctacgcctacgacatcgaggatggtaaattctactgtaagccacactactgctatcgactctctggctacgcacaaaggaagagaccggcagtggctcccctgtctggaaaggaggccaaaggacccctgcaggatggcgccaccacagatgcaaacggacgggccaacgccgtggccagctccactgagagaaccccaggttcaggcgtgaacggcctggaggagcccagcatcgccaagcgactgaggggcaccccagagcggatcgagctggagaactaccgcctgtccctgaggcaggctgaggcactgcaggaggtaccggaggagactcaggccgagcacaacctgagcagcgtgctggacacgggcgccgaggaggacgtcgccagcaggtcagcacgcagggctgcagggcgcccacccgccacacggccctaagagcctcctcacctctgtgtgtctcggtttcttctcagtgaagggaggcctcctgtctttcctgctgcccgcagtccattctccccagtcccttttaggttcttagcctcatcttctagtcagtgaggactcctccatcagactcaattcagagattcaggaagtatttattccttgaggacctgacatgtccccagctccaagtctgtcattgggaaggaaagtggcaggctctgcccccgggttattcacagattcagcagagggaaggacgggcacacggggagggactctgggtgattcagccaccagtgcaccgggccgtcttgagggaggcctagtccgtcccccaggcatctttttttctcctgtaggtaaagaaagggactgaaaatgtgtgccccaggggccgcatgcagcaccagtggatgcatgcttaggcagttccagagctgtaatcacatccagctgggtgacacctttggggatgtgcatgctataaccctaggactccctatatccactgccctgcaccccagggcttccagtatcagcgaaggcttcaaagtgttcagccgattacagatgatcaagagagccaagaatcaaaagggggtccggtgtcctgtggggcttcaggacagaaacacaggctgcaaacccgaggggcagaggcctcaagtggccttggagagcatttgaatcacacaccttgatttagccatgatgaagggaacatgtggggataaggagagcagagcagtttttttaaggtccaagaacgctttccagaaggtgtttgctgggccgagctgctttcagctgcacccgccacctcagccctcatgtcagacaccctctgcctagattcattcttgggctgcctcacagaccgctcctccgtgcatgccgggggcagcctctgccttggtgtctgcagttccaaagctgtcactgatggtgcatcctcatccagaactctgcttccctatccagagcacccatggaggccccactctccccactgtgcccagatgagggggagcccactctctctctccactgaccctgcagtgagggtgagagatgctgtgtgtcaaaacacatttataaacccttgagcagagctactggcttgaccttgggctgagtgtgggtcagcaccattttctccactgtaatttataaattgtgagaggcagtggggcagcaagttcatgtaatgtagcaaggacattccaggaaggctaacccctggcatttatggcaggtatgacaggagggcagcacagaaaacatgaaatcagtcagcatctatgcaatgcaatacatgcctcatcttactcagattgaagttaaaaaaagattttaaaactagcattcatgctgggcgcagtggctcatgcctgtaatcccagcactttgggaggccaaggtgggcacatcacttaaggtcaggagttcaagaccagcctggccaacataatgaaaccctgtctctactaaaaatacaaaaattagctgggcatggtggtgcacacctgtaatcccagctacttgggagggtaaggcatgagaattgcttgaacctgggaggcggaggttgcagcgagccgagatcatgccactgcaccactgcactccagcctgtgtgacagaatgagactccatctcaaaaaaaattaaaattaaaatcaaaaaataaaataaaggccaggcacggtggctcacacaggagaatcacttgaacctgggaggcggaggttgcagtgatctgagatcacaccagtacactccagcctgggagatggtgagactccgtctc

SEQ ID NO: 299942 - DNA, 4806 bp, Homo sapiens
ggggagcgacaggccccgggcgagcagacaacttaatggaggccccttccccctcagatcagaccaggagggcatcagtcaccaaatctgccacagccatcccacctccccctctggggagtgctgagagtgaggcagcatggaggagaggaagcatgagaccatgaacccagctcatgtcctctttgaccggtttgtccaggccaccacctgcaagggaaccctcaaggctttccaggagctctgtgaccacctggaactaaagccaaaggactaccgctccttctatcacaagctcaagtccaagcttaactactggaaagccaaagccctctgggcaaaattggacaaacggggcagtcacaaagactacaaaaagggaaaagcgtgcactatgtctcatcattggggctggcccctgtggtctccgtacagccatcgacttatccttactgggggccaaggtggttgttattgagaaacgagatgccttctcccgcaacaacgtcttgcatctctggccattcaccatacatgatctacgaggtctgggtgccaagaagttctatggcaagttctgtgctggagccatcgaccatatcagtatccgtcagctccaactaatacttttgaaagtagccttgatcctaggcattgaaatccacgtcaatgtggaattccaaggacttatacagcctcctgaggaccaagagaatgaacggataggctggcgggcactggtgcaccccaagactcatcctgtgtcagagtatgaatttgaagtgatcatcggtggggatggtcggaggaacaccttggaagggtttcgtcggaaagaattccgtggcaaactggccatcgccatcacggcaaattttatcaaccgaaatacaacagcagaagctaaagtggaagagatcagtggtgtggcttttatattcaaccaaaaatttttccaggaactgagggaagccacagcaggtattgacttggagaacatcgtttactacaaagatgacacacactatttcgttatgacagccaaaaagcagagtttgctggacaaaggagtgatactacatgactacgccgacacagagctcctgctttcccgagaaaacgtggaccaggaggctctgctcagctatgccagggaggcggcagacttctctacccagcagcagctgccgtctctggattttgccatcaatcactatgggcagcccgatgtggccatgtttgacttcacttgtatgtatgcctccgagaacgccgccttggtgcgggagcagaacggacaccagttactagtggctctggtcggggacagcctcctagagcctttctggccaatgggaacaggaatagcccggggctttctagctgctatggactctgcctggatggtccgaagttggtctctaggaacgagccctttggaagtgctggcagagagggaaagtatttacaggttgctgcctcagaccacccctgagaatgtgagtaagaacttcagccagtacagtatcgaccctgtcactcggtatcccaatatcaacgtcaacttcctccggccaagccaggtgcgccatttatatgatactggcgaaacaaaagatattcacctggaaatggagagcctggtgaattcccgaaccacccccaaattgactcgcaatgagtctgtagctcgttcaagcaaactgctgggttggtgccagaggcagacagatggctatgcaggggtaaacgtgacagatctcaccatgtcctggaaaagtggcttggccctttgtgcaattatccatagataccgccctgacctgatagattttgattctttggatgagcaaaatgtggagaagaataaccaactggcctttgacattgctgagaaggaattgggcatttctcccatcatgacaggcaaagaaatggcctccgtgggggagcctgataagctgtccatggtgatgtacctgactcagttctacgagatgtttaaggactccctcccctctagcgacaccttggacctaaatgccgaggagaaagcagtcctgatagccagcaccagatcccctatctccttcctaagcaaacttggccagaccatctctcggaagcgttctcccaaggataaaaaggaaaaggacttggatggtgctgggaagaggagaaagaccagtcaatcagaggaggaggaagctcctcggggccacagaggagaaagaccgaccctggtgagcactctgacagacaggaggatggacgttgccgttgggaaccagaacaaagtgaagtacatggcgacccagctgctggccaaatttgaagagaatgcgcccgcacagtccatcggcatacggagacagggctccatgaagaaggagttcccgcagaacctgggaggcagcgacacatgctacttctgccagaagcgggtctacgtgatggagaggctgagtgccgagggcaagttcttccaccggagctgcttcaagtgcgagtactgcgccaccaccctgcgcctctcggcctacgcctacgacatcgaggatggtaaattctactgtaagccacactactgctatcgactctctggctacgcacaaaggaagagaccggcagtggctcccctgtctggaaaggaggccaaaggacccctgcaggatggcgccaccacagatgcaaacggacgggccaacgccgtggccagctccactgagagaaccccaggttcaggcgtgaacggcctggaggagcccagcatcgccaagcgactgaggggcaccccagagcggatcgagctggagaactaccgcctgtccctgaggcaggctgaggcactgcaggaggtaccggaggagactcaggccgagcacaacctgagcagcgtgctggacacgggcgccgaggaggacgtcgccagcaggtcagcacgcagggctgcagggcgcccacccgccacacggccctaagagcctcctcacctctgtgtgtctcggtttcttctcagtgaagggaggcctcctgtctttcctgctgcccgcagtccattctccccagtcccttttaggttcttagcctcatcttctagtcagtgaggactcctccatcagactcaattcagagattcaggaagtatttattccttgaggacctgacatgtccccagctccaagtctgtcattgggaaggaaagtggcaggctctgcccccgggttattcacagattcagcagagggaaggacgggcacacggggagggactctgggtgattcagccaccagtgcaccgggccgtcttgagggaggcctagtccgtcccccaggcatctttttttctcctgtaggtaaagaaagggactgaaaatgtgtgccccaggggccgcatgcagcaccagtggatgcatgcttaggcagttccagagctgtaatcacatccagctgggtgacacctttggggatgtgcatgctataaccctaggactccctatatccactgccctgcaccccagggcttccagtatcagcgaaggcttcaaagtgttcagccgattacagatgatcaagagagccaagaatcaaaagggggtccggtgtcctgtggggcttcaggacagaaacacaggctgcaaacccgaggggcagaggcctcaagtggccttggagagcatttgaatcacacaccttgatttagccatgatgaagggaacatgtggggataaggagagcagagcagtttttttaaggtccaagaacgctttccagaaggtgtttgctgggccgagctgctttcagctgcacccgccacctcagccctcatgtcagacaccctctgcctagattcattcttgggctgcctcacagaccgctcctccgtgcatgccgggggcagcctctgccttggtgtctgcagttccaaagctgtcactgatggtgcatcctcatccagaactctgcttccctatccagagcacccatggaggccccactctccccactgtgcccagatgagggggagcccactctctctctccactgaccctgcagtgagggtgagagatgctgtgtgtcaaaacacatttataaacccttgagcagagctactggcttgaccttgggctgagtgtgggtcagcaccattttctccactgtaatttataaattgtgagaggcagtggggcagcaagttcatgtaatgtagcaaggacattccaggaaggctaacccctggcatttatggcaggtatgacaggagggcagcacagaaaacatgaaatcagtcagcatctatgcaatgcaatacatgcctcatcttactcagattgaagttaaaaaaagattttaaaactagcattcatgctgggcgcagtggctcatgcctgtaatcccagcactttgggaggccaaggtgggcacatcacttaaggtcaggagttcaagaccagcctggccaacataatgaaaccctgtctctactaaaaatacaaaaattagctgggcatggtggtgcacacctgtaatcccagctacttgggagggtaaggcatgagaattgcttgaacctgggaggcggaggttgcagcgagccgagatcatgccactgcaccactgcactccagcctgtgtgacagaatgagactccatctcaaaaaaaattaaaattaaaatcaaaaaataaaataaaggccaggcacggtggctcacacaggagaatcacttgaacctgggaggcggaggttgcagtgatctgagatcacaccagtacactccagcctgggagatggtgagactccgtctc

SEQ ID NO: 299943 - DNA, 3548 bp, Homo sapiens
agttacaacagctcctggattcgttaattttttgaacggacaccagttactagtggctctggtcggggacagcctcctagagcctttctggccaatgggaacaggaatagcccggggctttctagctgctatggactctgcctggatggtccgaagttggtctctaggaacgagccctttggaagtgctggcagagagggaaagtatttacaggttgctgcctcagaccacccctgagaatgtgagtaagaacttcagccagtacagtatcgaccctgtcactcggtatcccaatatcaacgtcaacttcctccggccaagccaggtgcgccatttatatgatactggcgaaacaaaagatattcacctggaaatggagagcctggtgaattcccgaaccacccccaaattgactcgcaatgagtctgtagctcgttcaagcaaactgctgggttggtgccagaggcagacagatggctatgcaggggtaaacgtgacagatctcaccatgtcctggaaaagtggcttggccctttgtgcaattatccatagataccgccctgacctgatagattttgattctttggatgagcaaaatgtggagaagaataaccaactggcctttgacattgctgagaaggaattgggcatttctcccatcatgacaggcaaagaaatggcctccgtgggggagcctgataagctgtccatggtgatgtacctgactcagttctacgagatgtttaaggactccctcccctctagcgacaccttggacctaaatgccgaggagaaagcagtcctgatagccagcaccagatcccctatctccttcctaagcaaacttggccagaccatctctcggaagcgttctcccaaggataaaaaggaaaaggacttggatggtgctgggaagaggagaaagaccagtcaatcagaggaggaggaagctcctcggggccacagaggagaaagaccgaccctggtgagcactctgacagacaggaggatggacgttgccgttgggaaccagaacaaagtgaagtacatggcgacccagctgctggccaaatttgaagagaatgcgcccgcacagtccatcggcatacggagacagggctccatgaagaaggagttcccgcagaacctgggaggcagcgacacatgctacttctgccagaagcgggtctacgtgatggagaggctgagtgccgagggcaagttcttccaccggagctgcttcaagtgcgagtactgcgccaccaccctgcgcctctcggcctacgcctacgacatcgaggatggtaaattctactgtaagccacactactgctatcgactctctggctacgcacaaaggaagagaccggcagtggctcccctgtctggaaaggaggccaaaggacccctgcaggatggcgccaccacagatgcaaacggacgggccaacgccgtggccagctccactgagagaaccccaggttcaggcgtgaacggcctggaggagcccagcatcgccaagcgactgaggggcaccccagagcggatcgagctggagaactaccgcctgtccctgaggcaggctgaggcactgcaggaggtaccggaggagactcaggccgagcacaacctgagcagcgtgctggacacgggcgccgaggaggacgtcgccagcaggtcagcacgcagggctgcagggcgcccacccgccacacggccctaagagcctcctcacctctgtgtgtctcggtttcttctcagtgaagggaggcctcctgtctttcctgctgcccgcagtccattctccccagtcccttttaggttcttagcctcatcttctagtcagtgaggactcctccatcagactcaattcagagattcaggaagtatttattccttgaggacctgacatgtccccagctccaagtctgtcattgggaaggaaagtggcaggctctgcccccgggttattcacagattcagcagagggaaggacgggcacacggggagggactctgggtgattcagccaccagtgcaccgggccgtcttgagggaggcctagtccgtcccccaggcatctttttttctcctgtaggtaaagaaagggactgaaaatgtgtgccccaggggccgcatgcagcaccagtggatgcatgcttaggcagttccagagctgtaatcacatccagctgggtgacacctttggggatgtgcatgctataaccctaggactccctatatccactgccctgcaccccagggcttccagtatcagcgaaggcttcaaagtgttcagccgattacagatgatcaagagagccaagaatcaaaagggggtccggtgtcctgtggggcttcaggacagaaacacaggctgcaaacccgaggggcagaggcctcaagtggccttggagagcatttgaatcacacaccttgatttagccatgatgaagggaacatgtggggataaggagagcagagcagtttttttaaggtccaagaacgctttccagaaggtgtttgctgggccgagctgctttcagctgcacccgccacctcagccctcatgtcagacaccctctgcctagattcattcttgggctgcctcacagaccgctcctccgtgcatgccgggggcagcctctgccttggtgtctgcagttccaaagctgtcactgatggtgcatcctcatccagaactctgcttccctatccagagcacccatggaggccccactctccccactgtgcccagatgagggggagcccactctctctctccactgaccctgcagtgagggtgagagatgctgtgtgtcaaaacacatttataaacccttgagcagagctactggcttgaccttgggctgagtgtgggtcagcaccattttctccactgtaatttataaattgtgagaggcagtggggcagcaagttcatgtaatgtagcaaggacattccaggaaggctaacccctggcatttatggcaggtatgacaggagggcagcacagaaaacatgaaatcagtcagcatctatgcaatgcaatacatgcctcatcttactcagattgaagttaaaaaaagattttaaaactagcattcatgctgggcgcagtggctcatgcctgtaatcccagcactttgggaggccaaggtgggcacatcacttaaggtcaggagttcaagaccagcctggccaacataatgaaaccctgtctctactaaaaatacaaaaattagctgggcatggtggtgcacacctgtaatcccagctacttgggagggtaaggcatgagaattgcttgaacctgggaggcggaggttgcagcgagccgagatcatgccactgcaccactgcactccagcctgtgtgacagaatgagactccatctcaaaaaaaattaaaattaaaatcaaaaaataaaataaaggccaggcacggtggctcacacaggagaatcacttgaacctgggaggcggaggttgcagtgatctgagatcacaccagtacactccagcctgggagatggtgagactccgtctc

SEQ ID NO: 299944 - DNA, 3677 bp, Homo sapiens
ttttctttaaaattgaagtaaatattgggatgcttgaaaaaataaaagagtaaatgtgtgaccttttgagttggaggcagcatctgtgggcgctcacggttttgtgcctgctctctctcctcggctcttacccggtcggttcctgtgggatcactgcaggtgggtgtggggagcaggggctgacgtaggactcaagaagactggtcaaggatgaggatttgtcaggcatgtcaggtgacttgctgcgctgtcagaacaatcatgaaacgagagggagatgttcatggtgctggtcccgattctgagtatattgttgtgttattgcagggaaagtatttacaggttgctgcctcagaccacccctgagaatgtgagtaagaacttcagccagtacagtatcgaccctgtcactcggtatcccaatatcaacgtcaacttcctccggccaagccaggtgcgccatttatatgatactggcgaaacaaaagatattcacctggaaatggagagcctggtgaattcccgaaccacccccaaattgactcgcaatgagtctgtagctcgttcaagcaaactgctgggttggtgccagaggcagacagatggctatgcaggggtaaacgtgacagatctcaccatgtcctggaaaagtggcttggccctttgtgcaattatccatagataccgccctgacctgatagattttgattctttggatgagcaaaatgtggagaagaataaccaactggcctttgacattgctgagaaggaattgggcatttctcccatcatgacaggcaaagaaatggcctccgtgggggagcctgataagctgtccatggtgatgtacctgactcagttctacgagatgtttaaggactccctcccctctagcgacaccttggacctaaatgccgaggagaaagcagtcctgatagccagcaccagatcccctatctccttcctaagcaaacttggccagaccatctctcggaagcgttctcccaaggataaaaaggaaaaggacttggatggtgctgggaagaggagaaagaccagtcaatcagaggaggaggaagctcctcggggccacagaggagaaagaccgaccctggtgagcactctgacagacaggaggatggacgttgccgttgggaaccagaacaaagtgaagtacatggcgacccagctgctggccaaatttgaagagaatgcgcccgcacagtccatcggcatacggagacagggctccatgaagaaggagttcccgcagaacctgggaggcagcgacacatgctacttctgccagaagcgggtctacgtgatggagaggctgagtgccgagggcaagttcttccaccggagctgcttcaagtgcgagtactgcgccaccaccctgcgcctctcggcctacgcctacgacatcgaggatggtaaattctactgtaagccacactactgctatcgactctctggctacgcacaaaggaagagaccggcagtggctcccctgtctggaaaggaggccaaaggacccctgcaggatggcgccaccacagatgcaaacggacgggccaacgccgtggccagctccactgagagaaccccaggttcaggcgtgaacggcctggaggagcccagcatcgccaagcgactgaggggcaccccagagcggatcgagctggagaactaccgcctgtccctgaggcaggctgaggcactgcaggaggtaccggaggagactcaggccgagcacaacctgagcagcgtgctggacacgggcgccgaggaggacgtcgccagcaggtcagcacgcagggctgcagggcgcccacccgccacacggccctaagagcctcctcacctctgtgtgtctcggtttcttctcagtgaagggaggcctcctgtctttcctgctgcccgcagtccattctccccagtcccttttaggttcttagcctcatcttctagtcagtgaggactcctccatcagactcaattcagagattcaggaagtatttattccttgaggacctgacatgtccccagctccaagtctgtcattgggaaggaaagtggcaggctctgcccccgggttattcacagattcagcagagggaaggacgggcacacggggagggactctgggtgattcagccaccagtgcaccgggccgtcttgagggaggcctagtccgtcccccaggcatctttttttctcctgtaggtaaagaaagggactgaaaatgtgtgccccaggggccgcatgcagcaccagtggatgcatgcttaggcagttccagagctgtaatcacatccagctgggtgacacctttggggatgtgcatgctataaccctaggactccctatatccactgccctgcaccccagggcttccagtatcagcgaaggcttcaaagtgttcagccgattacagatgatcaagagagccaagaatcaaaagggggtccggtgtcctgtggggcttcaggacagaaacacaggctgcaaacccgaggggcagaggcctcaagtggccttggagagcatttgaatcacacaccttgatttagccatgatgaagggaacatgtggggataaggagagcagagcagtttttttaaggtccaagaacgctttccagaaggtgtttgctgggccgagctgctttcagctgcacccgccacctcagccctcatgtcagacaccctctgcctagattcattcttgggctgcctcacagaccgctcctccgtgcatgccgggggcagcctctgccttggtgtctgcagttccaaagctgtcactgatggtgcatcctcatccagaactctgcttccctatccagagcacccatggaggccccactctccccactgtgcccagatgagggggagcccactctctctctccactgaccctgcagtgagggtgagagatgctgtgtgtcaaaacacatttataaacccttgagcagagctactggcttgaccttgggctgagtgtgggtcagcaccattttctccactgtaatttataaattgtgagaggcagtggggcagcaagttcatgtaatgtagcaaggacattccaggaaggctaacccctggcatttatggcaggtatgacaggagggcagcacagaaaacatgaaatcagtcagcatctatgcaatgcaatacatgcctcatcttactcagattgaagttaaaaaaagattttaaaactagcattcatgctgggcgcagtggctcatgcctgtaatcccagcactttgggaggccaaggtgggcacatcacttaaggtcaggagttcaagaccagcctggccaacataatgaaaccctgtctctactaaaaatacaaaaattagctgggcatggtggtgcacacctgtaatcccagctacttgggagggtaaggcatgagaattgcttgaacctgggaggcggaggttgcagcgagccgagatcatgccactgcaccactgcactccagcctgtgtgacagaatgagactccatctcaaaaaaaattaaaattaaaatcaaaaaataaaataaaggccaggcacggtggctcacacaggagaatcacttgaacctgggaggcggaggttgcagtgatctgagatcacaccagtacactccagcctgggagatggtgagactccgtctc

SEQ ID NO: 299945 - DNA, 3314 bp, Homo sapiens
ggggagcgacaggccccgggcgagcagacaacttaatggaggccccttccccctcagatcagaccaggagggcatcagtcaccaaatctgccacagccatcccacctccccctctggggagtgctgagagtgaggcagcatggaggagaggaagcatgagaccatgaacccagctcatgtcctctttgaccggtttgtccaggccaccacctgcaagggaaccctcaaggctttccaggagctctgtgaccacctggaactaaagccaaaggactaccgctccttctatcacaagctcaagtccaagcttaactactggaaagccaaagccctctgggcaaaattggacaaacggggcagtcacaaagactacaaaaagggaaaagcgtgcactatgtctcatcattggggctggcccctgtggtctccgtacagccatcgacttatccttactgggggccaaggtggttgttattgagaaacgagatgccttctcccgcaacaacgtcttgcatctctggccattcaccatacatgatctacgaggtctgggtgccaagaagttctatggcaagttctgtgctggagccatcgaccatatcagtatccgtcagctccaactaatacttttgaaagtagccttgatcctaggcattgaaatccacgtcaatgtggaattccaaggacttatacagcctcctgaggaccaagagaatgaacggataggctggcgggcactggtgcaccccaagactcatcctgtgtcagagtatgaatttgaagtgatcatcggtggggatggtcggaggaacaccttggaagggtttcgtcggaaagaattccgtggcaaactggccatcgccatcacggcaaattttatcaaccgaaatacaacagcagaagctaaagtggaagagatcagtggtgtggcttttatattcaaccaaaaatttttccaggaactgagggaagccacagcaggtattgacttggagaacatcgtttactacaaagatgacacacactatttcgttatgacagccaaaaagcagagtttgctggacaaaggagtgatactacatgactacgccgacacagagctcctgctttcccgagaaaacgtggaccaggaggctctgctcagctatgccagggaggcggcagacttctctacccagcagcagctgccgtctctggattttgccatcaatcactatgggcagcccgatgtggccatgtttgacttcacttgtatgtatgcctccgagaacgccgccttggtgcgggagcagaacggacaccagttactagtggctctggtcggggacagcctcctagagcctttctggccaatgggaacaggaatagcccggggctttctagctgctatggactctgcctggatggtccgaagttggtctctaggaacgagccctttggaagtgctggcagagagggaaagtatttacaggttgctgcctcagaccacccctgagaatgtgagtaagaacttcagccagtacagtatcgaccctgtcactcggtatcccaatatcaacgtcaacttcctccggccaagccaggtgcgccatttatatgatactggcgaaacaaaagatattcacctggaaatggagagcctggtgaattcccgaaccacccccaaattgactcgcaatgagtctgtagctcgttcaagcaaactgctgggttggtgccagaggcagacagatggctatgcaggggtaaacgtgacagatctcaccatgtcctggaaaagtggcttggccctttgtgcaattatccatagataccgccctgacctgatagattttgattctttggatgagcaaaatgtggagaagaataaccaactggcctttgacattgctgagaaggaattgggcatttctcccatcatgacaggcaaagaaatggcctccgtgggggagcctgataagctgtccatggtgatgtacctgactcagttctacgagatgtttaaggactccctcccctctagcgacaccttggacctaaatgccgaggagaaagcagtcctgatagccagcaccagatcccctatctccttcctaagcaaacttggccagaccatctctcggaagcgttctcccaaggataaaaaggaaaaggacttggatggtgctgggaagaggagaaagaccagtcaatcagaggaggaggaagctcctcggggccacagaggagaaagaccgaccctggtgagcactctgacagacaggaggatggacgttgccgttgggaaccagaacaaagtgaagtacatggcgacccagctgctggccaaatttgaagagaatgcgcccgcacagtccatcggcatacggagacagggctccatgaagaaggagttcccgcagaacctgggaggcagcgacacatgctacttctgccagaagcgggtctacgtgatggagaggctgagtgccgagggcaagttcttccaccggagctgcttcaagtgcgagtactgcgccaccaccctgcgcctctcggcctacgcctacgacatcgaggatggtaaattctactgtaagccacactactgctatcgactctctggctacgcacaaaggaagagaccggcagtggctcccctgtctggaaaggaggccaaaggacccctgcaggatggcgccaccacagatgcaaacggacgggccaacgccgtggccagctccactgagagaaccccaggtagcctcacttccttgtttggctgggtggcgcgtcactccctcggcctctgtgacaaggccaagggcatgagccagcacctccaaagcaacatttcttcattcgggcaacaagtggcccaaaaccctctggactcctttttcatgtgccagctgcttgcgttcggagtcccctttctctatggcctgtcggaggtgctggtgcaaatcagaggggagttccactggcaggctgtggcccagtgatggggccgtccggtgggcggcagagccgtgaagtgctgtccctcagccccgtcccgcaccatcacacctgagggcggcccaggtcctgtgtaggtagacaggagctcgcaggcgctcagacactgctcccatcacccgccctggtgaggccaaggccactcggccttcatgcagtttgcttccaagctcctctgacggcctggagctgtgttgattaagccccgtggtcttgttttgggttcaccttcacttaagattctgcgtcctgttccctgtcactgtgtgtggatgagctgtggctgctctcctgtctgccctgcaccgtgatgg

SEQ ID NO: 299946 - DNA, 3039 bp, Homo sapiens
  misc_feature (3039)..(3039): n is a, c, g, or t
ggggagcgacaggccccgggcgagcagacaacttaatggaggccccttccccctcagatcagaccaggagggcatcagtcaccaaatctgccacagccatcccacctccccctctggggagtgctgagagtgaggcagcatggaggagaggaagcatgagaccatgaacccagctcatgtcctctttgaccggtttgtccaggccaccacctgcaagggaaccctcaaggctttccaggagctctgtgaccacctggaactaaagccaaaggactaccgctccttctatcacaagctcaagtccaagcttaactactggaaagccaaagccctctgggcaaaattggacaaacggggcagtcacaaagactacaaaaagggaaaagcgtgcactatgtctcatcattggggctggcccctgtggtctccgtacagccatcgacttatccttactgggggccaaggtggttgttattgagaaacgagatgccttctcccgcaacaacgtcttgcatctctggccattcaccatacatgatctacgaggtctgggtgccaagaagttctatggcaagttctgtgctggagccatcgaccatatcagtatccgtcagctccaactaatacttttgaaagtagccttgatcctaggcattgaaatccacgtcaatgtggaattccaaggacttatacagcctcctgaggaccaagagaatgaacggataggctggcgggcactggtgcaccccaagactcatcctgtgtcagagtatgaatttgaagtgatcatcggtggggatggtcggaggaacaccttggaagggtttcgtcggaaagaattccgtggcaaactggccatcgccatcacggcaaattttatcaaccgaaatacaacagcagaagctaaagtggaagagatcagtggtgtggcttttatattcaaccaaaaatttttccaggaactgagggaagccacagcaggtattgacttggagaacatcgtttactacaaagatgacacacactatttcgttatgacagccaaaaagcagagtttgctggacaaaggagtgatactacatgactacgccgacacagagctcctgctttcccgagaaaacgtggaccaggaggctctgctcagctatgccagggaggcggcagacttctctacccagcagcagctgccgtctctggattttgccatcaatcactatgggcagcccgatgtggccatgtttgacttcacttgtatgtatgcctccgagaacgccgccttggtgcgggagcagaacggacaccagttactagtggctctggtcggggacagcctcctagagcctttctggccaatgggaacaggaatagcccggggctttctagctgctatggactctgcctggatggtccgaagttggtctctaggaacgagccctttggaagtgctggcagagagggaaagtatttacaggttgctgcctcagaccacccctgagaatgtgagtaagaacttcagccagtacagtatcgaccctgtcactcggtatcccaatatcaacgtcaacttcctccggccaagccaggtgcgccatttatatgatactggcgaaacaaaagatattcacctggaaatggagagcctggtgaattcccgaaccacccccaaattgactcgcaatgagtctgtagctcgttcaagcaaactgctgggttggtgccagaggcagacagatggctatgcaggggtaaacgtgacagatctcaccatgtcctggaaaagtggcttggccctttgtgcaattatccatagataccgccctgacctgatagattttgattctttggatgagcaaaatgtggagaagaataaccaactggcctttgacattgctgagaaggaattgggcatttctcccatcatgacaggcaaagaaatggcctccgtgggggagcctgataagctgtccatggtgatgtacctgactcagttctacgagatgtttaaggactccctcccctctagcgacaccttggacctaaatgccgaggagaaagcagtcctgatagccagcaccagatcccctatctccttcctaagcaaacttggccagaccatctctcggaagcgttctcccaaggataaaaaggaaaaggacttggatggtgctgggaagaggagaaagaccagtcaatcagaggaggaggaagctcctcggggccacagaggagaaagaccgaccctggtgagcactctgacagacaggaggatggacgttgccgttgggaaccagaacaaagtgaagtacatggcgacccagctgctggccaaatttgaagagaatgcgcccgcacagtccatcggcatacggagacagggctccatgaagaaggagttcccgcagaacctgggaggcagcgacacatgctacttctgccagaagcgggtctacgtgatggagaggctgagtgccgagggcaagttcttccaccggagctgcttcaagtgcgagtactgcgccaccaccctgcgcctctcggcctacgcctacgacatcgaggatggtaaattctactgtaagccacactactgctatcgactctctggctacgcacaaaggaagagaccggcagtggctcccctgtctggaaaggaggccaaaggacccctgcaggatggcgccaccacagatgcaaacggacgggccaacgccgtggccagctccactgagagaaccccaggttcaggcgtgaacggcctggaggagcccagcatcgccaagcgactgaggggcaccccagagcggatcgagctggagaactaccgcctgtccctgaggcaggctgaggcactgcaggaggtaccggaggagactcaggccgagcacaacctgagcagcgtgctggacacgggcgccgaggaggacgtcgccagcagtttgcttgaacgagctacagactcattgcgagtcaatttggggggggttcgggaattcaccaggctctccatttccaggtgaatatcgcttgtttccccagtgn

SEQ ID NO: 299947 - DNA, 1686 bp, Homo sapiens
ggggagcgacaggccccgggcgagcagacaacttaatggaggccccttccccctcagatcagaccaggagggcatcagtcaccaaatctgccacagccatcccacctccccctctggggagtgctgagagtgaggcagcatggaggagaggaagcatgagaccatgaacccagctcatgtcctctttgaccggtttgtccaggccaccacctgcaagggaaccctcaaggctttccaggagctctgtgaccacctggaactaaagccaaaggactaccgctccttctatcacaagctcaagtccaagcttaactactggaaagccaaagccctctgggcaaaattggacaaacggggcagtcacaaagactacaaaaagggaaaagcgtgcactatgtctcatcattggggctggcccctgtggtctccgtacagccatcgacttatccttactgggggccaaggtggttgttattgagaaacgagatgccttctcccgcaacaacgtcttgcatctctggccattcaccatacatgatctacgaggtctgggtgccaagaagttctatggcaagttctgtgctggagccatcgaccatatcagtatccgtcagctccaactaatacttttgaaagtagccttgatcctaggcattgaaatccacgtcaatgtggaattccaaggacttatacagcctcctgaggaccaagagaatgaacggataggctggcgggcactggtgcaccccaagactcatcctgtgtcagagtatgaatttgaagtgatcatcggtggggatggtcggaggaacaccttggaagggtttcgtcggaaagaattccgtggcaaactggccatcgccatcacggcaaattttatcaaccgaaatacaacagcagaagctaaagtggaagagatcagtggtgtggcttttatattcaaccaaaaatttttccaggaactgagggaagccacagcaggtattgacttggagaacatcgtttactacaaagatgacacacactatttcgttatgacagccaaaaagcagagtttgctggacaaaggagtgatactacatgactacgccgacacagagctcctgctttcccgagaaaacgtggaccaggaggctctgctcagctatgccagggaggcggcagacttctctacccagcagcagctgccgtctctggattttgccatcaatcactatgggcagcccgatgtggccatgtttgacttcacttgtatgtatgcctccgagaacgccgccttggtgcgggagcagaacggacaccagttactagtggctctggtcggggacagcctcctagagcctttctggccaatgggaacaggaatagcccggggctttctagctgctatggactctgcctggatggtccgaagttggtctctaggaacgagccctttggaagtgctggcagagagggaaagtatttacaggttgctgcctcagaccacccctgagaatgtgagtaagaacttcagccagtacagtatcgaccctgtcactcggtatcccaatatcaacgtcaacttcctccggccaagccaggtaagaccttcttgtcagtatttacatctgggcccatctgcagtgagccatcatcatggcatcattgcattccagcctgggcaacagagcaagacctcgtctc

SEQ ID NO: 299948 - DNA, 874 bp, Homo sapiens
ggggagcgacaggccccgggcgagcagacaacttaatggaggccccttccccctcagatcagaccaggagggcatcagtcaccaaatctgccacagccatcccacctccccctctggggagtgctgagagtgaggcagcatggaggagaggaagcatgagaccatgaacccagctcatgtcctctttgaccggtttgtccaggccaccacctgcaagggaaccctcaaggctttccaggagctctgtgaccacctggaactaaagccaaaggactaccgctccttctatcacaagctcaagtccaagcttaactactggaaagccaaagccctctgggcaaaattggacaaacggggcagtcacaaagactacaaaaagggaaaagcgtgcactacaggtattgacttggagaacatcgtttactacaaagatgacacacactatttcgttatgacagccaaaaagcagagtttgctggacaaaggagtgatactacatgtgagccacggatttccttcaaaactctttcttattgaagtggttaatatcaccaagagaaagaattgtctgatgggtttttcctgcaagggaatgaaaatgagcactgaatgcatcttctggtaacccctgatgttttccagtttagcgtgaacaactcttaactatggctaatttcaaatgtaaataaaaacggggggagaatagtgtaatgaaccctcacgtacctaccgtccagctttcacagttctcaacacgtggccagtgttctgtcagtaatatttctgtgcactccttcttcaccactggattcttgcaaagcaggtttcagacagcatttcatgcataaatactcagtttaattttaaaaaaaaa

SEQ ID NO: 299949 - DNA, 312 bp, Homo sapiens
agatggctatgcaggggtaaacgtgacagatctcaccatgtcctggaaaagtggcttggccctttgtgcaattatccatagataccgccctgacctgatgtaagttgtgatcaaactttgtgtttttttatactcctcaaggatctcagaccactctgctatcaagtaacattttgtcctttttcctagaatgaggtacatagtaagatactttctctagaaggcagtgattttgatttcactatatttgaaactctgtatgtcatgtattatatagctcaacccaggaatgatttttatttttgttttttt

SEQ ID NO: 299950 - DNA, 428 bp, Homo sapiens
ctccatccctaccctcctctttctctggagacaggactacgccgacacagagctcctgctttcccgagaaaacgtggaccaggaggctctgctcagctatgccagggaggcggcagacttctctacccagcagcagctgccgtctctggattttgccatcaatcactatgggcagcccgatgtggccatgtttgacttcacttgtatgtatgcctccgagaacgccgccttggtgcgggagcagaacggacaccagttactagtggctctggtcggggacagcctcctagaggtgagtgctaagcatggcagcactctgtggtaggggcaggaataattaggagtgaatctgggcatcctgggtcttggaatgagcgtctgcagtgttgtacagcacaggtaaactccctgcaggagtcacaccagga

SEQ ID NO: 299951 - DNA, 561 bp, Homo sapiens
acaggtcccagtactctttatacggccctacctccaggcttgctgtctctgtgtggacacgggaaccttgagagctgagccagtccaccagcccccatgccaggtcctgagtgcacttctgtgagggaggggcatggggggagcctcctgtcacagcgccgggttctttggggttggcattgaccaggaggaagctcctcggggccacagaggagaaagaccgaccctggtgagcactctgacagacaggaggatggacgttgccgttgggaaccagaacaaagtgaagtacatggcgacccagctgctggccaaatttgaagagaatgcgcccgcacagtccatcggcatacggagacaggtaaacccaacccgtgccctgcccacaccgatttggtcagatcacacaagaaggggggatcttttccatccattgagatgggctgtgtcacagaccccagcgttcgtgggctggcatctggctttccctcgcctgactgcagcaaagaagagccctgtatatgcttgcttcaggctctgagggttgctccgtcctcagtg

SEQ ID NO: 299952 - DNA, 169 bp, Homo sapiens
tgggaaggaaactacttgggcttttaaagaaaaggaaacctgaagagcaagacggtgagcaagtacagcaaagaactgagggtgtgtgtgtacacatacacataaagcaaaagtgcaagagatgtgttacgttctcagtctcgagcctcaaaaaagtacctctaggtag

SEQ ID NO: 299953 - DNA, 1424 bp, Homo sapiens
agcgggtaccgcgcctgcgtgctgcagtagcgcctggtggcggtggcagtttgcccgcgggtgtgtgaagggagacagtgtggaggccacagggtactcgccacgatgagcagcaccttagctaagatcgcggagatagaagcagagatggctcggactcaaaagaacaaggccacagcacaccacttagggctgcttaaggctcgtcttgctaagcttcgtcgagaactcattactccaaagggtggtggtggtggaggtccaggagaaggttttgatgtggccaagacaggtgatgctcgaattggatttgttggttttccatctgtggggaagtcaacactgcttagtaacctggcaggggtatattctgaggtggcagcctatgaattcactactctgaccactgtgcctggtgtcatcagatacaaaggtgccaagatccagctcctggatctcccaggtatcattgaaggtgccaaggatgggaaaggtagaggtcgtcaagtcattgcagtggcccgaacctgtaacttgatcttgattgttctggatgtcctgaaacctttgggacataagaagataattgaaaatgagctggaaggctttggcattcgcttgaacagcaaaccccccaacattggctttaagaagaaggacaagggaggcattaatctcacagccacttgcccccagagtgagctggatgctgaaactgtgaagagcattctggctgaatacaagattcataatgccgatgtgactctacgtagtgatgctacagctgatgacctcattgatgtggtggaaggaaacagagtttatatcccctgtatctatgtgttaaataagattgaccaaatctccattgaggaattggatatcatctataaggtgcctcactgtgtacccatctctgcccatcaccgctggaattttgatgacctattggaaaagatctgggactatctgaaactagtgagaatttacaccaaacccaaaggccagttaccagattacacatccccagtggtgcttccttactccaggaccacagtggaggatttctgcatgaagattcacaaaaatcttatcaaagaatttaaatatgctctggtctggggtctctctgtgaaacacaatcctcagaaagtgggtaaagaccatacgttggaggatgaggatgtcattcaaattgtgaagaagtgaaacctttcccttttcccatctgccggacgaaccacaacagcgttccccatgatcaagcaccctaccccagttctttctggttttggcagtcactggatcaggatccaggggagggagatggaggcacccaaactggaacttcatttgtcttaccttggtgtcaccttgtatgtcgaactgcataaaagatctggtaggctggtcagctacatgca

SEQ ID NO: 299954 - DNA, 1932 bp, Homo sapiens
  misc_feature (1603)..(1603): n is a, c, g, or t
agcgggtaccgcgcctgcgtgctgcagtagcgcctggtggcggtggcagtttgcccgcgggtgtgtgaagggagacagtgtggaggccacagggtactcgccacgatgagcagcaccttagctaagatcgcggagatagaagcagagatggctcggactcaaaagaacaaggccacagcacaccacttagggctgcttaaggctcgtcttgctaagcttcgtcgagaactcattactccaaagggtggtggtggtggaggtccaggagaaggttttgatgtggccaagacaggtgatgctcgaattggatttgttggttttccatctgtggggaagtcaacactgcttagtaacctggcaggggtatattctgaggtggcagcctatgaattcactactctgaccactgtgcctggtgtcatcagatacaaaggtgccaagatccagctcctggatctcccaggtatcattgaaggtgccaaggatgggaaaggtagaggtcgtcaagtcattgcagtggcccgaacctgtaacttgatcttgattgttctggatgtcctgaaacctttgggacataagaagataattgaaaatgagctggaaggctttggcattcgcttgaacagcaaaccccccaacattggctttaagaagaaggacaagggaggcattaatctcacagccacttgcccccagagtgagctggatgctgaaactgtgaagagcattctggctgaatacaagattcataatgccgatgtgactctacgtagtgatgctacagctgatgacctcattgatgtggtggaaggaaacagagtttatatcccctgtatctatgtgttaaataagattgaccaaatctccattgaggaattggatatcatctataaggtgcctcactgtgtacccatctctgcccatcaccgctggaattttgatgacctattggaaaagatctgggactatctgaaactagtgagaatttacaccaaacccaaaggccagttaccagattacacatccccagtggtgcttccttactccaggaccacagtggaggatttctgcatgaagattcacaaaaatcttatcaaagaatttaaatatgctctggtctggggtctctctgtgaaacacaatcctcagaaagtgggtaaagaccatacgttggaggatgaggatgtcattcaaattgtgaagaagtgaaacctttcccttttcccatctgccggacgaaccacaacagcgttccccatgatcaagcaccctaccccagttctttctggttttggcagtcactggatcaggatccaggggagggagatggaggcacccaaactggaacttcatttgtcttaccttggtgtcaccttgtatgtcgaactgcataaaagatctggtaggctggtcagctacatgcagctcatgtgtcattgtcagaatttgttttgggatgggctgaatgaggaagggtatatacggtgaagcagctacagaagggatccttgggaacttcatcttgagtgtgaaatggataaaaatatgacatgctgcatcttacttgatgtttacttatgggaaccccttccaaactagatanggctttcagtcctttcaagtagtctttcccacatgatactggagagaggaaggactttatgtaagttaactgatcactccccgcaaggctaacctattttgggagatcatgtaattaagtactccgaccaggcagatcagggtttgaaattgcaggtccacctctagttagctgtggagccctgaacaaattacccaacctttatgagcctcagtttcctcatgtaacatggggatagtaatagcacttactttctgcggtggtgattgttagtaatggagggagatggtacttatatgtcaaatactgtgctaagcaatttgtaagta

SEQ ID NO: 299955 - DNA, 710 bp, Homo sapiens
agcgggtaccgcgcctgcgtgctgcagtagcgcctggtggcggtggcagtttgcccgcgggtgtgtgaagggagacagtgtggaggccacagggtactcgccacgatgagcagcaccttagctaagatcgcggagatagaagcagagatggctcggactcaaaagaacaaggccacagcacaccacttagggctgcttaaggctcgtcttgctaagcttcgtcgagaactcattactccaaagggtggtggtggtggaggtccaggagaaggttttgatgtggccaagacaggtgatgctcgaattggatttgttggttttccatctgtggggaagtcaacactgcttagtaacctggcaggggtatattctgaggtggcagcctatgaattcactactctgaccactgtgcctggtgtcatcagatacaaaggtgccaagatccagctcctggatctcccaggtatcattgaaggtgccaaggatgggaaaggtagaggtcgtcaagtcattgcagtggcccgaacctgtaacttgatcttgattgttctggatgtcctgaaacctttgggacataagaagataattgaaaatgaggacagggaggcataatttacagccctaaacgagatttgcatggtgccagctggcttgacttttgcctaagctgctctggttggcttcccagagtgggatacagggccccaaag

SEQ ID NO: 299956 - DNA, 752 bp, Homo sapiens
taatttttgtatttttagtggagacggggtttcaccatgttggccaggcttttcttgaacgcctgatctcaggtgatccacacccttcggcctcccaaagtggtgggattacaggcatgagcccctgcgcccggcccagagtatttctctataacaaatccatgctttcttttaattttaaactaggctctttatactaaacatgttttttgtctttgactttctgcaataagaggaaccacacaacttccagaagtctttaccggcttttatgttaaggcttcagtgtctcatgctgctagggaagataaagcttttgtaggtctatggttcttaagggtatgatactaaatctgagcagaagggtggcatccaggcaaatagggcagaagctaggttattatttacactgactgttctttttcccttccatgcagtgctctggtctggggtctctctgtgaaacacaatcctcagaaagtgggtaaagaccatacgttggaggatgaggatgtcattcaaattgtgaagaagtgaaacctttcccttttcccatctgccggacgaaccacaacagcgttccccatgatcaagcaccctaccccagttctttctggttttggcagtcactggatcaggatccaggggagggagatggaggcacccaaactggaacttcatttgtcttaccttggtgtcaccttgtatgtcgaactgcataaaagatctggtaggctggtcagctacatgca

SEQ ID NO: 299957 - DNA, 1624 bp, Homo sapiens
  misc_feature (1295)..(1295): n is a, c, g, or t
agcgggtaccgcgcctgcgtgctgcagtagcgcctggtggcggtggcagtttgcccgcgggtgtgtgaagggagacagtgtggaggccacagggtactcgccacgatgagcagcaccttagctaagatcgcggagatagaagcagagatggctcggactcaaaagaacaaggccacagcacaccacttagggctgcttaaggctcgtcttgctaagcttcgtcgagaactcattactccaaagggtggtggtggtggaggtccaggagaaggttttgatgtggccaagacaggtgatgctcgaattggatttgttggttttccatctgtggggaagtcaacactgcttagtaacctggcaggggtatattctgaggtggcagcctatgaattcactactctgaccactgtgcctggtgtcatcagatacaaaggtgccaagatccagctcctggatctcccaggtatcattgaaggtgccaaggatgggaaaggtagaggtcgtcaagtcattgcagtggcccgaacctgtaacttgatcttgattgttctggatgtcctgaaacctttgggacataagaagataattgaaaatgagctggaaggctttggcattcgcttgaacagcaaaccccccaacattggctttaagaagaaggacaagggaggcattaatctcacagccacttgcccccagagtgagctggatgctgaaactgtgaagagcattctggctgaatacaagattcataatgccgatgtgactctacgtagtgatgctacagctgatgacctcattgatgtggtggaaggaaacagagtttatatcccctgtatctatgtgttaaataagattgaccaaatctccattgaggaattggatatcatctataaggtgcctcactgtgtacccatctctgcccatcaccgctggaattttgatgacctattggaaaagatctgggactatctgaaactagtgagaatttacaccaaacccaaaggccagttaccagattacacatccccccaaactggaacttcatttgtcttaccttggtgtcaccttgtatgtcgaactgcataaaagatctggtaggctggtcagctacatgcagctcatgtgtcattgtcagaatttgttttgggatgggctgaatgaggaagggtatatacggtgaagcagctacagaagggatccttgggaacttcatcttgagtgtgaaatggataaaaatatgacatgctgcatcttacttgatgtttacttatgggaaccccttccaaactagatanggctttcagtcctttcaagtagtctttcccacatgatactggagagaggaaggactttatgtaagttaactgatcactccccgcaaggctaacctattttgggagatcatgtaattaagtactccgaccaggcagatcagggtttgaaattgcaggtccacctctagttagctgtggagccctgaacaaattacccaacctttatgagcctcagtttcctcatgtaacatggggatagtaatagcacttactttctgcggtggtgattgttagtaatggagggagatggtacttatatgtcaaatactgtgctaagcaatttgtaagta

SEQ ID NO: 299958 - DNA, 1116 bp, Homo sapiens
agcgggtaccgcgcctgcgtgctgcagtagcgcctggtggcggtggcagtttgcccgcgggtgtgtgaagggagacagtgtggaggccacagggtactcgccacgatgagcagcaccttagctaagatcgcggagatagaagcagagatggctcggactcaaaagaacaaggccacagcacaccacttagggctgcttaaggctcgtcttgctaagcttcgtcgagaactcattactccaaagggtggtggtggtggaggtccaggagaaggttttgatgtggccaagacaggtgatgctcgaattggatttgttggttttccatctgtggggaagtcaacactgcttagtaacctggcaggggtatattctgaggtggcagcctatgaattcactactctgaccactgtgcctggtgtcatcagatacaaaggtgccaagatccagctcctggatctcccaggtatcattgaaggtgccaaggatgggaaaggtagaggtcgtcaagtcattgcagtggcccgaacctgtaacttgatcttgattgttctggatgtcctgaaacctttgggacataagaagataattgaaaatgagctggaaggctttggcattcgcttgaacagcaaaccccccaacattggctttaagaagaaggacaagggaggcattaatctcacagccacttgcccccagagtgagctggatgctgaaactgtgaagagcattctggctgaatacaagattcataatgccgatgtgactctacgtagtgatgctacagctgatgacctcattgatgtggtggaaggaaacagagtttatatcccctgtatctatgtgttaaataagattgaccaaatctccattgaggaattggatatcatctataaggtgcctcactgtgtacccatctctgcccatcaccgctggaattttgatgacctattggaaaagatctgggactatctgaaactagtgagaatttacaccaaacccaaaggccagttaccagattacacatccccccaaactggaacttcatttgtcttaccttggtgtcaccttgtatgtcgaactgcataaaagatctggtaggctggtcagctacatgca

SEQ ID NO: 299959 - DNA, 1075 bp, Homo sapiens
agcgggtaccgcgcctgcgtgctgcagtagcgcctggtggcggtggcagtttgcccgcgggtgtgtgaagggagacagtgtggaggccacagggtactcgccacgatgagcagcaccttagctaagatcgcggagatagaagcagagatggctcggactcaaaagaacaaggccacagcacaccacttagggctgcttaaggctcgtcttgctaagcttcgtcgagaactcattactccaaagggtggtggtggtggaggtccaggagaaggttttgatgtggccaagacaggtgatgctcgaattggatttgttggttttccatctgtggggaagtcaacactgcttagtaacctggcaggggtatattctgaggtggcagcctatgaattcactactctgaccactgtgcctggtgtcatcagatacaaaggtgccaagatccagctcctggatctcccaggtatcattgaaggtgccaaggatgggaaaggtagaggtcgtcaagtcattgcagtggcccgaacctgtaacttgatcttgattgttctggatgtcctgaaacctttgggacataagaagataattgaaaatgagctggaaggctttggcattcgcttgaacagcaaaccccccaacattggctttaagaagaaggacaagggaggcattaatctcacagccacttgcccccagagtgagctggatgctgaaactgtgaagagcattctggctgaatacaagattcataatgccgatgtgactctacgtagtgatgctacagctgatgacctcattgatgtggtggaaggaaacagagtttatatcccctgtatctatgtgttaaataagattgaccaaatctccattgaggaattggatatcatctataaggtgcctcactgtgtacccatctctgcccatcaccgctggaattttgatgacctattggaaaagatctgggactatctgaaactagtgagaatcccaaactggaacttcatttgtcttaccttggtgtcaccttgtatgtcgaactgcataaaagatctggtaggctggtcagctacatgca

SEQ ID NO: 299960 - DNA, 1430 bp, Homo sapiens
ctaggtacgatccgtttggtgtgcgggcccactatgtgaagtgaccacatgggtcatatcgctgatctgacctgtaggagaatccctgaggtctatagaatagctgcatgagtagtaacgtcagcacgattgagaatcgagagctccggaggaacaccgacccgtgctgaacacttccggatgatgatcggacgtcttgcttggctcctatcagacaaggacattctactccaaacgtgcgagtgatgcgaagagttgagcagcgccacgcaggaaggttttgatgtggccaagacaggtgatgctcgaattggatttgttggttttccatctgtggggaagtcaacactgcttagtaacctggcaggggtatattctgaggtggcagcctatgaattcactactctgaccactgtgcctggtgtcatcagatacaaaggtgccaagatccagctcctggatctcccaggtatcattgaaggtgccaaggatgggaaaggtagaggtcgtcaagtcattgcagtggcccgaacctgtaacttgatcttgattgttctggatgtcctgaaacctttgggacataagaagataattgaaaatgagctggaaggctttggcattcgcttgaacagcaaaccccccaacattggctttaagaagaaggacaagggaggcattaatctcacagccacttgcccccagagtgagctggatgctgaaactgtgaagagcattctggctgaatacaagattcataatgccgatgtgactctacgtagtgatgctacagctgatgacctcattgatgtggtggaaggaaacagagtttatatcccctgtatctatgtgttaaataagattgaccaaatctccattgaggaattggatatcatctataaggtgcctcactgtgtacccatctctgcccatcaccgctggaattttgatgacctattggaaaagatctgggactatctgaaactagtgagaatttacaccaaacccaaaggccagttaccagattacacatccccagtggtgcttccttactccaggaccacagtggaggatttctgcatgaagattcacaaaaatcttatcaaagaatttaaatatgctctggtctggggtctctctgtgaaacacaatcctcagaaagtgggtaaagaccatacgttggaggatgaggatgtcattcaaattgtgaagaagtgaaacctttcccttttcccatctgccggacgaaccacaacagcgttccccatgatcaagcaccctaccccagttctttctggttttggcagtcactggatcaggatccaggggagggagatggaggcacccaaactggaacttcatttgtcttaccttggtgtcaccttgtatgtcgaactgcataaaagatctggtaggctggtcagctacatgca

SEQ ID NO: 299961 - DNA, 1516 bp, Homo sapiens
agcgggtaccgcgcctgcgtgctgcagtagcgcctggtggcggtggcagtttgcccgcgggtgtgtgaagggagacagtgtggaggccacagggtactcgccacgatgagcagcaccttagctaagatcgcggagatagaagcagagatggctcggactcaaaagaacaaggccacagcacaccacttagggctgcttaaggctcgtcttgctaagcttcgtcgagaactcattactccaaagggtggtggtggtggaggtccaggagaaggttttgatgtggccaagacaggtgatgctcgaattggatttgttggttttccatctgtggggaagtcaacactgcttagtaacctggcaggggtatattctgaggtggcagcctatgaattcactactctgaccactgtgcctggtgtcatcagatacaaaggtgccaagatccagctcctggatctcccaggtatcattgaaggtgccaaggatgggaaaggtagaggtcgtcaagtcattgcagtggcccgaacctgtaacttgatcttgattgttctggatgtcctgaaacctttgggacataagaagataattgaaaatgagctggaaggctttggcattcgcttgaacagcaaaccccccaacattggctttaagaagaaggacaagggaggcattaatctcacagccactaaacggagatttgccatgttgcccaggctggtcttgaacttttggcctcaagctgtctcctgcttcggtctcccaaagtgttgggattacagtgcccccagagtgagctggatgctgaaactgtgaagagcattctggctgaatacaagattcataatgccgatgtgactctacgtagtgatgctacagctgatgacctcattgatgtggtggaaggaaacagagtttatatcccctgtatctatgtgttaaataagattgaccaaatctccattgaggaattggatatcatctataaggtgcctcactgtgtacccatctctgcccatcaccgctggaattttgatgacctattggaaaagatctgggactatctgaaactagtgagaatttacaccaaacccaaaggccagttaccagattacacatccccagtggtgcttccttactccaggaccacagtggaggatttctgcatgaagattcacaaaaatcttatcaaagaatttaaatatgctctggtctggggtctctctgtgaaacacaatcctcagaaagtgggtaaagaccatacgttggaggatgaggatgtcattcaaattgtgaagaagtgaaacctttcccttttcccatctgccggacgaaccacaacagcgttccccatgatcaagcaccctaccccagttctttctggttttggcagtcactggatcaggatccaggggagggagatggaggcacccaaactggaacttcatttgtcttaccttggtgtcaccttgtatgtcgaactgcataaaagatctggtaggctggtcagctacatgca

SEQ ID NO: 299962 - DNA, 1340 bp, Homo sapiens
agcgggtaccgcgcctgcgtgctgcagtagcgcctggtggcggtggcagtttgcccgcgggtgtgtgaagggagacagtgtggaggccacagggtactcgccacgatgagcagcaccttagctaagatcgcggagatagaagcagagatggctcggactcaaaagaacaaggccacagcacaccacttagggctgcttaaggctcgtcttgctaagcttcgtcgagaactcattactccaaagggtggtggtggtggaggtccaggagaagctcctggatctcccaggtatcattgaaggtgccaaggatgggaaaggtagaggtcgtcaagtcattgcagtggcccgaacctgtaacttgatcttgattgttctggatgtcctgaaacctttgggacataagaagataattgaaaatgagctggaaggctttggcattcgcttgaacagcaaaccccccaacattggctttaagaagaaggacaagggaggcattaatctcacagccactaaacggagatttgccatgttgcccaggctggtcttgaacttttggcctcaagctgtctcctgcttcggtctcccaaagtgttgggattacagtgcccccagagtgagctggatgctgaaactgtgaagagcattctggctgaatacaagattcataatgccgatgtgactctacgtagtgatgctacagctgatgacctcattgatgtggtggaaggaaacagagtttatatcccctgtatctatgtgttaaataagattgaccaaatctccattgaggaattggatatcatctataaggtgcctcactgtgtacccatctctgcccatcaccgctggaattttgatgacctattggaaaagatctgggactatctgaaactagtgagaatttacaccaaacccaaaggccagttaccagattacacatccccagtggtgcttccttactccaggaccacagtggaggatttctgcatgaagattcacaaaaatcttatcaaagaatttaaatatgctctggtctggggtctctctgtgaaacacaatcctcagaaagtgggtaaagaccatacgttggaggatgaggatgtcattcaaattgtgaagaagtgaaacctttcccttttcccatctgccggacgaaccacaacagcgttccccatgatcaagcaccctaccccagttctttctggttttggcagtcactggatcaggatccaggggagggagatggaggcacccaaactggaacttcatttgtcttaccttggtgtcaccttgtatgtcgaactgcataaaagatctggtaggctggtcagctacatgca

SEQ ID NO: 299963 - DNA, 1236 bp, Homo sapiens
agcgggtaccgcgcctgcgtgctgcagtagcgcctggtggcggtggcagtttgcccgcgggtgtgtgaagggagacagtgtggaggccacagggtactcgccacgatgagcagcaccttagctaagatcgcggagatagaagcagagatggctcggactcaaaagaacaaggccacagcacaccacttagggctgcttaaggctcgtcttgctaagcttcgtcgagaactcattactccaaagggtggtggtggtggaggtccaggagaaggttttgatgtggccaagacaggtgatgctcgaattggatttgttggttttccatctgtggggaagtcaacactgcttagtaacctggcaggggtatattctgaggtggcagcctatgaattcactactctgaccactgtgcctggtgtcatcagatacaaaggtgccaagatccagctcctggatctcccaggtatcattgaaggtgccaaggatgggaaaggtagaggtcgtcaagtcattgcagtggcccgaacctgtaacttgatcttgattgttctggatgtcctgaaacctttgggacataagaagataattgaaaatgagtgatgacctcattgatgtggtggaaggaaacagagtttatatcccctgtatctatgtgttaaataagattgaccaaatctccattgaggaattggatatcatctataaggtgcctcactgtgtacccatctctgcccatcaccgctggaattttgatgacctattggaaaagatctgggactatctgaaactagtgagaatttacaccaaacccaaaggccagttaccagattacacatccccagtggtgcttccttactccaggaccacagtggaggatttctgcatgaagattcacaaaaatcttatcaaagaatttaaatatgctctggtctggggtctctctgtgaaacacaatcctcagaaagtgggtaaagaccatacgttggaggatgaggatgtcattcaaattgtgaagaagtgaaacctttcccttttcccatctgccggacgaaccacaacagcgttccccatgatcaagcaccctaccccagttctttctggttttggcagtcactggatcaggatccaggggagggagatggaggcacccaaactggaacttcatttgtcttaccttggtgtcaccttgtatgtcgaactgcataaaagatctggtaggctggtcagctacatgca

SEQ ID NO: 299964 - DNA, 1287 bp, Homo sapiens
ggttgacagcgctctccccccctacccgaaccatggaatctgccacaggggaggaaaagcccccacttccaagcccctgctttttttcttaaaaggactttaaaaggaaatttgtttgtattttttataccaatttataattttggacaaattgttagggtccacccattttaatgatctcggatgacccaacccgccttcggagcgttctctgtcctacttctgactttacttgtggtgtgaccctgttccattataatctccaaggagaaaaaaaaccttgtaaaaaagccaaatgaccacaggaaaaccatcttattccgagcattcccgtaacttttttgtgtatgtacttagctgtgactataagtagttggtttgtatgagatggttaaaaaggcccaagataaaaggtttctttttttttccctttttgtctatgaagttgctgtttattttttttggcccgtttgatgtatgtgtgaaaccatgttgtcccacaataaacaggaattttattttctgagttgttttaaaaaaaaaaaaaaagggcggccgctcgcgatctagaactagtcctgtgaagagcattctggctgaatacaagattcataatgccgatgtgactctacgtagtgatgctacagctgatgacctcattgatgtggtggaaggaaacagagtttatatcccctgtatctatgtgttaaataagattgaccaaatctccattgaggaattggatatcatctataaggtgcctcactgtgtacccatctctgcccatcaccgctggaattttgatgacctattggaaaagatctgggactatctgaaactagtgagaatttacaccaaacccaaaggccagttaccagattacacatccccagtggtgcttccttactccaggaccacagtggaggatttctgcatgaagattcacaaaaatcttatcaaagaatttaaatatgctctggtctggggtctctctgtgaaacacaatcctcagaaagtgggtaaagaccatacgttggaggatgaggatgtcattcaaattgtgaagaagtgaaacctttcccttttcccatctgccggacgaaccacaacagcgttccccatgatcaagcaccctaccccagttctttctggttttggcagtcactggatcaggatccaggggagggagatggaggcacccaaactggaacttcatttgtcttaccttggtgtcaccttgtatgtcgaactgcataaaagatctggtaggctggtcagctacatgca

SEQ ID NO: 299965 - DNA, 897 bp, Homo sapiens
gagggccagctgggattagaatcagtctgagcacttcaaagcttgtgttctttccactgcagtatgctttcctagcagttagctttgtggctggtactagggcctgacttctgttacttttcaacccatagttcactttttctttttcttttttctttttctggctgatctgctacttacagtccctcttgggagcgccagttgggtctgggtgagggtgtgctgttcaacagtctgacagttctgtcaacaactccagactaataccctgtttttcttcactttctgtagagtttatatcccctgtatctatgtgttaaataagattgaccaaatctccattgaggaattggatatcatctataaggtgcctcactgtgtacccatctctgcccatcaccgctggaattttgatgacctattggaaaagatctgggactatctgaaactagtgagaatttacaccaaacccaaaggccagttaccagattacacatccccagtggtgcttccttactccaggaccacagtggaggatttctgcatgaagattcacaaaaatcttatcaaagaatttaaatatgctctggtctggggtctctctgtgaaacacaatcctcagaaagtgggtaaagaccatacgttggaggatgaggatgtcattcaaattgtgaagaagtgaaacctttcccttttcccatctgccggacgaaccacaacagcgttccccatgatcaagcaccctaccccagttctttctggttttggcagtcactggatcaggatccaggggagggagatggaggcacccaaactggaacttcatttgtcttaccttggtgtcaccttgtatgtcgaactgcataaaagatctggtaggctggtcagctacatgca

SEQ ID NO: 299966 - DNA, 829 bp, Homo sapiens
  misc_feature (729)..(729): n is a, c, g, or t
gtagagacaaaggaaacacagagacatagacatggatctgggaaatacaccttttgctactcgttcagttttagcaaggaggtttcttgcatggctaagcaaaacttaaacttcctctgagaattacaggaattacaggacctgacaaagctatgaagattaaaacctataggaagaaaatctgaaccagaaacagtatggcagaattgggatctgactcacagagggaagaacttataattcttcacaggtcacatagaagcatgagaatttgggttcaagcaagtaaattctaaatcagaatccatacataaagtgtttgcaatgtccagttatatctccatgatattttctttgtggaagttgattgttcttccttacaataaattgcttgaattgtctgtctattcatttagctatttcttttcttgtctttgcgatatttttttttgtaagtaaaaaattttcagactaaacagaacaagaaacatatccaaggaatatcacatttttcggcacctgttgcccttcggaaacggtgtttatgaagacgatttcgtttaggcgcctcggggccccgttcggtaagtgaacactgtgggcccaagcgcgagtctgccgaaggaaaacacctgggggctctagcagaattagcggcgcgggattctccctccactattaaaatagcccgcgcggttcggggacaaacccgaagctgtctcctgtacnacaactctccagaacggagtgctcggaagaggagtccatccaccgggagcctacttgacgcggggaagcccaccaggagcacctcgaatatcaaatacgt

SEQ ID NO: 299967 - DNA, 719 bp, Homo sapiens
  misc_feature (400)..(400): n is a, c, g, or t
gtagagacaaaggaaacacagagacatagacatggatctgggaaatacaccttttgctactcgttcagttttagcaaggaggtttcttgcatggctaagcaaaacttaaacttcctctgagaattacaggaattacaggacctgacaaagctatgaagattaaaacctataggaagaaaatctgaaccagaaacagtatggcagaattgggatctgactcacagagggaagaacttataattcttcacaggtcacatagaagcatgagaatttgggttcaagcaagtaaattctaaatcagaatccatacataaagtgtttgcaatgtccagttatatctccatgatattttctttgtggaagttgattgttcttccttacaataaattgcttgaattgncaaaaaaaaaaaaaaaaaaaaaaaaatttggggggggctggggccggaaaaagagcttgtaacaccactccggttggggcgcggagcggggggcccacaagagagtaaaagagagacgatggggcgccaagcagctggtccccaaagagaagactccgtcggcacggagcatcgggcgcggggctttcccaccacaataaaaacacgcggggggaaaccgagcgtctttggggacactcccagaagggggtcaggagggccaaaggggcgctacaaacgggagccaaggggaaccaaaaaatacaggaggcgagggggc

SEQ ID NO: 299968 - DNA, 649 bp, Homo sapiens
  misc_feature (477)..(477): n is a, c, g, or t
  misc_feature (506)..(506): n is a, c, g, or t
gtagagacaaaggaaacacagagacatagacatggatctgggaaatacaccttttgctactcgttcagttttagcaaggaggtttcttgcatggctaagcaaaacttaaacttcctctgagaattacaggaattacaggacctgacaaagctatgaagattaaaacctataggaagaaaatctgaaccagaaacagtatggcagaattgggatctgactcacagagggaagaacttataattcttcacaggtcacatagaagcatgagaatttgggttcaagcaagtaaattctaaatcagaatccatacataaagtgtttgcaatgtccagttatatctccatgatattttctttgtggaagttgattgttcttccttacaataaattgcttgaattgtctgtctattcatttagctatttcttttcttgtctttgcgatatttttttttgtaagtaaaaaattttcagactaaancaaaaaaaaaaaaaaaaactcgagtgccnggctgcctatttttatacactttttttaaaataaaaaaaaggctgacattttattttcaggttggcacagtgttaaagcacagggctaatggctttggtgtcctggaacctgagggacggggggttggttcagccacgttcct

SEQ ID NO: 299969 - DNA, 974 bp, Homo sapiens
gtagagacaaaggaaacacagagacatagacatggatctgggaaatacaccttttgctactcgttcagttttagcaaggaggtttcttgcatggctaagcaaaacttaaacttcctctgagaattacaggaattacaggacctgacaaagctatgaagattaaaacctataggaagaaaatctgaaccagaaacagtatggcagaattgggatctgactcacagagggaagaacttataattcttcacaggtcacatagaagcatgagaatttgggttcaagcaaacgcctaaatacctgacgtgtgacagcaaatgcctgttcccatggagctgctgcttctgagaaagcttgaaacagacaaagaataaggtagaaatgacctcctcactagagatgaaaagaagctgtcctggtgaggaaattggatcccagcttttgccgctaagattcttctcttctgcctctggttttctttattgttcacccccagaagcaatcgctctctcacaaggcaacacacgcaatagagtgaacagtgattctacagtctgattctggaaaaggcgaccacagtggaaagagtgatccacacaagtatagggcctcctgattaaaacactaagatttcatctcacgctgtgcctttatactgttgagatactaaagaggacactaaagatcaaagtgctactttacaacattttgaagaaaacaactgctacctgtgtattagtttgtgcagatgtgttacacagcttagctgtgtctgtaccagtttattagaatcaaagtatttttaaagtacctaaggccaggcacagtggctcacacctgtaatcccagcactttgggaggctgaggcaagtggatcacttgagatcaggaattcaagaccagcctggccaacatggtgaaaccccatctctactaaaaatacaaaaattagccaggcatggtgtcacatgcctgta

SEQ ID NO: 299970 - DNA, 939 bp, Homo sapiens
gtagagacaaaggaaacacagagacatagacatggatctgggaaatacaccttttgctactcgttcagttttagcaaggaggtttcttgcatggctaagcaaaacttaaacttcctctgagaattacaggaattacaggacctgacaaagctatgaagattaaaacctataggaagaaaatctgaaccagaaacagtatggcagaattgggatctgactcacagagggaagaacttataattcttcacagacgcctaaatacctgacgtgtgacagcaaatgcctgttcccatggagctgctgcttctgagaaagcttgaaacagacaaagaataaggtagaaatgacctcctcactagagatgaaaagaagctgtcctggtgaggaaattggatcccagcttttgccgctaagattcttctcttctgcctctggttttctttattgttcacccccagaagcaatcgctctctcacaaggcaacacacgcaatagagtgaacagtgattctacagtctgattctggaaaaggcgaccacagtggaaagagtgatccacacaagtatagggcctcctgattaaaacactaagatttcatctcacgctgtgcctttatactgttgagatactaaagaggacactaaagatcaaagtgctactttacaacattttgaagaaaacaactgctacctgtgtattagtttgtgcagatgtgttacacagcttagctgtgtctgtaccagtttattagaatcaaagtatttttaaagtacctaaggccaggcacagtggctcacacctgtaatcccagcactttgggaggctgaggcaagtggatcacttgagatcaggaattcaagaccagcctggccaacatggtgaaaccccatctctactaaaaatacaaaaattagccaggcatggtgtcacatgcctgta

SEQ ID NO: 299971 - DNA, 7377 bp, Homo sapiens
ggggtaaagcggagcggctgcagcctgctgttgagtgagaaaacaaaattatcttcctttccaaatccaaaaagatgaaaacgactgagatactttcaaaagacaaccaagtgagcagcacagactaatgagtagaatcaataagaacgtggttttggcccttttaacgctgacaagttctgcatttctgctgtttcagttgtactactacaagcactatttatcaacaaagaatggagctggtttgtcaaaatccaaaggaagccgaattggatttgatagcacacagtggcgtgcagttaaaaaatttattatgttaacatccaaccaaaatgtaccagtgtttcttattgatcctttgatactggaattgattaataagaactttgaacaagtcaaaaatacttctcatggctctacttcacaatgcaagtttttctgtgttccaagagactttactgcatttgcactgcagtatcacctatggaagaatgaggaaggctggtttcggatagctgagaatatgggatttcagtgcctaaagattgagagtaaagatccccggctagacgggatagactcactctctggaactgaaatccccctgcactatatctgcaaactggccactcatgcgatccacttggtagtctttcatgagaggagtggcaactacctctggcacggccacttgagacttaaagaacacattgacaggaaatttgttcccttccaaaagttacagtttggtcgttatccaggagcttttgacaggccagagttacagcaagttactgttgatggactggaagttctcattccaaaggatccaatgcactttgtagaagaagtaccacactctaggtttattgagtgtaggtataaagaagctcgagcattctttcagcagtaccttgatgataacactgtggaagctgtggcctttcggaagagtgcaaaggaattactgcaactagcagcgaaaacattaaacaaattgggagtaccattctggctgagcagtggaacttgtctaggatggtatcgacaatgcaacattattccttatagcaaagatgttgacctaggaatttttatacaagattacaaatctgatattattttagcatttcaggatgcaggacttccgctcaaacacaaatttgggaaggtagaagacagcttggaactatccttccagggaaaagatgatgtaaaacttgatgtttttttcttctatgaagaaactgatcacatgtggaatggaggcactcaggccaaaacaggaaaaaaattcaaatacctgtttccgaagtttacactgtgctggactgagtttgtagacatgaaggtccatgtaccctgtgaaaccctcgaatacattgaagccaactatggtaagacctggaagattcctgtaaagacgtgggactggaagcgctctcctcccaatgtgcaacccaatggaatctggcctatttctgagtgggatgaggttatccagttatattgagatagtaggttgaaatgggagaatttctcttttggaaaaaaaggtagataactgtttaaaaaatacatgtctatttgtcaaacataagtgggaaccaaagaaaaaatgtgacaagtttgaagacacagaaagagtcatctgatgtaattctctcacttagtactgaggaattttcatgtgccacatacaatgctaggttacagtggagaagccaagatgaatgagacaaatacctacttcttttattcctccttttggtaaacaactcaattttcctttgagggaaccctcccccaccctttgaagagttcaagttctgtacaggtttttaaaacgtgaagtaatgtttgaactggaagatgagctcaccaggcaaagctaaggaaggatatactagttgaaaagaataacccactcctcttctgggcatttaagctggtatgttagtgctacttttaagattgtggagtctgagttaatattcaagtgatcagactttgagtgacatcaagaaaagatgatatcaggttcatttttcaactaatcttatgtggaattgaattagagaacaaggcattattcttttagggaaggtgagagcttatttgtatcagagcttattacttgtcaggataagtaaatttctgtacatgtactgttttcatatgtgaagtgagaagaaactttatgcttgtttaatgcttaaatttccatccattgtgagaatattttcactgacctctgatggcacttgttgacaaatcattcaagtgagaccatgttactagacatgatcttgaaagaggccatgatttcacaaaactcatttttattttattctcagacagtctgttaggtaaaaatatgagaaattcatgtacattttatattttctgaatttataatctgtgcactcccaattttaatgacactaaaatattaatagaattttttaaatatactctaatttttaaaacatactctttattatcttcatttatcaattacagcttcgtatctctaatttatggtctatataccaatttaaatggcatgtaaacctgcctgtttcttctcctcttctaatatatcagatctccaaaatggaagctaaatggtggacttgacaactattcaccctacctcagatcatagagtttgtaaagtttgtgtccctccccagtttttcagtctgttgaatgtcgatggggcaagaactcagacttctactttaccaagtaccacacactctggaatgctttagtttccttttcccctcaagatgtctgagtcagctaggatgctgtttaccccatctctctcttatatcacttgaatgatatattgtaagtgagaggtaaaggaaaatgtaggcacaataagcactgctatttttctctttgtctaggaaaggaagctgaatcttatatcttatctatgctatttaggactactttctggagcttggcagattttcctctgacaccagagaacaatagtagtctcaagaatggaaacctgaatgtctgagggaatgggctggtagactttttcgaaaacaaattagagaaagtaacttacaaccacccattccggatttgtaaagcaacatgaaaacctttgataaatgataaccaacagtcttctgtcctaatttgcattctcaatgcagaattattgggtctttcataaacaacatgagtggtttctggagacatttaagattgtcagcaaacttgtcccaaaatggcacatcatcataatccattttctctttgctagaaaatcagcccatagagtgcattcccaaattctaaatagctgaccctaaattcatttttcatgcttaaaaataatagaacaaataataatactatttttgggcaaaatccaccctacttgatgaggaccatttgcttgtgctcagtatttagaaatgcatacactccacatttctccccatttccaattgggactcccattctttgccaggagatcttacccatcccttttcagattaatcttttatcctttcctgaagtacaaagtcttaagagtgtctgaaatccaagacatcttggcccaattgacacaggttctatattcttccctacatagaccactggctgctgaaatacttttcttgtcttctggtttcacaggcttcagctcatgggttccaccctaacttggggaaacaaaagccttctctagaatctgaaggccaggcttacctctgattctgattcatccatacttcatcttatgtattttaacagttgggttctgtggagtgtccagagaccttgggttaggtatatccatcttcagtacctcattggatcacttttctttcatcacttgagtattctagcagtcattctcctaatctgaccactttcaggtttagtttacctggcttacctggggaagttgacaacttgttggtagttaggcacccatgaatgtctccagagacatcctgagaggcaagattcctcttaattgataaccaggacaaccaggtagtcacccagtcctctctaagcagggagcacttgtccttctctcctctgctgcagctactgatatctggcccctggaataaaaccatagttcctaaaattgagcatccctaagagtagctgcttggtgggacagctgatttctttgattccctagctgcaaaacctgaaattgaccactaggtgacagaatgtttgccagtatccccacaaaacaagttaaaacttaagtgaaaatcattctgcttttgaatcttaaaagctagaaaaaccataatgtaatattctttttaaaccctcttattttataactaaataaataatcacagaaaagaatgatctgaacaagaacagctgaggctaaaacccaagactgccgtgactcctagtccaatgtctgtttcgcatcacaacacagtatctttaacagtgcttgagatgcttaacagagaaggcatccagtgcttcattgaggctaagtctcagggtgtttctgccgcttagtatctttttgttcagattgagaacctaaggcgacagagaggtcaaggggaagtattttctagttcagaattcagaattcttaggcaaccttcatacctttatctggaaaatgccttctctccagacaataagacagttcacatctggagacatcagcctttggtacctaattctctaagctcaagatgcatcccattgccactttaccattctatttcccaagggaaccatcagcaccaacctgctaaatgcctgtatttgaagtctctccccttcctgaagtgaccttttatgaggctctttccttcctaagggacctttccctggtagtagtggtctcattcacaaaaaagaataatagatgtaactggagtcactttgcagttttcaagattttttttttatctgcttggctggaaaggagactagagtatctagtttttagtatttaaactacttttaattatttatattgatactctctgataaatgcaggtagttaagaatagattgtactcattcctttttgagtttgtgacctcaaaccattgtttttattcttacacgactacagtacttcaaatggcacatagataggcaggatattacataggtaagcaggaatttatacattgggtaccagagctaaatctggaaaacacatttggaatgagcttccacacttcagtctaaaatctcacccaaacttatggctacatatttttctaagtttcccccctagtttcactttctggaaagtgaacagttttttaaatcctaaatgttataaatccttaggagaaatattccctcaaaacctagtcaagaaagtgccacattcccaccttctaacaggtaattattagttgtaatagctttaatgcatggaaaaacttcagttactgaccagtcaagagaatttctcaagaaaaatcccagcaacgttccctctttcctccttgtcttccactatcattaagacctgggctagatcacctctaacatctcactcagggaaggcaatgtgttgccataaaaagaccacaagcttttgagttaggcctgaatttgaatttcagcttaatcatgtgggatttatggtgggggccctttcagtctcaatttccacattagtgaactggggaaatgatacatacttctaagggtttttagggggattaaatgaagtatacagttcttagcctcaggcctaggattaagtaagtactcaagaaatgtgcaattttctagttccatgtttcttttctaatcttcaaatggaattatagaaaccatgggtcagaacatattcctttactcaaaagattgcatgactgaatttgcttaagaaaaaaaaaattgtatcaagtcattaatacaattatacattaattatattacattaatacaatatatggtttgtgaattcagagacattaccagtttgcctccttctctcaatagaacttgtattttcattttcttggttaagcagttgtctcctaatattatcccatatgctacctagtttgctggtcccaagcagtttactgtacttcactagatttggtacctgctctcccctggacttctttttcaatattctagcctttcctagatgtaaatctttacctccttgttagtgaaattagatataagccatgatttggagagggaagaaatctggaatacttaatttcatttaattatctatgctgatgaatgcctgtatcattgttaataaaggagaattgaaaatactcatttctactttctgccctcaaatttctgtttctatctcaactaggcaagaatcagcagggtgcatgatgccattttaagctgcttcacatcagactgaaatcctaattacagttcataagtgaaacagactaattcaatggcaataccttttgtataggtcctgtgcttaaaggaggcaagtataaattttctaataagaaatccctgcttcttttgggtgcagtggctcacacctgtaataccagcagtttgagaagctaaggcaggtggatcacttgaggccaggagttcgagaccagcctggccaacatagtgaaaccccgtctcttctaaaaatacaaaaaaattagctgggcatggtggtgcacgcctatagtcccagctacacaggaggctgaggcaggagaatcacttgaacccgggaagcagagtctgcagtgagccaagatcgcggcattgcacttcagcctgggcgatagagcaagactctgtctcagaaaaaaaaaaaaggaaagaaagaaatctctgcttccgtactatcaaaacttctaccctagaataccccctggcaccttctaacccaacctaatacagagattttgtagggacccattaacaagctcctatataattataagcagctctcacagtagggttgaaagagaatataaggaaaattagaagtactgtatttttgctattggaaatgaaatattgtttcatgcacctttgaaaaaaataacaggattttacagccttctgatgattcattcaaagcatggggaatagttcatatgtttgttaaatgaaaatcttatgtagctatttgtgtgtccctcccacttcataactacaaaaacatatatatgaatttctaaacaaagtgatattttaaagatgaattgattcaatgtgtacttaccagtttactgtgtggttttatcttcaggtacagatagtttgtggtactacttgaaaatacctttaatattattttcatcagaatttgtaatatataatccagtttgggatgatgaataaaatttttctaatctcttgaaaaaacttgta

SEQ ID NO: 299972 - DNA, 365 bp, Homo sapiens
ggggtaaagcggagcggctgcagcctgctgttgagtgagaaaacaaaattatcttcctttccaaatccaaaaagatgaaaacgactgagatactttcaaaagacaaccaagtgagcagcacagactaatgagtagaatcaataagaacgtggttttggcccttttaacgctgacaagttctgcatttctgctgtttcagttgtactactacaagcactatttatcaacaaagaatggagctggtttgtcaaaatccaaaggaagccgaattggatttgatagcacacagtgggtatgtagaataaacaagaaatttctcaattataatgttcatttagttcattcatttactccgtaagtatttg

SEQ ID NO: 299973 - DNA, 7323 bp, Homo sapiens
ggggtaaagcggagcggctgcagcctgctgttgagtgagaaaacaaaattatcttcctttccaaatccaaaaagatgaaaacgactgagatactttcaaaagacaaccaagtgagcagcacagactaatgagtagaatcaataagaacgtggttttggcccttttaacgctgacaagttctgcatttctgctgtttcagttgtactactacaagcactatttatcaacaaagaatggagctggtttgtcaaaatccaaaggaagccgaattggatttgatagcacacagtggcgtgcagttaaaaaatttattatgttaacatccaaccaaaatgtaccagtgtttcttattgatcctttgatactggaattgattaataagaactttgaacaagtcaaaaatacttctcatggctctacttcacaatgcaagtttttctgtgttccaagagactttactgcatttgcactgcagtatcacctatggaagaatgaggaaggctggtttcggatagctgagaatatgggatttcagtgcctaaagattgagagtaaagatccccggctagacgggatagactcactctctggaactgaaatccccctgcactatatctgcaaactggccactcatgcgatccacttggtagtctttcatgagaggagtggcaactacctctggcacggccacttgagacttaaagaacacattgacaggaaatttgttcccttccaaaagttacagtttggtcgttatccaggagcttttgacaggccagagttacagcaagttactgttgatggactggaagttctcattccaaaggatccaatgcactttgtagaagaagtaccacactctaggtttattgagtgtaggtataaagaagctcgagcattctttcagcagtaccttgatgataacactgtggaagctgtggcctttcggaagagtgcaaaggaattactgcaactagcagcgaaaacattaaacaaattgggagtaccattctggctgagcagtggaacttgtctaggatggtatcgacaatgcaacattattccttatagcaaagatgttgacctaggaatttttatacaagattacaaatctgatattattttagcatttcaggatgcaggacttccgctcaaacacaaatttgggaaggtagaagacagcttggaactatccttccagggaaaagatgatgtaaaacttgatgtttttttcttctatgaagaaactgatcacatgtggaatggaggcactcaggccaaaacaggaaaaaaattcaaatacctgtttccgaagtttacactgtgctggactgagtttgtagacatgaaggtccatgtaccctgtgaaaccctcgaatacattgaagccaactatggtaagacctggaagattcctgtaaagacgtgggactggaagcgctctcctcccaatgtgcaacccaatggaatctggcctatttctgagtgggatgaggttatccagttatattgagatagtaggttgaaatgggagaatttctcttttggaaaaaaaggtagataactgtttaaaaaatacatgtctatttgtcaaacataagtgggaaccaaagaaaaaatgtgacaagtttgaagacacagaaagagtcatctgatgtaattctctcacttagtactgaggaattttcatgtgccacatacaatgctaggttacagtggagaagccaagatgaatgagacaaatacctacttcttttattcctccttttggtaaacaactcaattttcctttgagggaaccctcccccaccctttgaagagttcaagttctgtacaggtttttaaaacgtgaagtaatgtttgaactggaagatgagctcaccaggcaaagctaaggaaggatatactagttgaaaagaataacccactcctcttctgggcatttaagctggtatgttagtgctacttttaagattgtggagtctgagttaatattcaagtgatcagactttgagtgacatcaagaaaagatgatatcaggttcatttttcaactaatcttatgtggaattgaattagagaacaaggcattattcttttagggaaggtgagagcttatttgtatcagagcttattacttgtcaggataagtaaatttctgtacatgtactgttttcatatgtgaagtgagaagaaactttatgcttgtttaatgcttaaatttccatccattgtgagaatattttcactgacctctgatggcacttgttgacaaatcattcaagtgagaccatgttactagacatgatcttgaaagaggccatgatttcacaaaactcatttttattttattctcagacagtctgttaggtaaaaatatgagaaattcatgtacattttatattttctgaatttataatctgtgcactcccaattttaatgacactaaaatattaatagaattttttaaatatactctaatttttaaaacatactctttattatcttcatttatcaattacagcttcgtatctctaatttatggtctatataccaatttaaatggcatgtaaacctgcctgtttcttctcctcttctaatatatcagatctccaaaatggaagctaaatggtggacttgacaactattcaccctacctcagatcatagagtttgtaaagtttgtgtccctccccagtttttcagtctgttgaatgtcgatggggcaagaactcagacttctactttaccaagtaccacacactctggaatgctttagtttccttttcccctcaagatgtctgagtcagctaggatgctgtttaccccatctctctcttatatcacttgaatgatatattgtaagtgagaggtaaaggaaaatgtaggcacaataagcactgctatttttctctttgtctaggaaaggaagctgaatcttatatcttatctatgctatttaggactactttctggagcttggcagattttcctctgacaccagagaacaatagtagtctcaagaatggaaacctgaatgtctgagggaatgggctggtagactttttcgaaaacaaattagagaaagtaacttacaaccacccattccggatttgtaaagcaacatgaaaacctttgataaatgataaccaacagtcttctgtcctaatttgcattctcaatgcagaattattgggtctttcataaacaacatgagtggtttctggagacatttaagattgtcagcaaacttgtcccaaaatggcacatcatcataatccattttctctttgctagaaaatcagcccatagagtgcattcccaaattctaaatagctgaccctaaattcatttttcatgcttaaaaataatagaacaaataataatactatttttgggcaaaatccaccctacttgatgaggaccatttgcttgtgctcagtatttagaaatgcatacactccacatttctccccatttccaattgggactcccattctttgccaggagatcttacccatcccttttcagattaatcttttatcctttcctgaagtacaaagtcttaagagtgtctgaaatccaagacatcttggcccaattgacacaggttctatattcttccctacatagaccactggctgctgaaatacttttcttgtcttctggtttcacaggcttcagctcatgggttccaccctaacttggggaaacaaaagccttctctagaatctgaaggccaggcttacctctgattctgattcatccatacttcatcttatgtattttaacagttgggttctgtggagtgtccagagaccttgggttaggtatatccatcttcagtacctcattggatcacttttctttcatcacttgagtattctagcagtcattctcctaatctgaccactttcaggtttagtttacctggcttacctggggaagttgacaacttgttggtagttaggcacccatgaatgtctccagagacatcctgagaggcaagattcctcttaattgataaccaggacaaccaggtagtcacccagtcctctctaagcagggagcacttgtccttctctcctctgctgcagctactgatatctggcccctggaataaaaccatagttcctaaaattgagcatccctaagagtagctgcttggtgggacagctgatttctttgattccctagctgcaaaacctgaaattgaccactaggtgacagaatgtttgccagtatccccacaaaacaagttaaaacttaagtgaaaatcattctgcttttgaatcttaaaagctagaaaaaccataatgtaatattctttttaaaccctcttattttataactaaataaataatcacagaaaagaatgatctgaacaagaacagctgaggctagtatctttaacagtgcttgagatgcttaacagagaaggcatccagtgcttcattgaggctaagtctcagggtgtttctgccgcttagtatctttttgttcagattgagaacctaaggcgacagagaggtcaaggggaagtattttctagttcagaattcagaattcttaggcaaccttcatacctttatctggaaaatgccttctctccagacaataagacagttcacatctggagacatcagcctttggtacctaattctctaagctcaagatgcatcccattgccactttaccattctatttcccaagggaaccatcagcaccaacctgctaaatgcctgtatttgaagtctctccccttcctgaagtgaccttttatgaggctctttccttcctaagggacctttccctggtagtagtggtctcattcacaaaaaagaataatagatgtaactggagtcactttgcagttttcaagattttttttttatctgcttggctggaaaggagactagagtatctagtttttagtatttaaactacttttaattatttatattgatactctctgataaatgcaggtagttaagaatagattgtactcattcctttttgagtttgtgacctcaaaccattgtttttattcttacacgactacagtacttcaaatggcacatagataggcaggatattacataggtaagcaggaatttatacattgggtaccagagctaaatctggaaaacacatttggaatgagcttccacacttcagtctaaaatctcacccaaacttatggctacatatttttctaagtttcccccctagtttcactttctggaaagtgaacagttttttaaatcctaaatgttataaatccttaggagaaatattccctcaaaacctagtcaagaaagtgccacattcccaccttctaacaggtaattattagttgtaatagctttaatgcatggaaaaacttcagttactgaccagtcaagagaatttctcaagaaaaatcccagcaacgttccctctttcctccttgtcttccactatcattaagacctgggctagatcacctctaacatctcactcagggaaggcaatgtgttgccataaaaagaccacaagcttttgagttaggcctgaatttgaatttcagcttaatcatgtgggatttatggtgggggccctttcagtctcaatttccacattagtgaactggggaaatgatacatacttctaagggtttttagggggattaaatgaagtatacagttcttagcctcaggcctaggattaagtaagtactcaagaaatgtgcaattttctagttccatgtttcttttctaatcttcaaatggaattatagaaaccatgggtcagaacatattcctttactcaaaagattgcatgactgaatttgcttaagaaaaaaaaaattgtatcaagtcattaatacaattatacattaattatattacattaatacaatatatggtttgtgaattcagagacattaccagtttgcctccttctctcaatagaacttgtattttcattttcttggttaagcagttgtctcctaatattatcccatatgctacctagtttgctggtcccaagcagtttactgtacttcactagatttggtacctgctctcccctggacttctttttcaatattctagcctttcctagatgtaaatctttacctccttgttagtgaaattagatataagccatgatttggagagggaagaaatctggaatacttaatttcatttaattatctatgctgatgaatgcctgtatcattgttaataaaggagaattgaaaatactcatttctactttctgccctcaaatttctgtttctatctcaactaggcaagaatcagcagggtgcatgatgccattttaagctgcttcacatcagactgaaatcctaattacagttcataagtgaaacagactaattcaatggcaataccttttgtataggtcctgtgcttaaaggaggcaagtataaattttctaataagaaatccctgcttcttttgggtgcagtggctcacacctgtaataccagcagtttgagaagctaaggcaggtggatcacttgaggccaggagttcgagaccagcctggccaacatagtgaaaccccgtctcttctaaaaatacaaaaaaattagctgggcatggtggtgcacgcctatagtcccagctacacaggaggctgaggcaggagaatcacttgaacccgggaagcagagtctgcagtgagccaagatcgcggcattgcacttcagcctgggcgatagagcaagactctgtctcagaaaaaaaaaaaaggaaagaaagaaatctctgcttccgtactatcaaaacttctaccctagaataccccctggcaccttctaacccaacctaatacagagattttgtagggacccattaacaagctcctatataattataagcagctctcacagtagggttgaaagagaatataaggaaaattagaagtactgtatttttgctattggaaatgaaatattgtttcatgcacctttgaaaaaaataacaggattttacagccttctgatgattcattcaaagcatggggaatagttcatatgtttgttaaatgaaaatcttatgtagctatttgtgtgtccctcccacttcataactacaaaaacatatatatgaatttctaaacaaagtgatattttaaagatgaattgattcaatgtgtacttaccagtttactgtgtggttttatcttcaggtacagatagtttgtggtactacttgaaaatacctttaatattattttcatcagaatttgtaatatataatccagtttgggatgatgaataaaatttttctaatctcttgaaaaaacttgta

SEQ ID NO: 299974 - DNA, 7513 bp, Homo sapiens
agattgaaaggaaacacactgaatgaggaaaaactaacatacggtcatcaacatccttgtataacctagtttttaaaaaaattggatttcaaagctggagaacaaaagacatataaaccttagatatcaagcataagagaggtgtcagtatatttgaaggattgaaggaataaatgtaagcatttgaagaactaaatgtgtttaaccaaaatcaaacagtggagacaagaaaacaaaattatcttcctttccaaatccaaaaagatgaaaacgactgagatactttcaaaagacaaccaagtgagcagcacagactaatgagtagaatcaataagaacgtggttttggcccttttaacgctgacaagttctgcatttctgctgtttcagttgtactactacaagcactatttatcaacaaagaatggagctggtttgtcaaaatccaaaggaagccgaattggatttgatagcacacagtggcgtgcagttaaaaaatttattatgttaacatccaaccaaaatgtaccagtgtttcttattgatcctttgatactggaattgattaataagaactttgaacaagtcaaaaatacttctcatggctctacttcacaatgcaagtttttctgtgttccaagagactttactgcatttgcactgcagtatcacctatggaagaatgaggaaggctggtttcggatagctgagaatatgggatttcagtgcctaaagattgagagtaaagatccccggctagacgggatagactcactctctggaactgaaatccccctgcactatatctgcaaactggccactcatgcgatccacttggtagtctttcatgagaggagtggcaactacctctggcacggccacttgagacttaaagaacacattgacaggaaatttgttcccttccaaaagttacagtttggtcgttatccaggagcttttgacaggccagagttacagcaagttactgttgatggactggaagttctcattccaaaggatccaatgcactttgtagaagaagtaccacactctaggtttattgagtgtaggtataaagaagctcgagcattctttcagcagtaccttgatgataacactgtggaagctgtggcctttcggaagagtgcaaaggaattactgcaactagcagcgaaaacattaaacaaattgggagtaccattctggctgagcagtggaacttgtctaggatggtatcgacaatgcaacattattccttatagcaaagatgttgacctaggaatttttatacaagattacaaatctgatattattttagcatttcaggatgcaggacttccgctcaaacacaaatttgggaaggtagaagacagcttggaactatccttccagggaaaagatgatgtaaaacttgatgtttttttcttctatgaagaaactgatcacatgtggaatggaggcactcaggccaaaacaggaaaaaaattcaaatacctgtttccgaagtttacactgtgctggactgagtttgtagacatgaaggtccatgtaccctgtgaaaccctcgaatacattgaagccaactatggtaagacctggaagattcctgtaaagacgtgggactggaagcgctctcctcccaatgtgcaacccaatggaatctggcctatttctgagtgggatgaggttatccagttatattgagatagtaggttgaaatgggagaatttctcttttggaaaaaaaggtagataactgtttaaaaaatacatgtctatttgtcaaacataagtgggaaccaaagaaaaaatgtgacaagtttgaagacacagaaagagtcatctgatgtaattctctcacttagtactgaggaattttcatgtgccacatacaatgctaggttacagtggagaagccaagatgaatgagacaaatacctacttcttttattcctccttttggtaaacaactcaattttcctttgagggaaccctcccccaccctttgaagagttcaagttctgtacaggtttttaaaacgtgaagtaatgtttgaactggaagatgagctcaccaggcaaagctaaggaaggatatactagttgaaaagaataacccactcctcttctgggcatttaagctggtatgttagtgctacttttaagattgtggagtctgagttaatattcaagtgatcagactttgagtgacatcaagaaaagatgatatcaggttcatttttcaactaatcttatgtggaattgaattagagaacaaggcattattcttttagggaaggtgagagcttatttgtatcagagcttattacttgtcaggataagtaaatttctgtacatgtactgttttcatatgtgaagtgagaagaaactttatgcttgtttaatgcttaaatttccatccattgtgagaatattttcactgacctctgatggcacttgttgacaaatcattcaagtgagaccatgttactagacatgatcttgaaagaggccatgatttcacaaaactcatttttattttattctcagacagtctgttaggtaaaaatatgagaaattcatgtacattttatattttctgaatttataatctgtgcactcccaattttaatgacactaaaatattaatagaattttttaaatatactctaatttttaaaacatactctttattatcttcatttatcaattacagcttcgtatctctaatttatggtctatataccaatttaaatggcatgtaaacctgcctgtttcttctcctcttctaatatatcagatctccaaaatggaagctaaatggtggacttgacaactattcaccctacctcagatcatagagtttgtaaagtttgtgtccctccccagtttttcagtctgttgaatgtcgatggggcaagaactcagacttctactttaccaagtaccacacactctggaatgctttagtttccttttcccctcaagatgtctgagtcagctaggatgctgtttaccccatctctctcttatatcacttgaatgatatattgtaagtgagaggtaaaggaaaatgtaggcacaataagcactgctatttttctctttgtctaggaaaggaagctgaatcttatatcttatctatgctatttaggactactttctggagcttggcagattttcctctgacaccagagaacaatagtagtctcaagaatggaaacctgaatgtctgagggaatgggctggtagactttttcgaaaacaaattagagaaagtaacttacaaccacccattccggatttgtaaagcaacatgaaaacctttgataaatgataaccaacagtcttctgtcctaatttgcattctcaatgcagaattattgggtctttcataaacaacatgagtggtttctggagacatttaagattgtcagcaaacttgtcccaaaatggcacatcatcataatccattttctctttgctagaaaatcagcccatagagtgcattcccaaattctaaatagctgaccctaaattcatttttcatgcttaaaaataatagaacaaataataatactatttttgggcaaaatccaccctacttgatgaggaccatttgcttgtgctcagtatttagaaatgcatacactccacatttctccccatttccaattgggactcccattctttgccaggagatcttacccatcccttttcagattaatcttttatcctttcctgaagtacaaagtcttaagagtgtctgaaatccaagacatcttggcccaattgacacaggttctatattcttccctacatagaccactggctgctgaaatacttttcttgtcttctggtttcacaggcttcagctcatgggttccaccctaacttggggaaacaaaagccttctctagaatctgaaggccaggcttacctctgattctgattcatccatacttcatcttatgtattttaacagttgggttctgtggagtgtccagagaccttgggttaggtatatccatcttcagtacctcattggatcacttttctttcatcacttgagtattctagcagtcattctcctaatctgaccactttcaggtttagtttacctggcttacctggggaagttgacaacttgttggtagttaggcacccatgaatgtctccagagacatcctgagaggcaagattcctcttaattgataaccaggacaaccaggtagtcacccagtcctctctaagcagggagcacttgtccttctctcctctgctgcagctactgatatctggcccctggaataaaaccatagttcctaaaattgagcatccctaagagtagctgcttggtgggacagctgatttctttgattccctagctgcaaaacctgaaattgaccactaggtgacagaatgtttgccagtatccccacaaaacaagttaaaacttaagtgaaaatcattctgcttttgaatcttaaaagctagaaaaaccataatgtaatattctttttaaaccctcttattttataactaaataaataatcacagaaaagaatgatctgaacaagaacagctgaggctagtatctttaacagtgcttgagatgcttaacagagaaggcatccagtgcttcattgaggctaagtctcagggtgtttctgccgcttagtatctttttgttcagattgagaacctaaggcgacagagaggtcaaggggaagtattttctagttcagaattcagaattcttaggcaaccttcatacctttatctggaaaatgccttctctccagacaataagacagttcacatctggagacatcagcctttggtacctaattctctaagctcaagatgcatcccattgccactttaccattctatttcccaagggaaccatcagcaccaacctgctaaatgcctgtatttgaagtctctccccttcctgaagtgaccttttatgaggctctttccttcctaagggacctttccctggtagtagtggtctcattcacaaaaaagaataatagatgtaactggagtcactttgcagttttcaagattttttttttatctgcttggctggaaaggagactagagtatctagtttttagtatttaaactacttttaattatttatattgatactctctgataaatgcaggtagttaagaatagattgtactcattcctttttgagtttgtgacctcaaaccattgtttttattcttacacgactacagtacttcaaatggcacatagataggcaggatattacataggtaagcaggaatttatacattgggtaccagagctaaatctggaaaacacatttggaatgagcttccacacttcagtctaaaatctcacccaaacttatggctacatatttttctaagtttcccccctagtttcactttctggaaagtgaacagttttttaaatcctaaatgttataaatccttaggagaaatattccctcaaaacctagtcaagaaagtgccacattcccaccttctaacaggtaattattagttgtaatagctttaatgcatggaaaaacttcagttactgaccagtcaagagaatttctcaagaaaaatcccagcaacgttccctctttcctccttgtcttccactatcattaagacctgggctagatcacctctaacatctcactcagggaaggcaatgtgttgccataaaaagaccacaagcttttgagttaggcctgaatttgaatttcagcttaatcatgtgggatttatggtgggggccctttcagtctcaatttccacattagtgaactggggaaatgatacatacttctaagggtttttagggggattaaatgaagtatacagttcttagcctcaggcctaggattaagtaagtactcaagaaatgtgcaattttctagttccatgtttcttttctaatcttcaaatggaattatagaaaccatgggtcagaacatattcctttactcaaaagattgcatgactgaatttgcttaagaaaaaaaaaattgtatcaagtcattaatacaattatacattaattatattacattaatacaatatatggtttgtgaattcagagacattaccagtttgcctccttctctcaatagaacttgtattttcattttcttggttaagcagttgtctcctaatattatcccatatgctacctagtttgctggtcccaagcagtttactgtacttcactagatttggtacctgctctcccctggacttctttttcaatattctagcctttcctagatgtaaatctttacctccttgttagtgaaattagatataagccatgatttggagagggaagaaatctggaatacttaatttcatttaattatctatgctgatgaatgcctgtatcattgttaataaaggagaattgaaaatactcatttctactttctgccctcaaatttctgtttctatctcaactaggcaagaatcagcagggtgcatgatgccattttaagctgcttcacatcagactgaaatcctaattacagttcataagtgaaacagactaattcaatggcaataccttttgtataggtcctgtgcttaaaggaggcaagtataaattttctaataagaaatccctgcttcttttgggtgcagtggctcacacctgtaataccagcagtttgagaagctaaggcaggtggatcacttgaggccaggagttcgagaccagcctggccaacatagtgaaaccccgtctcttctaaaaatacaaaaaaattagctgggcatggtggtgcacgcctatagtcccagctacacaggaggctgaggcaggagaatcacttgaacccgggaagcagagtctgcagtgagccaagatcgcggcattgcacttcagcctgggcgatagagcaagactctgtctcagaaaaaaaaaaaaggaaagaaagaaatctctgcttccgtactatcaaaacttctaccctagaataccccctggcaccttctaacccaacctaatacagagattttgtagggacccattaacaagctcctatataattataagcagctctcacagtagggttgaaagagaatataaggaaaattagaagtactgtatttttgctattggaaatgaaatattgtttcatgcacctttgaaaaaaataacaggattttacagccttctgatgattcattcaaagcatggggaatagttcatatgtttgttaaatgaaaatcttatgtagctatttgtgtgtccctcccacttcataactacaaaaacatatatatgaatttctaaacaaagtgatattttaaagatgaattgattcaatgtgtacttaccagtttactgtgtggttttatcttcaggtacagatagtttgtggtactacttgaaaatacctttaatattattttcatcagaatttgtaatatataatccagtttgggatgatgaataaaatttttctaatctcttgaaaaaacttgta

SEQ ID NO: 299975 - DNA, 5799 bp, Homo sapiens
ggggtaaagcggagcggctgcagcctgctgttgagtgagaaaacaaaattatcttcctttccaaatccaaaaagatgaaaacgactgagatactttcaaaagacaaccaagtgagcagcacagactaatgagtagaatcaataagaacgtggttttggcccttttaacgctgacaagttctgcatttctgctgtttcagttgtactactacaagcactatttatcaacaaagaatggagctggtttgtcaaaatccaaaggaagccgaattggatttgatagcacacagtggcgtgcagttaaaaaatttattatgttaacatccaaccaaaatgtaccagtgtttcttattgatcctttgatactggaattgattaataagaactttgaacaagtcaaaaatacttctcatggctctacttcacaatgcaagtttttctgtgttccaagagactttactgcatttgcactgcagtatcacctatggaagaatgaggaaggctggtttcggatagctgagaatatgggatttcagtgcctaaagattgagagtaaagatccccggctagacgggatagactcactctctggaactgaaatccccctgcactatatctgcaaactggccactcatgcgatccacttggtagtctttcatgagaggagtggcaactacctctggcacggccacttgagacttaaagaacacattgacaggaaatttgttcccttccaaaagttacagtttggtcgttatccaggagcttttgacaggccagagttacagcaagttactgttgatggactggaagttctcattccaaaggatccaatgcactttgtagaagaagtaccacactctaggtttattgagtgtaggtataaagaagctcgagcattctttcagcagtaccttgatgataacactgtggaagctgtggcctttcggaagagtgcaaaggaattactgcaactagcagcgaaaacattaaacaaattgggagtaccattctggctgagcagtggaacttgtctaggatggtatcgacaatgcaacattattccttatagcaaagatgttgacctaggaatttttatacaagattacaaatctgatattattttagcatttcaggatgcaggacttccgctcaaacacaaatttgggaaggtagaagacagcttggaactatccttccagggaaaagatgatgtaaaacttgatgtttttttcttctatgaagaaactgatcacatgtggaatggaggcactcaggccaaaacaggaaaaaaattcaaatacctgtttccgaagtttacactgtgctggactgagtttgtagacatgaaggtccatgtaccctgtgaaaccctcgaatacattgaagccaactatggaaaggaagctgaatcttatatcttatctatgctatttaggactactttctggagcttggcagattttcctctgacaccagagaacaatagtagtctcaagaatggaaacctgaatgtctgagggaatgggctggtagactttttcgaaaacaaattagagaaagtaacttacaaccacccattccggatttgtaaagcaacatgaaaacctttgataaatgataaccaacagtcttctgtcctaatttgcattctcaatgcagaattattgggtctttcataaacaacatgagtggtttctggagacatttaagattgtcagcaaacttgtcccaaaatggcacatcatcataatccattttctctttgctagaaaatcagcccatagagtgcattcccaaattctaaatagctgaccctaaattcatttttcatgcttaaaaataatagaacaaataataatactatttttgggcaaaatccaccctacttgatgaggaccatttgcttgtgctcagtatttagaaatgcatacactccacatttctccccatttccaattgggactcccattctttgccaggagatcttacccatcccttttcagattaatcttttatcctttcctgaagtacaaagtcttaagagtgtctgaaatccaagacatcttggcccaattgacacaggttctatattcttccctacatagaccactggctgctgaaatacttttcttgtcttctggtttcacaggcttcagctcatgggttccaccctaacttggggaaacaaaagccttctctagaatctgaaggccaggcttacctctgattctgattcatccatacttcatcttatgtattttaacagttgggttctgtggagtgtccagagaccttgggttaggtatatccatcttcagtacctcattggatcacttttctttcatcacttgagtattctagcagtcattctcctaatctgaccactttcaggtttagtttacctggcttacctggggaagttgacaacttgttggtagttaggcacccatgaatgtctccagagacatcctgagaggcaagattcctcttaattgataaccaggacaaccaggtagtcacccagtcctctctaagcagggagcacttgtccttctctcctctgctgcagctactgatatctggcccctggaataaaaccatagttcctaaaattgagcatccctaagagtagctgcttggtgggacagctgatttctttgattccctagctgcaaaacctgaaattgaccactaggtgacagaatgtttgccagtatccccacaaaacaagttaaaacttaagtgaaaatcattctgcttttgaatcttaaaagctagaaaaaccataatgtaatattctttttaaaccctcttattttataactaaataaataatcacagaaaagaatgatctgaacaagaacagctgaggctagtatctttaacagtgcttgagatgcttaacagagaaggcatccagtgcttcattgaggctaagtctcagggtgtttctgccgcttagtatctttttgttcagattgagaacctaaggcgacagagaggtcaaggggaagtattttctagttcagaattcagaattcttaggcaaccttcatacctttatctggaaaatgccttctctccagacaataagacagttcacatctggagacatcagcctttggtacctaattctctaagctcaagatgcatcccattgccactttaccattctatttcccaagggaaccatcagcaccaacctgctaaatgcctgtatttgaagtctctccccttcctgaagtgaccttttatgaggctctttccttcctaagggacctttccctggtagtagtggtctcattcacaaaaaagaataatagatgtaactggagtcactttgcagttttcaagattttttttttatctgcttggctggaaaggagactagagtatctagtttttagtatttaaactacttttaattatttatattgatactctctgataaatgcaggtagttaagaatagattgtactcattcctttttgagtttgtgacctcaaaccattgtttttattcttacacgactacagtacttcaaatggcacatagataggcaggatattacataggtaagcaggaatttatacattgggtaccagagctaaatctggaaaacacatttggaatgagcttccacacttcagtctaaaatctcacccaaacttatggctacatatttttctaagtttcccccctagtttcactttctggaaagtgaacagttttttaaatcctaaatgttataaatccttaggagaaatattccctcaaaacctagtcaagaaagtgccacattcccaccttctaacaggtaattattagttgtaatagctttaatgcatggaaaaacttcagttactgaccagtcaagagaatttctcaagaaaaatcccagcaacgttccctctttcctccttgtcttccactatcattaagacctgggctagatcacctctaacatctcactcagggaaggcaatgtgttgccataaaaagaccacaagcttttgagttaggcctgaatttgaatttcagcttaatcatgtgggatttatggtgggggccctttcagtctcaatttccacattagtgaactggggaaatgatacatacttctaagggtttttagggggattaaatgaagtatacagttcttagcctcaggcctaggattaagtaagtactcaagaaatgtgcaattttctagttccatgtttcttttctaatcttcaaatggaattatagaaaccatgggtcagaacatattcctttactcaaaagattgcatgactgaatttgcttaagaaaaaaaaaattgtatcaagtcattaatacaattatacattaattatattacattaatacaatatatggtttgtgaattcagagacattaccagtttgcctccttctctcaatagaacttgtattttcattttcttggttaagcagttgtctcctaatattatcccatatgctacctagtttgctggtcccaagcagtttactgtacttcactagatttggtacctgctctcccctggacttctttttcaatattctagcctttcctagatgtaaatctttacctccttgttagtgaaattagatataagccatgatttggagagggaagaaatctggaatacttaatttcatttaattatctatgctgatgaatgcctgtatcattgttaataaaggagaattgaaaatactcatttctactttctgccctcaaatttctgtttctatctcaactaggcaagaatcagcagggtgcatgatgccattttaagctgcttcacatcagactgaaatcctaattacagttcataagtgaaacagactaattcaatggcaataccttttgtataggtcctgtgcttaaaggaggcaagtataaattttctaataagaaatccctgcttcttttgggtgcagtggctcacacctgtaataccagcagtttgagaagctaaggcaggtggatcacttgaggccaggagttcgagaccagcctggccaacatagtgaaaccccgtctcttctaaaaatacaaaaaaattagctgggcatggtggtgcacgcctatagtcccagctacacaggaggctgaggcaggagaatcacttgaacccgggaagcagagtctgcagtgagccaagatcgcggcattgcacttcagcctgggcgatagagcaagactctgtctcagaaaaaaaaaaaaggaaagaaagaaatctctgcttccgtactatcaaaacttctaccctagaataccccctggcaccttctaacccaacctaatacagagattttgtagggacccattaacaagctcctatataattataagcagctctcacagtagggttgaaagagaatataaggaaaattagaagtactgtatttttgctattggaaatgaaatattgtttcatgcacctttgaaaaaaataacaggattttacagccttctgatgattcattcaaagcatggggaatagttcatatgtttgttaaatgaaaatcttatgtagctatttgtgtgtccctcccacttcataactacaaaaacatatatatgaatttctaaacaaagtgatattttaaagatgaattgattcaatgtgtacttaccagtttactgtgtggttttatcttcaggtacagatagtttgtggtactacttgaaaatacctttaatattattttcatcagaatttgtaatatataatccagtttgggatgatgaataaaatttttctaatctcttgaaaaaacttgta

SEQ ID NO: 299976 - DNA, 7270 bp, Homo sapiens
ggggtaaagcggagcggctgcagcctgctgttgagtgagaaaacaaaattatcttcctttccaaatccaaaaagatgaaaacgactgagatactttcaaaagacaaccaagtgagcagcacagactaatgagtagaatcaataagaacgtggttttggcccttttaacgctgacaagttctgcatttctgctgtttcagttgtactactacaagcactatttatcaacaaagaatggagctggtttgtcaaaatccaaaggaagccgaattggatttgatagcacacagtggcgtgcagttaaaaaatttattatgttaacatccaaccaaaatgtaccagtgtttcttattgatcctttgatactggaattgattaataagaactttgaacaagtcaaaaatacttctcatggctctacttcacaatgcaagtttttctgtgttccaagagactttactgcatttgcactgcagtatcacctatggaagaatgaggaaggctggtttcggatagctgagaatatgggatttcagtgcctaaagattgagagtaaagatccccggctagacgggatagactcactctctggaactgaaatccccctgcactatatctgcaaactggccactcatgcgatccacttggtagtctttcatgagaggagtggcaactacctctggcacggccacttgagacttaaagaacacattgacaggaaatttgttcccttccaaaagttacagtttggtcgttatccaggagcttttgacaggccagagttacagcaagttactgttgatggactggaagttctcattccaaaggatccaatgcactttgtagaagaagtaccacactctaggtttattgagtgtaggtataaagaagctcgagcattctttcagcagtaccttgatgataacactgtggaagctgtggcctttcggaagagtgcaaaggaattactgcaactagcagcgaaaacattaaacaaattgggagtaccattctggctgagcagtggaacttgtctaggatggtatcgacaatgcaacattattccttatagcaaagatgttgacctaggaatttttatacaagattacaaatctgatattattttagcatttcaggatgcaggacttccgctcaaacacaaatttgggaaggtagaagacagcttggaactatccttccagggaaaagatgatgtaaaacttgatgtttttttcttctatgaagaaactgatcacatgtggaatggaggcactcaggccaaaacaggaaaaaaattcaaatacctgtttccgaagtttacactgtgctggactgagtttgtagacatgaaggtccatgtaccctgtgaaaccctcgaatacattgaagccaactatggtaagacctggaagattcctgtaaagacgtgggactggaagcgctctcctcccaatgtgcaacccaatggaatctggcctatttctgagtgggatgaggttatccagttatattgagatagtaggttgaaatgggagaatttctcttttggaaaaaaaggtagataactgtttaaaaaatacatgtctatttgtcaaacataagtgggaaccaaagaaaaaatgtgacaagtttgaagacacagaaagagtcatctgatgtaattctctcacttagtactgaggaattttcatgtgccacatacaatgctaggttacagtggagaagccaagatgaatgagacaaatacctacttcttttattcctccttttggtaaacaactcaattttcctttgagggaaccctcccccaccctttgaagagttcaagttctgtacaggtttttaaaacgtgaagtaatgtttgaactggaagatgagctcaccaggcaaagctaaggaaggatatactagttgaaaagaataacccactcctcttctgggcatttaagctggtatgttagtgctacttttaagattgtggagtctgagttaatattcaagtgatcagactttgagtgacatcaagaaaagatgatatcaggttcatttttcaactaatcttatgtggaattgaattagagaacaaggcattattcttttagggaaggtgagagcttatttgtatcagagcttattacttgtcaggataagtaaatttctgtacatgtactgttttcatatgtgaagtgagaagaaactttatgcttgtttaatgcttaaatttccatccattgtgagaatattttcactgacctctgatggcacttgttgacaaatcattcaagtgagaccatgttactagacatgatcttgaaagaggccatgatttcacaaaactcatttttattttattctcagacagtctgttaggtaaaaatatgagaaattcatgtacattttatattttctgaatttataatctgtgcactcccaattttaatgacactaaaatattaatagaattttttaaatatactctaatttttaaaacatactctttattatcttcatttatcaattacagcttcgtatctctaatttatggtctatataccaatttaaatggcatgtaaacctgcctgtttcttctcctcttctaatatatcagatctccaaaatggaagctaaatggtggacttgacaactattcaccctacctcagatcatagagtttgtaaagtttgtgtccctccccagtttttcagtctgttgaatgtcgatggggcaagaactcagacttctactttaccaagtaccacacactctggaatgctttagtttccttttcccctcaagatgtctgagtcagctaggatgctgtttaccccatctctctcttatatcacttgaatgatatattgtaagtgagaggtaaaggaaaatgtaggcacaataagcactgctatttttctctttgtctaggaaaggaagctgaatcttatatcttatctatgctatttaggactactttctggagcttggcagattttcctctgacaccagagaacaatagtagtctcaagaatggaaacctgaatgtctgagggaatgggctggtagactttttcgaaaacaaattagagaaagtaacttacaaccacccattccggatttgtaaagcaacatgaaaacctttgataaatgataaccaacagtcttctgtcctaatttgcattctcaatgcagaattattgggtctttcataaacaacatgagtggtttctggagacatttaagattgtcagcaaacttgtcccaaaatggcacatcatcataatccattttctctttgctagaaaatcagcccatagagtgcattcccaaattctaaatagctgaccctaaattcatttttcatgcttaaaaataatagaacaaataataatactatttttgggcaaaatccaccctacttgatgaggaccatttgcttgtgctcagtatttagaaatgcatacactccacatttctccccatttccaattgggactcccattctttgccaggagatcttacccatcccttttcagattaatcttttatcctttcctgaagtacaaagtcttaagagtgtctgaaatccaagacatcttggcccaattgacacaggttctatattcttccctacatagaccactggctgctgaaatacttttcttgtcttctggtttcacaggcttcagctcatgggttccaccctaacttggggaaacaaaagccttctctagaatctgaaggccaggcttacctctgattctgattcatccatacttcatcttatgtattttaacagttgggttctgtggagtgtccagagaccttgggttaggtatatccatcttcagtacctcattggatcacttttctttcatcacttgagtattctagcagtcattctcctaatctgaccactttcaggtttagtttacctggcttacctggggaagttgacaacttgttggtagttaggcacccatgaatgtctccagagacatcctgagaggcaagattcctcttaattgataaccaggacaaccaggtagtcacccagtcctctctaagcagggagcacttgtccttctctcctctgctgcagctactgatatctggcccctggaataaaaccatagttcctaaaattgagcatccctaagagtagctgcttggtgggacagctgatttctttgattccctagctgcaaaacctgaaattgaccactaggtgacagaatgtttgccagtatccccacaaaacaagttaaaacttaagtgaaaatcattctgcttttgaatcttaaaagctagaaaaaccataatgtaatattctttttaaaccctcttattttataactaaataaataatcacagaaaagaatgatctgaacaagaacagctgaggctagtatctttaacagtgcttgagatgcttaacagagaaggcatccagtgcttcattgaggctaagtctcagggtgtttctgccgcttagtatctttttgttcagattgagaacctaaggcgacagagaggtcaaggggaagtattttctagttcagaattcagaattcttaggcaaccttcatacctttatctggaaaatgccttctctccagacaataagacagttcacatctggagacatcagcctttggtacctaattctctaagctcaagatgcatcccattgccactttaccattctatttcccaagggaaccatcagcaccaacctgctaaatgcctgtatttgaagtctctccccttcctgaagtgaccttttatgaggctctttccttcctaagggacctttccctggtagtagtggtctcattcacaattatctgcttggctggaaaggagactagagtatctagtttttagtatttaaactacttttaattatttatattgatactctctgataaatgcaggtagttaagaatagattgtactcattcctttttgagtttgtgacctcaaaccattgtttttattcttacacgactacagtacttcaaatggcacatagataggcaggatattacataggtaagcaggaatttatacattgggtaccagagctaaatctggaaaacacatttggaatgagcttccacacttcagtctaaaatctcacccaaacttatggctacatatttttctaagtttcccccctagtttcactttctggaaagtgaacagttttttaaatcctaaatgttataaatccttaggagaaatattccctcaaaacctagtcaagaaagtgccacattcccaccttctaacaggtaattattagttgtaatagctttaatgcatggaaaaacttcagttactgaccagtcaagagaatttctcaagaaaaatcccagcaacgttccctctttcctccttgtcttccactatcattaagacctgggctagatcacctctaacatctcactcagggaaggcaatgtgttgccataaaaagaccacaagcttttgagttaggcctgaatttgaatttcagcttaatcatgtgggatttatggtgggggccctttcagtctcaatttccacattagtgaactggggaaatgatacatacttctaagggtttttagggggattaaatgaagtatacagttcttagcctcaggcctaggattaagtaagtactcaagaaatgtgcaattttctagttccatgtttcttttctaatcttcaaatggaattatagaaaccatgggtcagaacatattcctttactcaaaagattgcatgactgaatttgcttaagaaaaaaaaaattgtatcaagtcattaatacaattatacattaattatattacattaatacaatatatggtttgtgaattcagagacattaccagtttgcctccttctctcaatagaacttgtattttcattttcttggttaagcagttgtctcctaatattatcccatatgctacctagtttgctggtcccaagcagtttactgtacttcactagatttggtacctgctctcccctggacttctttttcaatattctagcctttcctagatgtaaatctttacctccttgttagtgaaattagatataagccatgatttggagagggaagaaatctggaatacttaatttcatttaattatctatgctgatgaatgcctgtatcattgttaataaaggagaattgaaaatactcatttctactttctgccctcaaatttctgtttctatctcaactaggcaagaatcagcagggtgcatgatgccattttaagctgcttcacatcagactgaaatcctaattacagttcataagtgaaacagactaattcaatggcaataccttttgtataggtcctgtgcttaaaggaggcaagtataaattttctaataagaaatccctgcttcttttgggtgcagtggctcacacctgtaataccagcagtttgagaagctaaggcaggtggatcacttgaggccaggagttcgagaccagcctggccaacatagtgaaaccccgtctcttctaaaaatacaaaaaaattagctgggcatggtggtgcacgcctatagtcccagctacacaggaggctgaggcaggagaatcacttgaacccgggaagcagagtctgcagtgagccaagatcgcggcattgcacttcagcctgggcgatagagcaagactctgtctcagaaaaaaaaaaaaggaaagaaagaaatctctgcttccgtactatcaaaacttctaccctagaataccccctggcaccttctaacccaacctaatacagagattttgtagggacccattaacaagctcctatataattataagcagctctcacagtagggttgaaagagaatataaggaaaattagaagtactgtatttttgctattggaaatgaaatattgtttcatgcacctttgaaaaaaataacaggattttacagccttctgatgattcattcaaagcatggggaatagttcatatgtttgttaaatgaaaatcttatgtagctatttgtgtgtccctcccacttcataactacaaaaacatatatatgaatttctaaacaaagtgatattttaaagatgaattgattcaatgtgtacttaccagtttactgtgtggttttatcttcaggtacagatagtttgtggtactacttgaaaatacctttaatattattttcatcagaatttgtaatatataatccagtttgggatgatgaataaaatttttctaatctcttgaaaaaacttgta

SEQ ID NO: 299977 - DNA, 6049 bp, Homo sapiens
gtctgtgactacccagtctgtgctacccaatggaatctggcctatttctgagtgggactgagtttgtagacatgaaggtccatgtaccctgtgaaaccctcgaatacattgaagccaactatggtaagacctggaagattcctgtaaagacgtgggactggaagcgctctcctcccaatgtgcaacccaatggaatctggcctatttctgagtgggatgaggttatccagttatattgagatagtaggttgaaatgggagaatttctcttttggaaaaaaaggtagataactgtttaaaaaatacatgtctatttgtcaaacataagtgggaaccaaagaaaaaatgtgacaagtttgaagacacagaaagagtcatctgatgtaattctctcacttagtactgaggaattttcatgtgccacatacaatgctaggttacagtggagaagccaagatgaatgagacaaatacctacttcttttattcctccttttggtaaacaactcaattttcctttgagggaaccctcccccaccctttgaagagttcaagttctgtacaggtttttaaaacgtgaagtaatgtttgaactggaagatgagctcaccaggcaaagctaaggaaggatatactagttgaaaagaataacccactcctcttctgggcatttaagctggtatgttagtgctacttttaagattgtggagtctgagttaatattcaagtgatcagactttgagtgacatcaagaaaagatgatatcaggttcatttttcaactaatcttatgtggaattgaattagagaacaaggcattattcttttagggaaggtgagagcttatttgtatcagagcttattacttgtcaggataagtaaatttctgtacatgtactgttttcatatgtgaagtgagaagaaactttatgcttgtttaatgcttaaatttccatccattgtgagaatattttcactgacctctgatggcacttgttgacaaatcattcaagtgagaccatgttactagacatgatcttgaaagaggccatgatttcacaaaactcatttttattttattctcagacagtctgttaggtaaaaatatgagaaattcatgtacattttatattttctgaatttataatctgtgcactcccaattttaatgacactaaaatattaatagaattttttaaatatactctaatttttaaaacatactctttattatcttcatttatcaattacagcttcgtatctctaatttatggtctatataccaatttaaatggcatgtaaacctgcctgtttcttctcctcttctaatatatcagatctccaaaatggaagctaaatggtggacttgacaactattcaccctacctcagatcatagagtttgtaaagtttgtgtccctccccagtttttcagtctgttgaatgtcgatggggcaagaactcagacttctactttaccaagtaccacacactctggaatgctttagtttccttttcccctcaagatgtctgagtcagctaggatgctgtttaccccatctctctcttatatcacttgaatgatatattgtaagtgagaggtaaaggaaaatgtaggcacaataagcactgctatttttctctttgtctaggaaaggaagctgaatcttatatcttatctatgctatttaggactactttctggagcttggcagattttcctctgacaccagagaacaatagtagtctcaagaatggaaacctgaatgtctgagggaatgggctggtagactttttcgaaaacaaattagagaaagtaacttacaaccacccattccggatttgtaaagcaacatgaaaacctttgataaatgataaccaacagtcttctgtcctaatttgcattctcaatgcagaattattgggtctttcataaacaacatgagtggtttctggagacatttaagattgtcagcaaacttgtcccaaaatggcacatcatcataatccattttctctttgctagaaaatcagcccatagagtgcattcccaaattctaaatagctgaccctaaattcatttttcatgcttaaaaataatagaacaaataataatactatttttgggcaaaatccaccctacttgatgaggaccatttgcttgtgctcagtatttagaaatgcatacactccacatttctccccatttccaattgggactcccattctttgccaggagatcttacccatcccttttcagattaatcttttatcctttcctgaagtacaaagtcttaagagtgtctgaaatccaagacatcttggcccaattgacacaggttctatattcttccctacatagaccactggctgctgaaatacttttcttgtcttctggtttcacaggcttcagctcatgggttccaccctaacttggggaaacaaaagccttctctagaatctgaaggccaggcttacctctgattctgattcatccatacttcatcttatgtattttaacagttgggttctgtggagtgtccagagaccttgggttaggtatatccatcttcagtacctcattggatcacttttctttcatcacttgagtattctagcagtcattctcctaatctgaccactttcaggtttagtttacctggcttacctggggaagttgacaacttgttggtagttaggcacccatgaatgtctccagagacatcctgagaggcaagattcctcttaattgataaccaggacaaccaggtagtcacccagtcctctctaagcagggagcacttgtccttctctcctctgctgcagctactgatatctggcccctggaataaaaccatagttcctaaaattgagcatccctaagagtagctgcttggtgggacagctgatttctttgattccctagctgcaaaacctgaaattgaccactaggtgacagaatgtttgccagtatccccacaaaacaagttaaaacttaagtgaaaatcattctgcttttgaatcttaaaagctagaaaaaccataatgtaatattctttttaaaccctcttattttataactaaataaataatcacagaaaagaatgatctgaacaagaacagctgaggctagtatctttaacagtgcttgagatgcttaacagagaaggcatccagtgcttcattgaggctaagtctcagggtgtttctgccgcttagtatctttttgttcagattgagaacctaaggcgacagagaggtcaaggggaagtattttctagttcagaattcagaattcttaggcaaccttcatacctttatctggaaaatgccttctctccagacaataagacagttcacatctggagacatcagcctttggtacctaattctctaagctcaagatgcatcccattgccactttaccattctatttcccaagggaaccatcagcaccaacctgctaaatgcctgtatttgaagtctctccccttcctgaagtgaccttttatgaggctctttccttcctaagggacctttccctggtagtagtggtctcattcacaaaaaagaataatagatgtaactggagtcactttgcagttttcaagattttttttttatctgcttggctggaaaggagactagagtatctagtttttagtatttaaactacttttaattatttatattgatactctctgataaatgcaggtagttaagaatagattgtactcattcctttttgagtttgtgacctcaaaccattgtttttattcttacacgactacagtacttcaaatggcacatagataggcaggatattacataggtaagcaggaatttatacattgggtaccagagctaaatctggaaaacacatttggaatgagcttccacacttcagtctaaaatctcacccaaacttatggctacatatttttctaagtttcccccctagtttcactttctggaaagtgaacagttttttaaatcctaaatgttataaatccttaggagaaatattccctcaaaacctagtcaagaaagtgccacattcccaccttctaacaggtaattattagttgtaatagctttaatgcatggaaaaacttcagttactgaccagtcaagagaatttctcaagaaaaatcccagcaacgttccctctttcctccttgtcttccactatcattaagacctgggctagatcacctctaacatctcactcagggaaggcaatgtgttgccataaaaagaccacaagcttttgagttaggcctgaatttgaatttcagcttaatcatgtgggatttatggtgggggccctttcagtctcaatttccacattagtgaactggggaaatgatacatacttctaagggtttttagggggattaaatgaagtatacagttcttagcctcaggcctaggattaagtaagtactcaagaaatgtgcaattttctagttccatgtttcttttctaatcttcaaatggaattatagaaaccatgggtcagaacatattcctttactcaaaagattgcatgactgaatttgcttaagaaaaaaaaaattgtatcaagtcattaatacaattatacattaattatattacattaatacaatatatggtttgtgaattcagagacattaccagtttgcctccttctctcaatagaacttgtattttcattttcttggttaagcagttgtctcctaatattatcccatatgctacctagtttgctggtcccaagcagtttactgtacttcactagatttggtacctgctctcccctggacttctttttcaatattctagcctttcctagatgtaaatctttacctccttgttagtgaaattagatataagccatgatttggagagggaagaaatctggaatacttaatttcatttaattatctatgctgatgaatgcctgtatcattgttaataaaggagaattgaaaatactcatttctactttctgccctcaaatttctgtttctatctcaactaggcaagaatcagcagggtgcatgatgccattttaagctgcttcacatcagactgaaatcctaattacagttcataagtgaaacagactaattcaatggcaataccttttgtataggtcctgtgcttaaaggaggcaagtataaattttctaataagaaatccctgcttcttttgggtgcagtggctcacacctgtaataccagcagtttgagaagctaaggcaggtggatcacttgaggccaggagttcgagaccagcctggccaacatagtgaaaccccgtctcttctaaaaatacaaaaaaattagctgggcatggtggtgcacgcctatagtcccagctacacaggaggctgaggcaggagaatcacttgaacccgggaagcagagtctgcagtgagccaagatcgcggcattgcacttcagcctgggcgatagagcaagactctgtctcagaaaaaaaaaaaaggaaagaaagaaatctctgcttccgtactatcaaaacttctaccctagaataccccctggcaccttctaacccaacctaatacagagattttgtagggacccattaacaagctcctatataattataagcagctctcacagtagggttgaaagagaatataaggaaaattagaagtactgtatttttgctattggaaatgaaatattgtttcatgcacctttgaaaaaaataacaggattttacagccttctgatgattcattcaaagcatggggaatagttcatatgtttgttaaatgaaaatcttatgtagctatttgtgtgtccctcccacttcataactacaaaaacatatatatgaatttctaaacaaagtgatattttaaagatgaattgattcaatgtgtacttaccagtttactgtgtggttttatcttcaggtacagatagtttgtggtactacttgaaaatacctttaatattattttcatcagaatttgtaatatataatccagtttgggatgatgaataaaatttttctaatctcttgaaaaaacttgta

SEQ ID NO: 299978 - DNA, 6304 bp, Homo sapiens
ggggtaaagcggagcggctgcagcctgctgttgagtgagaaaacaaaattatcttcctttccaaatccaaaaagatgaaaacgactgagatactttcaaaagacaaccaagtgagcagcacagactaatgagtagaatcaataagaacgtggttttggcccttttaacgctgacaagttctgcatttctgctgtttcagttgtactactacaagcactatttatcaacaaagaatggagctggtttgtcaaaatccaaaggaagccgaattggatttgatagcacacagtggcgtgcagttaaaaaatttattatgttaacatccaaccaaaatgtaccagtgtttcttattgatcctttgatactggaattgattaataagaactttgaacaagtcaaaaatacttctcatggctctacttcacaatgcaagtttttctgtgttccaagagactttactgcatttgcactgcagtatcacctatggaagaatgaggaaggctggtttcggatagctgagaatatgggatttcagtgcctaaagattgagagtaaagatccccggctagacgggatagactcactctctggaactgaaatccccctgcactatatctgcaaactggccactcatgcgatccacttggtagtctttcatgagaggagtggcaactacctctggcacggccacttgagacttaaagaacacattgacaggaaatttgttcccttccaaaagttacagtttggtcgttatccaggagcttttgacaggccagagttacagcaagttactgttgatggactggaagttctcattccaaaggatccaatgcactttgtagaagaagtaccacactctaggtttattgagtgtaggtataaagaagctcgagcattctttcagcagtaccttgatgataacactgtggaagctgtggcctttcggaagagtgcaaaggaattactgcaactagcagcgaaaacattaaacaaattgggagtaccattctggctgagcagtggaacttgtctaggatggtatcgacaatgcaacattattccttatagcaaagatgttgacctaggaatttttatacaagattacaaatctgatattattttagcatttcaggatgcaggacttccgctcaaacacaaatttgggaaggtagaagacagcttggaactatccttccagggaaaagatgatgtaaaacttgatgtttttttcttctatgaagaaactgatcacatgtggaatggaggcactcaggccaaaacaggaaaaaaattcaaatacctgtttccgaagtttacactgtgctggactgagtttgtagacatgaaggtccatgtaccctgtgaaaccctcgaatacattgaagccaactatggtaagacctggaagattcctgtaaagacgtgggactggaagcgctctcctcccaatgtgcaacccaatggaatctggcctatttctgagtgggatgaggttatccagttatattgagatagtaggttgaaatgggagaatttctcttttggaaaaaaaggtagataactgtttaaaaaatacatgtctatttgtcaaacataagtgggaaccaaagaaaaaatgtgacaagtttgaagacacagaaagagtcatctgatgtaattctctcacttagtactgaggaattttcatgtgccacatacaatgctaggttacagtggagaagccaagatgaatgagacaaatacctacttcttttattcctccttttggtaaacaactcaattttcctttgagggaaccctcccccaccctttgaagagttcaagttctgtacaggtttttaaaacgtgaagtaatgtttgaactggaagatgagctcaccaggcaaagctaaggaaggatatactagttgaaaagaataacccactcctcttctgggcatttaagctggtatgttagtgctacttttaagattgtggagtctgagttaatattcaagtgatcagactttgagtgacatcaagaaaagatgatatcaggttcatttttcaactaatcttatgtggaattgaattagagaacaaggcattattcttttagggaaggtgagagcttatttgtatcagagcttattacttgtcaggataagtaaatttctgtacatgtactgttttcatatgtgaagtgagaagaaactttatgcttgtttaatgcttaaatttccatccattgtgagaatattttcactgacctctgatggcacttgttgacaaatcattcaagtgagaccatgttactagacatgatcttgaaagaggccatgatttcacaaaactcatttttattttattctcagacagtctgttaggtaaaaatatgagaaattcatgtacattttatattttctgaatttataatctgtgcactcccaattttaatgacactaaaatattaatagaattttttaaatatactctaatttttaaaacatactctttattatcttcatttatcaattacagcttcgtatctctaatttatggtctatataccaatttaaatggcatgtaaacctgcctgtttcttctcctcttctaatatatcagatctccaaaatggaagctaaatggtggacttgacaactattcaccctacctcagatcatagagtttgtaaagtttgtgtccctccccagtttttcagtctgttgaatgtcgatggggcaagaactcagacttctactttaccaagtaccacacactctggaatgctttagtttccttttcccctcaagatgtctgagtcagctaggatgctgtttaccccatctctctcttatatcacttgaatgatatattgtaagtgagaggtaaaggaaaatgtaggcacaataagcactgctatttttctctttgtctaggaaaggaagctgaatcttatatcttatctatgctatttaggactactttctggagcttggcagattttcctctgacaccagagaacaatagtagtctcaagaatggaaacctgaatgtctgagggaatgggctggtagactttttcgaaaacaaattagagaaagtaacttacaaccacccattccggatttgtaaagcaacatgaaaacctttgataaatgataaccaacagtcttctgtcctaatttgcattctcaatgcagaattattgggtctttcataaacaacatgagtggtttctggagacatttaagattgtcagcaaacttgtcccaaaatggcacatcatcataatccattttctctttgctagaaaatcagcccatagagtgcattcccaaattctaaatagctgaccctaaattcatttttcatgcttaaaaataatagaacaaataataatactatttttgggcaaaatccaccctacttgatgaggaccatttgcttgtgctcagtatttagaaatgcatacactccacatttctccccatttccaattgggactcccattctttgccaggagatcttacccatcccttttcagattaatcttttatcctttcctgaagtacaaagtcttaagagtgtctgaaatccaagacatcttggcccaattgacacaggttctatattcttccctacatagaccactggctgctgaaatacttttcttgtcttctggtttcacaggcttcagctcatgggttccaccctaacttggggaaacaaaagccttctctagaatctgaaggccaggcttacctctgattctgattcatccatacttcatcttatgtattttaacagttgggttctgtggagtgtccagagaccttgggttaggtatatccatcttcagtacctcattggatcacttttctttcatcacttgagtattctagcagtcattctcctaatctgaccactttcaggtttagtttacctggcttacctggggaagttgacaacttgttggtagttaggcacccatgaatgtctccagagacatcctgagaggcaagattcctcttaattgataaccaggacaaccaggtagtcacccagtcctctctaagcagggagcacttgtccttctctcctctgctgcagctactgatatctggcccctggaataaaaccatagttcctaaaattgagcatccctaagagtagctgcttggtgggacagctgatttctttgattccctagctgcaaaacctgaaattgaccactaggtgacagaatgtttgccagtatccccacaaaacaagttaaaacttaagtgaaaatcattctgcttttgaatcttaaaagctagaaaaaccataatgtaatattctttttaaaccctcttattttataactaaataaataatcacagaaaagaatgatctgaacaagaacagctgaggctagtatctttaacagtgcttgagatgcttaacagagaaggcatccagtgcttcattgaggctaagtctcagggtgtttctgccgcttagtatctttttgttcagattgagaacctaaggcgacagagaggtcaaggggaagtattttctagttcagaattcagaattcttaggcaaccttcatacctttatctggaaaatgccttctctccagacaataagacagttcacatctggagacatcagcctttggtacctaattctctaagctcaagatgcatcccattgccactttaccattctatttcccaagggaaccatcagcaccaacctgctaaatgcctgtatttgaagtctctccccttcctgaagtgaccttttatgaggctctttccttcctaagggacctttccctggtagtagtggtctcattcacaaaaaagaataatagatgtaactggagtcactttgcagttttcaagattttttttttatctgcttggctggaaaggagactagagtatctagtttttagtatttaaactacttttaattatttatattgatactctctgataaatgcaggtagttaagaatagattgtactcattcctttttgagtttgtgacctcaaaccattgtttttattcttacacgactacagtacttcaaatggcacatagataggcaggatattacataggtaagcaggaatttatacattgggtaccagagctaaatctggaaaacacatttggaatgagcttccacacttcagtctaaaatctcacccaaacttatggctacatatttttctaagtttcccccctagtttcactttctggaaagtgaacagttttttaaatcctaaatgttataaatccttaggagaaatattccctcaaaacctagtcaagaaagtgccacattcccaccttctaacaggtaattattagttgtaatagctttaatgcatggaaaaacttcagttactgaccagtcaagagaatttctcaagaaaaatcccagcaacgttccctctttcctccttgtcttccactatcattaagacctgggctagatcacctctaacatctcactcagggaaggcaatgtgttgccataaaaagaccacaagcttttgagttaggcctgaatttgaatttcagcttaatcatgtgggatttatggtgggggccctttcagtctcaatttccacattagtgaactggggaaatgatacatacttctaagggtttttagggggattaaatgaagtatacagttcttagcctcaggcctaggattaagtaagtactcaagaaatgtgcaattttctagttccatgtttcttttctaatcttcaaatggaattatagaaaccatgggtcagaacatattcctttactcaaaagattgcatgactgaatttgcttaagaaaaaaaaaattgtatcaagtcattaatacaattatacattaattatattacattaatacaatatatggtttgtgaattcagagacattaccagtttgcctccttctctcaatagaacttgtattttcattttcttggttaagcagttgtctcctaatattatcccatatgctacctagtttgctggtcccaagcagtttactgtacttcactagatttggtacctgctctcccctgggttcaggtctcacctggcccagtcgcacctaacgtgttgtgcgttggtcgtagcggactcgggggtctgctgttcgaattcataagaacagggcaggttagaagtcgggtcttggtgcacacatatgttgtgtagagttcaggggagagtgcgtcatctgttgttcctaggaagattgtagtggtgagggtgtttattatcatcactgtttgtggttaggtctacctgg

SEQ ID NO: 299979 - DNA, 3564 bp, Homo sapiens
  misc_feature (928)..(928): n is a, c, g, or t
  misc_feature (1024)..(1024): n is a, c, g, or t
atcgagcttcagattgtttactatttaagatgtacttttacaaaggaacaaagaagggaaaaggtatttttgtttttgttgtttggtctgttatcatcaataacctgttcatatgccaattcagagaggtggactccaggttcaggagggagaagagcaaagccgcttcctctctgtgctttgaaacttcacaccctcacggtggcagctgtgtatggaccagtgccctccgcagacagctcacaaaaccagttgaggtgcactaaagggacatgaggtagaatggatgcttccatcacagtaccatcattcagaataactcttccaatttctgctttcagacatgctgcaggtcctcatctgaactgttgggttcgtttttttttttttttttcctgctccaagaaagtgacttcaaaaataactgatcaggatagattattttattttactttttaacactccttctccccttttcccactgaaccaaaaagaaatcccatccctaaaacctgccttctccttttatgcaaaactgaaaatggcaatacattattatagccataatggtatagatagtgattgcgtttggctatgtgttgttttctttttttttaaattatgaatatgtgtaaaatctgaggtaacttgctaacgtgaatggtcatataactttaaagatatatttataattatttaatgacatttggacccttgaaacatttcttagtgtattgatatgttgacttcggtctctaaaagtgctctttattaaataacaaatttcttcagtggtctagagccatatctgaaatattgctaagcaatttcagttcatccaggcacaatgtgattttaaaaatacttccatctccaatatttagatatagattgttttgtgatgtatgaggaatgtatgttagtcttncagatctttgaatgcctctaacacagctttgccttctaaagcggtaattagggatttaaaaaacaacctttagccctttatcagcatgaaatgctngagtgatgtggttttctaatttctttggggtaattatgactcttgtcatattaaaaagacaagcacaagtaaatcattgaactacagaaaaatgttctgtggtttcatagttaagcaaaactctaaatcgccaggcttcatagcaaagacatagtcagctaaaagccgcacatgtggatagagggttcaattatgagacacctagtacaggagagcaaaattgcaccagagattcttaaccaaccagccttaccaaacaacacaacaggggaaccccaatctgccttacccaaggccccactggcagctttccacagaatttgcatttagaggagcagaatgacatcactgtcctttgggagtaggtcctctgaaaaggcagcaggttccagcaggtagctgagctgagaggacatatggcccacggggacctacagacagcctttgacatttgtatttcttacaatggagggccaaggagggcaaggggctgtggagtttggtgtctactagtgtgtatgaatttgagctagagtccttctgtggcatgcactttgaccactcctggcagtcacatggcagatttccaagtgcaaatccttaatccaaacaaggatcatctaatgacaccaccaggccaatccctgctctcctccccgaaaagtcagggtcccttcattggaatcctccacccacccaagcagaatttagcagagatttgccttcaaaccctaacggcccccttgttctctggtccttctcaaacccacctttgtaggccacccagcattgcaggacagcgtgtggggcagctggacctgtgcttcctgcctgggagtctcccttggaattcatcctgactccttctaataaaaatggatgggaaagcaaaacactttgccttctaaaggccgtataccaagtatgcttagataaataagccacttttctattacttaagtaagaaggaagtagtaattgatactatttattgtttgtgtgtggtagcttgaagcacaccactgtccatttatttgtaagtgtaaaatatgtgtgtttgtttcagcagcacttaaaaaagccagtgtctggttacacatttcaattttaattaattgacataaaaatgctaccgccagtgccagctgcatcctatttaattaaaaaggtactatatttgtacattattttttaatgttaaaagggcttttttaagtttacagtacacataccgagtgactttagggatgcttttgtgttgaaatgttactatagtggctgcaggcagcaacccagaaacactttagaagctttttttccttgggaaaaattcaagcacttcttccctccaccctcactccaaccaccccaatgggggtaattcacatttcttagaacaaattctgcccttttttggtctagggattaaaattttgtttttctttctttctttttttttttttttcactgaacccttaatttgcactgggtcatgtgtttgatttgtgatttcaagaccaaagcaaagtcttactactactgtggaaccatgtactagttcctgggaattaaaatagcgtggttctctttgtagcacaaacattgctggaatttgcagtcttttcaatgcagccacatttttatccatttcagttgtctcacaaattttaacccatatcagagttccagaacaggtaccacagctttggttttagattagtggaataacattcagcccagaactgagaaactcaacagattaactatcgtttgctctttagacggtctcactgcctctcacttgccagagccctttcaaaatgagcagagaagtccacaccattagggaccatctgtgataaattcagaagggaggagatgtgtgtacagctttaaggattccctcaattccgaggaaagggactggcccagaatccaggttaatacatggaaacacgaagcattagcaaaagtaataattatacctatggtatttgaaagaacaataataaaagacacttcttccaaaccttgaatttgttgtttttagaaaacgaatgcatttaaaaatattttctatgtgagaattttttagatgtgtgtttacttcatgtttacaaataactgtttgctttttaatgcagtactttgaaatatatcagccaaaaccataacttacaataatttcttaggtattctgaataaaattccatttcttttggatatgctttaccattcttaggtttctgtggaacaaaaatatttgtagcattttgtgtaaatacaagctttcatttttattttttccaattgctattgcccaagaattgctttccatgcacatattgtaaaaattccgctttgtgccacaggtcatgattgtggatgagtttactcttaacttcaaagggactatttgtattgtatgttgcaactgtaaattgaattatttggcatttttctcatgattgtaatattaatttgaagtttgaatttaattttcaataaaatggcttttttggttttgttatgtgtgtacc

SEQ ID NO: 299980 - DNA, 2887 bp, Homo sapiens
ttccggtctgtacaaagatggctgccacattggcgctgtcattttggtactgagcagagcgacgggcttaattcgacccaatccaggccagagtctttctctcaggggcttcctcgtgctcagctaatcctccgatcaatccttgggaatccctgggacctcttcggtatccctactctcagccagggatcatgtcttgggccgctcgcccgcccttcctccctcagcggcatgccgcagggcagtgtgggccggtgggggtgcgaaaagaaatgcattgtggggtcgcgtcccggtggcggcggcgacggccctggctggatcccgcagcggcggcggcggcggcggtggcaggcggagaacaacaaaccccggagccggagccaggggaggctggacgggacgggatgggcgacagcgggcgggactcccgaagcccagacagctcctccccaaatccccttccccagggagtccctcccccttctcctcctgggccacccctacccccttcaacagctccatcccttggaggctctggggccccacccccacccccgatgccaccacccccactgggctctccctttccagtcatcagttcttccatggggtcccctggtctgccccctccagctcccccaggattctccgggcctgtcagcagcccccagattaactcaacagtgtcactccctgggggtgggtctggcccccctgaagatgtgaagccaccagtcttaggggtccggggcctgcactgtccaccccctccaggtggccctggggctggcaaacggctatgtgcaatctgcggggacagaagctcaggcaaacactacggggtttacagctgtgagggttgcaagggcttcttcaaacgcaccatccgcaaagaccttacatactcttgccgggacaacaaagactgcacagtggacaagcgccagcggaaccgctgtcagtactgccgctatcagaagtgcctggccactggcatgaagagggaggcggtacaggaggagcgtcagcggggaaaggacaaggatggggatggggagggggctgggggagcccccgaggagatgcctgtggacaggatcctggaggcagagcttgctgtggaacagaagagtgaccagggcgttgagggtcctgggggaaccgggggtagcggcagcagcccaaatgaccctgtgactaacatctgtcaggcagctgacaaacagctattcacgcttgttgagtgggcgaagaggatcccacacttttcctccttgcctctggatgatcaggtcatattgctgcgggcaggctggaatgaactcctcattgcctccttttcacaccgatccattgatgttcgagatggcatcctccttgccacaggtcttcacgtgcaccgcaactcagcccattcagcaggagtaggagccatctttgatcgggtgctgacagagctagtgtccaaaatgcgtgacatgaggatggacaagacagagcttggctgcctgagggcaatcattctgtttaatccagatgccaagggcctctccaaccctagtgaggtggaggtcctgcgggagaaagtgtatgcatcactggagacctactgcaaacagaagtaccctgagcagcagggacggtttgccaagctgctgctacgtcttcctgccctccggtccattggccttaagtgtctagagcatctgtttttcttcaagctcattggtgacacccccatcgacaccttcctcatggagatgcttgaggctccccatcaactggcctgagctcagacccagacgtggtgcttctcacactggaggagcacacatccaagagggactccaagccctggggcagggtggggggccatgttcccagaaccttgatggggtgagaagtacagggcagaaccaagaacataaaccctccaagggatctgcttgatatcccaagttggaagggaccccagatacctgtgaggactggttgtctctcttcggtggccttgagtctctgaatttgtcgggttctcccatgatttggggtgatttctcaccctctgtccttcccccagcacaaagcactggccttgcctccaggaccttgcttccttctcatcttgcctcattttgcttcccatctgaagagtggaaatggggaactcccccagaggtggatactggggggcaggcctcccaagctgatggacatgagagtagggccctgacaggccttcctcctctcaaacctggcagatgggggcctctctggaagagggaggggccctgtcactgtccagagtctctttttacacttcacctccttctgcagtcagactgaaatataaaaaaggtggtggtggtggtgaaggggctggtggagatgtaggaaccgatctgctatttttaatttcctgtgaggatagagacttgcagttagactcaaagaagtactgtactttcccaggttgactaagaaatgccagtggtggaggtgggtgtttgggaaaggcagggccctgaaatggcctgtccctagggctctccaagcactagccttcccagcttcccgccgccccccccatctcttcctgtctaacttggggaaggggcctgggctgtgaggacagggcccccacaggggatggtttcacgagtgtagtcccggaggccttccctttacagctctcctccagccctgggcacatagcataggctggggacacaggatcctggcctgagaattgaggggaggtggccagcccgcagaggtggggtgctggggctgcatgatttttgccctgcgtcccttctctttggggctcctttcccctctcatacataaaatcgctttcaaattaaaatcgctgttttctgga

SEQ ID NO: 299981 - DNA, 3232 bp, Homo sapiens
ttccggtctgtacaaagatggctgccacattggcgctgtcattttggtactgagcagagcgacgggcttaattcgacccaatccaggccagagtctttctctcaggggcttcctcgtgctcagctaatcctccgatcaatccttgggaatccctgggacctcttcggtatccctactctcagccagggatcatgtcttgggccgctcgcccgcccttcctccctcagcggcatgccgcagggcagtgtgggccggtgggggtgcgaaaagaaatgcattgtggggtcgcgtcccggtggcggcggcgacggccctggctggatcccgcagcggcggcggcggcggcggtggcaggcggagaacaacaaaccccggagccggagccaggggaggctggacgggacgggatgggcgacagcgggcgggactcccgaagcccagacagctcctccccaaatccccttccccagggagtccctcccccttctcctcctgggccacccctacccccttcaacagctccatcccttggaggctctggggccccacccccacccccgatgccaccacccccactgggctctccctttccagtcatcagttcttccatggggtcccctggtctgccccctccagctcccccaggattctccgggcctgtcagcagcccccagattaactcaacagtgtcactccctgggggtgggtctggcccccctgaagatgtgaagccaccagtcttaggggtccggggcctgcactgtccaccccctccaggtggccctggggctggcaaacggctatgtgcaatctgcggggacagaagctcaggcaaacactacggggtttacagctgtgagggttgcaagggcttcttcaaacgcaccatccgcaaagaccttacatactcttgccgggacaacaaagactgcacagtggacaagcgccagcggaaccgctgtcagtactgccgctatcagaagtgcctggccactggcatgaagagggaggcggtacaggaggagcgtcagcggggaaaggacaaggatggggatggggagggggctgggggagcccccgaggagatgcctgtggacaggatcctggaggcagagcttgctgtggaacagaagagtgaccagggcgttgagggtcctgggggaaccgggggtagcggcagcagcccaaatgaccctgtgactaacatctgtcaggcagctgacaaacagctattcacgcttgttgagtgggcgaagaggatcccacacttttcctccttgcctctggatgatcaggtcatattgctgcgggcaggctggaatgaactcctcattgcctccttttcacaccgatccattgatgttcgagatggcatcctccttgccacaggtcttcacgtgcaccgcaactcagcccattcagcaggagtaggagccatctttgatcgggtgctgacagagctagtgtccaaaatgcgtgacatgaggatggacaagacagagcttggctgcctgagggcaatcattctgtttaatccagatgccaagggcctctccaaccctagtgaggtggaggtcctgcgggagaaagtgtatgcatcactggagacctactgcaaacagaagtaccctgagcagcagggacggtttgccaagctgctgctacgtcttcctgccctccggtccattggccttaagtgtctagagcatctgtttttcttcaagctcattggtgacacccccatcgacaccttcctcatggagatgcttgaggctccccatcaactggcctgagctcagacccagacgtggtgcttctcacactggaggagcacacatccaagagggactccaagccctggggcagggtggggggccatgttcccagaaccttgatggggtgagaagtacagggcagaaccaagaacataaaccctccaagggatctgcttgatatcccaagttggaagggaccccagatacctgtgaggactggttgtctctcttcggtggccttgagtctctgaatttgtcgggttctcccatgatttggggtgatttctcaccctctgtccttcccccagcacaaagcactggccttgcctccaggaccttgcttccttctcatcttgcctcattttgcttcccatctgaagagtggaaatggggaactcccccagaggtggatactggggggcaggcctcccaagctgatggacatgagagtagggccctgacaggccttcctcctctcaaacctggcagatgggggcctctctggaagagggaggggccctgtcactgtccagagtctctttttacacttcacctccttctgcagtcagactgaaatataaaaaaggtggtggtggtggtgaaggggctggtggagatgtaggaaccgatctgctatttttaatttcctgtgaggatagagacttgcagttagactcaaagaagtactgtactttcccaggttgactaagaaatgccagtggtggaggtgggtgtttgggaaaggcagggccctgaaatggcctgtccctagggctctccaagcactagccttcccagcttcccgccgccccccccatctcttcctgtctaacttggggaaggggcctgggctgtgaggacagggcccccacaggggatggtttcacgagtgtagtcccggaggccttccctttacagctctcctccagccctgggcacatagcataggctggggacacaggatcctggcctgagaattgaggggaggtggccagcccgcagaggtggggtgctggggctgcatgatttttgccctgcgtcccttctctttggggctcctttcccctctcatacataaaatcgctttcaaattaaaatcgctgttttctggaaataaaaaaaaaaaaaaaaaaaaaaaaaaaaaaaaaaaaaaaaaaaaaaaaaaaacaaaaaaaaaaaaaaaaagagagaggggggcgcgcgccgcaaaagaacgtcccccgcgggggacccacaatcacgaggagcgcacccgagcgtcttggggaccaaaggggggcccccagagagggggagagcactattataagaaagaggaggggcgggggccgcgggggtaacaaccaccggcgggggcggggggaaaacaggcgcgcccggggggagcacaccggggggaaggaggagccaccaccggcggggcggggcaacaaggagggcgggaacacgccaccgac

SEQ ID NO: 299982 - DNA, 3225 bp, Homo sapiens
ttccggtctgtacaaagatggctgccacattggcgctgtcattttggtactgagcagagcgacgggcttaattcgacccaatccaggccagagtctttctctcaggggcttcctcgtgctcagctaatcctccgatcaatccttgggaatccctgggacctcttcggtatccctactctcagccagggatcatgtcttgggccgctcgcccgcccttcctccctcagcggcatgccgcagggcagtgtgggccggtgggggtgcgaaaagaaatgcattgtggggtcgcgtcccggtggcggcggcgacggccctggctggatcccgcagcggcggcggcggcggcggtggcaggcggagaacaacaaaccccggagccggagccaggggaggctggacgggacgggatgggcgacagcgggcgggactcccgaagcccagacagctcctccccaaatccccttccccagggagtccctcccccttctcctcctgggccacccctacccccttcaacagctccatcccttggaggctctggggccccacccccacccccgatgccaccacccccactgggctctccctttccagtcatcagttcttccatggggtcccctggtctgccccctccagctcccccaggattctccgggcctgtcagcagcccccagattaactcaacagtgtcactccctgggggtgggtctggcccccctgaagatgtgaagccaccagtcttaggggtccggggcctgcactgtccaccccctccaggtggccctggggctggcaaacggctatgtgcaatctgcggggacagaagctcaggcaaacactacggggtttacagctgtgagggttgcaagggcttcttcaaacgcaccatccgcaaagaccttacatactcttgccgggacaacaaagactgcacagtggacaagcgccagcggaaccgctgtcagtactgccgctatcagaagtgcctggccactggcatgaagagggaggcggtacaggaggagcgtcagcggggaaaggacaaggatggggatggggagggggctgggggagcccccgaggagatgcctgtggacaggatcctggaggcagagcttgctgtggaacagaagagtgaccagggcgttgagggtcctgggggaaccgggggtagcggcagcagcccaaatgaccctgtgactaacatctgtcaggcagctgacaaacagctattcacgcttgttgagtgggcgaagaggatcccacacttttcctccttgcctctggatgatcaggtcatattgctgcgggcaggctggaatgaactcctcattgcctccttttcacaccgatccattgatgttcgagatggcatcctccttgccacaggtcttcacgtgcaccgcaactcagcccattcagcaggagtaggagccatctttgatcgggtgctgacagagctagtgtccaaaatgcgtgacatgaggatggacaagacagagcttggctgcctgagggcaatcattctgtttaatccagatgccaagggcctctccaaccctagtgaggtggaggtcctgcgggagaaagtgtatgcatcactggagacctactgcaaacagaagtaccctgagcagcagggacggtttgccaagctgctgctacgtcttcctgccctccggtccattggccttaagtgtctagagcatctgtttttcttcaagctcattggtgacacccccatcgacaccttcctcatggagatgcttgaggctccccatcaactggcctgagctcagacccagacgtggtgcttctcacactggaggagcacacatccaagagggactccaagccctggggcagggtggggggccatgttcccagaaccttgatggggtgagaagtacagggcagaaccaagaacataaaccctccaagggatctgcttgatatcccaagttggaagggaccccagatacctgtgaggactggttgtctctcttcggtggccttgagtctctgaatttgtcgggttctcccatgatttggggtgatttctcaccctctgtccttcccccagcacaaagcactggccttgcctccaggaccttgcttccttctcatcttgcctcattttgcttcccatctgaagagtggaaatggggaactcccccagaggtggatactggggggcaggcctcccaagctgatggacatgagagtagggccctgacaggccttcctcctctcaaacctggcagatgggggcctctctggaagagggaggggccctgtcactgtccagagtctctttttacacttcacctccttctgcagtcagactgaaatataaaaaaggtggtggtggtggtgaaggggctggtggagatgtaggaaccgatctgctatttttaatttcctgtgaggatagagacttgcagttagactcaaagaagtactgtactttcccaggttgactaagaaatgccagtggtggaggtgggtgtttgggaaaggcagggccctgaaatggcctgtccctagggctctccaagcactagccttcccagcttcccgccgccccccccatctcttcctgtctaacttggggaaggggcctgggctgtgaggacagggcccccacaggggatggtttcacgagtgtagtcccggaggccttccctttacagctctcctccagccctgggcacatagcataggctggggacacaggatcctggcctgagaattgaggggaggtggccagcccgcagaggtggggtgctggggctgcatgatttttgccctgcgtcccttctctttggggctcctttcccctctcatacataaaatcgctttcaaattaaaatcgctgttttctggaaataaaaaaaaaaaaaaaaaaaaaaaaaaaaaaaaaaaaaaaaaaaaaaaaaaaaaaggggggggggcccaaaaaaaaaccccccggggggggacccaacagttagtcgggcatccaccacacttcttttttcgtccaacagggggcgccccccaatatgggaggggcagcgataataataacacagaggaggacagaggggcgccggatgcattaaaaaaacgcggcagagaagcgacgaaaaacactggtactgccgcagggggaacatcgtggaaggagagaaccccttatcatgggggggagggggcacaattgtgttggcacccaccctcaga

SEQ ID NO: 299983 - DNA, 2869 bp, Homo sapiens
ttccggtctgtacaaagatggctgccacattggcgctgtcattttggtactgagcagagcgacgggcttaattcgacccaatccaggccagagtctttctctcaggggcttcctcgtgctcagctaatcctccgatcaatccttgggaatccctgggacctcttcggtatccctactctcagccagggatcatgtcttgggccgctcgcccgcccttcctccctcagcggcatgccgcagggcagtgtgggccggtgggggtgcgaaaagaaatgcattgtggggtcgcgtcccggtggcggcggcgacggccctggctggatcccgcagcggcggcggcggcggcggtggcaggcggagaacaacaaaccccggagccggagccaggggaggctggacgggacgggatgggcgacagcgggcgggactcccgaagcccagacagctcctccccaaatccccttccccagggagtccctcccccttctcctcctgggccacccctacccccttcaacagctccatcccttggaggctctggggccccacccccacccccgatgccaccacccccactgggctctccctttccagtcatcagttcttccatggggtcccctggtctgccccctccagctcccccaggattctccgggcctgtcagcagcccccagattaactcaacagtgtcactccctgggggtgggtctggcccccctgaagatgtgaagccaccagtcttaggggtccggggcctgcactgtccaccccctccaggtggccctggggctggcaaacggctatgtgcaatctgcggggacagaagctcaggcaaacactacggggtttacagctgtgagggttgcaagggcttcttcaaacgcaccatccgcaaagaccttacatactcttgccgggacaacaaagactgcacagtggacaagcgccagcggaaccgctgtcagtactgccgctatcagaagtgcctggccactggcatgaagagggaggcggtacaggaggagcgtcagcggggaaaggacaaggatggggatggggagggggctgggggagcccccgaggagatgcctgtggacaggatcctggaggcagagcttgctgtggaacagaagagtgaccagggcgttgagggtcctgggggaaccgggggtagcggcagcagcccaaatgaccctgtgactaacatctgtcaggcagctgacaaacagctattcacgcttgttgagtgggcgaagaggatcccacacttttcctccttgcctctggatgatcaggtcatattgctgcgggcaggctggaatgaactcctcattgcctccttttcacaccgatccattgatgttcgagatggcatcctccttgccacaggtcttcacgtgcaccgcaactcagcccattcagcaggagtaggagccatctttgatcgggtgctgacagagctagtgtccaaaatgcgtgacatgaggatggacaagacagagcttggctgcctgagggcaatcattctgtttaatccagatgccaagggcctctccaaccctagtgaggtggaggtcctgcgggagaaagtgtatgcatcactggagacctactgcaaacagaagtaccctgagcagcagggacggtttgccaagctgctgctacgtcttcctgccctccggtccattggccttaagtgtctagagcatctgtttttcttcaagctcattggtgacacccccatcgacaccttcctcatggagatgcttgaggctccccatcaactggcctgagctcagacccagacgtggtgcttctcacactggaggagcacacatccaagagggactccaagccctggggcagggtggggggccatgttcccagaaccttgatggggtgagaagtacagggcagaaccaagaacataaaccctccaagggatctgcttgatatcccaagttggaagggaccccagatacctgtgaggactggttgtctctcttcggtggccttgagtctctgaatttgtcgggttctcccatgatttggggtgatttctcaccacaaagcactggccttgcctccaggaccttgcttccttctcatcttgcctcattttgcttcccatctgaagagtggaaatggggaactcccccagaggtggatactggggggcaggcctcccaagctgatggacatgagagtagggccctgacaggccttcctcctctcaaacctggcagatgggggcctctctggaagagggaggggccctgtcactgtccagagtctctttttacacttcacctccttctgcagtcagactgaaatataaaaaaggtggtggtggtggtgaaggggctggtggagatgtaggaaccgatctgctatttttaatttcctgtgaggatagagacttgcagttagactcaaagaagtactgtactttcccaggttgactaagaaatgccagtggtggaggtgggtgtttgggaaaggcagggccctgaaatggcctgtccctagggctctccaagcactagccttcccagcttcccgccgccccccccatctcttcctgtctaacttggggaaggggcctgggctgtgaggacagggcccccacaggggatggtttcacgagtgtagtcccggaggccttccctttacagctctcctccagccctgggcacatagcataggctggggacacaggatcctggcctgagaattgaggggaggtggccagcccgcagaggtggggtgctggggctgcatgatttttgccctgcgtcccttctctttggggctcctttcccctctcatacataaaatcgctttcaaattaaaatcgctgttttctgga

SEQ ID NO: 299984 - DNA, 2789 bp, Homo sapiens
ttccggtctgtacaaagatggctgccacattggcgctgtcattttggtactgagcagagcgacgggcttaattcgacccaatccaggccagagtctttctctcaggggcttcctcgtgctcagctaatcctccgatcaatccttgggaatccctgggacctcttcggtatccctactctcagccagggatcatgtcttgggccgctcgcccgcccttcctccctcagcggcatgccgcagggcagtgtgggccggtgggggtgcgaaaagaaatgcattgtggggtcgcgtcccggtggcggcggcgacggccctggctggatcccgcagcggcggcggcggcggcggtggcaggcggagaacaacaaaccccggagccggagccaggggaggctggacgggacgggatgggcgacagcgggcgggactcccgaagcccagacagctcctccccaaatccccttccccagggagtccctcccccttctcctcctgggccacccctacccccttcaacagctccatcccttggaggctctggggccccacccccacccccgatgccaccacccccactgggctctccctttccagtcatcagttcttccatggggtcccctggtctgccccctccagctcccccaggattctccgggcctgtcagcagcccccagattaactcaacagtgtcactccctgggggtgggtctggcccccctgaagatgtgaagccaccagtcttaggggtccggggcctgcactgtccaccccctccaggtggccctggggctggcaaacggctatgtgcaatctgcggggacagaagctcaggcaaacactacggggtttacagctgtgagggttgcaagggcttcttcaaacgcaccatccgcaaagaccttacatactcttgccgggacaacaaagactgcacagtggacaagcgccagcggaaccgctgtcagtactgccgctatcagaagtgcctggccactggcatgaagagggaggcggtacaggaggagcgtcagcggggaaaggacaaggatggggatggggagggggctgggggagcccccgaggagatgcctgtggacaggatcctggaggcagagcttgctgtggaacagaagagtgaccagggcgttgagggtcctgggggaaccgggggtagcggcagcagcccaaatgaccctgtgactaacatctgtcaggcagctgacaaacagctattcacgcttgttgagtgggcgaagaggatcccacacttttcctccttgcctctggatgatcaggtcatattgctgcgggcaggctggaatgaactcctcattgcctccttttcacaccgatccattgatgttcgagatggcatcctccttgccacaggtcttcacgtgcaccgcaactcagcccattcagcaggagtaggagccatctttgatcgggtgctgacagagctagtgtccaaaatgcgtgacatgaggatggacaagacagagcttggctgcctgagggcaatcattctgtttaatccagatgccaagggcctctccaaccctagtgaggtggaggtcctgcgggagaaagtgtatgcatcactggagacctactgcaaacagaagtaccctgagcagcagggacggtttgccaagctgctgctacgtcttcctgccctccggtccattggccttaagtgtctagagcatctgtttttcttcaagctcattggtgacacccccatcgacaccttcctcatggagatgcttgaggctccccatcaactggcctgagctcagacccagacgtggtgcttctcacactggaggagcacacatccaagagggactccaagccctggggcagggtggggggccatgttcccagaaccttgatggggtgagaagtacagggcagaaccaagaacataaaccctccaagggatctgcttgatatcccaagttggaagggaccccagatacctgtgaggactggttgtctctcttcggtggccttgagtctctgaatttgtcgggttctcccatgatttggggtgatttctcaccctctgtccttcccccagcacaaagcactggccttgcctccaggaccttgcttccttctcatcttgcctcattttgcttcccatctgaagagtggaaatggggaactcccccagaggtggatactggggggcaggcctcccaagctgatggacatgagagtagggccctgacaggccttcctcctctcaaacctggcagatgggggcctctctggaagagggaggggccctgtcactgtccagagtctctttttacacttcacctccttctgcagtcagactgaaatataaaaaaggtggtggtggtggtgaaggggctggtggagatgtaggaaccgatctgctatttttaatttcctgtgaggatagagacttgcagttagactcaaagaagtactgtactttcccaggttgactaagaaatgccagtggtggaggtgggtgtttgggaaaggcagggccctgaaatggcctgtccctagggctctccaagcactagccttcccagcttcccgccgccccccccatctcttcctgtctaacttggggaaggggcctgggctgtgaggacagggcccccacaggggatggtttcacgagtgtagtcccggaggccttccctttacagctctcctccagccctgggcacatagcataggctggggacacaggatcctggcctgagaattgaggggaggtggcttgggaaataaaaaatacatat

SEQ ID NO: 299985 - DNA, 2639 bp, Homo sapiens
ttccggtctgtacaaagatggctgccacattggcgctgtcattttggtactgagcagagcgacgggcttaattcgacccaatccaggccagagtctttctctcaggggcttcctcgtgctcagctaatcctccgatcaatccttgggaatccctgggacctcttcggtatccctactctcagccagggatcatgtcttgggccgctcgcccgcccttcctccctcagcggcatgccgcagggcagtgtgggccggtgggggtgcgaaaagaaatgcattgtggggtcgcgtcccggtggcggcggcgacggccctggctggatcccgcagcggcggcggcggcggcggtggcaggcggagaacaacaaaccccggagccggagccaggggaggctggacgggacgggatgggcgacagcgggcgggattaactcaacagtgtcactccctgggggtgggtctggcccccctgaagatgtgaagccaccagtcttaggggtccggggcctgcactgtccaccccctccaggtggccctggggctggcaaacggctatgtgcaatctgcggggacagaagctcaggcaaacactacggggtttacagctgtgagggttgcaagggcttcttcaaacgcaccatccgcaaagaccttacatactcttgccgggacaacaaagactgcacagtggacaagcgccagcggaaccgctgtcagtactgccgctatcagaagtgcctggccactggcatgaagagggaggcggtacaggaggagcgtcagcggggaaaggacaaggatggggatggggagggggctgggggagcccccgaggagatgcctgtggacaggatcctggaggcagagcttgctgtggaacagaagagtgaccagggcgttgagggtcctgggggaaccgggggtagcggcagcagcccaaatgaccctgtgactaacatctgtcaggcagctgacaaacagctattcacgcttgttgagtgggcgaagaggatcccacacttttcctccttgcctctggatgatcaggtcatattgctgcgggcaggctggaatgaactcctcattgcctccttttcacaccgatccattgatgttcgagatggcatcctccttgccacaggtcttcacgtgcaccgcaactcagcccattcagcaggagtaggagccatctttgatcgggtgctgacagagctagtgtccaaaatgcgtgacatgaggatggacaagacagagcttggctgcctgagggcaatcattctgtttaatccagatgccaagggcctctccaaccctagtgaggtggaggtcctgcgggagaaagtgtatgcatcactggagacctactgcaaacagaagtaccctgagcagcagggacggtttgccaagctgctgctacgtcttcctgccctccggtccattggccttaagtgtctagagcatctgtttttcttcaagctcattggtgacacccccatcgacaccttcctcatggagatgcttgaggctccccatcaactggcctgagctcagacccagacgtggtgcttctcacactggaggagcacacatccaagagggactccaagccctggggcagggtggggggccatgttcccagaaccttgatggggtgagaagtacagggcagaaccaagaacataaaccctccaagggatctgcttgatatcccaagttggaagggaccccagatacctgtgaggactggttgtctctcttcggtggccttgagtctctgaatttgtcgggttctcccatgatttggggtgatttctcaccctctgtccttcccccagcacaaagcactggccttgcctccaggaccttgcttccttctcatcttgcctcattttgcttcccatctgaagagtggaaatggggaactcccccagaggtggatactggggggcaggcctcccaagctgatggacatgagagtagggccctgacaggccttcctcctctcaaacctggcagatgggggcctctctggaagagggaggggccctgtcactgtccagagtctctttttacacttcacctccttctgcagtcagactgaaatataaaaaaggtggtggtggtggtgaaggggctggtggagatgtaggaaccgatctgctatttttaatttcctgtgaggatagagacttgcagttagactcaaagaagtactgtactttcccaggttgactaagaaatgccagtggtggaggtgggtgtttgggaaaggcagggccctgaaatggcctgtccctagggctctccaagcactagccttcccagcttcccgccgccccccccatctcttcctgtctaacttggggaaggggcctgggctgtgaggacagggcccccacaggggatggtttcacgagtgtagtcccggaggccttccctttacagctctcctccagccctgggcacatagcataggctggggacacaggatcctggcctgagaattgaggggaggtggccagcccgcagaggtggggtgctggggctgcatgatttttgccctgcgtcccttctctttggggctcctttcccctctcatacataaaatcgctttcaaattaaaatcgctgttttctgga

SEQ ID NO: 299986 - DNA, 2386 bp, Homo sapiens
ctttggggttgtgctccagggatggcctttcacatagactgcagtgtaaatgacagcctctggaatgtgcattgcagggccttgcttagtggtagggaatgatttccatcacttctgtgacattctgcttcccaataagtcttcctgtgacttccctatttcccccatcccagattaactcaacagtgtcactccctgggggtgggtctggcccccctgaagatgtgaagccaccagtcttaggggtccggggcctgcactgtccaccccctccaggtggccctggggctggcaaacggctatgtgcaatctgcggggacagaagctcaggcaaacactacggggtttacagctgtgagggttgcaagggcttcttcaaacgcaccatccgcaaagaccttacatactcttgccgggacaacaaagactgcacagtggacaagcgccagcggaaccgctgtcagtactgccgctatcagaagtgcctggccactggcatgaagagggaggcggtacaggaggagcgtcagcggggaaaggacaaggatggggatggggagggggctgggggagcccccgaggagatgcctgtggacaggatcctggaggcagagcttgctgtggaacagaagagtgaccagggcgttgagggtcctgggggaaccgggggtagcggcagcagcccaaatgaccctgtgactaacatctgtcaggcagctgacaaacagctattcacgcttgttgagtgggcgaagaggatcccacacttttcctccttgcctctggatgatcaggtcatattgctgcgggcaggctggaatgaactcctcattgcctccttttcacaccgatccattgatgttcgagatggcatcctccttgccacaggtcttcacgtgcaccgcaactcagcccattcagcaggagtaggagccatctttgatcgggtgctgacagagctagtgtccaaaatgcgtgacatgaggatggacaagacagagcttggctgcctgagggcaatcattctgtttaatccagatgccaagggcctctccaaccctagtgaggtggaggtcctgcgggagaaagtgtatgcatcactggagacctactgcaaacagaagtaccctgagcagcagggacggtttgccaagctgctgctacgtcttcctgccctccggtccattggccttaagtgtctagagcatctgtttttcttcaagctcattggtgacacccccatcgacaccttcctcatggagatgcttgaggctccccatcaactggcctgagctcagacccagacgtggtgcttctcacactggaggagcacacatccaagagggactccaagccctggggcagggtggggggccatgttcccagaaccttgatggggtgagaagtacagggcagaaccaagaacataaaccctccaagggatctgcttgatatcccaagttggaagggaccccagatacctgtgaggactggttgtctctcttcggtggccttgagtctctgaatttgtcgggttctcccatgatttggggtgatttctcaccctctgtccttcccccagcacaaagcactggccttgcctccaggaccttgcttccttctcatcttgcctcattttgcttcccatctgaagagtggaaatggggaactcccccagaggtggatactggggggcaggcctcccaagctgatggacatgagagtagggccctgacaggccttcctcctctcaaacctggcagatgggggcctctctggaagagggaggggccctgtcactgtccagagtctctttttacacttcacctccttctgcagtcagactgaaatataaaaaaggtggtggtggtggtgaaggggctggtggagatgtaggaaccgatctgctatttttaatttcctgtgaggatagagacttgcagttagactcaaagaagtactgtactttcccaggttgactaagaaatgccagtggtggaggtgggtgtttgggaaaggcagggccctgaaatggcctgtccctagggctctccaagcactagccttcccagcttcccgccgccccccccatctcttcctgtctaacttggggaaggggcctgggctgtgaggacagggcccccacaggggatggtttcacgagtgtagtcccggaggccttccctttacagctctcctccagccctgggcacatagcataggctggggacacaggatcctggcctgagaattgaggggaggtggccagcccgcagaggtggggtgctggggctgcatgatttttgccctgcgtcccttctctttggggctcctttcccctctcatacataaaatcgctttcaaattaaaatcgctgttttctgga

SEQ ID NO: 299987 - DNA, 2749 bp, Homo sapiens
ttccggtctgtacaaagatggctgccacattggcgctgtcattttggtactgagcagagcgacgggcttaattcgacccaatccaggccagagtctttctctcaggggcttcctcgtgctcagctaatcctccgatcaatccttgggaatccctgggacctcttcggtatccctactctcagccagggatcatgtcttgggccgctcgcccgcccttcctccctcagcggcatgccgcagggcagtgtgggccggtgggggtgcgaaaagaaatgcattgtggggtcgcgtcccggtggcggcggcgacggccctggctggatcccgcagcggcggcggcggcggcggtggcaggcggagaacaacaaaccccggagccggagccaggggaggctggacgggacgggatgggcgacagcgggcgggactcccgaagcccagacagctcctccccaaatccccttccccagggagtccctcccccttctcctcctgggccacccctacccccttcaacagctccatcccttggaggctctggggccccacccccacccccgatgccaccacccccactgggctctccctttccagtcatcagttcttccatggggtcccctggtctgccccctccagctcccccaggattctccgggcctgtcagcagcccccagattaactcaacagtgtcactccctgggggtgggtctggcccccctgaagatgtgaagccaccagtcttaggggtccggggcctgcactgtccaccccctccaggtggccctggggctggcaaacggctatgtgcaatctgcggggacagaagctcaggcaaacactacggggtttacagctgtgagggttgcaagggcttcttcaaacgcaccatccgcaaagaccttacatactcttgccgggacaacaaagactgcacagtggacaagcgccagcggaaccgctgtcagtactgccgctatcagaagtgcctggccactggcatgaagagggaggcggtacaggaggagcgtcagcggggaaaggacaaggatggggatggggagggggctgggggagcccccgaggagatgcctgtggacaggatcctggaggcagagcttgctgtggaacagaagagtgaccagggcgttgagggtcctgggggaaccgggggtagcggcagcagcccaaatgaccctgtgactaacatctgtcaggcagctgacaaacagctattcacgcttgttgagtgggcgaagaggatcccacacttttcctccttgcctctggatgatcaggtcatattgctgcgggcaggctggaatgaactcctcattgcctccttttcacaccgatccattgatgttcgagatggcatcctccttgccacaggtcttcacgtgcaccgcaactcagcccattcagcaggagtaggagccatctttgatcgggtgctgacagagctagtgtccaaaatgcgtgacatgaggatggacaagacagagcttggctgcctgagggcaatcattctgtttaatccagatgccaagggcctctccaaccctagtgaggtggaggtcctgcgggagaaagtgtatgcatcactggagacctactgcaaacagaagtaccctgagcagcagggacggtttgccaagctgctgctacgtcttcctgccctccggtccattggccttaagtgtctagagcatctgtttttcttcaagctcattggtgacacccccatcgacaccttcctcatggagatgcttgaggctccccatcaactggcctgagctcagacccagacgtggtgcttctcacactggaggagcacacatccaagagggactccaagccctggggcagggtggggggccatgttcccagaaccttgatggggtgagaagtacagggcagaaccaagaacataaaccctccaagggatctgcttgatatcccaagttggaagggaccccagatacctgtgaggactggttgtctctcttcggtggccttgagtctctgaatttgtcgggttctcccatgatttggggtgatttctcaccctctgtccttcccccagcacaaagcactggccttgcctccaggaccttgcttccttctcatcttgcctcattttgcttcccatctgaagagtggaaatggggaactcccccagaggtggatactggggggcaggcctcccaagctgatggacatgagagtagggccctgacaggccttcctcctctcaaacctggcagatgggggcctctctggaagagggaggggccctgtcactgtccagagtctctttttacacttcacctccttctgcagtcagactgaaatataaaaaaggtggtggtggtggtgaaggggctggtggagatgtaggaaccgatctgctatttttaatttcctgtgaggatagagacttgcagttagactcaaagaagtactgtactttcccaggttgactaagaaatgccagtggtggaggtgggttagaaaataacaagtcatcccgagtttccattgtggcccagtggttaacgaatctgactaggaaccatgaggttgtgggttcgatccctggccttgcttagtgggttaaggatccagtgttgatgtgagctgtggtgtaggtcgcagatgtggctcagatctggcattgctgtggctctggataggccggtggctacagctctgattggacccctagccttgggaaataaaaaatacatat

SEQ ID NO: 299988 - DNA, 3284 bp, Homo sapiens
ttccggtctgtacaaagatggctgccacattggcgctgtcattttggtactgagcagagcgacgggcttaattcgacccaatccaggccagagtctttctctcaggggcttcctcgtgctcagctaatcctccgatcaatccttgggaatccctgggacctcttcggtatccctactctcagccagggatcatgtcttgggccgctcgcccgcccttcctccctcagcggcatgccgcagggcagtgtgggccggtgggggtgcgaaaagaaatgcattgtggggtcgcgtcccggtggcggcggcgacggccctggctggatcccgcagcggcggcggcggcggcggtggcaggcggagaacaacaaaccccggagccggagccaggggaggctggacgggacgggatgggcgacagcgggcgggactcccgaagcccagacagctcctccccaaatccccttccccagggagtccctcccccttctcctcctgggccacccctacccccttcaacagctccatcccttggaggctctggggccccacccccacccccgatgccaccacccccactgggctctccctttccagtcatcagttcttccatggggtcccctggtctgccccctccagctcccccaggattctccgggcctgtcagcagcccccagattaactcaacagtgtcactccctgggggtgggtctggcccccctgaagatgtgaagccaccagtcttaggggtccggggcctgcactgtccaccccctccaggtggccctggggctggcaaacggctatgtgcaatctgcggggacagaagctcaggcaaacactacggggtttacagctgtgagggttgcaagggcttcttcaaacgcaccatccgcaaagaccttacatactcttgccgggacaacaaagactgcacagtggacaagcgccagcggaaccgctgtcagtactgccgctatcagaagtgcctggccactggcatgaagagggaggcggtacaggaggagcgtcagcggggaaaggacaaggatggggatggggagggggctgggggagcccccgaggagatgcctgtggacaggatcctggaggcagagcttgctgtggaacagaagagtgaccagggcgttgagggtcctgggggaaccgggggtagcggcagcagcgtgagtgttggggtcaatccactctccttcgtgatgggggttgggggaggcagtctaggtctgttctacatcccctccccctcctttcccctcataaccttcctaacactacttgggactggaggtgctgccaaacaaggtctttcaaacatctgaggtggatgtgatagctccttctgtctccactccccaaacaacccactggcagaaccataggcatgtcccaaataaataattgtttgcactaatgccagaagagaagactcacttacagggattggtttggatggggctcacaggaagactatatgtaaggagggggtgtcaaaagcctcttacaagggggctcccagcatatctcaaaatcttccataactcttacccccgtcccctgcagccaaatgaccctgtgactaacatctgtcaggcagctgacaaacagctattcacgcttgttgagtgggcgaagaggatcccacacttttcctccttgcctctggatgatcaggtcatattgctgcgggcaggctggaatgaactcctcattgcctccttttcacaccgatccattgatgttcgagatggcatcctccttgccacaggtcttcacgtgcaccgcaactcagcccattcagcaggagtaggagccatctttgatcgggtgctgacagagctagtgtccaaaatgcgtgacatgaggatggacaagacagagcttggctgcctgagggcaatcattctgtttaatccagatgccaagggcctctccaaccctagtgaggtggaggtcctgcgggagaaagtgtatgcatcactggagacctactgcaaacagaagtaccctgagcagcagggacggtttgccaagctgctgctacgtcttcctgccctccggtccattggccttaagtgtctagagcatctgtttttcttcaagctcattggtgacacccccatcgacaccttcctcatggagatgcttgaggctccccatcaactggcctgagctcagacccagacgtggtgcttctcacactggaggagcacacatccaagagggactccaagccctggggcagggtggggggccatgttcccagaaccttgatggggtgagaagtacagggcagaaccaagaacataaaccctccaagggatctgcttgatatcccaagttggaagggaccccagatacctgtgaggactggttgtctctcttcggtggccttgagtctctgaatttgtcgggttctcccatgatttggggtgatttctcaccctctgtccttcccccagcacaaagcactggccttgcctccaggaccttgcttccttctcatcttgcctcattttgcttcccatctgaagagtggaaatggggaactcccccagaggtggatactggggggcaggcctcccaagctgatggacatgagagtagggccctgacaggccttcctcctctcaaacctggcagatgggggcctctctggaagagggaggggccctgtcactgtccagagtctctttttacacttcacctccttctgcagtcagactgaaatataaaaaaggtggtggtggtggtgaaggggctggtggagatgtaggaaccgatctgctatttttaatttcctgtgaggatagagacttgcagttagactcaaagaagtactgtactttcccaggttgactaagaaatgccagtggtggaggtgggtgtttgggaaaggcagggccctgaaatggcctgtccctagggctctccaagcactagccttcccagcttcccgccgccccccccatctcttcctgtctaacttggggaaggggcctgggctgtgaggacagggcccccacaggggatggtttcacgagtgtagtcccggaggccttccctttacagctctcctccagccctgggcacatagcataggctggggacacaggatcctggcctgagaattgaggggaggtggccagcccgcagaggtggggtgctggggctgcatgatttttgccctgcgtcccttctctttggggctcctttcccctctcatacataaaatcgctttcaaattaaaatcgctgttttctgga

SEQ ID NO: 299989 - DNA, 3488 bp, Homo sapiens
ttccggtctgtacaaagatggctgccacattggcgctgtcattttggtactgagcagagcgacgggcttaattcgacccaatccaggccagagtctttctctcaggggcttcctcgtgctcagctaatcctccgatcaatccttgggaatccctgggacctcttcggtatccctactctcagccagggatcatgtcttgggccgctcgcccgcccttcctccctcagcggcatgccgcagggcagtgtgggccggtgggggtgcgaaaagaaatgcattgtggggtcgcgtcccggtggcggcggcgacggccctggctggatcccgcagcggcggcggcggcggcggtggcaggcggagaacaacaaaccccggagccggagccaggggaggctggacgggacgggatgggcgacagcgggcgggactcccgaagcccagacagctcctccccaaatccccttccccagggagtccctcccccttctcctcctgggccacccctacccccttcaacagctccatcccttggaggctctggggccccacccccacccccgatgccaccacccccactgggctctccctttccagtcatcagttcttccatggggtcccctggtctgccccctccagctcccccaggattctccgggcctgtcagcagcccccagattaactcaacagtgtcactccctgggggtgggtctggcccccctgaagatgtgaagccaccagtcttaggggtccggggcctgcactgtccaccccctccaggtggccctggggctggcaaacggctatgtgcaatctgcggggacagaagctcaggcaaacactacggggtttacagctgtgagggttgcaagggcttcttcaaacgcaccatccgcaaagaccttacatactcttgccgggacaacaaagactgcacagtggacaagcgccagcggaaccgctgtcagtactgccgctatcagaagtgcctggccactggcatgaagagggaggcggtacaggaggagcgtcagcggggaaaggacaaggatggggatggggagggggctgggggagcccccgaggagatgcctgtggacaggatcctggaggcagagcttgctgtggaacagaagagtgaccagggcgttgagggtcctgggggaaccgggggtagcggcagcagcgtgagtgttggggtcaatccactctccttcgtgatgggggttgggggaggcagtctaggtctgttctacatcccctccccctcctttcccctcataaccttcctaacactacttgggactggaggtgctgccaaacaaggtctttcaaacatctgaggtggatgtgatagctccttctgtctccactccccaaacaacccactggcagaaccataggcatgtcccaaataaataattgtttgcactaatgccagaagagaagactcacttacagggattggtttggatggggctcacaggaagactatatgtaaggagggggtgtcaaaagcctcttacaagggggctcccagcatatctcaaaatcttccataactcttacccccgtcccctgcagccaaatgaccctgtgactaacatctgtcaggcagctgacaaacagctattcacgcttgttgagtgggcgaagaggatcccacacttttcctccttgcctctggatgatcaggtcatattgctgcgggcaggtcagtgaccttggatccctttgacttcttgacatttgacccctctttgacttcccgatctttagtgaccccagtggccttaccttgcgtacccagggagccaaacttgctgacctcgccacctcttttctccttctcttccactgatgtgctttgaatcccttggcctgatttctggctcctgacccttgctgccccacccaggctggaatgaactcctcattgcctccttttcacaccgatccattgatgttcgagatggcatcctccttgccacaggtcttcacgtgcaccgcaactcagcccattcagcaggagtaggagccatctttgatcgggtgctgacagagctagtgtccaaaatgcgtgacatgaggatggacaagacagagcttggctgcctgagggcaatcattctgtttaatccagatgccaagggcctctccaaccctagtgaggtggaggtcctgcgggagaaagtgtatgcatcactggagacctactgcaaacagaagtaccctgagcagcagggacggtttgccaagctgctgctacgtcttcctgccctccggtccattggccttaagtgtctagagcatctgtttttcttcaagctcattggtgacacccccatcgacaccttcctcatggagatgcttgaggctccccatcaactggcctgagctcagacccagacgtggtgcttctcacactggaggagcacacatccaagagggactccaagccctggggcagggtggggggccatgttcccagaaccttgatggggtgagaagtacagggcagaaccaagaacataaaccctccaagggatctgcttgatatcccaagttggaagggaccccagatacctgtgaggactggttgtctctcttcggtggccttgagtctctgaatttgtcgggttctcccatgatttggggtgatttctcaccctctgtccttcccccagcacaaagcactggccttgcctccaggaccttgcttccttctcatcttgcctcattttgcttcccatctgaagagtggaaatggggaactcccccagaggtggatactggggggcaggcctcccaagctgatggacatgagagtagggccctgacaggccttcctcctctcaaacctggcagatgggggcctctctggaagagggaggggccctgtcactgtccagagtctctttttacacttcacctccttctgcagtcagactgaaatataaaaaaggtggtggtggtggtgaaggggctggtggagatgtaggaaccgatctgctatttttaatttcctgtgaggatagagacttgcagttagactcaaagaagtactgtactttcccaggttgactaagaaatgccagtggtggaggtgggtgtttgggaaaggcagggccctgaaatggcctgtccctagggctctccaagcactagccttcccagcttcccgccgccccccccatctcttcctgtctaacttggggaaggggcctgggctgtgaggacagggcccccacaggggatggtttcacgagtgtagtcccggaggccttccctttacagctctcctccagccctgggcacatagcataggctggggacacaggatcctggcctgagaattgaggggaggtggccagcccgcagaggtggggtgctggggctgcatgatttttgccctgcgtcccttctctttggggctcctttcccctctcatacataaaatcgctttcaaattaaaatcgctgttttctgga

SEQ ID NO: 299990 - DNA, 2987 bp, Homo sapiens
ctttggggttgtgctccagggatggcctttcacatagactgcagtgtaaatgacagcctctggaatgtgcattgcagggccttgcttagtggtagggaatgatttccatcacttctgtgacattctgcttcccaataagtcttcctgtgacttccctatttcccccatcccagattaactcaacagtgtcactccctgggggtgggtctggcccccctgaagatgtgaagccaccagtcttaggggtccggggcctgcactgtccaccccctccaggtggccctggggctggcaaacggctatgtgcaatctgcggggacagaagctcaggcaaacactacggggtttacagctgtgagggttgcaagggcttcttcaaacgcaccatccgcaaagaccttacatactcttgccgggacaacaaagactgcacagtggacaagcgccagcggaaccgctgtcagtactgccgctatcagaagtgcctggccactggcatgaagagggaggcggtacaggaggagcgtcagcggggaaaggacaaggatggggatggggagggggctgggggagcccccgaggagatgcctgtggacaggatcctggaggcagagcttgctgtggaacagaagagtgaccagggcgttgagggtcctgggggaaccgggggtagcggcagcagcgtgagtgttggggtcaatccactctccttcgtgatgggggttgggggaggcagtctaggtctgttctacatcccctccccctcctttcccctcataaccttcctaacactacttgggactggaggtgctgccaaacaaggtctttcaaacatctgaggtggatgtgatagctccttctgtctccactccccaaacaacccactggcagaaccataggcatgtcccaaataaataattgtttgcactaatgccagaagagaagactcacttacagggattggtttggatggggctcacaggaagactatatgtaaggagggggtgtcaaaagcctcttacaagggggctcccagcatatctcaaaatcttccataactcttacccccgtcccctgcagccaaatgaccctgtgactaacatctgtcaggcagctgacaaacagctattcacgcttgttgagtgggcgaagaggatcccacacttttcctccttgcctctggatgatcaggtcatattgctgcgggcaggtcagtgaccttggatccctttgacttcttgacatttgacccctctttgacttcccgatctttagtgaccccagtggccttaccttgcgtacccagggagccaaacttgctgacctcgccacctcttttctccttctcttccactgatgtgctttgaatcccttggcctgatttctggctcctgacccttgctgccccacccaggctggaatgaactcctcattgcctccttttcacaccgatccattgatgttcgagatggcatcctccttgccacaggtcttcacgtgcaccgcaactcagcccattcagcaggagtaggagccatctttgatcgggtgctgacagagctagtgtccaaaatgcgtgacatgaggatggacaagacagagcttggctgcctgagggcaatcattctgtttaatccagatgccaagggcctctccaaccctagtgaggtggaggtcctgcgggagaaagtgtatgcatcactggagacctactgcaaacagaagtaccctgagcagcagggacggtttgccaagctgctgctacgtcttcctgccctccggtccattggccttaagtgtctagagcatctgtttttcttcaagctcattggtgacacccccatcgacaccttcctcatggagatgcttgaggctccccatcaactggcctgagctcagacccagacgtggtgcttctcacactggaggagcacacatccaagagggactccaagccctggggcagggtggggggccatgttcccagaaccttgatggggtgagaagtacagggcagaaccaagaacataaaccctccaagggatctgcttgatatcccaagttggaagggaccccagatacctgtgaggactggttgtctctcttcggtggccttgagtctctgaatttgtcgggttctcccatgatttggggtgatttctcaccctctgtccttcccccagcacaaagcactggccttgcctccaggaccttgcttccttctcatcttgcctcattttgcttcccatctgaagagtggaaatggggaactcccccagaggtggatactggggggcaggcctcccaagctgatggacatgagagtagggccctgacaggccttcctcctctcaaacctggcagatgggggcctctctggaagagggaggggccctgtcactgtccagagtctctttttacacttcacctccttctgcagtcagactgaaatataaaaaaggtggtggtggtggtgaaggggctggtggagatgtaggaaccgatctgctatttttaatttcctgtgaggatagagacttgcagttagactcaaagaagtactgtactttcccaggttgactaagaaatgccagtggtggaggtgggtgtttgggaaaggcagggccctgaaatggcctgtccctagggctctccaagcactagccttcccagcttcccgccgccccccccatctcttcctgtctaacttggggaaggggcctgggctgtgaggacagggcccccacaggggatggtttcacgagtgtagtcccggaggccttccctttacagctctcctccagccctgggcacatagcataggctggggacacaggatcctggcctgagaattgaggggaggtggccagcccgcagaggtggggtgctggggctgcatgatttttgccctgcgtcccttctctttggggctcctttcccctctcatacataaaatcgctttcaaattaaaatcgctgttttctgga

SEQ ID NO: 299991 - DNA, 2812 bp, Homo sapiens
ttccggtctgtacaaagatggctgccacattggcgctgtcattttggtactgagcagagcgacgggcttaattcgacccaatccaggccagagtctttctctcaggggcttcctcgtgctcagctaatcctccgatcaatccttgggaatccctgggacctcttcggtatccctactctcagccagggatcatgtcttgggccgctcgcccgcccttcctccctcagcggcatgccgcagggcagtgtgggccggtgggggtgcgaaaagaaatgcattgtggggtcgcgtcccggtggcggcggcgacggccctggctggatcccgcagcggcggcggcggcggcggtggcaggcggagaacaacaaaccccggagccggagccaggggaggctggacgggacgggatgggcgacagcgggcgggactcccgaagcccagacagctcctccccaaatccccttccccagggagtccctcccccttctcctcctgggccacccctacccccttcaacagctccatcccttggaggctctggggccccacccccacccccgatgccaccacccccactgggctctccctttccagtcatcagttcttccatggggtcccctggtctgccccctccagctcccccaggattctccgggcctgtcagcagcccccagattaactcaacagtgtcactccctgggggtgggtctggcccccctgaagatgtgaagccaccagtcttaggggtccggggcctgcactgtccaccccctccaggtggccctggggctggcaaacggctatgtgcaatctgcggggacagaagctcaggcaaacactacggggtttacagctgtgagggttgcaagggcttcttcaaacgcaccatccgcaaagaccttacatactcttgccgggacaacaaagactgcacagtggacaagcgccagcggaaccgctgtcagtactgccgctatcagaagtgcctggccactggcatgaagagggaggcggtacaggaggagcgtcagcggggaaaggacaaggatggggatggggagggggctgggggagcccccgaggagatgcctgtggacaggatcctggaggcagagcttgctgtggaacagaagagtgaccagggcgttgagggtcctgggggaaccgggggtagcggcagcagcccaaatgaccctgtgactaacatctgtcaggcagctgacaaacagctattcacgcttgttgagtgggcgaagaggatcccacacttttcctccttgcctctggatgatcaggtcatattgctgcgggcaggtcttcacgtgcaccgcaactcagcccattcagcaggagtaggagccatctttgatcgggtgctgacagagctagtgtccaaaatgcgtgacatgaggatggacaagacagagcttggctgcctgagggcaatcattctgtttaatccagatgccaagggcctctccaaccctagtgaggtggaggtcctgcgggagaaagtgtatgcatcactggagacctactgcaaacagaagtaccctgagcagcagggacggtttgccaagctgctgctacgtcttcctgccctccggtccattggccttaagtgtctagagcatctgtttttcttcaagctcattggtgacacccccatcgacaccttcctcatggagatgcttgaggctccccatcaactggcctgagctcagacccagacgtggtgcttctcacactggaggagcacacatccaagagggactccaagccctggggcagggtggggggccatgttcccagaaccttgatggggtgagaagtacagggcagaaccaagaacataaaccctccaagggatctgcttgatatcccaagttggaagggaccccagatacctgtgaggactggttgtctctcttcggtggccttgagtctctgaatttgtcgggttctcccatgatttggggtgatttctcaccctctgtccttcccccagcacaaagcactggccttgcctccaggaccttgcttccttctcatcttgcctcattttgcttcccatctgaagagtggaaatggggaactcccccagaggtggatactggggggcaggcctcccaagctgatggacatgagagtagggccctgacaggccttcctcctctcaaacctggcagatgggggcctctctggaagagggaggggccctgtcactgtccagagtctctttttacacttcacctccttctgcagtcagactgaaatataaaaaaggtggtggtggtggtgaaggggctggtggagatgtaggaaccgatctgctatttttaatttcctgtgaggatagagacttgcagttagactcaaagaagtactgtactttcccaggttgactaagaaatgccagtggtggaggtgggtgtttgggaaaggcagggccctgaaatggcctgtccctagggctctccaagcactagccttcccagcttcccgccgccccccccatctcttcctgtctaacttggggaaggggcctgggctgtgaggacagggcccccacaggggatggtttcacgagtgtagtcccggaggccttccctttacagctctcctccagccctgggcacatagcataggctggggacacaggatcctggcctgagaattgaggggaggtggccagcccgcagaggtggggtgctggggctgcatgatttttgccctgcgtcccttctctttggggctcctttcccctctcatacataaaatcgctttcaaattaaaatcgctgttttctgga

SEQ ID NO: 299992 - DNA, 2597 bp, Homo sapiens
ttccggtctgtacaaagatggctgccacattggcgctgtcattttggtactgagcagagcgacgggcttaattcgacccaatccaggccagagtctttctctcaggggcttcctcgtgctcagctaatcctccgatcaatccttgggaatccctgggacctcttcggtatccctactctcagccagggatcatgtcttgggccgctcgcccgcccttcctccctcagcggcatgccgcagggcagtgtgggccggtgggggtgcgaaaagaaatgcattgtggggtcgcgtcccggtggcggcggcgacggccctggctggatcccgcagcggcggcggcggcggcggtggcaggcggagaacaacaaaccccggagccggagccaggggaggctggacgggacgggatgggcgacagcgggcgggactcccgaagcccagacagctcctccccaaatccccttccccagggagtccctcccccttctcctcctgggccacccctacccccttcaacagctccatcccttggaggctctggggccccacccccacccccgatgccaccacccccactgggctctccctttccagtcatcagttcttccatggggtcccctggtctgccccctccagctcccccaggattctccgggcctgtcagcagcccccagattaactcaacagtgtcactccctgggggtgggtctggcccccctgaagatgtgaagccaccagtcttaggggtccggggcctgcactgtccaccccctccaggtggccctggggctggcaaacggctatgtgcaatctgcggggacagaagctcaggcaaacactacggggtttacagctgtgagggttgcaagggcttcttcaaacgcaccatccgcaaagaccttacatactcttgccgggacaacaaagactgcacagtggacaagcgccagcggaaccgctgtcagtactgccgctatcagaagtgcctggccactggcatgaagagggaggcggtacaggaggagcgtcagcggggaaaggacaaggatggggatggggagggggctgggggagcccccgaggagatgcctgtggacaggatcctggaggcagagcttgctgtggaacagaagagtgaccagggcgttgagggtcctgggggaaccgggggtagcggcagcagcccaaatgaccctgtgactaacatctgtcaggcagctgacaaacagctattcacgcttgttgagtgggcgaagaggatcccacacttttcctccttgcctctggatgatcaggtcatattgctgcgggcaggctggaatgaactcctcattgcctccttttcacaccgatccattgatgttcgagatggcatcctccttgccacaggtcttcacgtgcaccgcaactcagcccattcagcaggagtaggagccatctttgatcgggtgctgacagagctagtgtccaaaatgcgtgacatgaggatggacaagacagagcttggctgcctgagggcaatcattctgtttaatccagatgccaagggcctctccaaccctagtgaggtggaggtcctgcgggagaaagtgtatgcatcactggagacctactgcaaacagaagtaccctgagcagcagggacggtttgccaagctgctgctacgtcttcctgccctccggtccattggccttaagtgtctagagcatctgtttttcttcaagctcattggtgacacccccatcgacaccttcctcatggagatgcttgaggctccccatcaactggcctgagctcagacccagacgtggtgcttctcacactggaggagcacacatccaagagggactccaagccctggggcagggtggggggccatgttcccagaaccttgatggggtgagaagtacagggcagaaccaagaacataaaccctccaagggatctgcttgatatcccaagttggaagggaccccagatacctgtgaggactggttgtctctcttcggagggggggataagcagtctcatccccttcttcaacttcataaaaagtaatagtttcttccaagcccctgggcatctgtccattccctggggtaaatcatactgggactccttattcacacaactcatctggcggtactacgctcaaataacgagatctataagtgaagttatcatagctctggcagcaccttttacctgggcctgggtaaaaatcaactttagggccgcatgttgtgccctgtcagcattgtcagcttatatagctgatgtaccaattgataaaatgaatataaagtatttcattggttcaaaaatcacacatcatattaaaccatgcagaattggagtaacttccacttttttctagaaagtaaaaccaagagcctttgcttctggataactcacttaatattaaattaaagagctcttcacgtttcttgagaattatctgaagccagttgcattctgtgatatcagttttgaaggcacatggttctctgctttagatttatcccatatgctattgtttaatactggatgtatgtaagtaagtgttttactgcactgtattgaattggtgtcttttg

SEQ ID NO: 299993 - DNA, 1654 bp, Homo sapiens
ggaggattacctttgtctctcaaggccaaggcaaccttggagcctcctcttctccgagactcctaagttacccagctatccccctcagtaagaccctcaacctggaaatctcccaactggccgaggaaaaacccacatccacggatccatcccacaaacccagtgggccctgcttcccttgccaggcctctggtaaagggcaagcaagtgcagcccaaaaggggcatcctgtggctcacatctgcatggccatcctgatttggtttgtcttcatttctcttcctcctctcttccctgccatcccagatgccaagggcctctccaaccctagtgaggtggaggtcctgcgggagaaagtgtatgcatcactggagacctactgcaaacagaagtaccctgagcagcagggacggtttgccaagctgctgctacgtcttcctgccctccggtccattggccttaagtgtctagagcatctgtttttcttcaagctcattggtgacacccccatcgacaccttcctcatggagatgcttgaggctccccatcaactggcctgagctcagacccagacgtggtgcttctcacactggaggagcacacatccaagagggactccaagccctggggcagggtggggggccatgttcccagaaccttgatggggtgagaagtacagggcagaaccaagaacataaaccctccaagggatctgcttgatatcccaagttggaagggaccccagatacctgtgaggactggttgtctctcttcggtggccttgagtctctgaatttgtcgggttctcccatgatttggggtgatttctcaccctctgtccttcccccagcacaaagcactggccttgcctccaggaccttgcttccttctcatcttgcctcattttgcttcccatctgaagagtggaaatggggaactcccccagaggtggatactggggggcaggcctcccaagctgatggacatgagagtagggccctgacaggccttcctcctctcaaacctggcagatgggggcctctctggaagagggaggggccctgtcactgtccagagtctctttttacacttcacctccttctgcagtcagactgaaatataaaaaaggtggtggtggtggtgaaggggctggtggagatgtaggaaccgatctgctatttttaatttcctgtgaggatagagacttgcagttagactcaaagaagtactgtactttcccaggttgactaagaaatgccagtggtggaggtgggtgtttgggaaaggcagggccctgaaatggcctgtccctagggctctccaagcactagccttcccagcttcccgccgccccccccatctcttcctgtctaacttggggaaggggcctgggctgtgaggacagggcccccacaggggatggtttcacgagtgtagtcccggaggccttccctttacagctctcctccagccctgggcacatagcataggctggggacacaggatcctggcctgagaattgaggggaggtggccagcccgcagaggtggggtgctggggctgcatgatttttgccctgcgtcccttctctttggggctcctttcccctctcatacataaaatcgctttcaaattaaaatcgctgttttctgga

SEQ ID NO: 299994 - DNA, 2332 bp, Homo sapiens
ttccggtctgtacaaagatggctgccacattggcgctgtcattttggtactgagcagagcgacgggcttaattcgacccaatccaggccagagtctttctctcaggggcttcctcgtgctcagctaatcctccgatcaatccttgggaatccctgggacctcttcggtatccctactctcagccagggatcatgtcttgggccgctcgcccgcccttcctccctcagcggcatgccgcagggcagtgtgggccggtgggggtgcgaaaagaaatgcattgtggggtcgcgtcccggtggcggcggcgacggccctggctggatcccgcagcggcggcggcggcggcggtggcaggcggagaacaacaaaccccggagccggagccaggggaggctggacgggacgggatgggcgacagcgggcgggactcccgaagcccagacagctcctccccaaatccccttccccagggagtccctcccccttctcctcctgggccacccctacccccttcaacagctccatcccttggaggctctggggccccacccccacccccgatgccaccacccccactgggctctccctttccagtcatcagttcttccatggggtcccctggtctgccccctccagctcccccaggattctccgggcctgtcagcagcccccagattaactcaacagtgtcactccctgggggtgggtctggcccccctgaagatgtgaagccaccagtcttaggggtccggggcctgcactgtccaccccctccaggtggccctggggctggcaaacggctatgtgcaatctgcggggacagaagctcaggcaaacactacggggtttacagctgtgagggttgcaagggcttcttcaaacgcaccatccgcaaagaccttacatactcttgccgggacaacaaagactgcacagtggacaagcgccagcggaaccgctgtcagtactgccgctatcagaagtgcctggccactggcatgaagagggaggcggtacaggaggagcgtcagcggggaaaggacaaggatggggatggggagggggctgggggagcccccgaggagatgcctgtggacaggatcctggaggcagagcttgctgtggaacagaagagtgaccagggcgttgagggtcctgggggaaccgggggtagcggcagcagcgtgagtgttggggtcaatccactctccttcgtgatgggggttgggggaggcagtctaggtctgttctacatcccctccccctcctttcccctcataaccttcctaacactacttgggactggaggtgctgccaaacaaggtctttcaaacatctgaggtggatgtgatagctccttctgtctccactccccaaacaacccactggcagaaccataggcatgtcccaaataaataattgtttgcactaatgccagaagagaagactcacttacagggattggtttggatggggctcacaggaagactatatgtaaggagggggtgtcaaaagcctcttacaagggggctcccagcatatctcaaaatcttccataactcttacccccgtcccctgcagccaaatgaccctgtgactaacatctgtcaggcagctgacaaacagctattcacgcttgttgagtgggcgaagaggatcccacacttttcctccttgcctctggatgatcaggtcatattgctgcgggcaggtcagtgaccttggatccctttgacttcttgacatttgacccctctttgacttcccgatctttagtgaccccagtggccttaccttgcgtacccagggagccaaacttgctgacctcgccacctcttttctccttctcttccactgatgtgctttgaatcccttggcctgatttctggctcctgacccttgctgccccacccaggctggaatgaactcctcattgcctccttttcacaccgatccattgatgttcgagatggcatcctccttgccacaggtcttcacgtgcaccgcaactcagcccattcagcaggagtaggagccatctttgatcgggtgctgacagagctagtgtccaaaatgcgtgacatgaggatggacaagacagagcttggctgcctgagggcaatcattctgtttaatccagatgccaagggcctctccaacctaagggaggtggaggtctcgcggaacaggtgatgcctcagggactatgtaaacaaatacttgacagaggaggtgcaagtggggaagactcctagccggacaggctaggctaagactcgttctacaagcgggaaaccatactcctggaatgaggccaagggaggacacaagg

SEQ ID NO: 299995 - DNA, 778 bp, Homo sapiens
ttccggtctgtacaaagatggctgccacattggcgctgtcattttggtactgagcagagcgacgggcttaattcgacccaatccaggccagagtctttctctcaggggcttcctcgtgctcagctaatcctccgatcaatccttgggaatccctgggacctcttcggtatccctactctcagccagggatcatgtcttgggccgctcgcccgcccttcctccctcagcggcatgccgcagggcagtgtgggccggtgggggtgcgaaaagaaatgcattgtggggtcgcgtcccggtggcggcggcgacggccctggctggatcccgcagcggcggcggcggcggcggtggcaggcggagaacaacaaaccccggagccggagccaggggaggctggacgggacgggatgggcgacagcgggcgggactcccgaagcccagacagctcctccccaaatccccttccccagggagtccctcccccttctcctcctgggccacccctacccccttcaacagctccatcccttggaggctctggggccccacccccacccccgatgccaccacccccactgggctctccctttccagtcatcagttcttccatggggtcccctggtctgccccctccagctcccccaggattctccgggcctgtcagcagcccccaggtgagaggttgtgaccaacttactgcctggccactttcattttcttgttttccttgtaaccccagatccttgtgtgaacttccccatggcccattgaccttcca

SEQ ID NO: 299996 - DNA, 400 bp, Homo sapiens
aaccttggagcctcctcttctccgagactcctaagttacccagctatccccctcagtaagaccctcaacctggaaatctcccaactggccgaggaaaaacccacatccacggatccatcccacaaacccagtgggccctgcttcccttgccaggcctctggtaaagggcaagcaagtgcagcccaaaaggggcatcctgtggctcacatctgcatggccatcctgatttggtttgtcttcatttctcttcctcctctcttccctgccatcccagatgccaagggcctctccaaccctagtgaggtggaggtcctgcgggagaaagtgtatgcatcactggagacctactgcaaacagaagtaccctgagcagcagggacggtgagatggggctggggggc

SEQ ID NO: 299997 - DNA, 969 bp, Homo sapiens
aaggccaaagaaccataactaatggctgggcttcaggagaaagtggtcattgtctctgcagactgcagagagggagacgggagggaaggtgtgttcgctcttcctgccaagggccctagagacagagaagagggatgtctttgtcataagcgatcacaggggactcctgaggactggggagggctctctgtaacttgggaggttccccagtaggtaaattgatggatttttctcccccacagtgcgaaaacaggagatcattaagattacagaacagctgattgaagccatcaacaatggggactttgaggcctacacgaagatttgtgatccaggcctcacttcctttgagcctgaggcccttggtaacctcgtggaggggatggatttccataagttttactttgagaatcgtgagtgggttcgtgctgctgatatactcctgcctgcccctttacccctttgtctctgtctcctgctcaccttctcatcccagttgcccacttttcccttatttgaccttcgtgctgcactcctactctgtatgcttgtccccttgtgccccgatggttgtagacaggcacctttgaaggccctgctcctgagctccaagtgccattcattctgcagctgctttgtggcagtgccagtcaccacaatcaagctcacttatttcttgccgggcgcggtggcttacgcctgtaatcccaacactttgggaggctgaggctggcggatcacgaggtcaggagatcgaggccatcctggctaacacggtgaaaccccatctctactaaaaatacaaaaaattagccgggcgtggtggcggtgcctgtagtcccagctactcgggtggctgaggcaggagaatgatgtgaacctgggaggcagagcttgcagtgagccaagatcaggccactgcactccagcctgggcaacagagcaagactccatctcaaaaaaaaagaa

SEQ ID NO: 299998 - DNA, 3689 bp, Homo sapiens
  misc_feature (19)..(19): n is a, c, g, or t
agcgggctgccgggctcanccccgtctcctcctcttgctccctcggccgggcggcggtgactgtgcaccgacgtcggcgcgggctgcaccgccgcgtccgcccgcccgccagcatggccaccaccgccacctgcacccgtttcaccgacgactaccagctcttcgaggagcttggcaagggtgctttctctgtggtccgcaggtgtgtgaagaaaacctccacgcaggagtacgcagcaaaaatcatcaataccaagaagttgtctgcccgggatcaccagaaactagaacgtgaggctcggatatgtcgacttctgaaacatccaaacatcgtgcgcctccatgacagtatttctgaagaagggtttcactacctcgtgtttgaccttgttaccggcggggagctgtttgaagacattgtggccagagagtactacagtgaagcagatgccagccactgtatacatcagattctggagagtgttaaccacatccaccagcatgacatcgtccacagggacctgaagcctgagaacctgctgctggcgagtaaatgcaagggtgccgccgtcaagctggctgattttggcctagccatcgaagtacagggagagcagcaggcttggtttggttttgctggcaccccaggttacttgtcccctgaggtcttgaggaaagatccctatggaaaacctgtggatatctgggcctgcggggtcatcctgtatatcctcctggtgggctatcctcccttctgggatgaggatcagcacaagctgtatcagcagatcaaggctggagcctatgatttcccatcaccagaatgggacacggtaactcctgaagccaagaacttgatcaaccagatgctgaccataaacccagcaaagcgcatcacggctgaccaggctctcaagcacccgtgggtctgtcaacgatccacggtggcatccatgatgcatcgtcaggagactgtggagtgtttgcgcaagttcaatgcccggagaaaactgaagggtgccatcctcacgaccatgcttgtctccaggaacttctcagctgccaaaagcctattgaacaagaagtcggatggcggtgtcaagccacagagcaacaacaaaaacagtctcgtaagcccagcccaagagcccgcgcccttgcagacggccatggagccacaaaccactgtggtacacaacgctacagatgggatcaagggctccacagagagctgcaacaccaccacagaagatgaggacctcaaagtgcgaaaacaggagatcattaagattacagaacagctgattgaagccatcaacaatggggactttgaggcctacacgaagatttgtgatccaggcctcacttcctttgagcctgaggcccttggtaacctcgtggaggggatggatttccataagttttactttgagaatctcctgtccaagaacagcaagcctatccataccaccatcctaaacccacacgtccacgtgattggggaggacgcagcgtgcatcgcctacatccgcctcacccagtacatcgacgggcagggtcggcctcgcaccagccagtcagaagagacccgggtctggcaccgtcgggatggcaagtggctcaatgtccactatcactgctcaggggcccctgccgcaccgctgcagtgagctcagccacaggggctttaggagattccagccggaggtccaaccttcgcagccagtggctctggagggcctgagtgacagcggcagtcctgtttgtttgaggtttaaaacaattcaattacaaaagcggcagcagccaatgcacgcccctgcatgcagccctcccgcccgcccttcgtgtctgtctctgctgtaccgaggtgttttttacatttaagaaaaaaaaaaaaagaaaaaaagattgtttaaaaaaaaaaggaatccataccatgatgcgttttaaaaccaccgacagcccttgggttggcaagaaggcaggagtatgtatgaggtccatcctggcatgagcagtggctcacccaccggccttgaagaggtgagcttggcctctctggtccccatggacttagggggaccaggcaagaactctgacagagctttgggggccgtgatgtgattgcagctcctgaggtggcctgcttaccccaggtctaggaatgaacttctttggaacttgcataggcgcctagaatggggctgatgagaacatcgtgaccatcagacctacttgggagagaacgcagagctcccagcctgctgtggaggcagctgagaagtggtggcctcaggactgagagcccggacgttgctgtactgtcttgtttagtgtagaagggaagagaattggtgctgcagaagtgtacccgccatgaagccgatgagaaacctcgtgttagtctgacatgcactcactcatccatttctataggatgcacaatgcatgtgggccctaatattgaggccttatccctgcagctaggagggggaggggttgttgctgctttgcttcgtgttttcttctaacctggcaaggagagagccaggccctggtcagggctcccgtgccgcctttggcggttctgtttctgtgctgatctggaccatctttgtcttgccttttcacggtagtggtccccatgctgaccctcatctgggcctgggccctctgccaagtgcccctgtgggatgggaggagtgaggcagtgggagaagaggtggtggtcgtttctatgcattcaggctgcctttggggctgcctcccttcttattcttccttgctgcacgtccatctcttttcctgtctttgagattgacctgactgctctggcaagaagaagaggtgtccttacagaggcctctttactgaccaactgaagtatagacttactgctggacaatctgcatgggcatcacccctccccgcatgtaacccaaaagaggtgtccagagccaaggcttctaccttcattgtccctctctgtgctcaaggagttccattccaggaggaagagatctataccctaagcagatagcaaagaagataatggaggagcaattggtcatggccttggtttccctcaaaacaacgctgcagatttatctgcacaaacatctccacttttgggggaaaggtgggtagattccagttccctggactaccttcaggaggcacgagagctgggagaagaggcaaagctacaggtttacttgggagccagctgagaagagagcagactcacaggtgctggtgcttggatttagccaggctcctccgagcacctcatgcatgtcccagcccctgggccctagccctttcctgccctgcagtctgcagtgccagcacgcaaatcccttcaccacagggtttcgttttgctggcttgaagacaaatggtcttagaattcattgagacccatagcttcatatggctgctccagccccacttcttagcattcttactcctcttctggggctaatgtcagcatctatagacaatagactattaaaaaatcaccttttaaacaagaaacggaaggcatttgatgcagaatttttgcatgacaacatagaaataatttaaaaatagtgtttgttctgaatgttggtagacccttcatagctttgttacaatgaaaccttgaactgaaaatatttaataaaataacctttaaacagtca

SEQ ID NO: 299999 - DNA, 4079 bp, Homo sapiens
gtcggcaggctactggacttctcgtgtctgtctctgctgtacgaggtgttttttacatttaagaaaaaaacaaaaagaaacaacacgattgtttacaaaaaaagggactccataccatgatgcgttttaaaaccaccgacagcccttgggttggcaagaaggcaggagtatgtatgaggtccatcctggcatgagcagtggctcacccaccggccttgaagaggtgagcttggcctctctggtccccatggacttagggggaccaggcaagaactctgacagagctttgggggccgtgatgtgattgcagctcctgaggtggcctgcttaccccaggtctaggaatgaacttctttggaacttgcataggcgcctagaatggggctgatgagaacatcgtgaccatcagacctacttgctcctcttgctccctcggccgggcggcggtgactgtgcaccgacgtcggcgcgggctgcaccgccgcgtccgcccgcccgccagcatggccaccaccgccacctgcacccgtttcaccgacgactaccagctcttcgaggagcttggcaagggtgctttctctgtggtccgcaggtgtgtgaagaaaacctccacgcaggagtacgcagcaaaaatcatcaataccaagaagttgtctgcccgggatcaccagaaactagaacgtgaggctcggatatgtcgacttctgaaacatccaaacatcgtgcgcctccatgacagtatttctgaagaagggtttcactacctcgtgtttgaccttgttaccggcggggagctgtttgaagacattgtggccagagagtactacagtgaagcagatgccagccactgtatacatcagattctggagagtgttaaccacatccaccagcatgacatcgtccacagggacctgaagcctgagaacctgctgctggcgagtaaatgcaagggtgccgccgtcaagctggctgattttggcctagccatcgaagtacagggagagcagcaggcttggtttggttttgctggcaccccaggttacttgtcccctgaggtcttgaggaaagatccctatggaaaacctgtggatatctgggcctgcggggtcatcctgtatatcctcctggtgggctatcctcccttctgggatgaggatcagcacaagctgtatcagcagatcaaggctggagcctatgatttcccatcaccagaatgggacacggtaactcctgaagccaagaacttgatcaaccagatgctgaccataaacccagcaaagcgcatcacggctgaccaggctctcaagcacccgtgggtctgtcaacgatccacggtggcatccatgatgcatcgtcaggagactgtggagtgtttgcgcaagttcaatgcccggagaaaactgaagggtgccatcctcacgaccatgcttgtctccaggaacttctcagctgccaaaagcctattgaacaagaagtcggatggcggtgtcaagccacagagcaacaacaaaaacagtctcgtaagcccagcccaagagcccgcgcccttgcagacggccatggagccacaaaccactgtggtacacaacgctacagatgggatcaagggctccacagagagctgcaacaccaccacagaagatgaggacctcaaagtgcgaaaacaggagatcattaagattacagaacagctgattgaagccatcaacaatggggactttgaggcctacacgaagatttgtgatccaggcctcacttcctttgagcctgaggcccttggtaacctcgtggaggggatggatttccataagttttactttgagaatctcctgtccaagaacagcaagcctatccataccaccatcctaaacccacacgtccacgtgattggggaggacgcagcgtgcatcgcctacatccgcctcacccagtacatcgacgggcagggtcggcctcgcaccagccagtcagaagagacccgggtctggcaccgtcgggatggcaagtggctcaatgtccactatcactgctcaggggcccctgccgcaccgctgcagtgagctcagccacaggggctttaggagattccagccggaggtccaaccttcgcagccagtggctctggagggcctgagtgacagcggcagtcctgtttgtttgaggtttaaaacaattcaattacaaaagcggcagcagccaatgcacgcccctgcatgcagccctcccgcccgcccttcgtgtctgtctctgctgtaccgaggtgttttttacatttaagaaaaaaaaaaaaagaaaaaaagattgtttaaaaaaaaaaggaatccataccatgatgcgttttaaaaccaccgacagcccttgggttggcaagaaggcaggagtatgtatgaggtccatcctggcatgagcagtggctcacccaccggccttgaagaggtgagcttggcctctctggtccccatggacttagggggaccaggcaagaactctgacagagctttgggggccgtgatgtgattgcagctcctgaggtggcctgcttaccccaggtctaggaatgaacttctttggaacttgcataggcgcctagaatggggctgatgagaacatcgtgaccatcagacctacttgggagagaacgcagagctcccagcctgctgtggaggcagctgagaagtggtggcctcaggactgagagcccggacgttgctgtactgtcttgtttagtgtagaagggaagagaattggtgctgcagaagtgtacccgccatgaagccgatgagaaacctcgtgttagtctgacatgcactcactcatccatttctataggatgcacaatgcatgtgggccctaatattgaggccttatccctgcagctaggagggggaggggttgttgctgctttgcttcgtgttttcttctaacctggcaaggagagagccaggccctggtcagggctcccgtgccgcctttggcggttctgtttctgtgctgatctggaccatctttgtcttgccttttcacggtagtggtccccatgctgaccctcatctgggcctgggccctctgccaagtgcccctgtgggatgggaggagtgaggcagtgggagaagaggtggtggtcgtttctatgcattcaggctgcctttggggctgcctcccttcttattcttccttgctgcacgtccatctcttttcctgtctttgagattgacctgactgctctggcaagaagaagaggtgtccttacagaggcctctttactgaccaactgaagtatagacttactgctggacaatctgcatgggcatcacccctccccgcatgtaacccaaaagaggtgtccagagccaaggcttctaccttcattgtccctctctgtgctcaaggagttccattccaggaggaagagatctataccctaagcagatagcaaagaagataatggaggagcaattggtcatggccttggtttccctcaaaacaacgctgcagatttatctgcacaaacatctccacttttgggggaaaggtgggtagattccagttccctggactaccttcaggaggcacgagagctgggagaagaggcaaagctacaggtttacttgggagccagctgagaagagagcagactcacaggtgctggtgcttggatttagccaggctcctccgagcacctcatgcatgtcccagcccctgggccctagccctttcctgccctgcagtctgcagtgccagcacgcaaatcccttcaccacagggtttcgttttgctggcttgaagacaaatggtcttagaattcattgagacccatagcttcatatggctgctccagccccacttcttagcattcttactcctcttctggggctaatgtcagcatctatagacaatagactattaaaaaatcaccttttaaacaagaaacggaaggcatttgatgcagaatttttgcatgacaacatagaaataatttaaaaatagtgtttgttctgaatgttggtagacccttcatagctttgttacaatgaaaccttgaactgaaaatatttaataaaataacctttaaacagtca

SEQ ID NO: 300000 - DNA, 3803 bp, Homo sapiens
  misc_feature (19)..(19): n is a, c, g, or t
agcgggctgccgggctcanccccgtctcctcctcttgctccctcggccgggcggcggtgactgtgcaccgacgtcggcgcgggctgcaccgccgcgtccgcccgcccgccagcatggccaccaccgccacctgcacccgtttcaccgacgactaccagctcttcgaggagcttggcaagggtgctttctctgtggtccgcaggtgtgtgaagaaaacctccacgcaggagtacgcagcaaaaatcatcaataccaagaagttgtctgcccgggatcaccagaaactagaacgtgaggctcggatatgtcgacttctgaaacatccaaacatcgtgcgcctccatgacagtatttctgaagaagggtttcactacctcgtgtttgaccttgttaccggcggggagctgtttgaagacattgtggccagagagtactacagtgaagcagatgccagccactgtatacatcagattctggagagtgttaaccacatccaccagcatgacatcgtccacagggacctgaagcctgagaacctgctgctggcgagtaaatgcaagggtgccgccgtcaagctggctgattttggcctagccatcgaagtacagggagagcagcaggcttggtttggttttgctggcaccccaggttacttgtcccctgaggtcttgaggaaagatccctatggaaaacctgtggatatctgggcctgcggggtcatcctgtatatcctcctggtgggctatcctcccttctgggatgaggatcagcacaagctgtatcagcagatcaaggctggagcctatgatttcccatcaccagaatgggacacggtaactcctgaagccaagaacttgatcaaccagatgctgaccataaacccagcaaagcgcatcacggctgaccaggctctcaagcacccgtgggtctgtcaacgatccacggtggcatccatgatgcatcgtcaggagactgtggagtgtttgcgcaagttcaatgcccggagaaaactgaagggtgccatcctcacgaccatgcttgtctccaggaacttctcagctgccaaaagcctattgaacaagaagtcggatggcggtgtcaagccacagagcaacaacaaaaacagtctcgtaagcccagcccaagagcccgcgcccttgcagacggccatggagccacaaaccactgtggtacacaacgctacagatgggatcaagggctccacagagagctgcaacaccaccacagaagatgaggacctcaaagctgccccgctccgcactgggaatggcagctcggtgcctgaaggacggagctcccgggacagaacagccccctctgcaggcatgcagccccagccttctctctgctcctcagccatgcgaaaacaggagatcattaagattacagaacagctgattgaagccatcaacaatggggactttgaggcctacacgaagatttgtgatccaggcctcacttcctttgagcctgaggcccttggtaacctcgtggaggggatggatttccataagttttactttgagaatctcctgtccaagaacagcaagcctatccataccaccatcctaaacccacacgtccacgtgattggggaggacgcagcgtgcatcgcctacatccgcctcacccagtacatcgacgggcagggtcggcctcgcaccagccagtcagaagagacccgggtctggcaccgtcgggatggcaagtggctcaatgtccactatcactgctcaggggcccctgccgcaccgctgcagtgagctcagccacaggggctttaggagattccagccggaggtccaaccttcgcagccagtggctctggagggcctgagtgacagcggcagtcctgtttgtttgaggtttaaaacaattcaattacaaaagcggcagcagccaatgcacgcccctgcatgcagccctcccgcccgcccttcgtgtctgtctctgctgtaccgaggtgttttttacatttaagaaaaaaaaaaaaagaaaaaaagattgtttaaaaaaaaaaggaatccataccatgatgcgttttaaaaccaccgacagcccttgggttggcaagaaggcaggagtatgtatgaggtccatcctggcatgagcagtggctcacccaccggccttgaagaggtgagcttggcctctctggtccccatggacttagggggaccaggcaagaactctgacagagctttgggggccgtgatgtgattgcagctcctgaggtggcctgcttaccccaggtctaggaatgaacttctttggaacttgcataggcgcctagaatggggctgatgagaacatcgtgaccatcagacctacttgggagagaacgcagagctcccagcctgctgtggaggcagctgagaagtggtggcctcaggactgagagcccggacgttgctgtactgtcttgtttagtgtagaagggaagagaattggtgctgcagaagtgtacccgccatgaagccgatgagaaacctcgtgttagtctgacatgcactcactcatccatttctataggatgcacaatgcatgtgggccctaatattgaggccttatccctgcagctaggagggggaggggttgttgctgctttgcttcgtgttttcttctaacctggcaaggagagagccaggccctggtcagggctcccgtgccgcctttggcggttctgtttctgtgctgatctggaccatctttgtcttgccttttcacggtagtggtccccatgctgaccctcatctgggcctgggccctctgccaagtgcccctgtgggatgggaggagtgaggcagtgggagaagaggtggtggtcgtttctatgcattcaggctgcctttggggctgcctcccttcttattcttccttgctgcacgtccatctcttttcctgtctttgagattgacctgactgctctggcaagaagaagaggtgtccttacagaggcctctttactgaccaactgaagtatagacttactgctggacaatctgcatgggcatcacccctccccgcatgtaacccaaaagaggtgtccagagccaaggcttctaccttcattgtccctctctgtgctcaaggagttccattccaggaggaagagatctataccctaagcagatagcaaagaagataatggaggagcaattggtcatggccttggtttccctcaaaacaacgctgcagatttatctgcacaaacatctccacttttgggggaaaggtgggtagattccagttccctggactaccttcaggaggcacgagagctgggagaagaggcaaagctacaggtttacttgggagccagctgagaagagagcagactcacaggtgctggtgcttggatttagccaggctcctccgagcacctcatgcatgtcccagcccctgggccctagccctttcctgccctgcagtctgcagtgccagcacgcaaatcccttcaccacagggtttcgttttgctggcttgaagacaaatggtcttagaattcattgagacccatagcttcatatggctgctccagccccacttcttagcattcttactcctcttctggggctaatgtcagcatctatagacaatagactattaaaaaatcaccttttaaacaagaaacggaaggcatttgatgcagaatttttgcatgacaacatagaaataatttaaaaatagtgtttgttctgaatgttggtagacccttcatagctttgttacaatgaaaccttgaactgaaaatatttaataaaataacctttaaacagtca

SEQ ID NO: 300001 - DNA, 3620 bp, Homo sapiens
  misc_feature (19)..(19): n is a, c, g, or t
agcgggctgccgggctcanccccgtctcctcctcttgctccctcggccgggcggcggtgactgtgcaccgacgtcggcgcgggctgcaccgccgcgtccgcccgcccgccagcatggccaccaccgccacctgcacccgtttcaccgacgactaccagctcttcgaggagcttggcaagggtgctttctctgtggtccgcaggtgtgtgaagaaaacctccacgcaggagtacgcagcaaaaatcatcaataccaagaagttgtctgcccgggatcaccagaaactagaacgtgaggctcggatatgtcgacttctgaaacatccaaacatcgtgcgcctccatgacagtatttctgaagaagggtttcactacctcgtgtttgaccttgttaccggcggggagctgtttgaagacattgtggccagagagtactacagtgaagcagatgccagccactgtatacatcagattctggagagtgttaaccacatccaccagcatgacatcgtccacagggacctgaagcctgagaacctgctgctggcgagtaaatgcaagggtgccgccgtcaagctggctgattttggcctagccatcgaagtacagggagagcagcaggcttggtttggttttgctggcaccccaggttacttgtcccctgaggtcttgaggaaagatccctatggaaaacctgtggatatctgggcctgcggggtcatcctgtatatcctcctggtgggctatcctcccttctgggatgaggatcagcacaagctgtatcagcagatcaaggctggagcctatgatttcccatcaccagaatgggacacggtaactcctgaagccaagaacttgatcaaccagatgctgaccataaacccagcaaagcgcatcacggctgaccaggctctcaagcacccgtgggtctgtcaacgatccacggtggcatccatgatgcatcgtcaggagactgtggagtgtttgcgcaagttcaatgcccggagaaaactgaagggtgccatcctcacgaccatgcttgtctccaggaacttctcagctgccaaaagcctattgaacaagaagtcggatggcggtgtcaaggagccacaaaccactgtggtacacaacgctacagatgggatcaagggctccacagagagctgcaacaccaccacagaagatgaggacctcaaagtgcgaaaacaggagatcattaagattacagaacagctgattgaagccatcaacaatggggactttgaggcctacacgaagatttgtgatccaggcctcacttcctttgagcctgaggcccttggtaacctcgtggaggggatggatttccataagttttactttgagaatctcctgtccaagaacagcaagcctatccataccaccatcctaaacccacacgtccacgtgattggggaggacgcagcgtgcatcgcctacatccgcctcacccagtacatcgacgggcagggtcggcctcgcaccagccagtcagaagagacccgggtctggcaccgtcgggatggcaagtggctcaatgtccactatcactgctcaggggcccctgccgcaccgctgcagtgagctcagccacaggggctttaggagattccagccggaggtccaaccttcgcagccagtggctctggagggcctgagtgacagcggcagtcctgtttgtttgaggtttaaaacaattcaattacaaaagcggcagcagccaatgcacgcccctgcatgcagccctcccgcccgcccttcgtgtctgtctctgctgtaccgaggtgttttttacatttaagaaaaaaaaaaaaagaaaaaaagattgtttaaaaaaaaaaggaatccataccatgatgcgttttaaaaccaccgacagcccttgggttggcaagaaggcaggagtatgtatgaggtccatcctggcatgagcagtggctcacccaccggccttgaagaggtgagcttggcctctctggtccccatggacttagggggaccaggcaagaactctgacagagctttgggggccgtgatgtgattgcagctcctgaggtggcctgcttaccccaggtctaggaatgaacttctttggaacttgcataggcgcctagaatggggctgatgagaacatcgtgaccatcagacctacttgggagagaacgcagagctcccagcctgctgtggaggcagctgagaagtggtggcctcaggactgagagcccggacgttgctgtactgtcttgtttagtgtagaagggaagagaattggtgctgcagaagtgtacccgccatgaagccgatgagaaacctcgtgttagtctgacatgcactcactcatccatttctataggatgcacaatgcatgtgggccctaatattgaggccttatccctgcagctaggagggggaggggttgttgctgctttgcttcgtgttttcttctaacctggcaaggagagagccaggccctggtcagggctcccgtgccgcctttggcggttctgtttctgtgctgatctggaccatctttgtcttgccttttcacggtagtggtccccatgctgaccctcatctgggcctgggccctctgccaagtgcccctgtgggatgggaggagtgaggcagtgggagaagaggtggtggtcgtttctatgcattcaggctgcctttggggctgcctcccttcttattcttccttgctgcacgtccatctcttttcctgtctttgagattgacctgactgctctggcaagaagaagaggtgtccttacagaggcctctttactgaccaactgaagtatagacttactgctggacaatctgcatgggcatcacccctccccgcatgtaacccaaaagaggtgtccagagccaaggcttctaccttcattgtccctctctgtgctcaaggagttccattccaggaggaagagatctataccctaagcagatagcaaagaagataatggaggagcaattggtcatggccttggtttccctcaaaacaacgctgcagatttatctgcacaaacatctccacttttgggggaaaggtgggtagattccagttccctggactaccttcaggaggcacgagagctgggagaagaggcaaagctacaggtttacttgggagccagctgagaagagagcagactcacaggtgctggtgcttggatttagccaggctcctccgagcacctcatgcatgtcccagcccctgggccctagccctttcctgccctgcagtctgcagtgccagcacgcaaatcccttcaccacagggtttcgttttgctggcttgaagacaaatggtcttagaattcattgagacccatagcttcatatggctgctccagccccacttcttagcattcttactcctcttctggggctaatgtcagcatctatagacaatagactattaaaaaatcaccttttaaacaagaaacggaaggcatttgatgcagaatttttgcatgacaacatagaaataatttaaaaatagtgtttgttctgaatgttggtagacccttcatagctttgttacaatgaaaccttgaactgaaaatatttaataaaataacctttaaacagtca

SEQ ID NO: 300002 - DNA, 3647 bp, Homo sapiens
  misc_feature (19)..(19): n is a, c, g, or t
agcgggctgccgggctcanccccgtctcctcctcttgctccctcggccgggcggcggtgactgtgcaccgacgtcggcgcgggctgcaccgccgcgtccgcccgcccgccagcatggccaccaccgccacctgcacccgtttcaccgacgactaccagctcttcgaggagcttggcaagggtgctttctctgtggtccgcaggtgtgtgaagaaaacctccacgcaggagtacgcagcaaaaatcatcaataccaagaagttgtctgcccgggatcaccagaaactagaacgtgaggctcggatatgtcgacttctgaaacatccaaacatcgtgcgcctccatgacagtatttctgaagaagggtttcactacctcgtgtttgaccttgttaccggcggggagctgtttgaagacattgtggccagagagtactacagtgaagcagatgccagccactgtatacatcagattctggagagtgttaaccacatccaccagcatgacatcgtccacagggacctgaagcctgagaacctgctgctggcgagtaaatgcaagggtgccgccgtcaagctggctgattttggcctagccatcgaagtacagggagagcagcaggcttggtttggttttgctggcaccccaggttacttgtcccctgaggtcttgaggaaagatccctatggaaaacctgtggatatctgggcctgcggggtcatcctgtatatcctcctggtgggctatcctcccttctgggatgaggatcagcacaagctgtatcagcagatcaaggctggagcctatgatttcccatcaccagaatgggacacggtaactcctgaagccaagaacttgatcaaccagatgctgaccataaacccagcaaagcgcatcacggctgaccaggctctcaagcacccgtgggtctgtcaacgatccacggtggcatccatgatgcatcgtcaggagactgtggagtgtttgcgcaagttcaatgcccggagaaaactgaagggtgccatcctcacgaccatgcttgtctccaggaacttctcagctgccaaaagcctattgaacaagaagtcggatggcggtgtcaagccacagagcaacaacaaaaacagtctcgagccacaaaccactgtggtacacaacgctacagatgggatcaagggctccacagagagctgcaacaccaccacagaagatgaggacctcaaagtgcgaaaacaggagatcattaagattacagaacagctgattgaagccatcaacaatggggactttgaggcctacacgaagatttgtgatccaggcctcacttcctttgagcctgaggcccttggtaacctcgtggaggggatggatttccataagttttactttgagaatctcctgtccaagaacagcaagcctatccataccaccatcctaaacccacacgtccacgtgattggggaggacgcagcgtgcatcgcctacatccgcctcacccagtacatcgacgggcagggtcggcctcgcaccagccagtcagaagagacccgggtctggcaccgtcgggatggcaagtggctcaatgtccactatcactgctcaggggcccctgccgcaccgctgcagtgagctcagccacaggggctttaggagattccagccggaggtccaaccttcgcagccagtggctctggagggcctgagtgacagcggcagtcctgtttgtttgaggtttaaaacaattcaattacaaaagcggcagcagccaatgcacgcccctgcatgcagccctcccgcccgcccttcgtgtctgtctctgctgtaccgaggtgttttttacatttaagaaaaaaaaaaaaagaaaaaaagattgtttaaaaaaaaaaggaatccataccatgatgcgttttaaaaccaccgacagcccttgggttggcaagaaggcaggagtatgtatgaggtccatcctggcatgagcagtggctcacccaccggccttgaagaggtgagcttggcctctctggtccccatggacttagggggaccaggcaagaactctgacagagctttgggggccgtgatgtgattgcagctcctgaggtggcctgcttaccccaggtctaggaatgaacttctttggaacttgcataggcgcctagaatggggctgatgagaacatcgtgaccatcagacctacttgggagagaacgcagagctcccagcctgctgtggaggcagctgagaagtggtggcctcaggactgagagcccggacgttgctgtactgtcttgtttagtgtagaagggaagagaattggtgctgcagaagtgtacccgccatgaagccgatgagaaacctcgtgttagtctgacatgcactcactcatccatttctataggatgcacaatgcatgtgggccctaatattgaggccttatccctgcagctaggagggggaggggttgttgctgctttgcttcgtgttttcttctaacctggcaaggagagagccaggccctggtcagggctcccgtgccgcctttggcggttctgtttctgtgctgatctggaccatctttgtcttgccttttcacggtagtggtccccatgctgaccctcatctgggcctgggccctctgccaagtgcccctgtgggatgggaggagtgaggcagtgggagaagaggtggtggtcgtttctatgcattcaggctgcctttggggctgcctcccttcttattcttccttgctgcacgtccatctcttttcctgtctttgagattgacctgactgctctggcaagaagaagaggtgtccttacagaggcctctttactgaccaactgaagtatagacttactgctggacaatctgcatgggcatcacccctccccgcatgtaacccaaaagaggtgtccagagccaaggcttctaccttcattgtccctctctgtgctcaaggagttccattccaggaggaagagatctataccctaagcagatagcaaagaagataatggaggagcaattggtcatggccttggtttccctcaaaacaacgctgcagatttatctgcacaaacatctccacttttgggggaaaggtgggtagattccagttccctggactaccttcaggaggcacgagagctgggagaagaggcaaagctacaggtttacttgggagccagctgagaagagagcagactcacaggtgctggtgcttggatttagccaggctcctccgagcacctcatgcatgtcccagcccctgggccctagccctttcctgccctgcagtctgcagtgccagcacgcaaatcccttcaccacagggtttcgttttgctggcttgaagacaaatggtcttagaattcattgagacccatagcttcatatggctgctccagccccacttcttagcattcttactcctcttctggggctaatgtcagcatctatagacaatagactattaaaaaatcaccttttaaacaagaaacggaaggcatttgatgcagaatttttgcatgacaacatagaaataatttaaaaatagtgtttgttctgaatgttggtagacccttcatagctttgttacaatgaaaccttgaactgaaaatatttaataaaataacctttaaacagtca

SEQ ID NO: 300003 - DNA, 3733 bp, Homo sapiens
  misc_feature (19)..(19): n is a, c, g, or t
agcgggctgccgggctcanccccgtctcctcctcttgctccctcggccgggcggcggtgactgtgcaccgacgtcggcgcgggctgcaccgccgcgtccgcccgcccgccagcatggccaccaccgccacctgcacccgtttcaccgacgactaccagctcttcgaggagcttggcaagggtgctttctctgtggtccgcaggtgtgtgaagaaaacctccacgcaggagtacgcagcaaaaatcatcaataccaagaagttgtctgcccgggatcaccagaaactagaacgtgaggctcggatatgtcgacttctgaaacatccaaacatcgtgcgcctccatgacagtatttctgaagaagggtttcactacctcgtgtttgaccttgttaccggcggggagctgtttgaagacattgtggccagagagtactacagtgaagcagatgccagccactgtatacatcagattctggagagtgttaaccacatccaccagcatgacatcgtccacagggacctgaagcctgagaacctgctgctggcgagtaaatgcaagggtgccgccgtcaagctggctgattttggcctagccatcgaagtacagggagagcagcaggcttggtttggttttgctggcaccccaggttacttgtcccctgaggtcttgaggaaagatccctatggaaaacctgtggatatctgggcctgcggggtcatcctgtatatcctcctggtgggctatcctcccttctgggatgaggatcagcacaagctgtatcagcagatcaaggctggagcctatgatttcccatcaccagaatgggacacggtaactcctgaagccaagaacttgatcaaccagatgctgaccataaacccagcaaagcgcatcacggctgaccaggctctcaagcacccgtgggtctgtcaacgatccacggtggcatccatgatgcatcgtcaggagactgtggagtgtttgcgcaagttcaatgcccggagaaaactgaagggtgccatcctcacgaccatgcttgtctccaggaacttctcagctgccaaaagcctattgaacaagaagtcggatggcggtgtcaagccacagagcaacaacaaaaacagtctcgagccacaaaccactgtggtacacaacgctacagatgggatcaagggctccacagagagctgcaacaccaccacagaagatgaggacctcaaagctcggtgcctgaaggacggagctcccgggacagaacagccccctctgcaggcatgcagccccagccttctctctgctcctcagccatgcgaaaacaggagatcattaagattacagaacagctgattgaagccatcaacaatggggactttgaggcctacacgaagatttgtgatccaggcctcacttcctttgagcctgaggcccttggtaacctcgtggaggggatggatttccataagttttactttgagaatctcctgtccaagaacagcaagcctatccataccaccatcctaaacccacacgtccacgtgattggggaggacgcagcgtgcatcgcctacatccgcctcacccagtacatcgacgggcagggtcggcctcgcaccagccagtcagaagagacccgggtctggcaccgtcgggatggcaagtggctcaatgtccactatcactgctcaggggcccctgccgcaccgctgcagtgagctcagccacaggggctttaggagattccagccggaggtccaaccttcgcagccagtggctctggagggcctgagtgacagcggcagtcctgtttgtttgaggtttaaaacaattcaattacaaaagcggcagcagccaatgcacgcccctgcatgcagccctcccgcccgcccttcgtgtctgtctctgctgtaccgaggtgttttttacatttaagaaaaaaaaaaaaagaaaaaaagattgtttaaaaaaaaaaggaatccataccatgatgcgttttaaaaccaccgacagcccttgggttggcaagaaggcaggagtatgtatgaggtccatcctggcatgagcagtggctcacccaccggccttgaagaggtgagcttggcctctctggtccccatggacttagggggaccaggcaagaactctgacagagctttgggggccgtgatgtgattgcagctcctgaggtggcctgcttaccccaggtctaggaatgaacttctttggaacttgcataggcgcctagaatggggctgatgagaacatcgtgaccatcagacctacttgggagagaacgcagagctcccagcctgctgtggaggcagctgagaagtggtggcctcaggactgagagcccggacgttgctgtactgtcttgtttagtgtagaagggaagagaattggtgctgcagaagtgtacccgccatgaagccgatgagaaacctcgtgttagtctgacatgcactcactcatccatttctataggatgcacaatgcatgtgggccctaatattgaggccttatccctgcagctaggagggggaggggttgttgctgctttgcttcgtgttttcttctaacctggcaaggagagagccaggccctggtcagggctcccgtgccgcctttggcggttctgtttctgtgctgatctggaccatctttgtcttgccttttcacggtagtggtccccatgctgaccctcatctgggcctgggccctctgccaagtgcccctgtgggatgggaggagtgaggcagtgggagaagaggtggtggtcgtttctatgcattcaggctgcctttggggctgcctcccttcttattcttccttgctgcacgtccatctcttttcctgtctttgagattgacctgactgctctggcaagaagaagaggtgtccttacagaggcctctttactgaccaactgaagtatagacttactgctggacaatctgcatgggcatcacccctccccgcatgtaacccaaaagaggtgtccagagccaaggcttctaccttcattgtccctctctgtgctcaaggagttccattccaggaggaagagatctataccctaagcagatagcaaagaagataatggaggagcaattggtcatggccttggtttccctcaaaacaacgctgcagatttatctgcacaaacatctccacttttgggggaaaggtgggtagattccagttccctggactaccttcaggaggcacgagagctgggagaagaggcaaagctacaggtttacttgggagccagctgagaagagagcagactcacaggtgctggtgcttggatttagccaggctcctccgagcacctcatgcatgtcccagcccctgggccctagccctttcctgccctgcagtctgcagtgccagcacgcaaatcccttcaccacagggtttcgttttgctggcttgaagacaaatggtcttagaattcattgagacccatagcttcatatggctgctccagccccacttcttagcattcttactcctcttctggggctaatgtcagcatctatagacaatagactattaaaaaatcaccttttaaacaagaaacggaaggcatttgatgcagaatttttgcatgacaacatagaaataatttaaaaatagtgtttgttctgaatgttggtagacccttcatagctttgttacaatgaaaccttgaactgaaaatatttaataaaataacctttaaacagtca

SEQ ID NO: 300004 - DNA, 3761 bp, Homo sapiens
  misc_feature (19)..(19): n is a, c, g, or t
agcgggctgccgggctcanccccgtctcctcctcttgctccctcggccgggcggcggtgactgtgcaccgacgtcggcgcgggctgcaccgccgcgtccgcccgcccgccagcatggccaccaccgccacctgcacccgtttcaccgacgactaccagctcttcgaggagcttggcaagggtgctttctctgtggtccgcaggtgtgtgaagaaaacctccacgcaggagtacgcagcaaaaatcatcaataccaagaagttgtctgcccgggatcaccagaaactagaacgtgaggctcggatatgtcgacttctgaaacatccaaacatcgtgcgcctccatgacagtatttctgaagaagggtttcactacctcgtgtttgaccttgttaccggcggggagctgtttgaagacattgtggccagagagtactacagtgaagcagatgccagccactgtatacatcagattctggagagtgttaaccacatccaccagcatgacatcgtccacagggacctgaagcctgagaacctgctgctggcgagtaaatgcaagggtgccgccgtcaagctggctgattttggcctagccatcgaagtacagggagagcagcaggcttggtttggttttgctggcaccccaggttacttgtcccctgaggtcttgaggaaagatccctatggaaaacctgtggatatctgggcctgcggggtcatcctgtatatcctcctggtgggctatcctcccttctgggatgaggatcagcacaagctgtatcagcagatcaaggctggagcctatgatttcccatcaccagaatgggacacggtaactcctgaagccaagaacttgatcaaccagatgctgaccataaacccagcaaagcgcatcacggctgaccaggctctcaagcacccgtgggtctgtcaacgatccacggtggcatccatgatgcatcgtcaggagactgtggagtgtttgcgcaagttcaatgcccggagaaaactgaagggtgccatcctcacgaccatgcttgtctccaggaacttctcagctgccaaaagcctattgaacaagaagtcggatggcggtgtcaagccacagagcaacaacaaaaacagtctcgagccacaaaccactgtggtacacaacgctacagatgggatcaagggctccacagagagctgcaacaccaccacagaagatgaggacctcaaagctgccccgctccgcactgggaatggcagctcggtgcctgaaggacggagctcccgggacagaacagccccctctgcaggcatgcagccccagccttctctctgctcctcagccatgcgaaaacaggagatcattaagattacagaacagctgattgaagccatcaacaatggggactttgaggcctacacgaagatttgtgatccaggcctcacttcctttgagcctgaggcccttggtaacctcgtggaggggatggatttccataagttttactttgagaatctcctgtccaagaacagcaagcctatccataccaccatcctaaacccacacgtccacgtgattggggaggacgcagcgtgcatcgcctacatccgcctcacccagtacatcgacgggcagggtcggcctcgcaccagccagtcagaagagacccgggtctggcaccgtcgggatggcaagtggctcaatgtccactatcactgctcaggggcccctgccgcaccgctgcagtgagctcagccacaggggctttaggagattccagccggaggtccaaccttcgcagccagtggctctggagggcctgagtgacagcggcagtcctgtttgtttgaggtttaaaacaattcaattacaaaagcggcagcagccaatgcacgcccctgcatgcagccctcccgcccgcccttcgtgtctgtctctgctgtaccgaggtgttttttacatttaagaaaaaaaaaaaaagaaaaaaagattgtttaaaaaaaaaaggaatccataccatgatgcgttttaaaaccaccgacagcccttgggttggcaagaaggcaggagtatgtatgaggtccatcctggcatgagcagtggctcacccaccggccttgaagaggtgagcttggcctctctggtccccatggacttagggggaccaggcaagaactctgacagagctttgggggccgtgatgtgattgcagctcctgaggtggcctgcttaccccaggtctaggaatgaacttctttggaacttgcataggcgcctagaatggggctgatgagaacatcgtgaccatcagacctacttgggagagaacgcagagctcccagcctgctgtggaggcagctgagaagtggtggcctcaggactgagagcccggacgttgctgtactgtcttgtttagtgtagaagggaagagaattggtgctgcagaagtgtacccgccatgaagccgatgagaaacctcgtgttagtctgacatgcactcactcatccatttctataggatgcacaatgcatgtgggccctaatattgaggccttatccctgcagctaggagggggaggggttgttgctgctttgcttcgtgttttcttctaacctggcaaggagagagccaggccctggtcagggctcccgtgccgcctttggcggttctgtttctgtgctgatctggaccatctttgtcttgccttttcacggtagtggtccccatgctgaccctcatctgggcctgggccctctgccaagtgcccctgtgggatgggaggagtgaggcagtgggagaagaggtggtggtcgtttctatgcattcaggctgcctttggggctgcctcccttcttattcttccttgctgcacgtccatctcttttcctgtctttgagattgacctgactgctctggcaagaagaagaggtgtccttacagaggcctctttactgaccaactgaagtatagacttactgctggacaatctgcatgggcatcacccctccccgcatgtaacccaaaagaggtgtccagagccaaggcttctaccttcattgtccctctctgtgctcaaggagttccattccaggaggaagagatctataccctaagcagatagcaaagaagataatggaggagcaattggtcatggccttggtttccctcaaaacaacgctgcagatttatctgcacaaacatctccacttttgggggaaaggtgggtagattccagttccctggactaccttcaggaggcacgagagctgggagaagaggcaaagctacaggtttacttgggagccagctgagaagagagcagactcacaggtgctggtgcttggatttagccaggctcctccgagcacctcatgcatgtcccagcccctgggccctagccctttcctgccctgcagtctgcagtgccagcacgcaaatcccttcaccacagggtttcgttttgctggcttgaagacaaatggtcttagaattcattgagacccatagcttcatatggctgctccagccccacttcttagcattcttactcctcttctggggctaatgtcagcatctatagacaatagactattaaaaaatcaccttttaaacaagaaacggaaggcatttgatgcagaatttttgcatgacaacatagaaataatttaaaaatagtgtttgttctgaatgttggtagacccttcatagctttgttacaatgaaaccttgaactgaaaatatttaataaaataacctttaaacagtca

SEQ ID NO: 300005 - DNA, 3752 bp, Homo sapiens
  misc_feature (19)..(19): n is a, c, g, or t
agcgggctgccgggctcanccccgtctcctcctcttgctccctcggccgggcggcggtgactgtgcaccgacgtcggcgcgggctgcaccgccgcgtccgcccgcccgccagcatggccaccaccgccacctgcacccgtttcaccgacgactaccagctcttcgaggagcttggcaagggtgctttctctgtggtccgcaggtgtgtgaagaaaacctccacgcaggagtacgcagcaaaaatcatcaataccaagaagttgtctgcccgggatcaccagaaactagaacgtgaggctcggatatgtcgacttctgaaacatccaaacatcgtgcgcctccatgacagtatttctgaagaagggtttcactacctcgtgtttgaccttgttaccggcggggagctgtttgaagacattgtggccagagagtactacagtgaagcagatgccagccactgtatacatcagattctggagagtgttaaccacatccaccagcatgacatcgtccacagggacctgaagcctgagaacctgctgctggcgagtaaatgcaagggtgccgccgtcaagctggctgattttggcctagccatcgaagtacagggagagcagcaggcttggtttggttttgctggcaccccaggttacttgtcccctgaggtcttgaggaaagatccctatggaaaacctgtggatatctgggcctgcggggtcatcctgtatatcctcctggtgggctatcctcccttctgggatgaggatcagcacaagctgtatcagcagatcaaggctggagcctatgatttcccatcaccagaatgggacacggtaactcctgaagccaagaacttgatcaaccagatgctgaccataaacccagcaaagcgcatcacggctgaccaggctctcaagcacccgtgggtctgtcaacgatccacggtggcatccatgatgcatcgtcaggagactgtggagtgtttgcgcaagttcaatgcccggagaaaactgaagggtgccatcctcacgaccatgcttgtctccaggaacttctcagttggcaggcagagctccgcccccgcctcgcctgccgcgagcgccgccggcctggccgggcaagctgccaaaagcctattgaacaagaagtcggatggcggtgtcaagccacagagcaacaacaaaaacagtctcgtaagcccagcccaagagcccgcgcccttgcagacggccatggagccacaaaccactgtggtacacaacgctacagatgggatcaagggctccacagagagctgcaacaccaccacagaagatgaggacctcaaagtgcgaaaacaggagatcattaagattacagaacagctgattgaagccatcaacaatggggactttgaggcctacacgaagatttgtgatccaggcctcacttcctttgagcctgaggcccttggtaacctcgtggaggggatggatttccataagttttactttgagaatctcctgtccaagaacagcaagcctatccataccaccatcctaaacccacacgtccacgtgattggggaggacgcagcgtgcatcgcctacatccgcctcacccagtacatcgacgggcagggtcggcctcgcaccagccagtcagaagagacccgggtctggcaccgtcgggatggcaagtggctcaatgtccactatcactgctcaggggcccctgccgcaccgctgcagtgagctcagccacaggggctttaggagattccagccggaggtccaaccttcgcagccagtggctctggagggcctgagtgacagcggcagtcctgtttgtttgaggtttaaaacaattcaattacaaaagcggcagcagccaatgcacgcccctgcatgcagccctcccgcccgcccttcgtgtctgtctctgctgtaccgaggtgttttttacatttaagaaaaaaaaaaaaagaaaaaaagattgtttaaaaaaaaaaggaatccataccatgatgcgttttaaaaccaccgacagcccttgggttggcaagaaggcaggagtatgtatgaggtccatcctggcatgagcagtggctcacccaccggccttgaagaggtgagcttggcctctctggtccccatggacttagggggaccaggcaagaactctgacagagctttgggggccgtgatgtgattgcagctcctgaggtggcctgcttaccccaggtctaggaatgaacttctttggaacttgcataggcgcctagaatggggctgatgagaacatcgtgaccatcagacctacttgggagagaacgcagagctcccagcctgctgtggaggcagctgagaagtggtggcctcaggactgagagcccggacgttgctgtactgtcttgtttagtgtagaagggaagagaattggtgctgcagaagtgtacccgccatgaagccgatgagaaacctcgtgttagtctgacatgcactcactcatccatttctataggatgcacaatgcatgtgggccctaatattgaggccttatccctgcagctaggagggggaggggttgttgctgctttgcttcgtgttttcttctaacctggcaaggagagagccaggccctggtcagggctcccgtgccgcctttggcggttctgtttctgtgctgatctggaccatctttgtcttgccttttcacggtagtggtccccatgctgaccctcatctgggcctgggccctctgccaagtgcccctgtgggatgggaggagtgaggcagtgggagaagaggtggtggtcgtttctatgcattcaggctgcctttggggctgcctcccttcttattcttccttgctgcacgtccatctcttttcctgtctttgagattgacctgactgctctggcaagaagaagaggtgtccttacagaggcctctttactgaccaactgaagtatagacttactgctggacaatctgcatgggcatcacccctccccgcatgtaacccaaaagaggtgtccagagccaaggcttctaccttcattgtccctctctgtgctcaaggagttccattccaggaggaagagatctataccctaagcagatagcaaagaagataatggaggagcaattggtcatggccttggtttccctcaaaacaacgctgcagatttatctgcacaaacatctccacttttgggggaaaggtgggtagattccagttccctggactaccttcaggaggcacgagagctgggagaagaggcaaagctacaggtttacttgggagccagctgagaagagagcagactcacaggtgctggtgcttggatttagccaggctcctccgagcacctcatgcatgtcccagcccctgggccctagccctttcctgccctgcagtctgcagtgccagcacgcaaatcccttcaccacagggtttcgttttgctggcttgaagacaaatggtcttagaattcattgagacccatagcttcatatggctgctccagccccacttcttagcattcttactcctcttctggggctaatgtcagcatctatagacaatagactattaaaaaatcaccttttaaacaagaaacggaaggcatttgatgcagaatttttgcatgacaacatagaaataatttaaaaatagtgtttgttctgaatgttggtagacccttcatagctttgttacaatgaaaccttgaactgaaaatatttaataaaataacctttaaacagtca

SEQ ID NO: 300006 - DNA, 3576 bp, Homo sapiens
  misc_feature (19)..(19): n is a, c, g, or t
agcgggctgccgggctcanccccgtctcctcctcttgctccctcggccgggcggcggtgactgtgcaccgacgtcggcgcgggctgcaccgccgcgtccgcccgcccgccagcatggccaccaccgccacctgcacccgtttcaccgacgactaccagctcttcgaggagcttggcaagggtgctttctctgtggtccgcaggtgtgtgaagaaaacctccacgcaggagtacgcagcaaaaatcatcaataccaagaagttgtctgcccgggatcaccagaaactagaacgtgaggctcggatatgtcgacttctgaaacatccaaacatcgtgcgcctccatgacagtatttctgaagaagggtttcactacctcgtgtttgaccttgttaccggcggggagctgtttgaagacattgtggccagagagtactacagtgaagcagatgccagccactgtatacatcagattctggagagtgttaaccacatccaccagcatgacatcgtccacagggacctgaagcctgagaacctgctgctggcgagtaaatgcaagggtgccgccgtcaagctggctgattttggcctagccatcgaagtacagggagagcagcaggcttggtttggttttgctggcaccccaggttacttgtcccctgaggtcttgaggaaagatccctatggaaaacctgtggatatctgggcctgcggggtcatcctgtatatcctcctggtgggctatcctcccttctgggatgaggatcagcacaagctgtatcagcagatcaaggctggagcctatgatttcccatcaccagaatgggacacggtaactcctgaagccaagaacttgatcaaccagatgctgaccataaacccagcaaagcgcatcacggctgaccaggctctcaagcacccgtgggtctgtcaacgatccacggtggcatccatgatgcatcgtcaggagactgtggagtgtttgcgcaagttcaatgcccggagaaaactgaagggtgccatcctcacgaccatgcttgtctccaggaacttctcagctgccaaaagcctattgaacaagaagtcggatggcggtgtcaagccacagagcaacaacaaaaacagtctcgtaagcccagcccaagagcccgcgcccttgcagacggccatggagccacaaaccactgtggtacacaacgctacagatgggatcaagggctccacagagagctgcaacaccaccacagaagatgaggacctcaaagtgcgaaaacaggagatcattaagattacagaacagctgattgaagccatcaacaatggggactttgaggcctacacgaagatttgtgatccaggcctcacttcctttgagcctgaggcccttggtaacctcgtggaggggatggatttccataagttttactttgagaatctcctgtccaagaacagcaagcctatccataccaccatcctaaacccacacgtccacgtgattggggaggacgcagcgtgcatcgcctacatccgcctcacccagtacatcgacgggcagggtcggcctcgcaccagccagtcagaagagacccgggtctggcaccgtcgggatggcaagtggctcaatgtccactatcactgctcaggggcccctgccgcaccgctgcagtgagctcagccacaggggctttaggagattccagccggaggtccaaccttcgcagccagtggctctggagggcctgagtgacagcggcagtcctgtttgtttgaggtttaaaacaattcaattacaaaagcggcagcagccaatgcacgcccctgcatgcagccctcccgcccgcccttcgtgtctgtctctgctgtaccgaggtgttttttacatttaagaaaaaaaaaaaaagaaaaaaagattgtttaaaaaaaaaaggaatccataccatgatgcgttttaaaaccaccgacagcccttgggttggcaagaaggcaggagtatgtatgaggtccatcctggcatgagcagtggctcacccaccggccttgaagaggtctaggaatgaacttctttggaacttgcataggcgcctagaatggggctgatgagaacatcgtgaccatcagacctacttgggagagaacgcagagctcccagcctgctgtggaggcagctgagaagtggtggcctcaggactgagagcccggacgttgctgtactgtcttgtttagtgtagaagggaagagaattggtgctgcagaagtgtacccgccatgaagccgatgagaaacctcgtgttagtctgacatgcactcactcatccatttctataggatgcacaatgcatgtgggccctaatattgaggccttatccctgcagctaggagggggaggggttgttgctgctttgcttcgtgttttcttctaacctggcaaggagagagccaggccctggtcagggctcccgtgccgcctttggcggttctgtttctgtgctgatctggaccatctttgtcttgccttttcacggtagtggtccccatgctgaccctcatctgggcctgggccctctgccaagtgcccctgtgggatgggaggagtgaggcagtgggagaagaggtggtggtcgtttctatgcattcaggctgcctttggggctgcctcccttcttattcttccttgctgcacgtccatctcttttcctgtctttgagattgacctgactgctctggcaagaagaagaggtgtccttacagaggcctctttactgaccaactgaagtatagacttactgctggacaatctgcatgggcatcacccctccccgcatgtaacccaaaagaggtgtccagagccaaggcttctaccttcattgtccctctctgtgctcaaggagttccattccaggaggaagagatctataccctaagcagatagcaaagaagataatggaggagcaattggtcatggccttggtttccctcaaaacaacgctgcagatttatctgcacaaacatctccacttttgggggaaaggtgggtagattccagttccctggactaccttcaggaggcacgagagctgggagaagaggcaaagctacaggtttacttgggagccagctgagaagagagcagactcacaggtgctggtgcttggatttagccaggctcctccgagcacctcatgcatgtcccagcccctgggccctagccctttcctgccctgcagtctgcagtgccagcacgcaaatcccttcaccacagggtttcgttttgctggcttgaagacaaatggtcttagaattcattgagacccatagcttcatatggctgctccagccccacttcttagcattcttactcctcttctggggctaatgtcagcatctatagacaatagactattaaaaaatcaccttttaaacaagaaacggaaggcatttgatgcagaatttttgcatgacaacatagaaataatttaaaaatagtgtttgttctgaatgttggtagacccttcatagctttgttacaatgaaaccttgaactgaaaatatttaataaaataacctttaaacagtca

SEQ ID NO: 300007 - DNA, 4085 bp, Homo sapiens
  misc_feature (19)..(19): n is a, c, g, or t
agcgggctgccgggctcanccccgtctcctcctcttgctccctcggccgggcggcggtgactgtgcaccgacgtcggcgcgggctgcaccgccgcgtccgcccgcccgccagcatggccaccaccgccacctgcacccgtttcaccgacgactaccagctcttcgaggagcttggcaagggtgctttctctgtggtccgcaggtgtgtgaagaaaacctccacgcaggagtacgcagcaaaaatcatcaataccaagaagttgtctgcccgggatcaccagaaactagaacgtgaggctcggatatgtcgacttctgaaacatccaaacatcgtgcgcctccatgacagtatttctgaagaagggtttcactacctcgtgtttgaccttgttaccggcggggagctgtttgaagacattgtggccagagagtactacagtgaagcagatgccagccactgtatacatcagattctggagagtgttaaccacatccaccagcatgacatcgtccacagggacctgaagcctgagaacctgctgctggcgagtaaatgcaagggtgccgccgtcaagctggctgattttggcctagccatcgaagtacagggagagcagcaggcttggtttggttttgctggcaccccaggttacttgtcccctgaggtcttgaggaaagatccctatggaaaacctgtggatatctgggcctgcggggtcatcctgtatatcctcctggtgggctatcctcccttctgggatgaggatcagcacaagctgtatcagcagatcaaggctggagcctatgatttcccatcaccagaatgggacacggtaactcctgaagccaagaacttgatcaaccagatgctgaccataaacccagcaaagcgcatcacggctgaccaggctctcaagcacccgtgggtctgtcaacgatccacggtggcatccatgatgcatcgtcaggagactgtggagtgtttgcgcaagttcaatgcccggagaaaactgaagggtgccatcctcacgaccatgcttgtctccaggaacttctcagctgccaaaagcctattgaacaagaagtcggatggcggtgtcaagccacagagcaacaacaaaaacagtctcgtaagcccagcccaagagcccgcgcccttgcagacggccatggagccacaaaccactgtggtacacaacgctacagatgggatcaagggctccacagagagctgcaacaccaccacagaagatgaggacctcaaagtgcgaaaacaggagatcattaagattacagaacagctgattgaagccatcaacaatggggactttgaggcctacacgaagatttgtgatccaggcctcacttcctttgagcctgaggcccttggtaacctcgtggaggggatggatttccataagttttactttgagaatctcctgtccaagaacagcaagcctatccataccaccatcctaaacccacacgtccacgtgattggggaggacgcagcgtgcatcgcctacatccgcctcacccagtacatcgacgggcagggtcggcctcgcaccagccagtcagaagagacccgggtctggcaccgtcgggatggcaagtggctcaatgtccactatcactgctcaggggcccctgccgcaccgctgcagtgagctcagccacaggggctttaggagattccagccggaggtccaaccttcgcagccagtggctctggagggcctgagtgacagcggcagtcctgtttgtttgaggtttaaaacaattcaattacaaaagcggcagcagccaatgcacgcccctgcatgcagccctcccgcccgcccttcgtgtctgtctctgctgtaccgaggtgttttttacatttaagaaaaaaaaaaaaagaaaaaaagattgtttaaaaaaaaaaggaatccataccatgatgcgttttaaaaccaccgacagcccttgggttggcaagaaggcaggagtatgtatgaggtccatcctggcatgagcagtggctcacccaccggccttgaagaggtgagcttggcctctctggtccccatggacttagggggaccaggcaagaactctgacagagctttgggggccgtgatgtgattgcagctcctgaggtggcctgcttaccccaggtctaggaatgaacttctttggaacttgcataggcgcctagaatggggctgatgagaacatcgtgaccatcagacctacttgggagagaacgcagagctcccagcctgctgtggaggcagctgagaagtggtggcctcaggactgagagcccggacgttgctgtactgtcttgtttagtgtagaagggaagagaattggtgctgcagaagtgtacccgccatgaagccgatgagaaacctcgtgttagtctgacatgcactcactcatccatttctataggatgcacaatgcatgtgggccctaatattgaggccttatccctgcagctaggagggggaggggttgttgctgctttgcttcgtgttttcttctaacctggcaaggagagagccaggccctggtcagggctcccgtgccgcctttggcggttctgtttctgtgctgatctggaccatctttgtcttgccttttcacggtagtggtccccatgctgaccctcatctgggcctgggccctctgccaagtgcccctgtgggatgggaggagtgaggcagtgggagaagaggtggtggtcgtttctatgcattcaggctgcctttggggctgcctcccttcttattcttccttgctgcacgtccatctcttttcctgtctttgagattgacctgactgctctggcaagaagaagaggtgtccttacagaggcctctttactgaccaactgaagtatagacttactgctggacaatctgcatgggcatcacccctccccgcatgtaacccaaaagaggtgtccagagccaaggcttctaccttcattgtccctctctgtgctcaaggagttccattccaggaggaagagatctataccctaagcagatagcaaagaagataatggaggagcaattggtcatggccttggtttccctcaaaacaacgctgcagatttatctgcacaaacatctccacttttgggggaaaggtgggtagattccagttccctggactaccttcaggaggcacgagagctgggagaagaggcaaagctacaggtttacttgggagccagctgagaagagagcagactcacaggtgctggtgcttggatttagccaggctcctccgagcacctcatgcatgtcccagcccctgggccctagccctttcctgccctgcagtctgcagtgccagcacgcaaatcccttcaccacagggtttcgttttgctggcttgaagacaaatggtcttagaattcattgagacccatagcttcatatggctgctccagccccacttcttagcattcttactcctcttctggggctaatgtcagcatctatagacaatagactattaaaaaatcaccttttaaacaagaaacggaaggcatttgatgcagaatttttgcatgacaacatagaaataatttaaaaatagtgtttgttctgaatgttggtagacccttcatagctttgttacaatgaaaccttgaactgaaaatatttaataaaataacctttaaacagtcaaaaaaaaaactgctgttggaggtttacggccagaggcgtagattttagcagcctggcttaccaggttggagagagtacctcctcctactccctttgggtacttttgagaataaaacttcctcatgcctgtaatcccagtactttgggaggccgacgcgggcgaatcacgaggtcaggagttcgagaccagcctggctaatatggtgaaaccccgtctctactaaaaaatacaaaaaatttagctgggcatagtggcgggcgcctgtaatcccagctgctcggaaggctgaggcaggagaatcgcttgaacctgggagggggaggttgcagtgagccgaggtcgcgccactgcactccagcccaggcgacagagtgagactccgtctcaaaaaaaaa

SEQ ID NO: 300008 - DNA, 3690 bp, Homo sapiens
tggtcgagccggctacctattggttggacgaccgacgactaccagctcttcgaggagcttggcaagggtgctttctctgtggtccgcaggtgtgtgaagaaaacctccacgcaggagtacgcagcaaaaatcatcaataccaagaagttgtctgcccgggatcaccagaaactagaacgtgaggctcggatatgtcgacttctgaaacatccaaacatcgtgcgcctccatgacagtatttctgaagaagggtttcactacctcgtgtttgaccttgttaccggcggggagctgtttgaagacattgtggccagagagtactacagtgaagcagatgccagccactgtatacatcagattctggagagtgttaaccacatccaccagcatgacatcgtccacagggacctgaagcctgagaacctgctgctggcgagtaaatgcaagggtgccgccgtcaagctggctgattttggcctagccatcgaagtacagggagagcagcaggcttggtttggttttgctggcaccccaggttacttgtcccctgaggtcttgaggaaagatccctatggaaaacctgtggatatctgggcctgcggggtcatcctgtatatcctcctggtgggctatcctcccttctgggatgaggatcagcacaagctgtatcagcagatcaaggctggagcctatgatttcccatcaccagaatgggacacggtaactcctgaagccaagaacttgatcaaccagatgctgaccataaacccagcaaagcgcatcacggctgaccaggctctcaagcacccgtgggtctgtcaacgatccacggtggcatccatgatgcatcgtcaggagactgtggagtgtttgcgcaagttcaatgcccggagaaaactgaagggtgccatcctcacgaccatgcttgtctccaggaacttctcagctgccaaaagcctattgaacaagaagtcggatggcggtgtcaagccacagagcaacaacaaaaacagtctcgtaagcccagcccaagagcccgcgcccttgcagacggccatggagccacaaaccactgtggtacacaacgctacagatgggatcaagggctccacagagagctgcaacaccaccacagaagatgaggacctcaaagctgccccgctccgcactgggaatggcagctcggtgcctgaaggacggagctcccgggacagaacagccccctctgcaggcatgcagccccagccttctctctgctcctcagccatgcgaaaacaggagatcattaagattacagaacagctgattgaagccatcaacaatggggactttgaggcctacacgaagatttgtgatccaggcctcacttcctttgagcctgaggcccttggtaacctcgtggaggggatggatttccataagttttactttgagaatctcctgtccaagaacagcaagcctatccataccaccatcctaaacccacacgtccacgtgattggggaggacgcagcgtgcatcgcctacatccgcctcacccagtacatcgacgggcagggtcggcctcgcaccagccagtcagaagagacccgggtctggcaccgtcgggatggcaagtggctcaatgtccactatcactgctcaggggcccctgccgcaccgctgcagtgagctcagccacaggggctttaggagattccagccggaggtccaaccttcgcagccagtggctctggagggcctgagtgacagcggcagtcctgtttgtttgaggtttaaaacaattcaattacaaaagcggcagcagccaatgcacgcccctgcatgcagccctcccgcccgcccttcgtgtctgtctctgctgtaccgaggtgttttttacatttaagaaaaaaaaaaaaagaaaaaaagattgtttaaaaaaaaaaggaatccataccatgatgcgttttaaaaccaccgacagcccttgggttggcaagaaggcaggagtatgtatgaggtccatcctggcatgagcagtggctcacccaccggccttgaagaggtgagcttggcctctctggtccccatggacttagggggaccaggcaagaactctgacagagctttgggggccgtgatgtgattgcagctcctgaggtggcctgcttaccccaggtctaggaatgaacttctttggaacttgcataggcgcctagaatggggctgatgagaacatcgtgaccatcagacctacttgggagagaacgcagagctcccagcctgctgtggaggcagctgagaagtggtggcctcaggactgagagcccggacgttgctgtactgtcttgtttagtgtagaagggaagagaattggtgctgcagaagtgtacccgccatgaagccgatgagaaacctcgtgttagtctgacatgcactcactcatccatttctataggatgcacaatgcatgtgggccctaatattgaggccttatccctgcagctaggagggggaggggttgttgctgctttgcttcgtgttttcttctaacctggcaaggagagagccaggccctggtcagggctcccgtgccgcctttggcggttctgtttctgtgctgatctggaccatctttgtcttgccttttcacggtagtggtccccatgctgaccctcatctgggcctgggccctctgccaagtgcccctgtgggatgggaggagtgaggcagtgggagaagaggtggtggtcgtttctatgcattcaggctgcctttggggctgcctcccttcttattcttccttgctgcacgtccatctcttttcctgtctttgagattgacctgactgctctggcaagaagaagaggtgtccttacagaggcctctttactgaccaactgaagtatagacttactgctggacaatctgcatgggcatcacccctccccgcatgtaacccaaaagaggtgtccagagccaaggcttctaccttcattgtccctctctgtgctcaaggagttccattccaggaggaagagatctataccctaagcagatagcaaagaagataatggaggagcaattggtcatggccttggtttccctcaaaacaacgctgcagatttatctgcacaaacatctccacttttgggggaaaggtgggtagattccagttccctggactaccttcaggaggcacgagagctgggagaagaggcaaagctacaggtttacttgggagccagctgagaagagagcagactcacaggtgctggtgcttggatttagccaggctcctccgagcacctcatgcatgtcccagcccctgggccctagccctttcctgccctgcagtctgcagtgccagcacgcaaatcccttcaccacagggtttcgttttgctggcttgaagacaaatggtcttagaattcattgagacccatagcttcatatggctgctccagccccacttcttagcattcttactcctcttctggggctaatgtcagcatctatagacaatagactattaaaaaatcaccttttaaacaagaaacggaaggcatttgatgcagaatttttgcatgacaacatagaaataatttaaaaatagtgtttgttctgaatgttggtagacccttcatagctttgttacaatgaaaccttgaactgaaaatatttaataaaataacctttaaacagtca

SEQ ID NO: 300009 - DNA, 3712 bp, Homo sapiens
  misc_feature (49)..(49): n is a, c, g, or t
gtttcgagaggatcccccccccgagccacgggccgcccctttcacccgnttcaccgacgactaccagctcttcgaggagcttggcaagggtgctttctctgtggtccgcaggtgtgtgaagaaaacctccacgcaggagtacgcagcaaaaatcatcaataccaagaagttgtctgcccgggatcaccagaaactagaacgtgaggctcggatatgtcgacttctgaaacatccaaacatcgtgcgcctccatgacagtatttctgaagaagggtttcactacctcgtgtttgaccttgttaccggcggggagctgtttgaagacattgtggccagagagtactacagtgaagcagatgccagccactgtatacatcagattctggagagtgttaaccacatccaccagcatgacatcgtccacagggacctgaagcctgagaacctgctgctggcgagtaaatgcaagggtgccgccgtcaagctggctgattttggcctagccatcgaagtacagggagagcagcaggcttggtttggttttgctggcaccccaggttacttgtcccctgaggtcttgaggaaagatccctatggaaaacctgtggatatctgggcctgcggggtcatcctgtatatcctcctggtgggctatcctcccttctgggatgaggatcagcacaagctgtatcagcagatcaaggctggagcctatgatttcccatcaccagaatgggacacggtaactcctgaagccaagaacttgatcaaccagatgctgaccataaacccagcaaagcgcatcacggctgaccaggctctcaagcacccgtgggtctgtcaacgatccacggtggcatccatgatgcatcgtcaggagactgtggagtgtttgcgcaagttcaatgcccggagaaaactgaagggtgccatcctcacgaccatgcttgtctccaggaacttctcagctgccaaaagcctattgaacaagaagtcggatggcggtgtcaagccacagagcaacaacaaaaacagtctcgtaagcccagcccaagagcccgcgcccttgcagacggccatggagccacaaaccactgtggtacacaacgctacagatgggatcaagggctccacagagagctgcaacaccaccacagaagatgaggacctcaaagctgccccgctccgcactgggaatggcagctcggtgcctgaaggacggagctcccgggacagaacagccccctctgcaggcatgcagccccagccttctctctgctcctcagccatgcgaaaacaggagatcattaagattacagaacagctgattgaagccatcaacaatggggactttgaggcctacacgaagatttgtgatccaggcctcacttcctttgagcctgaggcccttggtaacctcgtggaggggatggatttccataagttttactttgagaatctcctgtccaagaacagcaagcctatccataccaccatcctaaacccacacgtccacgtgattggggaggacgcagcgtgcatcgcctacatccgcctcacccagtacatcgacgggcagggtcggcctcgcaccagccagtcagaagagacccgggtctggcaccgtcgggatggcaagtggctcaatgtccactatcactgctcaggggcccctgccgcaccgctgcagtgagctcagccacaggggctttaggagattccagccggaggtccaaccttcgcagccagtggctctggagggcctgagtgacagcggcagtcctgtttgtttgaggtttaaaacaattcaattacaaaagcggcagcagccaatgcacgcccctgcatgcagccctcccgcccgcccttcgtgtctgtctctgctgtaccgaggtgttttttacatttaagaaaaaaaaaaaaagaaaaaaagattgtttaaaaaaaaaaggaatccataccatgatgcgttttaaaaccaccgacagcccttgggttggcaagaaggcaggagtatgtatgaggtccatcctggcatgagcagtggctcacccaccggccttgaagaggtgagcttggcctctctggtccccatggacttagggggaccaggcaagaactctgacagagctttgggggccgtgatgtgattgcagctcctgaggtggcctgcttaccccaggtctaggaatgaacttctttggaacttgcataggcgcctagaatggggctgatgagaacatcgtgaccatcagacctacttgggagagaacgcagagctcccagcctgctgtggaggcagctgagaagtggtggcctcaggactgagagcccggacgttgctgtactgtcttgtttagtgtagaagggaagagaattggtgctgcagaagtgtacccgccatgaagccgatgagaaacctcgtgttagtctgacatgcactcactcatccatttctataggatgcacaatgcatgtgggccctaatattgaggccttatccctgcagctaggagggggaggggttgttgctgctttgcttcgtgttttcttctaacctggcaaggagagagccaggccctggtcagggctcccgtgccgcctttggcggttctgtttctgtgctgatctggaccatctttgtcttgccttttcacggtagtggtccccatgctgaccctcatctgggcctgggccctctgccaagtgcccctgtgggatgggaggagtgaggcagtgggagaagaggtggtggtcgtttctatgcattcaggctgcctttggggctgcctcccttcttattcttccttgctgcacgtccatctcttttcctgtctttgagattgacctgactgctctggcaagaagaagaggtgtccttacagaggcctctttactgaccaactgaagtatagacttactgctggacaatctgcatgggcatcacccctccccgcatgtaacccaaaagaggtgtccagagccaaggcttctaccttcattgtccctctctgtgctcaaggagttccattccaggaggaagagatctataccctaagcagatagcaaagaagataatggaggagcaattggtcatggccttggtttccctcaaaacaacgctgcagatttatctgcacaaacatctccacttttgggggaaaggtgggtagattccagttccctggactaccttcaggaggcacgagagctgggagaagaggcaaagctacaggtttacttgggagccagctgagaagagagcagactcacaggtgctggtgcttggatttagccaggctcctccgagcacctcatgcatgtcccagcccctgggccctagccctttcctgccctgcagtctgcagtgccagcacgcaaatcccttcaccacagggtttcgttttgctggcttgaagacaaatggtcttagaattcattgagacccatagcttcatatggctgctccagccccacttcttagcattcttactcctcttctggggctaatgtcagcatctatagacaatagactattaaaaaatcaccttttaaacaagaaacggaaggcatttgatgcagaatttttgcatgacaacatagaaataatttaaaaatagtgtttgttctgaatgttggtagacccttcatagctttgttacaatgaaaccttgaactgaaaatatttaataaaataacctttaaacagtca

SEQ ID NO: 300010 - DNA, 4169 bp, Homo sapiens
gtcggcaggctactggacttctcgtgtctgtctctgctgtacgaggtgttttttacatttaagaaaaaaacaaaaagaaacaacacgattgtttacaaaaaaagggactccataccatgatgcgttttaaaaccaccgacagcccttgggttggcaagaaggcaggagtatgtatgaggtccatcctggcatgagcagtggctcacccaccggccttgaagaggtgagcttggcctctctggtccccatggacttagggggaccaggcaagaactctgacagagctttgggggccgtgatgtgattgcagctcctgaggtggcctgcttaccccaggtctaggaatgaacttctttggaacttgcataggcgcctagaatggggctgatgagaacatcgtgaccatcagacctacttgctcctcttgctccctcggccgggcggcggtgactgtgcaccgacgtcggcgcgggctgcaccgccgcgtccgcccgcccgccagcatggccaccaccgccacctgcacccgtttcaccgacgactaccagctcttcgaggagcttggcaagtgtgtgaagaaaacctccacgcaggagtacgcagcaaaaatcatcaataccaagaagttgtctgcccgggatcaccagaaactagaacgtgaggctcggatatgtcgacttctgaaacatccaaacatcgtgcgcctccatgacagtatttctgaagaagggtttcactacctcgtgtttgaccttgttaccggcggggagctgtttgaagacattgtggccagagagtactacagtgaagcagatgccagccactgtatacatcagattctggagagtgttaaccacatccaccagcatgacatcgtccacagggacctgaagcctgagaacctgctgctggcgagtaaatgcaagggtgccgccgtcaagctggctgattttggcctagccatcgaagtacagggagagcagcaggcttggtttggttttgctggcaccccaggttacttgtcccctgaggtcttgaggaaagatccctatggaaaacctgtggatatctgggcctgcggggtcatcctgtatatcctcctggtgggctatcctcccttctgggatgaggatcagcacaagctgtatcagcagatcaaggctggagcctatgatttcccatcaccagaatgggacacggtaactcctgaagccaagaacttgatcaaccagatgctgaccataaacccagcaaagcgcatcacggctgaccaggctctcaagcacccgtgggtctgtcaacgatccacggtggcatccatgatgcatcgtcaggagactgtggagtgtttgcgcaagttcaatgcccggagaaaactgaagggtgccatcctcacgaccatgcttgtctccaggaacttctcagctgccaaaagcctattgaacaagaagtcggatggcggtgtcaagccacagagcaacaacaaaaacagtctcgtaagcccagcccaagagcccgcgcccttgcagacggccatggagccacaaaccactgtggtacacaacgctacagatgggatcaagggctccacagagagctgcaacaccaccacagaagatgaggacctcaaagctgccccgctccgcactgggaatggcagctcggtgcctgaaggacggagctcccgggacagaacagccccctctgcaggcatgcagccccagccttctctctgctcctcagccatgcgaaaacaggagatcattaagattacagaacagctgattgaagccatcaacaatggggactttgaggcctacacgaagatttgtgatccaggcctcacttcctttgagcctgaggcccttggtaacctcgtggaggggatggatttccataagttttactttgagaatctcctgtccaagaacagcaagcctatccataccaccatcctaaacccacacgtccacgtgattggggaggacgcagcgtgcatcgcctacatccgcctcacccagtacatcgacgggcagggtcggcctcgcaccagccagtcagaagagacccgggtctggcaccgtcgggatggcaagtggctcaatgtccactatcactgctcaggggcccctgccgcaccgctgcagtgagctcagccacaggggctttaggagattccagccggaggtccaaccttcgcagccagtggctctggagggcctgagtgacagcggcagtcctgtttgtttgaggtttaaaacaattcaattacaaaagcggcagcagccaatgcacgcccctgcatgcagccctcccgcccgcccttcgtgtctgtctctgctgtaccgaggtgttttttacatttaagaaaaaaaaaaaaagaaaaaaagattgtttaaaaaaaaaaggaatccataccatgatgcgttttaaaaccaccgacagcccttgggttggcaagaaggcaggagtatgtatgaggtccatcctggcatgagcagtggctcacccaccggccttgaagaggtgagcttggcctctctggtccccatggacttagggggaccaggcaagaactctgacagagctttgggggccgtgatgtgattgcagctcctgaggtggcctgcttaccccaggtctaggaatgaacttctttggaacttgcataggcgcctagaatggggctgatgagaacatcgtgaccatcagacctacttgggagagaacgcagagctcccagcctgctgtggaggcagctgagaagtggtggcctcaggactgagagcccggacgttgctgtactgtcttgtttagtgtagaagggaagagaattggtgctgcagaagtgtacccgccatgaagccgatgagaaacctcgtgttagtctgacatgcactcactcatccatttctataggatgcacaatgcatgtgggccctaatattgaggccttatccctgcagctaggagggggaggggttgttgctgctttgcttcgtgttttcttctaacctggcaaggagagagccaggccctggtcagggctcccgtgccgcctttggcggttctgtttctgtgctgatctggaccatctttgtcttgccttttcacggtagtggtccccatgctgaccctcatctgggcctgggccctctgccaagtgcccctgtgggatgggaggagtgaggcagtgggagaagaggtggtggtcgtttctatgcattcaggctgcctttggggctgcctcccttcttattcttccttgctgcacgtccatctcttttcctgtctttgagattgacctgactgctctggcaagaagaagaggtgtccttacagaggcctctttactgaccaactgaagtatagacttactgctggacaatctgcatgggcatcacccctccccgcatgtaacccaaaagaggtgtccagagccaaggcttctaccttcattgtccctctctgtgctcaaggagttccattccaggaggaagagatctataccctaagcagatagcaaagaagataatggaggagcaattggtcatggccttggtttccctcaaaacaacgctgcagatttatctgcacaaacatctccacttttgggggaaaggtgggtagattccagttccctggactaccttcaggaggcacgagagctgggagaagaggcaaagctacaggtttacttgggagccagctgagaagagagcagactcacaggtgctggtgcttggatttagccaggctcctccgagcacctcatgcatgtcccagcccctgggccctagccctttcctgccctgcagtctgcagtgccagcacgcaaatcccttcaccacagggtttcgttttgctggcttgaagacaaatggtcttagaattcattgagacccatagcttcatatggctgctccagccccacttcttagcattcttactcctcttctggggctaatgtcagcatctatagacaatagactattaaaaaatcaccttttaaacaagaaacggaaggcatttgatgcagaatttttgcatgacaacatagaaataatttaaaaatagtgtttgttctgaatgttggtagacccttcatagctttgttacaatgaaaccttgaactgaaaatatttaataaaataacctttaaacagtca

SEQ ID NO: 300011 - DNA, 3878 bp, Homo sapiens
  misc_feature (19)..(19): n is a, c, g, or t
agcgggctgccgggctcanccccgtctcctcctcttgctccctcggccgggcggcggtgactgtgcaccgacgtcggcgcgggctgcaccgccgcgtccgcccgcccgccagcatggccaccaccgccacctgcacccgtttcaccgacgactaccagctcttcgaggagcttggcaagggtgctttctctgtggtccgcaggtgtgtgaagaaaacctccacgcaggagtacgcagcaaaaatcatcaataccaagaagttgtctgcccgggatcaccagaaactagaacgtgaggctcggatatgtcgacttctgaaacatccaaacatcgtgcgcctccatgacagtatttctgaagaagggtttcactacctcgtgtttgaccttgttaccggcggggagctgtttgaagacattgtggccagagagtactacagtgaagcagatgccagccactgtatacatcagattctggagagtgttaaccacatccaccagcatgacatcgtccacagggacctgaagcctgagaacctgctgctggcgagtaaatgcaagggtgccgccgtcaagctggctgattttggcctagccatcgaagtacagggagagcagcaggcttggtttggttttgctggcaccccaggttacttgtcccctgaggtcttgaggaaagatccctatggaaaacctgtggatatctgggcctgcggggtcatcctgtatatcctcctggtgggctatcctcccttctgggatgaggatcagcacaagctgtatcagcagatcaaggctggagcctatgatttcccatcaccagaatgggacacggtaactcctgaagccaagaacttgatcaaccagatgctgaccataaacccagcaaagcgcatcacggctgaccaggctctcaagcacccgtgggtctgtcaacgatccacggtggcatccatgatgcatcgtcaggagactgtggagtgtttgcgcaagttcaatgcccggagaaaactgaagggtgccatcctcacgaccatgcttgtctccaggaacttctcagctgccaaaagcctattgaacaagaagtcggatggcggtgtcaagccacagagcaacaacaaaaacagtctcgtaagcccagcccaagagcccgcgcccttgcagacggccatggagccacaaaccactgtggtacacaacgctacagatgggatcaagggctccacagagagctgcaacaccaccacagaagatgaggacctcaaagctgccccgctccgcactgggaatggcagctcggtgcctgaaggacggagctcccgggacagaacagccccctctgcaggcatgcagccccagccttctctctgctcctcagccatgcgaaaacaggagatcattaagattacagaacagctgattgaagccatcaacaatggggactttgaggcctacacgaagatttgtgatccaggcctcacttcctttgagcctgaggcccttggtaacctcgtggaggggatggatttccataagttttactttgagaatctcctgtccaagaacagcaagcctatccataccaccatcctaaacccacacgtccacgtgattggggaggacgcagcgtgcatcgcctacatccgcctcacccagtacatcgacgggcagggtcggcctcgcaccagccagtcagaagagacccgggtctggcaccgtcgggatggcaagtgcatcgacgggcagggtcggcctcgcaccagccagtcagaagagacccgggtctggcaccgtcgggatggcaagtggctcaatgtccactatcactgctcaggggcccctgccgcaccgctgcagtgagctcagccacaggggctttaggagattccagccggaggtccaaccttcgcagccagtggctctggagggcctgagtgacagcggcagtcctgtttgtttgaggtttaaaacaattcaattacaaaagcggcagcagccaatgcacgcccctgcatgcagccctcccgcccgcccttcgtgtctgtctctgctgtaccgaggtgttttttacatttaagaaaaaaaaaaaaagaaaaaaagattgtttaaaaaaaaaaggaatccataccatgatgcgttttaaaaccaccgacagcccttgggttggcaagaaggcaggagtatgtatgaggtccatcctggcatgagcagtggctcacccaccggccttgaagaggtgagcttggcctctctggtccccatggacttagggggaccaggcaagaactctgacagagctttgggggccgtgatgtgattgcagctcctgaggtggcctgcttaccccaggtctaggaatgaacttctttggaacttgcataggcgcctagaatggggctgatgagaacatcgtgaccatcagacctacttgggagagaacgcagagctcccagcctgctgtggaggcagctgagaagtggtggcctcaggactgagagcccggacgttgctgtactgtcttgtttagtgtagaagggaagagaattggtgctgcagaagtgtacccgccatgaagccgatgagaaacctcgtgttagtctgacatgcactcactcatccatttctataggatgcacaatgcatgtgggccctaatattgaggccttatccctgcagctaggagggggaggggttgttgctgctttgcttcgtgttttcttctaacctggcaaggagagagccaggccctggtcagggctcccgtgccgcctttggcggttctgtttctgtgctgatctggaccatctttgtcttgccttttcacggtagtggtccccatgctgaccctcatctgggcctgggccctctgccaagtgcccctgtgggatgggaggagtgaggcagtgggagaagaggtggtggtcgtttctatgcattcaggctgcctttggggctgcctcccttcttattcttccttgctgcacgtccatctcttttcctgtctttgagattgacctgactgctctggcaagaagaagaggtgtccttacagaggcctctttactgaccaactgaagtatagacttactgctggacaatctgcatgggcatcacccctccccgcatgtaacccaaaagaggtgtccagagccaaggcttctaccttcattgtccctctctgtgctcaaggagttccattccaggaggaagagatctataccctaagcagatagcaaagaagataatggaggagcaattggtcatggccttggtttccctcaaaacaacgctgcagatttatctgcacaaacatctccacttttgggggaaaggtgggtagattccagttccctggactaccttcaggaggcacgagagctgggagaagaggcaaagctacaggtttacttgggagccagctgagaagagagcagactcacaggtgctggtgcttggatttagccaggctcctccgagcacctcatgcatgtcccagcccctgggccctagccctttcctgccctgcagtctgcagtgccagcacgcaaatcccttcaccacagggtttcgttttgctggcttgaagacaaatggtcttagaattcattgagacccatagcttcatatggctgctccagccccacttcttagcattcttactcctcttctggggctaatgtcagcatctatagacaatagactattaaaaaatcaccttttaaacaagaaacggaaggcatttgatgcagaatttttgcatgacaacatagaaataatttaaaaatagtgtttgttctgaatgttggtagacccttcatagctttgttacaatgaaaccttgaactgaaaatatttaataaaataacctttaaacagtca

SEQ ID NO: 300012 - DNA, 3623 bp, Homo sapiens
ctccattggattgggtctctcctccacgttggttgtggtttaatgtcttaaaagtggctcttacctcctggacactcctctccaggattctcagggttgggtctctgtgtcattggtctcattactcttcaacttcagtagtagctctgtccttcctgggcagcgatattttagtgtttatgttggtctcaaagctgtgacttttgggtgttaccggcggggagctgtttgaagacattgtggccagagagtactacagtgaagcagatgccagccactgtatacatcagattctggagagtgttaaccacatccaccagcatgacatcgtccacagggacctgaagcctgagaacctgctgctggcgagtaaatgcaagggtgccgccgtcaagctggctgattttggcctagccatcgaagtacagggagagcagcaggcttggtttggttttgctggcaccccaggttacttgtcccctgaggtcttgaggaaagatccctatggaaaacctgtggatatctgggcctgcggggtcatcctgtatatcctcctggtgggctatcctcccttctgggatgaggatcagcacaagctgtatcagcagatcaaggctggagcctatgatttcccatcaccagaatgggacacggtaactcctgaagccaagaacttgatcaaccagatgctgaccataaacccagcaaagcgcatcacggctgaccaggctctcaagcacccgtgggtctgtcaacgatccacggtggcatccatgatgcatcgtcaggagactgtggagtgtttgcgcaagttcaatgcccggagaaaactgaagggtgccatcctcacgaccatgcttgtctccaggaacttctcagctgccaaaagcctattgaacaagaagtcggatggcggtgtcaagccacagagcaacaacaaaaacagtctcgtaagcccagcccaagagcccgcgcccttgcagacggccatggagccacaaaccactgtggtacacaacgctacagatgggatcaagggctccacagagagctgcaacaccaccacagaagatgaggacctcaaagctgccccgctccgcactgggaatggcagctcggtgcctgaaggacggagctcccgggacagaacagccccctctgcaggcatgcagccccagccttctctctgctcctcagccatgcgaaaacaggagatcattaagattacagaacagctgattgaagccatcaacaatggggactttgaggcctacacgaagatttgtgatccaggcctcacttcctttgagcctgaggcccttggtaacctcgtggaggggatggatttccataagttttactttgagaatctcctgtccaagaacagcaagcctatccataccaccatcctaaacccacacgtccacgtgattggggaggacgcagcgtgcatcgcctacatccgcctcacccagtacatcgacgggcagggtcggcctcgcaccagccagtcagaagagacccgggtctggcaccgtcgggatggcaagtggctcaatgtccactatcactgctcaggggcccctgccgcaccgctgcagtgagctcagccacaggggctttaggagattccagccggaggtccaaccttcgcagccagtggctctggagggcctgagtgacagcggcagtcctgtttgtttgaggtttaaaacaattcaattacaaaagcggcagcagccaatgcacgcccctgcatgcagccctcccgcccgcccttcgtgtctgtctctgctgtaccgaggtgttttttacatttaagaaaaaaaaaaaaagaaaaaaagattgtttaaaaaaaaaaggaatccataccatgatgcgttttaaaaccaccgacagcccttgggttggcaagaaggcaggagtatgtatgaggtccatcctggcatgagcagtggctcacccaccggccttgaagaggtgagcttggcctctctggtccccatggacttagggggaccaggcaagaactctgacagagctttgggggccgtgatgtgattgcagctcctgaggtggcctgcttaccccaggtctaggaatgaacttctttggaacttgcataggcgcctagaatggggctgatgagaacatcgtgaccatcagacctacttgggagagaacgcagagctcccagcctgctgtggaggcagctgagaagtggtggcctcaggactgagagcccggacgttgctgtactgtcttgtttagtgtagaagggaagagaattggtgctgcagaagtgtacccgccatgaagccgatgagaaacctcgtgttagtctgacatgcactcactcatccatttctataggatgcacaatgcatgtgggccctaatattgaggccttatccctgcagctaggagggggaggggttgttgctgctttgcttcgtgttttcttctaacctggcaaggagagagccaggccctggtcagggctcccgtgccgcctttggcggttctgtttctgtgctgatctggaccatctttgtcttgccttttcacggtagtggtccccatgctgaccctcatctgggcctgggccctctgccaagtgcccctgtgggatgggaggagtgaggcagtgggagaagaggtggtggtcgtttctatgcattcaggctgcctttggggctgcctcccttcttattcttccttgctgcacgtccatctcttttcctgtctttgagattgacctgactgctctggcaagaagaagaggtgtccttacagaggcctctttactgaccaactgaagtatagacttactgctggacaatctgcatgggcatcacccctccccgcatgtaacccaaaagaggtgtccagagccaaggcttctaccttcattgtccctctctgtgctcaaggagttccattccaggaggaagagatctataccctaagcagatagcaaagaagataatggaggagcaattggtcatggccttggtttccctcaaaacaacgctgcagatttatctgcacaaacatctccacttttgggggaaaggtgggtagattccagttccctggactaccttcaggaggcacgagagctgggagaagaggcaaagctacaggtttacttgggagccagctgagaagagagcagactcacaggtgctggtgcttggatttagccaggctcctccgagcacctcatgcatgtcccagcccctgggccctagccctttcctgccctgcagtctgcagtgccagcacgcaaatcccttcaccacagggtttcgttttgctggcttgaagacaaatggtcttagaattcattgagacccatagcttcatatggctgctccagccccacttcttagcattcttactcctcttctggggctaatgtcagcatctatagacaatagactattaaaaaatcaccttttaaacaagaaacggaaggcatttgatgcagaatttttgcatgacaacatagaaataatttaaaaatagtgtttgttctgaatgttggtagacccttcatagctttgttacaatgaaaccttgaactgaaaatatttaataaaataacctttaaacagtca

SEQ ID NO: 300013 - DNA, 4072 bp, Homo sapiens
gtcggcaggctactggacttctcgtgtctgtctctgctgtacgaggtgttttttacatttaagaaaaaaacaaaaagaaacaacacgattgtttacaaaaaaagggactccataccatgatgcgttttaaaaccaccgacagcccttgggttggcaagaaggcaggagtatgtatgaggtccatcctggcatgagcagtggctcacccaccggccttgaagaggtgagcttggcctctctggtccccatggacttagggggaccaggcaagaactctgacagagctttgggggccgtgatgtgattgcagctcctgaggtggcctgcttaccccaggtctaggaatgaacttctttggaacttgcataggcgcctagaatggggctgatgagaacatcgtgaccatcagacctacttgctcctcttgctccctcggccgggcggcggtgactgtgcaccgacgtcggcgcgggctgcaccgccgcgtccgcccgcccgccagcatggccaccaccgccacctgcacccgtttcaccgacgactaccagctcttcgaggagcttggcaagggtgctttctctgtggtccgcaggtgtgtgaagaaaacctccacgcaggagtacgcagcaaaaatcatcaataccaagaagttgtctgcccgggatcaccagaaactagaacgtgaggctcggatatgtcgacttctgaaacatccaaacatcgccactgtatacatcagattctggagagtgttaaccacatccaccagcatgacatcgtccacagggacctgaagcctgagaacctgctgctggcgagtaaatgcaagggtgccgccgtcaagctggctgattttggcctagccatcgaagtacagggagagcagcaggcttggtttggttttgctggcaccccaggttacttgtcccctgaggtcttgaggaaagatccctatggaaaacctgtggatatctgggcctgcggggtcatcctgtatatcctcctggtgggctatcctcccttctgggatgaggatcagcacaagctgtatcagcagatcaaggctggagcctatgatttcccatcaccagaatgggacacggtaactcctgaagccaagaacttgatcaaccagatgctgaccataaacccagcaaagcgcatcacggctgaccaggctctcaagcacccgtgggtctgtcaacgatccacggtggcatccatgatgcatcgtcaggagactgtggagtgtttgcgcaagttcaatgcccggagaaaactgaagggtgccatcctcacgaccatgcttgtctccaggaacttctcagctgccaaaagcctattgaacaagaagtcggatggcggtgtcaagccacagagcaacaacaaaaacagtctcgtaagcccagcccaagagcccgcgcccttgcagacggccatggagccacaaaccactgtggtacacaacgctacagatgggatcaagggctccacagagagctgcaacaccaccacagaagatgaggacctcaaagctgccccgctccgcactgggaatggcagctcggtgcctgaaggacggagctcccgggacagaacagccccctctgcaggcatgcagccccagccttctctctgctcctcagccatgcgaaaacaggagatcattaagattacagaacagctgattgaagccatcaacaatggggactttgaggcctacacgaagatttgtgatccaggcctcacttcctttgagcctgaggcccttggtaacctcgtggaggggatggatttccataagttttactttgagaatctcctgtccaagaacagcaagcctatccataccaccatcctaaacccacacgtccacgtgattggggaggacgcagcgtgcatcgcctacatccgcctcacccagtacatcgacgggcagggtcggcctcgcaccagccagtcagaagagacccgggtctggcaccgtcgggatggcaagtggctcaatgtccactatcactgctcaggggcccctgccgcaccgctgcagtgagctcagccacaggggctttaggagattccagccggaggtccaaccttcgcagccagtggctctggagggcctgagtgacagcggcagtcctgtttgtttgaggtttaaaacaattcaattacaaaagcggcagcagccaatgcacgcccctgcatgcagccctcccgcccgcccttcgtgtctgtctctgctgtaccgaggtgttttttacatttaagaaaaaaaaaaaaagaaaaaaagattgtttaaaaaaaaaaggaatccataccatgatgcgttttaaaaccaccgacagcccttgggttggcaagaaggcaggagtatgtatgaggtccatcctggcatgagcagtggctcacccaccggccttgaagaggtgagcttggcctctctggtccccatggacttagggggaccaggcaagaactctgacagagctttgggggccgtgatgtgattgcagctcctgaggtggcctgcttaccccaggtctaggaatgaacttctttggaacttgcataggcgcctagaatggggctgatgagaacatcgtgaccatcagacctacttgggagagaacgcagagctcccagcctgctgtggaggcagctgagaagtggtggcctcaggactgagagcccggacgttgctgtactgtcttgtttagtgtagaagggaagagaattggtgctgcagaagtgtacccgccatgaagccgatgagaaacctcgtgttagtctgacatgcactcactcatccatttctataggatgcacaatgcatgtgggccctaatattgaggccttatccctgcagctaggagggggaggggttgttgctgctttgcttcgtgttttcttctaacctggcaaggagagagccaggccctggtcagggctcccgtgccgcctttggcggttctgtttctgtgctgatctggaccatctttgtcttgccttttcacggtagtggtccccatgctgaccctcatctgggcctgggccctctgccaagtgcccctgtgggatgggaggagtgaggcagtgggagaagaggtggtggtcgtttctatgcattcaggctgcctttggggctgcctcccttcttattcttccttgctgcacgtccatctcttttcctgtctttgagattgacctgactgctctggcaagaagaagaggtgtccttacagaggcctctttactgaccaactgaagtatagacttactgctggacaatctgcatgggcatcacccctccccgcatgtaacccaaaagaggtgtccagagccaaggcttctaccttcattgtccctctctgtgctcaaggagttccattccaggaggaagagatctataccctaagcagatagcaaagaagataatggaggagcaattggtcatggccttggtttccctcaaaacaacgctgcagatttatctgcacaaacatctccacttttgggggaaaggtgggtagattccagttccctggactaccttcaggaggcacgagagctgggagaagaggcaaagctacaggtttacttgggagccagctgagaagagagcagactcacaggtgctggtgcttggatttagccaggctcctccgagcacctcatgcatgtcccagcccctgggccctagccctttcctgccctgcagtctgcagtgccagcacgcaaatcccttcaccacagggtttcgttttgctggcttgaagacaaatggtcttagaattcattgagacccatagcttcatatggctgctccagccccacttcttagcattcttactcctcttctggggctaatgtcagcatctatagacaatagactattaaaaaatcaccttttaaacaagaaacggaaggcatttgatgcagaatttttgcatgacaacatagaaataatttaaaaatagtgtttgttctgaatgttggtagacccttcatagctttgttacaatgaaaccttgaactgaaaatatttaataaaataacctttaaacagtca

SEQ ID NO: 300014 - DNA, 3130 bp, Homo sapiens
tccagagaacttccatggcacctagggatggagccctcactctttcaccccggcactctgcttccaggcctgggtggaagctgtcaaaggcagagtccccagtgccccacgcggctccagtactgagcatggtttctcctctaagtgtcgtgcatccatgccctcctccacgcagaggagatcctgaggtgccaccctgagggctctgacgccactcaagatccccttcttgctgagaggctataggaagtgcctcttttgggggtttcgggagacccttggcccccttgtcagacacagcactctcttgtggatctggctgccggacttcaggttggggagagggtacaatgcaggagacttgatattcctctttgttttcacagctgccaaaagcctattgaacaagaagtcggatggcggtgtcaagccacagagcaacaacaaaaacagtctcgtaagcccagcccaagagcccgcgcccttgcagacggccatggagccacaaaccactgtggtacacaacgctacagatgggatcaagggctccacagagagctgcaacaccaccacagaagatgaggacctcaaagctgccccgctccgcactgggaatggcagctcggtgcctgaaggacggagctcccgggacagaacagccccctctgcaggcatgcagccccagccttctctctgctcctcagccatgcgaaaacaggagatcattaagattacagaacagctgattgaagccatcaacaatggggactttgaggcctacacgaagatttgtgatccaggcctcacttcctttgagcctgaggcccttggtaacctcgtggaggggatggatttccataagttttactttgagaatctcctgtccaagaacagcaagcctatccataccaccatcctaaacccacacgtccacgtgattggggaggacgcagcgtgcatcgcctacatccgcctcacccagtacatcgacgggcagggtcggcctcgcaccagccagtcagaagagacccgggtctggcaccgtcgggatggcaagtggctcaatgtccactatcactgctcaggggcccctgccgcaccgctgcagtgagctcagccacaggggctttaggagattccagccggaggtccaaccttcgcagccagtggctctggagggcctgagtgacagcggcagtcctgtttgtttgaggtttaaaacaattcaattacaaaagcggcagcagccaatgcacgcccctgcatgcagccctcccgcccgcccttcgtgtctgtctctgctgtaccgaggtgttttttacatttaagaaaaaaaaaaaaagaaaaaaagattgtttaaaaaaaaaaggaatccataccatgatgcgttttaaaaccaccgacagcccttgggttggcaagaaggcaggagtatgtatgaggtccatcctggcatgagcagtggctcacccaccggccttgaagaggtgagcttggcctctctggtccccatggacttagggggaccaggcaagaactctgacagagctttgggggccgtgatgtgattgcagctcctgaggtggcctgcttaccccaggtctaggaatgaacttctttggaacttgcataggcgcctagaatggggctgatgagaacatcgtgaccatcagacctacttgggagagaacgcagagctcccagcctgctgtggaggcagctgagaagtggtggcctcaggactgagagcccggacgttgctgtactgtcttgtttagtgtagaagggaagagaattggtgctgcagaagtgtacccgccatgaagccgatgagaaacctcgtgttagtctgacatgcactcactcatccatttctataggatgcacaatgcatgtgggccctaatattgaggccttatccctgcagctaggagggggaggggttgttgctgctttgcttcgtgttttcttctaacctggcaaggagagagccaggccctggtcagggctcccgtgccgcctttggcggttctgtttctgtgctgatctggaccatctttgtcttgccttttcacggtagtggtccccatgctgaccctcatctgggcctgggccctctgccaagtgcccctgtgggatgggaggagtgaggcagtgggagaagaggtggtggtcgtttctatgcattcaggctgcctttggggctgcctcccttcttattcttccttgctgcacgtccatctcttttcctgtctttgagattgacctgactgctctggcaagaagaagaggtgtccttacagaggcctctttactgaccaactgaagtatagacttactgctggacaatctgcatgggcatcacccctccccgcatgtaacccaaaagaggtgtccagagccaaggcttctaccttcattgtccctctctgtgctcaaggagttccattccaggaggaagagatctataccctaagcagatagcaaagaagataatggaggagcaattggtcatggccttggtttccctcaaaacaacgctgcagatttatctgcacaaacatctccacttttgggggaaaggtgggtagattccagttccctggactaccttcaggaggcacgagagctgggagaagaggcaaagctacaggtttacttgggagccagctgagaagagagcagactcacaggtgctggtgcttggatttagccaggctcctccgagcacctcatgcatgtcccagcccctgggccctagccctttcctgccctgcagtctgcagtgccagcacgcaaatcccttcaccacagggtttcgttttgctggcttgaagacaaatggtcttagaattcattgagacccatagcttcatatggctgctccagccccacttcttagcattcttactcctcttctggggctaatgtcagcatctatagacaatagactattaaaaaatcaccttttaaacaagaaacggaaggcatttgatgcagaatttttgcatgacaacatagaaataatttaaaaatagtgtttgttctgaatgttggtagacccttcatagctttgttacaatgaaaccttgaactgaaaatatttaataaaataacctttaaacagtca

SEQ ID NO: 300015 - DNA, 2693 bp, Homo sapiens
  misc_feature (32)..(32): n is a, c, g, or t
  misc_feature (61)..(61): n is a, c, g, or t
ccgcgagcgccgccgcctgggccgggcaagtngccaaaagctttttgaacaagaattcggntggcgttgtcaagaaaaggaagtcgagttccagcgtgcacctaatgccacagagcaacaacaaaaacagtctcgtaagcccagcccaagagcccgcgcccttgcagacggccatggagccacaaaccactgtggtacacaacgctacagatgggatcaagggctccacagagagctgcaacaccaccacagaagatgaggacctcaaagtgcgaaaacaggagatcattaagattacagaacagctgattgaagccatcaacaatggggactttgaggcctacacgaagatttgtgatccaggcctcacttcctttgagcctgaggcccttggtaacctcgtggaggggatggatttccataagttttactttgagaatctcctgtccaagaacagcaagcctatccataccaccatcctaaacccacacgtccacgtgattggggaggacgcagcgtgcatcgcctacatccgcctcacccagtacatcgacgggcagggtcggcctcgcaccagccagtcagaagagacccgggtctggcaccgtcgggatggcaagtggctcaatgtccactatcactgctcaggggcccctgccgcaccgctgcagtgagctcagccacaggggctttaggagattccagccggaggtccaaccttcgcagccagtggctctggagggcctgagtgacagcggcagtcctgtttgtttgaggtttaaaacaattcaattacaaaagcggcagcagccaatgcacgcccctgcatgcagccctcccgcccgcccttcgtgtctgtctctgctgtaccgaggtgttttttacatttaagaaaaaaaaaaaaagaaaaaaagattgtttaaaaaaaaaaggaatccataccatgatgcgttttaaaaccaccgacagcccttgggttggcaagaaggcaggagtatgtatgaggtccatcctggcatgagcagtggctcacccaccggccttgaagaggtgagcttggcctctctggtccccatggacttagggggaccaggcaagaactctgacagagctttgggggccgtgatgtgattgcagctcctgaggtggcctgcttaccccaggtctaggaatgaacttctttggaacttgcataggcgcctagaatggggctgatgagaacatcgtgaccatcagacctacttgggagagaacgcagagctcccagcctgctgtggaggcagctgagaagtggtggcctcaggactgagagcccggacgttgctgtactgtcttgtttagtgtagaagggaagagaattggtgctgcagaagtgtacccgccatgaagccgatgagaaacctcgtgttagtctgacatgcactcactcatccatttctataggatgcacaatgcatgtgggccctaatattgaggccttatccctgcagctaggagggggaggggttgttgctgctttgcttcgtgttttcttctaacctggcaaggagagagccaggccctggtcagggctcccgtgccgcctttggcggttctgtttctgtgctgatctggaccatctttgtcttgccttttcacggtagtggtccccatgctgaccctcatctgggcctgggccctctgccaagtgcccctgtgggatgggaggagtgaggcagtgggagaagaggtggtggtcgtttctatgcattcaggctgcctttggggctgcctcccttcttattcttccttgctgcacgtccatctcttttcctgtctttgagattgacctgactgctctggcaagaagaagaggtgtccttacagaggcctctttactgaccaactgaagtatagacttactgctggacaatctgcatgggcatcacccctccccgcatgtaacccaaaagaggtgtccagagccaaggcttctaccttcattgtccctctctgtgctcaaggagttccattccaggaggaagagatctataccctaagcagatagcaaagaagataatggaggagcaattggtcatggccttggtttccctcaaaacaacgctgcagatttatctgcacaaacatctccacttttgggggaaaggtgggtagattccagttccctggactaccttcaggaggcacgagagctgggagaagaggcaaagctacaggtttacttgggagccagctgagaagagagcagactcacaggtgctggtgcttggatttagccaggctcctccgagcacctcatgcatgtcccagcccctgggccctagccctttcctgccctgcagtctgcagtgccagcacgcaaatcccttcaccacagggtttcgttttgctggcttgaagacaaatggtcttagaattcattgagacccatagcttcatatggctgctccagccccacttcttagcattcttactcctcttctggggctaatgtcagcatctatagacaatagactattaaaaaatcaccttttaaacaagaaacggaaggcatttgatgcagaatttttgcatgacaacatagaaataatttaaaaatagtgtttgttctgaatgttggtagacccttcatagctttgttacaatgaaaccttgaactgaaaatatttaataaaataacctttaaacagtca

SEQ ID NO: 300016 - DNA, 2665 bp, Homo sapiens
aaggccaaagaaccataactaatggctgggcttcaggagaaagtggtcattgtctctgcagactgcagagagggagacgggagggaaggtgtgttcgctcttcctgccaagggccctagagacagagaagagggatgtctttgtcataagcgatcacaggggactcctgaggactggggagggctctctgtaacttgggaggttccccagtaggtaaattgatggatttttctcccccacagtgcgaaaacaggagatcattaagattacagaacagctgattgaagccatcaacaatggggactttgaggcctacacgaagatttgtgatccaggcctcacttcctttgagcctgaggcccttggtaacctcgtggaggggatggatttccataagttttactttgagaatctcctgtccaagaacagcaagcctatccataccaccatcctaaacccacacgtccacgtgattggggaggacgcagcgtgcatcgcctacatccgcctcacccagtacatcgacgggcagggtcggcctcgcaccagccagtcagaagagacccgggtctggcaccgtcgggatggcaagtggctcaatgtccactatcactgctcaggggcccctgccgcaccgctgcagtgagctcagccacaggggctttaggagattccagccggaggtccaaccttcgcagccagtggctctggagggcctgagtgacagcggcagtcctgtttgtttgaggtttaaaacaattcaattacaaaagcggcagcagccaatgcacgcccctgcatgcagccctcccgcccgcccttcgtgtctgtctctgctgtaccgaggtgttttttacatttaagaaaaaaaaaaaaagaaaaaaagattgtttaaaaaaaaaaggaatccataccatgatgcgttttaaaaccaccgacagcccttgggttggcaagaaggcaggagtatgtatgaggtccatcctggcatgagcagtggctcacccaccggccttgaagaggtgagcttggcctctctggtccccatggacttagggggaccaggcaagaactctgacagagctttgggggccgtgatgtgattgcagctcctgaggtggcctgcttaccccaggtctaggaatgaacttctttggaacttgcataggcgcctagaatggggctgatgagaacatcgtgaccatcagacctacttgggagagaacgcagagctcccagcctgctgtggaggcagctgagaagtggtggcctcaggactgagagcccggacgttgctgtactgtcttgtttagtgtagaagggaagagaattggtgctgcagaagtgtacccgccatgaagccgatgagaaacctcgtgttagtctgacatgcactcactcatccatttctataggatgcacaatgcatgtgggccctaatattgaggccttatccctgcagctaggagggggaggggttgttgctgctttgcttcgtgttttcttctaacctggcaaggagagagccaggccctggtcagggctcccgtgccgcctttggcggttctgtttctgtgctgatctggaccatctttgtcttgccttttcacggtagtggtccccatgctgaccctcatctgggcctgggccctctgccaagtgcccctgtgggatgggaggagtgaggcagtgggagaagaggtggtggtcgtttctatgcattcaggctgcctttggggctgcctcccttcttattcttccttgctgcacgtccatctcttttcctgtctttgagattgacctgactgctctggcaagaagaagaggtgtccttacagaggcctctttactgaccaactgaagtatagacttactgctggacaatctgcatgggcatcacccctccccgcatgtaacccaaaagaggtgtccagagccaaggcttctaccttcattgtccctctctgtgctcaaggagttccattccaggaggaagagatctataccctaagcagatagcaaagaagataatggaggagcaattggtcatggccttggtttccctcaaaacaacgctgcagatttatctgcacaaacatctccacttttgggggaaaggtgggtagattccagttccctggactaccttcaggaggcacgagagctgggagaagaggcaaagctacaggtttacttgggagccagctgagaagagagcagactcacaggtgctggtgcttggatttagccaggctcctccgagcacctcatgcatgtcccagcccctgggccctagccctttcctgccctgcagtctgcagtgccagcacgcaaatcccttcaccacagggtttcgttttgctggcttgaagacaaatggtcttagaattcattgagacccatagcttcatatggctgctccagccccacttcttagcattcttactcctcttctggggctaatgtcagcatctatagacaatagactattaaaaaatcaccttttaaacaagaaacggaaggcatttgatgcagaatttttgcatgacaacatagaaataatttaaaaatagtgtttgttctgaatgttggtagacccttcatagctttgttacaatgaaaccttgaactgaaaatatttaataaaataacctttaaacagtca

SEQ ID NO: 300017 - DNA, 2705 bp, Homo sapiens
  misc_feature (148)..(148): n is a, c, g, or t
atacgaagatgagaagagattaggggaagccacagaaccaccaggtaggttttgaggggaaacctactatttagccccccgtcctgccacgccgtggagcatcagcgcacacactctgcaaccgcatcacccgttcgaacgggtgatncggttggggaggaggcctctggagggcaccacctctgcctgcctgtcagtctgagccctgtctggttttcctgaggaacacgtcctggcaatgagagctggtgtgaaatgtgcagctttcccaagcctcgagagtgcgaaaacaggagatcattaagattacagaacagctgattgaagccatcaacaatggggactttgaggcctacacgaagatttgtgatccaggcctcacttcctttgagcctgaggcccttggtaacctcgtggaggggatggatttccataagttttactttgagaatctcctgtccaagaacagcaagcctatccataccaccatcctaaacccacacgtccacgtgattggggaggacgcagcgtgcatcgcctacatccgcctcacccagtacatcgacgggcagggtcggcctcgcaccagccagtcagaagagacccgggtctggcaccgtcgggatggcaagtggctcaatgtccactatcactgctcaggggcccctgccgcaccgctgcagtgagctcagccacaggggctttaggagattccagccggaggtccaaccttcgcagccagtggctctggagggcctgagtgacagcggcagtcctgtttgtttgaggtttaaaacaattcaattacaaaagcggcagcagccaatgcacgcccctgcatgcagccctcccgcccgcccttcgtgtctgtctctgctgtaccgaggtgttttttacatttaagaaaaaaaaaaaaagaaaaaaagattgtttaaaaaaaaaaggaatccataccatgatgcgttttaaaaccaccgacagcccttgggttggcaagaaggcaggagtatgtatgaggtccatcctggcatgagcagtggctcacccaccggccttgaagaggtgagcttggcctctctggtccccatggacttagggggaccaggcaagaactctgacagagctttgggggccgtgatgtgattgcagctcctgaggtggcctgcttaccccaggtctaggaatgaacttctttggaacttgcataggcgcctagaatggggctgatgagaacatcgtgaccatcagacctacttgggagagaacgcagagctcccagcctgctgtggaggcagctgagaagtggtggcctcaggactgagagcccggacgttgctgtactgtcttgtttagtgtagaagggaagagaattggtgctgcagaagtgtacccgccatgaagccgatgagaaacctcgtgttagtctgacatgcactcactcatccatttctataggatgcacaatgcatgtgggccctaatattgaggccttatccctgcagctaggagggggaggggttgttgctgctttgcttcgtgttttcttctaacctggcaaggagagagccaggccctggtcagggctcccgtgccgcctttggcggttctgtttctgtgctgatctggaccatctttgtcttgccttttcacggtagtggtccccatgctgaccctcatctgggcctgggccctctgccaagtgcccctgtgggatgggaggagtgaggcagtgggagaagaggtggtggtcgtttctatgcattcaggctgcctttggggctgcctcccttcttattcttccttgctgcacgtccatctcttttcctgtctttgagattgacctgactgctctggcaagaagaagaggtgtccttacagaggcctctttactgaccaactgaagtatagacttactgctggacaatctgcatgggcatcacccctccccgcatgtaacccaaaagaggtgtccagagccaaggcttctaccttcattgtccctctctgtgctcaaggagttccattccaggaggaagagatctataccctaagcagatagcaaagaagataatggaggagcaattggtcatggccttggtttccctcaaaacaacgctgcagatttatctgcacaaacatctccacttttgggggaaaggtgggtagattccagttccctggactaccttcaggaggcacgagagctgggagaagaggcaaagctacaggtttacttgggagccagctgagaagagagcagactcacaggtgctggtgcttggatttagccaggctcctccgagcacctcatgcatgtcccagcccctgggccctagccctttcctgccctgcagtctgcagtgccagcacgcaaatcccttcaccacagggtttcgttttgctggcttgaagacaaatggtcttagaattcattgagacccatagcttcatatggctgctccagccccacttcttagcattcttactcctcttctggggctaatgtcagcatctatagacaatagactattaaaaaatcaccttttaaacaagaaacggaaggcatttgatgcagaatttttgcatgacaacatagaaataatttaaaaatagtgtttgttctgaatgttggtagacccttcatagctttgttacaatgaaaccttgaactgaaaatatttaataaaataacctttaaacagtca

SEQ ID NO: 300018 - DNA, 3460 bp, Homo sapiens
agcctcacctctttccaagacggattggaaggaaaccctttgagattaggttgagatgatctcagcacataagaactaagctctgtgtctgcaggtttcacaatagaggaaattaaaaccaggataagaatgtgcaaaccagggcactgttggtgatttgcgagatcggaagttgtggctagaatcttcctgactatggaggaaggcagacgtcttgtatagggggtggggtgtacattctggacagttcatggaaaataaggggataagaagctgaatcatcaccccctcccatctttctctctgctctatgagaccctccccttccttatttttatctcttcccactttatgctgggccttccctatcctgccctgagttatagttagtcactaacttctccgctggctcccacccttatcacatctcagctacatatataaactctctgttatctaagtaattctattagccagaagcaattccagagtttatattagtactaggaaggtgtcatgtagcccctgtctaacatttgaattgaactaaaatgtgaatctcaataaaagcaacacagttttcacagcatatgctgataatggcaatccaacttcttttgccttttccccagagaatcctgggaatatcctgagcttggtgctttgatgattctatttcagctttggtgccttaaaaaaaattacaaatcaattttgaatggtttaagttcatgattttgttctgcagccctagctaggggtgagccaagccttatgaaatctaaactcagcctaacagaatagaaaatctataggctttagttaagagtcacatggtcctgagttcaggtgtgtgatttgagcaaattattccttgagcctatttcctcatcttataatgaagaaaatattatccaccaagaaatacagctcgggcatgtaaaaccccagcacaatgcctgattaaaagcgcagcaggtactgtcactgttacccatctttctgttccttttggataaaggagactaatgtaatgtggcatcctggcctctggagggcgttcaggggttcgggggtgggggggggcggtacttggagattctgggagtggttgcttgggagatggtaagacttggaagtgcaggctgggaggaaaatgcaggtgcccaggcctgatgtcctcttacctaccccaccctgccctgcagtcctgtccaagaacagcaagcctatccataccaccatcctaaacccacacgtccacgtgattggggaggacgcagcgtgcatcgcctacatccgcctcacccagtacatcgacgggcagggtcggcctcgcaccagccagtcagaagagacccgggtctggcaccgtcgggatggcaagtggctcaatgtccactatcactgctcaggggcccctgccgcaccgctgcagtgagctcagccacaggggctttaggagattccagccggaggtccaaccttcgcagccagtggctctggagggcctgagtgacagcggcagtcctgtttgtttgaggtttaaaacaattcaattacaaaagcggcagcagccaatgcacgcccctgcatgcagccctcccgcccgcccttcgtgtctgtctctgctgtaccgaggtgttttttacatttaagaaaaaaaaaaaaagaaaaaaagattgtttaaaaaaaaaaggaatccataccatgatgcgttttaaaaccaccgacagcccttgggttggcaagaaggcaggagtatgtatgaggtccatcctggcatgagcagtggctcacccaccggccttgaagaggtgagcttggcctctctggtccccatggacttagggggaccaggcaagaactctgacagagctttgggggccgtgatgtgattgcagctcctgaggtggcctgcttaccccaggtctaggaatgaacttctttggaacttgcataggcgcctagaatggggctgatgagaacatcgtgaccatcagacctacttgggagagaacgcagagctcccagcctgctgtggaggcagctgagaagtggtggcctcaggactgagagcccggacgttgctgtactgtcttgtttagtgtagaagggaagagaattggtgctgcagaagtgtacccgccatgaagccgatgagaaacctcgtgttagtctgacatgcactcactcatccatttctataggatgcacaatgcatgtgggccctaatattgaggccttatccctgcagctaggagggggaggggttgttgctgctttgcttcgtgttttcttctaacctggcaaggagagagccaggccctggtcagggctcccgtgccgcctttggcggttctgtttctgtgctgatctggaccatctttgtcttgccttttcacggtagtggtccccatgctgaccctcatctgggcctgggccctctgccaagtgcccctgtgggatgggaggagtgaggcagtgggagaagaggtggtggtcgtttctatgcattcaggctgcctttggggctgcctcccttcttattcttccttgctgcacgtccatctcttttcctgtctttgagattgacctgactgctctggcaagaagaagaggtgtccttacagaggcctctttactgaccaactgaagtatagacttactgctggacaatctgcatgggcatcacccctccccgcatgtaacccaaaagaggtgtccagagccaaggcttctaccttcattgtccctctctgtgctcaaggagttccattccaggaggaagagatctataccctaagcagatagcaaagaagataatggaggagcaattggtcatggccttggtttccctcaaaacaacgctgcagatttatctgcacaaacatctccacttttgggggaaaggtgggtagattccagttccctggactaccttcaggaggcacgagagctgggagaagaggcaaagctacaggtttacttgggagccagctgagaagagagcagactcacaggtgctggtgcttggatttagccaggctcctccgagcacctcatgcatgtcccagcccctgggccctagccctttcctgccctgcagtctgcagtgccagcacgcaaatcccttcaccacagggtttcgttttgctggcttgaagacaaatggtcttagaattcattgagacccatagcttcatatggctgctccagccccacttcttagcattcttactcctcttctggggctaatgtcagcatctatagacaatagactattaaaaaatcaccttttaaacaagaaacggaaggcatttgatgcagaatttttgcatgacaacatagaaataatttaaaaatagtgtttgttctgaatgttggtagacccttcatagctttgttacaatgaaaccttgaactgaaaatatttaataaaataacctttaaacagtca

SEQ ID NO: 300019 - DNA, 3535 bp, Homo sapiens
agcctcacctctttccaagacggattggaaggaaaccctttgagattaggttgagatgatctcagcacataagaactaagctctgtgtctgcaggtttcacaatagaggaaattaaaaccaggataagaatgtgcaaaccagggcactgttggtgatttgcgagatcggaagttgtggctagaatcttcctgactatggaggaaggcagacgtcttgtatagggggtggggtgtacattctggacagttcatggaaaataaggggataagaagctgaatcatcaccccctcccatctttctctctgctctatgagaccctccccttccttatttttatctcttcccactttatgctgggccttccctatcctgccctgagttatagttagtcactaacttctccgctggctcccacccttatcacatctcagctacatatataaactctctgttatctaagtaattctattagccagaagcaattccagagtttatattagtactaggaaggtgtcatgtagcccctgtctaacatttgaattgaactaaaatgtgaatctcaataaaagcaacacagttttcacagcatatgctgataatggcaatccaacttcttttgccttttccccagagaatcctgggaatatcctgagcttggtgctttgatgattctatttcagctttggtgccttaaaaaaaattacaaatcaattttgaatggtttaagttcatgattttgttctgcagccctagctaggggtgagccaagccttatgaaatctaaactcagcctaacagaatagaaaatctataggctttagttaagagtcacatggtcctgagttcaggtgtgtgatttgagcaaattattccttgagcctatttcctcatcttataatgaagaaaatattatccaccaagaaatacagctcgggcatgtaaaaccccagcacaatgcctgattaaaagcgcagcaggtactgtcactgttacccatctttctgttccttttggataaaggagactaatgtaatgtggcatcctggcctctggagggcgttcaggggttcgggggtgggggggggcggtacttggagattctgggagtggttgcttgggagatggtaagacttggaagtgcaggctgggaggaaaatgcaggtgcccaggcctgatgtcctcttacctaccccaccctgccctgcagtcctgtccaagaacagcaagcctatccataccaccatcctaaacccacacgtccacgtgattggggaggacgcagcgtgcatcgcctacatccgcctcacccagtacatcgacgggcagggtcggcctcgcaccagccagtcagaagagacccgggtctggcaccgtcgggatggcaagtgcatcgacgggcagggtcggcctcgcaccagccagtcagaagagacccgggtctggcaccgtcgggatggcaagtggctcaatgtccactatcactgctcaggggcccctgccgcaccgctgcagtgagctcagccacaggggctttaggagattccagccggaggtccaaccttcgcagccagtggctctggagggcctgagtgacagcggcagtcctgtttgtttgaggtttaaaacaattcaattacaaaagcggcagcagccaatgcacgcccctgcatgcagccctcccgcccgcccttcgtgtctgtctctgctgtaccgaggtgttttttacatttaagaaaaaaaaaaaaagaaaaaaagattgtttaaaaaaaaaaggaatccataccatgatgcgttttaaaaccaccgacagcccttgggttggcaagaaggcaggagtatgtatgaggtccatcctggcatgagcagtggctcacccaccggccttgaagaggtgagcttggcctctctggtccccatggacttagggggaccaggcaagaactctgacagagctttgggggccgtgatgtgattgcagctcctgaggtggcctgcttaccccaggtctaggaatgaacttctttggaacttgcataggcgcctagaatggggctgatgagaacatcgtgaccatcagacctacttgggagagaacgcagagctcccagcctgctgtggaggcagctgagaagtggtggcctcaggactgagagcccggacgttgctgtactgtcttgtttagtgtagaagggaagagaattggtgctgcagaagtgtacccgccatgaagccgatgagaaacctcgtgttagtctgacatgcactcactcatccatttctataggatgcacaatgcatgtgggccctaatattgaggccttatccctgcagctaggagggggaggggttgttgctgctttgcttcgtgttttcttctaacctggcaaggagagagccaggccctggtcagggctcccgtgccgcctttggcggttctgtttctgtgctgatctggaccatctttgtcttgccttttcacggtagtggtccccatgctgaccctcatctgggcctgggccctctgccaagtgcccctgtgggatgggaggagtgaggcagtgggagaagaggtggtggtcgtttctatgcattcaggctgcctttggggctgcctcccttcttattcttccttgctgcacgtccatctcttttcctgtctttgagattgacctgactgctctggcaagaagaagaggtgtccttacagaggcctctttactgaccaactgaagtatagacttactgctggacaatctgcatgggcatcacccctccccgcatgtaacccaaaagaggtgtccagagccaaggcttctaccttcattgtccctctctgtgctcaaggagttccattccaggaggaagagatctataccctaagcagatagcaaagaagataatggaggagcaattggtcatggccttggtttccctcaaaacaacgctgcagatttatctgcacaaacatctccacttttgggggaaaggtgggtagattccagttccctggactaccttcaggaggcacgagagctgggagaagaggcaaagctacaggtttacttgggagccagctgagaagagagcagactcacaggtgctggtgcttggatttagccaggctcctccgagcacctcatgcatgtcccagcccctgggccctagccctttcctgccctgcagtctgcagtgccagcacgcaaatcccttcaccacagggtttcgttttgctggcttgaagacaaatggtcttagaattcattgagacccatagcttcatatggctgctccagccccacttcttagcattcttactcctcttctggggctaatgtcagcatctatagacaatagactattaaaaaatcaccttttaaacaagaaacggaaggcatttgatgcagaatttttgcatgacaacatagaaataatttaaaaatagtgtttgttctgaatgttggtagacccttcatagctttgttacaatgaaaccttgaactgaaaatatttaataaaataacctttaaacagtca

SEQ ID NO: 300020 - DNA, 2401 bp, Homo sapiens
gccgtcccagaggactggcaaagctggcagaatggttgcaataagttatgcttggaaatcagacagactagggtctggctccgtgactccaaattggatgacctcagacaggttacttcccctccctaaactgtttccttagctgtcaaagaaaggcagagagtggtgcctacctcatttaatcattgtgaggattaagtaagatactataagtaaagcacttagttagtgcttagcaaatgggaggcagttttgtatttaagcattagcttcacccactttccccaccttctcaggccgacttggccatgtgtttagcgtgctaaagtcgctggaactcatctgtgtgctcattgtcctctgttctgttaccacattctgtcctgtttgacaggggctttaggagattccagccggaggtccaaccttcgcagccagtggctctggagggcctgagtgacagcggcagtcctgtttgtttgaggtttaaaacaattcaattacaaaagcggcagcagccaatgcacgcccctgcatgcagccctcccgcccgcccttcgtgtctgtctctgctgtaccgaggtgttttttacatttaagaaaaaaaaaaaaagaaaaaaagattgtttaaaaaaaaaaggaatccataccatgatgcgttttaaaaccaccgacagcccttgggttggcaagaaggcaggagtatgtatgaggtccatcctggcatgagcagtggctcacccaccggccttgaagaggtgagcttggcctctctggtccccatggacttagggggaccaggcaagaactctgacagagctttgggggccgtgatgtgattgcagctcctgaggtggcctgcttaccccaggtctaggaatgaacttctttggaacttgcataggcgcctagaatggggctgatgagaacatcgtgaccatcagacctacttgggagagaacgcagagctcccagcctgctgtggaggcagctgagaagtggtggcctcaggactgagagcccggacgttgctgtactgtcttgtttagtgtagaagggaagagaattggtgctgcagaagtgtacccgccatgaagccgatgagaaacctcgtgttagtctgacatgcactcactcatccatttctataggatgcacaatgcatgtgggccctaatattgaggccttatccctgcagctaggagggggaggggttgttgctgctttgcttcgtgttttcttctaacctggcaaggagagagccaggccctggtcagggctcccgtgccgcctttggcggttctgtttctgtgctgatctggaccatctttgtcttgccttttcacggtagtggtccccatgctgaccctcatctgggcctgggccctctgccaagtgcccctgtgggatgggaggagtgaggcagtgggagaagaggtggtggtcgtttctatgcattcaggctgcctttggggctgcctcccttcttattcttccttgctgcacgtccatctcttttcctgtctttgagattgacctgactgctctggcaagaagaagaggtgtccttacagaggcctctttactgaccaactgaagtatagacttactgctggacaatctgcatgggcatcacccctccccgcatgtaacccaaaagaggtgtccagagccaaggcttctaccttcattgtccctctctgtgctcaaggagttccattccaggaggaagagatctataccctaagcagatagcaaagaagataatggaggagcaattggtcatggccttggtttccctcaaaacaacgctgcagatttatctgcacaaacatctccacttttgggggaaaggtgggtagattccagttccctggactaccttcaggaggcacgagagctgggagaagaggcaaagctacaggtttacttgggagccagctgagaagagagcagactcacaggtgctggtgcttggatttagccaggctcctccgagcacctcatgcatgtcccagcccctgggccctagccctttcctgccctgcagtctgcagtgccagcacgcaaatcccttcaccacagggtttcgttttgctggcttgaagacaaatggtcttagaattcattgagacccatagcttcatatggctgctccagccccacttcttagcattcttactcctcttctggggctaatgtcagcatctatagacaatagactattaaaaaatcaccttttaaacaagaaacggaaggcatttgatgcagaatttttgcatgacaacatagaaataatttaaaaatagtgtttgttctgaatgttggtagacccttcatagctttgttacaatgaaaccttgaactgaaaatatttaataaaataacctttaaacagtca

SEQ ID NO: 300021 - DNA, 1924 bp, Homo sapiens
  misc_feature (19)..(19): n is a, c, g, or t
agcgggctgccgggctcanccccgtctcctcctcttgctccctcggccgggcggcggtgactgtgcaccgacgtcggcgcgggctgcaccgccgcgtccgcccgcccgccagcatggccaccaccgccacctgcacccgtttcaccgacgactaccagctcttcgaggagcttggcaagggtgctttctctgtggtccgcaggtgtgtgaagaaaacctccacgcaggagtacgcagcaaaaatcatcaataccaagaagttgtctgcccgggatcaccagaaactagaacgtgaggctcggatatgtcgacttctgaaacatccaaacatcgtgcgcctccatgacagtatttctgaagaagggtttcactacctcgtgtttgaccttgttaccggcggggagctgtttgaagacattgtggccagagagtactacagtgaagcagatgccagccactgtatacatcagattctggagagtgttaaccacatccaccagcatgacatcgtccacagggacctgaagcctgagaacctgctgctggcgagtaaatgcaagggtgccgccgtcaagctggctgattttggcctagccatcgaagtacagggagagcagcaggcttggtttggttttgctggcaccccaggttacttgtcccctgaggtcttgaggaaagatccctatggaaaacctgtggatatctgggcctgcggggtcatcctgtatatcctcctggtgggctatcctcccttctgggatgaggatcagcacaagctgtatcagcagatcaaggctggagcctatgatttcccatcaccagaatgggacacggtaactcctgaagccaagaacttgatcaaccagatgctgaccataaacccagcaaagcgcatcacggctgaccaggctctcaagcacccgtgggtctgtcaacgatccacggtggcatccatgatgcatcgtcaggagactgtggagtgtttgcgcaagttcaatgcccggagaaaactgaagggtgccatcctcacgaccatgcttgtctccaggaacttctcagctgccaaaagcctattgaacaagaagtcggatggcggtgtcaaggagccacaaaccactgtggtacacaacgctacagatgggatcaagggctccacagagagctgcaacaccaccacagaagatgaggacctcaaagtgcgaaaacaggagatcattaagattacagaacagctgattgaagccatcaacaatggggactttgaggcctacacgaagatttgtgatccaggcctcacttcctttgagcctgaggcccttggtaacctcgtggaggggatggatttccataagttttactttgagaatcgtgagtgggttcgtgctgctgatatactcctgcctgcccctttacccctttgtctctgtctcctgctcaccttctcatcccagttgcccacttttcccttatttgaccttcgtgctgcactcctactctgtatgcttgtccccttgtgccccgatggttgtagacaggcacctttgaaggccctgctcctgagctccaagtgccattcattctgcagctgctttgtggcagtgccagtcaccacaatcaagctcacttatttcttgccgggcgcggtggcttacgcctgtaatcccaacactttgggaggctgaggctggcggatcacgaggtcaggagatcgaggccatcctggctaacacggtgaaaccccatctctactaaaaatacaaaaaattagccgggcgtggtggcggtgcctgtagtcccagctactcgggtggctgaggcaggagaatgatgtgaacctgggaggcagagcttgcagtgagccaagatcaggccactgcactccagcctgggcaacagagcaagactccatctcaaaaaaaaagaa

SEQ ID NO: 300022 - DNA, 1946 bp, Homo sapiens
  misc_feature (19)..(19): n is a, c, g, or t
agcgggctgccgggctcanccccgtctcctcctcttgctccctcggccgggcggcggtgactgtgcaccgacgtcggcgcgggctgcaccgccgcgtccgcccgcccgccagcatggccaccaccgccacctgcacccgtttcaccgacgactaccagctcttcgaggagcttggcaagggtgctttctctgtggtccgcaggtgtgtgaagaaaacctccacgcaggagtacgcagcaaaaatcatcaataccaagaagttgtctgcccgggatcaccagaaactagaacgtgaggctcggatatgtcgacttctgaaacatccaaacatcgtgcgcctccatgacagtatttctgaagaagggtttcactacctcgtgtttgaccttgttaccggcggggagctgtttgaagacattgtggccagagagtactacagtgaagcagatgccagccactgtatacatcagattctggagagtgttaaccacatccaccagcatgacatcgtccacagggacctgaagcctgagaacctgctgctggcgagtaaatgcaagggtgccgccgtcaagctggctgattttggcctagccatcgaagtacagggagagcagcaggcttggtttggttttgctggcaccccaggttacttgtcccctgaggtcttgaggaaagatccctatggaaaacctgtggatatctgggcctgcggggtcatcctgtatatcctcctggtgggctatcctcccttctgggatgaggatcagcacaagctgtatcagcagatcaaggctggagcctatgatttcccatcaccagaatgggacacggtaactcctgaagccaagaacttgatcaaccagatgctgaccataaacccagcaaagcgcatcacggctgaccaggctctcaagcacccgtgggtctgtcaacgatccacggtggcatccatgatgcatcgtcaggagactgtggagtgtttgcgcaagttcaatgcccggagaaaactgaagggtgccatcctcacgaccatgcttgtctccaggaacttctcagctgccaaaagcctattgaacaagaagtcggatggcggtgtcaagccacagagcaacaacaaaaacagtctcgtaagcccagcccaagagcccgcgcccttgcagacggccatggagccacaaaccactgtggtacacaacgctacagatgggatcaagggctccacagagagctgcaacaccaccacagaagatgaggacctcaaagctgccccgctccgcactgggaatggcagctcggtgcctgaaggacggagctcccgggacagaacagccccctctgcaggcatgcagccccagccttctctctgctcctcagccatgcgaaaacaggagatcattaagattacagaacagctgattgaagccatcaacaatggggactttgaggcctacacgaagatttgtgatccaggcctcacttcctttgagcctgaggcccttggtaacctcgtggaggggatggatttccataagttttactttgagaatctcctgtccaagaacagcaagcctatccataccaccatcctaaacccacacgtccacgtgattggggaggacgcagcgtgcatcgcctacatccgcctcacccagtacatcgacgggcagggtcggcctcgcaccagccagtcagaagagacccgggtctggcaccgtcgggatggcaagtggctcaatgtccactatcactgctcaggggcccctgccgcaccgctgcagtgagctcagccacagtgtgagggcttgagtcctcttttaccccacagagggtcacctattctccaccatccaaggcgtctcttggtctggtcactgcctctttcttcttgcactcaaatgattacttcactcctgtcacaaatatcagcagcaggggatcctcta

SEQ ID NO: 300023 - DNA, 1625 bp, Homo sapiens
gccgtcccagaggactggcaaagctggcagaatggttgcaataagttatgcttggaaatcagacagactagggtctggctccgtgactccaaattggatgacctcagacaggttacttcccctccctaaactgtttccttagctgtcaaagaaaggcagagagtggtgcctacctcatttaatcattgtgaggattaagtaagatactataagtaaagcacttagttagtgcttagcaaatgggaggcagttttgtatttaagcattagcttcacccactttccccaccttctcaggccgacttggccatgtgtttagcgtgctaaagtcgctggaactcatctgtgtgctcattgtcctctgttctgttaccacattctgtcctgtttgacaggggctttaggagattccagccggaggtccaaccttcgcagccagtggctctggagggcctgagtgacagcggcagtcctggcaaggagagagccaggccctggtcagggctcccgtgccgcctttggcggttctgtttctgtgctgatctggaccatctttgtcttgccttttcacggtagtggtccccatgctgaccctcatctgggcctgggccctctgccaagtgcccctgtgggatgggaggagtgaggcagtgggagaagaggtggtggtcgtttctatgcattcaggctgcctttggggctgcctcccttcttattcttccttgctgcacgtccatctcttttcctgtctttgagattgacctgactgctctggcaagaagaagaggtgtccttacagaggcctctttactgaccaactgaagtatagacttactgctggacaatctgcatgggcatcacccctccccgcatgtaacccaaaagaggtgtccagagccaaggcttctaccttcattgtccctctctgtgctcaaggagttccattccaggaggaagagatctataccctaagcagatagcaaagaagataatggaggagcaattggtcatggccttggtttccctcaaaacaacgctgcagatttatctgcacaaacatctccacttttgggggaaaggtgggtagattccagttccctggactaccttcaggaggcacgagagctgggagaagaggcaaagctacaggtttacttgggagccagctgagaagagagcagactcacaggtgctggtgcttggatttagccaggctcctccgagcacctcatgcatgtcccagcccctgggccctagccctttcctgccctgcagtctgcagtgccagcacgcaaatcccttcaccacagggtttcgttttgctggcttgaagacaaatggtcttagaattcattgagacccatagcttcatatggctgctccagccccacttcttagcattcttactcctcttctggggctaatgtcagcatctatagacaatagactattaaaaaatcaccttttaaacaagaaacggaaggcatttgatgcagaatttttgcatgacaacatagaaataatttaaaaatagtgtttgttctgaatgttggtagacccttcatagctttgttacaatgaaaccttgaactgaaaatatttaataaaataacctttaaacagtca

SEQ ID NO: 300024 - DNA, 1559 bp, Homo sapiens
  misc_feature (19)..(19): n is a, c, g, or t
agcgggctgccgggctcanccccgtctcctcctcttgctccctcggccgggcggcggtgactgtgcaccgacgtcggcgcgggctgcaccgccgcgtccgcccgcccgccagcatggccaccaccgccacctgcacccgtttcaccgacgactaccagctcttcgaggagcttggcaagggtgctttctctgtggtccgcaggtgtgtgaagaaaacctccacgcaggagtacgcagcaaaaatcatcaataccaagaagttgtctgcccgggatcaccagaaactagaacgtgaggctcggatatgtcgacttctgaaacatccaaacatcgtgcgcctccatgacagtatttctgaagaagggtttcactacctcgtgtttgaccttgttaccggcggggagctgtttgaagacattgtggccagagagtactacagtgaagcagatgccagccactgtatacatcagattctggagagtgttaaccacatccaccagcatgacatcgtccacagggacctgaagcctgagaacctgctgctggcgagtaaatgcaagggtgccgccgtcaagctggctgattttggcctagccatcgaagtacagggagagcagcaggcttggtttggttttgctggcaccccaggttacttgtcccctgaggtcttgaggaaagatccctatggaaaacctgtggatatctgggcctgcggggtcatcctgtatatcctcctggtgggctatcctcccttctgggatgaggatcagcacaagctgtatcagcagatcaaggctggagcctatgatttcccatcaccagaatgggacacggtaactcctgaagccaagaacttgatcaaccagatgctgaccataaacccagcaaagcgcatcacggctgaccaggctctcaagcacccgtgggtctgtcaacgatccacggtggcatccatgatgcatcgtcaggagactgtggagtgtttgcgcaagttcaatgcccggagaaaactgaagggtgccatcctcacgaccatgcttgtctccaggaacttctcagctgccaaaagcctattgaacaagaagtcggatggcggtgtcaaggtaagtgtctccagcctctgaacagactggcctctttctccccgcagtcactatgggaattcttggcacctggttccccctttcccagggaatcttcctatccttgctagtctgctttaaaccagatgcctttgtgctcagaacagaaggttctgctggcctgagagggaagtagggaggtatttttcctggccctagctggatgggaatgactcaggggaagtgatccaaatcatagtttataccagagctgaatccggaacctgacttctacacggatgcttcatctccagggcttgactctgggttttttaggtcatttggttatctttctttttttcctttttagagcacaaatccttttaatcaaatgaaagccaaatttgcctgagtgattcaggcagggtatagggcttggaacctgaaaccactctccttttggtctttttccttctc

SEQ ID NO: 300025 - DNA, 1364 bp, Homo sapiens
  misc_feature (19)..(19): n is a, c, g, or t
agcgggctgccgggctcanccccgtctcctcctcttgctccctcggccgggcggcggtgactgtgcaccgacgtcggcgcgggctgcaccgccgcgtccgcccgcccgccagcatggccaccaccgccacctgcacccgtttcaccgacgactaccagctcttcgaggagcttggcaagggtgctttctctgtggtccgcaggtgtgtgaagaaaacctccacgcaggagtacgcagcaaaaatcatcaataccaagaagttgtctgcccgggatcaccagaaactagaacgtgaggctcggatatgtcgacttctgaaacatccaaacatcgtgcgcctccatgacagtatttctgaagaagggtttcactacctcgtgtttgaccttgttaccggcggggagctgtttgaagacattgtggccagagagtactacagtgaagcagatgccagccactgtatacatcagattctggagagtgttaaccacatccaccagcatgacatcgtccacagggacctgaagcctgagaacctgctgctggcgagtaaatgcaagggtgccgccgtcaagctggctgattttggcctagccatcgaagtacagggagagcagcaggcttggtttggttttgctggcaccccaggttacttgtcccctgaggtcttgaggaaagatccctatggaaaacctgtggatatctgggcctgcggggtcatcctgtatatcctcctggtgggctatcctcccttctgggatgaggatcagcacaagctgtatcagcagatcaaggctggagcctatgatttcccatcaccagaatgggacacggtaactcctgaagccaagaacttgatcaaccagatgctgaccataaacccagcaaagcgcatcacggctgaccaggctctcaagcacccgtgggtctgtcaacgatccacggtggcatccatgatgcatcgtcaggagactgtggagtgtttgcgcaagttcaatgcccggagaaaactgaagggtgccatcctcacgaccatgcttgtctccaggaacttctcagtggcaaaagctatgaacaagaagtcggatggcgggtcaagccacagagcaacacaaaacagctcgtaagccagccaagaagccggcctgagagggcagggggcacaacccttgggtgaccaacgccaatggatcagggcccaggaaggcggcccaagaagaggcccaagggcccgcagggaaggccggcgggaaggccggaaaaaccctgggggagcactcttcgcccggaaagagataaaaacgggccaggggggcaaagaggccccgacgctcggggagaaatacaccacccggggcaggcgc

SEQ ID NO: 300026 - DNA, 416 bp, Homo sapiens
acggagctcccgggacagaacagccccctctgcaggcatgcagccccagccttctctctgctcctcagccagtaagtgtgagggaggcacattctggcttccgtctccctggctcgtcctgaagcccctcagggacccccaccacagctgtcagtcccacccacctgcccgtggtagtaagctctgggagcatggcctctgctgggggtggggggtagactggaggtgctgttgagaccaggcaggggcccctgagtctggggcccaaagaaatatgagaagtgtgggtggaaaaacatggcctgggatgaggggagtagaaagcccccaggatgtgcagtgggccttgcctcagcgctgagccaggaagaagggcagagtcggaagtcaggtctgtgggggtgggagtgggatga

SEQ ID NO: 300027 - DNA, 744 bp, Homo sapiens
ataggatcttgctctgttaccaaggttggagtgcactggcacgatcgtggctcactgcagcctcaacctcctgggactcagagatggagtttcaccatgttgcccaggctggttttgaactccagggctcaggcccacctccacctcccaaagtgctgggattataggtatgggccactgtgcccagccctatgaagaatatcttcaaagtatataaaatactgctttttcaaaataggtacaacctcttcatcttcacaacaacgaataatgtagctgggacaagtatcagaatgattctcactgtacagatgaagaaactcagtctgcgtgcatggtatttgcccaaggtcatacaggtcattaagagaaagtgggaatacaatctaggtctctactagtgtgtcattttgtctttatcaaaaataaaaataaatccagatggaattagggtaaaaaaaattcttgtgtccattaatagcagaaatagctttgttattcatttaaatctttataatcacagttatattaatctaaaaacttgtctgctaaccattgtattaatttggtaagagaaattccaaccagaaaagcattctagtcaatatttaaagaaagaacaatattagatacattctagtaaagcaattattttaataaattaagaaagcaaataaaaacctttgtatttaaggtctgtatcacataatttataataatgaattaaaatgacagtaaatatgt

SEQ ID NO: 300028 - DNA, 493 bp, Homo sapiens
ataggatcttgctctgttaccaaggttggagtgcactggcacgatcgtggctcactgcagcctcaacctcctgggactcagagatggagtttcaccatgttgcccaggctggttttgaactccagggctcaggcccacctccacctcccaaagtgctgggattataggtatgggccactgtgcccagccctatgaagaatatcttcaaagtatataaaatactgctttttcaaaataggtacaacctcttcatcttcacaacaacgaataatgtagctgggacaagtatcagaatgattctcactgtacagatgaagaaactcagtctgcgtgcatggtatttgcccaaggtcatacaggtcattaagagaaagtgggaatacaatctaggtctctactagtgtgtcattttgtctttatcaaaaataaaaataaatccagtgccagatgcggccgacccccagctcaccataccaaccagaagaatgacaca

SEQ ID NO: 300029 - DNA, 492 bp, Homo sapiens
ataggatcttgctctgttaccaaggttggagtgcactggcacgatcgtggctcactgcagcctcaacctcctgggactcagagatggagtttcaccatgttgcccaggctggttttgaactccagggctcaggcccacctccacctcccaaagtgctgggattataggtatgggccactgtgcccagccctatgaagaatatcttcaaagtatataaaatactgctttttcaaaataggtacaacctcttcatcttcacaacaacgaataatgtagctgggacaagtatcagaatgattctcactgtacagatgaagaaactcagtctgcgtgcatggtatttgcccaaggtcatacaggtcattaagagaaagtgggaatacaatctaggtctctactagtgtgtcattttgtctttatcaaaaataaaaataaatccagcggcacgcatttctccatgatagcacaaaaagctaacactattctcacaca

SEQ ID NO: 300030 - DNA, 484 bp, Homo sapiens
agatggagtttcaccatgttgcccaggctggttttgaactccagggctcaggcccacctccacctcccaaagtgctgggattataggtatgggccactgtgcccagccctatgaagaatatcttcaaagtatataaaatactgctttttcaaaataggtgagtatgtatataaatttacaagattcgaaaatacttatcatacttgccttttcttgctagaaagtcttaccagtaggaatttaagagacaatctatcctttcccactcagtccaagataaaaagttttagttttaacaaactttcctcccatttcaatcttgggaaatagaagccaaaatttaaattcctgaagaataaatagttctgaaatcaaataactggctcaaaacttaaggtgccctttaaattagaaatacatgttaattctagttttgctatatcatatgctttacataatcagttctaaaatgttaataatgcta

SEQ ID NO: 300031 - DNA, 2759 bp, Homo sapiens
agcggagctctcagagggaattgagcacccggcagcggtctcaggccaagccccctgccagcatggccagcgagttcaagaagaagctcttctggagggcagtggtggccgagttcctggccacgaccctctttgtcttcatcagcatcggttctgccctgggcttcaaatacccggtggggaacaaccagacggcggtccaggacaacgtgaaggtgtcgctggccttcgggctgagcatcgccacgctggcgcagagtgtgggccacatcagcggcgcccacctcaacccggctgtcacactggggctgctgctcagctgccagatcagcatcttccgtgccctcatgtacatcatcgcccagtgcgtgggggccatcgtcgccaccgccatcctctcaggcatcacctcctccctgactgggaactcgcttggccgcaatgacctggctgatggtgtgaactcgggccagggcctgggcatcgagatcatcgggaccctccagctggtgctatgcgtgctggctactaccgaccggaggcgccgtgaccttggtggctcagccccccttgccatcggcctctctgtagcccttggacacctcctggctattgactacactggctgtgggattaaccctgctcggtcctttggctccgcggtgatcacacacaacttcagcaaccactggattttctgggtggggccattcatcgggggagccctggctgtactcatctacgacttcatcctggccccacgcagcagtgacctcacagaccgcgtgaaggtgtggaccagcggccaggtggaggagtatgacctggatgccgacgacatcaactccagggtggagatgaagcccaaatagaaggggtctggcccgggcatccacgtagggggcaggggcaggggcgggcggagggaggggaggggtgaaatccatactgtagacactctgacaagctggccaaagtcacttccccaagatctgccagacctgcatggtcaagcctcttatgggggtgtttctatctctttctttctctttctgtttcctggcctcagagcttcctggggaccaagatttaccaattcacccactcccttgaagttgtggaggaggtgaaagaaagggacccacctgctagtcgcccctcagagcatgatgggaggtgtgccagaaagtcccccctcgccccaaagttgctcaccgactcacctgcgcaagtgcctgggattctaccgtaattgctttgtgcctttgggcacggccctccttcttttcctaacatgcaccttgctcccaatggtgcttggagggggaagagatcccaggaggtgcagtggagggggcaagctttgctccttcagttctgcttgctcccaagcccctgacccgctcggacttactgcctgaccttggaatcgtccctatatcagggcctgagtgacctccttctgcaaagtggcagggaccggcagagctctacaggcctgcagcccctaagtgcaaacacagcatgggtccagaagacgtggtctagaccagggctgctctttccacttgccctgtgttctttccccaggggcatgactgtcgccacacgcctctgtgtacatgtgtgcagagcagacaggctacaaagcagagatcgacagacagccaggtagttggaactttctgttccctatggagaggcttccctacacagggcctgctattgcagaatgaagccatttagagggtgaaggagaaatacccatgttacttctctgagttttagttggtctttccatctatcactgcattatcttgctcattcttcagttctctactccctcttgtcagtgtagacacaggtcaccattatgctggtgtatgtttatcaaagagcacttgagctgtctgaagcccaaagcctgaggacagaaagaccctgatgcaggtcagcccatggaggcagatgcccttgctgggcctgggggttttccaagccctcagctggtcctgaccaggatggagcaagctcttcccttgctcatgagctcctgatcagaggcatttgagcagctgaataacctgcacaggcttgctgtatgacccctggccacagccttccctctgcattgacctggaggggagaggtcagccttgacctaatgaggtagctatagttgcagcccaaggacagttcagagatcaggatcagctttgaaggctggattctatctacataagtcctttcaattccaccagggccagagcagctccaccactgtgcacttagccatgatggcaacagaaaccaagagacacaattacgcaggtatttagaagcagagggacaaccagaaggcccttaactatcaccagtgcatcacatctgcacactctcttctccattccctagcaggaacttctagctcatttaacagataaagaaactgaggcccacggtttcagctagacaatgatttggccaggcctagtaaccaaggccctgtctctggctactccctggaccacgaggctgattcctctcatttccagcttctcagtttctgcctgggcaatggccaggggccaggagtggggagagttgtgatggaggggagaggggtcacacccaccccctgcctggttctaggctgctgcacaccaaggccctgcatctgtctgctctgcatatatgtctctttggagttggaatttcattatatgttaagaaaataaaggaaaatgacttgtaaggtc

SEQ ID NO: 300032 - DNA, 1692 bp, Homo sapiens
agcggagctctcagagggaattgagcacccggcagcggtctcaggccaagccccctgccagcatggccagcgagttcaagaagaagctcttctggagggcagtggtggccgagttcctggccacgaccctctttgtcttcatcagcatcggttctgccctgggcttcaaatacccggtggggaacaaccagacggcggtccaggacaacgtgaaggtgtcgctggccttcgggctgagcatcgccacgctggcgcagagtgtgggccacatcagcggcgcccacctcaacccggctgtcacactggggctgctgctcagctgccagatcagcatcttccgtgccctcatgtacatcatcgcccagtgcgtgggggccatcgtcgccaccgccatcctctcaggcatcacctcctccctgactgggaactcgcttggccgcaatgacctggctgatggtgtgaactcgggccagggcctgggcatcgagatcatcgggaccctccagctggtgctatgcgtgctggctactaccgaccggaggcgccgtgaccttggtggctcagccccccttgccatcggcctctctgtagcccttggacacctcctggctattgactacactggctgtgggattaaccctgctcggtcctttggctccgcggtgatcacacacaacttcagcaaccactggattttctgggtggggccattcatcgggggagccctggctgtactcatctacgacttcatcctggccccacgcagcagtgacctcacagaccgcgtgaaggtgtggaccagcggccaggtggaggagtatgacctggatgccgacgacatcaactccagggtggagatgaagcccaaatagaaggggtctggcccgggcatccacgtagggggcaggggcaggggcgggcggagggaggggaggggtgaaatccatactgtagacactctgacaagctggccaaagtcacttccccaagatctgccagacctgcatggtcaagcctcttatgggggtgtttctatctctttctttctctttctgtttcctggcctcagagcttcctggggaccaagatttaccaattcacccactcccttgaagttgtggaggaggtgaaagaaagggacccacctgctagtcgcccctcagagcatgatgggaggtgtgccagaaagtcccccctcgccccaaagttgctcaccgactcacctgcgcaagtgcctgggattctaccgtaattgctttgtgcctttgggcacggccctccttcttttcctaacatgcaccttgctcccaatggtgcttggagggggaagagatcccaggaggtgcagtggagggggcaagctttgctccttcagttctgcttgctcccaagcccctgacccgctcggacttactgcctgaccttggaatcgtccctatatcagggcctgagtgacctccttctgcaaagtggcagggaccggcagagctctacaggcctgcagcccctaagtgcaaacacagcatgggtccagaagacgtggtctagaccagggctgctctttccacttgccctgtgttctttccccaggggcatgactgtcgccacacgcctctgtgtagcatatatgtctctttggagttggaatttcattatatgttaagaaaataaaggaaaatgacttgtaaggtc

SEQ ID NO: 300033 - DNA, 2184 bp, Homo sapiens
ggtcgactactactactaaattcgcggccgcgtcgaattgactacactggctgtgggattaaccctgctcggtcctttggctccgcggtgatcacacacaacttcagcaaccactggattttctgggtggggccattcatcgggggagccctggctgtactcatctacgacttcatcctggccccacgcagcagtgacctcacagaccgcgtgaaggtgtggaccagcggccaggtggaggagtatgacctggatgccgacgacatcaactccagggtggagatgaagcccaaatagaaggggtctggcccgggcatccacgtagggggcaggggcaggggcgggcggagggaggggaggggtgaaatccatactgtagacactctgacaagctggccaaagtcacttccccaagatctgccagacctgcatggtcaagcctcttatgggggtgtttctatctctttctttctctttctgtttcctggcctcagagcttcctggggaccaagatttaccaattcacccactcccttgaagttgtggaggaggtgaaagaaagggacccacctgctagtcgcccctcagagcatgatgggaggtgtgccagaaagtcccccctcgccccaaagttgctcaccgactcacctgcgcaagtgcctgggattctaccgtaattgctttgtgcctttgggcacggccctccttcttttcctaacatgcaccttgctcccaatggtgcttggagggggaagagatcccaggaggtgcagtggagggggcaagctttgctccttcagttctgcttgctcccaagcccctgacccgctcggacttactgcctgaccttggaatcgtccctatatcagggcctgagtgacctccttctgcaaagtggcagggaccggcagagctctacaggcctgcagcccctaagtgcaaacacagcatgggtccagaagacgtggtctagaccagggctgctctttccacttgccctgtgttctttccccaggggcatgactgtcgccacacgcctctgtgtacatgtgtgcagagcagacaggctacaaagcagagatcgacagacagccaggtagttggaactttctgttccctatggagaggcttccctacacagggcctgctattgcagaatgaagccatttagagggtgaaggagaaatacccatgttacttctctgagttttagttggtctttccatctatcactgcattatcttgctcattcttcagttctctactccctcttgtcagtgtagacacaggtcaccattatgctggtgtatgtttatcaaagagcacttgagctgtctgaagcccaaagcctgaggacagaaagaccctgatgcaggtcagcccatggaggcagatgcccttgctgggcctgggggttttccaagccctcagctggtcctgaccaggatggagcaagctcttcccttgctcatgagctcctgatcagaggcatttgagcagctgaataacctgcacaggcttgctgtatgacccctggccacagccttccctctgcattgacctggaggggagaggtcagccttgacctaatgaggtagctatagttgcagcccaaggacagttcagagatcaggatcagctttgaaggctggattctatctacataagtcctttcaattccaccagggccagagcagctccaccactgtgcacttagccatgatggcaacagaaaccaagagacacaattacgcaggtatttagaagcagagggacaaccagaaggcccttaactatcaccagtgcatcacatctgcacactctcttctccattccctagcaggaacttctagctcatttaacagataaagaaactgaggcccacggtttcagctagacaatgatttggccaggcctagtaaccaaggccctgtctctggctactccctggaccacgaggctgattcctctcatttccagcttctcagtttctgcctgggcaatggccaggggccaggagtggggagagttgtgatggaggggagaggggtcacacccaccccctgcctggttctaggctgctgcacaccaaggccctgcatctgtctgctctgcatatatgtctctttggagttggaatttcattatatgttaagaaaataaaggaaaatgacttgtaaggtc

SEQ ID NO: 300034 - DNA, 1702 bp, Homo sapiens
cccagcaacgcccatttcacctggacgtgccgagggcatgacaaccctctcgtgcagaactttccagtcgactctcaaagggacccacctgctagtcgcccctcagagcatgatgggaggtgtgccagaaagtcccccctcgccccaaagttgctcaccgactcacctgcgcaagtgcctgggattctaccgtaattgctttgtgcctttgggcacggccctccttcttttcctaacatgcaccttgctcccaatggtgcttggagggggaagagatcccaggaggtgcagtggagggggcaagctttgctccttcagttctgcttgctcccaagcccctgacccgctcggacttactgcctgaccttggaatcgtccctatatcagggcctgagtgacctccttctgcaaagtggcagggaccggcagagctctacaggcctgcagcccctaagtgcaaacacagcatgggtccagaagacgtggtctagaccagggctgctctttccacttgccctgtgttctttccccaggggcatgactgtcgccacacgcctctgtgtacatgtgtgcagagcagacaggctacaaagcagagatcgacagacagccaggtagttggaactttctgttccctatggagaggcttccctacacagggcctgctattgcagaatgaagccatttagagggtgaaggagaaatacccatgttacttctctgagttttagttggtctttccatctatcactgcattatcttgctcattcttcagttctctactccctcttgtcagtgtagacacaggtcaccattatgctggtgtatgtttatcaaagagcacttgagctgtctgaagcccaaagcctgaggacagaaagaccctgatgcaggtcagcccatggaggcagatgcccttgctgggcctgggggttttccaagccctcagctggtcctgaccaggatggagcaagctcttcccttgctcatgagctcctgatcagaggcatttgagcagctgaataacctgcacaggcttgctgtatgacccctggccacagccttccctctgcattgacctggaggggagaggtcagccttgacctaatgaggtagctatagttgcagcccaaggacagttcagagatcaggatcagctttgaaggctggattctatctacataagtcctttcaattccaccagggccagagcagctccaccactgtgcacttagccatgatggcaacagaaaccaagagacacaattacgcaggtatttagaagcagagggacaaccagaaggcccttaactatcaccagtgcatcacatctgcacactctcttctccattccctagcaggaacttctagctcatttaacagataaagaaactgaggcccacggtttcagctagacaatgatttggccaggcctagtaaccaaggccctgtctctggctactccctggaccacgaggctgattcctctcatttccagcttctcagtttctgcctgggcaatggccaggggccaggagtggggagagttgtgatggaggggagaggggtcacacccaccccctgcctggttctaggctgctgcacaccaaggccctgcatctgtctgctctgcatatatgtctctttggagttggaatttcattatatgttaagaaaataaaggaaaatgacttgtaaggtc

SEQ ID NO: 300035 - DNA, 1930 bp, Homo sapiens
agcggagctctcagagggaattgagcacccggcagcggtctcaggccaagccccctgccagcatggccagcgagttcaagaagaagctcttctggagggcagtggtggccgagttcctggccacgaccctctttgtcttcatcagcatcggttctgccctgggcttcaaatacccggtggggaacaaccagacggcggtccaggacaacgtgaaggtgtcgctggccttcgggctgagcatcgccacgctggcgcagagtgtgggccacatcagcggcgcccacctcaacccggctgtcacactggggctgctgctcagctgccagatcagcatcttccgtgccctcatgtacatcatcgcccagtgcgtgggggccatcgtcgccaccgccatcctctcaggcatcacctcctccctgactgggaactcgcttggccgcaatgacctggctgatggtgtgaactcgggccagggcctgggcatcgagatcatcgggaccctccagctggtgctatgcgtgctggctactaccgaccggaggcgccgtgaccttggtggctcagccccccttgccatcggcctctctgtagcccttggaatcgtccctatatcagggcctgagtgacctccttctgcaaagtggcagggaccggcagagctctacaggcctgcagcccctaagtgcaaacacagcatgggtccagaagacgtggtctagaccagggctgctctttccacttgccctgtgttctttccccaggggcatgactgtcgccacacgcctctgtgtacatgtgtgcagagcagacaggctacaaagcagagatcgacagacagccaggtagttggaactttctgttccctatggagaggcttccctacacagggcctgctattgcagaatgaagccatttagagggtgaaggagaaatacccatgttacttctctgagttttagttggtctttccatctatcactgcattatcttgctcattcttcagttctctactccctcttgtcagtgtagacacaggtcaccattatgctggtgtatgtttatcaaagagcacttgagctgtctgaagcccaaagcctgaggacagaaagaccctgatgcaggtcagcccatggaggcagatgcccttgctgggcctgggggttttccaagccctcagctggtcctgaccaggatggagcaagctcttcccttgctcatgagctcctgatcagaggcatttgagcagctgaataacctgcacaggcttgctgtatgacccctggccacagccttccctctgcattgacctggaggggagaggtcagccttgacctaatgaggtagctatagttgcagcccaaggacagttcagagatcaggatcagctttgaaggctggattctatctacataagtcctttcaattccaccagggccagagcagctccaccactgtgcacttagccatgatggcaacagaaaccaagagacacaattacgcaggtatttagaagcagagggacaaccagaaggcccttaactatcaccagtgcatcacatctgcacactctcttctccattccctagcaggaacttctagctcatttaacagataaagaaactgaggcccacggtttcagctagacaatgatttggccaggcctagtaaccaaggccctgtctctggctactccctggaccacgaggctgattcctctcatttccagcttctcagtttctgcctgggcaatggccaggggccaggagtggggagagttgtgatggaggggagaggggtcacacccaccccctgcctggttctaggctgctgcacaccaaggccctgcatctgtctgctctgcatatatgtctctttggagttggaatttcattatatgttaagaaaataaaggaaaatgacttgtaaggtc

SEQ ID NO: 300036 - DNA, 2872 bp, Homo sapiens
agcggagctctcagagggaattgagcacccggcagcggtctcaggccaagccccctgccagcatggccagcgagttcaagaagaagctcttctggagggcagtggtggccgagttcctggccacgaccctctttgtcttcatcagcatcggttctgccctgggcttcaaatacccggtggggaacaaccagacggcggtccaggacaacgtgaaggtgtcgctggccttcgggctgagcatcgccacgctggcgcagagtgtgggccacatcagcggcgcccacctcaacccggctgtcacactggggctgctgctcagctgccagatcagcatcttccgtgccctcatgtacatcatcgcccagtgcgtgggggccatcgtcgccaccgccatcctctcaggcatcacctcctccctgactgggaactcgcttggccgcaatgacctggctgatggtgtgaactcgggccagggcctgggcatcgagatcatcgggaccctccagctggtgctatgcgtgctggctactaccgaccggaggcgccgtgaccttggtggctcagccccccttgccatcggcctctctgtagcccttggacacctcctggctattgactacactggctgtgggattaaccctgctcggtcctttggctccgcggtgatcacacacaacttcagcaaccactggattttctgggtggggccattcatcgggggagccctggctgtactcatctacgacttcatcctggccccacgcagcagtgacctcacagaccgcgtgaaggtgtggaccagcggccaggtggaggagtatgacctggatgccgacgacatcaactccagggtggagatgaagcccaaatagaaggggtctggcccgggcatccacgtagggggcaggggcaggggcgggcggagggaggggaggggtgaaatccatactgtagacactctgacaagctggccaaagtcacttccccaagatctgccagacctgcatggtcaagcctcttatgggggtgtttctatctctttctttctctttctgtttcctggcctcagagcttcctggggaccaagatttaccaattcacccactcccttgaagttgtggaggaggtgaaagaaagggacccacctgctagtcgcccctcagagcatgatgggaggtgtgccagaaagtcccccctcgccccaaagttgctcaccgactcacctgcgcaagtgcctgggattctaccgtaattgctttgtgcctttgggcacggccctccttcttttcctaacatgcaccttgctcccaatggtgcttggagggggaagagatcccaggaggtgcagtggagggggcaagctttgctccttcagttctgcttgctcccaagcccctgacccgctcggacttactgcctgaccttggaatcgtccctatatcagggcctgagtgacctccttctgcaaagtggcagggaccggcagagctctacaggcctgcagcccctaagtgcaaacacagcatgggtccagaagacgtggtctagaccagggctgctctttccacttgccctgtgttctttccccaggggcatgactgtcgccacacgcctctgtgtacatgtgtgcagagcagacaggctacaaagcagagatcgacagacagccaggtagttggaactttctgttccctatggagaggcttccctacacagggcctgctattgcagaatgaagccatttagagggtgaaggagaaatacccatgttacttctctgagttttagttggtctttccatctatcactgcattatcttgctcattcttcagttctctactccctcttgtcagtgtagacacaggtcaccattatgctggtgtatgtttatcaaagagcacttgagctgtctgaagcccaaagcctgaggacagaaagaccctgatgcaggtcagcccatggaggcagatgcccttgctgggcctgggggttttccaagccctcagctggtcctgaccaggatggagcaagctcttcccttgctcatgagctcctgatcagaggcatttgagcagctgaataacctgcacaggcttgctgtatgacccctggccacagccttccctctgcattgacctggaggggagaggtcagccttgacctaatgaggtagctatagttgcagcccaaggacagttcagagatcaggatcagctttgaaggctggattctatctacataagtcctttcaattccaccagggccagagcagctccaccactgtgcacttagccatgatggcaacagaaaccaagagacacaattacgcaggtatttagaagcagagggacaaccagaaggcccttaactatcaccagtgcatcacatctgcacactctcttctccattccctagcaggaacttctagctcatttaacagataaagaaactgaggcccacggtttcagctagacaatgatttggccaggcctagtaaccaaggccctgtctctggctactccctggaccacgaggctgattcctctcatttccagcttctcagtttctgcctgggcaatggccaggggccaggagtggggagagttgtgatggaggggagaggggtcacacccaccccctgcctggttctaggctgctgcacaccaaggccctgcatctgtctgctctgcatatatgtctctttggagttggaatttcattatatgttaagaaaataaaggaaaatgacttgtaaggtcaaaaaaaaaaaaaaaaaaaaaaaaaaaaaaaaacaaaaacaaaacacaaaaaaaagacaggggggcggcgcgcgcgccaaagatattatcctccccgcgcgggggcgccccac

SEQ ID NO: 300037 - DNA, 2751 bp, Homo sapiens
agcggagctctcagagggaattgagcacccggcagcggtctcaggccaagccccctgccagcatggccagcgagttcaagaagaagctcttctggagggcagtggtggccgagttcctggccacgaccctctttgtcttcatcagcatcggttctgccctgggcttcaaatacccggtggggaacaaccagacggcggtccaggacaacgtgaaggtgtcgctggccttcgggctgagcatcgccacgctggcgcagagtgtgggccacatcagcggcgcccacctcaacccggctgtcacactggggctgctgctcagctgccagatcagcatcttccgtgccctcatgtacatcatcgcccagtgcgtgggggccatcgtcgccaccgccatcctctcaggcatcacctcctccctgactgggaactcgcttggccgcaatgacctggctgatggtgtgaactcgggccagggcctgggcatcgagatcatcgggaccctccagctggtgctatgcgtgctggctactaccgaccggaggcgccgtgaccttggtggctcagccccccttgccatcggcctctctgtagcccttggacacctcctggctattgactacactggctgtgggattaaccctgctcggtcctttggctccgcggtgatcacacacaacttcagcaaccactggattttctgggtggggccattcatcgggggagccctggctgtactcatctacgacttcatcctggccccacgcagcagtgacctcacagaccgcgtgaaggtgtggaccagcggccaggtggaggagtatgacctggatgccgacgacatcaactccagggtggagatgaagcccaaatagaaggggtctggcccgggcatccacgtagggggcaggggcaggggcgggcggagggaggggaggggtgaaatccatactgtagacactctgacaagctggccaaagtcacttccccaagatctgccagacctgcatggtcaagcctcttatgggggtgtttctatctctttctttctctttctgtttcctggcctcagagcttcctggggaccaagatttaccaattcacccactcccttgaagttgtggaggaggtgaaagaaagggacccacctgctagtcgcccctcagagcatgatgggaggtgtgccagaaagtcccccctcgccccaaagttgctcaccgactcacctgcgcaagtgcctgggattctaccgtaattgctttgtgcctttgggcacggccctccttcttttcctaacatgcaccttgctcccaatggtgcttggagggggaagagatcccaggaggtgcagtggagggggcaagctttgctccttcagttctgcttgctcccaagcccctgacccgctcggacttactgcctgaccttggaatcgtccctatatcagggcctgagtgacctccttctgcaaagtggcagggaccggcagagctctacaggcctgcagcccctaagtgcaaacacagcatgggtccagaagacgtggtctagaccagggctgctctttccacttgccctgtgttctttccccaggggcatgactgtcgccacacgcctctgtgtacatgtgtgcagagcagacaggctacaaagcagagatcgacagacagccaggtagttggaactttctgttccctatggagaggcttccctacacagggcctgctattgcagaatgaagccatttagagggtgaaggagaaatacccatgttacttctctgagttttagttggtctttccatctatcactgcattatcttgctcattcttcagttctctactccctcttgtcagtgtagacacaggtcaccattatgctggtgtatgtttatcaaagagcacttgagctgtctgaagcccaaagcctgaggacagaaagaccctgatgcaggtcagcccatggaggcagatgcccttgctgggcctgggggttttccaagccctcagctggtcctgaccaggatggagcaagctcttcccttgctcatgagctcctgatcagaggcatttgagcagctgaataacctgcacaggcttgctgtatgacccctggccacagccttccctctgcattgacctggaggggagaggtcagccttgacctaatgaggtagctatagttgcagcccaaggacagttcagagatcaggatcagctttgaaggctggattctatctacataagtcctttcaattccaccagggccagagcagctccaccactgtgcacttagccatgatggcaacagaaaccaagagacacaattacgcaggtatttagaagcagagggacaaccagaaggcccttaactatcaccagtgcatcacatctgcacactctcttctccattccctagcaggaacttctagctcatttaacagataaagaaactgaggcccacggtttcagctagacaatgatttggccaggcctagtaaccaaggccctgtctctggctactccctggaccacgaggctgattcctctcatttccagcttctcagtttctgcctgggcaatggccaggggccaggagtggggagagttgtgatggaggggagagggaggccggacacctaattattagcatcatccctctactattttttaaccaaatcaccaccacctatttagctgttcccaaccttttcctccgacccctaacaaccccactcctaatactacctccctg

SEQ ID NO: 300038 - DNA, 1226 bp, Homo sapiens
  misc_feature (4)..(4): n is a, c, g, or t
  misc_feature (74)..(74): n is a, c, g, or t
aganggatccgccaaccgggctgtccacgcagggcgcagagcagctccgaccactgtgcacttagccattgatnggcaacagaaaccacatgtgtgcagagcagacaggctacaaagcagagatcgacagacagccaggtagttggaactttctgttccctatggagaggcttccctacacagggcctgctattgcagaatgaagccatttagagggtgaaggagaaatacccatgttacttctctgagttttagttggtctttccatctatcactgcattatcttgctcattcttcagttctctactccctcttgtcagtgtagacacaggtcaccattatgctggtgtatgtttatcaaagagcacttgagctgtctgaagcccaaagcctgaggacagaaagaccctgatgcaggtcagcccatggaggcagatgcccttgctgggcctgggggttttccaagccctcagctggtcctgaccaggatggagcaagctcttcccttgctcatgagctcctgatcagaggcatttgagcagctgaataacctgcacaggcttgctgtatgacccctggccacagccttccctctgcattgacctggaggggagaggtcagccttgacctaatgaggtagctatagttgcagcccaaggacagttcagagatcaggatcagctttgaaggctggattctatctacataagtcctttcaattccaccagggccagagcagctccaccactgtgcacttagccatgatggcaacagaaaccaagagacacaattacgcaggtatttagaagcagagggacaaccagaaggcccttaactatcaccagtgcatcacatctgcacactctcttctccattccctagcaggaacttctagctcatttaacagataaagaaactgaggcccacggtttcagctagacaatgatttggccaggcctagtaaccaaggccctgtctctggctactccctggaccacgaggctgattcctctcatttccagcttctcagtttctgcctgggcaatggccaggggccaggagtggggagagttgtgatggaggggagaggggtcacacccaccccctgcctggttctaggctgctgcacaccaaggccctgcatctgtctgctctgcatatatgtctctttggagttggaatttcattatatgttaagaaaataaaggaaaatgacttgtaaggtc

SEQ ID NO: 300039 - DNA, 2396 bp, Homo sapiens
agcggagctctcagagggaattgagcacccggcagcggtctcaggccaagccccctgccagcatggccagcgagttcaagaagaagctcttctggagggcagtggtggccgagttcctggccacgaccctctttgtcttcatcagcatcggttctgccctgggcttcaaatacccggtggggaacaaccagacggcggtccaggacaacgtgaaggtgtcgctggccttcgggctgagcatcgccacgctggcgcagagtgtgggccacatcagcggcgcccacctcaacccggctgtcacactggggctgctgctcagctgccagatcagcatcttccgtgccctcatgtacatcatcgcccagtgcgtgggggccatcgtcgccaccgccatcctctcaggcatcacctcctccctgactgggaactcgcttggccgcaatgacctggctgatggtgtgaactcgggccagggcctgggcatcgagatcatcgggaccctccagctggtgctatgcgtgctggctactaccgaccggaggcgccgtgaccttggtggctcagccccccttgccatcggcctctctgtagcccttggacacctcctggctattgactacactggctgtgggattaaccctgctcggtcctttggctccgcggtgatcacacacaacttcagcaaccactggattttctgggtggggccattcatcgggggagccctggctgtactcatctacgacttcatcctggccccacgcagcagtgacctcacagaccgcgtgaaggtgtggaccagcggccaggtggaggagtatgacctggatgccgacgacatcaactccagggtggagatgaagcccaaatagaaggggtctggcccgggcatccacgtagggggcaggggcaggggcgggcggagggaggggaggggtgaaatccatactgtagacactctgacaagctggccaaagtcacttccccaagatctgccagacctgcatggtcaagcctcttatgggggtgtttctatctctttctttctctttctgtttcctggcctcagagcttcctggggaccaagatttaccaattcacccactcccttgaagttgtggaggaggtgaaagaaagggacccacctgctagtcgcccctcagagcatgatgggaggtgtgccagaaagtcccccctcgccccaaagttgctcaccgactcacctgcgcaagtgcctgggattctaccgtaattgctttgtgcctttgggcacggccctccttcttttcctaacatgcaccttgctcccaatggtgcttggagggggaagagatcccaggaggtgcagtggagggggcaagctttgctccttcagttctgcttgctcccaagcccctgacccgctcggacttactgcctgaccttggaatcgtccctatatcagggcctgagtgacctccttctgcaaagtggcagggaccggcagagctctacaggcctgcagcccctaagtgcaaacacagcatgggtccagaagacgtggtctagaccagggctgctctttccacttgccctgtgttctttccccaggggcatgactgtcgccacacgcctctgtgtacatgtgtgcagagcagacaggctacaaagcagagatcgacagacagccaggtagttggaactttctgttccctatggagaggcttccctacacagggcctgctattgcagaatgaagccatttagagggtgaaggagaaatacccatgttacttctctgagttttagttggtctttccatctatcactgcattatcttgctcattcttcagttctctactccctcttgtcagtgtagacacaggtcaccattatgctggtgtatgtttatcaaagagcacttgagctgtctgaagcccaaagcctgaggacagaaagaccctgatgcaggtcagcccatggaggcagatgcccttgctgggcctgggggttttccaagccctcagctggtcctgaccaggatggagcaagctcttcccttgctcatgagctcctgatcagaggcatttgagcagctgaataacctgcacaggcttgctgtatgacccctggccacagccttccctctgcattgacctggaggggagaggtcagccttgacctaatgaggtagctatagttgcagcccaaggacagttcagagatcaggatcagctttgaaggctggattctatctacataagtcctttcaattccaccagggccagagcagctccaccactgtgcacttagccatgatggcaacagaaaccaagagacacaattacgcaggtatttagtggaccgtgcagagctctacagtgcctgcagccccttaagtgcaaacgtgtgcatgg

SEQ ID NO: 300040 - DNA, 812 bp, Homo sapiens
ggtcgactactactactaaattcgcggccgcgtcgactgggggttttccaagccctcagctggtcctgaccaggatggagcaagctcttcccttgctcatgagctcctgatcagaggcatttgagcagctgaataacctgcacaggcttgctgtatgacccctggccacagccttccctctgcattgacctggaggggagaggtcagccttgacctaatgaggtagctatagttgcagcccaaggacagttcagagatcaggatcagctttgaaggctggattctatctacataagtcctttcaattccaccagggccagagcagctccaccactgtgcacttagccatgatggcaacagaaaccaagagacacaattacgcaggtatttagaagcagagggacaaccagaaggcccttaactatcaccagtgcatcacatctgcacactctcttctccattccctagcaggaacttctagctcatttaacagataaagaaactgaggcccacggtttcagctagacaatgatttggccaggcctagtaaccaaggccctgtctctggctactccctggaccacgaggctgattcctctcatttccagcttctcagtttctgcctgggcaatggccaggggccaggagtggggagagttgtgatggaggggagaggggtcacacccaccccctgcctggttctaggctgctgcacaccaaggccctgcatctgtctgctctgcatatatgtctctttggagttggaatttcattatatgttaagaaaataaaggaaaatgacttgtaaggtc

SEQ ID NO: 300041 - DNA, 830 bp, Homo sapiens
ctcttcatgagcagtgtcccccacctgtaggtcatgttggcacagccacgcttccacagttccagaatcaccgtggaccagatgaggttgaatgaggcaaagatcacgtacttgtcatagtcttcccacacaaacaagtagtaaggtaacccaatgacagccatggtgccatttactccctggccacagccttccctctgcattgacctggaggggagaggtcagccttgacctaatgaggtagctatagttgcagcccaaggacagttcagagatcaggatcagctttgaaggctggattctatctacataagtcctttcaattccaccagggccagagcagctccaccactgtgcacttagccatgatggcaacagaaaccaagagacacaattacgcaggtatttagaagcagagggacaaccagaaggcccttaactatcaccagtgcatcacatctgcacactctcttctccattccctagcaggaacttctagctcatttaacagataaagaaactgaggcccacggtttcagctagacaatgatttggccaggcctagtaaccaaggccctgtctctggctactccctggaccacgaggctgattcctctcatttccagcttctcagtttctgcctgggcaatggccaggggccaggagtggggagagttgtgatggaggggagaggggtcacacccaccccctgcctggttctaggctgctgcacaccaaggccctgcatctgtctgctctgcatatatgtctctttggagttggaatttcattatatgttaagaaaataaaggaaaatgacttgtaaggtc

SEQ ID NO: 300042 - DNA, 1901 bp, Homo sapiens
  misc_feature (1884)..(1884): n is a, c, g, or t
  misc_feature (1890)..(1890): n is a, c, g, or t
agcggagctctcagagggaattgagcacccggcagcggtctcaggccaagccccctgccagcatggccagcgagttcaagaagaagctcttctggagggcagtggtggccgagttcctggccacgaccctctttgtcttcatcagcatcggttctgccctgggcttcaaatacccggtggggaacaaccagacggcggtccaggacaacgtgaaggtgtcgctggccttcgggctgagcatcgccacgctggcgcagagtgtgggccacatcagcggcgcccacctcaacccggctgtcacactggggctgctgctcagctgccagatcagcatcttccgtgccctcatgtacatcatcgcccagtgcgtgggggccatcgtcgccaccgccatcctctcaggcatcacctcctccctgactgggaactcgcttggccgcaatgacctggctgatggtgtgaactcgggccagggcctgggcatcgagatcatcgggaccctccagctggtgctatgcgtgctggctactaccgaccggaggcgccgtgaccttggtggctcagccccccttgccatcggcctctctgtagcccttggacacctcctggctattgactacactggctgtgggattaaccctgctcggtcctttggctccgcggtgatcacacacaacttcagcaaccactggattttctgggtggggccattcatcgggggagccctggctgtactcatctacgacttcatcctggccccacgcagcagtgacctcacagaccgcgtgaaggtgtggaccagcggccaggtggaggagtatgacctggatgccgacgacatcaactccagggtggagatgaagcccaaatagaaggggtctggcccgggcatccacgtagggggcaggggcaggggcgggcggagggaggggaggggtgaaatccatactgtagacactctgacaagctggccaaagtcacttccccaagatctgccagacctgcatggtcaagcctcttatgggggtgtttctatctctttctttctctttctgtttcctggcctcagagcttcctggggaccaagatttaccaattcacccactcccttgaagttgtggaggaggtgaaagaaagggacccacctgctagtcgcccctcagagcatgatgggaggtgtgccagaaagtcccccctcgccccaaagttgctcaccgactcacctgcgcaagtgcctgggattctaccgtaattgctttgtgcctttgggcacggccctccttcttttcctaacatgcaccttgctcccaatggtgcttggagggggaagagatcccaggaggtgcagtggagggggcaagctttgctccttcagttctgcttgctcccaagcccctgacccgctcggacttactgcctgaccttggaatcgtccctatatcagggcctgagtgacctccttctgcaaagtggcagggaccggcagagctctacaggcctgcagcccctaagtgcaaacacagcatgggtccagaagacgtggtctagaccagggctgctctttccacttgccctgtgttctttccccaggggcatgactgtcgccacacgcctctgtgtacatgtgtgcagagcagacaggctacaaagcagagatcgacagacagccaggtagttggaactttctgttccctatggagaggcttccctacacagggcctgctattgcagaatgaagccatttagagggtgaaggagaaatacccatgttacttctctgagttttagttggtctttccatctatcactgcattatcttgctcattcttcagttctctactccctcttgtcagtgtagacacaggtcaccattatgctgggacngaagtnctgtaccggct

SEQ ID NO: 300043 - DNA, 385 bp, Homo sapiens
tttgtgctccaggaaaaagcactgtgtattgtaagaaattagatgaattttcaaactcacatagcgtttgaaaaacgagatagaaatctcgttttaggctgggcgcggtggctcacgcctgtaattccagcagtttgggaggccgaggcgagtggatcctgggtggtcaggagttcaagatcagcctgaccaacatggtgaaaccccatctctactaaaaatacaaaaattagccgaacatggcgcacgcttgtgatcccagctactcaggaggctgagtcaggagaaccgctggaacccgggcggtggaggttgcagtgagccaagattgtgccactgcactccagcctgggggacagagcaagactgcatctcaaaaaaagaa

SEQ ID NO: 300044 - DNA, 1765 bp, Homo sapiens
agcaccgtgcgcctcccgcctacggagaactacatgccccagcctgccccgcgaagggaagaagtcaggaggccccgcttcgcgctaacgcttgcgatggttgaattcccctcctcacgccagcctaggagaagaagttcgtagtcccagaggtgaggcaggaggcggcagtttctggcgggtgagggcggagctgaagtgacagcggaggcggaagcaacggtcggtggggcggagaagggggctggccccaggaggaggaggaaacccttccgagaaaacagcaacaagctgagctgctgtgacagaggggaacaagatggcggcgccgaaggggagcctctgggtgaggacccaactggggctcccgccgctgctgctgctgaccatggccttggccggaggttcggggaccgcttcggctgaagcatttgactcggtcttgggtgatacggcgtcttgccaccgggcctgtcagttgacctaccccttgcacacctaccctaaggaagaggagttgtacgcatgtcagagaggttgcaggctgttttcaatttgtcagtttgtggatgatggaattgacttaaatcgaactaaattggaatgtgaatctgcatgtacagaagcatattcccaatctgatgagcaatatgcttgccatcttggttgccagaatcagctgccattcgctgaactgagacaagaacaacttatgtccctgatgccaaaaatgcacctactctttcctctaactctggtgaggtcattctggagtgacatgatggactccgcacagagcttcataacctcttcatggactttttatcttcaagccgatgacggaaaaatagttatattccagtctaagccagaaatccagtacgcaccacatttggagcaggagcctacaaatttgagagaatcatctctaagcaaaatgtcctatctgcaaatgagaaattcacaagcgcacaggaattttcttgaagatggagaaagtgatggctttttaagatgcctctctcttaactctgggtggattttaactacaactcttgtcctctcggtgatggtattgctttggatttgttgtgcaactgttgctacagctgtggagcagtatgttccctctgagaagctgagtatctatggtgacttggagtttatgaatgaacaaaagctaaacagatatccagcttcttctcttgtggttgttagatctaaaactgaagatcatgaagaagcagggcctctacctacaaaagtgaatcttgctcattctgaaatttaagcatttttcttttaaaagacaagtgtaatagacatctaaaattccactcctcatagagcttttaaaatggtttcattggatataggccttaagaaatcactataaaatgcaaataaagttactcaaatctgtgaagactgtatttgctataactttattggtattgtttttgtagtaatttaagaggtggatgtttgggattgtattattattttactaatatctgtagctattttgttttttgctttggttattgtttttttcccttttcttagctatgagctgatcattgctccttctcacctcctgccatgatactgtcagttaccttagttaacaagctgaatatttagtagaaatgatgcttctgctcaggaatggcccacaaatctgtaatttgaaatttagcaggaaatgacctttaatgacactacattttcaggaactgaaatcattaaaattttatttgaataa

SEQ ID NO: 300045 - DNA, 776 bp, Homo sapiens
  misc_feature (46)..(46): n is a, c, g, or t
gttgctacagctgggacagggttgaaaaattttggggttgttttancccccccccctttctccctttggtaaaggaaaagctgagtatctatggtgacttggagtttatgaatgaacaaaagctaaacagatatccagcttcttctcttgtggttgttagatctaaaactgaagatcatgaagaagcagggcctctacctacaaaagtgaatcttgctcattctgaaatttaagcatttttcttttaaaagacaagtgtaatagacatctaaaattccactcctcatagagcttttaaaatggtttcattggatataggccttaagaaatcactataaaatgcaaataaagttactcaaatctgtgaagactgtatttgctataactttattggtattgtttttgtagtaatttaagaggtggatgtttgggattgtattattattttactaatatctgtagctattttgttttttgctttggttattgtttttttcccttttcttagctatgagctgatcattgctccttctcacctcctgccatgatactgtcagttaccttagttaacaagctgaatatttagtagaaatgatgcttctgctcaggaatggcccacaaatctgtaatttgaaatttagcaggaaatgacctttaatgacactacattttcaggaactgaaatcattaaaattttatttgaataattatgtgctgaaatttgagtatctgatttttctagaccttccctcctattcctgcccaacctagataag

SEQ ID NO: 300046 - DNA, 480 bp, Homo sapiens
ctaagtacataaggttgactaattaagaatttcctgtttcttataaaattttaatataactaattgttgattttttttttccagtaactctgggtggattttaactacaactcttgtcctctcggtgatggtattgctttggatttgttgtgcaactgttgctacagctgtggagcagtatgttccctctgagaagctgagtatctatggtgacttggagtttatgaatgaacaaaagctaaacagatatccagcttcttctcttgtggttgttagatctaaaactgaagatcatgaagaagcagggcctctacctacaaaagtgaatcttgctcattctgaaatttaagcatttttcttttaaaagacaagtgtaatagacatctaaaattccactcctcatagagcttttaaaatggtttcattggatataggccttaagaaatcactataaaatgcaaataaagttactcaaatctg

SEQ ID NO: 300047 - DNA, 364 bp, Homo sapiens
  misc_feature (46)..(46): n is a, c, g, or t
gttgctacagctgggacagggttgaaaaattttggggttgttttancccccccccctttctccctttggtaaaggaaaagctgagtatctatggtgacttggagtttatgaatgaacaaaagctaaacagatatccagcttcttctcttgtggttgttagatctaaaactgaagatcatgaagaagcagggcctctacctacaaaagtgaatcttgctcattctgaaatttaagcatttttcttttaaaagacaagtgtaatagacatctaaaattccactcctcatagagcttttaaaatggtttcattggatataggccttaagaaatcactataaaatgcaaataaagttactcaaatctg

SEQ ID NO: 300048 - DNA, 405 bp, Homo sapiens
attctacaccctagtaggctcccttcccctactaaaaaaaaaaaaaaaaaaaaaaaaaaaaaaaaaaaaaaaaaaaaaaaactcgagactagttctctctctctctctcctcgggccgaattcggcacgatggcggcgccgaaggggagcctctgggtgaggacccaactggggctcccgccgctgctgctgctgaccatggccttggccggaggttcggggaccgcttcggctgaagcatttgactcggtcttgggtgatacggcgtcttgccaccgggcctgtcagttgacctaccccttgcacacctaccctaagaacaggagacggccgcatgtaatataggttaaaaattgcaaaaatttggataggcaaaccatatcttaaagccgatggccaaacttt

SEQ ID NO: 300049 - DNA, 364 bp, Homo sapiens
tccagtgaagatattatcctcattttacatatgaaaaaaccaaggctcagaggaattatttcagagttctttttctccatcccaactcccattggacagttgccattgccttaactcagataatcatttcttgtctgtatttttaaattaacttccaaactgtttttctaatttaaccctgtctaactccatcctttgctgtgtccagatttttttttctaaatttcatcatgccattctcctgtcttatataatcagtagctcccaattacatataggatttaagtccaaactgtttatcacaacctactcctgattactgctccaatgccatctctttaaaatttcctgacaagggaatttc

SEQ ID NO: 300050 - DNA, 1834 bp, Homo sapiens
agcaccgtgcgcctcccgcctacggagaactacatgccccagcctgccccgcgaagggaagaagtcaggaggccccgcttcgcgctaacgcttgcgatggttgaattcccctcctcacgccagcctaggagaagaagttcgtagtcccagaggtgaggcaggaggcggcagtttctggcgggtgagggcggagctgaagtgacagcggaggcggaagcaacggtcggtggggcggagaagggggctggccccaggaggaggaggaaacccttccgagaaaacagcaacaagctgagctgctgtgacagaggggaacaagatggcggcgccgaaggggagcctctgggtgaggacccaactggggctcccgccgctgctgctgctgaccatggccttggccggaggttcggggaccgcttcggctgaagcatttgactcggtcttgggtgatacggcgtcttgccaccgggcctgtcagttgacctaccccttgcacacctaccctaaggaagaggagttgtacgcatgtcagagaggttgcaggctgttttcaatttgtcagtttgtggatgatggaattgacttaaatcgaactaaattggaatgtgaatctgcatgtacagaagcatattcccaatctgatgagcaatatgcttgccatcttggttgccagaatcagctgccattcgctgaactgagacaagaacaacttatgtccctgatgccaaaaatgcacctactctttcctctaactctggtgaggtcattctggagtgacatgatggactccgcacagagcttcataacctcttcatggactttttatcttcaagccgatgacggaaaaatagttatattccagtctaagccagaaatccagtacgcaccacatttggagcaggagcctacaaatttgagagaatcatctctaagcaaaatgtcctatctgcaaatgagaaattcacaagcgcacaggaattttcttgaagatggagaaagtgatggctttttaagatgcctctctcttaactctgggtggattttaactacaactcttgtcctctcggtgatggtattgctttggatttgttgtgcaactgttgctacagctgtggagcagtatgttccctctgagaagctgagtatctatggtgacttggagtttatgaatgaacaaaagctaaacagatatccagcttcttctcttgtggttgttagatctaaaactgaagatcatgaagaagcagggcctctacctacaaaagtgaatcttgctcattctgaaatttaagcatttttcttttaaaagacaagtgtaatagacatctaaaattccactcctcatagagcttttaaaatggtttcattggatataggccttaagaaatcactataaaatgcaaataaagttactcaaatctgtgaagactgtatttgctataactttattggtattgtttttgtagtaatttaagaggtggatgtttgggattgtattattattttactaatatctgtagctattttgttttttgctttggttattgtttttttcccttttcttagctatgagctgatcattgctccttctcacctcctgccatgatactgtcagttaccttagttaacaagctgaatatttagtagaaatgatgcttctgctcaggaatggcccacaaatctgtaatttgaaatttagcaggaaatgacctttaatgacactacattttcaggaactgaaatcattaaaattttatttgaataattatgtgctgaaatttgagtatctgatttttctagaccttccctcctattcctgcccaacctagataag

SEQ ID NO: 300051 - DNA, 2371 bp, Homo sapiens
agcaccgtgcgcctcccgcctacggagaactacatgccccagcctgccccgcgaagggaagaagtcaggaggccccgcttcgcgctaacgcttgcgatggttgaattcccctcctcacgccagcctaggagaagaagttcgtagtcccagaggtgaggcaggaggcggcagtttctggcgggtgagggcggagctgaagtgacagcggaggcggaagcaacggtcggtggggcggagaagggggctggccccaggaggaggaggaaacccttccgagaaaacagcaacaagctgagctgctgtgacagaggggaacaagatggcggcgccgaaggggagcctctgggtgaggacccaactggggctcccgccgctgctgctgctgaccatggccttggccggaggttcggggaccgcttcggctgaagcatttgactcggtcttgggtgatacggcgtcttgccaccgggcctgtcagttgacctaccccttgcacacctaccctaaggaagaggagttgtacgcatgtcagagaggttgcaggctgttttcaatttgtcagtttgtggatgatggaattgacttaaatcgaactaaattggaatgtgaatctgcatgtacagaagcatattcccaatctgatgagcaatatgcttgccatcttggttgccagaatcagctgccattcgctgaactgagacaagaacaacttatgtccctgatgccaaaaatgcacctactctttcctctaactctggtgaggtcattctggagtgacatgatggactccgcacagagcttcataacctcttcatggactttttatcttcaagccgatgacggaaaaatagttatattccagtctaagccagaaatccagtacgcaccacatttggagcaggagcctacaaatttgagagaatcatctctaagcaaaatgtcctatctgcaaatgagaaattcacaagcgcacaggaattttcttgaagatggagaaagtgatggctttttaagatgcctctctcttaactctgggtggattttaactacaactcttgtcctctcggtgatggtattgctttggatttgttgtgcaactgttgctacagctgtggagcagtatgttccctctgagaagctgagtatctatggtgacttggagtttatgaatgaacaaaagctaaacagatatccagcttcttctcttgtggttgttagatctaaaactgaagatcatgaagaagcagggcctctacctacaaaagtgaatcttgctcattctgaaatttaagcatttttcttttaaaagacaagtgtaatagacatctaaaattccactcctcatagagcttttaaaatggtttcattggatataggccttaagaaatcactataaaatgcaaataaagttactcaaatctgtgaagactgtatttgctataactttattggtattgtttttgtagtaatttaagaggtggatgtttgggattgtattattattttactaatatctgtagctattttgttttttgctttggttattgtttttttcccttttcttagctatgagctgatcattgctccttctcacctcctgccatgatactgtcagttaccttagttaacaagctgaatatttagtagaaatgatgcttctgctcaggaatggcccacaaatctgtaatttgaaatttagcaggaaatgacctttaatgacactacattttcaggaactgaaatcattaaaattttatttgaataaaaaaacaacacacaccaacaaccaacaacacaacaaatcacaacaccaaaccacaacacacaacacaaccacaacccaaacaccacaccgactcaacgcaaaaaaacaaaaacaaaaaaggggggccacatatatacaaaatctcgacagagggagcacatattatgaccaccagtttttgttaaaaagaggcccaataattatgaaatttatataaaaaaaccagaacagcggattatacacacagcgctggaagaaacacattatatggactctcttgtggaagacccccaatacgaggggcgacacacagcggaaaaccaccacaaataattagagccgggagataaaacaaggaggaatgtgttgaaaccgcaattttgccgcgaaaagtgctccggattttttattaatagacgggggccgtggttcattaacacactacgtcgttaccgctatcgctgcgcgatcgggtgctgatgccgtctcgcctctcgggatgtgagtacaaccccagacacaacacgagtagtatgtagacttgtaccgaacaacgagagcagctcactgaacaacacagagagaggacgagatcaggctactaaa

SEQ ID NO: 300052 - DNA, 1708 bp, Homo sapiens
agcaccgtgcgcctcccgcctacggagaactacatgccccagcctgccccgcgaagggaagaagtcaggaggccccgcttcgcgctaacgcttgcgatggttgaattcccctcctcacgccagcctaggagaagaagttcgtagtcccagaggtgaggcaggaggcggcagtttctggcgggtgagggcggagctgaagtgacagcggaggcggaagcaacggtcggtggggcggagaagggggctggccccaggaggaggaggaaacccttccgagaaaacagcaacaagctgagctgctgtgacagaggggaacaagatggcggcgccgaaggggagcctctgggtgaggacccaactggggctcccgccgctgctgctgctgaccatggccttggccggaggttcggggaccgcttcggctgaagcatttgactcggtcttgggtgatacggcgtcttgccaccgggcctgtcagttgacctaccccttgcacacctaccctaaggaagaggagttgtacgcatgtcagagaggttgcaggctgttttcaatttgtcagtttgtggatgatggaattgacttaaatcgaactaaattggaatgtgaatctgcatgtacagaagcatattcccaatctgatgagcaatatgcttgccatcttggttgccagaatcagctgccattcgctgaactgagacaagaacaacttatgtccctgatgccaaaaatgcacctactctttcctctaactctggtgaggtcattctggagtgacatgatggactccgcacagagcttcataacctcttcatggactttttatcttcaagccgatgacggaaaaatagttatattccagtctaagccagaaatccagtacgcaccacatttggagcaggagcctacaaatttgagagaatcatctctaagcaaaatgtcctatctgcaaatgagaaattcacaagcgcacaggaattttcttgaagatggagaaagtgatggctttttaagatgcctctctcttaactctgggtggattttaactacaactcttgtcctctcggtgatggtattgctttggatttgttgtgcaactgttgctacagctgtggagcagtatgttccctctgagaagctgagtatctatggtgacttggagtttatgaatgaacaaaagctaaacagatatccagcttcttctcttgtggttgttagatctaaaactgaagatcatgaagaagcagggcctctacctacaaaagtgaatcttgctcattctgaaatttaagcatttttcttttaaaagacaagtgtaatagacatctaaaattccactcctcatagagcttttaaaatggtttcattggatataggccttaagaaatcactataaaatgcaaataaagttactcaaatctgtgaagactgtatttgctataactttattggtattgtttttgtagtaatttaagaggtggatgtttgggattgtattattattttactaatatctgtagctattttgttttttgctttggttattgtttttttcccttttcttagctatgagctgatcattgctccttctcacctaagaaaagggataaaagacaacatattggtacagtgaacactgctcgggtgatgggtgcaccaaaatctcagaattgaccactaaagaactcgttcatgtaatgaaaaacca

SEQ ID NO: 300053 - DNA, 1409 bp, Homo sapiens
agcaccgtgcgcctcccgcctacggagaactacatgccccagcctgccccgcgaagggaagaagtcaggaggccccgcttcgcgctaacgcttgcgatggttgaattcccctcctcacgccagcctaggagaagaagttcgtagtcccagaggaagaggagttgtacgcatgtcagagaggttgcaggctgttttcaatttgtcagtttgtggatgatggaattgacttaaatcgaactaaattggaatgtgaatctgcatgtacagaagcatattcccaatctgatgagcaatatgcttgccatcttggttgccagaatcagctgccattcgctgaactgagacaagaacaacttatgtccctgatgccaaaaatgcacctactctttcctctaactctggtgaggtcattctggagtgacatgatggactccgcacagagcttcataacctcttcatggactttttatcttcaagccgatgacggaaaaatagttatattccagtctaagccagaaatccagtacgcaccacatttggagcaggagcctacaaatttgagagaatcatctctaagcaaaatgtcctatctgcaaatgagaaattcacaagcgcacaggaattttcttgaagatggagaaagtgatggctttttaagatgcctctctcttaactctgggtggattttaactacaactcttgtcctctcggtgatggtattgctttggatttgttgtgcaactgttgctacagctgtggagcagtatgttccctctgagaagctgagtatctatggtgacttggagtttatgaatgaacaaaagctaaacagatatccagcttcttctcttgtggttgttagatctaaaactgaagatcatgaagaagcagggcctctacctacaaaagtgaatcttgctcattctgaaatttaagcatttttcttttaaaagacaagtgtaatagacatctaaaattccactcctcatagagcttttaaaatggtttcattggatataggccttaagaaatcactataaaatgcaaataaagttactcaaatctgtgaagactgtatttgctataactttattggtattgtttttgtagtaatttaagaggtggatgtttgggattgtattattattttactaatatctgtagctattttgttttttgctttggttattgtttttttcccttttcttagctatgagctgatcattgctccttctcacctcctgccatgatactgtcagttaccttagttaacaagctgaatatttagtagaaatgatgcttctgctcaggaatggcccacaaatctgtaatttgaaatttagcaggaaatgacctttaatgacactacattttcaggaactgaaatcattaaaattttatttgaataa

SEQ ID NO: 300054 - DNA, 1422 bp, Homo sapiens
agcaccgtgcgcctcccgcctacggagaactacatgccccagcctgccccgcgaagggaagaagtcaggaggccccgcttcgcgctaacgcttgcgatggttgaattcccctcctcacgccagcctaggagaagaagttcgtagtcccagaggtgaggcaggaggcggcagtttctggcgggtgagggcggagctgaagtgacagcggaggcggaagcaacggtcggtggggcggagaagggggctggccccaggaggaggaggaaacccttccgagaaaacagcaacaagctgagctgctgtgacagaggggaacaagatggcggcgccgaaggggagcctctgggtgaggacccaactggggctcccgccgctgctgctgctgaccatggccttggccggaggttcggggaccgcttcggctgaagcatttgactcggtcttgggtgatacggcgtcttgccaccgggcctgtcagttgacctaccccttgcacacctaccctaaggaagaggagttgtacgcatgtcagagaggttgcaggctgttttcaatttgtcagtttgtggatgatggaattgacttaaatcgaactaaattggaatgtgaatctgcatgtacagaagcatattcccaatctgatgagcaatatgcttgccatcttggttgccagaatcagctgccattcgctgaactgagacaagaacaacttatgtccctgatgccaaaaatgcacctactctttcctctaactctggtgaggtcattctggagtgacatgatggactccgcacagagcttcataacctcttcatggactttttatcttcaagccgatgacggaaaaatagttatattccagtctaagccagaaatccagtacgcaccacatttggagcaggagcctacaaatttgagagaatcatctctaagcaaaatgtcctatctgcaaatgagaaattcacaagcgcacaggaattttcttgaagatggagaaagtgatggctttttaagatgcctctctcttaactctgggtggattttaactacaactcttgtcctctcggtgatggtattgctttggatttgttgtgcaactgttgctacagctgtggagcagtatgttccctctgagaagctgagtatctatggtgacttggagtttatgaatgaacaaaagctaaacagatatccagcttcttctcttgtggttgttagatctaaaactgaagatcatgaagaagcagggcctctacctacaaaagtgaatcttgctcattctgaaatttaagcatttttcttttaaaagacaagtgtaatagacatctaaaattccactcctcatagagcttttaaaatggtttcattggatataggccttaagaaatcactataaaatgcaaataaagttactcaaatctg

SEQ ID NO: 300055 - DNA, 1724 bp, Homo sapiens
agcaccgtgcgcctcccgcctacggagaactacatgccccagcctgccccgcgaagggaagaagtcaggaggccccgcttcgcgctaacgcttgcgatggttgaattcccctcctcacgccagcctaggagaagaagttcgtagtcccagaggtgaggcaggaggcggcagtttctggcgggtgagggcggagctgaagtgacagcggaggcggaagcaacggtcggtggggcggagaagggggctggccccaggaggaggaggaaacccttccgagaaaacagcaacaagctgagctgctgtgacagaggggaacaagatggcggcgccgaaggggagcctctgggtgaggacccaactggggctcccgccgctgctgctgtgaagcatttgactcggtcttgggtgatacggcgtcttgccaccgggcctgtcagttgacctaccccttgcacacctaccctaaggaagaggagttgtacgcatgtcagagaggttgcaggctgttttcaatttgtcagtttgtggatgatggaattgacttaaatcgaactaaattggaatgtgaatctgcatgtacagaagcatattcccaatctgatgagcaatatgcttgccatcttggttgccagaatcagctgccattcgctgaactgagacaagaacaacttatgtccctgatgccaaaaatgcacctactctttcctctaactctggtgaggtcattctggagtgacatgatggactccgcacagagcttcataacctcttcatggactttttatcttcaagccgatgacggaaaaatagttatattccagtctaagccagaaatccagtacgcaccacatttggagcaggagcctacaaatttgagagaatcatctctaagcaaaatgtcctatctgcaaatgagaaattcacaagcgcacaggaattttcttgaagatggagaaagtgatggctttttaagatgcctctctcttaactctgggtggattttaactacaactcttgtcctctcggtgatggtattgctttggatttgttgtgcaactgttgctacagctgtggagcagtatgttccctctgagaagctgagtatctatggtgacttggagtttatgaatgaacaaaagctaaacagatatccagcttcttctcttgtggttgttagatctaaaactgaagatcatgaagaagcagggcctctacctacaaaagtgaatcttgctcattctgaaatttaagcatttttcttttaaaagacaagtgtaatagacatctaaaattccactcctcatagagcttttaaaatggtttcattggatataggccttaagaaatcactataaaatgcaaataaagttactcaaatctgtgaagactgtatttgctataactttattggtattgtttttgtagtaatttaagaggtggatgtttgggattgtattattattttactaatatctgtagctattttgttttttgctttggttattgtttttttcccttttcttagctatgagctgatcattgctccttctcacctcctgccatgatactgtcagttaccttagttaacaagctgaatatttagtagaaatgatgcttctgctcaggaatggcccacaaatctgtaatttgaaatttagcaggaaatgacctttaatgacactacattttcaggaactgaaatcattaaaattttatttgaataa

SEQ ID NO: 300056 - DNA, 1442 bp, Homo sapiens
agcaccgtgcgcctcccgcctacggagaactacatgccccagcctgccccgcgaagggaagaagtcaggaggccccgcttcgcgctaacgcttgcgatggttgaattcccctcctcacgccagcctaggagaagaagttcgtagtcccagaggtgtctgccagtttgtacacagtggatcacatagaagaggagttgtacgcatgtcagagaggttgcaggctgttttcaatttgtcagtttgtggatgatggaattgacttaaatcgaactaaattggaatgtgaatctgcatgtacagaagcatattcccaatctgatgagcaatatgcttgccatcttggttgccagaatcagctgccattcgctgaactgagacaagaacaacttatgtccctgatgccaaaaatgcacctactctttcctctaactctggtgaggtcattctggagtgacatgatggactccgcacagagcttcataacctcttcatggactttttatcttcaagccgatgacggaaaaatagttatattccagtctaagccagaaatccagtacgcaccacatttggagcaggagcctacaaatttgagagaatcatctctaagcaaaatgtcctatctgcaaatgagaaattcacaagcgcacaggaattttcttgaagatggagaaagtgatggctttttaagatgcctctctcttaactctgggtggattttaactacaactcttgtcctctcggtgatggtattgctttggatttgttgtgcaactgttgctacagctgtggagcagtatgttccctctgagaagctgagtatctatggtgacttggagtttatgaatgaacaaaagctaaacagatatccagcttcttctcttgtggttgttagatctaaaactgaagatcatgaagaagcagggcctctacctacaaaagtgaatcttgctcattctgaaatttaagcatttttcttttaaaagacaagtgtaatagacatctaaaattccactcctcatagagcttttaaaatggtttcattggatataggccttaagaaatcactataaaatgcaaataaagttactcaaatctgtgaagactgtatttgctataactttattggtattgtttttgtagtaatttaagaggtggatgtttgggattgtattattattttactaatatctgtagctattttgttttttgctttggttattgtttttttcccttttcttagctatgagctgatcattgctccttctcacctcctgccatgatactgtcagttaccttagttaacaagctgaatatttagtagaaatgatgcttctgctcaggaatggcccacaaatctgtaatttgaaatttagcaggaaatgacctttaatgacactacattttcaggaactgaaatcattaaaattttatttgaataa

SEQ ID NO: 300057 - DNA, 1603 bp, Homo sapiens
agcaccgtgcgcctcccgcctacggagaactacatgccccagcctgccccgcgaagggaagaagtcaggaggccccgcttcgcgctaacgcttgcgatggttgaattcccctcctcacgccagcctaggagaagaagttcgtagtcccagaggtgaggcaggaggcggcagtttctggcgggtgagggcggagctgaagtgacagcggaggcggaagcaacggtcggtggggcggagaagggggctggccccaggaggaggaggaaacccttccgagaaaacagcaacaagctgagctgctgtgacagaggggaacaagatggcggcgccgaaggggagcctctgggaagaggagttgtacgcatgtcagagaggttgcaggctgttttcaatttgtcagtttgtggatgatggaattgacttaaatcgaactaaattggaatgtgaatctgcatgtacagaagcatattcccaatctgatgagcaatatgcttgccatcttggttgccagaatcagctgccattcgctgaactgagacaagaacaacttatgtccctgatgccaaaaatgcacctactctttcctctaactctggtgaggtcattctggagtgacatgatggactccgcacagagcttcataacctcttcatggactttttatcttcaagccgatgacggaaaaatagttatattccagtctaagccagaaatccagtacgcaccacatttggagcaggagcctacaaatttgagagaatcatctctaagcaaaatgtcctatctgcaaatgagaaattcacaagcgcacaggaattttcttgaagatggagaaagtgatggctttttaagatgcctctctcttaactctgggtggattttaactacaactcttgtcctctcggtgatggtattgctttggatttgttgtgcaactgttgctacagctgtggagcagtatgttccctctgagaagctgagtatctatggtgacttggagtttatgaatgaacaaaagctaaacagatatccagcttcttctcttgtggttgttagatctaaaactgaagatcatgaagaagcagggcctctacctacaaaagtgaatcttgctcattctgaaatttaagcatttttcttttaaaagacaagtgtaatagacatctaaaattccactcctcatagagcttttaaaatggtttcattggatataggccttaagaaatcactataaaatgcaaataaagttactcaaatctgtgaagactgtatttgctataactttattggtattgtttttgtagtaatttaagaggtggatgtttgggattgtattattattttactaatatctgtagctattttgttttttgctttggttattgtttttttcccttttcttagctatgagctgatcattgctccttctcacctcctgccatgatactgtcagttaccttagttaacaagctgaatatttagtagaaatgatgcttctgctcaggaatggcccacaaatctgtaatttgaaatttagcaggaaatgacctttaatgacactacattttcaggaactgaaatcattaaaattttatttgaataa

SEQ ID NO: 300058 - DNA, 1308 bp, Homo sapiens
agagcatcaggtaccacaccgttgtcagttgacactacccccttgcacaccgaagaggagttgtacgcatgtcagagaggttgcaggctgttttcaatttgtcagtttgtggatgatggaattgacttaaatcgaactaaattggaatgtgaatctgcatgtacagaagcatattcccaatctgatgagcaatatgcttgccatcttggttgccagaatcagctgccattcgctgaactgagacaagaacaacttatgtccctgatgccaaaaatgcacctactctttcctctaactctggtgaggtcattctggagtgacatgatggactccgcacagagcttcataacctcttcatggactttttatcttcaagccgatgacggaaaaatagttatattccagtctaagccagaaatccagtacgcaccacatttggagcaggagcctacaaatttgagagaatcatctctaagcaaaatgtcctatctgcaaatgagaaattcacaagcgcacaggaattttcttgaagatggagaaagtgatggctttttaagatgcctctctcttaactctgggtggattttaactacaactcttgtcctctcggtgatggtattgctttggatttgttgtgcaactgttgctacagctgtggagcagtatgttccctctgagaagctgagtatctatggtgacttggagtttatgaatgaacaaaagctaaacagatatccagcttcttctcttgtggttgttagatctaaaactgaagatcatgaagaagcagggcctctacctacaaaagtgaatcttgctcattctgaaatttaagcatttttcttttaaaagacaagtgtaatagacatctaaaattccactcctcatagagcttttaaaatggtttcattggatataggccttaagaaatcactataaaatgcaaataaagttactcaaatctgtgaagactgtatttgctataactttattggtattgtttttgtagtaatttaagaggtggatgtttgggattgtattattattttactaatatctgtagctattttgttttttgctttggttattgtttttttcccttttcttagctatgagctgatcattgctccttctcacctcctgccatgatactgtcagttaccttagttaacaagctgaatatttagtagaaatgatgcttctgctcaggaatggcccacaaatctgtaatttgaaatttagcaggaaatgacctttaatgacactacattttcaggaactgaaatcattaaaattttatttgaataa

SEQ ID NO: 300059 - DNA, 2102 bp, Homo sapiens
agcaccgtgcgcctcccgcctacggagaactacatgccccagcctgccccgcgaagggaagaagtcaggaggccccgcttcgcgctaacgcttgcgatggttgaattcccctcctcacgccagcctaggagaagaagttcgtagtcccagaggtgaggcaggaggcggcagtttctggcgggtgagggcggagctgaagtgacagcggaggcggaagcaacggtcggtggggcggagaagggggctggccccaggaggaggaggaaacccttccgagaaaacagcaacaagctgagctgctgtgacagaggggaacaagatggcggcgccgaaggggagcctctgggtgaggacccaactggggctcccgccgctgctgctgctgaccatggccttggccggaggttcggggaccgcttcggctgaagcatttgactcggtcttgggtgatacggcgtcttgccaccgggcctgtcagttgacctaccccttgcacacctaccctaaggaagaggagttgtacgcatgtcagagaggttgcaggctgttttcaatttgtcagtttgtggatgatggaattgacttaaatcgaactaaattggaatgtgaatctgcatgtacagaagcatattcccaatctgatgagcaatatgcttgccatcttggttgccagaatcagctgccattcgctgaactgagacaagaacaacttatgtccctgatgccaaaaatgcacctactctttcctctaactctggtgaggtcattctggagtgacatgatggactccgcacagagcttcataacctcttcatggactttttatcttcaagccgatgacggaaaaatagttatattccagtctaagccagaaatccagtacgcaccacatttggagcaggagcctacaaatttgagagaatcatctctaagcaaaatgtcctatctgcaaatgagaaattcacaagcgcacaggaattttcttgaagatggagaaagtgatggctttttaagatgcctctctcttaactctgggtggattttaactacaactcttgtcctctcggtgatggtattgctttggatttgttgtgcaactgttgctacagctgtggagcagtatgttccctctgagaagctgagtatctatggtgacttggagtttatgaatgaacaaaagctaaacagatatccagcttcttctcttgtggttgttagatctaaaactgaagatcatgaagaagcagggcctctacctacaaaagtgaatcttgctcattctgaaatttaagcatttttcttttaaaagacaagtgtaatagacatctaaaattccactcctcatagagcttttaaaatggtttcattggatataggccttaagaaatcactataaaatgcaaataaagttactcaaatctgaaaaaaaaaataaaaaagaaataaaaatccagagtgaacgggtgatgaatatggtggcagggggaggatgtaagggaaagtttagggggagcgggaggatgatttgtgggaaaagcgagtgcatgatctctagggtggtgggcagacacaaatgctacaaatagggctgtgaccctgatcactgtgttctggaccccgagattgaggcggtacataaaacgcagggtattaaaaaagcccatctttaccaagccaagggcctttttcccaataaccaaacctggctgtttccttcaaccttgattttaaccaagcccaaagataccggagagtatgtcttgggccaacagctaaacctcgttgtgcacaacgactgggcccaagttgaatgcctcaaaaaggctgtgcaggaggagcccacactaaaagaggggagcccacccggggacacacagccaggcgtttcccggcgaaagagaaagcaaaacaccccaggtgtcaagcccaacgaagcgcaccacgaggggggtggccccgcgcgccgcgagagaagcaaagggacacacgtgtcaccgagcgacgggcagctatagagccaaggccacaggagccccctggtcaacactggccacaaagaataccactggctggacaaagtacacgccaagcaccagggggcc

SEQ ID NO: 300060 - DNA, 1303 bp, Homo sapiens
agcaccgtgcgcctcccgcctacggagaactacatgccccagcctgccccgcgaagggaagaagtcaggaggccccgcttcgcgctaacgcttgcgatggttgaattcccctcctcacgccagcctaggagaagaagttcgtagtcccagagcatgtacagaagcatattcccaatctgatgagcaatatgcttgccatcttggttgccagaatcagctgccattcgctgaactgagacaagaacaacttatgtccctgatgccaaaaatgcacctactctttcctctaactctggtgaggtcattctggagtgacatgatggactccgcacagagcttcataacctcttcatggactttttatcttcaagccgatgacggaaaaatagttatattccagtctaagccagaaatccagtacgcaccacatttggagcaggagcctacaaatttgagagaatcatctctaagcaaaatgtcctatctgcaaatgagaaattcacaagcgcacaggaattttcttgaagatggagaaagtgatggctttttaagatgcctctctcttaactctgggtggattttaactacaactcttgtcctctcggtgatggtattgctttggatttgttgtgcaactgttgctacagctgtggagcagtatgttccctctgagaagctgagtatctatggtgacttggagtttatgaatgaacaaaagctaaacagatatccagcttcttctcttgtggttgttagatctaaaactgaagatcatgaagaagcagggcctctacctacaaaagtgaatcttgctcattctgaaatttaagcatttttcttttaaaagacaagtgtaatagacatctaaaattccactcctcatagagcttttaaaatggtttcattggatataggccttaagaaatcactataaaatgcaaataaagttactcaaatctgtgaagactgtatttgctataactttattggtattgtttttgtagtaatttaagaggtggatgtttgggattgtattattattttactaatatctgtagctattttgttttttgctttggttattgtttttttcccttttcttagctatgagctgatcattgctccttctcacctcctgccatgatactgtcagttaccttagttaacaagctgaatatttagtagaaatgatgcttctgctcaggaatggcccacaaatctgtaatttgaaatttagcaggaaatgacctttaatgacactacattttcaggaactgaaatcattaaaattttatttgaataa

SEQ ID NO: 300061 - DNA, 1765 bp, Homo sapiens
agcaccgtgcgcctcccgcctacggagaactacatgccccagcctgccccgcgaagggaagaagtcaggaggccccgcttcgcgctaacgcttgcgatggttgaattcccctcctcacgccagcctaggagaagaagttcgtagtcccagaggtgaggcaggaggcggcagtttctggcgggtgagggcggagctgaagtgacagcggaggcggaagcaacggtcggtggggcggagaagggggctggccccaggaggaggaggaaacccttccgagaaaacagcaacaagctgagctgctgtgacagaggggaacaagatggcggcgccgaaggggagcctctgggtgaggacccaactggggctcccgccgctgctgctgctgaccatggccttggccggaggttcggggaccgcttcggctgaagcatttgactcggtcttgggtgatacggcgtcttgccaccgggcctgtcagttgacctaccccttgcacacctaccctaaggaagaggagttgtacgcatgtcagagaggttgcaggctgttttcaatttgtcagtttgtggatgatggaattgacttaaatcgaactaaattggaatgtgaatctgcatgtacagaagcatattcccaatctgatgagcaatatgcttgccatcttggttgccagaatcagctgccattcgctgaactgagacaagaacaacttatgtccctgatgccaaaaatgcacctactctttcctctaactctggtgaggtcattctggagtgacatgatggactccgcacagagcttcataacctcttcatggactttttatcttcaagccgatgacggaaaaatagttatattccagtctaagccagaaatccagtacgcaccacatttggagcaggagcctacaaatttgagagaatcatctctaagcaaaatgtcctatctgcaaatgagaaattcacaagcgcacaggaattttcttgaagatggagaaagtgatggctttttaagatgcctctctcttaactctgggtggattttaactacaactcttgtcctctcggtgatggtattgctttggatttgttgtgcaactgttgctacagctgtggagcagtatgttccctctgagaagctgagtatctatggtgacttggagtttatgaatgaacaaaagctaaacagatatccagcttcttctcttgtggttgttagatctaaaactgaagatcatgaagaagcagggcctctacctacaaaagtgaatcttgctcattctgaaatttaagcatttttcttttaaaagacaagtgtaatagacatctaaaattccactcctcatagagcttttgaagactgtatttgctataactttattggtattgtttttgtagtaatttaagaggtggatgtttgggattgtattattattttactaatatctgtagctattttgttttttgctttggttattgtttttttcccttttcttagctatgagctgatcattgctccttctcacctcctgccatgatactgtcagttaccttagttaacaagctgaatatttagtagaaatgatgcttctgctcaggaatggcccacaaatctgtaatttgaaatttagcaggaaatgacctttaatgacactacattttcaggaactgaaatcattaaaattttatttgaataattatgtgctgaaatttgagtatctgatttttctagaccttccctcctattcctgcccaacctagataag

SEQ ID NO: 300062 - DNA, 1564 bp, Homo sapiens
agcaccgtgcgcctcccgcctacggagaactacatgccccagcctgccccgcgaagggaagaagtcaggaggccccgcttcgcgctaacgcttgcgatggttgaattcccctcctcacgccagcctaggagaagaagttcgtagtcccagaggtgaggcaggaggcggcagtttctggcgggtgagggcggagctgaagtgacagcggaggcggaagcaacggtcggtggggcggagaagggggctggccccaggaggaggaggaaacccttccgagaaaacagcaacaagctgagctgctgtgacagaggggaacaagatggcggcgccgaaggggagcctctgggtgaggacccaactggggctcccgccgctgctgctgctgaccatggccttggccggaggttcggggaccgcttcggctgaagcatttgactcggtcttgggtgatacggcgtcttgccaccgggcctgtcagttgacctaccccttgcacacctaccctaagcttatgtccctgatgccaaaaatgcacctactctttcctctaactctggtgaggtcattctggagtgacatgatggactccgcacagagcttcataacctcttcatggactttttatcttcaagccgatgacggaaaaatagttatattccagtctaagccagaaatccagtacgcaccacatttggagcaggagcctacaaatttgagagaatcatctctaagcaaaatgtcctatctgcaaatgagaaattcacaagcgcacaggaattttcttgaagatggagaaagtgatggctttttaagatgcctctctcttaactctgggtggattttaactacaactcttgtcctctcggtgatggtattgctttggatttgttgtgcaactgttgctacagctgtggagcagtatgttccctctgagaagctgagtatctatggtgacttggagtttatgaatgaacaaaagctaaacagatatccagcttcttctcttgtggttgttagatctaaaactgaagatcatgaagaagcagggcctctacctacaaaagtgaatcttgctcattctgaaatttaagcatttttcttttaaaagacaagtgtaatagacatctaaaattccactcctcatagagcttttaaaatggtttcattggatataggccttaagaaatcactataaaatgcaaataaagttactcaaatctgtgaagactgtatttgctataactttattggtattgtttttgtagtaatttaagaggtggatgtttgggattgtattattattttactaatatctgtagctattttgttttttgctttggttattgtttttttcccttttcttagctatgagctgatcattgctccttctcacctcctgccatgatactgtcagttaccttagttaacaagctgaatatttagtagaaatgatgcttctgctcaggaatggcccacaaatctgtaatttgaaatttagcaggaaatgacctttaatgacactacattttcaggaactgaaatcattaaaattttatttgaataa

SEQ ID NO: 300063 - DNA, 1400 bp, Homo sapiens
agcaccgtgcgcctcccgcctacggagaactacatgccccagcctgccccgcgaagggaagaagtcaggaggccccgcttcgcgctaacgcttgcgatggttgaattcccctcctcacgccagcctaggagaagaagttcgtagtcccagaggtgaggcaggaggcggcagtttctggcgggtgagggcggagctgaagtgacagcggaggcggaagcaacggtcggtggggcggagaagggggctggccccaggaggaggaggaaacccttccgagaaaacagcaacaagctgagctgctgtgacagaggggaacaagatggcggcgccgaaggggagcctctgggtgaggacccaactggggctcccgccgctgctgctgctgaccatggccttggccggaggttcggggaccgcttcggctgaagcatttgactcggtcttgggtgatacggcgtcttgccaccgggcctgtcagttgacctaccccttgcacacctaccctaaggaagaggagttgtacgcatgtcagagaggttgcaggctgttttcaatttgtcagtttgtggatgatggaattgacttaaatcgaactaaattggaatgtgaatctgcatgtacagaagcatattcccaatctgatgagcaatatgcttgccatcttggttgccagaatcagctgccattcgctgaactgagacaagaacaacttatgtccctgatgccaaaaatgcacctactctttcctctaactctggtgaggtcattctggagtgacatgatggactccgcacagagcttcataacctcttcatggactttttatcttcaagccgatgacggaaaaatagttatattccagtctaagccagaaatccagtacgcaccacatttggagcaggagcctacaaatttgagagaatcatctctaagcaaaatgtcctatctgcaaatgagaaattcacaagcgcacaggaattttcttgaagatggagaaagtgatggctttttaagatgcctctctcttaactctgggtggattttaactacaactcttgtcctctcggtgatggtattgctttggatttgttgtgcaactgttgctacagctgtggagcagtatgttccctctgagaagctgagtatctatggtgacttggagtttatgaatgaacaaaagctaaacagatatccagcttcttctcttgtggttgttagatctaaaactgaagatcatgaagaggacaagagttgtagttaaaatccacccagagttaagagagaggcatcttaaaaagccatcactttctccatcttcaagaaaattcctgtgcgcttgtgaatttctcatttgcagatctgaggacattttgcttagagatgattctctcaaatttgta

SEQ ID NO: 300064 - DNA, 1189 bp, Homo sapiens
agcaccgtgcgcctcccgcctacggagaactacatgccccagcctgccccgcgaagggaagaagtcaggaggccccgcttcgcgctaacgcttgcgatggttgaattcccctcctcacgccagcctaggagaagaagttcgtagtcccagaggtgaggcaggaggcggcagtttctggcgggtgagggcggagctgaatgacatgatggactccgcacagagcttcataacctcttcatggactttttatcttcaagccgatgacggaaaaatagttatattccagtctaagccagaaatccagtacgcaccacatttggagcaggagcctacaaatttgagagaatcatctctaagcaaaatgtcctatctgcaaatgagaaattcacaagcgcacaggaattttcttgaagatggagaaagtgatggctttttaagatgcctctctcttaactctgggtggattttaactacaactcttgtcctctcggtgatggtattgctttggatttgttgtgcaactgttgctacagctgtggagcagtatgttccctctgagaagctgagtatctatggtgacttggagtttatgaatgaacaaaagctaaacagatatccagcttcttctcttgtggttgttagatctaaaactgaagatcatgaagaagcagggcctctacctacaaaagtgaatcttgctcattctgaaatttaagcatttttcttttaaaagacaagtgtaatagacatctaaaattccactcctcatagagcttttaaaatggtttcattggatataggccttaagaaatcactataaaatgcaaataaagttactcaaatctgtgaagactgtatttgctataactttattggtattgtttttgtagtaatttaagaggtggatgtttgggattgtattattattttactaatatctgtagctattttgttttttgctttggttattgtttttttcccttttcttagctatgagctgatcattgctccttctcacctcctgccatgatactgtcagttaccttagttaacaagctgaatatttagtagaaatgatgcttctgctcaggaatggcccacaaatctgtaatttgaaatttagcaggaaatgacctttaatgacactacattttcaggaactgaaatcattaaaattttatttgaataa

SEQ ID NO: 300065 - DNA, 1093 bp, Homo sapiens
agagcatcaggtaccacaccgttgtcagttgacactacccccttgcacaccgaagaggagttgtacgcatgtcagagaggttgcaggctgttttcaatttgtcagtttgtggatgatggaattgacttaaatcgaactaaattggaatgtgaatctgcatgtacagaagcatattcccaatctgatgagcaatatgcttgccatcttggttgccagaatcagctgccattcgctgaactgagacaagaacaacttatgtccctgatgccaaaaatgcacctactctttcctctaactctggtgaggtcattctggagtgacatgatggactccgcacagagcttcataacctcttaactctgggtggattttaactacaactcttgtcctctcggtgatggtattgctttggatttgttgtgcaactgttgctacagctgtggagcagtatgttccctctgagaagctgagtatctatggtgacttggagtttatgaatgaacaaaagctaaacagatatccagcttcttctcttgtggttgttagatctaaaactgaagatcatgaagaagcagggcctctacctacaaaagtgaatcttgctcattctgaaatttaagcatttttcttttaaaagacaagtgtaatagacatctaaaattccactcctcatagagcttttaaaatggtttcattggatataggccttaagaaatcactataaaatgcaaataaagttactcaaatctgtgaagactgtatttgctataactttattggtattgtttttgtagtaatttaagaggtggatgtttgggattgtattattattttactaatatctgtagctattttgttttttgctttggttattgtttttttcccttttcttagctatgagctgatcattgctccttctcacctcctgccatgatactgtcagttaccttagttaacaagctgaatatttagtagaaatgatgcttctgctcaggaatggcccacaaatctgtaatttgaaatttagcaggaaatgacctttaatgacactacattttcaggaactgaaatcattaaaattttatttgaataa

SEQ ID NO: 300066 - DNA, 837 bp, Homo sapiens
cctcttttggaaagaccaccagaaactctaaagaatgcaaccatctgtctgtcacctgcctgtgacctgggttaggtctacctggccaggtagacctataactctgggtggattttaactacaactcttgtcctctcggtgatggtattgctttggatttgttgtgcaactgttgctacagctgtggagcagtatgttccctctgagaagctgagtatctatggtgacttggagtttatgaatgaacaaaagctaaacagatatccagcttcttctcttgtggttgttagatctaaaactgaagatcatgaagaagcagggcctctacctacaaaagtgaatcttgctcattctgaaatttaagcatttttcttttaaaagacaagtgtaatagacatctaaaattccactcctcatagagcttttaaaatggtttcattggatataggccttaagaaatcactataaaatgcaaataaagttactcaaatctgtgaagactgtatttgctataactttattggtattgtttttgtagtaatttaagaggtggatgtttgggattgtattattattttactaatatctgtagctattttgttttttgctttggttattgtttttttcccttttcttagctatgagctgatcattgctccttctcacctcctgccatgatactgtcagttaccttagttaacaagctgaatatttagtagaaatgatgcttctgctcaggaatggcccacaaatctgtaatttgaaatttagcaggaaatgacctttaatgacactacattttcaggaactgaaatcattaaaattttatttgaataa

SEQ ID NO: 300067 - DNA, 1017 bp, Homo sapiens
agcaccgtgcgcctcccgcctacggagaactacatgccccagcctgccccgcgaagggaagaagtcaggaggccccgcttcgcgctaacgcttgcgatggttgaattcccctcctcacgccagcctaggagaagaagttcgtagtcccagaggtgaggcaggaggcggcagtttctggcgggtgagggcggagctgaagtgacagcggaggcggaagcaacggtcggtggggcggagaagggggctggccccaggaggaggaggaaacccttccgagaaaacagcaacaagctgagctgctgtgacagaggggaacaagatggcggcgccgaaggggagcctctgggtgaggacccaactggggctcccgccgctgctgctgctgaccatggccttggccggaggttcggggaccgcttcggctgaagcatttgactcggtcttgggtgatacggcgtcttgccaccgggcctgtcagttgacctaccccttgcacacctaccctaaggaagaggagttgtacgcatgtcagagaggttgcaggctgttttcaatttgtcagtttgtggatgatggaattgacttaaatcgaactaaattggaatgtgaatctgcatgtacagaagcatattcccaatctgatgagcaatatgcttgccatcttggttgccagaatcagctgccattcgctgaactgagacaagaacaacttatgtccctgatgccaaaaatgcacctactctttcctctaactctggtgaggtcattctggagtgacatgatggactccgcacagagcttcataacctcttcatggactttttatcttcaagccgatgacggaaaaatagttatattccagtctaagccagaaatccagtacgcaccacatttggagcaggagcctacaaatttgagagaatcatctctaagcaaaatgtcctcagtgatggctttttaagatgccttttcttaacctttggggatttaactacaaccttggctttcgggaagggt

SEQ ID NO: 300068 - DNA, 3511 bp, Homo sapiens
agcaccgtgcgcctcccgcctacggagaactacatgccccagcctgccccgcgaagggaagaagtcaggaggccccgcttcgcgctaacgcttgcgatggttgaattcccctcctcacgccagcctaggagaagaagttcgtagtcccagaggtgaggcaggaggcggcagtttctggcgggtgagggcggagctgaagtgacagcggaggcggaagcaacggtcggtggggcggagaagggggctggccccaggaggaggaggaaacccttccgagaaaacagcaacaagctgagctgctgtgacagaggggaacaagatggcggcgccgaaggggagcctctgggtgaggacccaactggggctcccgccgctgctgctgctgaccatggccttggccggaggttcggggaccgcttcggctgaagcatttgactcggtcttgggtgatacggcgtcttgccaccgggcctgtcagttgacctaccccttgcacacctaccctaaggtagggcccgtccggagcgggctgcgacccttcccttgcagcccatttctcggctccccacacgtatgtcggctctggcaacctggctgttaaatcggcccttcaatcgctgtctcccatctgtgtagctcctgttttcctccctaatcctgcctgcaccccatttctgctgtcattaccggaagtttgtcctgcactaccctgtgataggctgggggacacaaagatgagaaagacgcgatccctttcctctgggagcttgccgggctgcaggggagtcgagcactcggaggaggataggggaggatatggatgattaatgcggggtcctcacctaagggagcgtaaggggggattgtagaaagggaggcgcagatacgcgagtccacaaatgattgattgataacccttgtttactaagcgcctctcggggccaggagcgcagtcttcggggagtcagacaagtagacgattccactgtggtataaaaagcgtcacgaaggcagctcagggagtagcgagacgctcaggaatgctgtctgcctatgttgagttactgtgtccaagacgctgccaagagggactgggttagagaagaggcaattaggtgtctgcctaccagaaactgaccactcagtgcagaaaacggggaattcgtggagtgggtgaagaaatgagactgtggacaggagggggttcgcagcttacagagaggaatggccctcctctctatgcttcccccctttcttttaattacatacctaaccctcttcacgttggtttttcagcctaagaactctgtttactcaacattctaaattgcttgatgattcccaccacacctttcccatgtatgatttgagtatatgccctcccccacgttgttttatgagagcttttgttgatgttgctggtggtttcctcttcgtttttccttcatctcctctatgctatttgcttaaccattgtggctggacctccttgctctctaaaactggagtggctacggagacagttccagtgaagcttaggatgttccatattggcgagtattttcaggtctttgaaatgaaaagttctaagtgccggcacttctcagattttgttacggctggattttaaactgcatggagattatcaattttcaaaaaaaagtgtgggagaagggactgtactaaatttttccagagatttatgtaacaatcgagaaagaagtgagaagttttaacttcagacttaaatcaatgaatactgcttctaaccacgttatttttctccacctcttgtaaacttctcatcattaagaggattgtatgaagaagctcattaatattgatttggcctggaattgggttgagacttactttctattgttctagggtttgtttccttttttgggattttctcggcaattttgtggtataagtttgaaaaacgagatagaaatctcgttttaggctgggcgcggtggctcacgcctgtaattccagcagtttgggaggccgaggcgagtggatcctgggtggtcaggagttcaagatcagcctgaccaacatggtgaaaccccatctctactaaaaatacaaaaattagccgaacatggcgcacgcttgtgatcccagctactcaggaggctgagtcaggagaaccgctggaacccgggcggtggaggttgcagtgagccaagattgtgccactgcactccagcctgggtaacagaacaagaccccgtctctttaaaaaaaaaaaaaaaagagacagagacattcatacatatatctaagtctacctactctcaaaagatgctagatattactattattctccaatgagttttatgacatttgcagtgattctgttttatgctttcattcttttagtgtcttcttgtatatggtattaacaattaaggaactttatatatttatgaagacccttctatcagtgtgagagcatttcatgcatattctttgttctcgcagccttttcaaatagcatctatcattttccatacatgttaagctaaaacatttaggagcagaaaaacttgcaccaaattattttaccacttggtaggagagctaagatgttgaaggacttgatcacttaaggcatccatagctgtttttcttgatacccaattgttatactcctgaggattttaacttgagacgtggaacagctttctttggccatccattgggagctgaatcacatatctacaacactttgagaaaaagtattcttctttcttaaagttgtttatagaattttttttaccaactatttataaattaaattgttatttaaagactaacttggagaggttcctaattatccagactactaatgtacattggttttcttttgcagaagctgagtatctatggtgacttggagtttatgaatgaacaaaagctaaacagatatccagcttcttctcttgtggttgttagatctaaaactgaagatcatgaagaagcagggcctctacctacaaaagtgaatcttgctcattctgaaatttaagcatttttcttttaaaagacaagtgtaatagacatctaaaattccactcctcatagagcttttaaaatggtttcattggatataggccttaagaaatcactataaaatgcaaataaagttactcaaatctgtgaagactgtatttgctataactttattggtattgtttttgtagtaatttaagaggtggatgtttgggattgtattattattttactaatatctgtagctattttgttttttgctttggttattgtttttttcccttttcttagctatgagctgatcattgctccttctcacctcctgccatgatactgtcagttaccttagttaacaagctgaatatttagtagaaatgatgcttctgctcaggaatggcccacaaatctgtaatttgaaatttagcaggaaatgacctttaatgacactacattttcaggaactgaaatcattaaaattttatttgaataa

SEQ ID NO: 300069 - DNA, 934 bp, Homo sapiens
agcaccgtgcgcctcccgcctacggagaactacatgccccagcctgccccgcgaagggaagaagtcaggaggccccgcttcgcgctaacgcttgcgatggttgaattcccctcctcacgccagcctaggagaagaagttcgtagtcccagaggtgaggcaggaggcggcagtttctggcgggtgagggcggagctgaagtgacagcggaggcggaagcaacggtcggtggggcggagaagggggctggccccaggaggaggaggaaacccttccgagaaaacagcaacaagctgagctgctgtgacagaggggaacaagatggcggcgccgaaggggagcctctgggtgaggacccaactggggctcccgccgctgctgctgctgaccatggccttggccggaggttcggggaccgcttcggctgaagcatttgactcggtcttgggtgatacggcgtcttgccaccgggcctgtcagttgacctaccccttgcacacctaccctaaggaagaggagttgtacgcatgtcagagaggttgcaggctgttttcaatttgtcagtttgtggatgatggaattgacttaaatcgaactaaattggaatgtgaatctgcatgtacagaagcatattcccaatctgatgagcaatatgcttgccatcttggttgccagaatcagctgccattcgctgaactgagacaagaacaacttatgtccctgatgccaaaaatgcacctactctttcctctaactctggtgaggtcattctggagtgacatgatggactccgcacagagcttcataacctcttcatggactttttatcttcaagccgatgacggaaaaatagttatattccagtctaagccagaaatccagtacttcaacttgtttctgtagaaattgccagaaatgttgatgccttcacagcgt

SEQ ID NO: 300070 - DNA, 878 bp, Homo sapiens
agcaccgtgcgcctcccgcctacggagaactacatgccccagcctgccccgcgaagggaagaagtcaggaggccccgcttcgcgctaacgcttgcgatggttgaattcccctcctcacgccagcctaggagaagaagttcgtagtcccagaggtgaggcaggaggcggcagtttctggcgggtgagggcggagctgaagtgacagcggaggcggaagcaacggtcggtggggcggagaagggggctggccccaggaggaggaggaaacccttccgagaaaacagcaacaagctgagctgctgtgacagaggggaacaagatggcggcgccgaaggggagcctctgggtgaggacccaactggggctcccgccgctgctgctgctgaccatggccttggccggaggttcggggaccgcttcggctgaagcatttgactcggtcttgggtgatacggcgtcttgccaccgggcctgtcagttgacctaccccttgcacacctaccctaaggaagaggagttgtacgcatgtcagagaggttgcaggctgttttcaatttgtcagtttgtggatgatggaattgacttaaatcgaactaaattggaatgtgaatctgcatgtacagaagcatattcccaatctgatgagcaatatgcttgccatcttggttgccagaatcagctgccattcgctgaactgagacaagaacaacctgccatgatactgtcagttaccttagttaacaagctgaatatttagtagaaatgatgcttctgctcaggaatggcccacaaatctgtaatttgaaatttagcaggaaatgacctttaatgacactacattttcaggaactgaaatcattaaaattttatttgaataa

SEQ ID NO: 300071 - DNA, 3168 bp, Homo sapiens
agcaccgtgcgcctcccgcctacggagaactacatgccccagcctgccccgcgaagggaagaagtcaggaggccccgcttcgcgctaacgcttgcgatggttgaattcccctcctcacgccagcctaggagaagaagttcgtagtcccagaggtgaggcaggaggcggcagtttctggcgggtgagggcggagctgaagtgacagcggaggcggaagcaacggtcggtggggcggagaagggggctggccccaggaggaggaggaaacccttccgagaaaacagcaacaagctgagctgctgtgacagaggggaacaagatggcggcgccgaaggggagcctctgggtgaggacccaactggggctcccgccgctgctgctgctgaccatggccttggccggaggttcggggaccgcttcggctgaagcatttgactcggtcttgggtgatacggcgtcttgccaccgggcctgtcagttgacctaccccttgcacacctaccctaaggtagggcccgtccggagcgggctgcgacccttcccttgcagcccatttctcggctccccacacgtatgtcggctctggcaacctggctgttaaatcggcccttcaatcgctgtctcccatctgtgtagctcctgttttcctccctaatcctgcctgcaccccatttctgctgtcattaccggaagtttgtcctgcactaccctgtgataggctgggggacacaaagatgagaaagacgcgatccctttcctctgggagcttgccgggctgcaggggagtcgagcactcggaggaggataggggaggatatggatgattaatgcggggtcctcacctaagggagcgtaaggggggattgtagaaagggaggcgcagatacgcgagtccacaaatgattgattgataacccttgtttactaagcgcctctcggggccaggagcgcagtcttcggggagtcagacaagtagacgattccactgtggtataaaaagcgtcacgaaggcagctcagggagtagcgagacgctcaggaatgctgtctgcctatgttgagttactgtgtccaagacgctgccaagagggactgggttagagaagaggcaattaggtgtctgcctaccagaaactgaccactcagtgcagaaaacggggaattcgtggagtgggtgaagaaatgagactgtggacaggagggggttcgcagcttacagagaggaatggccctcctctctatgcttcccccctttcttttaattacatacctaaccctcttcacgttggtttttcagcctaagaactctgtttactcaacattctaaattgcttgatgattcccaccacacctttcccatgtatgatttgagtatatgccctcccccacgttgttttatgagagcttttgttgatgttgctggtggtttcctcttcgtttttccttcatctcctctatgctatttgcttaaccattgtggctggacctccttgctctctaaaactggagtggctacggagacagttccagtgaagcttaggatgttccatattggcgagtattttcaggtctttgaaatgaaaagttctaagtgccggcacttctcagattttgttacggctggattttaaactgcatggagattatcaattttcaaaaaaaagtgtgggagaagggactgtactaaatttttccagagatttatgtaacaatcgagaaagaagtgagaagttttaacttcagacttaaatcaatgaatactgcttctaaccacgttatttttctccacctcttgtaaacttctcatcattaagaggattgtatgaagaagctcattaatattgatttggcctggaattgggttgagacttactttctattgttctagggtttgtttccttttttgggattttctcggcaattttgtggtataagtttgaaaaacgagatagaaatctcgttttaggctgggcgcggtggctcacgcctgtaattccagcagtttgggaggccgaggcgagtggatcctgggtggtcaggagttcaagatcagcctgaccaacatggtgaaaccccatctctactaaaaatacaaaaattagccgaacatggcgcacgcttgtgatcccagctactcaggaggctgagtcaggagaaccgctggaacccgggcggtggaggttgcagtgagccaagattgtgccactgcactccagcctgggtaacagaacaagaccccgtctctttaaaaaaaaaaaaaaaagagacagagacattcatacatatatctaagtctacctactctcaaaagatgctagatattactattattctccaatgagttttatgacatttgcagtgattctgttttatgctttcattcttttagtgtcttcttgtatatggtattaacaattaaggaactttatatatttatgaagacccttctatcagtgtgagagcatttcatgcatattctttgttctcgcagccttttcaaatagcatctatcattttccatacatgttaagctaaaacatttaggagcagaaaaacttgcaccaaattattttaccacttggtaggagagctaagatgttgaaggacttgatcacttaaggcatccatagctgtttttcttgatacccaattgttatactcctgaggattttaacttgagacgtggaacagctttctttggccatccattgggagctgaatcacatatctacaacactttgagaaaaagtattcttctttcttaaagttgtttatagaattttttttaccaactatttataaattaaattgttatttaaagactaacttggagaggttcctaattatccagactactaatgtacattggttttcttttgcagaagctgagtatctatggtgacttggagtttatgaatgaacaaaagctaaacagatatccagcttcttctcttgtggttgttagatctaaaactgaagatcatgaagaagcagggcctctacctacaaaagtgaatcttgctcattctgaaatttaagcatttttcttttaaaagacaagtgtaatagacatctaaaattccactcctcatagagcttttaaaatggtttcattggatataggccttaagaaatcactataaaatgcaaataaagttactcaaatctg

SEQ ID NO: 300072 - DNA, 2140 bp, Homo sapiens
agcaccgtgcgcctcccgcctacggagaactacatgccccagcctgccccgcgaagggaagaagtcaggaggccccgcttcgcgctaacgcttgcgatggttgaattcccctcctcacgccagcctaggagaagaagttcgtagtcccagaggtgaggcaggaggcggcagtttctggcgggtgagggcggagctgaagtgacagcggaggcggaagcaacggtcggtggggcggagaagggggctggccccaggaggaggaggaaacccttccgagaaaacagcaacaagctgagctgctgtgacagaggggaacaagatggcggcgccgaaggggagcctctgggtgaggacccaactggggctcccgccgctgctgctgctgaccatggccttggccggaggttcggggaccgcttcggctgaagcatttgactcggtcttgggtgatacggcgtcttgccaccgggcctgtcagttgacctaccccttgcacacctaccctaaggtagggcccgtccggagcgggctgcgacccttcccttgcagcccatttctcggctccccacacgtatgtcggctctggcaacctggctgttaaatcggcccttcaatcgctgtctcccatctgtgtagctcctgttttcctccctaatcctgcctgcaccccatttctgctgtcattaccggaagtttgtcctgcactaccctgtgataggctgggggacacaaagatgagaaagacgcgatccctttcctctgggagcttgccgggctgcaggggagtcgagcactcggaggaggataggggaggatatggatgattaatgcggggtcctcacctaagggagcgtaaggggggattgtagaaagggaggcgcagatacgcgagtccacaaatgattgattgataacccttgtttactaagcgcctctcggggccaggagcgcagtcttcggggagtcagacaagtagacgattccactgtggtataaaaagcgtcacgaaggcagctcagggagtagcgagacgctcaggaatgctgtctgcctatgttgagttactgtgtccaagacgctgccaagagggactgggttagagaagaggcaattaggtgtctgcctaccagaaactgaccactcagtgcagaaaacggggaattcgtggagtgggtgaagaaatgagactgtggacaggagggggttcgcagcttacagagaggaatggccctcctctctatgcttcccccctttcttttaattacatacctaaccctcttcacgttggtttttcagcctaagaactctgtttactcaacattctaaattgcttgatgattcccaccacacctttcccatgtatgatttgagtatatgccctcccccacgttgttttatgagagcttttgttgatgttgctggtggtttcctcttcgtttttccttcatctcctctatgctatttgcttaaccattgtggctggacctccttgctctctaaaactggagtggctacggagacagttccagtgaagcttaggatgttccatattggcgagtattttcaggtctttgaaatgaaaagttctaagtgccggcacttctcagattttgttacggctggattttaaactgcatggagattatcaattttcaaaaaaaagtgtgggagaagggactgtactaaatttttccagagatttatgtaacaatcgagaaagaagtgagaagttttaacttcagacttaaatcaatgaatactgcttctaaccacgttatttttctccacctcttgtaaacttctcatcattaagaggattgtatgaagaagctcattaatattgatttggcctggaattgggttgagacttactttctattgttctagggtttgtttccttttttgggattttctcggcaattttgtggtataaaccagaatgttgggaaaataatcaaataatttgaaaggataccttcctggaagttgtaggtactttaataatgtccactattttctaacaattggtgttatatctataaactatttttacttatttattaaagcttttctcacaaagaactccaaatcatctggctccctataggtcctggacaacatggcaagaccccgtctctgg

SEQ ID NO: 300073 - DNA, 718 bp, Homo sapiens
atattaccaaatttggaaattcacattgatgaaacctttttaagtataaaaatttttttaataaaatgccaaatccttttctttcctctttccctttctcttttgtttcttgtaatttgactatttttctcttacagcatgtacagaagcatattcccaatctgatgagcaatatgcttgccatcttggttgccagaatcagctgccattcgctgaactgagacaagaacaagtacgaaacaatactgcctttcaaactagcctgcttagatggcactgacttgtattgcttgaagtgtttatcacccacttgatcctattttagtgttatattttatatttggctttcagcaaacaaaattagtttgcaaatagaaaagtcagttgaataattgcttttgtataatgctttactattaaaagttatgcttacgttcataatcttattttgtttcttctcacattccagtgaagatattatcctcattttacatatgaaaaaaccaaggctcagaggaattatttcagagttctttttctccatcccaactcccattggacagttgccattgccttaactcagataatcatttcttgtctgtatttttaaattaacttccaaactgtttttctaatttaaccctgtctaactccatcctttgctgtgtccagatttttttttctaaatttcatcatgccattctcctgtcttatataa

SEQ ID NO: 300074 - DNA, 2586 bp, Homo sapiens
  misc_feature (2)..(2): n is a, c, g, or t
  misc_feature (1510)..(1510): n is a, c, g, or t
  misc_feature (1515)..(1515): n is a, c, g, or t
  misc_feature (1533)..(1534): n is a, c, g, or t
gncagaggccagctttgagtcctggcttcacctctcatcagctgtgtgacctagggtggcatgtggagcctcccaccaccacctaggtcctgagatgcgctgaagcccagcctgtctgccatcatcccccagcatggaccgtgggagcctcctgcccttccagctatggtgcccccggccctttggcacctactcacagaaccagccacgcccgccttctgcggccctcaagccatcagcctgccctgagcctggtggcggggccgagccagaccatgggcctgcccactcagagaacacaccacccgccttggccactgaggtccctgcctcccagccggctccgctcctctcagcagcagctgctggtgatgagggtcgagtcctcctggacacgtggtatgtcatcaagcccgggaatacaaaggagaaggtggccttctttgtggcccaccagtgtggtgggggcagccgggccagctccatgaaggtcaaggggcactggggcagcgatagctccaaggccaagcggcggaggcgctgtcttgaccccaccaaggctcctcctgacccagggggccgggagggcccccctgctgctgaggagggccccgcctcagccggtgaggacgtggacctgctctctgtggccgagatggtggccctggtggaacagcgggcagccctggccctgcagagctacccacgaccgaccaccccagcgcctgtagtctttgtgtccgccgagcaaggtggaccggccaagggggtgggatctgaacggcggtccggtggtggggactgcagccgtgtagccgaggccgtggcccactttgaagcgcagagggacagccctcccaccaagaacgtgaaggaggagactgtgtgcctgacggtcagcccggaggaaccgccgcctccgggccagctcttctttctccagaaccgcgggccggacgggcccccggagccacccccggccgactccccggccactgcgcccggcccagacgatgccgagggcacggcggacacctccctgtgccgcttgtaccggcacgtgtcgcacgacttcctagagatccgcttcaagattcagcggctgctggagccgcgacagtacatgctgctgctgcccgagcacgtgctggtcaagatcttcagcttcctgcccacgcgcgcgctggccgccctcaagtgcacctgccaccacttcaagggcatcatcgaggcgtttggcgtgcgggccacagactcgcgctggagccgagacccgctctaccgcgatgatccgtgcaaacagtgccgcaagagatacgagaagggcgacgtgtcgctctgccgctggcaccccaagccctaccaccatgacctgccttacggacgttcctactggatgtgctgccgtcgagccgaccgcgagactcccggctgccgcctgggcctccacgataacaactgggtgctgccctgcaatgggccaggcgggggccgggccggccgggaggangggangtgaagccgggggagggnnggggagagcccaccacgcccacccctcccctctccccccgggagccgagggtccggactgggccgcctgcccattcccctactccaggcagcattgatccctcaccggaactgagctggggttcagcaggggtgacccaggaaagccctctgcttgatcctgttgattttctactcttcagaaccagggccgtggaccctctgagaagggtgtttttttttttttatcagcatctcactttcttctccattcagccccaaccccctccctgccatgctttccaccccaaggacccaccagcagggagcagacggcagctaattttggtaccacttaagggtccccccattctggcccccatcctctccctcaccccaattctttctcgctggagctgttatttcccaagaagccgcatcgcccaaggttggcacctctcctaacctgccacacgacagctctcacctctctaggaattgggggctgtcaggtcacaggtgggatctggcatttttttatgacagtccatttctagatggtttgcctattaaagaagtgggggggaaatactgttttctccttaacctcaagctaccagtctctcctcttccgcgtagaggaagaggggggcagacaaaaaaaaagctgaagtataaaaaccctcctcctcccgttattatttaagctactgccatcaaccccacccccataaagctgtgaagccctttgcctcgcttttgacagcgtgggggggccccgtgggcagggacttcggatttgcatttctgggttgtttttccttccactctggggtctcgttcaggcattggggtctcctcaccccagccacatgtttctttaagaatcctttggtcaaccaggaccttgatttttcaggcattttggtctggggtatttttgtttgttctctctgttttttgttttcttttttttctttccatcgtggttctggaagcttctagcgtgtggcatctgaccaattttgaattggtcctttctataaaatcaatatttataaggcaaaaaacaga

SEQ ID NO: 300075 - DNA, 3049 bp, Homo sapiens
  misc_feature (42)..(42): n is a, c, g, or t
  misc_feature (1973)..(1973): n is a, c, g, or t
  misc_feature (1978)..(1978): n is a, c, g, or t
  misc_feature (1996)..(1997): n is a, c, g, or t
ttgaagccggtcgcctgcacgtttcggtccggttttcccggngtcgacccacgcgtccggcgtagccgagggagatgcagcgcgcggcgatggtggcatgtggagcctcccaccaccacctaggtcctgagatgcgctgaagcccagcctgtctgccatcatcccccagcatggaccgtgggagcctcctgcccttccagctatggtgcccccggccctttggcacctactcacagaaccagccacgcccgccttctgcggccctcaagccatcagcctgccctgagcctggtggcggggccgagccagaccatgggcctgcccactcagagaacacaccacccgccttggccactgaggtccctgcctcccagccggctccgctcctctcagcagcagctgctggtgatgagggtcgagtcctcctggacacgtggtatgtcatcaagcccgggaatacaaaggagaaggtggccttctttgtggcccaccagtgtggtgggggcagccgggccagctccatgaaggtcaaggggcactggggcagcgatagctccaaggccaagcggcggaggcgctgtcttgaccccaccaaggctcctcctgacccagggggccgggagggcccccctgctgctgaggagggccccgcctcagccggtgaggacgtggacctgctctctgtggccgagatggtggccctggtggaacagcgggcagccctggccctgcagagctacccacgaccgaccaccccagcgcctgtagtctttgtgtccgccgagcaaggtggaccggccaagggggtgggatctgaacggcggtccggtggtggggactgcagccgtgtagccgaggccgtggcccactttgaagcgcagagggacagccctcccaccaagggcctccgcaaggaagagcggcccgggccaggccctggggaggtgcgcatcgccttccgcatctccaacggccgggagccccgtgcaccagacagcggcctgcccagtgggggcgggggcaggcctggttgtgcctaccctggcagcccaggtcctggggcccgagccaaggacaagatcacatgtgacttataccagctcatcagcccctcgcgggatgccctccccagcaacgtggagttcctgctggccagggcggatgaggccagtgagggtgacagcccggcacccgccaggcctgaggacactcccccggcgccccctccgccccctgcccgggactgcggagcgtcaggcttccacgtggacgtggtggtgacgggcgtggtagatgagtgcatcttctttggcaaggacggcaccaagaacgtgaaggaggagactgtgtgcctgacggtcagcccggaggaaccgccgcctccgggccagctcttctttctccagaaccgcgggccggacgggcccccggagccacccccggccgactccccggccactgcgcccggcccagacgatgccgagggcacggcggacacctccctgtgccgcttgtaccggcacgtgtcgcacgacttcctagagatccgcttcaagattcagcggctgctggagccgcgacagtacatgctgctgctgcccgagcacgtgctggtcaagatcttcagcttcctgcccacgcgcgcgctggccgccctcaagtgcacctgccaccacttcaagggcatcatcgaggcgtttggcgtgcgggccacagactcgcgctggagccgagacccgctctaccgcgatgatccgtgcaaacagtgccgcaagagatacgagaagggcgacgtgtcgctctgccgctggcaccccaagccctaccaccatgacctgccttacggacgttcctactggatgtgctgccgtcgagccgaccgcgagactcccggctgccgcctgggcctccacgataacaactgggtgctgccctgcaatgggccaggcgggggccgggccggccgggaggangggangtgaagccgggggagggnnggggagagcccaccacgcccacccctcccctctccccccgggagccgagggtccggactgggccgcctgcccattcccctactccaggcagcattgatccctcaccggaactgagctggggttcagcaggggtgacccaggaaagccctctgcttgatcctgttgattttctactcttcagaaccagggccgtggaccctctgagaagggtgtttttttttttttatcagcatctcactttcttctccattcagccccaaccccctccctgccatgctttccaccccaaggacccaccagcagggagcagacggcagctaattttggtaccacttaagggtccccccattctggcccccatcctctccctcaccccaattctttctcgctggagctgttatttcccaagaagccgcatcgcccaaggttggcacctctcctaacctgccacacgacagctctcacctctctaggaattgggggctgtcaggtcacaggtgggatctggcatttttttatgacagtccatttctagatggtttgcctattaaagaagtgggggggaaatactgttttctccttaacctcaagctaccagtctctcctcttccgcgtagaggaagaggggggcagacaaaaaaaaagctgaagtataaaaaccctcctcctcccgttattatttaagctactgccatcaaccccacccccataaagctgtgaagccctttgcctcgcttttgacagcgtgggggggccccgtgggcagggacttcggatttgcatttctgggttgtttttccttccactctggggtctcgttcaggcattggggtctcctcaccccagccacatgtttctttaagaatcctttggtcaaccaggaccttgatttttcaggcattttggtctggggtatttttgtttgttctctctgttttttgttttcttttttttctttccatcgtggttctggaagcttctagcgtgtggcatctgaccaattttgaattggtcctttctataaaatcaatatttataaggcaaaaaacaga

SEQ ID NO: 300076 - DNA, 3153 bp, Homo sapiens
  misc_feature (2077)..(2077): n is a, c, g, or t
  misc_feature (2082)..(2082): n is a, c, g, or t
  misc_feature (2100)..(2101): n is a, c, g, or t
gcagcttgaggagaaagctaggctagaacaggcaccctcgtgttttctttctttttttttcccaagatgggttctctctcagtcacccaggctggagtgcagtggtatgatcacagcatcacagctcactgcagcctccacctcctgggctcaagcgatactcccacctcagcctcccaactagctgggactacaggtggcatgtggagcctcccaccaccacctaggtcctgagatgcgctgaagcccagcctgtctgccatcatcccccagcatggaccgtgggagcctcctgcccttccagctatggtgcccccggccctttggcacctactcacagaaccagccacgcccgccttctgcggccctcaagccatcagcctgccctgagcctggtggcggggccgagccagaccatgggcctgcccactcagagaacacaccacccgccttggccactgaggtccctgcctcccagccggctccgctcctctcagcagcagctgctggtgatgagggtcgagtcctcctggacacgtggtatgtcatcaagcccgggaatacaaaggagaaggtggccttctttgtggcccaccagtgtggtgggggcagccgggccagctccatgaaggtcaaggggcactggggcagcgatagctccaaggccaagcggcggaggcgctgtcttgaccccaccaaggctcctcctgacccagggggccgggagggcccccctgctgctgaggagggccccgcctcagccggtgaggacgtggacctgctctctgtggccgagatggtggccctggtggaacagcgggcagccctggccctgcagagctacccacgaccgaccaccccagcgcctgtagtctttgtgtccgccgagcaaggtggaccggccaagggggtgggatctgaacggcggtccggtggtggggactgcagccgtgtagccgaggccgtggcccactttgaagcgcagagggacagccctcccaccaagggcctccgcaaggaagagcggcccgggccaggccctggggaggtgcgcatcgccttccgcatctccaacggccgggagccccgtgcaccagacagcggcctgcccagtgggggcgggggcaggcctggttgtgcctaccctggcagcccaggtcctggggcccgagccaaggacaagatcacatgtgacttataccagctcatcagcccctcgcgggatgccctccccagcaacgtggagttcctgctggccagggcggatgaggccagtgagggtgacagcccggcacccgccaggcctgaggacactcccccggcgccccctccgccccctgcccgggactgcggagcgtcaggcttccacgtggacgtggtggtgacgggcgtggtagatgagtgcatcttctttggcaaggacggcaccaagaacgtgaaggaggagactgtgtgcctgacggtcagcccggaggaaccgccgcctccgggccagctcttctttctccagaaccgcgggccggacgggcccccggagccacccccggccgactccccggccactgcgcccggcccagacgatgccgagggcacggcggacacctccctgtgccgcttgtaccggcacgtgtcgcacgacttcctagagatccgcttcaagattcagcggctgctggagccgcgacagtacatgctgctgctgcccgagcacgtgctggtcaagatcttcagcttcctgcccacgcgcgcgctggccgccctcaagtgcacctgccaccacttcaagggcatcatcgaggcgtttggcgtgcgggccacagactcgcgctggagccgagacccgctctaccgcgatgatccgtgcaaacagtgccgcaagagatacgagaagggcgacgtgtcgctctgccgctggcaccccaagccctaccaccatgacctgccttacggacgttcctactggatgtgctgccgtcgagccgaccgcgagactcccggctgccgcctgggcctccacgataacaactgggtgctgccctgcaatgggccaggcgggggccgggccggccgggaggangggangtgaagccgggggagggnnggggagagcccaccacgcccacccctcccctctccccccgggagccgagggtccggactgggccgcctgcccattcccctactccaggcagcattgatccctcaccggaactgagctggggttcagcaggggtgacccaggaaagccctctgcttgatcctgttgattttctactcttcagaaccagggccgtggaccctctgagaagggtgtttttttttttttatcagcatctcactttcttctccattcagccccaaccccctccctgccatgctttccaccccaaggacccaccagcagggagcagacggcagctaattttggtaccacttaagggtccccccattctggcccccatcctctccctcaccccaattctttctcgctggagctgttatttcccaagaagccgcatcgcccaaggttggcacctctcctaacctgccacacgacagctctcacctctctaggaattgggggctgtcaggtcacaggtgggatctggcatttttttatgacagtccatttctagatggtttgcctattaaagaagtgggggggaaatactgttttctccttaacctcaagctaccagtctctcctcttccgcgtagaggaagaggggggcagacaaaaaaaaagctgaagtataaaaaccctcctcctcccgttattatttaagctactgccatcaaccccacccccataaagctgtgaagccctttgcctcgcttttgacagcgtgggggggccccgtgggcagggacttcggatttgcatttctgggttgtttttccttccactctggggtctcgttcaggcattggggtctcctcaccccagccacatgtttctttaagaatcctttggtcaaccaggaccttgatttttcaggcattttggtctggggtatttttgtttgttctctctgttttttgttttcttttttttctttccatcgtggttctggaagcttctagcgtgtggcatctgaccaattttgaattggtcctttctataaaatcaatatttataaggcaaaaaacaga

SEQ ID NO: 300077 - DNA, 3027 bp, Homo sapiens
  misc_feature (1951)..(1951): n is a, c, g, or t
  misc_feature (1956)..(1956): n is a, c, g, or t
  misc_feature (1974)..(1975): n is a, c, g, or t
tggaggttggggtggtcctgggaagaaaggctgtccccctagctccccaacctcctcttcgtgtctccaggtggcatgtggagcctcccaccaccacctaggtcctgagatgcgctgaagcccagcctgtctgccatcatcccccagcatggaccgtgggagcctcctgcccttccagctatggtgcccccggccctttggcacctactcacagaaccagccacgcccgccttctgcggccctcaagccatcagcctgccctgagcctggtggcggggccgagccagaccatgggcctgcccactcagagaacacaccacccgccttggccactgaggtccctgcctcccagccggctccgctcctctcagcagcagctgctggtgatgagggtcgagtcctcctggacacgtggtatgtcatcaagcccgggaatacaaaggagaaggtggccttctttgtggcccaccagtgtggtgggggcagccgggccagctccatgaaggtcaaggggcactggggcagcgatagctccaaggccaagcggcggaggcgctgtcttgaccccaccaaggctcctcctgacccagggggccgggagggcccccctgctgctgaggagggccccgcctcagccggtgaggacgtggacctgctctctgtggccgagatggtggccctggtggaacagcgggcagccctggccctgcagagctacccacgaccgaccaccccagcgcctgtagtctttgtgtccgccgagcaaggtggaccggccaagggggtgggatctgaacggcggtccggtggtggggactgcagccgtgtagccgaggccgtggcccactttgaagcgcagagggacagccctcccaccaagggcctccgcaaggaagagcggcccgggccaggccctggggaggtgcgcatcgccttccgcatctccaacggccgggagccccgtgcaccagacagcggcctgcccagtgggggcgggggcaggcctggttgtgcctaccctggcagcccaggtcctggggcccgagccaaggacaagatcacatgtgacttataccagctcatcagcccctcgcgggatgccctccccagcaacgtggagttcctgctggccagggcggatgaggccagtgagggtgacagcccggcacccgccaggcctgaggacactcccccggcgccccctccgccccctgcccgggactgcggagcgtcaggcttccacgtggacgtggtggtgacgggcgtggtagatgagtgcatcttctttggcaaggacggcaccaagaacgtgaaggaggagactgtgtgcctgacggtcagcccggaggaaccgccgcctccgggccagctcttctttctccagaaccgcgggccggacgggcccccggagccacccccggccgactccccggccactgcgcccggcccagacgatgccgagggcacggcggacacctccctgtgccgcttgtaccggcacgtgtcgcacgacttcctagagatccgcttcaagattcagcggctgctggagccgcgacagtacatgctgctgctgcccgagcacgtgctggtcaagatcttcagcttcctgcccacgcgcgcgctggccgccctcaagtgcacctgccaccacttcaagggcatcatcgaggcgtttggcgtgcgggccacagactcgcgctggagccgagacccgctctaccgcgatgatccgtgcaaacagtgccgcaagagatacgagaagggcgacgtgtcgctctgccgctggcaccccaagccctaccaccatgacctgccttacggacgttcctactggatgtgctgccgtcgagccgaccgcgagactcccggctgccgcctgggcctccacgataacaactgggtgctgccctgcaatgggccaggcgggggccgggccggccgggaggangggangtgaagccgggggagggnnggggagagcccaccacgcccacccctcccctctccccccgggagccgagggtccggactgggccgcctgcccattcccctactccaggcagcattgatccctcaccggaactgagctggggttcagcaggggtgacccaggaaagccctctgcttgatcctgttgattttctactcttcagaaccagggccgtggaccctctgagaagggtgtttttttttttttatcagcatctcactttcttctccattcagccccaaccccctccctgccatgctttccaccccaaggacccaccagcagggagcagacggcagctaattttggtaccacttaagggtccccccattctggcccccatcctctccctcaccccaattctttctcgctggagctgttatttcccaagaagccgcatcgcccaaggttggcacctctcctaacctgccacacgacagctctcacctctctaggaattgggggctgtcaggtcacaggtgggatctggcatttttttatgacagtccatttctagatggtttgcctattaaagaagtgggggggaaatactgttttctccttaacctcaagctaccagtctctcctcttccgcgtagaggaagaggggggcagacaaaaaaaaagctgaagtataaaaaccctcctcctcccgttattatttaagctactgccatcaaccccacccccataaagctgtgaagccctttgcctcgcttttgacagcgtgggggggccccgtgggcagggacttcggatttgcatttctgggttgtttttccttccactctggggtctcgttcaggcattggggtctcctcaccccagccacatgtttctttaagaatcctttggtcaaccaggaccttgatttttcaggcattttggtctggggtatttttgtttgttctctctgttttttgttttcttttttttctttccatcgtggttctggaagcttctagcgtgtggcatctgaccaattttgaattggtcctttctataaaatcaatatttataaggcaaaaaacaga

SEQ ID NO: 300078 - DNA, 1098 bp, Homo sapiens
gcagcttgaggagaaagctaggctagaacaggcaccctcgtgttttctttctttttttttcccaagatgggttctctctcagtcacccaggctggagtgcagtggtatgatcacagcatcacagctcactgcagcctccacctcctgggctcaagcgatactcccacctcagcctcccaactagctgggactacaggtgcgccacaccccacccggctaatttttgtatcttttttcgtagagatggattttgcccaggctggtctcaaactcctgggctcaagcaatctgcccacctcggcctcccaaagtgctaagattacaggcacaagccaccacacccggctttgttctctgttttttagagggtctcactctgtcacccgggttggagtgcagtggtgccatcattgctccctgcagcctggaactcctcctaggctctagaacaggccctcttactccgcgggtccacggctgtgctttagggaatcccctgtactgtctttgcaagggtgtgcatttttctgactgaggacacacagctttaataaattctcattaagccccactacctgaaaaaaaaaaagaaaagccgatttcttaagtgcttgtctgaatctgacctcagattttcatccccatcccagcgcatttcgttcctctctctgtgggtttaagcagccatagctgtgggtggggctgggaatttctgtcttttcaggaacgagctactgagtgagcaaatagaaaaaggaccttgtctgtcagtggtcctttcacttaagtgtaaaagttatggcagtttaaaggcctctggattgtgggcaaaggcagttggacagtggggtaggacctatggggttggtgcgtgctgccagttagggtcccgctctgcaagttaaaagggcatctctcatcccctctgcaacctctgtctgctcacctgagcatggcagtgggaatagagttctttttttttttttttttttttttgagacggagtttcgctcttgtcgcccaggctggagtgtaatggtgccatctggtctcgctgcaacctccacctcccaggttcaagcgattctcgtgcctcag

SEQ ID NO: 300079 - DNA, 1109 bp, Homo sapiens
ttgcttggttgtagtttctaagcacgatgtcctgaaagtctggcgtgagacccgaggtgctcgtgtctttttactttaacttctgtgtgctggtgagaggagagaagcagctgttcttctccaggtgctgctaaggccttagtggaaataacgcccatcaagtttttattaatgttgagctggccacagtctaggtcctggtgagaggcctctctgctgtgagccttggctagatgcgctgagggggctcagtgcatgtgtagatggatgtgtgtcttgtttatgcatgtagattttgttttgtatttattcacatacatggtgaggagatcgagaccatcctggccaacatggtgaaaccccatctctactaaaaattagctgggtgtggcggcatgcgcctgtaatctcagctactggggaggctgaggcaggagaattgcttgaacccgggaagcggaggttgcagtgagccgagattgctccactgcactccagcctggtgacagagcaaggctccgtttcaaaaaaaaaaaaaagttaaacttacacttaacatatgacccagcagtcccacccctaagtacatacccaagagaagtgaaaacttacattcacacaaacacttgtacgcaaatgttcacagcagctttatccactgtcctcccaaattagaaaccacctgtccttcaactggtgagtgaataaacaaactggtgcatccatacaatggaccaccaatggacgcagctataaaaaggaacaaattattaacactaggccctcacttaatgtcattggtaggttcttgaagtgaaacaacacacactgcaacttgaagtgaaacaacatacactgaagccagttttaccataggctaattgacatgagtaagagttaagttcctacagcatatttccggtccccaaaacaccaccagacttttaaataaagacccaaaacaggccgggtgctgtggctcacgcctgtaatcccagcactttgggaagccgaggcaggcagatcacctgaggtcaagagttcgagaccagcctgaccaacatggaaaccccgtctctactacaaatataaaaattagctgggcatgg

SEQ ID NO: 300080 - DNA, 483 bp, Homo sapiens
ggatatgtaataggagtctgatttctttctttctttccttctttctacaaatactgagcacctgtgcaccaggcactattctaggccatttggttattagcatacccaaggaagtaatatttcaactgaatcctattggtatggcacctaaacaacctccccccaacattttgtgttcaagagcattttcataagcactgttgaaaggagacaaagcagtatgtgagtctggtctttactaaaaagcaaatttgagtcacttataatggattcttcattaccaaatgatgggaacctagtattcaggaaataatgagcttacttaaaaatggttaggtccccacttgtctaggcaagttaaaactgcaggcattagaggtgtgtgagcaagaatcctctctccccctcaggatgcccaggtttcagaggaatccatgcttgcttggttgtagtttctaagcacgatgtcctgaaagtctggcg

SEQ ID NO: 300081 - DNA, 2399 bp, Homo sapiens
tattgagttcttcaaacattgtagcctctttatggtctctgagaaataactaccttaaacccataatctttaatacttcctaaactttcttaataagagaagctctattcctgacactacctctcatttgcaaggtcaaatcatcattagttttgtagtctattaactgggtttgcttaggtcaggcattattattactaaccttattgttaatattctaaccataagaattaaactattaatggtgaatagagtttttcactttaacataggcctatcccactggtgggatacgagccaattcgaaagaaaagtcagtcatgtgcttttcagaggatgaaagcttaagataaagactaaaagtgtttgatgctggaggtgggagtggtattatataggtctcagccaagacatgtgataatcactgtagtagtagctggaaagagaaatctgtgactccaattagccagttcctgcagaccttgtgaggactagaggaagaatgctcctggctgttttgtactgcctgctgtggagtttccagacctccgctggccatttccctagagcctgtgtctcctctaagaacctgatggagaaggaatgctgtccaccgtggagcggggacaggagtccctgtggccagctttcaggcagaggttcctgtcagaatatccttctgtccaatgcaccacttgggcctcaatttcccttcacaggggtggatgaccgggagtcgtggccttccgtcttttataataggacctgccagtgctctggcaacttcatgggattcaactgtggaaactgcaagtttggcttttggggaccaaactgcacagagagacgactcttggtgagaagaaacatcttcgatttgagtgccccagagaaggacaaattttttgcctacctcactttagcaaagcataccatcagctcagactatgtcatccccatagggacctatggccaaatgaaaaatggatcaacacccatgtttaacgacatcaatatttatgacctctttgtctggatgcattattatgtgtcaatggatgcactgcttgggggatctgaaatctggagagacattgattttgcccatgaagcaccagcttttctgccttggcatagactcttcttgttgcggtgggaacaagaaatccagaagctgacaggagatgaaaacttcactattccatattgggactggcgggatgcagaaaagtgtgacatttgcacagatgagtacatgggaggtcagcaccccacaaatcctaacttactcagcccagcatcattcttctcctcttggcagattgtctgtagccgattggaggagtacaacagccatcagtctttatgcaatggaacgcccgagggacctttacggcgtaatcctggaaaccatgacaaatccagaaccccaaggctcccctcttcagctgatgtagaattttgcctgagtttgacccaatatgaatctggttccatggataaagctgccaatttcagctttagaaatacactggaaggatttgctagtccacttactgggatagcggatgcctctcaaagcagcatgcacaatgccttgcacatctatatgaatggaacaatgtcccaggtacagggatctgccaacgatcctatcttccttcttcaccatgcatttgttgacagtatttttgagcagtggctccgaaggcaccgtcctcttcaagaagtttatccagaagccaatgcacccattggacataaccgggaatcctacatggttccttttataccactgtacagaaatggtgatttctttatttcatccaaagatctgggctatgactatagctatctacaagattcagacccagactcttttcaagactacattaagtcctatttggaacaagcgagtcggatctggtcatggctccttggggcggcgatggtaggggccgtcctcactgccctgctggcagggcttgtgagcttgctgtgtcgtcacaagagaaagcagcttcctgaagaaaagcagccactcctcatggagaaagaggattaccacagcttgtatcagagccatttataaaaggcttaggcaatagagtagggccaaaaagcctgacctcactctaactcaaagtaatgtccaggttcccagagaatatctgctggtatttttctgtaaagaccatttgcaaaattgtaacctaatacaaagtgtagccttcttccaactcaggtagaacacacctgtctttgtcttgctgttttcactcagcccttttaacattttcccctaagcccatatgtctaaggaaaggatgctatttggtaatgaggaactgttatttgtatgtgaattaaagtgctcttattttaaaaaattgaaataa

SEQ ID NO: 300082 - DNA, 230 bp, Homo sapiens
  misc_feature (217)..(217): n is a, c, g, or t
aataaccttttcctctgcagtatttttgagcagtggctccgaaggcaccgtcctcttcaagaagtttatccagaagccaatgcacccattggacataaccgggaatcctacatggttccttttataccactgtacagaaatggtgatttctttatttcatccaaagatctgggctatgactatagctatctacaagattcaggtaaagtttactttntttcagaggaatt

SEQ ID NO: 300083 - DNA, 5255 bp, Homo sapiens
cgcttgtgggccggccttgggggagggggacgcgcacccacagaaggactcagagggcttcacggtaagctgagcagggtcaaggtccacagggagcgggagagggtagtaatccgggaagtcttcctggtggcagtgaattctttgcggggttcggcaggcgcaggatccttggggccgcgcaccctgcagcggcccctcccctcccctcccccctcccacctgtgggaaacgcaggccctgagagaggctccgtcagtgccagcagctggcgccactgcgtcccctgccccggcctcagccagccctgggacctctgcggaggactgatcccgggaagggggccctgtcttcccagggccccggtgcggccgagctgggaagaccttggggagggcaggcctgccacctactgcagccgcggcccccgtccatccgcgagggacaggctgtgcccttggcggcgcccacccgcgacccagatgtgtgtcgcctacccaccctcccccagacccccgtttcctcaggcgctcgccgcctcggggcgcctggcacgcggcagccccgcaaggtaggtccttcattcctcccatttcgcagaggagaaaactgcagtccgggatggctcagtcggcccctccaaagtcgcgcagctggttcgggccgagccccgactgcgagagtgaggcacatggcccctgcagaccgggcctcggagggtcccaggcttgaggacccgtcggcccctcaaccccttggaaaggcaaggagagaagcctgcgctggtagtgagcttccacttctgccctgactgcaacacttaggttagggggctgggaaggacccccaccctcaatttttggataggggtgtatttctctccctcccctaatttctgaggttggttccctgttggattcaggtactgctctccccttccaaccccatttccccagcccatgaggttgggatattagggtcccagacccaagataaagaaccccaaaattctggggttgcagcaaagagttgagagggtcactgagcctgggaagctcatggcggaggtggggctaaggcagaagtttaggaatggaacgctgagctgagctgagctgagctgagctgagctgagctgagcaacgctgggggctatgtgcatggagccctgggggttgggctttatcaggtgggcaacaggcagcccccattcccaagttctctcttttatcccagccttattccttcaccttggatgcctgggaactttttgtacccattgtagggaaggggacactgaggggcagagcggtgccgggttgacttggctggggtggtgggaataggagtagggtcttacctatctctgccttcccacctgtgcccacagtgcccccctggcttagtcatggcgaagctggagacgctgcctgtgcgcgctgacccagggcgggaccctctcctggcctttgccccacggccctccgagcttggacccccggacccccgcctggccatgggcagcgtgggcagtggggtggcccatgcccaggagtttgccatgaagagcgtgggtacccgcacagggggtgggggcagccagggcagtttccctggcccccgaggcagtggcagtggggccagcagggagaggccgggccgctacccctcagaggacaagggtctcgccaactccctctacctcaatggtgagctgcggggcagtgaccacaccgatgtctgtggcaacgtggttggcagcagcggaggcagcagcagcagtggtggcagtgacaaagccccaccgcagtatcgtgagcccagccacccacccaagctcctggccacctctggcaagctagaccagtgctcagaaccactagttcggccgtcggccttcaagcctgtcgtacccaagaatttccactccatgcagaatttgtgccccccgcagaccaatgggactcctgagggacggcagggccctggtggcctcaaaggcggactggacaagtctcggaccatgactccagcgggtgggagtgggagtggcctctcagactcaggccggaactccctcacaagcctgcccacctacagctccagctacagccagcacctggcacccctcagtgcctccaccagccacattaaccgcattggcactgccagctatggtagtggtagtggcggcagcagcggtggggggtcgggctaccaggacctggggacctccgatagtggacgggcctccagcaagagtgggtcgtcgtcatctatggggcggccaggccacctgggctctggggagggcggaggtggaggcctgcctttcgcggcctgctcaccgccctcccccagtgcactcatccaggagctggaggagcggctgtgggagaaggagcaggaggtggcagctctgcggcgcagcctggagcagagcgaggcggctgtggcccaggtactggaggagcggcagaaggcgtgggagcgggagctggccgagctgcggcagggctgcagcgggaagctacagcaggtggcccgacgtgcccagcgcgcccagcagggcctacagctgcaggtgttgcggctgcagcaggacaagaagcagctgcaggaggaggcggcccggctgatgcggcagcgggaagagctggaggacaaggtggccgcctgccagaaggagcaggccgacttcctgccccggatagaggaaactaagtgggaggtgtgccagaaggctggcgagatctccctcctgaagcagcagctgaaggactcgcaggcggatgtgtcgcagaagttgagtgagatcgtgggactgcgctcgcagctgcgggagggccgggcttcgctgcgggagaaggaggagcagctgctcagcctgcgggactccttcagcagcaagcaggccagcctggagctgggcgaaggcgagctgcctgccgcctgcctcaagccggcgctgacccccgtggacccggccgagccacaggatgctctggccacctgcgagagcgacgaggctaagatgcgccgtcaggccggggtggccgctgccgcctccttggtttccgtggacggggaggcggaggctggcggggagagcgggacgcgggccctgcggcgggaggtggggcggctgcaggccgagctggcggctgagcggcgggcccgggagcgccagggtgccagcttcgccgaggagcgccgcgtgtggctggaggagaaggagaaggtgatcgagtaccagaagcagctgcagctgagctacgtggagatgtaccagcgcaaccagcagctggagcgcaggctgcgggagcgcggggccgcagggggtgcaagcacgcccactccccagcatggcgaggagaagaaggcctggaccccctcccgcctcgagcgcattgagtccacagaaatctgatcgacctgggcactcggcattttgacacatgtcctgtcaaaaggccagagtccccagtgtcccctcccctccatctctcttccccatagaccccataaccccagaccaaagaggttctctaagcagctgtgaccaggttcctccctccccacctgccctcctagctccagcactgcccccgtggcagcccacttggacccccctaaaaggagggaataggaggagggcagggtgagtgggggcaatcctaggtggtgggggagtcatgctccctttctcggcacccccttgttggagatggaggcagcagacgtgcagtgccataaggtgccccagtccttctggaggcctgggctgctactgttggccaccctgtgtctagtgatgctctctgtgctcacctcctaggccatggagcctgagggggcctgcaccgggtttgctgaaactgacagagcctgggctccagacctctctccctcctacagtgctctccctccctgggcagattggcaggacaagtgggagcagatggcctgcctttggctgagagggctacctgcccagcccctcccccaacaagatctcttggactcaggcctcagagcctggcctggttgtgagtgtgtgtccctgtgtgtgtgttgcgggaggggaggactggggctggaagtccagcacccagggaagatctgtcctcctgttcttgggaagcgttgcctgacggcttctcggctctaccctcacccttctggccaggatcccgcagggcaacagccccatctgcttggctgaccccacacccaggaccactgtccggctctaacacagctattaagtgctacctgcctctcaggcactctcctcgcccagtttctgaggtcagacgagtgtctgcgatgtcttcccgcactctattcccccagcctctttctgctttcatgctcagcacatcatcttcctaggcagtctcttccccaaagtctcaccttttcttccaatagaaaattccgcttgacctttggtgcactgcccacttcccagctccactggcccaagtctgagccggaggcccttgttttgggggcggggggagagttggatgtgattgcccttgaagaacaaggctgacctgagaggttcctggcgccctgaggtggctcagcacctgcccagggtaggcctggcatgaggggttaggtcagccaatgtcagctgcttctcttggggccctctcagagtctatctccccaagacaggaagggaaaagcaaatttctaattcaccagcaataaaaattggaggaggcttggccctcagcccttatatctctctctttttcactctcttcctcccacccccaagactgagttttggggggcaaggtggagagagctggcaactactgtgagcaagtcccctagcccctgaccagcctcctcccatgactggtgactgtttaatgagctgtgcatcccccacaaaaacatgagtgcccctctgtgtggcctctaaccctctgcacagcccttctgggtggtcctcaccaggtctctgagctgggtgggaggccatcctggcgaccactgcccattccattcacccctcactgtacctgccctagaacctgggcctaggccacaggggcagggagaagagaaggcattagtaagaaaaaaatagaaaaaaatatgaacagactcagctttgggacgtccaaccacaaaagaaattatatataaatatatataaatatatatctctaccatatgtgatggaaagactttttgttttcctttcccaaagaaataaaacggaaaaagcc

SEQ ID NO: 300084 - DNA, 4189 bp, Homo sapiens
cccgcgcagcgcgccccgccgggcgtgcttcgggctgcgccagcaagcggggccggtggcgcccgtgtcggagaccccgcgccggaccctgaggcagcgaaggagaaaactgcagtccgggatggctcagtcggcccctccaaagtcgcgcagctggttcgggccgagccccgactgcgagagtgaggcacatggcccctgcagaccgggcctcggagggtcccaggcttgaggacccgtcggcccctcaaccccttggaaaggcaaggagagaagcctgcgctggtagtgagcttccacttctgccctgactgcaacacttagtgcccccctggcttagtcatggcgaagctggagacgctgcctgtgcgcgctgacccagggcgggaccctctcctggcctttgccccacggccctccgagcttggacccccggacccccgcctggccatgggcagcgtgggcagtggggtggcccatgcccaggagtttgccatgaagagcgtgggtacccgcacagggggtgggggcagccagggcagtttccctggcccccgaggcagtggcagtggggccagcagggagaggccgggccgctacccctcagaggacaagggtctcgccaactccctctacctcaatggtgagctgcggggcagtgaccacaccgatgtctgtggcaacgtggttggcagcagcggaggcagcagcagcagtggtggcagtgacaaagccccaccgcagtatcgtgagcccagccacccacccaagctcctggccacctctggcaagctagaccagtgctcagaaccactagttcggccgtcggccttcaagcctgtcgtacccaagaatttccactccatgcagaatttgtgccccccgcagaccaatgggactcctgagggacggcagggccctggtggcctcaaaggcggactggacaagtctcggaccatgactccagcgggtgggagtgggagtggcctctcagactcaggccggaactccctcacaagcctgcccacctacagctccagctacagccagcacctggcacccctcagtgcctccaccagccacattaaccgcattggcactgccagctatggtagtggtagtggcggcagcagcggtggggggtcgggctaccaggacctggggacctccgatagtggacgggcctccagcaagagtgggtcgtcgtcatctatggggcggccaggccacctgggctctggggagggcggaggtggaggcctgcctttcgcggcctgctcaccgccctcccccagtgcactcatccaggagctggaggagcggctgtgggagaaggagcaggaggtggcagctctgcggcgcagcctggagcagagcgaggcggctgtggcccaggtactggaggagcggcagaaggcgtgggagcgggagctggccgagctgcggcagggctgcagcgggaagctacagcaggtggcccgacgtgcccagcgcgcccagcagggcctacagctgcaggtgttgcggctgcagcaggacaagaagcagctgcaggaggaggcggcccggctgatgcggcagcgggaagagctggaggacaaggtggccgcctgccagaaggagcaggccgacttcctgccccggatagaggaaactaagtgggaggtgtgccagaaggctggcgagatctccctcctgaagcagcagctgaaggactcgcaggcggatgtgtcgcagaagttgagtgagatcgtgggactgcgctcgcagctgcgggagggccgggcttcgctgcgggagaaggaggagcagctgctcagcctgcgggactccttcagcagcaagcaggccagcctggagctgggcgaaggcgagctgcctgccgcctgcctcaagccggcgctgacccccgtggacccggccgagccacaggatgctctggccacctgcgagagcgacgaggctaagatgcgccgtcaggccggggtggccgctgccgcctccttggtttccgtggacggggaggcggaggctggcggggagagcgggacgcgggccctgcggcgggaggtggggcggctgcaggccgagctggcggctgagcggcgggcccgggagcgccagggtgccagcttcgccgaggagcgccgcgtgtggctggaggagaaggagaaggtgatcgagtaccagaagcagctgcagctgagctacgtggagatgtaccagcgcaaccagcagctggagcgcaggctgcgggagcgcggggccgcagggggtgcaagcacgcccactccccagcatggcgaggagaagaaggcctggaccccctcccgcctcgagcgcattgagtccacagaaatctgatcgacctgggcactcggcattttgacacatgtcctgtcaaaaggccagagtccccagtgtcccctcccctccatctctcttccccatagaccccataaccccagaccaaagaggttctctaagcagctgtgaccaggttcctccctccccacctgccctcctagctccagcactgcccccgtggcagcccacttggacccccctaaaaggagggaataggaggagggcagggtgagtgggggcaatcctaggtggtgggggagtcatgctccctttctcggcacccccttgttggagatggaggcagcagacgtgcagtgccataaggtgccccagtccttctggaggcctgggctgctactgttggccaccctgtgtctagtgatgctctctgtgctcacctcctaggccatggagcctgagggggcctgcaccgggtttgctgaaactgacagagcctgggctccagacctctctccctcctacagtgctctccctccctgggcagattggcaggacaagtgggagcagatggcctgcctttggctgagagggctacctgcccagcccctcccccaacaagatctcttggactcaggcctcagagcctggcctggttgtgagtgtgtgtccctgtgtgtgtgttgcgggaggggaggactggggctggaagtccagcacccagggaagatctgtcctcctgttcttgggaagcgttgcctgacggcttctcggctctaccctcacccttctggccaggatcccgcagggcaacagccccatctgcttggctgaccccacacccaggaccactgtccggctctaacacagctattaagtgctacctgcctctcaggcactctcctcgcccagtttctgaggtcagacgagtgtctgcgatgtcttcccgcactctattcccccagcctctttctgctttcatgctcagcacatcatcttcctaggcagtctcttccccaaagtctcaccttttcttccaatagaaaattccgcttgacctttggtgcactgcccacttcccagctccactggcccaagtctgagccggaggcccttgttttgggggcggggggagagttggatgtgattgcccttgaagaacaaggctgacctgagaggttcctggcgccctgaggtggctcagcacctgcccagggtaggcctggcatgaggggttaggtcagccaatgtcagctgcttctcttggggccctctcagagtctatctccccaagacaggaagggaaaagcaaatttctaattcaccagcaataaaaattggaggaggcttggccctcagcccttatatctctctctttttcactctcttcctcccacccccaagactgagttttggggggcaaggtggagagagctggcaactactgtgagcaagtcccctagcccctgaccagcctcctcccatgactggtgactgtttaatgagctgtgcatcccccacaaaaacatgagtgcccctctgtgtggcctctaaccctctgcacagcccttctgggtggtcctcaccaggtctctgagctgggtgggaggccatcctggcgaccactgcccattccattcacccctcactgtacctgccctagaacctgggcctaggccacaggggcagggagaagagaaggcattagtaagaaaaaaatagaaaaaaatatgaacagactcagctttgggacgtccaaccacaaaagaaattatatataaatatatataaatatatatctctaccatatgtgatggaaagactttttgttttcctttcccaaagaaataaaacggaaaaagcc

SEQ ID NO: 300085 - DNA, 3954 bp, Homo sapiens
cccgcgcagcgcgccccgccgggcgtgcttcgggctgcgccagcaagcggggccggtggcgcccgtgtcggagaccccgcgccggaccctgaggcagcgaaggagaaaactgcagtccgggatggctcagtcggcccctccaaagtcgcgcagctggttcgggccgagccccgactgcgagagtgaggcacatggcccctgcagaccgggcctcggagggtcccaggcttgaggacccgtcggcccctcaaccccttggaaaggcaaggagagaagcctgcgctggtagtgagcttccacttctgccctgactgcaacacttagtgcccccctggcttagtcatggcgaagctggagacgctgcctgtgcgcgctgacccagggcgggaccctctcctggcctttgccccacggccctccgagcttggacccccggacccccgcctggccatgggcagcgtgggcagtggggtggcccatgcccaggagtttgccatgaagagcgtgggtacccgcacagggggtgggggcagccagggcagtttccctggcccccgaggcagtggcagtggggccagcagggagaggccgggccgctacccctcagaggacaagggtctcgccaactccctctacctcaatggtgagctgcggggcagtgaccacaccgatgtctgtggcaacgtggttggcagcagcggaggcagcagcagcagtggtggcagtgacaaagccccaccgcagtatcgtgagcccagccacccacccaagctcctggccacctctggcaagctagaccagtgctcagaaccactagttcggccgtcggccttcaagcctgtcgtacccaagaatttccactccatgcagaatttgtgccccccgcagaccaatgggactcctgagggacggcagggccctggtggcctcaaaggcggactggacaagtctcggaccatgactccagcgggtgggagtgggagtggcctctcagactcaggccggaactccctcacaagcctgcccacctacagctccagctacagccagcacctggcacccctcagtgcctccaccagccacattaaccgcattggcactgccagctatggtagtggtagtggcggcagcagcggtggggggtcgggctaccaggacctggggacctccgatagtggacgggcctccagcaagagtgggtcgtcgtcatctatggggcggccaggccacctgggctctggggagggcggaggtggaggcctgcctttcgcggcctgctcaccgccctcccccagtgcactcatccaggagctggaggagcggctgtgggagaaggagcaggaggtggcagctctgcggcgcagcctggagcagagcgaggcggctgtggcccaggtactggaggagcggcagaaggcgtgggagcgggagctggccgagctgcggcagggctgcagcgggaagctacagcaggtggcccgacgtgcccagcgcgcccagcagggcctacagctgcaggtgttgcggctgcagcaggacaagaagcagctgcaggaggaggcggcccggctgatgcggcagcgggaagagctggaggacaaggtggccgcctgccagaaggagcaggccgacttcctgccccggatagaggaaactaagtgggaggtgtgccagaaggctggcgagatctccctcctgaagcagcagctgaaggactcgcaggcggatgtgtcgcagaagttgagtgagatcgtgggactgcgctcgcagctgcgggagggccgggcttcgctgcgggagaaggaggagcagctgctcagcctgcgggactccttcagcagcaagcaggccagcctggagctgggcgaaggcgagctgcctgccgcctgcctcaagccggcgctgacccccgtggacccggccgagccacaggatgctctggccacctgcgagagcgacgaggctaagatgcgccgtcaggccggggtggccgctgccgcctccttggtttccgtggacggggaggcggaggctggcggggagagcgggacgcgggccctgcggcgggaggtggggcggctgcaggccgagctggcggctgagcggcgggcccgggagcgccagggtgccagcttcgccgaggagcgccgcgtgtggctggaggagaaggagaaggtgatcgagtaccagaagcagctgcagctgagctacgtggagatgtaccagcgcaaccagcagctggagcgcaggctgcgggagcgcggggccgcagggggtgcaagcacgcccactccccagcatggcgaggagaagaaggcctggaccccctcccgcctcgagcgcattgagtccacagaaatctgatcgacctgggcactcggcattttgacacatgtcctgtcaaaaggccagagtccccagtgtcccctcccctccatctctcttccccatagaccccataaccccagaccaaagaggttctctaagcagctgtgaccaggttcctccctccccacctgccctcctagctccagcactgcccccgtggcagcccacttggacccccctaaaaggagggaataggaggagggcagggtgagtgggggcaatcctaggtggtgggggagtcatgctccctttctcggcacccccttgttggagatggaggcagcagacgtgcagtgccataaggtgccccagtccttctggaggcctgggctgctactgttggccaccctgtgtctagtgatgctctctgtgctcacctcctaggccatggagcctgagggggcctgcaccgggtttgctgaaactgacagagcctgggctccagacctctctccctcctacagtgctctccctccctgggcagattggcaggacaagtgggagcagatggcctgcctttggctgagagggctacctgcccagcccctcccccaacaagatctcttggactcaggcctcagagcctggcctggttgtgagtgtgtgtccctgtgtgtgtgttgcgggaggggaggactggggctggaagtccagcacccagggaagatctgtcctcctgttcttgggaagcgttgcctgacggcttctcggctctaccctcacccttctggccaggatcccgcagggcaacagccccatctgcttggctgaccccacacccaggaccactgtccggctctaacacagctattaagtgctacctgcctctcaggcactctcctcgcccagtttctgaggtcagacgagtgtctgcgatgtcttcccgcactctattcccccagcctctttctgctttcatgctcagcacatcatcttcctaggcagtctcttccccaaagtctcaccttttcttccaatagaaaattccgcttgacctttggtgcactgcccacttcccagctccactggcccaagtctgagccggaggcccttgttttgggggcggggggagagttggatgtgattgcccttgaagaacaaggctgacctgagaggttcctggcgccctgaggtggctcagcacctgcccagggtaggcctggcatgaggggttaggtcagccaatgtcagctgcttctcttggggccctctcagagtctatctccccaagacaggaagggaaaagcaaatttctaattcaccagcaataaaaattggaggaggcttggccctcagcccttatatctctctctttttcactctcttcctcccacccccaagactgagttttggggggcaaggtggagagagctggcaactactgtgagcaaggagaagagaaggcattagtaagaaaaaaatagaaaaaaatatgaacagactcagctttgggacgtccaaccacaaaagaaattatatataaatatatataaatatatatctctaccatatgtgatggaaagactttttgttttcctttcccaaagaaataaaacggaaaaagcc

SEQ ID NO: 300086 - DNA, 182 bp, Homo sapiens
ctcataacacttactagagttatgggtcaatttctaagcttataccacctgaggaagataaagaactaaaaatccttggtttataaagggcttttggtttttaaaattcactaacaaatatgcaaagcttaaaggtttgtgggaattatttttcagaaggaaaaaattacttaagcccccca

SEQ ID NO: 300087 - DNA, 2556 bp, Homo sapiens
agcggggtcttacgtttcgcccccggcagcgccgacagcggacccaagatggcgaccgagttggagtacgagtctgtgctgtgtgtgaagccagacgtcagcgtctaccggattccgccccgggcctccaaccgcggttacagggcctctgactggaaattagaccagcctgattggactggtcgcctccgaatcacttcaaaagggaagactgcctatatcaaactcgaggataaagtttcaggggagctctttgctcaggcaccagtagaacaatatcctggtattgctgtggagacggtgacagattctagccgctactttgtaatccggatccaggatggtactgggcgcagtgctttcattggcattggcttcacagatcggggagatgccttcgactttaatgtctccttgcaggatcacttcaagtgggtaaagcaggaatctgagatttccaaggaatctcaagaaatggatgctcgtcctaagttggatctgggcttcaaggaaggacaaaccatcaagttgtgtatcgggaacattacaaacaagaaaggaggtgcttctaagcccaggactgcaaggggtgggggtctgagcttactcccacccccgccaggaggcaaagtcactattcccccaccatcctcctcagttgccatcagcaatcatgtcaccccaccacccattccgaaatctaaccatggaggcagtgatgcagatatccttttagatttggattctcctgctcctgtcacgacaccagcaccaactccagtttctgtaagcaatgacttgtggggagacttcagcactgcctccagctctgttccaaaccaggcaccacagccatccaactgggtccagttctgaatggcattggcaggacattaaggacagacttgaggaataaaaatgaccttgagggcaccaatctgtgagggaagttaggaacccatttcctccccagaaccagaatgactggacaatctttttcatagcttctccatcacattcaagctggtttatgtcactcccctgtgttgttacttgtacagccaagaaagtatctgttatctcctgcgtagtaccaaggtaggggactagtggatcttatcatagttttggctgactatgcagggcttaaaaggccagcgtctgtttgagggggaatgacctctaacatctgtaaaatttgtctcatcttttaatttctttaacttatttcaaaatcatctcatgacccttgtgtgcctctttgtgaagccctatttagcaatttcaggggagtcaaaaaccttgcaacttccttctccactaacccaggactaaaaatggacaggctgacctcagtgtttacaaattcagaattttgataggggtagatatggagaaagacctatttcctgggtctctgctgtgtagtctccttcaggcttattgtgctcagtgaacatccagtgctgggtgcagctccatcaccctcttgtgtgtttacatgtctctttctatgataagagggttgtgttggtggcacctccactactcttttctgtttgttgagtttgaattgtgtaacatctttgatcagtgggtgtatctgtaatgaaggaggttcaagaggctgtgctttccaagtgatagtctataggagtgtttaatttcttgcagctccatctggttgctgcatttgaagcatggcattaatttgtatttgccctgttctttgacctaaagttgaagggtttagagtttttaacctgatctgtagagcagagaggttgaaagcacttaactcttgtttagtatcctcattgccttgctgcctgggtatctggcccctttccataaacatttcttttcagttcatgtagttctttaatagaaagctgctattatgtatattgtcatttgtgaaggaagttggagagtcacagctttactgtgacaggttttgcccaaggctttgatacctgtcacccagggtatcttaaaagcaagttgttctcccactactttcctttccctctgccctgccattcctattacaatgctgtgaaaaaagttctgcttcttaggtgaatgggtactttctattttgtttctaaacgagcaattttgaggatgaaatgggaagatatcattgcttcctttttgcacctattgggtatgtacactctggccgaagggagtccttatgtttagtttcaaaatatattactttcctggattctcttcttcactttttctgactttgggtccattttcttttcattgcctccttttccaggcagctctattcttgcagagccatagcaggacatgttaaaattccaatagaaaacactaaaaggaaagtctgtggaatcactagtgactaaatactgggaacctattttctcaatcttcctccatgttgtgttctttgtattcttgagatgataatatattatgtatttgaattcctgaaaaatggaaaatgtttaagatatatgtatataaagtgtatgctgtattggtgcaataatggtaattaaaaatatgaaaaaagtg

SEQ ID NO: 300088 - DNA, 2474 bp, Homo sapiens
agcggggtcttacgtttcgcccccggcagcgccgacagcggacccaagatggcgaccgagttggagtacgagtctgtgctgtgtgtgaagccagacgtcagcgtctaccggattccgccccgggcctccaaccgcggttacagggcctctgactggaaattagaccagcctgattggactggtcgcctccgaatcacttcaaaagggaagactgcctatatcaaactcgaggataaagtttcaggggagctctttgctcaggcaccagtagaacaatatcctggtattgctgtggagacggtgacagattctagccgctactttgtaatccggatccaggatggtactggtgggtaaagcaggaatctgagatttccaaggaatctcaagaaatggatgctcgtcctaagttggatctgggcttcaaggaaggacaaaccatcaagttgtgtatcgggaacattacaaacaagaaaggaggtgcttctaagcccaggactgcaaggggtgggggtctgagcttactcccacccccgccaggaggcaaagtcactattcccccaccatcctcctcagttgccatcagcaatcatgtcaccccaccacccattccgaaatctaaccatggaggcagtgatgcagatatccttttagatttggattctcctgctcctgtcacgacaccagcaccaactccagtttctgtaagcaatgacttgtggggagacttcagcactgcctccagctctgttccaaaccaggcaccacagccatccaactgggtccagttctgaatggcattggcaggacattaaggacagacttgaggaataaaaatgaccttgagggcaccaatctgtgagggaagttaggaacccatttcctccccagaaccagaatgactggacaatctttttcatagcttctccatcacattcaagctggtttatgtcactcccctgtgttgttacttgtacagccaagaaagtatctgttatctcctgcgtagtaccaaggtaggggactagtggatcttatcatagttttggctgactatgcagggcttaaaaggccagcgtctgtttgagggggaatgacctctaacatctgtaaaatttgtctcatcttttaatttctttaacttatttcaaaatcatctcatgacccttgtgtgcctctttgtgaagccctatttagcaatttcaggggagtcaaaaaccttgcaacttccttctccactaacccaggactaaaaatggacaggctgacctcagtgtttacaaattcagaattttgataggggtagatatggagaaagacctatttcctgggtctctgctgtgtagtctccttcaggcttattgtgctcagtgaacatccagtgctgggtgcagctccatcaccctcttgtgtgtttacatgtctctttctatgataagagggttgtgttggtggcacctccactactcttttctgtttgttgagtttgaattgtgtaacatctttgatcagtgggtgtatctgtaatgaaggaggttcaagaggctgtgctttccaagtgatagtctataggagtgtttaatttcttgcagctccatctggttgctgcatttgaagcatggcattaatttgtatttgccctgttctttgacctaaagttgaagggtttagagtttttaacctgatctgtagagcagagaggttgaaagcacttaactcttgtttagtatcctcattgccttgctgcctgggtatctggcccctttccataaacatttcttttcagttcatgtagttctttaatagaaagctgctattatgtatattgtcatttgtgaaggaagttggagagtcacagctttactgtgacaggttttgcccaaggctttgatacctgtcacccagggtatcttaaaagcaagttgttctcccactactttcctttccctctgccctgccattcctattacaatgctgtgaaaaaagttctgcttcttaggtgaatgggtactttctattttgtttctaaacgagcaattttgaggatgaaatgggaagatatcattgcttcctttttgcacctattgggtatgtacactctggccgaagggagtccttatgtttagtttcaaaatatattactttcctggattctcttcttcactttttctgactttgggtccattttcttttcattgcctccttttccaggcagctctattcttgcagagccatagcaggacatgttaaaattccaatagaaaacactaaaaggaaagtctgtggaatcactagtgactaaatactgggaacctattttctcaatcttcctccatgttgtgttctttgtattcttgagatgataatatattatgtatttgaattcctgaaaaatggaaaatgtttaagatatatgtatataaagtgtatgctgtattggtgcaataatggtaattaaaaatatgaaaaaagtg

SEQ ID NO: 300089 - DNA, 415 bp, Homo sapiens
ttcggatcacgttggatccgaattcggatcaacgtacactctggccgaagggagtccttatgtttagtttcaaaatatattactttcctggattctcttcttcactttttctgactttgggtccattttcttttcattgcctccttttccaggcagctctattcttgcagagccatagcaggacatgttaaaattccaatagaaaacactaaaaggaaagtctgtggaatcactagtgactaaatactgggaacctattttctcaatcttcctccatgttgtgttctttgtattcttgagatgataatatattatgtatttgaattcctgaaaaatggaaaatgtttaagatatatgtatataaagtgtatgctgtattggtgcaataatggtaattaaaaatatgaaaaaagtg

SEQ ID NO: 300090 - DNA, 517 bp, Homo sapiens
agcggggtcttacgtttcgcccccggcagcgccgacagcggacccaagatggcgaccgagttggagtacgagtctgtgctgtgtgtgaagccagacgtcagcgtctaccggattccgccccgggcctccaaccgcggttacagggcctctgactggaaattagaccagcctgattggactggtcgcctccgaatcacttcaaaagggaagactgcctatatcaaactcgaggataaagtttcaggggagctctttgctcaggcaccagtagaacaatatcctggtattgctgtggagacggtgacagattctagccgctactttgtaatccggatccaggatggtactggtaagagaactgggattttgagtggaacgaagttaggaaaacaggtgaatgcacagccatgaaaagtgtttccgattgcatttatctttctttggtttacttcattttttcttccctttctctaaagttgctctagttgctaaaggaaaagtattaacatgttatttg

SEQ ID NO: 300091 - DNA, 2663 bp, Homo sapiens
agcggggtcttacgtttcgcccccggcagcgccgacagcggacccaagatggcgaccgagttggagtacgagtctgtgctgtgtgtgaagccagacgtcagcgtctaccggattccgccccgggcctccaaccgcggttacagggcctctgactggaaattagaccagcctgattggactggtcgcctccgaatcacttcaaaagggaagactgcctatatcaaactcgaggataaagtttcaggggagctctttgctcaggcaccagtagaacaatatcctggtattgctgtggagacggtgacagattctagccgctactttgtaatccggatccaggatggtactgggcgcagtgctttcattggcattggcttcacagatcggggagatgccttcgactttaatgtctccttgcaggatcacttcaagtgggtaaagcaggaatctgagatttccaaggaatctcaagaaatggatgctcgtcctaagttggatctgggcttcaaggaaggacaaaccatcaagttgtgtatcgggaacattacaaacaagaaaggaggtgcttctaagcccaggactgcaaggggtgggggtctgagcttactcccacccccgccaggaggcaaagtcactattcccccaccatcctcctcagttgccatcagcaatcatgtcaccccaccacccattccgaaatctaaccatggaggcagtgatgcagatatccttttagatttggattctcctgctcctgtcacgacaccagcaccaactccagtttctgtaagcaatgacttgtggggagacttcagcactgcctccagctctgttccaaaccaggcaccacagccatccaactgggtccagttctgaatggcattggcaggacattaaggacagacttgaggaataaaaatgaccttgagggcaccaatctgtgagggaagttaggaacccatttcctccccagaaccagaatgactggacaatctttttcatagcttctccatcacattcaagctggtttatgtcactcccctgtgttgttacttgtacagccaagaaagtatctgttatctcctgcgtagtaccaaggtaggggactagtggatcttatcatagttttggctgactatgcagggcttaaaaggccagcgtctgtttgagggggaatgacctctaacatctgtaaaatttgtctcatcttttaatttctttaacttatttcaaaatcatctcatgacccttgtgtgcctctttgtgaagccctatttagcaatttcaggggagtcaaaaaccttgcaacttccttctccactaacccaggactaaaaatggacaggctgacctcagtgtttacaaattcagaattttgataggggtagatatggagaaagacctatttcctgggtctctgctgtgtagtctccttcaggcttattgtgctcagtgaacatccagtgctgggtgcagctccatcaccctcttgtgtgtttacatgtctctttctatgataagagggttgtgttggtggcacctccactactcttttctgtttgttgagtttgaattgtgtaacatctttgatcagtgggtgtatctgtaatgaaggaggttcaagaggctgtgctttccaagtgatagtctataggagtgtttaatttcttgcagctccatctggttgctgcatttgaagcatggcattaatttgtatttgccctgttctttgacctaaagttgaagggtttagagtttttaacctgatctgtagagcagagaggttgaaagcacttaactcttgtttagtatcctcattgccttgctgcctgggtatctggcccctttccataaacatttcttttcagttcatgtagttctttaatagaaagctgctattatgtatattgtcatttgtgaaggaagttggagagtcacagctttactgtgacaggttttgcccaaggctttgatacctgtcacccagggtatcttaaaagcaagttgttctcccactactttcctttccctctgccctgccattcctattacaatgctgtgaaaaaagttctgcttcttaggtgaatgggtactttctattttgtttctaaacgagcaattttgaggatgaaatgggaagatatcattgcttcctttttgcacctattgggtatgtacactctggccgaagggagtccttatgtttagtttcaaaatatattactttcctggattctcttcttcactttttctgactttgggtccattttcttttcattgcctccttttccaggcagctctattcttgcagagccatagcaggacatgttaaaattccaatagaaaacactaaaaggaaagtctgtggaatcactagtgactaaatactgggaacctattttctcaatcttcctccatgttgtgttctttgtattcttgagatgataatatattatgtatttgaattcctgaaaaatggaaaatgtttaagatatatgtatataaagtgtatgctgtattggtgcaataatggtaattaaaaatatgaaaaaagtgtctcttttatcttttaatttgcttatttgattaccttttaaatttaattgaccaaatataagtggaccagtagttaataaaggatatttatatcactctttattaag

SEQ ID NO: 300092 - DNA, 2476 bp, Homo sapiens
agcggggtcttacgtttcgcccccggcagcgccgacagcggacccaagatggcgaccgagttggagtacgagtctgtgctgtgtgtgaagccagacgtcagcgtctaccggattccgccccgggcctccaaccgcggttacagggcctctgactggaaattagaccagcctgattggactggtcgcctccgaatcacttcaaaagggaagactgcctatatcaaactcgaggataaagtttcaggggagctctttgctcaggcaccagtagaacaatatcctggtattgctgtggagacggtgacagattctagccgctactttgtaatccggatccaggatggtactgggcgcagtgctttcattggcattggcttcacagatcggggagatgccttcgactttaatgtctccttgcaggatcacttcaagtgggtaaagcaggaatctgagatttccaaggaatctcaagaaatggatgctcgtcctaagttggatctgggcttcaaggaaggacaaaccatcaagttgtgtatcgggaacattacaaacaagaaaggaggtgcttctaagcccaggactgcaaggggtgggggtctgagcttactcccacccccgccaggaggcaaagtcactattcccccaccatcctcctcagttgccatcagcaatcatgtcaccccaccacccattccgaaatctaaccatggaggcagtgatgcagatatccttttagatttggattctcctgctcctgtcacgacaaccacagccatccaactgggtccagttctgaatggcattggcaggacattaaggacagacttgaggaataaaaatgaccttgagggcaccaatctgtgagggaagttaggaacccatttcctccccagaaccagaatgactggacaatctttttcatagcttctccatcacattcaagctggtttatgtcactcccctgtgttgttacttgtacagccaagaaagtatctgttatctcctgcgtagtaccaaggtaggggactagtggatcttatcatagttttggctgactatgcagggcttaaaaggccagcgtctgtttgagggggaatgacctctaacatctgtaaaatttgtctcatcttttaatttctttaacttatttcaaaatcatctcatgacccttgtgtgcctctttgtgaagccctatttagcaatttcaggggagtcaaaaaccttgcaacttccttctccactaacccaggactaaaaatggacaggctgacctcagtgtttacaaattcagaattttgataggggtagatatggagaaagacctatttcctgggtctctgctgtgtagtctccttcaggcttattgtgctcagtgaacatccagtgctgggtgcagctccatcaccctcttgtgtgtttacatgtctctttctatgataagagggttgtgttggtggcacctccactactcttttctgtttgttgagtttgaattgtgtaacatctttgatcagtgggtgtatctgtaatgaaggaggttcaagaggctgtgctttccaagtgatagtctataggagtgtttaatttcttgcagctccatctggttgctgcatttgaagcatggcattaatttgtatttgccctgttctttgacctaaagttgaagggtttagagtttttaacctgatctgtagagcagagaggttgaaagcacttaactcttgtttagtatcctcattgccttgctgcctgggtatctggcccctttccataaacatttcttttcagttcatgtagttctttaatagaaagctgctattatgtatattgtcatttgtgaaggaagttggagagtcacagctttactgtgacaggttttgcccaaggctttgatacctgtcacccagggtatcttaaaagcaagttgttctcccactactttcctttccctctgccctgccattcctattacaatgctgtgaaaaaagttctgcttcttaggtgaatgggtactttctattttgtttctaaacgagcaattttgaggatgaaatgggaagatatcattgcttcctttttgcacctattgggtatgtacactctggccgaagggagtccttatgtttagtttcaaaatatattactttcctggattctcttcttcactttttctgactttgggtccattttcttttcattgcctccttttccaggcagctctattcttgcagagccatagcaggacatgttaaaattccaatagaaaacactaaaaggaaagtctgtggaatcactagtgactaaatactgggaacctattttctcaatcttcctccatgttgtgttctttgtattcttgagatgataatatattatgtatttgaattcctgaaaaatggaaaatgtttaagatatatgtatataaagtgtatgctgtattggtgcaataatggtaattaaaaatatgaaaaaagtg

SEQ ID NO: 300093 - DNA, 2602 bp, Homo sapiens
acacacacacacacacacacacacacacacacacacacctttccagttccccatgcacatttatgggtaatcgtgttgcttgccactctggattatctgatttattttttgtactgttgtcaatttcgtcaccaactgtcatcatccaccattcggtttttccttcagcagttttaccagtgagcaaagggcctctgactggaaattagaccagcctgattggactggtcgcctccgaatcacttcaaaagggaagactgcctatatcaaactcgaggataaagtttcaggggagctctttgctcaggcaccagtagaacaatatcctggtattgctgtggagacggtgacagattctagccgctactttgtaatccggatccaggatggtactgggcgcagtgctttcattggcattggcttcacagatcggggagatgccttcgactttaatgtctccttgcaggatcacttcaagtgggtaaagcaggaatctgagatttccaaggaatctcaagaaatggatgctcgtcctaagttggatctgggcttcaaggaaggacaaaccatcaagttgtgtatcgggaacattacaaacaagaaaggaggtgcttctaagcccaggactgcaaggggtgggggtctgagcttactcccacccccgccaggaggcaaagtcactattcccccaccatcctcctcagttgccatcagcaatcatgtcaccccaccacccattccgaaatctaaccatggaggcagtgatgcagatatccttttagatttggattctcctgctcctgtcacgacaccagcaccaactccagtttctgtaagcaatgacttgtggggagacttcagcactgcctccagctctgttccaaaccaggcaccacagccatccaactgggtccagttctgaatggcattggcaggacattaaggacagacttgaggaataaaaatgaccttgagggcaccaatctgtgagggaagttaggaacccatttcctccccagaaccagaatgactggacaatctttttcatagcttctccatcacattcaagctggtttatgtcactcccctgtgttgttacttgtacagccaagaaagtatctgttatctcctgcgtagtaccaaggtaggggactagtggatcttatcatagttttggctgactatgcagggcttaaaaggccagcgtctgtttgagggggaatgacctctaacatctgtaaaatttgtctcatcttttaatttctttaacttatttcaaaatcatctcatgacccttgtgtgcctctttgtgaagccctatttagcaatttcaggggagtcaaaaaccttgcaacttccttctccactaacccaggactaaaaatggacaggctgacctcagtgtttacaaattcagaattttgataggggtagatatggagaaagacctatttcctgggtctctgctgtgtagtctccttcaggcttattgtgctcagtgaacatccagtgctgggtgcagctccatcaccctcttgtgtgtttacatgtctctttctatgataagagggttgtgttggtggcacctccactactcttttctgtttgttgagtttgaattgtgtaacatctttgatcagtgggtgtatctgtaatgaaggaggttcaagaggctgtgctttccaagtgatagtctataggagtgtttaatttcttgcagctccatctggttgctgcatttgaagcatggcattaatttgtatttgccctgttctttgacctaaagttgaagggtttagagtttttaacctgatctgtagagcagagaggttgaaagcacttaactcttgtttagtatcctcattgccttgctgcctgggtatctggcccctttccataaacatttcttttcagttcatgtagttctttaatagaaagctgctattatgtatattgtcatttgtgaaggaagttggagagtcacagctttactgtgacaggttttgcccaaggctttgatacctgtcacccagggtatcttaaaagcaagttgttctcccactactttcctttccctctgccctgccattcctattacaatgctgtgaaaaaagttctgcttcttaggtgaatgggtactttctattttgtttctaaacgagcaattttgaggatgaaatgggaagatatcattgcttcctttttgcacctattgggtatgtacactctggccgaagggagtccttatgtttagtttcaaaatatattactttcctggattctcttcttcactttttctgactttgggtccattttcttttcattgcctccttttccaggcagctctattcttgcagagccatagcaggacatgttaaaattccaatagaaaacactaaaaggaaagtctgtggaatcactagtgactaaatactgggaacctattttctcaatcttcctccatgttgtgttctttgtattcttgagatgataatatattatgtatttgaattcctgaaaaatggaaaatgtttaagatatatgtatataaagtgtatgctgtattggtgcaataatggtaattaaaaatatgaaaaaagtg

SEQ ID NO: 300094 - DNA, 2508 bp, Homo sapiens
agcggggtcttacgtttcgcccccggcagcgccgacagcggacccaagatggcgaccgagttggagtacgagtctgtgctgtgtgtgaagccagacgtcagcgtctaccggattccgccccgggcctccaaccgcggttacagggcctctgactggaaattagaccagcctgattggactggtcgcctccgaatcagggagctctttgctcaggcaccagtagaacaatatcctggtattgctgtggagacggtgacagattctagccgctactttgtaatccggatccaggatggtactgggcgcagtgctttcattggcattggcttcacagatcggggagatgccttcgactttaatgtctccttgcaggatcacttcaagtgggtaaagcaggaatctgagatttccaaggaatctcaagaaatggatgctcgtcctaagttggatctgggcttcaaggaaggacaaaccatcaagttgtgtatcgggaacattacaaacaagaaaggaggtgcttctaagcccaggactgcaaggggtgggggtctgagcttactcccacccccgccaggaggcaaagtcactattcccccaccatcctcctcagttgccatcagcaatcatgtcaccccaccacccattccgaaatctaaccatggaggcagtgatgcagatatccttttagatttggattctcctgctcctgtcacgacaccagcaccaactccagtttctgtaagcaatgacttgtggggagacttcagcactgcctccagctctgttccaaaccaggcaccacagccatccaactgggtccagttctgaatggcattggcaggacattaaggacagacttgaggaataaaaatgaccttgagggcaccaatctgtgagggaagttaggaacccatttcctccccagaaccagaatgactggacaatctttttcatagcttctccatcacattcaagctggtttatgtcactcccctgtgttgttacttgtacagccaagaaagtatctgttatctcctgcgtagtaccaaggtaggggactagtggatcttatcatagttttggctgactatgcagggcttaaaaggccagcgtctgtttgagggggaatgacctctaacatctgtaaaatttgtctcatcttttaatttctttaacttatttcaaaatcatctcatgacccttgtgtgcctctttgtgaagccctatttagcaatttcaggggagtcaaaaaccttgcaacttccttctccactaacccaggactaaaaatggacaggctgacctcagtgtttacaaattcagaattttgataggggtagatatggagaaagacctatttcctgggtctctgctgtgtagtctccttcaggcttattgtgctcagtgaacatccagtgctgggtgcagctccatcaccctcttgtgtgtttacatgtctctttctatgataagagggttgtgttggtggcacctccactactcttttctgtttgttgagtttgaattgtgtaacatctttgatcagtgggtgtatctgtaatgaaggaggttcaagaggctgtgctttccaagtgatagtctataggagtgtttaatttcttgcagctccatctggttgctgcatttgaagcatggcattaatttgtatttgccctgttctttgacctaaagttgaagggtttagagtttttaacctgatctgtagagcagagaggttgaaagcacttaactcttgtttagtatcctcattgccttgctgcctgggtatctggcccctttccataaacatttcttttcagttcatgtagttctttaatagaaagctgctattatgtatattgtcatttgtgaaggaagttggagagtcacagctttactgtgacaggttttgcccaaggctttgatacctgtcacccagggtatcttaaaagcaagttgttctcccactactttcctttccctctgccctgccattcctattacaatgctgtgaaaaaagttctgcttcttaggtgaatgggtactttctattttgtttctaaacgagcaattttgaggatgaaatgggaagatatcattgcttcctttttgcacctattgggtatgtacactctggccgaagggagtccttatgtttagtttcaaaatatattactttcctggattctcttcttcactttttctgactttgggtccattttcttttcattgcctccttttccaggcagctctattcttgcagagccatagcaggacatgttaaaattccaatagaaaacactaaaaggaaagtctgtggaatcactagtgactaaatactgggaacctattttctcaatcttcctccatgttgtgttctttgtattcttgagatgataatatattatgtatttgaattcctgaaaaatggaaaatgtttaagatatatgtatataaagtgtatgctgtattggtgcaataatggtaattaaaaatatgaaaaaagtg

SEQ ID NO: 300095 - DNA, 975 bp, Homo sapiens
agcggggtcttacgtttcgcccccggcagcgccgacagcggacccaagatggcgaccgagttggagtacgagtctgtgctgtgtgtgaagccagacgtcagcgtctaccggattccgccccgggcctccaaccgcggttacagggcctctgactggaaattagaccagcctgattggactggtcgcctccgaatcacttcaaaagggaagactgcctatatcaaactcgaggataaagtttcaggggagctctttgctcaggcaccagtagaacaatatcctggtattgctgtggagacggtgacagattctagccgctactttgtaatccggatccaggatggtactgggcgcagtgctttcattggcattggcttcacagatcggggagatgccttcgactttaatgtctccttgcaggatcacttcaagtgggtaaagcaggaatctgagatttccaaggaatctcaagaaatggatgctcgtcctaagttggatctgggcttcaaggaaggacaaaccatcaagttgtgtatcgggaacattacaaacaagaaaggaggtgcttctaagcccaggactgcaaggggtgggggtctgagcttactcccacccccgccaggaggcaaagtcactattcccccaccatcctcctcagttgccatcagcaatcatgtcaccccaccacccattccgaaatctaaccatggaggcagtgatgcagatatccttttagatttggattctcctgctcctgtcacgacaccagcaccaactccagtttctgtaagcaatgacttgtggggagacttcagcactgcctccaggtaatgggcatagtgaaactagcatactctcaatcagggtgtaggagatatgtacagtcaattgaaatctttgatctggagaagcaatggatatgcaggtcacatagagtcttttggaagagttctagtgaaggaaatatagtagtgc

SEQ ID NO: 300096 - DNA, 827 bp, Homo sapiens
agcggggtcttacgtttcgcccccggcagcgccgacagcggacccaagatggcgaccgagttggagtacgagtctgtgctgtgtgtgaagccagacgtcagcgtctaccggattccgccccgggcctccaaccgcggttacagggcctctgactggaaattagaccagcctgattggactggtcgcctccgaatcacttcaaaagggaagactgcctatatcaaactcgaggataaagtttcaggggagctctttgctcaggcaccagtagaacaatatcctggtattgctgtggagacggtgacagattctagccgctactttgtaatccggatccaggatggtactgggcgcagtgctttcattggcattggcttcacagatcggggagatgccttcgactttaatgtctccttgcaggatcacttcaactcacttcaagtgagtgaagcttgtccttagttacgaggctgaatgcttataggaatgctgcttctcacatgaatgggcagtatctcttttcctcctggtttctttgtttcttaaactatttcattgtgaatataaatctccccattcacttttgtttccttaggtcatctttgtatctattctgtttcctttccttatagcctgcaatatatttcagatcccttgtgcagtagtttgaaatgatgctctgtcgaatttgccccgtcttttaggtggtagagggaggcctatggtaacagcagggctttatgtggggagtcgtgtgccactcttgttacctatgtagctgacatgttttgtgacttttgcaacatttctttagcccacttgatttt

SEQ ID NO: 300097 - DNA, 840 bp, Homo sapiens
  misc_feature (8)..(8): n is a, c, g, or t
  misc_feature (15)..(15): n is a, c, g, or t
  misc_feature (17)..(17): n is a, c, g, or t
  misc_feature (45)..(45): n is a, c, g, or t
tcatagangatcccncntaaatggctgtcccaaatgctgactccnaagctctggacttattggacaaaatgttgacattcaacccacacaagaggattgaagtagaacaggctctggcccacccatatctggagcagtattacgacccgagtgacgagcccatcgccgaagcaccattcaagttcgacatggaattggatgacttgcctaaggaaaagctcaaagaactaatttttgaagagactgctagattccagccaggatacagatcttaaatttgtcaggacaagggctcagaggactggacgtgctcagacatcggtgttcttcttcccagttcttgacccctggtcctgtctccagcccgtcttggcttatccactttgactcctttgagccgtttggaggggcggtttctggtagttgtggcttttatgctttcaaagaatttcttcagtccagagaattcctcctggcagccctgtgtgtgtcacccattggtgacctgcggcagtatgtacttcagtgcacctactgcttactgttgctttagtcactaattgctttctggtttgaaagatgcagtggttcctccctctcctgaatccttttctacatgatgccctgctgaccatgcagccgcaccagagagagattcttccccaattggctctagtcactggcatctcactttatgatagggaaggctactacctagggcactttaagtcagtgacagccccttatttgcacttcaccttttgatagggaaggctactacctagggcactttaagtcagtgacagccccttatggtcaaaaggtgaagtgcaaataagg

SEQ ID NO: 300098 - DNA, 401 bp, Homo sapiens
agtcctgttgtaaattcagaatctgagcagtggtcattttatgaatcagtaaattactgccttacccataacaactttgactgttaaatgttttgttttcttttaaagcccatcgccgaagcaccattcaagttcgacatggaattggatgacttgcctaaggaaaagctcaaagaactaatttttgaagagactgctagattccagccaggatacagatcttaaatttgtcaggtacctggagtttaatacagtgagctctagcaagggaggcgctgccttttgtttctagaatattatgttcctcaaggtccattattttgtattcttttccaagctccttattggaaggtatttttttaaatttagaattaaaaattatttagaaagttaaatataaa

SEQ ID NO: 300099 - DNA, 11161 bp, Homo sapiens
  misc_feature (6213)..(6213): n is a, c, g, or t
  misc_feature (7151)..(7151): n is a, c, g, or t
  misc_feature (7426)..(7426): n is a, c, g, or t
  misc_feature (10119)..(10119): n is a, c, g, or t
  misc_feature (10357)..(10357): n is a, c, g, or t
  misc_feature (10572)..(10572): n is a, c, g, or t
acataatttctggagccctgtaccaacgtgtggccacatattctgtcaggaaccctgtgtgatcatggtctggatctgcaacacgggccaggccaaagtcacagatcttgagatcacaggtggtgttgagcagcaggcaggcaggcaatcggtccgagtggctgtcggctcttcagctctcccgctcggcgtcttccttcctcctcccggtcagcgtcggcggctgcaccggcggcggcgcagtccctgcgggaggggcgacaagagctgagcggcggccgccgagcgtcgagctcagcgcggcggaggcggcggcggcccggcagccaacatggcggcggcggcggcggcgggcgcgggcccggagatggtccgcgggcaggtgttcgacgtggggccgcgctacaccaacctctcgtacatcggcgagggcgcctacggcatggtgtgctctgcttatgataatgtcaacaaagttcgagtagctatcaagaaaatcagcccctttgagcaccagacctactgccagagaaccctgagggagataaaaatcttactgcgcttcagacatgagaacatcattggaatcaatgacattattcgagcaccaaccatcgagcaaatgaaagatgtatatatagtacaggacctcatggaaacagatctttacaagctcttgaagacacaacacctcagcaatgaccatatctgctattttctctaccagatcctcagagggttaaaatatatccattcagctaacgttctgcaccgtgacctcaagccttccaacctgctgctcaacaccacctgtgatctcaagatctgtgactttggcctggcccgtgttgcagatccagaccatgatcacacagggttcctgacagaatatgtggccacacgttggtacagggctccagaaattatgttgaattccaagggctacaccaagtccattgatatttggtctgtaggctgcattctggcagaaatgctttctaacaggcccatctttccagggaagcattatcttgaccagctgaaccacattttgggtattcttggatccccatcacaagaagacctgaattgtataataaatttaaaagctaggaactatttgctttctcttccacacaaaaataaggtgccatggaacaggctgttcccaaatgctgactccaaagctctggacttattggacaaaatgttgacattcaacccacacaagaggattgaagtagaacaggctctggcccacccatatctggagcagtattacgacccgagtgacgagcccatcgccgaagcaccattcaagttcgacatggaattggatgacttgcctaaggaaaagctcaaagaactaatttttgaagagactgctagattccagccaggatacagatcttaaatttgtcaggacaagggctcagaggactggacgtgctcagacatcggtgttcttcttcccagttcttgacccctggtcctgtctccagcccgtcttggcttatccactttgactcctttgagccgtttggaggggcggtttctggtagttgtggcttttatgctttcaaagaatttcttcagtccagagaattcctcctggcagccctgtgtgtgtcacccattggtgacctgcggcagtatgtacttcagtgcacctactgcttactgttgctttagtcactaattgctttctggtttgaaagatgcagtggttcctccctctcctgaatccttttctacatgatgccctgctgaccatgcagccgcaccagagagagattcttccccaattggctctagtcactggcatctcactttatgatagggaaggctactacctagggcactttaagtcagtgacagccccttatttgcacttcaccttttgaccataactgtttccccagagcaggagcttgtggaaataccttggctgatgttgcagcctgcagcaagtgcttccgtctccggaatccttggggagcacttgtccacgtcttttctcatatcatggtagtcactaacatatataaggtatgtgctattggcccagcttttagaaaatgcagtcatttttctaaataaaaaggaagtactgcacccagcagtgtcactctgtagttactgtggtcacttgtaccatatagaggtgtaacacttgtcaagaagcgttatgtgcagtacttaatgtttgtaagacttacaaaaaaagatttaaagtggcagcttcactcgacatttggtgagagaagtacaaaggttgcagtgctgagctgtgggcggtttctggggatgtcccagggtggaactccacatgctggtgcatatacgcccttgagctacttcaaatgtgggtgtttcagtaaccacgttccatgcctgaggatttagcagagaggaacactgcgtctttaaatgagaaagtatacaattctttttccttctacagcatgtcagcatctcaagttcatttttcaacctacagtataacaatttgtaataaagcctccaggagctcatgacgtgaagcactgttctgtcctcaagtactcaaatatttctgatactgctgagtcagactgtcagaaaaagctagcactaactcgtgtttggagctctatccatattttactgatctctttaagtatttgttcctgccactgtgtactgtggagttgactcggtgttctgtcccagtgcggtgcctcctcttgacttccccactgctctctgtggtgagaaatttgccttgttcaataattactgtaccctcgcatgactgttacagctttctgtgcagagatgactgtccaagtgccacatgcctacgattgaaatgaaaactctattgttacctctgagttgtgttccacggaaaatgctatccagcagatcatttaggaaaaataattctatttttagcttttcatttctcagctgtccttttttcttgtttgatttttgacagcaatggagaatgggttatataaagactgcctgctaatatgaacagaaatgcatttgtaattcatgaaaataaatgtacatcttctatcttcacattcatgttaagattcagtgttgctttcctctggatcagcgtgtctgaatggacagtcaggttcaggttgtgctgaacacagaaatgctcacaggcctcactttgccgcccaggcactggcccagcacttggatttacataagatgagttagaaaggtacttctgtagggtcctttttacctctgctcggcagagaatcgatgctgtcatgttcctttattcacaatcttaggtctcaaatattctgtcaaaccctaacaaagaagccccgacatctcaggttggattccctggttctctctaaagagggcctgcccttgtgccccagaggtgctgctgggcacagccaagagttgggaagggccgccccacagtacgcagtcctcaccacccagcccagggtgctcacgctcaccactcctgtggctgaggaaggatagctggctcatcctcggaaaacagacccacatctctattcttgccctgaaatacgcgcttttcacttgcgtgctcagagctgccgtctgaaggtccacacagcattgacgggacacagaaatgtgactgttaccggataacactgattagtcagttttcatttataaaaaagcattgacagttttattactcttgtttctttttaaatggaaagttactattataaggttaatttgcagtcctcttctaaatagaaaaccatatccttggctactaacatctggagactgtgagctccttcccattccccttcctggtactgtggagtcagattggcatgaaaccactaacttcattctagaatcattgtagccataagttgtgtgctttttattaatcatgccaaacataatgtaactgggcagagaatggtcctaaccaaggtacctatgaaaagcgctagctatcatgtgtagtagatgcatcattttggctcttcttacatttgtaaaaatgtacagattaggtcatcttaattcatattagtgacacggaacagcacctccactatttgtatgttcaaataagctttcagactaatagcttttttggtgtctaaaatgtaagcaaaaaattcctgctgaaacattccagtcctttcatttagtataaaagaaatactgaacaagccagtgggatggaattgaaagaactaatcatgaggactctgtcctgacacaggtcctcaaagctagcagagatacgcagacattgtggcatctgggtagaagaatactgtattgtgtgtgcagtgcacagtgtgtggtgtgtgcacactcattccttctgctcttgggcacaggcagtgggtgtagaggtaaccagtagctttgagaagctacatgtagctcaccagtggttttctctaaggaatcacaaaggtaaactacccaaccacatgccacgtaatatttcagccattcagaggaaactgttttctctttatttgcttatatgttaatatggtttttaaattggtaacttttatatagtatggtaacagtatgttaatacacacatacatatgcacacatgctttgggtccttccataatacttttatatttgtaaatcaatgttttggagcaatcccaagtttaagggaaatatttttgtaaatgtaatggttttgaaaatctgagcaatccttttgcttatacatttttaaagcatttgtgctttaaaattgttatgctggtgtttgaaacatgatactcctgtggtgcagatgagaagctataacagtgaatatgtggtttctcttacgtcatccaccttgacatgatgggtcagaaacaaatggaaatccagagcaagtcctccagggttgcaccaggtttacctaaagcttgttgccttttcttgtgctgtttatccgtgtagagcactcaagaaagttctgaaactgctttgtatctgctttgtactgttggtgccttcttggtattgtaccccaaaattctgcatagattatttagtataatggtaagttaaaaaatgttaaaggaagattttattaagaatctgaatgtttattcattatattgttacaatttaacattaacatttatttgtggtatttgtgatttggttaatctgtataaaaattgtaagtagaaaggtttatatttcatcttaattcttttgatgttgtaaacgtactttttaaaagatggattatttgaatgtttatggcacctgacttgtaaaaaaaaaaaactacaaaaaaatccttagaatcattaaattgtgtccctgtattaccaaaataacacagcaccgtgcatgtatagtttaattgcagtttcatctgtgaaaacgtgaaattgtctagtccttcgttatgttccccagatgtcttccagatttgctctgcatgtggtaacttgtgttagggctgtgagctgttcctcgagttgaatggggatgtcagtgctcctagggttctccaggtggttcttcagaccttcacctgtgggggggggggtaggcggtgcccacgcccatctcctcatcctcctgaacttctgcaaccccactgctgggcagacatcctgggcaaccccttttttcagagcaagaagtcataaagataggatttcttggacatttggttcttatcaatattgggcattatgtaatgacttatttacaaaacaaagatactggaaaatgttttggatgtggtgttatggaaagagcacaggccttggacccatccagctgggttcagaactaccccctgcttataactgcggctggctgtgggccagtcattctgcgtctctgctttcttcctctgcttcagactgtcagctgtaaagtggaagcaatattacttgccttgtatatggtaaagattataaaaatacatttcaactgttcagcatagtacttcaaagcaagtactcagtaaatagcaagtctttttaaatgctgctttatttcactaaattttgttgtgaggtgtcactaaaatgcctgcaaacaaacgtaactgctaatctgagaggaaaccctcttactaatcagagaagaaaccctcctgtcagaaaccttcagggaagtgagctgatcacacctaaactgggagtttgcaatggggtatttgaagcactgtgggagtattccactggcccnctccctgagagacttaacagtcttccctgttgtccagattctgtataaggcaatcagaataatcatcttccttgttcagcagaggagcctggtcccattttccccactttgtgatgggcttctctcagcggtagctcagcagttccagatggcagtttggaccagcatctaggctggccagttcgctgtgtttacttagaaccaacacgttcagagctggcctggaccatctgaggggaacaggaaacacccctaggctgtggaagcaagtgcagacccccacccccggccctgaagccaagggggcagggtttgggagtggccaaagagaagcagtgcagggatgggttttcctagggacaggcttagcattcctgactctaggaagaaggagcagtgaggcggagaaacagtggaggggatggtggcattgggccccatggggccgagatggacacagggctcgttctcttgagtctggtgccaaggacagctgaagacgacatcattttcaggtggagaggagagagtggagggagatcatgccctgtgatgtgtcttttgcaggtgaaggtgggagacaaggtctctgctgacgatgaggcagagccaccgtgaaagttgtaataggaggactgcccgccgctggaagggcctgcagtgacgctaggacaccctctgcctgcatgtcacgttagctgggctgggcgaagtagaagaccaaggggaagaggtgcagtggggagaccaggtgggatgcaaccacaggaccagtggaggggctgtggcacgtgggcggagactgagtggctgggcatgtgttgtggctgagcatgtggtgtgggcagtggtcctagaccccgccatgtccggacaatgatatagagcgtctcagcatcgccagtctagactgtctatggagagcagaaagttgtctngggctgcctggggaactgtgaggccagctatatcaccgtcgctgatggtgacattacggtggtggcaggagcaaggagagagggaagaaggaccccgtccagctttagtcacaaaatacccaatggaagatgccagtgccaatcctgtgggtttccttgggacttcacactggctttcttatctgctccagatccattcagtagtcactgagttcctgccaaatactttgtagcgccagaagccaggagcggggtctgcagcagggcagtccccnttttcaggaaatgcctggagctgctggtccctgagagaaaggaaaacatctttcagccgtacgcaggccaagaaggccaatgtccagtagctttgtgattttttttatatttttttatttatttatttttgagatagagtcttgctctgtcgctcaggctggagtgcagtggcgtgatctccactcactgcaacttccgcctcctggggtcaagcagttctgcctcagcctcccgagtagctgggattacaggcacacgccaccacacccagctaatttttgtgtttttagtagagacggtttcaccatgtcggccaggctggtctcaaactcctgacctcagatgattcagcctcccaaagtgctgggattacaggtgtgagccactgcacccagcctgtgatgtttctgtggggttccacaaatgtgtgtgtgtgtaaaagctgatgattacagcaagaatgtgaacagtagcagttttccatttgaaggcaagttttgtctttatctgggtatcagaaggaccctctgggccattgtcgcttcctgtactcagagccaccctagtactacgggcacacacagaaaacagcagcctgcgtactttcaaaggaaaggcatctttaatcaccaatgcctggaaaaattattttgtttccctcttccttccgtcttgtttcctaacttcttaccaaagtttagagtctgagtttttcgtataataatgtcccacatccacacatcgggcctacagatgctctcccttgaatcgactggaaacatgacaccggttccatgctctggaactgtcacctgtgatgtgctgggctgtgtcccaagcacaggaatcccagcagtttcagctcgatgcagaaccaccatgctccagacacaggcttgggaaagacacgtcaaaattaaaatactaggtaagagaagcacctgattgggtagaagttggagaggaatcctggaattttgtggccagaaggagccactgccccttttgtttagtaagactagacagtaacagaagccagttgtcagctatgaaagtggtgggtgaagcaggggaggctcctctatggtgggaccctggacaagggaagccgaatgtgtgaagaaggggtgcgggggtgtgcggtgccctaggacactagggcaaaggtttcaaacctggaacaaggcactggaggaagatctgctgccagtcagcagtgcgggccctcgagttagcagtccgtgcgcagaggggccagttctgagaccagtttggagagtcaggcagtgacccattggccatgtcataattccttcagcctgcctcctctttaatcccagagagtgctctttcttcatacttcctttaaaatactaaattgttcccattccatggggagctggctaggctttacaggctaggaaatgtaggttttctgagatggaaccatctacacaaggaggaggaaggcactaagactacagatgagacccatgacagggctgagcatttggaagccaaccctggttgcttttcaagaattgctttgtggctgggtgcagtggttcacacctgtaattgcagcactttgggaggctgaggcaggtggattgcttgaacccaggagttcgagaccagcctgggcaacatatgggacaccccaccgcccccggctctgcaaaaaaattaaaaattagccaggcgtggtgtcatgagcctgtggtctcaactactcaggaggctgaggctggaggatcgcttgaacctgggaggtcaaggctccagtgaaccataattgtgccactgcactgcagcctgggcgacaatttgttttctaaattgcttttgaaagtctactgcattacatattccaaaaagcagtggttttcaaatacttttatcaccgatatccttttatgaaatgaaatcagtagaactttctctgctctgaataagcaagggtgggaacctgtctacctcccacagatagcataatgtgcctgccatagaggagccaaaaaatggtgatgggaactgagaggagagcaaatgtcacaaaagactgagcaattgagaaaacaaaacaagaccacagatgactgttaacgcctccacagtggaccaagaaaggacagagagctggcagcatgggcatcactgtctggtcggcagcaggaaggcctcgctagggaattgagtacagtcatctaactagtttaaaagtacaggaaggatgattaaggctattggagaggtcatacaaataggggaggggcaggcaatggctgataagacatgaatttgtaaggcgatgagtattgcagtcagcaaaacaaacgagactgctctcccaacacataactcagcagggaggccaggcattggtttaaccatttaatataaagaagttaaaattacaaatgcgctaagtgcctaaagaagaataagtgcaggaatgagagcagcatggactgccacagttttagaataagcactgtcactgctagattggaaacaaaaatccataaatttggcccggtgtggtggcggacgcctgtagtcccagctacttggaggctgaggcgtgagaatcgcttgaacccgggaggcggaggttgcagtgagccgagatggcgccactgcactccagcctgggcgtcagagtgagaactctgtatcaaaaaataaaaanaaaaaaaagtccataaatctgcaatgtctcagttaagaaagaaagactgggccaatgcagatttcaaaccggagaaagtcatactgtcagtgaaggccgcctgtggccggaaggcgccaggggattagcaccctggactcagtgttgctgggaaacagggccccaaggctgggagcacagtgtttaaagggcatctacccaagaagggagcacagggcaaggaggagctgcagggggncttggctgccaaagtgaattctgaggagagagctattgctgcctacgatatgcaggctgcacagaacacaagtggaatcagcaggcaggagaggcagctaacgacgcagcccgtttcttatttctgttttctcacaagcgatgaaagtggaaaagagggtgagcaggtggcccacacatgtgcctccagtgctgcggcccctccggggaccatcngccaggccccggggagggagccagccacagtgtgtccggctcttctctgaagggaagagagccttgaatagactgaagcgaagacggttctgcaaggacaaggcagaccgaaggcattggttttttttttcagataaggagaattagactcccaagtagacaccagagtcactgtttggttggtgggtgatagtggggtcacagtggctgcctgtgctcccccagggtgagcgtgactgtgctaacctgggtggggcagcatgcacacccctctggcagccctttgttgctcgctgatgacaagtttggatgatcccgccaaacagcttgctaagatgtagtccccagtgttggaggtggggcctgatgggaggtgctacccttgtgagataaggttgtgtaaaagcctgtggcacctccccacactgacgctctcacccctgctctggccatgtgccgcgcctgctcccacttccccttctgccaggagtaaaagcccccgagacctcccagaagccaagcagatgctagtgccatgcttcctctgcagcctgcagaactgtgagccaattaaacctcttttctctat

SEQ ID NO: 300100 - DNA, 11072 bp, Homo sapiens
  misc_feature (6124)..(6124): n is a, c, g, or t
  misc_feature (7062)..(7062): n is a, c, g, or t
  misc_feature (7337)..(7337): n is a, c, g, or t
  misc_feature (10030)..(10030): n is a, c, g, or t
  misc_feature (10268)..(10268): n is a, c, g, or t
  misc_feature (10483)..(10483): n is a, c, g, or t
gcgcccctccctccgcccgcccgccggcccgcccgtcagtctggcaggcaggcaggcaatcggtccgagtggctgtcggctcttcagctctcccgctcggcgtcttccttcctcctcccggtcagcgtcggcggctgcaccggcggcggcgcagtccctgcgggaggggcgacaagagctgagcggcggccgccgagcgtcgagctcagcgcggcggaggcggcggcggcccggcagccaacatggcggcggcggcggcggcgggcgcgggcccggagatggtccgcgggcaggtgttcgacgtggggccgcgctacaccaacctctcgtacatcggcgagggcgcctacggcatggtgtgctctgcttatgataatgtcaacaaagttcgagtagctatcaagaaaatcagcccctttgagcaccagacctactgccagagaaccctgagggagataaaaatcttactgcgcttcagacatgagaacatcattggaatcaatgacattattcgagcaccaaccatcgagcaaatgaaagatgtatatatagtacaggacctcatggaaacagatctttacaagctcttgaagacacaacacctcagcaatgaccatatctgctattttctctaccagatcctcagagggttaaaatatatccattcagctaacgttctgcaccgtgacctcaagccttccaacctgctgctcaacaccacctgtgatctcaagatctgtgactttggcctggcccgtgttgcagatccagaccatgatcacacagggttcctgacagaatatgtggccacacgttggtacagggctccagaaattatgttgaattccaagggctacaccaagtccattgatatttggtctgtaggctgcattctggcagaaatgctttctaacaggcccatctttccagggaagcattatcttgaccagctgaaccacattttgggtattcttggatccccatcacaagaagacctgaattgtataataaatttaaaagctaggaactatttgctttctcttccacacaaaaataaggtgccatggaacaggctgttcccaaatgctgactccaaagctctggacttattggacaaaatgttgacattcaacccacacaagaggattgaagtagaacaggctctggcccacccatatctggagcagtattacgacccgagtgacgagcccatcgccgaagcaccattcaagttcgacatggaattggatgacttgcctaaggaaaagctcaaagaactaatttttgaagagactgctagattccagccaggatacagatcttaaatttgtcaggacaagggctcagaggactggacgtgctcagacatcggtgttcttcttcccagttcttgacccctggtcctgtctccagcccgtcttggcttatccactttgactcctttgagccgtttggaggggcggtttctggtagttgtggcttttatgctttcaaagaatttcttcagtccagagaattcctcctggcagccctgtgtgtgtcacccattggtgacctgcggcagtatgtacttcagtgcacctactgcttactgttgctttagtcactaattgctttctggtttgaaagatgcagtggttcctccctctcctgaatccttttctacatgatgccctgctgaccatgcagccgcaccagagagagattcttccccaattggctctagtcactggcatctcactttatgatagggaaggctactacctagggcactttaagtcagtgacagccccttatttgcacttcaccttttgaccataactgtttccccagagcaggagcttgtggaaataccttggctgatgttgcagcctgcagcaagtgcttccgtctccggaatccttggggagcacttgtccacgtcttttctcatatcatggtagtcactaacatatataaggtatgtgctattggcccagcttttagaaaatgcagtcatttttctaaataaaaaggaagtactgcacccagcagtgtcactctgtagttactgtggtcacttgtaccatatagaggtgtaacacttgtcaagaagcgttatgtgcagtacttaatgtttgtaagacttacaaaaaaagatttaaagtggcagcttcactcgacatttggtgagagaagtacaaaggttgcagtgctgagctgtgggcggtttctggggatgtcccagggtggaactccacatgctggtgcatatacgcccttgagctacttcaaatgtgggtgtttcagtaaccacgttccatgcctgaggatttagcagagaggaacactgcgtctttaaatgagaaagtatacaattctttttccttctacagcatgtcagcatctcaagttcatttttcaacctacagtataacaatttgtaataaagcctccaggagctcatgacgtgaagcactgttctgtcctcaagtactcaaatatttctgatactgctgagtcagactgtcagaaaaagctagcactaactcgtgtttggagctctatccatattttactgatctctttaagtatttgttcctgccactgtgtactgtggagttgactcggtgttctgtcccagtgcggtgcctcctcttgacttccccactgctctctgtggtgagaaatttgccttgttcaataattactgtaccctcgcatgactgttacagctttctgtgcagagatgactgtccaagtgccacatgcctacgattgaaatgaaaactctattgttacctctgagttgtgttccacggaaaatgctatccagcagatcatttaggaaaaataattctatttttagcttttcatttctcagctgtccttttttcttgtttgatttttgacagcaatggagaatgggttatataaagactgcctgctaatatgaacagaaatgcatttgtaattcatgaaaataaatgtacatcttctatcttcacattcatgttaagattcagtgttgctttcctctggatcagcgtgtctgaatggacagtcaggttcaggttgtgctgaacacagaaatgctcacaggcctcactttgccgcccaggcactggcccagcacttggatttacataagatgagttagaaaggtacttctgtagggtcctttttacctctgctcggcagagaatcgatgctgtcatgttcctttattcacaatcttaggtctcaaatattctgtcaaaccctaacaaagaagccccgacatctcaggttggattccctggttctctctaaagagggcctgcccttgtgccccagaggtgctgctgggcacagccaagagttgggaagggccgccccacagtacgcagtcctcaccacccagcccagggtgctcacgctcaccactcctgtggctgaggaaggatagctggctcatcctcggaaaacagacccacatctctattcttgccctgaaatacgcgcttttcacttgcgtgctcagagctgccgtctgaaggtccacacagcattgacgggacacagaaatgtgactgttaccggataacactgattagtcagttttcatttataaaaaagcattgacagttttattactcttgtttctttttaaatggaaagttactattataaggttaatttgcagtcctcttctaaatagaaaaccatatccttggctactaacatctggagactgtgagctccttcccattccccttcctggtactgtggagtcagattggcatgaaaccactaacttcattctagaatcattgtagccataagttgtgtgctttttattaatcatgccaaacataatgtaactgggcagagaatggtcctaaccaaggtacctatgaaaagcgctagctatcatgtgtagtagatgcatcattttggctcttcttacatttgtaaaaatgtacagattaggtcatcttaattcatattagtgacacggaacagcacctccactatttgtatgttcaaataagctttcagactaatagcttttttggtgtctaaaatgtaagcaaaaaattcctgctgaaacattccagtcctttcatttagtataaaagaaatactgaacaagccagtgggatggaattgaaagaactaatcatgaggactctgtcctgacacaggtcctcaaagctagcagagatacgcagacattgtggcatctgggtagaagaatactgtattgtgtgtgcagtgcacagtgtgtggtgtgtgcacactcattccttctgctcttgggcacaggcagtgggtgtagaggtaaccagtagctttgagaagctacatgtagctcaccagtggttttctctaaggaatcacaaaggtaaactacccaaccacatgccacgtaatatttcagccattcagaggaaactgttttctctttatttgcttatatgttaatatggtttttaaattggtaacttttatatagtatggtaacagtatgttaatacacacatacatatgcacacatgctttgggtccttccataatacttttatatttgtaaatcaatgttttggagcaatcccaagtttaagggaaatatttttgtaaatgtaatggttttgaaaatctgagcaatccttttgcttatacatttttaaagcatttgtgctttaaaattgttatgctggtgtttgaaacatgatactcctgtggtgcagatgagaagctataacagtgaatatgtggtttctcttacgtcatccaccttgacatgatgggtcagaaacaaatggaaatccagagcaagtcctccagggttgcaccaggtttacctaaagcttgttgccttttcttgtgctgtttatccgtgtagagcactcaagaaagttctgaaactgctttgtatctgctttgtactgttggtgccttcttggtattgtaccccaaaattctgcatagattatttagtataatggtaagttaaaaaatgttaaaggaagattttattaagaatctgaatgtttattcattatattgttacaatttaacattaacatttatttgtggtatttgtgatttggttaatctgtataaaaattgtaagtagaaaggtttatatttcatcttaattcttttgatgttgtaaacgtactttttaaaagatggattatttgaatgtttatggcacctgacttgtaaaaaaaaaaaactacaaaaaaatccttagaatcattaaattgtgtccctgtattaccaaaataacacagcaccgtgcatgtatagtttaattgcagtttcatctgtgaaaacgtgaaattgtctagtccttcgttatgttccccagatgtcttccagatttgctctgcatgtggtaacttgtgttagggctgtgagctgttcctcgagttgaatggggatgtcagtgctcctagggttctccaggtggttcttcagaccttcacctgtgggggggggggtaggcggtgcccacgcccatctcctcatcctcctgaacttctgcaaccccactgctgggcagacatcctgggcaaccccttttttcagagcaagaagtcataaagataggatttcttggacatttggttcttatcaatattgggcattatgtaatgacttatttacaaaacaaagatactggaaaatgttttggatgtggtgttatggaaagagcacaggccttggacccatccagctgggttcagaactaccccctgcttataactgcggctggctgtgggccagtcattctgcgtctctgctttcttcctctgcttcagactgtcagctgtaaagtggaagcaatattacttgccttgtatatggtaaagattataaaaatacatttcaactgttcagcatagtacttcaaagcaagtactcagtaaatagcaagtctttttaaatgctgctttatttcactaaattttgttgtgaggtgtcactaaaatgcctgcaaacaaacgtaactgctaatctgagaggaaaccctcttactaatcagagaagaaaccctcctgtcagaaaccttcagggaagtgagctgatcacacctaaactgggagtttgcaatggggtatttgaagcactgtgggagtattccactggcccnctccctgagagacttaacagtcttccctgttgtccagattctgtataaggcaatcagaataatcatcttccttgttcagcagaggagcctggtcccattttccccactttgtgatgggcttctctcagcggtagctcagcagttccagatggcagtttggaccagcatctaggctggccagttcgctgtgtttacttagaaccaacacgttcagagctggcctggaccatctgaggggaacaggaaacacccctaggctgtggaagcaagtgcagacccccacccccggccctgaagccaagggggcagggtttgggagtggccaaagagaagcagtgcagggatgggttttcctagggacaggcttagcattcctgactctaggaagaaggagcagtgaggcggagaaacagtggaggggatggtggcattgggccccatggggccgagatggacacagggctcgttctcttgagtctggtgccaaggacagctgaagacgacatcattttcaggtggagaggagagagtggagggagatcatgccctgtgatgtgtcttttgcaggtgaaggtgggagacaaggtctctgctgacgatgaggcagagccaccgtgaaagttgtaataggaggactgcccgccgctggaagggcctgcagtgacgctaggacaccctctgcctgcatgtcacgttagctgggctgggcgaagtagaagaccaaggggaagaggtgcagtggggagaccaggtgggatgcaaccacaggaccagtggaggggctgtggcacgtgggcggagactgagtggctgggcatgtgttgtggctgagcatgtggtgtgggcagtggtcctagaccccgccatgtccggacaatgatatagagcgtctcagcatcgccagtctagactgtctatggagagcagaaagttgtctngggctgcctggggaactgtgaggccagctatatcaccgtcgctgatggtgacattacggtggtggcaggagcaaggagagagggaagaaggaccccgtccagctttagtcacaaaatacccaatggaagatgccagtgccaatcctgtgggtttccttgggacttcacactggctttcttatctgctccagatccattcagtagtcactgagttcctgccaaatactttgtagcgccagaagccaggagcggggtctgcagcagggcagtccccnttttcaggaaatgcctggagctgctggtccctgagagaaaggaaaacatctttcagccgtacgcaggccaagaaggccaatgtccagtagctttgtgattttttttatatttttttatttatttatttttgagatagagtcttgctctgtcgctcaggctggagtgcagtggcgtgatctccactcactgcaacttccgcctcctggggtcaagcagttctgcctcagcctcccgagtagctgggattacaggcacacgccaccacacccagctaatttttgtgtttttagtagagacggtttcaccatgtcggccaggctggtctcaaactcctgacctcagatgattcagcctcccaaagtgctgggattacaggtgtgagccactgcacccagcctgtgatgtttctgtggggttccacaaatgtgtgtgtgtgtaaaagctgatgattacagcaagaatgtgaacagtagcagttttccatttgaaggcaagttttgtctttatctgggtatcagaaggaccctctgggccattgtcgcttcctgtactcagagccaccctagtactacgggcacacacagaaaacagcagcctgcgtactttcaaaggaaaggcatctttaatcaccaatgcctggaaaaattattttgtttccctcttccttccgtcttgtttcctaacttcttaccaaagtttagagtctgagtttttcgtataataatgtcccacatccacacatcgggcctacagatgctctcccttgaatcgactggaaacatgacaccggttccatgctctggaactgtcacctgtgatgtgctgggctgtgtcccaagcacaggaatcccagcagtttcagctcgatgcagaaccaccatgctccagacacaggcttgggaaagacacgtcaaaattaaaatactaggtaagagaagcacctgattgggtagaagttggagaggaatcctggaattttgtggccagaaggagccactgccccttttgtttagtaagactagacagtaacagaagccagttgtcagctatgaaagtggtgggtgaagcaggggaggctcctctatggtgggaccctggacaagggaagccgaatgtgtgaagaaggggtgcgggggtgtgcggtgccctaggacactagggcaaaggtttcaaacctggaacaaggcactggaggaagatctgctgccagtcagcagtgcgggccctcgagttagcagtccgtgcgcagaggggccagttctgagaccagtttggagagtcaggcagtgacccattggccatgtcataattccttcagcctgcctcctctttaatcccagagagtgctctttcttcatacttcctttaaaatactaaattgttcccattccatggggagctggctaggctttacaggctaggaaatgtaggttttctgagatggaaccatctacacaaggaggaggaaggcactaagactacagatgagacccatgacagggctgagcatttggaagccaaccctggttgcttttcaagaattgctttgtggctgggtgcagtggttcacacctgtaattgcagcactttgggaggctgaggcaggtggattgcttgaacccaggagttcgagaccagcctgggcaacatatgggacaccccaccgcccccggctctgcaaaaaaattaaaaattagccaggcgtggtgtcatgagcctgtggtctcaactactcaggaggctgaggctggaggatcgcttgaacctgggaggtcaaggctccagtgaaccataattgtgccactgcactgcagcctgggcgacaatttgttttctaaattgcttttgaaagtctactgcattacatattccaaaaagcagtggttttcaaatacttttatcaccgatatccttttatgaaatgaaatcagtagaactttctctgctctgaataagcaagggtgggaacctgtctacctcccacagatagcataatgtgcctgccatagaggagccaaaaaatggtgatgggaactgagaggagagcaaatgtcacaaaagactgagcaattgagaaaacaaaacaagaccacagatgactgttaacgcctccacagtggaccaagaaaggacagagagctggcagcatgggcatcactgtctggtcggcagcaggaaggcctcgctagggaattgagtacagtcatctaactagtttaaaagtacaggaaggatgattaaggctattggagaggtcatacaaataggggaggggcaggcaatggctgataagacatgaatttgtaaggcgatgagtattgcagtcagcaaaacaaacgagactgctctcccaacacataactcagcagggaggccaggcattggtttaaccatttaatataaagaagttaaaattacaaatgcgctaagtgcctaaagaagaataagtgcaggaatgagagcagcatggactgccacagttttagaataagcactgtcactgctagattggaaacaaaaatccataaatttggcccggtgtggtggcggacgcctgtagtcccagctacttggaggctgaggcgtgagaatcgcttgaacccgggaggcggaggttgcagtgagccgagatggcgccactgcactccagcctgggcgtcagagtgagaactctgtatcaaaaaataaaaanaaaaaaaagtccataaatctgcaatgtctcagttaagaaagaaagactgggccaatgcagatttcaaaccggagaaagtcatactgtcagtgaaggccgcctgtggccggaaggcgccaggggattagcaccctggactcagtgttgctgggaaacagggccccaaggctgggagcacagtgtttaaagggcatctacccaagaagggagcacagggcaaggaggagctgcagggggncttggctgccaaagtgaattctgaggagagagctattgctgcctacgatatgcaggctgcacagaacacaagtggaatcagcaggcaggagaggcagctaacgacgcagcccgtttcttatttctgttttctcacaagcgatgaaagtggaaaagagggtgagcaggtggcccacacatgtgcctccagtgctgcggcccctccggggaccatcngccaggccccggggagggagccagccacagtgtgtccggctcttctctgaagggaagagagccttgaatagactgaagcgaagacggttctgcaaggacaaggcagaccgaaggcattggttttttttttcagataaggagaattagactcccaagtagacaccagagtcactgtttggttggtgggtgatagtggggtcacagtggctgcctgtgctcccccagggtgagcgtgactgtgctaacctgggtggggcagcatgcacacccctctggcagccctttgttgctcgctgatgacaagtttggatgatcccgccaaacagcttgctaagatgtagtccccagtgttggaggtggggcctgatgggaggtgctacccttgtgagataaggttgtgtaaaagcctgtggcacctccccacactgacgctctcacccctgctctggccatgtgccgcgcctgctcccacttccccttctgccaggagtaaaagcccccgagacctcccagaagccaagcagatgctagtgccatgcttcctctgcagcctgcagaactgtgagccaattaaacctcttttctctat

SEQ ID NO: 300101 - DNA, 11205 bp, Homo sapiens
  misc_feature (6257)..(6257): n is a, c, g, or t
  misc_feature (7195)..(7195): n is a, c, g, or t
  misc_feature (7470)..(7470): n is a, c, g, or t
  misc_feature (10163)..(10163): n is a, c, g, or t
  misc_feature (10401)..(10401): n is a, c, g, or t
  misc_feature (10616)..(10616): n is a, c, g, or t
acataatttctggagccctgtaccaacgtgtggccacatattctgtcaggaaccctgtgtgatcatggtctggatctgcaacacgggccaggccaaagtcacagatcttgagatcacaggtggtgttgagcagcaggcaggcaggcaatcggtccgagtggctgtcggctcttcagctctcccgctcggcgtcttccttcctcctcccggtcagcgtcggcggctgcaccggcggcggcgcagtccctgcgggaggggcgacaagagctgagcggcggccgccgagcgtcgagctcagcgcggcggaggcggcggcggcccggcagccaacatggcggcggcggcggcggcgggcgcgggcccggagatggtccgcgggcaggtgttcgacgtggggccgcgctacaccaacctctcgtacatcggcgagggcgcctacggcatggtgtgctctgcttatgataatgtcaacaaagttcgagtagctatcaagaaaatcagcccctttgagcaccagacctactgccagagaaccctgagggagataaaaatcttactgcgcttcagacatgagaacatcattggaatcaatgacattattcgagcaccaaccatcgagcaaatgaaagatgtatatatagtacaggacctcatggaaacagatctttacaagctcttgaagacacaacacctcagcaatgaccatatctgctattttctctaccagatcctcagagggttaaaatatatccattcagctaacgttctgcaccgtgacctcaagccttccaacctgctgctcaacaccacctgtgatctcaagatctgtgactttggcctggcccgtgttgcagatccagaccatgatcacacagggttcctgacagaatatgtggccacacgttggtacagggctccagaaattatgttgaattccaagggctacaccaagtccattgatatttggtctgtaggctgcattctggcagaaatgctttctaacaggcccatctttccagggaagcattatcttgaccagctgaaccacattttgggtattcttggatccccatcacaagaagacctgaattgtataataaatttaaaagctaggaactatttgctttctcttccacacaaaaataaggtgccatggaacaggctgttcccaaatgctgactccaaagctctggacttattggacaaaatgttgacattcaacccacacaagaggattgaagtagaacaggctctggcccacccatatctggagcagtattacgacccgagtgacgagcccatcgccgaagcaccattcaagttcgacatggaattggatgacttgcctaaggaaaagctcaaagaactaatttttgaagagactgctagattccagccaggatacagatcttaaatttgtcaggacaagggctcagaggactggacgtgctcagacatcggtgttcttcttcccagttcttgacccctggtcctgtctccagcccgtcttggcttatccactttgactcctttgagccgtttggaggggcggtttctggtagttgtggcttttatgctttcaaagaatttcttcagtccagagaattcctcctggcagccctgtgtgtgtcacccattggtgacctgcggcagtatgtacttcagtgcacctactgcttactgttgctttagtcactaattgctttctggtttgaaagatgcagtggttcctccctctcctgaatccttttctacatgatgccctgctgaccatgcagccgcaccagagagagattcttccccaattggctctagtcactggcatctcactttatgatagggaaggctactacctagggcactttaagtcagtgacagccccttatttgcacttcaccttttgaccataactgtttccccagagcaggagcttgtggaaataccttggctgatgttgcagcctgcagcaagtgcttccgtctccggaatccttggggagcacttgtccacgtcttttctcatatcatggtagtcactaacatatataaggtatgtgctattggcccagcttttagaaaatgcagtcatttttctaaataaaaaggaagtactgcacccagcagtgttacacctctatatggtacaagtgaccacagtaactacagagtgacactctgtagttactgtggtcacttgtaccatatagaggtgtaacacttgtcaagaagcgttatgtgcagtacttaatgtttgtaagacttacaaaaaaagatttaaagtggcagcttcactcgacatttggtgagagaagtacaaaggttgcagtgctgagctgtgggcggtttctggggatgtcccagggtggaactccacatgctggtgcatatacgcccttgagctacttcaaatgtgggtgtttcagtaaccacgttccatgcctgaggatttagcagagaggaacactgcgtctttaaatgagaaagtatacaattctttttccttctacagcatgtcagcatctcaagttcatttttcaacctacagtataacaatttgtaataaagcctccaggagctcatgacgtgaagcactgttctgtcctcaagtactcaaatatttctgatactgctgagtcagactgtcagaaaaagctagcactaactcgtgtttggagctctatccatattttactgatctctttaagtatttgttcctgccactgtgtactgtggagttgactcggtgttctgtcccagtgcggtgcctcctcttgacttccccactgctctctgtggtgagaaatttgccttgttcaataattactgtaccctcgcatgactgttacagctttctgtgcagagatgactgtccaagtgccacatgcctacgattgaaatgaaaactctattgttacctctgagttgtgttccacggaaaatgctatccagcagatcatttaggaaaaataattctatttttagcttttcatttctcagctgtccttttttcttgtttgatttttgacagcaatggagaatgggttatataaagactgcctgctaatatgaacagaaatgcatttgtaattcatgaaaataaatgtacatcttctatcttcacattcatgttaagattcagtgttgctttcctctggatcagcgtgtctgaatggacagtcaggttcaggttgtgctgaacacagaaatgctcacaggcctcactttgccgcccaggcactggcccagcacttggatttacataagatgagttagaaaggtacttctgtagggtcctttttacctctgctcggcagagaatcgatgctgtcatgttcctttattcacaatcttaggtctcaaatattctgtcaaaccctaacaaagaagccccgacatctcaggttggattccctggttctctctaaagagggcctgcccttgtgccccagaggtgctgctgggcacagccaagagttgggaagggccgccccacagtacgcagtcctcaccacccagcccagggtgctcacgctcaccactcctgtggctgaggaaggatagctggctcatcctcggaaaacagacccacatctctattcttgccctgaaatacgcgcttttcacttgcgtgctcagagctgccgtctgaaggtccacacagcattgacgggacacagaaatgtgactgttaccggataacactgattagtcagttttcatttataaaaaagcattgacagttttattactcttgtttctttttaaatggaaagttactattataaggttaatttgcagtcctcttctaaatagaaaaccatatccttggctactaacatctggagactgtgagctccttcccattccccttcctggtactgtggagtcagattggcatgaaaccactaacttcattctagaatcattgtagccataagttgtgtgctttttattaatcatgccaaacataatgtaactgggcagagaatggtcctaaccaaggtacctatgaaaagcgctagctatcatgtgtagtagatgcatcattttggctcttcttacatttgtaaaaatgtacagattaggtcatcttaattcatattagtgacacggaacagcacctccactatttgtatgttcaaataagctttcagactaatagcttttttggtgtctaaaatgtaagcaaaaaattcctgctgaaacattccagtcctttcatttagtataaaagaaatactgaacaagccagtgggatggaattgaaagaactaatcatgaggactctgtcctgacacaggtcctcaaagctagcagagatacgcagacattgtggcatctgggtagaagaatactgtattgtgtgtgcagtgcacagtgtgtggtgtgtgcacactcattccttctgctcttgggcacaggcagtgggtgtagaggtaaccagtagctttgagaagctacatgtagctcaccagtggttttctctaaggaatcacaaaggtaaactacccaaccacatgccacgtaatatttcagccattcagaggaaactgttttctctttatttgcttatatgttaatatggtttttaaattggtaacttttatatagtatggtaacagtatgttaatacacacatacatatgcacacatgctttgggtccttccataatacttttatatttgtaaatcaatgttttggagcaatcccaagtttaagggaaatatttttgtaaatgtaatggttttgaaaatctgagcaatccttttgcttatacatttttaaagcatttgtgctttaaaattgttatgctggtgtttgaaacatgatactcctgtggtgcagatgagaagctataacagtgaatatgtggtttctcttacgtcatccaccttgacatgatgggtcagaaacaaatggaaatccagagcaagtcctccagggttgcaccaggtttacctaaagcttgttgccttttcttgtgctgtttatccgtgtagagcactcaagaaagttctgaaactgctttgtatctgctttgtactgttggtgccttcttggtattgtaccccaaaattctgcatagattatttagtataatggtaagttaaaaaatgttaaaggaagattttattaagaatctgaatgtttattcattatattgttacaatttaacattaacatttatttgtggtatttgtgatttggttaatctgtataaaaattgtaagtagaaaggtttatatttcatcttaattcttttgatgttgtaaacgtactttttaaaagatggattatttgaatgtttatggcacctgacttgtaaaaaaaaaaaactacaaaaaaatccttagaatcattaaattgtgtccctgtattaccaaaataacacagcaccgtgcatgtatagtttaattgcagtttcatctgtgaaaacgtgaaattgtctagtccttcgttatgttccccagatgtcttccagatttgctctgcatgtggtaacttgtgttagggctgtgagctgttcctcgagttgaatggggatgtcagtgctcctagggttctccaggtggttcttcagaccttcacctgtgggggggggggtaggcggtgcccacgcccatctcctcatcctcctgaacttctgcaaccccactgctgggcagacatcctgggcaaccccttttttcagagcaagaagtcataaagataggatttcttggacatttggttcttatcaatattgggcattatgtaatgacttatttacaaaacaaagatactggaaaatgttttggatgtggtgttatggaaagagcacaggccttggacccatccagctgggttcagaactaccccctgcttataactgcggctggctgtgggccagtcattctgcgtctctgctttcttcctctgcttcagactgtcagctgtaaagtggaagcaatattacttgccttgtatatggtaaagattataaaaatacatttcaactgttcagcatagtacttcaaagcaagtactcagtaaatagcaagtctttttaaatgctgctttatttcactaaattttgttgtgaggtgtcactaaaatgcctgcaaacaaacgtaactgctaatctgagaggaaaccctcttactaatcagagaagaaaccctcctgtcagaaaccttcagggaagtgagctgatcacacctaaactgggagtttgcaatggggtatttgaagcactgtgggagtattccactggcccnctccctgagagacttaacagtcttccctgttgtccagattctgtataaggcaatcagaataatcatcttccttgttcagcagaggagcctggtcccattttccccactttgtgatgggcttctctcagcggtagctcagcagttccagatggcagtttggaccagcatctaggctggccagttcgctgtgtttacttagaaccaacacgttcagagctggcctggaccatctgaggggaacaggaaacacccctaggctgtggaagcaagtgcagacccccacccccggccctgaagccaagggggcagggtttgggagtggccaaagagaagcagtgcagggatgggttttcctagggacaggcttagcattcctgactctaggaagaaggagcagtgaggcggagaaacagtggaggggatggtggcattgggccccatggggccgagatggacacagggctcgttctcttgagtctggtgccaaggacagctgaagacgacatcattttcaggtggagaggagagagtggagggagatcatgccctgtgatgtgtcttttgcaggtgaaggtgggagacaaggtctctgctgacgatgaggcagagccaccgtgaaagttgtaataggaggactgcccgccgctggaagggcctgcagtgacgctaggacaccctctgcctgcatgtcacgttagctgggctgggcgaagtagaagaccaaggggaagaggtgcagtggggagaccaggtgggatgcaaccacaggaccagtggaggggctgtggcacgtgggcggagactgagtggctgggcatgtgttgtggctgagcatgtggtgtgggcagtggtcctagaccccgccatgtccggacaatgatatagagcgtctcagcatcgccagtctagactgtctatggagagcagaaagttgtctngggctgcctggggaactgtgaggccagctatatcaccgtcgctgatggtgacattacggtggtggcaggagcaaggagagagggaagaaggaccccgtccagctttagtcacaaaatacccaatggaagatgccagtgccaatcctgtgggtttccttgggacttcacactggctttcttatctgctccagatccattcagtagtcactgagttcctgccaaatactttgtagcgccagaagccaggagcggggtctgcagcagggcagtccccnttttcaggaaatgcctggagctgctggtccctgagagaaaggaaaacatctttcagccgtacgcaggccaagaaggccaatgtccagtagctttgtgattttttttatatttttttatttatttatttttgagatagagtcttgctctgtcgctcaggctggagtgcagtggcgtgatctccactcactgcaacttccgcctcctggggtcaagcagttctgcctcagcctcccgagtagctgggattacaggcacacgccaccacacccagctaatttttgtgtttttagtagagacggtttcaccatgtcggccaggctggtctcaaactcctgacctcagatgattcagcctcccaaagtgctgggattacaggtgtgagccactgcacccagcctgtgatgtttctgtggggttccacaaatgtgtgtgtgtgtaaaagctgatgattacagcaagaatgtgaacagtagcagttttccatttgaaggcaagttttgtctttatctgggtatcagaaggaccctctgggccattgtcgcttcctgtactcagagccaccctagtactacgggcacacacagaaaacagcagcctgcgtactttcaaaggaaaggcatctttaatcaccaatgcctggaaaaattattttgtttccctcttccttccgtcttgtttcctaacttcttaccaaagtttagagtctgagtttttcgtataataatgtcccacatccacacatcgggcctacagatgctctcccttgaatcgactggaaacatgacaccggttccatgctctggaactgtcacctgtgatgtgctgggctgtgtcccaagcacaggaatcccagcagtttcagctcgatgcagaaccaccatgctccagacacaggcttgggaaagacacgtcaaaattaaaatactaggtaagagaagcacctgattgggtagaagttggagaggaatcctggaattttgtggccagaaggagccactgccccttttgtttagtaagactagacagtaacagaagccagttgtcagctatgaaagtggtgggtgaagcaggggaggctcctctatggtgggaccctggacaagggaagccgaatgtgtgaagaaggggtgcgggggtgtgcggtgccctaggacactagggcaaaggtttcaaacctggaacaaggcactggaggaagatctgctgccagtcagcagtgcgggccctcgagttagcagtccgtgcgcagaggggccagttctgagaccagtttggagagtcaggcagtgacccattggccatgtcataattccttcagcctgcctcctctttaatcccagagagtgctctttcttcatacttcctttaaaatactaaattgttcccattccatggggagctggctaggctttacaggctaggaaatgtaggttttctgagatggaaccatctacacaaggaggaggaaggcactaagactacagatgagacccatgacagggctgagcatttggaagccaaccctggttgcttttcaagaattgctttgtggctgggtgcagtggttcacacctgtaattgcagcactttgggaggctgaggcaggtggattgcttgaacccaggagttcgagaccagcctgggcaacatatgggacaccccaccgcccccggctctgcaaaaaaattaaaaattagccaggcgtggtgtcatgagcctgtggtctcaactactcaggaggctgaggctggaggatcgcttgaacctgggaggtcaaggctccagtgaaccataattgtgccactgcactgcagcctgggcgacaatttgttttctaaattgcttttgaaagtctactgcattacatattccaaaaagcagtggttttcaaatacttttatcaccgatatccttttatgaaatgaaatcagtagaactttctctgctctgaataagcaagggtgggaacctgtctacctcccacagatagcataatgtgcctgccatagaggagccaaaaaatggtgatgggaactgagaggagagcaaatgtcacaaaagactgagcaattgagaaaacaaaacaagaccacagatgactgttaacgcctccacagtggaccaagaaaggacagagagctggcagcatgggcatcactgtctggtcggcagcaggaaggcctcgctagggaattgagtacagtcatctaactagtttaaaagtacaggaaggatgattaaggctattggagaggtcatacaaataggggaggggcaggcaatggctgataagacatgaatttgtaaggcgatgagtattgcagtcagcaaaacaaacgagactgctctcccaacacataactcagcagggaggccaggcattggtttaaccatttaatataaagaagttaaaattacaaatgcgctaagtgcctaaagaagaataagtgcaggaatgagagcagcatggactgccacagttttagaataagcactgtcactgctagattggaaacaaaaatccataaatttggcccggtgtggtggcggacgcctgtagtcccagctacttggaggctgaggcgtgagaatcgcttgaacccgggaggcggaggttgcagtgagccgagatggcgccactgcactccagcctgggcgtcagagtgagaactctgtatcaaaaaataaaaanaaaaaaaagtccataaatctgcaatgtctcagttaagaaagaaagactgggccaatgcagatttcaaaccggagaaagtcatactgtcagtgaaggccgcctgtggccggaaggcgccaggggattagcaccctggactcagtgttgctgggaaacagggccccaaggctgggagcacagtgtttaaagggcatctacccaagaagggagcacagggcaaggaggagctgcagggggncttggctgccaaagtgaattctgaggagagagctattgctgcctacgatatgcaggctgcacagaacacaagtggaatcagcaggcaggagaggcagctaacgacgcagcccgtttcttatttctgttttctcacaagcgatgaaagtggaaaagagggtgagcaggtggcccacacatgtgcctccagtgctgcggcccctccggggaccatcngccaggccccggggagggagccagccacagtgtgtccggctcttctctgaagggaagagagccttgaatagactgaagcgaagacggttctgcaaggacaaggcagaccgaaggcattggttttttttttcagataaggagaattagactcccaagtagacaccagagtcactgtttggttggtgggtgatagtggggtcacagtggctgcctgtgctcccccagggtgagcgtgactgtgctaacctgggtggggcagcatgcacacccctctggcagccctttgttgctcgctgatgacaagtttggatgatcccgccaaacagcttgctaagatgtagtccccagtgttggaggtggggcctgatgggaggtgctacccttgtgagataaggttgtgtaaaagcctgtggcacctccccacactgacgctctcacccctgctctggccatgtgccgcgcctgctcccacttccccttctgccaggagtaaaagcccccgagacctcccagaagccaagcagatgctagtgccatgcttcctctgcagcctgcagaactgtgagccaattaaacctcttttctctat

SEQ ID NO: 300102 - DNA, 11107 bp, Homo sapiens
  misc_feature (6159)..(6159): n is a, c, g, or t
  misc_feature (7097)..(7097): n is a, c, g, or t
  misc_feature (7372)..(7372): n is a, c, g, or t
  misc_feature (10065)..(10065): n is a, c, g, or t
  misc_feature (10303)..(10303): n is a, c, g, or t
  misc_feature (10518)..(10518): n is a, c, g, or t
acataatttctggagccctgtaccaacgtgtggccacatattctgtcaggaaccctgtgtgatcatggtctggatctgcaacacgggccaggccaaagtcacagatcttgagatcacaggtggtgttgagcagcaggcaggcaggcaatcggtccgagtggctgtcggctcttcagctctcccgctcggcgtcttccttcctcctcccggtcagcgtcggcggctgcaccggcggcggcgcagtccctgcgggaggggcgacaagagctgagcggcggccgccgagcgtcgagctcagcgcggcggaggcggcggcggcccggcagccaacatggcggcggcggcggcggcgggcgcgggcccggagatggtccgcgggcaggtgttcgacgtggggccgcgctacaccaacctctcgtacatcggcgagggcgcctacggcatggtgtgctctgcttatgataatgtcaacaaagttcgagtagctatcaagaaaatcagcccctttgagcaccagacctactgccagagaaccctgagggagataaaaatcttactgcgcttcagacatgagaacatcattggaatcaatgacattattcgagcaccaaccatcgagcaaatgaaagatgtatatatagtacaggacctcatggaaacagatctttacaagctcttgaagacacaacacctcagcaatgaccatatctgctattttctctaccagatcctcagagggttaaaatatatccattcagctaacgttctgcaccgtgacctcaagccttccaacctgctgctcaacaccacctgtgatctcaagatctgtgactttggcctggcccgtgttgcagatccagaccatgatcacacagggttcctgacagaatatgtggccacacgttggtacagggctccagaaattatgttgaattccaagggctacaccaagtccattgatatttggtctgtaggctgcattctggcagaaatgctttctaacaggcccatctttccagggaagcattatcttgaccagctgaaccacattttgggtattcttggatccccatcacaagaagacctgaattgtataataaatttaaaagctaggaactatttgctttctcttccacacaaaaataaggtgccatggaacaggctgttcccaaatgctgactccaaagctctggacttattggacaaaatgttgacattcaacccacacaagaggattgaagtagaacaggctctggcccacccatatctggagcagtattacgacccgagtgacgagcccatcgccgaagcaccattcaagttcgacatggaattggatgacttgcctaaggaaaagctcaaagaactaatttttgaagagactgctagattccagccaggatacagatcttaaatttgtcaggacaagggctcagaggactggacgtgctcagacatcggtgttcttcttcccagttcttgacccctggtcctgtctccagcccgtcttggcttatccactttgactcctttgagccgtttggaggggcggtttctggtagttgtggcttttatgctttcaaagaatttcttcagtccagagaattcctcctggcagccctgtgtgtgtcacccattggtgacctgcggcagtatgtacttcagtgcacctactgcttactgttgctttagtcactaattgctttctggtttgaaagatgcagtggttcctccctctcctgaatccttttctacatgatgccctgctgaccatgcagccgcaccagagagagattcttccccaattggctctagtcactggcatctcactttatgatagggaaggctactacctagggcactttaagtcagtgacagccccttatttgcacttcaccttttgaccataactgtttccccagagcaggagcttgtggaaataccttggctgatgttgcagcctgcagcaagtgcttccgtctccggaatccttggggagcacttgtccacgtcttttctcatatcatggtagtcactaacatatataaggtatgtgctattggcccagcttttagaaaatgcagtcatttttctaaataaaaaggaagtactgcacccagcagtgtcactctgtagttactgtggtcacttgtaccatatagaggtgtaacacttgtcaagaagcgttatgtgcagtacttaatgtttgtaagacttacaaatgcagtgctgagctgtgggcggtttctggggatgtcccagggtggaactccacatgctggtgcatatacgcccttgagctacttcaaatgtgggtgtttcagtaaccacgttccatgcctgaggatttagcagagaggaacactgcgtctttaaatgagaaagtatacaattctttttccttctacagcatgtcagcatctcaagttcatttttcaacctacagtataacaatttgtaataaagcctccaggagctcatgacgtgaagcactgttctgtcctcaagtactcaaatatttctgatactgctgagtcagactgtcagaaaaagctagcactaactcgtgtttggagctctatccatattttactgatctctttaagtatttgttcctgccactgtgtactgtggagttgactcggtgttctgtcccagtgcggtgcctcctcttgacttccccactgctctctgtggtgagaaatttgccttgttcaataattactgtaccctcgcatgactgttacagctttctgtgcagagatgactgtccaagtgccacatgcctacgattgaaatgaaaactctattgttacctctgagttgtgttccacggaaaatgctatccagcagatcatttaggaaaaataattctatttttagcttttcatttctcagctgtccttttttcttgtttgatttttgacagcaatggagaatgggttatataaagactgcctgctaatatgaacagaaatgcatttgtaattcatgaaaataaatgtacatcttctatcttcacattcatgttaagattcagtgttgctttcctctggatcagcgtgtctgaatggacagtcaggttcaggttgtgctgaacacagaaatgctcacaggcctcactttgccgcccaggcactggcccagcacttggatttacataagatgagttagaaaggtacttctgtagggtcctttttacctctgctcggcagagaatcgatgctgtcatgttcctttattcacaatcttaggtctcaaatattctgtcaaaccctaacaaagaagccccgacatctcaggttggattccctggttctctctaaagagggcctgcccttgtgccccagaggtgctgctgggcacagccaagagttgggaagggccgccccacagtacgcagtcctcaccacccagcccagggtgctcacgctcaccactcctgtggctgaggaaggatagctggctcatcctcggaaaacagacccacatctctattcttgccctgaaatacgcgcttttcacttgcgtgctcagagctgccgtctgaaggtccacacagcattgacgggacacagaaatgtgactgttaccggataacactgattagtcagttttcatttataaaaaagcattgacagttttattactcttgtttctttttaaatggaaagttactattataaggttaatttgcagtcctcttctaaatagaaaaccatatccttggctactaacatctggagactgtgagctccttcccattccccttcctggtactgtggagtcagattggcatgaaaccactaacttcattctagaatcattgtagccataagttgtgtgctttttattaatcatgccaaacataatgtaactgggcagagaatggtcctaaccaaggtacctatgaaaagcgctagctatcatgtgtagtagatgcatcattttggctcttcttacatttgtaaaaatgtacagattaggtcatcttaattcatattagtgacacggaacagcacctccactatttgtatgttcaaataagctttcagactaatagcttttttggtgtctaaaatgtaagcaaaaaattcctgctgaaacattccagtcctttcatttagtataaaagaaatactgaacaagccagtgggatggaattgaaagaactaatcatgaggactctgtcctgacacaggtcctcaaagctagcagagatacgcagacattgtggcatctgggtagaagaatactgtattgtgtgtgcagtgcacagtgtgtggtgtgtgcacactcattccttctgctcttgggcacaggcagtgggtgtagaggtaaccagtagctttgagaagctacatgtagctcaccagtggttttctctaaggaatcacaaaggtaaactacccaaccacatgccacgtaatatttcagccattcagaggaaactgttttctctttatttgcttatatgttaatatggtttttaaattggtaacttttatatagtatggtaacagtatgttaatacacacatacatatgcacacatgctttgggtccttccataatacttttatatttgtaaatcaatgttttggagcaatcccaagtttaagggaaatatttttgtaaatgtaatggttttgaaaatctgagcaatccttttgcttatacatttttaaagcatttgtgctttaaaattgttatgctggtgtttgaaacatgatactcctgtggtgcagatgagaagctataacagtgaatatgtggtttctcttacgtcatccaccttgacatgatgggtcagaaacaaatggaaatccagagcaagtcctccagggttgcaccaggtttacctaaagcttgttgccttttcttgtgctgtttatccgtgtagagcactcaagaaagttctgaaactgctttgtatctgctttgtactgttggtgccttcttggtattgtaccccaaaattctgcatagattatttagtataatggtaagttaaaaaatgttaaaggaagattttattaagaatctgaatgtttattcattatattgttacaatttaacattaacatttatttgtggtatttgtgatttggttaatctgtataaaaattgtaagtagaaaggtttatatttcatcttaattcttttgatgttgtaaacgtactttttaaaagatggattatttgaatgtttatggcacctgacttgtaaaaaaaaaaaactacaaaaaaatccttagaatcattaaattgtgtccctgtattaccaaaataacacagcaccgtgcatgtatagtttaattgcagtttcatctgtgaaaacgtgaaattgtctagtccttcgttatgttccccagatgtcttccagatttgctctgcatgtggtaacttgtgttagggctgtgagctgttcctcgagttgaatggggatgtcagtgctcctagggttctccaggtggttcttcagaccttcacctgtgggggggggggtaggcggtgcccacgcccatctcctcatcctcctgaacttctgcaaccccactgctgggcagacatcctgggcaaccccttttttcagagcaagaagtcataaagataggatttcttggacatttggttcttatcaatattgggcattatgtaatgacttatttacaaaacaaagatactggaaaatgttttggatgtggtgttatggaaagagcacaggccttggacccatccagctgggttcagaactaccccctgcttataactgcggctggctgtgggccagtcattctgcgtctctgctttcttcctctgcttcagactgtcagctgtaaagtggaagcaatattacttgccttgtatatggtaaagattataaaaatacatttcaactgttcagcatagtacttcaaagcaagtactcagtaaatagcaagtctttttaaatgctgctttatttcactaaattttgttgtgaggtgtcactaaaatgcctgcaaacaaacgtaactgctaatctgagaggaaaccctcttactaatcagagaagaaaccctcctgtcagaaaccttcagggaagtgagctgatcacacctaaactgggagtttgcaatggggtatttgaagcactgtgggagtattccactggcccnctccctgagagacttaacagtcttccctgttgtccagattctgtataaggcaatcagaataatcatcttccttgttcagcagaggagcctggtcccattttccccactttgtgatgggcttctctcagcggtagctcagcagttccagatggcagtttggaccagcatctaggctggccagttcgctgtgtttacttagaaccaacacgttcagagctggcctggaccatctgaggggaacaggaaacacccctaggctgtggaagcaagtgcagacccccacccccggccctgaagccaagggggcagggtttgggagtggccaaagagaagcagtgcagggatgggttttcctagggacaggcttagcattcctgactctaggaagaaggagcagtgaggcggagaaacagtggaggggatggtggcattgggccccatggggccgagatggacacagggctcgttctcttgagtctggtgccaaggacagctgaagacgacatcattttcaggtggagaggagagagtggagggagatcatgccctgtgatgtgtcttttgcaggtgaaggtgggagacaaggtctctgctgacgatgaggcagagccaccgtgaaagttgtaataggaggactgcccgccgctggaagggcctgcagtgacgctaggacaccctctgcctgcatgtcacgttagctgggctgggcgaagtagaagaccaaggggaagaggtgcagtggggagaccaggtgggatgcaaccacaggaccagtggaggggctgtggcacgtgggcggagactgagtggctgggcatgtgttgtggctgagcatgtggtgtgggcagtggtcctagaccccgccatgtccggacaatgatatagagcgtctcagcatcgccagtctagactgtctatggagagcagaaagttgtctngggctgcctggggaactgtgaggccagctatatcaccgtcgctgatggtgacattacggtggtggcaggagcaaggagagagggaagaaggaccccgtccagctttagtcacaaaatacccaatggaagatgccagtgccaatcctgtgggtttccttgggacttcacactggctttcttatctgctccagatccattcagtagtcactgagttcctgccaaatactttgtagcgccagaagccaggagcggggtctgcagcagggcagtccccnttttcaggaaatgcctggagctgctggtccctgagagaaaggaaaacatctttcagccgtacgcaggccaagaaggccaatgtccagtagctttgtgattttttttatatttttttatttatttatttttgagatagagtcttgctctgtcgctcaggctggagtgcagtggcgtgatctccactcactgcaacttccgcctcctggggtcaagcagttctgcctcagcctcccgagtagctgggattacaggcacacgccaccacacccagctaatttttgtgtttttagtagagacggtttcaccatgtcggccaggctggtctcaaactcctgacctcagatgattcagcctcccaaagtgctgggattacaggtgtgagccactgcacccagcctgtgatgtttctgtggggttccacaaatgtgtgtgtgtgtaaaagctgatgattacagcaagaatgtgaacagtagcagttttccatttgaaggcaagttttgtctttatctgggtatcagaaggaccctctgggccattgtcgcttcctgtactcagagccaccctagtactacgggcacacacagaaaacagcagcctgcgtactttcaaaggaaaggcatctttaatcaccaatgcctggaaaaattattttgtttccctcttccttccgtcttgtttcctaacttcttaccaaagtttagagtctgagtttttcgtataataatgtcccacatccacacatcgggcctacagatgctctcccttgaatcgactggaaacatgacaccggttccatgctctggaactgtcacctgtgatgtgctgggctgtgtcccaagcacaggaatcccagcagtttcagctcgatgcagaaccaccatgctccagacacaggcttgggaaagacacgtcaaaattaaaatactaggtaagagaagcacctgattgggtagaagttggagaggaatcctggaattttgtggccagaaggagccactgccccttttgtttagtaagactagacagtaacagaagccagttgtcagctatgaaagtggtgggtgaagcaggggaggctcctctatggtgggaccctggacaagggaagccgaatgtgtgaagaaggggtgcgggggtgtgcggtgccctaggacactagggcaaaggtttcaaacctggaacaaggcactggaggaagatctgctgccagtcagcagtgcgggccctcgagttagcagtccgtgcgcagaggggccagttctgagaccagtttggagagtcaggcagtgacccattggccatgtcataattccttcagcctgcctcctctttaatcccagagagtgctctttcttcatacttcctttaaaatactaaattgttcccattccatggggagctggctaggctttacaggctaggaaatgtaggttttctgagatggaaccatctacacaaggaggaggaaggcactaagactacagatgagacccatgacagggctgagcatttggaagccaaccctggttgcttttcaagaattgctttgtggctgggtgcagtggttcacacctgtaattgcagcactttgggaggctgaggcaggtggattgcttgaacccaggagttcgagaccagcctgggcaacatatgggacaccccaccgcccccggctctgcaaaaaaattaaaaattagccaggcgtggtgtcatgagcctgtggtctcaactactcaggaggctgaggctggaggatcgcttgaacctgggaggtcaaggctccagtgaaccataattgtgccactgcactgcagcctgggcgacaatttgttttctaaattgcttttgaaagtctactgcattacatattccaaaaagcagtggttttcaaatacttttatcaccgatatccttttatgaaatgaaatcagtagaactttctctgctctgaataagcaagggtgggaacctgtctacctcccacagatagcataatgtgcctgccatagaggagccaaaaaatggtgatgggaactgagaggagagcaaatgtcacaaaagactgagcaattgagaaaacaaaacaagaccacagatgactgttaacgcctccacagtggaccaagaaaggacagagagctggcagcatgggcatcactgtctggtcggcagcaggaaggcctcgctagggaattgagtacagtcatctaactagtttaaaagtacaggaaggatgattaaggctattggagaggtcatacaaataggggaggggcaggcaatggctgataagacatgaatttgtaaggcgatgagtattgcagtcagcaaaacaaacgagactgctctcccaacacataactcagcagggaggccaggcattggtttaaccatttaatataaagaagttaaaattacaaatgcgctaagtgcctaaagaagaataagtgcaggaatgagagcagcatggactgccacagttttagaataagcactgtcactgctagattggaaacaaaaatccataaatttggcccggtgtggtggcggacgcctgtagtcccagctacttggaggctgaggcgtgagaatcgcttgaacccgggaggcggaggttgcagtgagccgagatggcgccactgcactccagcctgggcgtcagagtgagaactctgtatcaaaaaataaaaanaaaaaaaagtccataaatctgcaatgtctcagttaagaaagaaagactgggccaatgcagatttcaaaccggagaaagtcatactgtcagtgaaggccgcctgtggccggaaggcgccaggggattagcaccctggactcagtgttgctgggaaacagggccccaaggctgggagcacagtgtttaaagggcatctacccaagaagggagcacagggcaaggaggagctgcagggggncttggctgccaaagtgaattctgaggagagagctattgctgcctacgatatgcaggctgcacagaacacaagtggaatcagcaggcaggagaggcagctaacgacgcagcccgtttcttatttctgttttctcacaagcgatgaaagtggaaaagagggtgagcaggtggcccacacatgtgcctccagtgctgcggcccctccggggaccatcngccaggccccggggagggagccagccacagtgtgtccggctcttctctgaagggaagagagccttgaatagactgaagcgaagacggttctgcaaggacaaggcagaccgaaggcattggttttttttttcagataaggagaattagactcccaagtagacaccagagtcactgtttggttggtgggtgatagtggggtcacagtggctgcctgtgctcccccagggtgagcgtgactgtgctaacctgggtggggcagcatgcacacccctctggcagccctttgttgctcgctgatgacaagtttggatgatcccgccaaacagcttgctaagatgtagtccccagtgttggaggtggggcctgatgggaggtgctacccttgtgagataaggttgtgtaaaagcctgtggcacctccccacactgacgctctcacccctgctctggccatgtgccgcgcctgctcccacttccccttctgccaggagtaaaagcccccgagacctcccagaagccaagcagatgctagtgccatgcttcctctgcagcctgcagaactgtgagccaattaaacctcttttctctat

SEQ ID NO: 300103 - DNA, 5699 bp, Homo sapiens
  misc_feature (5557)..(5557): n is a, c, g, or t
acataatttctggagccctgtaccaacgtgtggccacatattctgtcaggaaccctgtgtgatcatggtctggatctgcaacacgggccaggccaaagtcacagatcttgagatcacaggtggtgttgagcagcaggcaggcaggcaatcggtccgagtggctgtcggctcttcagctctcccgctcggcgtcttccttcctcctcccggtcagcgtcggcggctgcaccggcggcggcgcagtccctgcgggaggggcgacaagagctgagcggcggccgccgagcgtcgagctcagcgcggcggaggcggcggcggcccggcagccaacatggcggcggcggcggcggcgggcgcgggcccggagatggtccgcgggcaggtgttcgacgtggggccgcgctacaccaacctctcgtacatcggcgagggcgcctacggcatggtgtgctctgcttatgataatgtcaacaaagttcgagtagctatcaagaaaatcagcccctttgagcaccagacctactgccagagaaccctgagggagataaaaatcttactgcgcttcagacatgagaacatcattggaatcaatgacattattcgagcaccaaccatcgagcaaatgaaagatgtatatatagtacaggacctcatggaaacagatctttacaagctcttgaagacacaacacctcagcaatgaccatatctgctattttctctaccagatcctcagagggttaaaatatatccattcagctaacgttctgcaccgtgacctcaagccttccaacctgctgctcaacaccacctgtgatctcaagatctgtgactttggcctggcccgtgttgcagatccagaccatgatcacacagggttcctgacagaatatgtggccacacgttggtacagggctccagaaattatgttgaattccaagggctacaccaagtccattgatatttggtctgtaggctgcattctggcagaaatgctttctaacaggcccatctttccagggaagcattatcttgaccagctgaaccacattttgggtattcttggatccccatcacaagaagacctgaattgtataataaatttaaaagctaggaactatttgctttctcttccacacaaaaataaggtgccatggaacaggctgttcccaaatgctgactccaaagctctggacttattggacaaaatgttgacattcaacccacacaagaggattgaagtagaacaggctctggcccacccatatctggagcagtattacgacccgagtgacgagcccatcgccgaagcaccattcaagttcgacatggaattggatgacttgcctaaggaaaagctcaaagaactaatttttgaagagactgctagattccagccaggatacagatcttaaatttgtcaggacaagggctcagaggactggacgtgctcagacatcggtgttcttcttcccagttcttgacccctggtcctgtctccagcccgtcttggcttatccactttgactcctttgagccgtttggaggggcggtttctggtagttgtggcttttatgctttcaaagaatttcttcagtccagagaattcctcctggcagccctgtgtgtgtcacccattggtgacctgcggcagtatgtacttcagtgcacctactgcttactgttgctttagtcactaattgctttctggtttgaaagatgcagtggttcctccctctcctgaatccttttctacatgatgccctgctgaccatgcagccgcaccagagagagattcttccccaattggctctagtcactggcatctcactttatgatagggaaggctactacctagggcactttaagtcagtgacagccccttatttgcacttcaccttttgaccataactgtttccccagagcaggagcttgtggaaataccttggctgatgttgcagcctgcagcaagtgcttccgtctccggaatccttggggagcacttgtccacgtcttttctcatatcatggtagtcactaacatatataaggtatgtgctattggcccagcttttagaaaatgcagtcatttttctaaataaaaaggaagtactgcacccagcagtgtcactctgtagttactgtggtcacttgtaccatatagaggtgtaacacttgtcaagaagcgttatgtgcagtacttaatgtttgtaagacttacaaaaaaagatttaaagtggcagcttcactcgacatttggtgagagaagtacaaaggttgcagtgctgagctgtgggcggtttctggggatgtcccagggtggaactccacatgctggtgcatatacgcccttgagctacttcaaatgtgggtgtttcagtaaccacgttccatgcctgaggatttagcagagaggaacactgcgtctttaaatgagaaagtatacaattctttttccttctacagcatgtcagcatctcaagttcatttttcaacctacagtataacaatttgtaataaagcctccaggagctcatgacgtgaagcactgttctgtcctcaagtactcaaatatttctgatactgctgagtcagactgtcagaaaaagctagcactaactcgtgtttggagctctatccatattttactgatctctttaagtatttgttcctgccactgtgtactgtggagttgactcggtgttctgtcccagtgcggtgcctcctcttgacttccccactgctctctgtggtgagaaatttgccttgttcaataattactgtaccctcgcatgactgttacagctttctgtgcagagatgactgtccaagtgccacatgcctacgattgaaatgaaaactctattgttacctctgagttgtgttccacggaaaatgctatccagcagatcatttaggaaaaataattctatttttagcttttcatttctcagctgtccttttttcttgtttgatttttgacagcaatggagaatgggttatataaagactgcctgctaatatgaacagaaatgcatttgtaattcatgaaaataaatgtacatcttctatcttcacattcatgttaagattcagtgttgctttcctctggatcagcgtgtctgaatggacagtcaggttcaggttgtgctgaacacagaaatgctcacaggcctcactttgccgcccaggcactggcccagcacttggatttacataagatgagttagaaaggtacttctgtagggtcctttttacctctgctcggcagagaatcgatgctgtcatgttcctttattcacaatcttaggtctcaaatattctgtcaaaccctaacaaagaagccccgacatctcaggttggattccctggttctctctaaagagggcctgcccttgtgccccagaggtgctgctgggcacagccaagagttgggaagggccgccccacagtacgcagtcctcaccacccagcccagggtgctcacgctcaccactcctgtggctgaggaaggatagctggctcatcctcggaaaacagacccacatctctattcttgccctgaaatacgcgcttttcacttgcgtgctcagagctgccgtctgaaggtccacacagcattgacgggacacagaaatgtgactgttaccggataacactgattagtcagttttcatttataaaaaagcattgacagttttattactcttgtttctttttaaatggaaagttactattataaggttaatttgcagtcctcttctaaatagaaaaccatatccttggctactaacatctggagactgtgagctccttcccattccccttcctggtactgtggagtcagattggcatgaaaccactaacttcattctagaatcattgtagccataagttgtgtgctttttattaatcatgccaaacataatgtaactgggcagagaatggtcctaaccaaggtacctatgaaaagcgctagctatcatgtgtagtagatgcatcattttggctcttcttacatttgtaaaaatgtacagattaggtcatcttaattcatattagtgacacggaacagcacctccactatttgtatgttcaaataagctttcagactaatagcttttttggtgtctaaaatgtaagcaaaaaattcctgctgaaacattccagtcctttcatttagtataaaagaaatactgaacaagccagtgggatggaattgaaagaactaatcatgaggactctgtcctgacacaggtcctcaaagctagcagagatacgcagacattgtggcatctgggtagaagaatactgtattgtgtgtgcagtgcacagtgtgtggtgtgtgcacactcattccttctgctcttgggcacaggcagtgggtgtagaggtaaccagtagctttgagaagctacatgtagctcaccagtggttttctctaaggaatcacaaaggtaaactacccaaccacatgccacgtaatatttcagccattcagaggaaactgttttctctttatttgcttatatgttaatatggtttttaaattggtaacttttatatagtatggtaacagtatgttaatacacacatacatatgcacacatgctttgggtccttccataatacttttatatttgtaaatcaatgttttggagcaatcccaagtttaagggaaatatttttgtaaatgtaatggttttgaaaatctgagcaatccttttgcttatacatttttaaagcatttgtgctttaaaattgttatgctggtgtttgaaacatgatactcctgtggtgcagatgagaagctataacagtgaatatgtggtttctcttacgtcatccaccttgacatgatgggtcagaaacaaatggaaatccagagcaagtcctccagggttgcaccaggtttacctaaagcttgttgccttttcttgtgctgtttatccgtgtagagcactcaagaaagttctgaaactgctttgtatctgctttgtactgttggtgccttcttggtattgtaccccaaaattctgcatagattatttagtataatggtaagttaaaaaatgttaaaggaagattttattaagaatctgaatgtttattcattatattgttacaatttaacattaacatttatttgtggtatttgtgatttggttaatctgtataaaaattgtaagtagaaaggtttatatttcatcttaattcttttgatgttgtaaacgtactttttaaaagatggattatttgaatgtttatggcacctgacttgtaaaaaaaaaaaactacaaaaaaatccttagaatcattaaattgtgtccctgtattaccaaaataacacagcaccgtgcatgtatagtttaattgcagtttcatctgtgaaaacgtgaaattgtctagtccttcgttatgttccccagatgtcttccagatttgctctgcatgtggtaacttgtgttagggctgtgagctgttcctcgagttgaatggggatgtcagtgctcctagggttctccaggtggttcttcagaccttcacctggggagacgngcggtcgccttttccattgccatattgtctatgctgttctttacccactacctgatttgctaaaagactagtggtgatataaggtgcgggcactttattttaaagatttatttccctaacattagaattgaatccttggtga

SEQ ID NO: 300104 - DNA, 10766 bp, Homo sapiens
  misc_feature (5818)..(5818): n is a, c, g, or t
  misc_feature (6756)..(6756): n is a, c, g, or t
  misc_feature (7031)..(7031): n is a, c, g, or t
  misc_feature (9724)..(9724): n is a, c, g, or t
  misc_feature (9962)..(9962): n is a, c, g, or t
  misc_feature (10177)..(10177): n is a, c, g, or t
acataatttctggagccctgtaccaacgtgtggccacatattctgtcaggaaccctgtgtgatcatggtctggatctgcaacacgggccaggccaaagtcacagatcttgagatcacaggtggtgttgagcagcaggcaggcaggcaatcggtccgagtggctgtcggctcttcagctctcccgctcggcgtcttccttcctcctcccggtcagcgtcggcggctgcaccggcggcggcgcagtccctgcgggaggggcgacaagagctgagcggcggccgccgagcgtcgagctcagcgcggcggaggcggcggcggcccggcagccaacatggcggcggcggcggcggcgggcgcgggcccggagatggtccgcgggcaggtgttcgacgtggggccgcgctacaccaacctctcgtacatcggcgagggcgcctacggcatggtgtgctctgcttatgataatgtcaacaaagttcgagtagctatcaagaaaatcagcccctttgagcaccagacctactgccagagaaccctgagggagataaaaatcttactgcgcttcagacatgagaacatcattggaatcaatgacattattcgagcaccaaccatcgagcaaatgaaagatgtatatatagtacaggacctcatggaaacagatctttacaagctcttgaagacacaacacctcagcaatgaccatatctgctattttctctaccagatcctcagagggttaaaatatatccattcagctaacgttctgcaccgtgacctcaagccttccaacctgctgctcaacaccacctgtgatctcaagatctgtgactttggcctggcccgtgttgcagatccagaccatgatcacacagggttcctgacagaatatgtggccacacgttggtacagggctccagaaattatgttgaattccaagggctacaccaagtccattgatatttggtctgtaggctgcattctggcagaaatgctttctaacaggcccatctttccagggaagcattatcttgaccagctgaaccacattttgggtattcttggatccccatcacaagaagacctgaattgtataataaatttaaaagctaggaactatttgctttctcttccacacaaaaataaggtgccatggaacaggctgttcccaaatgctgactccaaagctctggacttattggacaaaatgttgacattcaacccacacaagaggattgaagtagaacaggctctggcccacccatatctggagcagtattacgacccgagtgacgagcccatcgccgaagcaccattcaagttcgacatggaattggatgacttgcctaaggaaaagctcaaagaactaatttttgaagagactgctagattccagccaggatacagatcttaaatttgtcaggacaagggctcagaggactggacgtgctcagacatcggtgttcttcttcccagttcttgacccctggtcctgtctccagcccgtcttggcttatccactttgactcctttgagccgtttggaggggcggtttctggtagttgtggcttttatgctttcaaagaatttcttcagtccagagaattcctcctggcagccctgtgtgtgtcacccattggtgacctgcggcagtatgtacttcagtgcacctactgcttactgttgctttagtcactaattgctttctggtttgaaagatgcagtggttcctccctctcctgaatccttttctacatgatgccctgctgaccatgcagccgcaccagagagagattcttccccaattggctctagtcactggcatctcactttatgatagggaaggctactacctagggcactttaagtcagtgacagccccttatttgcacttcaccttttgaccataactgtttccccagagcaggagcttgtggaaataccttggctgatgttgcagcctgcagcaagtgcttccgtctccggaatccttggggagcacttgtccacgtcttttctcatatcatggtagtcactaacatatataaggtatgtgctattggcccagcttttagaaaatgcagtcatttttctaaataaaaaggaagtactgcacccagcagtgtcactctgtagttactgtggtcacttgtaccatatagaggtgtaacacttgtcaagaagcgttatgtgcagtacttaatgtttgtaagacttacaaaaaaagatttaaagtggcagcttcactcgacatttggtgagagaagtacaaaggttgcagtgctgagctgtgggcggtttctggggatgtcccaggtgcggtgcctcctcttgacttccccactgctctctgtggtgagaaatttgccttgttcaataattactgtaccctcgcatgactgttacagctttctgtgcagagatgactgtccaagtgccacatgcctacgattgaaatgaaaactctattgttacctctgagttgtgttccacggaaaatgctatccagcagatcatttaggaaaaataattctatttttagcttttcatttctcagctgtccttttttcttgtttgatttttgacagcaatggagaatgggttatataaagactgcctgctaatatgaacagaaatgcatttgtaattcatgaaaataaatgtacatcttctatcttcacattcatgttaagattcagtgttgctttcctctggatcagcgtgtctgaatggacagtcaggttcaggttgtgctgaacacagaaatgctcacaggcctcactttgccgcccaggcactggcccagcacttggatttacataagatgagttagaaaggtacttctgtagggtcctttttacctctgctcggcagagaatcgatgctgtcatgttcctttattcacaatcttaggtctcaaatattctgtcaaaccctaacaaagaagccccgacatctcaggttggattccctggttctctctaaagagggcctgcccttgtgccccagaggtgctgctgggcacagccaagagttgggaagggccgccccacagtacgcagtcctcaccacccagcccagggtgctcacgctcaccactcctgtggctgaggaaggatagctggctcatcctcggaaaacagacccacatctctattcttgccctgaaatacgcgcttttcacttgcgtgctcagagctgccgtctgaaggtccacacagcattgacgggacacagaaatgtgactgttaccggataacactgattagtcagttttcatttataaaaaagcattgacagttttattactcttgtttctttttaaatggaaagttactattataaggttaatttgcagtcctcttctaaatagaaaaccatatccttggctactaacatctggagactgtgagctccttcccattccccttcctggtactgtggagtcagattggcatgaaaccactaacttcattctagaatcattgtagccataagttgtgtgctttttattaatcatgccaaacataatgtaactgggcagagaatggtcctaaccaaggtacctatgaaaagcgctagctatcatgtgtagtagatgcatcattttggctcttcttacatttgtaaaaatgtacagattaggtcatcttaattcatattagtgacacggaacagcacctccactatttgtatgttcaaataagctttcagactaatagcttttttggtgtctaaaatgtaagcaaaaaattcctgctgaaacattccagtcctttcatttagtataaaagaaatactgaacaagccagtgggatggaattgaaagaactaatcatgaggactctgtcctgacacaggtcctcaaagctagcagagatacgcagacattgtggcatctgggtagaagaatactgtattgtgtgtgcagtgcacagtgtgtggtgtgtgcacactcattccttctgctcttgggcacaggcagtgggtgtagaggtaaccagtagctttgagaagctacatgtagctcaccagtggttttctctaaggaatcacaaaggtaaactacccaaccacatgccacgtaatatttcagccattcagaggaaactgttttctctttatttgcttatatgttaatatggtttttaaattggtaacttttatatagtatggtaacagtatgttaatacacacatacatatgcacacatgctttgggtccttccataatacttttatatttgtaaatcaatgttttggagcaatcccaagtttaagggaaatatttttgtaaatgtaatggttttgaaaatctgagcaatccttttgcttatacatttttaaagcatttgtgctttaaaattgttatgctggtgtttgaaacatgatactcctgtggtgcagatgagaagctataacagtgaatatgtggtttctcttacgtcatccaccttgacatgatgggtcagaaacaaatggaaatccagagcaagtcctccagggttgcaccaggtttacctaaagcttgttgccttttcttgtgctgtttatccgtgtagagcactcaagaaagttctgaaactgctttgtatctgctttgtactgttggtgccttcttggtattgtaccccaaaattctgcatagattatttagtataatggtaagttaaaaaatgttaaaggaagattttattaagaatctgaatgtttattcattatattgttacaatttaacattaacatttatttgtggtatttgtgatttggttaatctgtataaaaattgtaagtagaaaggtttatatttcatcttaattcttttgatgttgtaaacgtactttttaaaagatggattatttgaatgtttatggcacctgacttgtaaaaaaaaaaaactacaaaaaaatccttagaatcattaaattgtgtccctgtattaccaaaataacacagcaccgtgcatgtatagtttaattgcagtttcatctgtgaaaacgtgaaattgtctagtccttcgttatgttccccagatgtcttccagatttgctctgcatgtggtaacttgtgttagggctgtgagctgttcctcgagttgaatggggatgtcagtgctcctagggttctccaggtggttcttcagaccttcacctgtgggggggggggtaggcggtgcccacgcccatctcctcatcctcctgaacttctgcaaccccactgctgggcagacatcctgggcaaccccttttttcagagcaagaagtcataaagataggatttcttggacatttggttcttatcaatattgggcattatgtaatgacttatttacaaaacaaagatactggaaaatgttttggatgtggtgttatggaaagagcacaggccttggacccatccagctgggttcagaactaccccctgcttataactgcggctggctgtgggccagtcattctgcgtctctgctttcttcctctgcttcagactgtcagctgtaaagtggaagcaatattacttgccttgtatatggtaaagattataaaaatacatttcaactgttcagcatagtacttcaaagcaagtactcagtaaatagcaagtctttttaaatgctgctttatttcactaaattttgttgtgaggtgtcactaaaatgcctgcaaacaaacgtaactgctaatctgagaggaaaccctcttactaatcagagaagaaaccctcctgtcagaaaccttcagggaagtgagctgatcacacctaaactgggagtttgcaatggggtatttgaagcactgtgggagtattccactggcccnctccctgagagacttaacagtcttccctgttgtccagattctgtataaggcaatcagaataatcatcttccttgttcagcagaggagcctggtcccattttccccactttgtgatgggcttctctcagcggtagctcagcagttccagatggcagtttggaccagcatctaggctggccagttcgctgtgtttacttagaaccaacacgttcagagctggcctggaccatctgaggggaacaggaaacacccctaggctgtggaagcaagtgcagacccccacccccggccctgaagccaagggggcagggtttgggagtggccaaagagaagcagtgcagggatgggttttcctagggacaggcttagcattcctgactctaggaagaaggagcagtgaggcggagaaacagtggaggggatggtggcattgggccccatggggccgagatggacacagggctcgttctcttgagtctggtgccaaggacagctgaagacgacatcattttcaggtggagaggagagagtggagggagatcatgccctgtgatgtgtcttttgcaggtgaaggtgggagacaaggtctctgctgacgatgaggcagagccaccgtgaaagttgtaataggaggactgcccgccgctggaagggcctgcagtgacgctaggacaccctctgcctgcatgtcacgttagctgggctgggcgaagtagaagaccaaggggaagaggtgcagtggggagaccaggtgggatgcaaccacaggaccagtggaggggctgtggcacgtgggcggagactgagtggctgggcatgtgttgtggctgagcatgtggtgtgggcagtggtcctagaccccgccatgtccggacaatgatatagagcgtctcagcatcgccagtctagactgtctatggagagcagaaagttgtctngggctgcctggggaactgtgaggccagctatatcaccgtcgctgatggtgacattacggtggtggcaggagcaaggagagagggaagaaggaccccgtccagctttagtcacaaaatacccaatggaagatgccagtgccaatcctgtgggtttccttgggacttcacactggctttcttatctgctccagatccattcagtagtcactgagttcctgccaaatactttgtagcgccagaagccaggagcggggtctgcagcagggcagtccccnttttcaggaaatgcctggagctgctggtccctgagagaaaggaaaacatctttcagccgtacgcaggccaagaaggccaatgtccagtagctttgtgattttttttatatttttttatttatttatttttgagatagagtcttgctctgtcgctcaggctggagtgcagtggcgtgatctccactcactgcaacttccgcctcctggggtcaagcagttctgcctcagcctcccgagtagctgggattacaggcacacgccaccacacccagctaatttttgtgtttttagtagagacggtttcaccatgtcggccaggctggtctcaaactcctgacctcagatgattcagcctcccaaagtgctgggattacaggtgtgagccactgcacccagcctgtgatgtttctgtggggttccacaaatgtgtgtgtgtgtaaaagctgatgattacagcaagaatgtgaacagtagcagttttccatttgaaggcaagttttgtctttatctgggtatcagaaggaccctctgggccattgtcgcttcctgtactcagagccaccctagtactacgggcacacacagaaaacagcagcctgcgtactttcaaaggaaaggcatctttaatcaccaatgcctggaaaaattattttgtttccctcttccttccgtcttgtttcctaacttcttaccaaagtttagagtctgagtttttcgtataataatgtcccacatccacacatcgggcctacagatgctctcccttgaatcgactggaaacatgacaccggttccatgctctggaactgtcacctgtgatgtgctgggctgtgtcccaagcacaggaatcccagcagtttcagctcgatgcagaaccaccatgctccagacacaggcttgggaaagacacgtcaaaattaaaatactaggtaagagaagcacctgattgggtagaagttggagaggaatcctggaattttgtggccagaaggagccactgccccttttgtttagtaagactagacagtaacagaagccagttgtcagctatgaaagtggtgggtgaagcaggggaggctcctctatggtgggaccctggacaagggaagccgaatgtgtgaagaaggggtgcgggggtgtgcggtgccctaggacactagggcaaaggtttcaaacctggaacaaggcactggaggaagatctgctgccagtcagcagtgcgggccctcgagttagcagtccgtgcgcagaggggccagttctgagaccagtttggagagtcaggcagtgacccattggccatgtcataattccttcagcctgcctcctctttaatcccagagagtgctctttcttcatacttcctttaaaatactaaattgttcccattccatggggagctggctaggctttacaggctaggaaatgtaggttttctgagatggaaccatctacacaaggaggaggaaggcactaagactacagatgagacccatgacagggctgagcatttggaagccaaccctggttgcttttcaagaattgctttgtggctgggtgcagtggttcacacctgtaattgcagcactttgggaggctgaggcaggtggattgcttgaacccaggagttcgagaccagcctgggcaacatatgggacaccccaccgcccccggctctgcaaaaaaattaaaaattagccaggcgtggtgtcatgagcctgtggtctcaactactcaggaggctgaggctggaggatcgcttgaacctgggaggtcaaggctccagtgaaccataattgtgccactgcactgcagcctgggcgacaatttgttttctaaattgcttttgaaagtctactgcattacatattccaaaaagcagtggttttcaaatacttttatcaccgatatccttttatgaaatgaaatcagtagaactttctctgctctgaataagcaagggtgggaacctgtctacctcccacagatagcataatgtgcctgccatagaggagccaaaaaatggtgatgggaactgagaggagagcaaatgtcacaaaagactgagcaattgagaaaacaaaacaagaccacagatgactgttaacgcctccacagtggaccaagaaaggacagagagctggcagcatgggcatcactgtctggtcggcagcaggaaggcctcgctagggaattgagtacagtcatctaactagtttaaaagtacaggaaggatgattaaggctattggagaggtcatacaaataggggaggggcaggcaatggctgataagacatgaatttgtaaggcgatgagtattgcagtcagcaaaacaaacgagactgctctcccaacacataactcagcagggaggccaggcattggtttaaccatttaatataaagaagttaaaattacaaatgcgctaagtgcctaaagaagaataagtgcaggaatgagagcagcatggactgccacagttttagaataagcactgtcactgctagattggaaacaaaaatccataaatttggcccggtgtggtggcggacgcctgtagtcccagctacttggaggctgaggcgtgagaatcgcttgaacccgggaggcggaggttgcagtgagccgagatggcgccactgcactccagcctgggcgtcagagtgagaactctgtatcaaaaaataaaaanaaaaaaaagtccataaatctgcaatgtctcagttaagaaagaaagactgggccaatgcagatttcaaaccggagaaagtcatactgtcagtgaaggccgcctgtggccggaaggcgccaggggattagcaccctggactcagtgttgctgggaaacagggccccaaggctgggagcacagtgtttaaagggcatctacccaagaagggagcacagggcaaggaggagctgcagggggncttggctgccaaagtgaattctgaggagagagctattgctgcctacgatatgcaggctgcacagaacacaagtggaatcagcaggcaggagaggcagctaacgacgcagcccgtttcttatttctgttttctcacaagcgatgaaagtggaaaagagggtgagcaggtggcccacacatgtgcctccagtgctgcggcccctccggggaccatcngccaggccccggggagggagccagccacagtgtgtccggctcttctctgaagggaagagagccttgaatagactgaagcgaagacggttctgcaaggacaaggcagaccgaaggcattggttttttttttcagataaggagaattagactcccaagtagacaccagagtcactgtttggttggtgggtgatagtggggtcacagtggctgcctgtgctcccccagggtgagcgtgactgtgctaacctgggtggggcagcatgcacacccctctggcagccctttgttgctcgctgatgacaagtttggatgatcccgccaaacagcttgctaagatgtagtccccagtgttggaggtggggcctgatgggaggtgctacccttgtgagataaggttgtgtaaaagcctgtggcacctccccacactgacgctctcacccctgctctggccatgtgccgcgcctgctcccacttccccttctgccaggagtaaaagcccccgagacctcccagaagccaagcagatgctagtgccatgcttcctctgcagcctgcagaactgtgagccaattaaacctcttttctctat

SEQ ID NO: 300105 - DNA, 11017 bp, Homo sapiens
  misc_feature (6069)..(6069): n is a, c, g, or t
  misc_feature (7007)..(7007): n is a, c, g, or t
  misc_feature (7282)..(7282): n is a, c, g, or t
  misc_feature (9975)..(9975): n is a, c, g, or t
  misc_feature (10213)..(10213): n is a, c, g, or t
  misc_feature (10428)..(10428): n is a, c, g, or t
gcgcccctccctccgcccgcccgccggcccgcccgtcagtctggcaggcaggcaggcaatcggtccgagtggctgtcggctcttcagctctcccgctcggcgtcttccttcctcctcccggtcagcgtcggcggctgcaccggcggcggcgcagtccctgcgggaggggcgacaagagctgagcggcggccgccgagcgtcgagctcagcgcggcggaggcggcggcggcccggcagccaacatggcggcggcggcggcggcgggcgcgggcccggagatggtccgcgggcaggtgttcgacgtggggccgcgctacaccaacctctcgtacatcggcgagggcgcctacggcatggtgtgctctgcttatgataatgtcaacaaagttcgagtagctatcaagaaaatcagcccctttgagcaccagacctactgccagagaaccctgagggagataaaaatcttactgcgcttcagacatgagaacatcattggaatcaatgacattattcgagcaccaaccatcgagcaaatgaaagatgtatatatagtacaggacctcatggaaacagatctttacaagctcttgaagacacaacacctcagcaatgaccatatctgctattttctctaccagatcctcagaggctgctgctcaacaccacctgtgatctcaagatctgtgactttggcctggcccgtgttgcagatccagaccatgatcacacagggttcctgacagaatatgtggccacacgttggtacagggctccagaaattatgttgaattccaagggctacaccaagtccattgatatttggtctgtaggctgcattctggcagaaatgctttctaacaggcccatctttccagggaagcattatcttgaccagctgaaccacattttgggtattcttggatccccatcacaagaagacctgaattgtataataaatttaaaagctaggaactatttgctttctcttccacacaaaaataaggtgccatggaacaggctgttcccaaatgctgactccaaagctctggacttattggacaaaatgttgacattcaacccacacaagaggattgaagtagaacaggctctggcccacccatatctggagcagtattacgacccgagtgacgagcccatcgccgaagcaccattcaagttcgacatggaattggatgacttgcctaaggaaaagctcaaagaactaatttttgaagagactgctagattccagccaggatacagatcttaaatttgtcaggacaagggctcagaggactggacgtgctcagacatcggtgttcttcttcccagttcttgacccctggtcctgtctccagcccgtcttggcttatccactttgactcctttgagccgtttggaggggcggtttctggtagttgtggcttttatgctttcaaagaatttcttcagtccagagaattcctcctggcagccctgtgtgtgtcacccattggtgacctgcggcagtatgtacttcagtgcacctactgcttactgttgctttagtcactaattgctttctggtttgaaagatgcagtggttcctccctctcctgaatccttttctacatgatgccctgctgaccatgcagccgcaccagagagagattcttccccaattggctctagtcactggcatctcactttatgatagggaaggctactacctagggcactttaagtcagtgacagccccttatttgcacttcaccttttgaccataactgtttccccagagcaggagcttgtggaaataccttggctgatgttgcagcctgcagcaagtgcttccgtctccggaatccttggggagcacttgtccacgtcttttctcatatcatggtagtcactaacatatataaggtatgtgctattggcccagcttttagaaaatgcagtcatttttctaaataaaaaggaagtactgcacccagcagtgtcactctgtagttactgtggtcacttgtaccatatagaggtgtaacacttgtcaagaagcgttatgtgcagtacttaatgtttgtaagacttacaaaaaaagatttaaagtggcagcttcactcgacatttggtgagagaagtacaaaggttgcagtgctgagctgtgggcggtttctggggatgtcccagggtggaactccacatgctggtgcatatacgcccttgagctacttcaaatgtgggtgtttcagtaaccacgttccatgcctgaggatttagcagagaggaacactgcgtctttaaatgagaaagtatacaattctttttccttctacagcatgtcagcatctcaagttcatttttcaacctacagtataacaatttgtaataaagcctccaggagctcatgacgtgaagcactgttctgtcctcaagtactcaaatatttctgatactgctgagtcagactgtcagaaaaagctagcactaactcgtgtttggagctctatccatattttactgatctctttaagtatttgttcctgccactgtgtactgtggagttgactcggtgttctgtcccagtgcggtgcctcctcttgacttccccactgctctctgtggtgagaaatttgccttgttcaataattactgtaccctcgcatgactgttacagctttctgtgcagagatgactgtccaagtgccacatgcctacgattgaaatgaaaactctattgttacctctgagttgtgttccacggaaaatgctatccagcagatcatttaggaaaaataattctatttttagcttttcatttctcagctgtccttttttcttgtttgatttttgacagcaatggagaatgggttatataaagactgcctgctaatatgaacagaaatgcatttgtaattcatgaaaataaatgtacatcttctatcttcacattcatgttaagattcagtgttgctttcctctggatcagcgtgtctgaatggacagtcaggttcaggttgtgctgaacacagaaatgctcacaggcctcactttgccgcccaggcactggcccagcacttggatttacataagatgagttagaaaggtacttctgtagggtcctttttacctctgctcggcagagaatcgatgctgtcatgttcctttattcacaatcttaggtctcaaatattctgtcaaaccctaacaaagaagccccgacatctcaggttggattccctggttctctctaaagagggcctgcccttgtgccccagaggtgctgctgggcacagccaagagttgggaagggccgccccacagtacgcagtcctcaccacccagcccagggtgctcacgctcaccactcctgtggctgaggaaggatagctggctcatcctcggaaaacagacccacatctctattcttgccctgaaatacgcgcttttcacttgcgtgctcagagctgccgtctgaaggtccacacagcattgacgggacacagaaatgtgactgttaccggataacactgattagtcagttttcatttataaaaaagcattgacagttttattactcttgtttctttttaaatggaaagttactattataaggttaatttgcagtcctcttctaaatagaaaaccatatccttggctactaacatctggagactgtgagctccttcccattccccttcctggtactgtggagtcagattggcatgaaaccactaacttcattctagaatcattgtagccataagttgtgtgctttttattaatcatgccaaacataatgtaactgggcagagaatggtcctaaccaaggtacctatgaaaagcgctagctatcatgtgtagtagatgcatcattttggctcttcttacatttgtaaaaatgtacagattaggtcatcttaattcatattagtgacacggaacagcacctccactatttgtatgttcaaataagctttcagactaatagcttttttggtgtctaaaatgtaagcaaaaaattcctgctgaaacattccagtcctttcatttagtataaaagaaatactgaacaagccagtgggatggaattgaaagaactaatcatgaggactctgtcctgacacaggtcctcaaagctagcagagatacgcagacattgtggcatctgggtagaagaatactgtattgtgtgtgcagtgcacagtgtgtggtgtgtgcacactcattccttctgctcttgggcacaggcagtgggtgtagaggtaaccagtagctttgagaagctacatgtagctcaccagtggttttctctaaggaatcacaaaggtaaactacccaaccacatgccacgtaatatttcagccattcagaggaaactgttttctctttatttgcttatatgttaatatggtttttaaattggtaacttttatatagtatggtaacagtatgttaatacacacatacatatgcacacatgctttgggtccttccataatacttttatatttgtaaatcaatgttttggagcaatcccaagtttaagggaaatatttttgtaaatgtaatggttttgaaaatctgagcaatccttttgcttatacatttttaaagcatttgtgctttaaaattgttatgctggtgtttgaaacatgatactcctgtggtgcagatgagaagctataacagtgaatatgtggtttctcttacgtcatccaccttgacatgatgggtcagaaacaaatggaaatccagagcaagtcctccagggttgcaccaggtttacctaaagcttgttgccttttcttgtgctgtttatccgtgtagagcactcaagaaagttctgaaactgctttgtatctgctttgtactgttggtgccttcttggtattgtaccccaaaattctgcatagattatttagtataatggtaagttaaaaaatgttaaaggaagattttattaagaatctgaatgtttattcattatattgttacaatttaacattaacatttatttgtggtatttgtgatttggttaatctgtataaaaattgtaagtagaaaggtttatatttcatcttaattcttttgatgttgtaaacgtactttttaaaagatggattatttgaatgtttatggcacctgacttgtaaaaaaaaaaaactacaaaaaaatccttagaatcattaaattgtgtccctgtattaccaaaataacacagcaccgtgcatgtatagtttaattgcagtttcatctgtgaaaacgtgaaattgtctagtccttcgttatgttccccagatgtcttccagatttgctctgcatgtggtaacttgtgttagggctgtgagctgttcctcgagttgaatggggatgtcagtgctcctagggttctccaggtggttcttcagaccttcacctgtgggggggggggtaggcggtgcccacgcccatctcctcatcctcctgaacttctgcaaccccactgctgggcagacatcctgggcaaccccttttttcagagcaagaagtcataaagataggatttcttggacatttggttcttatcaatattgggcattatgtaatgacttatttacaaaacaaagatactggaaaatgttttggatgtggtgttatggaaagagcacaggccttggacccatccagctgggttcagaactaccccctgcttataactgcggctggctgtgggccagtcattctgcgtctctgctttcttcctctgcttcagactgtcagctgtaaagtggaagcaatattacttgccttgtatatggtaaagattataaaaatacatttcaactgttcagcatagtacttcaaagcaagtactcagtaaatagcaagtctttttaaatgctgctttatttcactaaattttgttgtgaggtgtcactaaaatgcctgcaaacaaacgtaactgctaatctgagaggaaaccctcttactaatcagagaagaaaccctcctgtcagaaaccttcagggaagtgagctgatcacacctaaactgggagtttgcaatggggtatttgaagcactgtgggagtattccactggcccnctccctgagagacttaacagtcttccctgttgtccagattctgtataaggcaatcagaataatcatcttccttgttcagcagaggagcctggtcccattttccccactttgtgatgggcttctctcagcggtagctcagcagttccagatggcagtttggaccagcatctaggctggccagttcgctgtgtttacttagaaccaacacgttcagagctggcctggaccatctgaggggaacaggaaacacccctaggctgtggaagcaagtgcagacccccacccccggccctgaagccaagggggcagggtttgggagtggccaaagagaagcagtgcagggatgggttttcctagggacaggcttagcattcctgactctaggaagaaggagcagtgaggcggagaaacagtggaggggatggtggcattgggccccatggggccgagatggacacagggctcgttctcttgagtctggtgccaaggacagctgaagacgacatcattttcaggtggagaggagagagtggagggagatcatgccctgtgatgtgtcttttgcaggtgaaggtgggagacaaggtctctgctgacgatgaggcagagccaccgtgaaagttgtaataggaggactgcccgccgctggaagggcctgcagtgacgctaggacaccctctgcctgcatgtcacgttagctgggctgggcgaagtagaagaccaaggggaagaggtgcagtggggagaccaggtgggatgcaaccacaggaccagtggaggggctgtggcacgtgggcggagactgagtggctgggcatgtgttgtggctgagcatgtggtgtgggcagtggtcctagaccccgccatgtccggacaatgatatagagcgtctcagcatcgccagtctagactgtctatggagagcagaaagttgtctngggctgcctggggaactgtgaggccagctatatcaccgtcgctgatggtgacattacggtggtggcaggagcaaggagagagggaagaaggaccccgtccagctttagtcacaaaatacccaatggaagatgccagtgccaatcctgtgggtttccttgggacttcacactggctttcttatctgctccagatccattcagtagtcactgagttcctgccaaatactttgtagcgccagaagccaggagcggggtctgcagcagggcagtccccnttttcaggaaatgcctggagctgctggtccctgagagaaaggaaaacatctttcagccgtacgcaggccaagaaggccaatgtccagtagctttgtgattttttttatatttttttatttatttatttttgagatagagtcttgctctgtcgctcaggctggagtgcagtggcgtgatctccactcactgcaacttccgcctcctggggtcaagcagttctgcctcagcctcccgagtagctgggattacaggcacacgccaccacacccagctaatttttgtgtttttagtagagacggtttcaccatgtcggccaggctggtctcaaactcctgacctcagatgattcagcctcccaaagtgctgggattacaggtgtgagccactgcacccagcctgtgatgtttctgtggggttccacaaatgtgtgtgtgtgtaaaagctgatgattacagcaagaatgtgaacagtagcagttttccatttgaaggcaagttttgtctttatctgggtatcagaaggaccctctgggccattgtcgcttcctgtactcagagccaccctagtactacgggcacacacagaaaacagcagcctgcgtactttcaaaggaaaggcatctttaatcaccaatgcctggaaaaattattttgtttccctcttccttccgtcttgtttcctaacttcttaccaaagtttagagtctgagtttttcgtataataatgtcccacatccacacatcgggcctacagatgctctcccttgaatcgactggaaacatgacaccggttccatgctctggaactgtcacctgtgatgtgctgggctgtgtcccaagcacaggaatcccagcagtttcagctcgatgcagaaccaccatgctccagacacaggcttgggaaagacacgtcaaaattaaaatactaggtaagagaagcacctgattgggtagaagttggagaggaatcctggaattttgtggccagaaggagccactgccccttttgtttagtaagactagacagtaacagaagccagttgtcagctatgaaagtggtgggtgaagcaggggaggctcctctatggtgggaccctggacaagggaagccgaatgtgtgaagaaggggtgcgggggtgtgcggtgccctaggacactagggcaaaggtttcaaacctggaacaaggcactggaggaagatctgctgccagtcagcagtgcgggccctcgagttagcagtccgtgcgcagaggggccagttctgagaccagtttggagagtcaggcagtgacccattggccatgtcataattccttcagcctgcctcctctttaatcccagagagtgctctttcttcatacttcctttaaaatactaaattgttcccattccatggggagctggctaggctttacaggctaggaaatgtaggttttctgagatggaaccatctacacaaggaggaggaaggcactaagactacagatgagacccatgacagggctgagcatttggaagccaaccctggttgcttttcaagaattgctttgtggctgggtgcagtggttcacacctgtaattgcagcactttgggaggctgaggcaggtggattgcttgaacccaggagttcgagaccagcctgggcaacatatgggacaccccaccgcccccggctctgcaaaaaaattaaaaattagccaggcgtggtgtcatgagcctgtggtctcaactactcaggaggctgaggctggaggatcgcttgaacctgggaggtcaaggctccagtgaaccataattgtgccactgcactgcagcctgggcgacaatttgttttctaaattgcttttgaaagtctactgcattacatattccaaaaagcagtggttttcaaatacttttatcaccgatatccttttatgaaatgaaatcagtagaactttctctgctctgaataagcaagggtgggaacctgtctacctcccacagatagcataatgtgcctgccatagaggagccaaaaaatggtgatgggaactgagaggagagcaaatgtcacaaaagactgagcaattgagaaaacaaaacaagaccacagatgactgttaacgcctccacagtggaccaagaaaggacagagagctggcagcatgggcatcactgtctggtcggcagcaggaaggcctcgctagggaattgagtacagtcatctaactagtttaaaagtacaggaaggatgattaaggctattggagaggtcatacaaataggggaggggcaggcaatggctgataagacatgaatttgtaaggcgatgagtattgcagtcagcaaaacaaacgagactgctctcccaacacataactcagcagggaggccaggcattggtttaaccatttaatataaagaagttaaaattacaaatgcgctaagtgcctaaagaagaataagtgcaggaatgagagcagcatggactgccacagttttagaataagcactgtcactgctagattggaaacaaaaatccataaatttggcccggtgtggtggcggacgcctgtagtcccagctacttggaggctgaggcgtgagaatcgcttgaacccgggaggcggaggttgcagtgagccgagatggcgccactgcactccagcctgggcgtcagagtgagaactctgtatcaaaaaataaaaanaaaaaaaagtccataaatctgcaatgtctcagttaagaaagaaagactgggccaatgcagatttcaaaccggagaaagtcatactgtcagtgaaggccgcctgtggccggaaggcgccaggggattagcaccctggactcagtgttgctgggaaacagggccccaaggctgggagcacagtgtttaaagggcatctacccaagaagggagcacagggcaaggaggagctgcagggggncttggctgccaaagtgaattctgaggagagagctattgctgcctacgatatgcaggctgcacagaacacaagtggaatcagcaggcaggagaggcagctaacgacgcagcccgtttcttatttctgttttctcacaagcgatgaaagtggaaaagagggtgagcaggtggcccacacatgtgcctccagtgctgcggcccctccggggaccatcngccaggccccggggagggagccagccacagtgtgtccggctcttctctgaagggaagagagccttgaatagactgaagcgaagacggttctgcaaggacaaggcagaccgaaggcattggttttttttttcagataaggagaattagactcccaagtagacaccagagtcactgtttggttggtgggtgatagtggggtcacagtggctgcctgtgctcccccagggtgagcgtgactgtgctaacctgggtggggcagcatgcacacccctctggcagccctttgttgctcgctgatgacaagtttggatgatcccgccaaacagcttgctaagatgtagtccccagtgttggaggtggggcctgatgggaggtgctacccttgtgagataaggttgtgtaaaagcctgtggcacctccccacactgacgctctcacccctgctctggccatgtgccgcgcctgctcccacttccccttctgccaggagtaaaagcccccgagacctcccagaagccaagcagatgctagtgccatgcttcctctgcagcctgcagaactgtgagccaattaaacctcttttctctat

SEQ ID NO: 300106 - DNA, 11107 bp, Homo sapiens
  misc_feature (6159)..(6159): n is a, c, g, or t
  misc_feature (7097)..(7097): n is a, c, g, or t
  misc_feature (7372)..(7372): n is a, c, g, or t
  misc_feature (10065)..(10065): n is a, c, g, or t
  misc_feature (10303)..(10303): n is a, c, g, or t
  misc_feature (10518)..(10518): n is a, c, g, or t
acataatttctggagccctgtaccaacgtgtggccacatattctgtcaggaaccctgtgtgatcatggtctggatctgcaacacgggccaggccaaagtcacagatcttgagatcacaggtggtgttgagcagcaggcaggcaggcaatcggtccgagtggctgtcggctcttcagctctcccgctcggcgtcttccttcctcctcccggtcagcgtcggcggctgcaccggcggcggcgcagtccctgcgggaggggcgacaagagctgagcggcggccgccgagcgtcgagctcagcgcggcggaggcggcggcggcccggcagccaacatggcggcggcggcggcggcgggcgcgggcccggagatggtccgcgggcaggtgttcgacgtggggccgcgctacaccaacctctcgtacatcggcgagggcgcctacggcatggtgtgctctgcttatgataatgtcaacaaagttcgagtagctatcaagaaaatcagcccctttgagcaccagacctactgccagagaaccctgagggagataaaaatcttactgcgcttcagacatgagaacatcattggaatcaatgacattattcgagcaccaaccatcgagcaaatgaaagatgtatatatagtacaggacctcatggaaacagatctttacaagctcttgaagacacaacacctcagcaatgaccatatctgctattttctctaccagatcctcagagggttaaaatatatccattcagctaacgttctgcaccgtgacctcaagccttccaacctgctgctcaacaccacctgtgatctcaagatctgtgactttggcctggcccgtgttgcagatccagaccatgatcacacagggttcctgacagaatatgtggccacacgttggtacagggctccagaaattatgttgaattccaagggctacaccaagtccattgatatttggtctgtaggctgcattctggcagaaatgctttctaacaggcccatctttccagggaagcattatcttgaccagctgaaccacattttgggtattcttggatccccatcacaagaagacctgaattgtataataaatttaaaagctaggaactatttgctttctcttccacacaaaaataaggtgccatggaacaggctgttcccaaatgctgactccaaagctctggacttattggacaaaatgttgacattcaacccacacaagaggattgaagtagaacaggctctggcccacccatatctggagcagtattacgacccgagtgacgagcccatcgccgaagcaccattcaagttcgacatggaattggatgacttgcctaaggaaaagctcaaagaactaatttttgaagagactgctagattccagccaggatacagatcttaaatttgtcaggacaagggctcagaggactggacgtgctcagacatcggtgttcttcttcccagttcttgacccctggtcctgtctccagcccgtcttggcttatccactttgactcctttgagccgtttggaggggcggtttctggtagttgtggcttttatgctttcaaagaatttcttcagtccagagaattcctcctggcagccctgtgtgtgtcacccattggtgacctgcggcagtatgtacttcagtgcacctactgcttactgttgctttagtcactaattgctttctggtttgaaagatgcagtggttcctccctctcctgaatccttttctacatgatgccctgctgaccatgcagccgcaccagagagagattcttccccaattggctctagtcactggcatctcactttatgatagggaaggctactacctagggcactttaagtcagtgacagccccttatttgcacttcaccttttgaccataactgtttccccagagcaggagcttgtggaaataccttggctgatgttgcagcctgcagcaagtgcttccgtctccggaatccttggggagcacttgtccacgtcttttctcatatcatggtagtcactaacatatataaggtatgtgctattggcccagcttttagaaaatgcagtcatttttctaaataaaaaggaagtactgcacccagcagtgtcactctgtagttactgtggtcacttgtaccatatagaggtgtaacacttgtcaagaagcgttatgtgcagtacttaatgtttgtaagacttacaaaaaaagatttaaagtggcagcttcactcgacatttggtgagagaagtacaaaggttgcagtgctgagctgtgggcggtttctggggatgtcccagggtggaactccacatgctggtgcatatacgcccttgagctacttcaaatgtgggtgtttcagtaaccacgttccatgcctgaggatttagcagagaggaacactgcgtctttaaatgagaaagtatacaattctttttccttctacagcatgtcagcatctcaagttcatttttcaacctacagtataacaatttgtaataaagcctccaggagctcatgacgtgaagcactgttctgtcctcaagtactcaaatatttctgatactgctgagtcagactgtcagaaaaagctagcactaactcgtgtttggagctctatccatattttactgatctctttaagtatttgttcctgccactgtgtactgtggagttgactcggtgttctgtcccagtgcggtgcctcctcttgacttccccactgctctctgtggtgagaaatttgccttgttcaataattactgtaccctcgcatgactgttacagctttctgtgcagagatgactgtccaagtgccacatgcctacgattgaaatgaaaactctattgttacctctgagttgtgttccacggaaaatgctatccagcagatcatttaggaaaaataattctatttttagcttttcatttctcagctgtccttttttcttgtttgatttttgacagcaatggagaatgggttatataaagactgcctgctaatatgaacagaaatgcatttgtaattcatgtcctctggatcagcgtgtctgaatggacagtcaggttcaggttgtgctgaacacagaaatgctcacaggcctcactttgccgcccaggcactggcccagcacttggatttacataagatgagttagaaaggtacttctgtagggtcctttttacctctgctcggcagagaatcgatgctgtcatgttcctttattcacaatcttaggtctcaaatattctgtcaaaccctaacaaagaagccccgacatctcaggttggattccctggttctctctaaagagggcctgcccttgtgccccagaggtgctgctgggcacagccaagagttgggaagggccgccccacagtacgcagtcctcaccacccagcccagggtgctcacgctcaccactcctgtggctgaggaaggatagctggctcatcctcggaaaacagacccacatctctattcttgccctgaaatacgcgcttttcacttgcgtgctcagagctgccgtctgaaggtccacacagcattgacgggacacagaaatgtgactgttaccggataacactgattagtcagttttcatttataaaaaagcattgacagttttattactcttgtttctttttaaatggaaagttactattataaggttaatttgcagtcctcttctaaatagaaaaccatatccttggctactaacatctggagactgtgagctccttcccattccccttcctggtactgtggagtcagattggcatgaaaccactaacttcattctagaatcattgtagccataagttgtgtgctttttattaatcatgccaaacataatgtaactgggcagagaatggtcctaaccaaggtacctatgaaaagcgctagctatcatgtgtagtagatgcatcattttggctcttcttacatttgtaaaaatgtacagattaggtcatcttaattcatattagtgacacggaacagcacctccactatttgtatgttcaaataagctttcagactaatagcttttttggtgtctaaaatgtaagcaaaaaattcctgctgaaacattccagtcctttcatttagtataaaagaaatactgaacaagccagtgggatggaattgaaagaactaatcatgaggactctgtcctgacacaggtcctcaaagctagcagagatacgcagacattgtggcatctgggtagaagaatactgtattgtgtgtgcagtgcacagtgtgtggtgtgtgcacactcattccttctgctcttgggcacaggcagtgggtgtagaggtaaccagtagctttgagaagctacatgtagctcaccagtggttttctctaaggaatcacaaaggtaaactacccaaccacatgccacgtaatatttcagccattcagaggaaactgttttctctttatttgcttatatgttaatatggtttttaaattggtaacttttatatagtatggtaacagtatgttaatacacacatacatatgcacacatgctttgggtccttccataatacttttatatttgtaaatcaatgttttggagcaatcccaagtttaagggaaatatttttgtaaatgtaatggttttgaaaatctgagcaatccttttgcttatacatttttaaagcatttgtgctttaaaattgttatgctggtgtttgaaacatgatactcctgtggtgcagatgagaagctataacagtgaatatgtggtttctcttacgtcatccaccttgacatgatgggtcagaaacaaatggaaatccagagcaagtcctccagggttgcaccaggtttacctaaagcttgttgccttttcttgtgctgtttatccgtgtagagcactcaagaaagttctgaaactgctttgtatctgctttgtactgttggtgccttcttggtattgtaccccaaaattctgcatagattatttagtataatggtaagttaaaaaatgttaaaggaagattttattaagaatctgaatgtttattcattatattgttacaatttaacattaacatttatttgtggtatttgtgatttggttaatctgtataaaaattgtaagtagaaaggtttatatttcatcttaattcttttgatgttgtaaacgtactttttaaaagatggattatttgaatgtttatggcacctgacttgtaaaaaaaaaaaactacaaaaaaatccttagaatcattaaattgtgtccctgtattaccaaaataacacagcaccgtgcatgtatagtttaattgcagtttcatctgtgaaaacgtgaaattgtctagtccttcgttatgttccccagatgtcttccagatttgctctgcatgtggtaacttgtgttagggctgtgagctgttcctcgagttgaatggggatgtcagtgctcctagggttctccaggtggttcttcagaccttcacctgtgggggggggggtaggcggtgcccacgcccatctcctcatcctcctgaacttctgcaaccccactgctgggcagacatcctgggcaaccccttttttcagagcaagaagtcataaagataggatttcttggacatttggttcttatcaatattgggcattatgtaatgacttatttacaaaacaaagatactggaaaatgttttggatgtggtgttatggaaagagcacaggccttggacccatccagctgggttcagaactaccccctgcttataactgcggctggctgtgggccagtcattctgcgtctctgctttcttcctctgcttcagactgtcagctgtaaagtggaagcaatattacttgccttgtatatggtaaagattataaaaatacatttcaactgttcagcatagtacttcaaagcaagtactcagtaaatagcaagtctttttaaatgctgctttatttcactaaattttgttgtgaggtgtcactaaaatgcctgcaaacaaacgtaactgctaatctgagaggaaaccctcttactaatcagagaagaaaccctcctgtcagaaaccttcagggaagtgagctgatcacacctaaactgggagtttgcaatggggtatttgaagcactgtgggagtattccactggcccnctccctgagagacttaacagtcttccctgttgtccagattctgtataaggcaatcagaataatcatcttccttgttcagcagaggagcctggtcccattttccccactttgtgatgggcttctctcagcggtagctcagcagttccagatggcagtttggaccagcatctaggctggccagttcgctgtgtttacttagaaccaacacgttcagagctggcctggaccatctgaggggaacaggaaacacccctaggctgtggaagcaagtgcagacccccacccccggccctgaagccaagggggcagggtttgggagtggccaaagagaagcagtgcagggatgggttttcctagggacaggcttagcattcctgactctaggaagaaggagcagtgaggcggagaaacagtggaggggatggtggcattgggccccatggggccgagatggacacagggctcgttctcttgagtctggtgccaaggacagctgaagacgacatcattttcaggtggagaggagagagtggagggagatcatgccctgtgatgtgtcttttgcaggtgaaggtgggagacaaggtctctgctgacgatgaggcagagccaccgtgaaagttgtaataggaggactgcccgccgctggaagggcctgcagtgacgctaggacaccctctgcctgcatgtcacgttagctgggctgggcgaagtagaagaccaaggggaagaggtgcagtggggagaccaggtgggatgcaaccacaggaccagtggaggggctgtggcacgtgggcggagactgagtggctgggcatgtgttgtggctgagcatgtggtgtgggcagtggtcctagaccccgccatgtccggacaatgatatagagcgtctcagcatcgccagtctagactgtctatggagagcagaaagttgtctngggctgcctggggaactgtgaggccagctatatcaccgtcgctgatggtgacattacggtggtggcaggagcaaggagagagggaagaaggaccccgtccagctttagtcacaaaatacccaatggaagatgccagtgccaatcctgtgggtttccttgggacttcacactggctttcttatctgctccagatccattcagtagtcactgagttcctgccaaatactttgtagcgccagaagccaggagcggggtctgcagcagggcagtccccnttttcaggaaatgcctggagctgctggtccctgagagaaaggaaaacatctttcagccgtacgcaggccaagaaggccaatgtccagtagctttgtgattttttttatatttttttatttatttatttttgagatagagtcttgctctgtcgctcaggctggagtgcagtggcgtgatctccactcactgcaacttccgcctcctggggtcaagcagttctgcctcagcctcccgagtagctgggattacaggcacacgccaccacacccagctaatttttgtgtttttagtagagacggtttcaccatgtcggccaggctggtctcaaactcctgacctcagatgattcagcctcccaaagtgctgggattacaggtgtgagccactgcacccagcctgtgatgtttctgtggggttccacaaatgtgtgtgtgtgtaaaagctgatgattacagcaagaatgtgaacagtagcagttttccatttgaaggcaagttttgtctttatctgggtatcagaaggaccctctgggccattgtcgcttcctgtactcagagccaccctagtactacgggcacacacagaaaacagcagcctgcgtactttcaaaggaaaggcatctttaatcaccaatgcctggaaaaattattttgtttccctcttccttccgtcttgtttcctaacttcttaccaaagtttagagtctgagtttttcgtataataatgtcccacatccacacatcgggcctacagatgctctcccttgaatcgactggaaacatgacaccggttccatgctctggaactgtcacctgtgatgtgctgggctgtgtcccaagcacaggaatcccagcagtttcagctcgatgcagaaccaccatgctccagacacaggcttgggaaagacacgtcaaaattaaaatactaggtaagagaagcacctgattgggtagaagttggagaggaatcctggaattttgtggccagaaggagccactgccccttttgtttagtaagactagacagtaacagaagccagttgtcagctatgaaagtggtgggtgaagcaggggaggctcctctatggtgggaccctggacaagggaagccgaatgtgtgaagaaggggtgcgggggtgtgcggtgccctaggacactagggcaaaggtttcaaacctggaacaaggcactggaggaagatctgctgccagtcagcagtgcgggccctcgagttagcagtccgtgcgcagaggggccagttctgagaccagtttggagagtcaggcagtgacccattggccatgtcataattccttcagcctgcctcctctttaatcccagagagtgctctttcttcatacttcctttaaaatactaaattgttcccattccatggggagctggctaggctttacaggctaggaaatgtaggttttctgagatggaaccatctacacaaggaggaggaaggcactaagactacagatgagacccatgacagggctgagcatttggaagccaaccctggttgcttttcaagaattgctttgtggctgggtgcagtggttcacacctgtaattgcagcactttgggaggctgaggcaggtggattgcttgaacccaggagttcgagaccagcctgggcaacatatgggacaccccaccgcccccggctctgcaaaaaaattaaaaattagccaggcgtggtgtcatgagcctgtggtctcaactactcaggaggctgaggctggaggatcgcttgaacctgggaggtcaaggctccagtgaaccataattgtgccactgcactgcagcctgggcgacaatttgttttctaaattgcttttgaaagtctactgcattacatattccaaaaagcagtggttttcaaatacttttatcaccgatatccttttatgaaatgaaatcagtagaactttctctgctctgaataagcaagggtgggaacctgtctacctcccacagatagcataatgtgcctgccatagaggagccaaaaaatggtgatgggaactgagaggagagcaaatgtcacaaaagactgagcaattgagaaaacaaaacaagaccacagatgactgttaacgcctccacagtggaccaagaaaggacagagagctggcagcatgggcatcactgtctggtcggcagcaggaaggcctcgctagggaattgagtacagtcatctaactagtttaaaagtacaggaaggatgattaaggctattggagaggtcatacaaataggggaggggcaggcaatggctgataagacatgaatttgtaaggcgatgagtattgcagtcagcaaaacaaacgagactgctctcccaacacataactcagcagggaggccaggcattggtttaaccatttaatataaagaagttaaaattacaaatgcgctaagtgcctaaagaagaataagtgcaggaatgagagcagcatggactgccacagttttagaataagcactgtcactgctagattggaaacaaaaatccataaatttggcccggtgtggtggcggacgcctgtagtcccagctacttggaggctgaggcgtgagaatcgcttgaacccgggaggcggaggttgcagtgagccgagatggcgccactgcactccagcctgggcgtcagagtgagaactctgtatcaaaaaataaaaanaaaaaaaagtccataaatctgcaatgtctcagttaagaaagaaagactgggccaatgcagatttcaaaccggagaaagtcatactgtcagtgaaggccgcctgtggccggaaggcgccaggggattagcaccctggactcagtgttgctgggaaacagggccccaaggctgggagcacagtgtttaaagggcatctacccaagaagggagcacagggcaaggaggagctgcagggggncttggctgccaaagtgaattctgaggagagagctattgctgcctacgatatgcaggctgcacagaacacaagtggaatcagcaggcaggagaggcagctaacgacgcagcccgtttcttatttctgttttctcacaagcgatgaaagtggaaaagagggtgagcaggtggcccacacatgtgcctccagtgctgcggcccctccggggaccatcngccaggccccggggagggagccagccacagtgtgtccggctcttctctgaagggaagagagccttgaatagactgaagcgaagacggttctgcaaggacaaggcagaccgaaggcattggttttttttttcagataaggagaattagactcccaagtagacaccagagtcactgtttggttggtgggtgatagtggggtcacagtggctgcctgtgctcccccagggtgagcgtgactgtgctaacctgggtggggcagcatgcacacccctctggcagccctttgttgctcgctgatgacaagtttggatgatcccgccaaacagcttgctaagatgtagtccccagtgttggaggtggggcctgatgggaggtgctacccttgtgagataaggttgtgtaaaagcctgtggcacctccccacactgacgctctcacccctgctctggccatgtgccgcgcctgctcccacttccccttctgccaggagtaaaagcccccgagacctcccagaagccaagcagatgctagtgccatgcttcctctgcagcctgcagaactgtgagccaattaaacctcttttctctat

SEQ ID NO: 300107 - DNA, 10262 bp, Homo sapiens
  misc_feature (5314)..(5314): n is a, c, g, or t
  misc_feature (6252)..(6252): n is a, c, g, or t
  misc_feature (6527)..(6527): n is a, c, g, or t
  misc_feature (9220)..(9220): n is a, c, g, or t
  misc_feature (9458)..(9458): n is a, c, g, or t
  misc_feature (9673)..(9673): n is a, c, g, or t
tctcaaaaaaaaaaaaaaaaaaaaaaaaaagaaatgatcattgtcagaaaagacgcttcattaagtagtgccagtgtttttgtttgcggtctgcaattgtcagatggtcggtccctatgttcacagtctcgggaggcttggagatatagtcagcaccctttgtgctggctgctctctctgtagtcatgcttagctcagttgttttgtgggtaagttacttaaacaggaaattgaagtatttctgtgactacttctgctctcactactgcaaaacctttctctttatagctctggacttattggacaaaatgttgacattcaacccacacaagaggattgaagtagaacaggctctggcccacccatatctggagcagtattacgacccgagtgacgagcccatcgccgaagcaccattcaagttcgacatggaattggatgacttgcctaaggaaaagctcaaagaactaatttttgaagagactgctagattccagccaggatacagatcttaaatttgtcaggacaagggctcagaggactggacgtgctcagacatcggtgttcttcttcccagttcttgacccctggtcctgtctccagcccgtcttggcttatccactttgactcctttgagccgtttggaggggcggtttctggtagttgtggcttttatgctttcaaagaatttcttcagtccagagaattcctcctggcagccctgtgtgtgtcacccattggtgacctgcggcagtatgtacttcagtgcacctactgcttactgttgctttagtcactaattgctttctggtttgaaagatgcagtggttcctccctctcctgaatccttttctacatgatgccctgctgaccatgcagccgcaccagagagagattcttccccaattggctctagtcactggcatctcactttatgatagggaaggctactacctagggcactttaagtcagtgacagccccttatttgcacttcaccttttgaccataactgtttccccagagcaggagcttgtggaaataccttggctgatgttgcagcctgcagcaagtgcttccgtctccggaatccttggggagcacttgtccacgtcttttctcatatcatggtagtcactaacatatataaggtatgtgctattggcccagcttttagaaaatgcagtcatttttctaaataaaaaggaagtactgcacccagcagtgtcactctgtagttactgtggtcacttgtaccatatagaggtgtaacacttgtcaagaagcgttatgtgcagtacttaatgtttgtaagacttacaaaaaaagatttaaagtggcagcttcactcgacatttggtgagagaagtacaaaggttgcagtgctgagctgtgggcggtttctggggatgtcccagggtggaactccacatgctggtgcatatacgcccttgagctacttcaaatgtgggtgtttcagtaaccacgttccatgcctgaggatttagcagagaggaacactgcgtctttaaatgagaaagtatacaattctttttccttctacagcatgtcagcatctcaagttcatttttcaacctacagtataacaatttgtaataaagcctccaggagctcatgacgtgaagcactgttctgtcctcaagtactcaaatatttctgatactgctgagtcagactgtcagaaaaagctagcactaactcgtgtttggagctctatccatattttactgatctctttaagtatttgttcctgccactgtgtactgtggagttgactcggtgttctgtcccagtgcggtgcctcctcttgacttccccactgctctctgtggtgagaaatttgccttgttcaataattactgtaccctcgcatgactgttacagctttctgtgcagagatgactgtccaagtgccacatgcctacgattgaaatgaaaactctattgttacctctgagttgtgttccacggaaaatgctatccagcagatcatttaggaaaaataattctatttttagcttttcatttctcagctgtccttttttcttgtttgatttttgacagcaatggagaatgggttatataaagactgcctgctaatatgaacagaaatgcatttgtaattcatgaaaataaatgtacatcttctatcttcacattcatgttaagattcagtgttgctttcctctggatcagcgtgtctgaatggacagtcaggttcaggttgtgctgaacacagaaatgctcacaggcctcactttgccgcccaggcactggcccagcacttggatttacataagatgagttagaaaggtacttctgtagggtcctttttacctctgctcggcagagaatcgatgctgtcatgttcctttattcacaatcttaggtctcaaatattctgtcaaaccctaacaaagaagccccgacatctcaggttggattccctggttctctctaaagagggcctgcccttgtgccccagaggtgctgctgggcacagccaagagttgggaagggccgccccacagtacgcagtcctcaccacccagcccagggtgctcacgctcaccactcctgtggctgaggaaggatagctggctcatcctcggaaaacagacccacatctctattcttgccctgaaatacgcgcttttcacttgcgtgctcagagctgccgtctgaaggtccacacagcattgacgggacacagaaatgtgactgttaccggataacactgattagtcagttttcatttataaaaaagcattgacagttttattactcttgtttctttttaaatggaaagttactattataaggttaatttgcagtcctcttctaaatagaaaaccatatccttggctactaacatctggagactgtgagctccttcccattccccttcctggtactgtggagtcagattggcatgaaaccactaacttcattctagaatcattgtagccataagttgtgtgctttttattaatcatgccaaacataatgtaactgggcagagaatggtcctaaccaaggtacctatgaaaagcgctagctatcatgtgtagtagatgcatcattttggctcttcttacatttgtaaaaatgtacagattaggtcatcttaattcatattagtgacacggaacagcacctccactatttgtatgttcaaataagctttcagactaatagcttttttggtgtctaaaatgtaagcaaaaaattcctgctgaaacattccagtcctttcatttagtataaaagaaatactgaacaagccagtgggatggaattgaaagaactaatcatgaggactctgtcctgacacaggtcctcaaagctagcagagatacgcagacattgtggcatctgggtagaagaatactgtattgtgtgtgcagtgcacagtgtgtggtgtgtgcacactcattccttctgctcttgggcacaggcagtgggtgtagaggtaaccagtagctttgagaagctacatgtagctcaccagtggttttctctaaggaatcacaaaggtaaactacccaaccacatgccacgtaatatttcagccattcagaggaaactgttttctctttatttgcttatatgttaatatggtttttaaattggtaacttttatatagtatggtaacagtatgttaatacacacatacatatgcacacatgctttgggtccttccataatacttttatatttgtaaatcaatgttttggagcaatcccaagtttaagggaaatatttttgtaaatgtaatggttttgaaaatctgagcaatccttttgcttatacatttttaaagcatttgtgctttaaaattgttatgctggtgtttgaaacatgatactcctgtggtgcagatgagaagctataacagtgaatatgtggtttctcttacgtcatccaccttgacatgatgggtcagaaacaaatggaaatccagagcaagtcctccagggttgcaccaggtttacctaaagcttgttgccttttcttgtgctgtttatccgtgtagagcactcaagaaagttctgaaactgctttgtatctgctttgtactgttggtgccttcttggtattgtaccccaaaattctgcatagattatttagtataatggtaagttaaaaaatgttaaaggaagattttattaagaatctgaatgtttattcattatattgttacaatttaacattaacatttatttgtggtatttgtgatttggttaatctgtataaaaattgtaagtagaaaggtttatatttcatcttaattcttttgatgttgtaaacgtactttttaaaagatggattatttgaatgtttatggcacctgacttgtaaaaaaaaaaaactacaaaaaaatccttagaatcattaaattgtgtccctgtattaccaaaataacacagcaccgtgcatgtatagtttaattgcagtttcatctgtgaaaacgtgaaattgtctagtccttcgttatgttccccagatgtcttccagatttgctctgcatgtggtaacttgtgttagggctgtgagctgttcctcgagttgaatggggatgtcagtgctcctagggttctccaggtggttcttcagaccttcacctgtgggggggggggtaggcggtgcccacgcccatctcctcatcctcctgaacttctgcaaccccactgctgggcagacatcctgggcaaccccttttttcagagcaagaagtcataaagataggatttcttggacatttggttcttatcaatattgggcattatgtaatgacttatttacaaaacaaagatactggaaaatgttttggatgtggtgttatggaaagagcacaggccttggacccatccagctgggttcagaactaccccctgcttataactgcggctggctgtgggccagtcattctgcgtctctgctttcttcctctgcttcagactgtcagctgtaaagtggaagcaatattacttgccttgtatatggtaaagattataaaaatacatttcaactgttcagcatagtacttcaaagcaagtactcagtaaatagcaagtctttttaaatgctgctttatttcactaaattttgttgtgaggtgtcactaaaatgcctgcaaacaaacgtaactgctaatctgagaggaaaccctcttactaatcagagaagaaaccctcctgtcagaaaccttcagggaagtgagctgatcacacctaaactgggagtttgcaatggggtatttgaagcactgtgggagtattccactggcccnctccctgagagacttaacagtcttccctgttgtccagattctgtataaggcaatcagaataatcatcttccttgttcagcagaggagcctggtcccattttccccactttgtgatgggcttctctcagcggtagctcagcagttccagatggcagtttggaccagcatctaggctggccagttcgctgtgtttacttagaaccaacacgttcagagctggcctggaccatctgaggggaacaggaaacacccctaggctgtggaagcaagtgcagacccccacccccggccctgaagccaagggggcagggtttgggagtggccaaagagaagcagtgcagggatgggttttcctagggacaggcttagcattcctgactctaggaagaaggagcagtgaggcggagaaacagtggaggggatggtggcattgggccccatggggccgagatggacacagggctcgttctcttgagtctggtgccaaggacagctgaagacgacatcattttcaggtggagaggagagagtggagggagatcatgccctgtgatgtgtcttttgcaggtgaaggtgggagacaaggtctctgctgacgatgaggcagagccaccgtgaaagttgtaataggaggactgcccgccgctggaagggcctgcagtgacgctaggacaccctctgcctgcatgtcacgttagctgggctgggcgaagtagaagaccaaggggaagaggtgcagtggggagaccaggtgggatgcaaccacaggaccagtggaggggctgtggcacgtgggcggagactgagtggctgggcatgtgttgtggctgagcatgtggtgtgggcagtggtcctagaccccgccatgtccggacaatgatatagagcgtctcagcatcgccagtctagactgtctatggagagcagaaagttgtctngggctgcctggggaactgtgaggccagctatatcaccgtcgctgatggtgacattacggtggtggcaggagcaaggagagagggaagaaggaccccgtccagctttagtcacaaaatacccaatggaagatgccagtgccaatcctgtgggtttccttgggacttcacactggctttcttatctgctccagatccattcagtagtcactgagttcctgccaaatactttgtagcgccagaagccaggagcggggtctgcagcagggcagtccccnttttcaggaaatgcctggagctgctggtccctgagagaaaggaaaacatctttcagccgtacgcaggccaagaaggccaatgtccagtagctttgtgattttttttatatttttttatttatttatttttgagatagagtcttgctctgtcgctcaggctggagtgcagtggcgtgatctccactcactgcaacttccgcctcctggggtcaagcagttctgcctcagcctcccgagtagctgggattacaggcacacgccaccacacccagctaatttttgtgtttttagtagagacggtttcaccatgtcggccaggctggtctcaaactcctgacctcagatgattcagcctcccaaagtgctgggattacaggtgtgagccactgcacccagcctgtgatgtttctgtggggttccacaaatgtgtgtgtgtgtaaaagctgatgattacagcaagaatgtgaacagtagcagttttccatttgaaggcaagttttgtctttatctgggtatcagaaggaccctctgggccattgtcgcttcctgtactcagagccaccctagtactacgggcacacacagaaaacagcagcctgcgtactttcaaaggaaaggcatctttaatcaccaatgcctggaaaaattattttgtttccctcttccttccgtcttgtttcctaacttcttaccaaagtttagagtctgagtttttcgtataataatgtcccacatccacacatcgggcctacagatgctctcccttgaatcgactggaaacatgacaccggttccatgctctggaactgtcacctgtgatgtgctgggctgtgtcccaagcacaggaatcccagcagtttcagctcgatgcagaaccaccatgctccagacacaggcttgggaaagacacgtcaaaattaaaatactaggtaagagaagcacctgattgggtagaagttggagaggaatcctggaattttgtggccagaaggagccactgccccttttgtttagtaagactagacagtaacagaagccagttgtcagctatgaaagtggtgggtgaagcaggggaggctcctctatggtgggaccctggacaagggaagccgaatgtgtgaagaaggggtgcgggggtgtgcggtgccctaggacactagggcaaaggtttcaaacctggaacaaggcactggaggaagatctgctgccagtcagcagtgcgggccctcgagttagcagtccgtgcgcagaggggccagttctgagaccagtttggagagtcaggcagtgacccattggccatgtcataattccttcagcctgcctcctctttaatcccagagagtgctctttcttcatacttcctttaaaatactaaattgttcccattccatggggagctggctaggctttacaggctaggaaatgtaggttttctgagatggaaccatctacacaaggaggaggaaggcactaagactacagatgagacccatgacagggctgagcatttggaagccaaccctggttgcttttcaagaattgctttgtggctgggtgcagtggttcacacctgtaattgcagcactttgggaggctgaggcaggtggattgcttgaacccaggagttcgagaccagcctgggcaacatatgggacaccccaccgcccccggctctgcaaaaaaattaaaaattagccaggcgtggtgtcatgagcctgtggtctcaactactcaggaggctgaggctggaggatcgcttgaacctgggaggtcaaggctccagtgaaccataattgtgccactgcactgcagcctgggcgacaatttgttttctaaattgcttttgaaagtctactgcattacatattccaaaaagcagtggttttcaaatacttttatcaccgatatccttttatgaaatgaaatcagtagaactttctctgctctgaataagcaagggtgggaacctgtctacctcccacagatagcataatgtgcctgccatagaggagccaaaaaatggtgatgggaactgagaggagagcaaatgtcacaaaagactgagcaattgagaaaacaaaacaagaccacagatgactgttaacgcctccacagtggaccaagaaaggacagagagctggcagcatgggcatcactgtctggtcggcagcaggaaggcctcgctagggaattgagtacagtcatctaactagtttaaaagtacaggaaggatgattaaggctattggagaggtcatacaaataggggaggggcaggcaatggctgataagacatgaatttgtaaggcgatgagtattgcagtcagcaaaacaaacgagactgctctcccaacacataactcagcagggaggccaggcattggtttaaccatttaatataaagaagttaaaattacaaatgcgctaagtgcctaaagaagaataagtgcaggaatgagagcagcatggactgccacagttttagaataagcactgtcactgctagattggaaacaaaaatccataaatttggcccggtgtggtggcggacgcctgtagtcccagctacttggaggctgaggcgtgagaatcgcttgaacccgggaggcggaggttgcagtgagccgagatggcgccactgcactccagcctgggcgtcagagtgagaactctgtatcaaaaaataaaaanaaaaaaaagtccataaatctgcaatgtctcagttaagaaagaaagactgggccaatgcagatttcaaaccggagaaagtcatactgtcagtgaaggccgcctgtggccggaaggcgccaggggattagcaccctggactcagtgttgctgggaaacagggccccaaggctgggagcacagtgtttaaagggcatctacccaagaagggagcacagggcaaggaggagctgcagggggncttggctgccaaagtgaattctgaggagagagctattgctgcctacgatatgcaggctgcacagaacacaagtggaatcagcaggcaggagaggcagctaacgacgcagcccgtttcttatttctgttttctcacaagcgatgaaagtggaaaagagggtgagcaggtggcccacacatgtgcctccagtgctgcggcccctccggggaccatcngccaggccccggggagggagccagccacagtgtgtccggctcttctctgaagggaagagagccttgaatagactgaagcgaagacggttctgcaaggacaaggcagaccgaaggcattggttttttttttcagataaggagaattagactcccaagtagacaccagagtcactgtttggttggtgggtgatagtggggtcacagtggctgcctgtgctcccccagggtgagcgtgactgtgctaacctgggtggggcagcatgcacacccctctggcagccctttgttgctcgctgatgacaagtttggatgatcccgccaaacagcttgctaagatgtagtccccagtgttggaggtggggcctgatgggaggtgctacccttgtgagataaggttgtgtaaaagcctgtggcacctccccacactgacgctctcacccctgctctggccatgtgccgcgcctgctcccacttccccttctgccaggagtaaaagcccccgagacctcccagaagccaagcagatgctagtgccatgcttcctctgcagcctgcagaactgtgagccaattaaacctcttttctctat

SEQ ID NO: 300108 - DNA, 10022 bp, Homo sapiens
  misc_feature (8)..(8): n is a, c, g, or t
  misc_feature (15)..(15): n is a, c, g, or t
  misc_feature (17)..(17): n is a, c, g, or t
  misc_feature (45)..(45): n is a, c, g, or t
  misc_feature (5074)..(5074): n is a, c, g, or t
  misc_feature (6012)..(6012): n is a, c, g, or t
  misc_feature (6287)..(6287): n is a, c, g, or t
  misc_feature (8980)..(8980): n is a, c, g, or t
  misc_feature (9218)..(9218): n is a, c, g, or t
  misc_feature (9433)..(9433): n is a, c, g, or t
tcatagangatcccncntaaatggctgtcccaaatgctgactccnaagctctggacttattggacaaaatgttgacattcaacccacacaagaggattgaagtagaacaggctctggcccacccatatctggagcagtattacgacccgagtgacgagcccatcgccgaagcaccattcaagttcgacatggaattggatgacttgcctaaggaaaagctcaaagaactaatttttgaagagactgctagattccagccaggatacagatcttaaatttgtcaggacaagggctcagaggactggacgtgctcagacatcggtgttcttcttcccagttcttgacccctggtcctgtctccagcccgtcttggcttatccactttgactcctttgagccgtttggaggggcggtttctggtagttgtggcttttatgctttcaaagaatttcttcagtccagagaattcctcctggcagccctgtgtgtgtcacccattggtgacctgcggcagtatgtacttcagtgcacctactgcttactgttgctttagtcactaattgctttctggtttgaaagatgcagtggttcctccctctcctgaatccttttctacatgatgccctgctgaccatgcagccgcaccagagagagattcttccccaattggctctagtcactggcatctcactttatgatagggaaggctactacctagggcactttaagtcagtgacagccccttatttgcacttcaccttttgaccataactgtttccccagagcaggagcttgtggaaataccttggctgatgttgcagcctgcagcaagtgcttccgtctccggaatccttggggagcacttgtccacgtcttttctcatatcatggtagtcactaacatatataaggtatgtgctattggcccagcttttagaaaatgcagtcatttttctaaataaaaaggaagtactgcacccagcagtgtcactctgtagttactgtggtcacttgtaccatatagaggtgtaacacttgtcaagaagcgttatgtgcagtacttaatgtttgtaagacttacaaaaaaagatttaaagtggcagcttcactcgacatttggtgagagaagtacaaaggttgcagtgctgagctgtgggcggtttctggggatgtcccagggtggaactccacatgctggtgcatatacgcccttgagctacttcaaatgtgggtgtttcagtaaccacgttccatgcctgaggatttagcagagaggaacactgcgtctttaaatgagaaagtatacaattctttttccttctacagcatgtcagcatctcaagttcatttttcaacctacagtataacaatttgtaataaagcctccaggagctcatgacgtgaagcactgttctgtcctcaagtactcaaatatttctgatactgctgagtcagactgtcagaaaaagctagcactaactcgtgtttggagctctatccatattttactgatctctttaagtatttgttcctgccactgtgtactgtggagttgactcggtgttctgtcccagtgcggtgcctcctcttgacttccccactgctctctgtggtgagaaatttgccttgttcaataattactgtaccctcgcatgactgttacagctttctgtgcagagatgactgtccaagtgccacatgcctacgattgaaatgaaaactctattgttacctctgagttgtgttccacggaaaatgctatccagcagatcatttaggaaaaataattctatttttagcttttcatttctcagctgtccttttttcttgtttgatttttgacagcaatggagaatgggttatataaagactgcctgctaatatgaacagaaatgcatttgtaattcatgaaaataaatgtacatcttctatcttcacattcatgttaagattcagtgttgctttcctctggatcagcgtgtctgaatggacagtcaggttcaggttgtgctgaacacagaaatgctcacaggcctcactttgccgcccaggcactggcccagcacttggatttacataagatgagttagaaaggtacttctgtagggtcctttttacctctgctcggcagagaatcgatgctgtcatgttcctttattcacaatcttaggtctcaaatattctgtcaaaccctaacaaagaagccccgacatctcaggttggattccctggttctctctaaagagggcctgcccttgtgccccagaggtgctgctgggcacagccaagagttgggaagggccgccccacagtacgcagtcctcaccacccagcccagggtgctcacgctcaccactcctgtggctgaggaaggatagctggctcatcctcggaaaacagacccacatctctattcttgccctgaaatacgcgcttttcacttgcgtgctcagagctgccgtctgaaggtccacacagcattgacgggacacagaaatgtgactgttaccggataacactgattagtcagttttcatttataaaaaagcattgacagttttattactcttgtttctttttaaatggaaagttactattataaggttaatttgcagtcctcttctaaatagaaaaccatatccttggctactaacatctggagactgtgagctccttcccattccccttcctggtactgtggagtcagattggcatgaaaccactaacttcattctagaatcattgtagccataagttgtgtgctttttattaatcatgccaaacataatgtaactgggcagagaatggtcctaaccaaggtacctatgaaaagcgctagctatcatgtgtagtagatgcatcattttggctcttcttacatttgtaaaaatgtacagattaggtcatcttaattcatattagtgacacggaacagcacctccactatttgtatgttcaaataagctttcagactaatagcttttttggtgtctaaaatgtaagcaaaaaattcctgctgaaacattccagtcctttcatttagtataaaagaaatactgaacaagccagtgggatggaattgaaagaactaatcatgaggactctgtcctgacacaggtcctcaaagctagcagagatacgcagacattgtggcatctgggtagaagaatactgtattgtgtgtgcagtgcacagtgtgtggtgtgtgcacactcattccttctgctcttgggcacaggcagtgggtgtagaggtaaccagtagctttgagaagctacatgtagctcaccagtggttttctctaaggaatcacaaaggtaaactacccaaccacatgccacgtaatatttcagccattcagaggaaactgttttctctttatttgcttatatgttaatatggtttttaaattggtaacttttatatagtatggtaacagtatgttaatacacacatacatatgcacacatgctttgggtccttccataatacttttatatttgtaaatcaatgttttggagcaatcccaagtttaagggaaatatttttgtaaatgtaatggttttgaaaatctgagcaatccttttgcttatacatttttaaagcatttgtgctttaaaattgttatgctggtgtttgaaacatgatactcctgtggtgcagatgagaagctataacagtgaatatgtggtttctcttacgtcatccaccttgacatgatgggtcagaaacaaatggaaatccagagcaagtcctccagggttgcaccaggtttacctaaagcttgttgccttttcttgtgctgtttatccgtgtagagcactcaagaaagttctgaaactgctttgtatctgctttgtactgttggtgccttcttggtattgtaccccaaaattctgcatagattatttagtataatggtaagttaaaaaatgttaaaggaagattttattaagaatctgaatgtttattcattatattgttacaatttaacattaacatttatttgtggtatttgtgatttggttaatctgtataaaaattgtaagtagaaaggtttatatttcatcttaattcttttgatgttgtaaacgtactttttaaaagatggattatttgaatgtttatggcacctgacttgtaaaaaaaaaaaactacaaaaaaatccttagaatcattaaattgtgtccctgtattaccaaaataacacagcaccgtgcatgtatagtttaattgcagtttcatctgtgaaaacgtgaaattgtctagtccttcgttatgttccccagatgtcttccagatttgctctgcatgtggtaacttgtgttagggctgtgagctgttcctcgagttgaatggggatgtcagtgctcctagggttctccaggtggttcttcagaccttcacctgtgggggggggggtaggcggtgcccacgcccatctcctcatcctcctgaacttctgcaaccccactgctgggcagacatcctgggcaaccccttttttcagagcaagaagtcataaagataggatttcttggacatttggttcttatcaatattgggcattatgtaatgacttatttacaaaacaaagatactggaaaatgttttggatgtggtgttatggaaagagcacaggccttggacccatccagctgggttcagaactaccccctgcttataactgcggctggctgtgggccagtcattctgcgtctctgctttcttcctctgcttcagactgtcagctgtaaagtggaagcaatattacttgccttgtatatggtaaagattataaaaatacatttcaactgttcagcatagtacttcaaagcaagtactcagtaaatagcaagtctttttaaatgctgctttatttcactaaattttgttgtgaggtgtcactaaaatgcctgcaaacaaacgtaactgctaatctgagaggaaaccctcttactaatcagagaagaaaccctcctgtcagaaaccttcagggaagtgagctgatcacacctaaactgggagtttgcaatggggtatttgaagcactgtgggagtattccactggcccnctccctgagagacttaacagtcttccctgttgtccagattctgtataaggcaatcagaataatcatcttccttgttcagcagaggagcctggtcccattttccccactttgtgatgggcttctctcagcggtagctcagcagttccagatggcagtttggaccagcatctaggctggccagttcgctgtgtttacttagaaccaacacgttcagagctggcctggaccatctgaggggaacaggaaacacccctaggctgtggaagcaagtgcagacccccacccccggccctgaagccaagggggcagggtttgggagtggccaaagagaagcagtgcagggatgggttttcctagggacaggcttagcattcctgactctaggaagaaggagcagtgaggcggagaaacagtggaggggatggtggcattgggccccatggggccgagatggacacagggctcgttctcttgagtctggtgccaaggacagctgaagacgacatcattttcaggtggagaggagagagtggagggagatcatgccctgtgatgtgtcttttgcaggtgaaggtgggagacaaggtctctgctgacgatgaggcagagccaccgtgaaagttgtaataggaggactgcccgccgctggaagggcctgcagtgacgctaggacaccctctgcctgcatgtcacgttagctgggctgggcgaagtagaagaccaaggggaagaggtgcagtggggagaccaggtgggatgcaaccacaggaccagtggaggggctgtggcacgtgggcggagactgagtggctgggcatgtgttgtggctgagcatgtggtgtgggcagtggtcctagaccccgccatgtccggacaatgatatagagcgtctcagcatcgccagtctagactgtctatggagagcagaaagttgtctngggctgcctggggaactgtgaggccagctatatcaccgtcgctgatggtgacattacggtggtggcaggagcaaggagagagggaagaaggaccccgtccagctttagtcacaaaatacccaatggaagatgccagtgccaatcctgtgggtttccttgggacttcacactggctttcttatctgctccagatccattcagtagtcactgagttcctgccaaatactttgtagcgccagaagccaggagcggggtctgcagcagggcagtccccnttttcaggaaatgcctggagctgctggtccctgagagaaaggaaaacatctttcagccgtacgcaggccaagaaggccaatgtccagtagctttgtgattttttttatatttttttatttatttatttttgagatagagtcttgctctgtcgctcaggctggagtgcagtggcgtgatctccactcactgcaacttccgcctcctggggtcaagcagttctgcctcagcctcccgagtagctgggattacaggcacacgccaccacacccagctaatttttgtgtttttagtagagacggtttcaccatgtcggccaggctggtctcaaactcctgacctcagatgattcagcctcccaaagtgctgggattacaggtgtgagccactgcacccagcctgtgatgtttctgtggggttccacaaatgtgtgtgtgtgtaaaagctgatgattacagcaagaatgtgaacagtagcagttttccatttgaaggcaagttttgtctttatctgggtatcagaaggaccctctgggccattgtcgcttcctgtactcagagccaccctagtactacgggcacacacagaaaacagcagcctgcgtactttcaaaggaaaggcatctttaatcaccaatgcctggaaaaattattttgtttccctcttccttccgtcttgtttcctaacttcttaccaaagtttagagtctgagtttttcgtataataatgtcccacatccacacatcgggcctacagatgctctcccttgaatcgactggaaacatgacaccggttccatgctctggaactgtcacctgtgatgtgctgggctgtgtcccaagcacaggaatcccagcagtttcagctcgatgcagaaccaccatgctccagacacaggcttgggaaagacacgtcaaaattaaaatactaggtaagagaagcacctgattgggtagaagttggagaggaatcctggaattttgtggccagaaggagccactgccccttttgtttagtaagactagacagtaacagaagccagttgtcagctatgaaagtggtgggtgaagcaggggaggctcctctatggtgggaccctggacaagggaagccgaatgtgtgaagaaggggtgcgggggtgtgcggtgccctaggacactagggcaaaggtttcaaacctggaacaaggcactggaggaagatctgctgccagtcagcagtgcgggccctcgagttagcagtccgtgcgcagaggggccagttctgagaccagtttggagagtcaggcagtgacccattggccatgtcataattccttcagcctgcctcctctttaatcccagagagtgctctttcttcatacttcctttaaaatactaaattgttcccattccatggggagctggctaggctttacaggctaggaaatgtaggttttctgagatggaaccatctacacaaggaggaggaaggcactaagactacagatgagacccatgacagggctgagcatttggaagccaaccctggttgcttttcaagaattgctttgtggctgggtgcagtggttcacacctgtaattgcagcactttgggaggctgaggcaggtggattgcttgaacccaggagttcgagaccagcctgggcaacatatgggacaccccaccgcccccggctctgcaaaaaaattaaaaattagccaggcgtggtgtcatgagcctgtggtctcaactactcaggaggctgaggctggaggatcgcttgaacctgggaggtcaaggctccagtgaaccataattgtgccactgcactgcagcctgggcgacaatttgttttctaaattgcttttgaaagtctactgcattacatattccaaaaagcagtggttttcaaatacttttatcaccgatatccttttatgaaatgaaatcagtagaactttctctgctctgaataagcaagggtgggaacctgtctacctcccacagatagcataatgtgcctgccatagaggagccaaaaaatggtgatgggaactgagaggagagcaaatgtcacaaaagactgagcaattgagaaaacaaaacaagaccacagatgactgttaacgcctccacagtggaccaagaaaggacagagagctggcagcatgggcatcactgtctggtcggcagcaggaaggcctcgctagggaattgagtacagtcatctaactagtttaaaagtacaggaaggatgattaaggctattggagaggtcatacaaataggggaggggcaggcaatggctgataagacatgaatttgtaaggcgatgagtattgcagtcagcaaaacaaacgagactgctctcccaacacataactcagcagggaggccaggcattggtttaaccatttaatataaagaagttaaaattacaaatgcgctaagtgcctaaagaagaataagtgcaggaatgagagcagcatggactgccacagttttagaataagcactgtcactgctagattggaaacaaaaatccataaatttggcccggtgtggtggcggacgcctgtagtcccagctacttggaggctgaggcgtgagaatcgcttgaacccgggaggcggaggttgcagtgagccgagatggcgccactgcactccagcctgggcgtcagagtgagaactctgtatcaaaaaataaaaanaaaaaaaagtccataaatctgcaatgtctcagttaagaaagaaagactgggccaatgcagatttcaaaccggagaaagtcatactgtcagtgaaggccgcctgtggccggaaggcgccaggggattagcaccctggactcagtgttgctgggaaacagggccccaaggctgggagcacagtgtttaaagggcatctacccaagaagggagcacagggcaaggaggagctgcagggggncttggctgccaaagtgaattctgaggagagagctattgctgcctacgatatgcaggctgcacagaacacaagtggaatcagcaggcaggagaggcagctaacgacgcagcccgtttcttatttctgttttctcacaagcgatgaaagtggaaaagagggtgagcaggtggcccacacatgtgcctccagtgctgcggcccctccggggaccatcngccaggccccggggagggagccagccacagtgtgtccggctcttctctgaagggaagagagccttgaatagactgaagcgaagacggttctgcaaggacaaggcagaccgaaggcattggttttttttttcagataaggagaattagactcccaagtagacaccagagtcactgtttggttggtgggtgatagtggggtcacagtggctgcctgtgctcccccagggtgagcgtgactgtgctaacctgggtggggcagcatgcacacccctctggcagccctttgttgctcgctgatgacaagtttggatgatcccgccaaacagcttgctaagatgtagtccccagtgttggaggtggggcctgatgggaggtgctacccttgtgagataaggttgtgtaaaagcctgtggcacctccccacactgacgctctcacccctgctctggccatgtgccgcgcctgctcccacttccccttctgccaggagtaaaagcccccgagacctcccagaagccaagcagatgctagtgccatgcttcctctgcagcctgcagaactgtgagccaattaaacctcttttctctat

SEQ ID NO: 300109 - DNA, 9972 bp, Homo sapiens
  misc_feature (5024)..(5024): n is a, c, g, or t
  misc_feature (5962)..(5962): n is a, c, g, or t
  misc_feature (6237)..(6237): n is a, c, g, or t
  misc_feature (8930)..(8930): n is a, c, g, or t
  misc_feature (9168)..(9168): n is a, c, g, or t
  misc_feature (9383)..(9383): n is a, c, g, or t
agtcctgttgtaaattcagaatctgagcagtggtcattttatgaatcagtaaattactgccttacccataacaactttgactgttaaatgttttgttttcttttaaagcccatcgccgaagcaccattcaagttcgacatggaattggatgacttgcctaaggaaaagctcaaagaactaatttttgaagagactgctagattccagccaggatacagatcttaaatttgtcaggacaagggctcagaggactggacgtgctcagacatcggtgttcttcttcccagttcttgacccctggtcctgtctccagcccgtcttggcttatccactttgactcctttgagccgtttggaggggcggtttctggtagttgtggcttttatgctttcaaagaatttcttcagtccagagaattcctcctggcagccctgtgtgtgtcacccattggtgacctgcggcagtatgtacttcagtgcacctactgcttactgttgctttagtcactaattgctttctggtttgaaagatgcagtggttcctccctctcctgaatccttttctacatgatgccctgctgaccatgcagccgcaccagagagagattcttccccaattggctctagtcactggcatctcactttatgatagggaaggctactacctagggcactttaagtcagtgacagccccttatttgcacttcaccttttgaccataactgtttccccagagcaggagcttgtggaaataccttggctgatgttgcagcctgcagcaagtgcttccgtctccggaatccttggggagcacttgtccacgtcttttctcatatcatggtagtcactaacatatataaggtatgtgctattggcccagcttttagaaaatgcagtcatttttctaaataaaaaggaagtactgcacccagcagtgtcactctgtagttactgtggtcacttgtaccatatagaggtgtaacacttgtcaagaagcgttatgtgcagtacttaatgtttgtaagacttacaaaaaaagatttaaagtggcagcttcactcgacatttggtgagagaagtacaaaggttgcagtgctgagctgtgggcggtttctggggatgtcccagggtggaactccacatgctggtgcatatacgcccttgagctacttcaaatgtgggtgtttcagtaaccacgttccatgcctgaggatttagcagagaggaacactgcgtctttaaatgagaaagtatacaattctttttccttctacagcatgtcagcatctcaagttcatttttcaacctacagtataacaatttgtaataaagcctccaggagctcatgacgtgaagcactgttctgtcctcaagtactcaaatatttctgatactgctgagtcagactgtcagaaaaagctagcactaactcgtgtttggagctctatccatattttactgatctctttaagtatttgttcctgccactgtgtactgtggagttgactcggtgttctgtcccagtgcggtgcctcctcttgacttccccactgctctctgtggtgagaaatttgccttgttcaataattactgtaccctcgcatgactgttacagctttctgtgcagagatgactgtccaagtgccacatgcctacgattgaaatgaaaactctattgttacctctgagttgtgttccacggaaaatgctatccagcagatcatttaggaaaaataattctatttttagcttttcatttctcagctgtccttttttcttgtttgatttttgacagcaatggagaatgggttatataaagactgcctgctaatatgaacagaaatgcatttgtaattcatgaaaataaatgtacatcttctatcttcacattcatgttaagattcagtgttgctttcctctggatcagcgtgtctgaatggacagtcaggttcaggttgtgctgaacacagaaatgctcacaggcctcactttgccgcccaggcactggcccagcacttggatttacataagatgagttagaaaggtacttctgtagggtcctttttacctctgctcggcagagaatcgatgctgtcatgttcctttattcacaatcttaggtctcaaatattctgtcaaaccctaacaaagaagccccgacatctcaggttggattccctggttctctctaaagagggcctgcccttgtgccccagaggtgctgctgggcacagccaagagttgggaagggccgccccacagtacgcagtcctcaccacccagcccagggtgctcacgctcaccactcctgtggctgaggaaggatagctggctcatcctcggaaaacagacccacatctctattcttgccctgaaatacgcgcttttcacttgcgtgctcagagctgccgtctgaaggtccacacagcattgacgggacacagaaatgtgactgttaccggataacactgattagtcagttttcatttataaaaaagcattgacagttttattactcttgtttctttttaaatggaaagttactattataaggttaatttgcagtcctcttctaaatagaaaaccatatccttggctactaacatctggagactgtgagctccttcccattccccttcctggtactgtggagtcagattggcatgaaaccactaacttcattctagaatcattgtagccataagttgtgtgctttttattaatcatgccaaacataatgtaactgggcagagaatggtcctaaccaaggtacctatgaaaagcgctagctatcatgtgtagtagatgcatcattttggctcttcttacatttgtaaaaatgtacagattaggtcatcttaattcatattagtgacacggaacagcacctccactatttgtatgttcaaataagctttcagactaatagcttttttggtgtctaaaatgtaagcaaaaaattcctgctgaaacattccagtcctttcatttagtataaaagaaatactgaacaagccagtgggatggaattgaaagaactaatcatgaggactctgtcctgacacaggtcctcaaagctagcagagatacgcagacattgtggcatctgggtagaagaatactgtattgtgtgtgcagtgcacagtgtgtggtgtgtgcacactcattccttctgctcttgggcacaggcagtgggtgtagaggtaaccagtagctttgagaagctacatgtagctcaccagtggttttctctaaggaatcacaaaggtaaactacccaaccacatgccacgtaatatttcagccattcagaggaaactgttttctctttatttgcttatatgttaatatggtttttaaattggtaacttttatatagtatggtaacagtatgttaatacacacatacatatgcacacatgctttgggtccttccataatacttttatatttgtaaatcaatgttttggagcaatcccaagtttaagggaaatatttttgtaaatgtaatggttttgaaaatctgagcaatccttttgcttatacatttttaaagcatttgtgctttaaaattgttatgctggtgtttgaaacatgatactcctgtggtgcagatgagaagctataacagtgaatatgtggtttctcttacgtcatccaccttgacatgatgggtcagaaacaaatggaaatccagagcaagtcctccagggttgcaccaggtttacctaaagcttgttgccttttcttgtgctgtttatccgtgtagagcactcaagaaagttctgaaactgctttgtatctgctttgtactgttggtgccttcttggtattgtaccccaaaattctgcatagattatttagtataatggtaagttaaaaaatgttaaaggaagattttattaagaatctgaatgtttattcattatattgttacaatttaacattaacatttatttgtggtatttgtgatttggttaatctgtataaaaattgtaagtagaaaggtttatatttcatcttaattcttttgatgttgtaaacgtactttttaaaagatggattatttgaatgtttatggcacctgacttgtaaaaaaaaaaaactacaaaaaaatccttagaatcattaaattgtgtccctgtattaccaaaataacacagcaccgtgcatgtatagtttaattgcagtttcatctgtgaaaacgtgaaattgtctagtccttcgttatgttccccagatgtcttccagatttgctctgcatgtggtaacttgtgttagggctgtgagctgttcctcgagttgaatggggatgtcagtgctcctagggttctccaggtggttcttcagaccttcacctgtgggggggggggtaggcggtgcccacgcccatctcctcatcctcctgaacttctgcaaccccactgctgggcagacatcctgggcaaccccttttttcagagcaagaagtcataaagataggatttcttggacatttggttcttatcaatattgggcattatgtaatgacttatttacaaaacaaagatactggaaaatgttttggatgtggtgttatggaaagagcacaggccttggacccatccagctgggttcagaactaccccctgcttataactgcggctggctgtgggccagtcattctgcgtctctgctttcttcctctgcttcagactgtcagctgtaaagtggaagcaatattacttgccttgtatatggtaaagattataaaaatacatttcaactgttcagcatagtacttcaaagcaagtactcagtaaatagcaagtctttttaaatgctgctttatttcactaaattttgttgtgaggtgtcactaaaatgcctgcaaacaaacgtaactgctaatctgagaggaaaccctcttactaatcagagaagaaaccctcctgtcagaaaccttcagggaagtgagctgatcacacctaaactgggagtttgcaatggggtatttgaagcactgtgggagtattccactggcccnctccctgagagacttaacagtcttccctgttgtccagattctgtataaggcaatcagaataatcatcttccttgttcagcagaggagcctggtcccattttccccactttgtgatgggcttctctcagcggtagctcagcagttccagatggcagtttggaccagcatctaggctggccagttcgctgtgtttacttagaaccaacacgttcagagctggcctggaccatctgaggggaacaggaaacacccctaggctgtggaagcaagtgcagacccccacccccggccctgaagccaagggggcagggtttgggagtggccaaagagaagcagtgcagggatgggttttcctagggacaggcttagcattcctgactctaggaagaaggagcagtgaggcggagaaacagtggaggggatggtggcattgggccccatggggccgagatggacacagggctcgttctcttgagtctggtgccaaggacagctgaagacgacatcattttcaggtggagaggagagagtggagggagatcatgccctgtgatgtgtcttttgcaggtgaaggtgggagacaaggtctctgctgacgatgaggcagagccaccgtgaaagttgtaataggaggactgcccgccgctggaagggcctgcagtgacgctaggacaccctctgcctgcatgtcacgttagctgggctgggcgaagtagaagaccaaggggaagaggtgcagtggggagaccaggtgggatgcaaccacaggaccagtggaggggctgtggcacgtgggcggagactgagtggctgggcatgtgttgtggctgagcatgtggtgtgggcagtggtcctagaccccgccatgtccggacaatgatatagagcgtctcagcatcgccagtctagactgtctatggagagcagaaagttgtctngggctgcctggggaactgtgaggccagctatatcaccgtcgctgatggtgacattacggtggtggcaggagcaaggagagagggaagaaggaccccgtccagctttagtcacaaaatacccaatggaagatgccagtgccaatcctgtgggtttccttgggacttcacactggctttcttatctgctccagatccattcagtagtcactgagttcctgccaaatactttgtagcgccagaagccaggagcggggtctgcagcagggcagtccccnttttcaggaaatgcctggagctgctggtccctgagagaaaggaaaacatctttcagccgtacgcaggccaagaaggccaatgtccagtagctttgtgattttttttatatttttttatttatttatttttgagatagagtcttgctctgtcgctcaggctggagtgcagtggcgtgatctccactcactgcaacttccgcctcctggggtcaagcagttctgcctcagcctcccgagtagctgggattacaggcacacgccaccacacccagctaatttttgtgtttttagtagagacggtttcaccatgtcggccaggctggtctcaaactcctgacctcagatgattcagcctcccaaagtgctgggattacaggtgtgagccactgcacccagcctgtgatgtttctgtggggttccacaaatgtgtgtgtgtgtaaaagctgatgattacagcaagaatgtgaacagtagcagttttccatttgaaggcaagttttgtctttatctgggtatcagaaggaccctctgggccattgtcgcttcctgtactcagagccaccctagtactacgggcacacacagaaaacagcagcctgcgtactttcaaaggaaaggcatctttaatcaccaatgcctggaaaaattattttgtttccctcttccttccgtcttgtttcctaacttcttaccaaagtttagagtctgagtttttcgtataataatgtcccacatccacacatcgggcctacagatgctctcccttgaatcgactggaaacatgacaccggttccatgctctggaactgtcacctgtgatgtgctgggctgtgtcccaagcacaggaatcccagcagtttcagctcgatgcagaaccaccatgctccagacacaggcttgggaaagacacgtcaaaattaaaatactaggtaagagaagcacctgattgggtagaagttggagaggaatcctggaattttgtggccagaaggagccactgccccttttgtttagtaagactagacagtaacagaagccagttgtcagctatgaaagtggtgggtgaagcaggggaggctcctctatggtgggaccctggacaagggaagccgaatgtgtgaagaaggggtgcgggggtgtgcggtgccctaggacactagggcaaaggtttcaaacctggaacaaggcactggaggaagatctgctgccagtcagcagtgcgggccctcgagttagcagtccgtgcgcagaggggccagttctgagaccagtttggagagtcaggcagtgacccattggccatgtcataattccttcagcctgcctcctctttaatcccagagagtgctctttcttcatacttcctttaaaatactaaattgttcccattccatggggagctggctaggctttacaggctaggaaatgtaggttttctgagatggaaccatctacacaaggaggaggaaggcactaagactacagatgagacccatgacagggctgagcatttggaagccaaccctggttgcttttcaagaattgctttgtggctgggtgcagtggttcacacctgtaattgcagcactttgggaggctgaggcaggtggattgcttgaacccaggagttcgagaccagcctgggcaacatatgggacaccccaccgcccccggctctgcaaaaaaattaaaaattagccaggcgtggtgtcatgagcctgtggtctcaactactcaggaggctgaggctggaggatcgcttgaacctgggaggtcaaggctccagtgaaccataattgtgccactgcactgcagcctgggcgacaatttgttttctaaattgcttttgaaagtctactgcattacatattccaaaaagcagtggttttcaaatacttttatcaccgatatccttttatgaaatgaaatcagtagaactttctctgctctgaataagcaagggtgggaacctgtctacctcccacagatagcataatgtgcctgccatagaggagccaaaaaatggtgatgggaactgagaggagagcaaatgtcacaaaagactgagcaattgagaaaacaaaacaagaccacagatgactgttaacgcctccacagtggaccaagaaaggacagagagctggcagcatgggcatcactgtctggtcggcagcaggaaggcctcgctagggaattgagtacagtcatctaactagtttaaaagtacaggaaggatgattaaggctattggagaggtcatacaaataggggaggggcaggcaatggctgataagacatgaatttgtaaggcgatgagtattgcagtcagcaaaacaaacgagactgctctcccaacacataactcagcagggaggccaggcattggtttaaccatttaatataaagaagttaaaattacaaatgcgctaagtgcctaaagaagaataagtgcaggaatgagagcagcatggactgccacagttttagaataagcactgtcactgctagattggaaacaaaaatccataaatttggcccggtgtggtggcggacgcctgtagtcccagctacttggaggctgaggcgtgagaatcgcttgaacccgggaggcggaggttgcagtgagccgagatggcgccactgcactccagcctgggcgtcagagtgagaactctgtatcaaaaaataaaaanaaaaaaaagtccataaatctgcaatgtctcagttaagaaagaaagactgggccaatgcagatttcaaaccggagaaagtcatactgtcagtgaaggccgcctgtggccggaaggcgccaggggattagcaccctggactcagtgttgctgggaaacagggccccaaggctgggagcacagtgtttaaagggcatctacccaagaagggagcacagggcaaggaggagctgcagggggncttggctgccaaagtgaattctgaggagagagctattgctgcctacgatatgcaggctgcacagaacacaagtggaatcagcaggcaggagaggcagctaacgacgcagcccgtttcttatttctgttttctcacaagcgatgaaagtggaaaagagggtgagcaggtggcccacacatgtgcctccagtgctgcggcccctccggggaccatcngccaggccccggggagggagccagccacagtgtgtccggctcttctctgaagggaagagagccttgaatagactgaagcgaagacggttctgcaaggacaaggcagaccgaaggcattggttttttttttcagataaggagaattagactcccaagtagacaccagagtcactgtttggttggtgggtgatagtggggtcacagtggctgcctgtgctcccccagggtgagcgtgactgtgctaacctgggtggggcagcatgcacacccctctggcagccctttgttgctcgctgatgacaagtttggatgatcccgccaaacagcttgctaagatgtagtccccagtgttggaggtggggcctgatgggaggtgctacccttgtgagataaggttgtgtaaaagcctgtggcacctccccacactgacgctctcacccctgctctggccatgtgccgcgcctgctcccacttccccttctgccaggagtaaaagcccccgagacctcccagaagccaagcagatgctagtgccatgcttcctctgcagcctgcagaactgtgagccaattaaacctcttttctctat

SEQ ID NO: 300110 - DNA, 9811 bp, Homo sapiens
  misc_feature (4863)..(4863): n is a, c, g, or t
  misc_feature (5801)..(5801): n is a, c, g, or t
  misc_feature (6076)..(6076): n is a, c, g, or t
  misc_feature (8769)..(8769): n is a, c, g, or t
  misc_feature (9007)..(9007): n is a, c, g, or t
  misc_feature (9222)..(9222): n is a, c, g, or t
gttatggatgctgatgatgatgctgttttcacatggctcactcttaactcagtggtctgtggtgtttctataggacaagggctcagaggactggacgtgctcagacatcggtgttcttcttcccagttcttgacccctggtcctgtctccagcccgtcttggcttatccactttgactcctttgagccgtttggaggggcggtttctggtagttgtggcttttatgctttcaaagaatttcttcagtccagagaattcctcctggcagccctgtgtgtgtcacccattggtgacctgcggcagtatgtacttcagtgcacctactgcttactgttgctttagtcactaattgctttctggtttgaaagatgcagtggttcctccctctcctgaatccttttctacatgatgccctgctgaccatgcagccgcaccagagagagattcttccccaattggctctagtcactggcatctcactttatgatagggaaggctactacctagggcactttaagtcagtgacagccccttatttgcacttcaccttttgaccataactgtttccccagagcaggagcttgtggaaataccttggctgatgttgcagcctgcagcaagtgcttccgtctccggaatccttggggagcacttgtccacgtcttttctcatatcatggtagtcactaacatatataaggtatgtgctattggcccagcttttagaaaatgcagtcatttttctaaataaaaaggaagtactgcacccagcagtgtcactctgtagttactgtggtcacttgtaccatatagaggtgtaacacttgtcaagaagcgttatgtgcagtacttaatgtttgtaagacttacaaaaaaagatttaaagtggcagcttcactcgacatttggtgagagaagtacaaaggttgcagtgctgagctgtgggcggtttctggggatgtcccagggtggaactccacatgctggtgcatatacgcccttgagctacttcaaatgtgggtgtttcagtaaccacgttccatgcctgaggatttagcagagaggaacactgcgtctttaaatgagaaagtatacaattctttttccttctacagcatgtcagcatctcaagttcatttttcaacctacagtataacaatttgtaataaagcctccaggagctcatgacgtgaagcactgttctgtcctcaagtactcaaatatttctgatactgctgagtcagactgtcagaaaaagctagcactaactcgtgtttggagctctatccatattttactgatctctttaagtatttgttcctgccactgtgtactgtggagttgactcggtgttctgtcccagtgcggtgcctcctcttgacttccccactgctctctgtggtgagaaatttgccttgttcaataattactgtaccctcgcatgactgttacagctttctgtgcagagatgactgtccaagtgccacatgcctacgattgaaatgaaaactctattgttacctctgagttgtgttccacggaaaatgctatccagcagatcatttaggaaaaataattctatttttagcttttcatttctcagctgtccttttttcttgtttgatttttgacagcaatggagaatgggttatataaagactgcctgctaatatgaacagaaatgcatttgtaattcatgaaaataaatgtacatcttctatcttcacattcatgttaagattcagtgttgctttcctctggatcagcgtgtctgaatggacagtcaggttcaggttgtgctgaacacagaaatgctcacaggcctcactttgccgcccaggcactggcccagcacttggatttacataagatgagttagaaaggtacttctgtagggtcctttttacctctgctcggcagagaatcgatgctgtcatgttcctttattcacaatcttaggtctcaaatattctgtcaaaccctaacaaagaagccccgacatctcaggttggattccctggttctctctaaagagggcctgcccttgtgccccagaggtgctgctgggcacagccaagagttgggaagggccgccccacagtacgcagtcctcaccacccagcccagggtgctcacgctcaccactcctgtggctgaggaaggatagctggctcatcctcggaaaacagacccacatctctattcttgccctgaaatacgcgcttttcacttgcgtgctcagagctgccgtctgaaggtccacacagcattgacgggacacagaaatgtgactgttaccggataacactgattagtcagttttcatttataaaaaagcattgacagttttattactcttgtttctttttaaatggaaagttactattataaggttaatttgcagtcctcttctaaatagaaaaccatatccttggctactaacatctggagactgtgagctccttcccattccccttcctggtactgtggagtcagattggcatgaaaccactaacttcattctagaatcattgtagccataagttgtgtgctttttattaatcatgccaaacataatgtaactgggcagagaatggtcctaaccaaggtacctatgaaaagcgctagctatcatgtgtagtagatgcatcattttggctcttcttacatttgtaaaaatgtacagattaggtcatcttaattcatattagtgacacggaacagcacctccactatttgtatgttcaaataagctttcagactaatagcttttttggtgtctaaaatgtaagcaaaaaattcctgctgaaacattccagtcctttcatttagtataaaagaaatactgaacaagccagtgggatggaattgaaagaactaatcatgaggactctgtcctgacacaggtcctcaaagctagcagagatacgcagacattgtggcatctgggtagaagaatactgtattgtgtgtgcagtgcacagtgtgtggtgtgtgcacactcattccttctgctcttgggcacaggcagtgggtgtagaggtaaccagtagctttgagaagctacatgtagctcaccagtggttttctctaaggaatcacaaaggtaaactacccaaccacatgccacgtaatatttcagccattcagaggaaactgttttctctttatttgcttatatgttaatatggtttttaaattggtaacttttatatagtatggtaacagtatgttaatacacacatacatatgcacacatgctttgggtccttccataatacttttatatttgtaaatcaatgttttggagcaatcccaagtttaagggaaatatttttgtaaatgtaatggttttgaaaatctgagcaatccttttgcttatacatttttaaagcatttgtgctttaaaattgttatgctggtgtttgaaacatgatactcctgtggtgcagatgagaagctataacagtgaatatgtggtttctcttacgtcatccaccttgacatgatgggtcagaaacaaatggaaatccagagcaagtcctccagggttgcaccaggtttacctaaagcttgttgccttttcttgtgctgtttatccgtgtagagcactcaagaaagttctgaaactgctttgtatctgctttgtactgttggtgccttcttggtattgtaccccaaaattctgcatagattatttagtataatggtaagttaaaaaatgttaaaggaagattttattaagaatctgaatgtttattcattatattgttacaatttaacattaacatttatttgtggtatttgtgatttggttaatctgtataaaaattgtaagtagaaaggtttatatttcatcttaattcttttgatgttgtaaacgtactttttaaaagatggattatttgaatgtttatggcacctgacttgtaaaaaaaaaaaactacaaaaaaatccttagaatcattaaattgtgtccctgtattaccaaaataacacagcaccgtgcatgtatagtttaattgcagtttcatctgtgaaaacgtgaaattgtctagtccttcgttatgttccccagatgtcttccagatttgctctgcatgtggtaacttgtgttagggctgtgagctgttcctcgagttgaatggggatgtcagtgctcctagggttctccaggtggttcttcagaccttcacctgtgggggggggggtaggcggtgcccacgcccatctcctcatcctcctgaacttctgcaaccccactgctgggcagacatcctgggcaaccccttttttcagagcaagaagtcataaagataggatttcttggacatttggttcttatcaatattgggcattatgtaatgacttatttacaaaacaaagatactggaaaatgttttggatgtggtgttatggaaagagcacaggccttggacccatccagctgggttcagaactaccccctgcttataactgcggctggctgtgggccagtcattctgcgtctctgctttcttcctctgcttcagactgtcagctgtaaagtggaagcaatattacttgccttgtatatggtaaagattataaaaatacatttcaactgttcagcatagtacttcaaagcaagtactcagtaaatagcaagtctttttaaatgctgctttatttcactaaattttgttgtgaggtgtcactaaaatgcctgcaaacaaacgtaactgctaatctgagaggaaaccctcttactaatcagagaagaaaccctcctgtcagaaaccttcagggaagtgagctgatcacacctaaactgggagtttgcaatggggtatttgaagcactgtgggagtattccactggcccnctccctgagagacttaacagtcttccctgttgtccagattctgtataaggcaatcagaataatcatcttccttgttcagcagaggagcctggtcccattttccccactttgtgatgggcttctctcagcggtagctcagcagttccagatggcagtttggaccagcatctaggctggccagttcgctgtgtttacttagaaccaacacgttcagagctggcctggaccatctgaggggaacaggaaacacccctaggctgtggaagcaagtgcagacccccacccccggccctgaagccaagggggcagggtttgggagtggccaaagagaagcagtgcagggatgggttttcctagggacaggcttagcattcctgactctaggaagaaggagcagtgaggcggagaaacagtggaggggatggtggcattgggccccatggggccgagatggacacagggctcgttctcttgagtctggtgccaaggacagctgaagacgacatcattttcaggtggagaggagagagtggagggagatcatgccctgtgatgtgtcttttgcaggtgaaggtgggagacaaggtctctgctgacgatgaggcagagccaccgtgaaagttgtaataggaggactgcccgccgctggaagggcctgcagtgacgctaggacaccctctgcctgcatgtcacgttagctgggctgggcgaagtagaagaccaaggggaagaggtgcagtggggagaccaggtgggatgcaaccacaggaccagtggaggggctgtggcacgtgggcggagactgagtggctgggcatgtgttgtggctgagcatgtggtgtgggcagtggtcctagaccccgccatgtccggacaatgatatagagcgtctcagcatcgccagtctagactgtctatggagagcagaaagttgtctngggctgcctggggaactgtgaggccagctatatcaccgtcgctgatggtgacattacggtggtggcaggagcaaggagagagggaagaaggaccccgtccagctttagtcacaaaatacccaatggaagatgccagtgccaatcctgtgggtttccttgggacttcacactggctttcttatctgctccagatccattcagtagtcactgagttcctgccaaatactttgtagcgccagaagccaggagcggggtctgcagcagggcagtccccnttttcaggaaatgcctggagctgctggtccctgagagaaaggaaaacatctttcagccgtacgcaggccaagaaggccaatgtccagtagctttgtgattttttttatatttttttatttatttatttttgagatagagtcttgctctgtcgctcaggctggagtgcagtggcgtgatctccactcactgcaacttccgcctcctggggtcaagcagttctgcctcagcctcccgagtagctgggattacaggcacacgccaccacacccagctaatttttgtgtttttagtagagacggtttcaccatgtcggccaggctggtctcaaactcctgacctcagatgattcagcctcccaaagtgctgggattacaggtgtgagccactgcacccagcctgtgatgtttctgtggggttccacaaatgtgtgtgtgtgtaaaagctgatgattacagcaagaatgtgaacagtagcagttttccatttgaaggcaagttttgtctttatctgggtatcagaaggaccctctgggccattgtcgcttcctgtactcagagccaccctagtactacgggcacacacagaaaacagcagcctgcgtactttcaaaggaaaggcatctttaatcaccaatgcctggaaaaattattttgtttccctcttccttccgtcttgtttcctaacttcttaccaaagtttagagtctgagtttttcgtataataatgtcccacatccacacatcgggcctacagatgctctcccttgaatcgactggaaacatgacaccggttccatgctctggaactgtcacctgtgatgtgctgggctgtgtcccaagcacaggaatcccagcagtttcagctcgatgcagaaccaccatgctccagacacaggcttgggaaagacacgtcaaaattaaaatactaggtaagagaagcacctgattgggtagaagttggagaggaatcctggaattttgtggccagaaggagccactgccccttttgtttagtaagactagacagtaacagaagccagttgtcagctatgaaagtggtgggtgaagcaggggaggctcctctatggtgggaccctggacaagggaagccgaatgtgtgaagaaggggtgcgggggtgtgcggtgccctaggacactagggcaaaggtttcaaacctggaacaaggcactggaggaagatctgctgccagtcagcagtgcgggccctcgagttagcagtccgtgcgcagaggggccagttctgagaccagtttggagagtcaggcagtgacccattggccatgtcataattccttcagcctgcctcctctttaatcccagagagtgctctttcttcatacttcctttaaaatactaaattgttcccattccatggggagctggctaggctttacaggctaggaaatgtaggttttctgagatggaaccatctacacaaggaggaggaaggcactaagactacagatgagacccatgacagggctgagcatttggaagccaaccctggttgcttttcaagaattgctttgtggctgggtgcagtggttcacacctgtaattgcagcactttgggaggctgaggcaggtggattgcttgaacccaggagttcgagaccagcctgggcaacatatgggacaccccaccgcccccggctctgcaaaaaaattaaaaattagccaggcgtggtgtcatgagcctgtggtctcaactactcaggaggctgaggctggaggatcgcttgaacctgggaggtcaaggctccagtgaaccataattgtgccactgcactgcagcctgggcgacaatttgttttctaaattgcttttgaaagtctactgcattacatattccaaaaagcagtggttttcaaatacttttatcaccgatatccttttatgaaatgaaatcagtagaactttctctgctctgaataagcaagggtgggaacctgtctacctcccacagatagcataatgtgcctgccatagaggagccaaaaaatggtgatgggaactgagaggagagcaaatgtcacaaaagactgagcaattgagaaaacaaaacaagaccacagatgactgttaacgcctccacagtggaccaagaaaggacagagagctggcagcatgggcatcactgtctggtcggcagcaggaaggcctcgctagggaattgagtacagtcatctaactagtttaaaagtacaggaaggatgattaaggctattggagaggtcatacaaataggggaggggcaggcaatggctgataagacatgaatttgtaaggcgatgagtattgcagtcagcaaaacaaacgagactgctctcccaacacataactcagcagggaggccaggcattggtttaaccatttaatataaagaagttaaaattacaaatgcgctaagtgcctaaagaagaataagtgcaggaatgagagcagcatggactgccacagttttagaataagcactgtcactgctagattggaaacaaaaatccataaatttggcccggtgtggtggcggacgcctgtagtcccagctacttggaggctgaggcgtgagaatcgcttgaacccgggaggcggaggttgcagtgagccgagatggcgccactgcactccagcctgggcgtcagagtgagaactctgtatcaaaaaataaaaanaaaaaaaagtccataaatctgcaatgtctcagttaagaaagaaagactgggccaatgcagatttcaaaccggagaaagtcatactgtcagtgaaggccgcctgtggccggaaggcgccaggggattagcaccctggactcagtgttgctgggaaacagggccccaaggctgggagcacagtgtttaaagggcatctacccaagaagggagcacagggcaaggaggagctgcagggggncttggctgccaaagtgaattctgaggagagagctattgctgcctacgatatgcaggctgcacagaacacaagtggaatcagcaggcaggagaggcagctaacgacgcagcccgtttcttatttctgttttctcacaagcgatgaaagtggaaaagagggtgagcaggtggcccacacatgtgcctccagtgctgcggcccctccggggaccatcngccaggccccggggagggagccagccacagtgtgtccggctcttctctgaagggaagagagccttgaatagactgaagcgaagacggttctgcaaggacaaggcagaccgaaggcattggttttttttttcagataaggagaattagactcccaagtagacaccagagtcactgtttggttggtgggtgatagtggggtcacagtggctgcctgtgctcccccagggtgagcgtgactgtgctaacctgggtggggcagcatgcacacccctctggcagccctttgttgctcgctgatgacaagtttggatgatcccgccaaacagcttgctaagatgtagtccccagtgttggaggtggggcctgatgggaggtgctacccttgtgagataaggttgtgtaaaagcctgtggcacctccccacactgacgctctcacccctgctctggccatgtgccgcgcctgctcccacttccccttctgccaggagtaaaagcccccgagacctcccagaagccaagcagatgctagtgccatgcttcctctgcagcctgcagaactgtgagccaattaaacctcttttctctat

SEQ ID NO: 300111 - DNA, 10195 bp, Homo sapiens
  misc_feature (5247)..(5247): n is a, c, g, or t
  misc_feature (6185)..(6185): n is a, c, g, or t
  misc_feature (6460)..(6460): n is a, c, g, or t
  misc_feature (9153)..(9153): n is a, c, g, or t
  misc_feature (9391)..(9391): n is a, c, g, or t
  misc_feature (9606)..(9606): n is a, c, g, or t
gcgcccctccctccgcccgcccgccggcccgcccgtcagtctggcaggcaggcaggcaatcggtccgagtggctgtcggctcttcagctctcccgctcggcgtcttccttcctcctcccggtcagcgtcggcggctgcaccggcggcggcgcagtccctgcgggaggggcgacaagagctgagcggcggccgccgagcgtcgagctcagcgcggcggaggcggcggcggcccggcagccaacatggcggcggcggcggcggcgggcgcgggcccggagatggtccgcgggcaggtgttcgacgtggggccgcgctacaccaacctctcgtacatcggcgagggcgcctacggcatggtgtgctctgcttatgataatgtcaacaaagttcgagtagctatcaagaaaatcagcccctttgagcaccagacctactgccagagaaccctgagggagataaaaatcttactgcgcttcagacatgagaacatcattggaatcaatgacattattcgagcaccaaccatcgagcaaatgaaagatgtatatatagtacaggacctcatggaaacagatctttacaagctcttgaagacacaacacctcagcaatgaccatatctgctattttctctaccagatcctcagagggttaaaatatatccattcagctaacgttctgcaccgtgacctcaagccttccaacctactgcttactgttgctttagtcactaattgctttctggtttgaaagatgcagtggttcctccctctcctgaatccttttctacatgatgccctgctgaccatgcagccgcaccagagagagattcttccccaattggctctagtcactggcatctcactttatgatagggaaggctactacctagggcactttaagtcagtgacagccccttatttgcacttcaccttttgaccataactgtttccccagagcaggagcttgtggaaataccttggctgatgttgcagcctgcagcaagtgcttccgtctccggaatccttggggagcacttgtccacgtcttttctcatatcatggtagtcactaacatatataaggtatgtgctattggcccagcttttagaaaatgcagtcatttttctaaataaaaaggaagtactgcacccagcagtgtcactctgtagttactgtggtcacttgtaccatatagaggtgtaacacttgtcaagaagcgttatgtgcagtacttaatgtttgtaagacttacaaaaaaagatttaaagtggcagcttcactcgacatttggtgagagaagtacaaaggttgcagtgctgagctgtgggcggtttctggggatgtcccagggtggaactccacatgctggtgcatatacgcccttgagctacttcaaatgtgggtgtttcagtaaccacgttccatgcctgaggatttagcagagaggaacactgcgtctttaaatgagaaagtatacaattctttttccttctacagcatgtcagcatctcaagttcatttttcaacctacagtataacaatttgtaataaagcctccaggagctcatgacgtgaagcactgttctgtcctcaagtactcaaatatttctgatactgctgagtcagactgtcagaaaaagctagcactaactcgtgtttggagctctatccatattttactgatctctttaagtatttgttcctgccactgtgtactgtggagttgactcggtgttctgtcccagtgcggtgcctcctcttgacttccccactgctctctgtggtgagaaatttgccttgttcaataattactgtaccctcgcatgactgttacagctttctgtgcagagatgactgtccaagtgccacatgcctacgattgaaatgaaaactctattgttacctctgagttgtgttccacggaaaatgctatccagcagatcatttaggaaaaataattctatttttagcttttcatttctcagctgtccttttttcttgtttgatttttgacagcaatggagaatgggttatataaagactgcctgctaatatgaacagaaatgcatttgtaattcatgaaaataaatgtacatcttctatcttcacattcatgttaagattcagtgttgctttcctctggatcagcgtgtctgaatggacagtcaggttcaggttgtgctgaacacagaaatgctcacaggcctcactttgccgcccaggcactggcccagcacttggatttacataagatgagttagaaaggtacttctgtagggtcctttttacctctgctcggcagagaatcgatgctgtcatgttcctttattcacaatcttaggtctcaaatattctgtcaaaccctaacaaagaagccccgacatctcaggttggattccctggttctctctaaagagggcctgcccttgtgccccagaggtgctgctgggcacagccaagagttgggaagggccgccccacagtacgcagtcctcaccacccagcccagggtgctcacgctcaccactcctgtggctgaggaaggatagctggctcatcctcggaaaacagacccacatctctattcttgccctgaaatacgcgcttttcacttgcgtgctcagagctgccgtctgaaggtccacacagcattgacgggacacagaaatgtgactgttaccggataacactgattagtcagttttcatttataaaaaagcattgacagttttattactcttgtttctttttaaatggaaagttactattataaggttaatttgcagtcctcttctaaatagaaaaccatatccttggctactaacatctggagactgtgagctccttcccattccccttcctggtactgtggagtcagattggcatgaaaccactaacttcattctagaatcattgtagccataagttgtgtgctttttattaatcatgccaaacataatgtaactgggcagagaatggtcctaaccaaggtacctatgaaaagcgctagctatcatgtgtagtagatgcatcattttggctcttcttacatttgtaaaaatgtacagattaggtcatcttaattcatattagtgacacggaacagcacctccactatttgtatgttcaaataagctttcagactaatagcttttttggtgtctaaaatgtaagcaaaaaattcctgctgaaacattccagtcctttcatttagtataaaagaaatactgaacaagccagtgggatggaattgaaagaactaatcatgaggactctgtcctgacacaggtcctcaaagctagcagagatacgcagacattgtggcatctgggtagaagaatactgtattgtgtgtgcagtgcacagtgtgtggtgtgtgcacactcattccttctgctcttgggcacaggcagtgggtgtagaggtaaccagtagctttgagaagctacatgtagctcaccagtggttttctctaaggaatcacaaaggtaaactacccaaccacatgccacgtaatatttcagccattcagaggaaactgttttctctttatttgcttatatgttaatatggtttttaaattggtaacttttatatagtatggtaacagtatgttaatacacacatacatatgcacacatgctttgggtccttccataatacttttatatttgtaaatcaatgttttggagcaatcccaagtttaagggaaatatttttgtaaatgtaatggttttgaaaatctgagcaatccttttgcttatacatttttaaagcatttgtgctttaaaattgttatgctggtgtttgaaacatgatactcctgtggtgcagatgagaagctataacagtgaatatgtggtttctcttacgtcatccaccttgacatgatgggtcagaaacaaatggaaatccagagcaagtcctccagggttgcaccaggtttacctaaagcttgttgccttttcttgtgctgtttatccgtgtagagcactcaagaaagttctgaaactgctttgtatctgctttgtactgttggtgccttcttggtattgtaccccaaaattctgcatagattatttagtataatggtaagttaaaaaatgttaaaggaagattttattaagaatctgaatgtttattcattatattgttacaatttaacattaacatttatttgtggtatttgtgatttggttaatctgtataaaaattgtaagtagaaaggtttatatttcatcttaattcttttgatgttgtaaacgtactttttaaaagatggattatttgaatgtttatggcacctgacttgtaaaaaaaaaaaactacaaaaaaatccttagaatcattaaattgtgtccctgtattaccaaaataacacagcaccgtgcatgtatagtttaattgcagtttcatctgtgaaaacgtgaaattgtctagtccttcgttatgttccccagatgtcttccagatttgctctgcatgtggtaacttgtgttagggctgtgagctgttcctcgagttgaatggggatgtcagtgctcctagggttctccaggtggttcttcagaccttcacctgtgggggggggggtaggcggtgcccacgcccatctcctcatcctcctgaacttctgcaaccccactgctgggcagacatcctgggcaaccccttttttcagagcaagaagtcataaagataggatttcttggacatttggttcttatcaatattgggcattatgtaatgacttatttacaaaacaaagatactggaaaatgttttggatgtggtgttatggaaagagcacaggccttggacccatccagctgggttcagaactaccccctgcttataactgcggctggctgtgggccagtcattctgcgtctctgctttcttcctctgcttcagactgtcagctgtaaagtggaagcaatattacttgccttgtatatggtaaagattataaaaatacatttcaactgttcagcatagtacttcaaagcaagtactcagtaaatagcaagtctttttaaatgctgctttatttcactaaattttgttgtgaggtgtcactaaaatgcctgcaaacaaacgtaactgctaatctgagaggaaaccctcttactaatcagagaagaaaccctcctgtcagaaaccttcagggaagtgagctgatcacacctaaactgggagtttgcaatggggtatttgaagcactgtgggagtattccactggcccnctccctgagagacttaacagtcttccctgttgtccagattctgtataaggcaatcagaataatcatcttccttgttcagcagaggagcctggtcccattttccccactttgtgatgggcttctctcagcggtagctcagcagttccagatggcagtttggaccagcatctaggctggccagttcgctgtgtttacttagaaccaacacgttcagagctggcctggaccatctgaggggaacaggaaacacccctaggctgtggaagcaagtgcagacccccacccccggccctgaagccaagggggcagggtttgggagtggccaaagagaagcagtgcagggatgggttttcctagggacaggcttagcattcctgactctaggaagaaggagcagtgaggcggagaaacagtggaggggatggtggcattgggccccatggggccgagatggacacagggctcgttctcttgagtctggtgccaaggacagctgaagacgacatcattttcaggtggagaggagagagtggagggagatcatgccctgtgatgtgtcttttgcaggtgaaggtgggagacaaggtctctgctgacgatgaggcagagccaccgtgaaagttgtaataggaggactgcccgccgctggaagggcctgcagtgacgctaggacaccctctgcctgcatgtcacgttagctgggctgggcgaagtagaagaccaaggggaagaggtgcagtggggagaccaggtgggatgcaaccacaggaccagtggaggggctgtggcacgtgggcggagactgagtggctgggcatgtgttgtggctgagcatgtggtgtgggcagtggtcctagaccccgccatgtccggacaatgatatagagcgtctcagcatcgccagtctagactgtctatggagagcagaaagttgtctngggctgcctggggaactgtgaggccagctatatcaccgtcgctgatggtgacattacggtggtggcaggagcaaggagagagggaagaaggaccccgtccagctttagtcacaaaatacccaatggaagatgccagtgccaatcctgtgggtttccttgggacttcacactggctttcttatctgctccagatccattcagtagtcactgagttcctgccaaatactttgtagcgccagaagccaggagcggggtctgcagcagggcagtccccnttttcaggaaatgcctggagctgctggtccctgagagaaaggaaaacatctttcagccgtacgcaggccaagaaggccaatgtccagtagctttgtgattttttttatatttttttatttatttatttttgagatagagtcttgctctgtcgctcaggctggagtgcagtggcgtgatctccactcactgcaacttccgcctcctggggtcaagcagttctgcctcagcctcccgagtagctgggattacaggcacacgccaccacacccagctaatttttgtgtttttagtagagacggtttcaccatgtcggccaggctggtctcaaactcctgacctcagatgattcagcctcccaaagtgctgggattacaggtgtgagccactgcacccagcctgtgatgtttctgtggggttccacaaatgtgtgtgtgtgtaaaagctgatgattacagcaagaatgtgaacagtagcagttttccatttgaaggcaagttttgtctttatctgggtatcagaaggaccctctgggccattgtcgcttcctgtactcagagccaccctagtactacgggcacacacagaaaacagcagcctgcgtactttcaaaggaaaggcatctttaatcaccaatgcctggaaaaattattttgtttccctcttccttccgtcttgtttcctaacttcttaccaaagtttagagtctgagtttttcgtataataatgtcccacatccacacatcgggcctacagatgctctcccttgaatcgactggaaacatgacaccggttccatgctctggaactgtcacctgtgatgtgctgggctgtgtcccaagcacaggaatcccagcagtttcagctcgatgcagaaccaccatgctccagacacaggcttgggaaagacacgtcaaaattaaaatactaggtaagagaagcacctgattgggtagaagttggagaggaatcctggaattttgtggccagaaggagccactgccccttttgtttagtaagactagacagtaacagaagccagttgtcagctatgaaagtggtgggtgaagcaggggaggctcctctatggtgggaccctggacaagggaagccgaatgtgtgaagaaggggtgcgggggtgtgcggtgccctaggacactagggcaaaggtttcaaacctggaacaaggcactggaggaagatctgctgccagtcagcagtgcgggccctcgagttagcagtccgtgcgcagaggggccagttctgagaccagtttggagagtcaggcagtgacccattggccatgtcataattccttcagcctgcctcctctttaatcccagagagtgctctttcttcatacttcctttaaaatactaaattgttcccattccatggggagctggctaggctttacaggctaggaaatgtaggttttctgagatggaaccatctacacaaggaggaggaaggcactaagactacagatgagacccatgacagggctgagcatttggaagccaaccctggttgcttttcaagaattgctttgtggctgggtgcagtggttcacacctgtaattgcagcactttgggaggctgaggcaggtggattgcttgaacccaggagttcgagaccagcctgggcaacatatgggacaccccaccgcccccggctctgcaaaaaaattaaaaattagccaggcgtggtgtcatgagcctgtggtctcaactactcaggaggctgaggctggaggatcgcttgaacctgggaggtcaaggctccagtgaaccataattgtgccactgcactgcagcctgggcgacaatttgttttctaaattgcttttgaaagtctactgcattacatattccaaaaagcagtggttttcaaatacttttatcaccgatatccttttatgaaatgaaatcagtagaactttctctgctctgaataagcaagggtgggaacctgtctacctcccacagatagcataatgtgcctgccatagaggagccaaaaaatggtgatgggaactgagaggagagcaaatgtcacaaaagactgagcaattgagaaaacaaaacaagaccacagatgactgttaacgcctccacagtggaccaagaaaggacagagagctggcagcatgggcatcactgtctggtcggcagcaggaaggcctcgctagggaattgagtacagtcatctaactagtttaaaagtacaggaaggatgattaaggctattggagaggtcatacaaataggggaggggcaggcaatggctgataagacatgaatttgtaaggcgatgagtattgcagtcagcaaaacaaacgagactgctctcccaacacataactcagcagggaggccaggcattggtttaaccatttaatataaagaagttaaaattacaaatgcgctaagtgcctaaagaagaataagtgcaggaatgagagcagcatggactgccacagttttagaataagcactgtcactgctagattggaaacaaaaatccataaatttggcccggtgtggtggcggacgcctgtagtcccagctacttggaggctgaggcgtgagaatcgcttgaacccgggaggcggaggttgcagtgagccgagatggcgccactgcactccagcctgggcgtcagagtgagaactctgtatcaaaaaataaaaanaaaaaaaagtccataaatctgcaatgtctcagttaagaaagaaagactgggccaatgcagatttcaaaccggagaaagtcatactgtcagtgaaggccgcctgtggccggaaggcgccaggggattagcaccctggactcagtgttgctgggaaacagggccccaaggctgggagcacagtgtttaaagggcatctacccaagaagggagcacagggcaaggaggagctgcagggggncttggctgccaaagtgaattctgaggagagagctattgctgcctacgatatgcaggctgcacagaacacaagtggaatcagcaggcaggagaggcagctaacgacgcagcccgtttcttatttctgttttctcacaagcgatgaaagtggaaaagagggtgagcaggtggcccacacatgtgcctccagtgctgcggcccctccggggaccatcngccaggccccggggagggagccagccacagtgtgtccggctcttctctgaagggaagagagccttgaatagactgaagcgaagacggttctgcaaggacaaggcagaccgaaggcattggttttttttttcagataaggagaattagactcccaagtagacaccagagtcactgtttggttggtgggtgatagtggggtcacagtggctgcctgtgctcccccagggtgagcgtgactgtgctaacctgggtggggcagcatgcacacccctctggcagccctttgttgctcgctgatgacaagtttggatgatcccgccaaacagcttgctaagatgtagtccccagtgttggaggtggggcctgatgggaggtgctacccttgtgagataaggttgtgtaaaagcctgtggcacctccccacactgacgctctcacccctgctctggccatgtgccgcgcctgctcccacttccccttctgccaggagtaaaagcccccgagacctcccagaagccaagcagatgctagtgccatgcttcctctgcagcctgcagaactgtgagccaattaaacctcttttctctat

SEQ ID NO: 300112 - DNA, 9272 bp, Homo sapiens
  misc_feature (4324)..(4324): n is a, c, g, or t
  misc_feature (5262)..(5262): n is a, c, g, or t
  misc_feature (5537)..(5537): n is a, c, g, or t
  misc_feature (8230)..(8230): n is a, c, g, or t
  misc_feature (8468)..(8468): n is a, c, g, or t
  misc_feature (8683)..(8683): n is a, c, g, or t
atgagccgctccgattatcctatagatcagtagagcaggagcttgtggaaataccttggctgatgttgcagcctgcagcaagtgcttccgtctccggaatccttggggagcacttgtccacgtcttttctcatatcatggtagtcactaacatatataaggtatgtgctattggcccagcttttagaaaatgcagtcatttttctaaataaaaaggaagtactgcacccagcagtgtcactctgtagttactgtggtcacttgtaccatatagaggtgtaacacttgtcaagaagcgttatgtgcagtacttaatgtttgtaagacttacaaaaaaagatttaaagtggcagcttcactcgacatttggtgagagaagtacaaaggttgcagtgctgagctgtgggcggtttctggggatgtcccagggtggaactccacatgctggtgcatatacgcccttgagctacttcaaatgtgggtgtttcagtaaccacgttccatgcctgaggatttagcagagaggaacactgcgtctttaaatgagaaagtatacaattctttttccttctacagcatgtcagcatctcaagttcatttttcaacctacagtataacaatttgtaataaagcctccaggagctcatgacgtgaagcactgttctgtcctcaagtactcaaatatttctgatactgctgagtcagactgtcagaaaaagctagcactaactcgtgtttggagctctatccatattttactgatctctttaagtatttgttcctgccactgtgtactgtggagttgactcggtgttctgtcccagtgcggtgcctcctcttgacttccccactgctctctgtggtgagaaatttgccttgttcaataattactgtaccctcgcatgactgttacagctttctgtgcagagatgactgtccaagtgccacatgcctacgattgaaatgaaaactctattgttacctctgagttgtgttccacggaaaatgctatccagcagatcatttaggaaaaataattctatttttagcttttcatttctcagctgtccttttttcttgtttgatttttgacagcaatggagaatgggttatataaagactgcctgctaatatgaacagaaatgcatttgtaattcatgaaaataaatgtacatcttctatcttcacattcatgttaagattcagtgttgctttcctctggatcagcgtgtctgaatggacagtcaggttcaggttgtgctgaacacagaaatgctcacaggcctcactttgccgcccaggcactggcccagcacttggatttacataagatgagttagaaaggtacttctgtagggtcctttttacctctgctcggcagagaatcgatgctgtcatgttcctttattcacaatcttaggtctcaaatattctgtcaaaccctaacaaagaagccccgacatctcaggttggattccctggttctctctaaagagggcctgcccttgtgccccagaggtgctgctgggcacagccaagagttgggaagggccgccccacagtacgcagtcctcaccacccagcccagggtgctcacgctcaccactcctgtggctgaggaaggatagctggctcatcctcggaaaacagacccacatctctattcttgccctgaaatacgcgcttttcacttgcgtgctcagagctgccgtctgaaggtccacacagcattgacgggacacagaaatgtgactgttaccggataacactgattagtcagttttcatttataaaaaagcattgacagttttattactcttgtttctttttaaatggaaagttactattataaggttaatttgcagtcctcttctaaatagaaaaccatatccttggctactaacatctggagactgtgagctccttcccattccccttcctggtactgtggagtcagattggcatgaaaccactaacttcattctagaatcattgtagccataagttgtgtgctttttattaatcatgccaaacataatgtaactgggcagagaatggtcctaaccaaggtacctatgaaaagcgctagctatcatgtgtagtagatgcatcattttggctcttcttacatttgtaaaaatgtacagattaggtcatcttaattcatattagtgacacggaacagcacctccactatttgtatgttcaaataagctttcagactaatagcttttttggtgtctaaaatgtaagcaaaaaattcctgctgaaacattccagtcctttcatttagtataaaagaaatactgaacaagccagtgggatggaattgaaagaactaatcatgaggactctgtcctgacacaggtcctcaaagctagcagagatacgcagacattgtggcatctgggtagaagaatactgtattgtgtgtgcagtgcacagtgtgtggtgtgtgcacactcattccttctgctcttgggcacaggcagtgggtgtagaggtaaccagtagctttgagaagctacatgtagctcaccagtggttttctctaaggaatcacaaaggtaaactacccaaccacatgccacgtaatatttcagccattcagaggaaactgttttctctttatttgcttatatgttaatatggtttttaaattggtaacttttatatagtatggtaacagtatgttaatacacacatacatatgcacacatgctttgggtccttccataatacttttatatttgtaaatcaatgttttggagcaatcccaagtttaagggaaatatttttgtaaatgtaatggttttgaaaatctgagcaatccttttgcttatacatttttaaagcatttgtgctttaaaattgttatgctggtgtttgaaacatgatactcctgtggtgcagatgagaagctataacagtgaatatgtggtttctcttacgtcatccaccttgacatgatgggtcagaaacaaatggaaatccagagcaagtcctccagggttgcaccaggtttacctaaagcttgttgccttttcttgtgctgtttatccgtgtagagcactcaagaaagttctgaaactgctttgtatctgctttgtactgttggtgccttcttggtattgtaccccaaaattctgcatagattatttagtataatggtaagttaaaaaatgttaaaggaagattttattaagaatctgaatgtttattcattatattgttacaatttaacattaacatttatttgtggtatttgtgatttggttaatctgtataaaaattgtaagtagaaaggtttatatttcatcttaattcttttgatgttgtaaacgtactttttaaaagatggattatttgaatgtttatggcacctgacttgtaaaaaaaaaaaactacaaaaaaatccttagaatcattaaattgtgtccctgtattaccaaaataacacagcaccgtgcatgtatagtttaattgcagtttcatctgtgaaaacgtgaaattgtctagtccttcgttatgttccccagatgtcttccagatttgctctgcatgtggtaacttgtgttagggctgtgagctgttcctcgagttgaatggggatgtcagtgctcctagggttctccaggtggttcttcagaccttcacctgtgggggggggggtaggcggtgcccacgcccatctcctcatcctcctgaacttctgcaaccccactgctgggcagacatcctgggcaaccccttttttcagagcaagaagtcataaagataggatttcttggacatttggttcttatcaatattgggcattatgtaatgacttatttacaaaacaaagatactggaaaatgttttggatgtggtgttatggaaagagcacaggccttggacccatccagctgggttcagaactaccccctgcttataactgcggctggctgtgggccagtcattctgcgtctctgctttcttcctctgcttcagactgtcagctgtaaagtggaagcaatattacttgccttgtatatggtaaagattataaaaatacatttcaactgttcagcatagtacttcaaagcaagtactcagtaaatagcaagtctttttaaatgctgctttatttcactaaattttgttgtgaggtgtcactaaaatgcctgcaaacaaacgtaactgctaatctgagaggaaaccctcttactaatcagagaagaaaccctcctgtcagaaaccttcagggaagtgagctgatcacacctaaactgggagtttgcaatggggtatttgaagcactgtgggagtattccactggcccnctccctgagagacttaacagtcttccctgttgtccagattctgtataaggcaatcagaataatcatcttccttgttcagcagaggagcctggtcccattttccccactttgtgatgggcttctctcagcggtagctcagcagttccagatggcagtttggaccagcatctaggctggccagttcgctgtgtttacttagaaccaacacgttcagagctggcctggaccatctgaggggaacaggaaacacccctaggctgtggaagcaagtgcagacccccacccccggccctgaagccaagggggcagggtttgggagtggccaaagagaagcagtgcagggatgggttttcctagggacaggcttagcattcctgactctaggaagaaggagcagtgaggcggagaaacagtggaggggatggtggcattgggccccatggggccgagatggacacagggctcgttctcttgagtctggtgccaaggacagctgaagacgacatcattttcaggtggagaggagagagtggagggagatcatgccctgtgatgtgtcttttgcaggtgaaggtgggagacaaggtctctgctgacgatgaggcagagccaccgtgaaagttgtaataggaggactgcccgccgctggaagggcctgcagtgacgctaggacaccctctgcctgcatgtcacgttagctgggctgggcgaagtagaagaccaaggggaagaggtgcagtggggagaccaggtgggatgcaaccacaggaccagtggaggggctgtggcacgtgggcggagactgagtggctgggcatgtgttgtggctgagcatgtggtgtgggcagtggtcctagaccccgccatgtccggacaatgatatagagcgtctcagcatcgccagtctagactgtctatggagagcagaaagttgtctngggctgcctggggaactgtgaggccagctatatcaccgtcgctgatggtgacattacggtggtggcaggagcaaggagagagggaagaaggaccccgtccagctttagtcacaaaatacccaatggaagatgccagtgccaatcctgtgggtttccttgggacttcacactggctttcttatctgctccagatccattcagtagtcactgagttcctgccaaatactttgtagcgccagaagccaggagcggggtctgcagcagggcagtccccnttttcaggaaatgcctggagctgctggtccctgagagaaaggaaaacatctttcagccgtacgcaggccaagaaggccaatgtccagtagctttgtgattttttttatatttttttatttatttatttttgagatagagtcttgctctgtcgctcaggctggagtgcagtggcgtgatctccactcactgcaacttccgcctcctggggtcaagcagttctgcctcagcctcccgagtagctgggattacaggcacacgccaccacacccagctaatttttgtgtttttagtagagacggtttcaccatgtcggccaggctggtctcaaactcctgacctcagatgattcagcctcccaaagtgctgggattacaggtgtgagccactgcacccagcctgtgatgtttctgtggggttccacaaatgtgtgtgtgtgtaaaagctgatgattacagcaagaatgtgaacagtagcagttttccatttgaaggcaagttttgtctttatctgggtatcagaaggaccctctgggccattgtcgcttcctgtactcagagccaccctagtactacgggcacacacagaaaacagcagcctgcgtactttcaaaggaaaggcatctttaatcaccaatgcctggaaaaattattttgtttccctcttccttccgtcttgtttcctaacttcttaccaaagtttagagtctgagtttttcgtataataatgtcccacatccacacatcgggcctacagatgctctcccttgaatcgactggaaacatgacaccggttccatgctctggaactgtcacctgtgatgtgctgggctgtgtcccaagcacaggaatcccagcagtttcagctcgatgcagaaccaccatgctccagacacaggcttgggaaagacacgtcaaaattaaaatactaggtaagagaagcacctgattgggtagaagttggagaggaatcctggaattttgtggccagaaggagccactgccccttttgtttagtaagactagacagtaacagaagccagttgtcagctatgaaagtggtgggtgaagcaggggaggctcctctatggtgggaccctggacaagggaagccgaatgtgtgaagaaggggtgcgggggtgtgcggtgccctaggacactagggcaaaggtttcaaacctggaacaaggcactggaggaagatctgctgccagtcagcagtgcgggccctcgagttagcagtccgtgcgcagaggggccagttctgagaccagtttggagagtcaggcagtgacccattggccatgtcataattccttcagcctgcctcctctttaatcccagagagtgctctttcttcatacttcctttaaaatactaaattgttcccattccatggggagctggctaggctttacaggctaggaaatgtaggttttctgagatggaaccatctacacaaggaggaggaaggcactaagactacagatgagacccatgacagggctgagcatttggaagccaaccctggttgcttttcaagaattgctttgtggctgggtgcagtggttcacacctgtaattgcagcactttgggaggctgaggcaggtggattgcttgaacccaggagttcgagaccagcctgggcaacatatgggacaccccaccgcccccggctctgcaaaaaaattaaaaattagccaggcgtggtgtcatgagcctgtggtctcaactactcaggaggctgaggctggaggatcgcttgaacctgggaggtcaaggctccagtgaaccataattgtgccactgcactgcagcctgggcgacaatttgttttctaaattgcttttgaaagtctactgcattacatattccaaaaagcagtggttttcaaatacttttatcaccgatatccttttatgaaatgaaatcagtagaactttctctgctctgaataagcaagggtgggaacctgtctacctcccacagatagcataatgtgcctgccatagaggagccaaaaaatggtgatgggaactgagaggagagcaaatgtcacaaaagactgagcaattgagaaaacaaaacaagaccacagatgactgttaacgcctccacagtggaccaagaaaggacagagagctggcagcatgggcatcactgtctggtcggcagcaggaaggcctcgctagggaattgagtacagtcatctaactagtttaaaagtacaggaaggatgattaaggctattggagaggtcatacaaataggggaggggcaggcaatggctgataagacatgaatttgtaaggcgatgagtattgcagtcagcaaaacaaacgagactgctctcccaacacataactcagcagggaggccaggcattggtttaaccatttaatataaagaagttaaaattacaaatgcgctaagtgcctaaagaagaataagtgcaggaatgagagcagcatggactgccacagttttagaataagcactgtcactgctagattggaaacaaaaatccataaatttggcccggtgtggtggcggacgcctgtagtcccagctacttggaggctgaggcgtgagaatcgcttgaacccgggaggcggaggttgcagtgagccgagatggcgccactgcactccagcctgggcgtcagagtgagaactctgtatcaaaaaataaaaanaaaaaaaagtccataaatctgcaatgtctcagttaagaaagaaagactgggccaatgcagatttcaaaccggagaaagtcatactgtcagtgaaggccgcctgtggccggaaggcgccaggggattagcaccctggactcagtgttgctgggaaacagggccccaaggctgggagcacagtgtttaaagggcatctacccaagaagggagcacagggcaaggaggagctgcagggggncttggctgccaaagtgaattctgaggagagagctattgctgcctacgatatgcaggctgcacagaacacaagtggaatcagcaggcaggagaggcagctaacgacgcagcccgtttcttatttctgttttctcacaagcgatgaaagtggaaaagagggtgagcaggtggcccacacatgtgcctccagtgctgcggcccctccggggaccatcngccaggccccggggagggagccagccacagtgtgtccggctcttctctgaagggaagagagccttgaatagactgaagcgaagacggttctgcaaggacaaggcagaccgaaggcattggttttttttttcagataaggagaattagactcccaagtagacaccagagtcactgtttggttggtgggtgatagtggggtcacagtggctgcctgtgctcccccagggtgagcgtgactgtgctaacctgggtggggcagcatgcacacccctctggcagccctttgttgctcgctgatgacaagtttggatgatcccgccaaacagcttgctaagatgtagtccccagtgttggaggtggggcctgatgggaggtgctacccttgtgagataaggttgtgtaaaagcctgtggcacctccccacactgacgctctcacccctgctctggccatgtgccgcgcctgctcccacttccccttctgccaggagtaaaagcccccgagacctcccagaagccaagcagatgctagtgccatgcttcctctgcagcctgcagaactgtgagccaattaaacctcttttctctat

SEQ ID NO: 300113 - DNA, 8729 bp, Homo sapiens
  misc_feature (3)..(3): n is a, c, g, or t
  misc_feature (5)..(5): n is a, c, g, or t
  misc_feature (3781)..(3781): n is a, c, g, or t
  misc_feature (4719)..(4719): n is a, c, g, or t
  misc_feature (4994)..(4994): n is a, c, g, or t
  misc_feature (7687)..(7687): n is a, c, g, or t
  misc_feature (7925)..(7925): n is a, c, g, or t
  misc_feature (8140)..(8140): n is a, c, g, or t
gcngncgcctactactactaaattcgcggccgcgtcgacgcatctcaagttcatttttcaacctacagtataacaatttgtaataaagcctccaggagctcatgacgtgaagcactgttctgtcctcaagtactcaaatatttctgatactgctgagtcagactgtcagaaaaagctagcactaactcgtgtttggagctctatccatattttactgatctctttaagtatttgttcctgccactgtgtactgtggagttgactcggtgttctgtcccagtgcggtgcctcctcttgacttccccactgctctctgtggtgagaaatttgccttgttcaataattactgtaccctcgcatgactgttacagctttctgtgcagagatgactgtccaagtgccacatgcctacgattgaaatgaaaactctattgttacctctgagttgtgttccacggaaaatgctatccagcagatcatttaggaaaaataattctatttttagcttttcatttctcagctgtccttttttcttgtttgatttttgacagcaatggagaatgggttatataaagactgcctgctaatatgaacagaaatgcatttgtaattcatgaaaataaatgtacatcttctatcttcacattcatgttaagattcagtgttgctttcctctggatcagcgtgtctgaatggacagtcaggttcaggttgtgctgaacacagaaatgctcacaggcctcactttgccgcccaggcactggcccagcacttggatttacataagatgagttagaaaggtacttctgtagggtcctttttacctctgctcggcagagaatcgatgctgtcatgttcctttattcacaatcttaggtctcaaatattctgtcaaaccctaacaaagaagccccgacatctcaggttggattccctggttctctctaaagagggcctgcccttgtgccccagaggtgctgctgggcacagccaagagttgggaagggccgccccacagtacgcagtcctcaccacccagcccagggtgctcacgctcaccactcctgtggctgaggaaggatagctggctcatcctcggaaaacagacccacatctctattcttgccctgaaatacgcgcttttcacttgcgtgctcagagctgccgtctgaaggtccacacagcattgacgggacacagaaatgtgactgttaccggataacactgattagtcagttttcatttataaaaaagcattgacagttttattactcttgtttctttttaaatggaaagttactattataaggttaatttgcagtcctcttctaaatagaaaaccatatccttggctactaacatctggagactgtgagctccttcccattccccttcctggtactgtggagtcagattggcatgaaaccactaacttcattctagaatcattgtagccataagttgtgtgctttttattaatcatgccaaacataatgtaactgggcagagaatggtcctaaccaaggtacctatgaaaagcgctagctatcatgtgtagtagatgcatcattttggctcttcttacatttgtaaaaatgtacagattaggtcatcttaattcatattagtgacacggaacagcacctccactatttgtatgttcaaataagctttcagactaatagcttttttggtgtctaaaatgtaagcaaaaaattcctgctgaaacattccagtcctttcatttagtataaaagaaatactgaacaagccagtgggatggaattgaaagaactaatcatgaggactctgtcctgacacaggtcctcaaagctagcagagatacgcagacattgtggcatctgggtagaagaatactgtattgtgtgtgcagtgcacagtgtgtggtgtgtgcacactcattccttctgctcttgggcacaggcagtgggtgtagaggtaaccagtagctttgagaagctacatgtagctcaccagtggttttctctaaggaatcacaaaggtaaactacccaaccacatgccacgtaatatttcagccattcagaggaaactgttttctctttatttgcttatatgttaatatggtttttaaattggtaacttttatatagtatggtaacagtatgttaatacacacatacatatgcacacatgctttgggtccttccataatacttttatatttgtaaatcaatgttttggagcaatcccaagtttaagggaaatatttttgtaaatgtaatggttttgaaaatctgagcaatccttttgcttatacatttttaaagcatttgtgctttaaaattgttatgctggtgtttgaaacatgatactcctgtggtgcagatgagaagctataacagtgaatatgtggtttctcttacgtcatccaccttgacatgatgggtcagaaacaaatggaaatccagagcaagtcctccagggttgcaccaggtttacctaaagcttgttgccttttcttgtgctgtttatccgtgtagagcactcaagaaagttctgaaactgctttgtatctgctttgtactgttggtgccttcttggtattgtaccccaaaattctgcatagattatttagtataatggtaagttaaaaaatgttaaaggaagattttattaagaatctgaatgtttattcattatattgttacaatttaacattaacatttatttgtggtatttgtgatttggttaatctgtataaaaattgtaagtagaaaggtttatatttcatcttaattcttttgatgttgtaaacgtactttttaaaagatggattatttgaatgtttatggcacctgacttgtaaaaaaaaaaaactacaaaaaaatccttagaatcattaaattgtgtccctgtattaccaaaataacacagcaccgtgcatgtatagtttaattgcagtttcatctgtgaaaacgtgaaattgtctagtccttcgttatgttccccagatgtcttccagatttgctctgcatgtggtaacttgtgttagggctgtgagctgttcctcgagttgaatggggatgtcagtgctcctagggttctccaggtggttcttcagaccttcacctgtgggggggggggtaggcggtgcccacgcccatctcctcatcctcctgaacttctgcaaccccactgctgggcagacatcctgggcaaccccttttttcagagcaagaagtcataaagataggatttcttggacatttggttcttatcaatattgggcattatgtaatgacttatttacaaaacaaagatactggaaaatgttttggatgtggtgttatggaaagagcacaggccttggacccatccagctgggttcagaactaccccctgcttataactgcggctggctgtgggccagtcattctgcgtctctgctttcttcctctgcttcagactgtcagctgtaaagtggaagcaatattacttgccttgtatatggtaaagattataaaaatacatttcaactgttcagcatagtacttcaaagcaagtactcagtaaatagcaagtctttttaaatgctgctttatttcactaaattttgttgtgaggtgtcactaaaatgcctgcaaacaaacgtaactgctaatctgagaggaaaccctcttactaatcagagaagaaaccctcctgtcagaaaccttcagggaagtgagctgatcacacctaaactgggagtttgcaatggggtatttgaagcactgtgggagtattccactggcccnctccctgagagacttaacagtcttccctgttgtccagattctgtataaggcaatcagaataatcatcttccttgttcagcagaggagcctggtcccattttccccactttgtgatgggcttctctcagcggtagctcagcagttccagatggcagtttggaccagcatctaggctggccagttcgctgtgtttacttagaaccaacacgttcagagctggcctggaccatctgaggggaacaggaaacacccctaggctgtggaagcaagtgcagacccccacccccggccctgaagccaagggggcagggtttgggagtggccaaagagaagcagtgcagggatgggttttcctagggacaggcttagcattcctgactctaggaagaaggagcagtgaggcggagaaacagtggaggggatggtggcattgggccccatggggccgagatggacacagggctcgttctcttgagtctggtgccaaggacagctgaagacgacatcattttcaggtggagaggagagagtggagggagatcatgccctgtgatgtgtcttttgcaggtgaaggtgggagacaaggtctctgctgacgatgaggcagagccaccgtgaaagttgtaataggaggactgcccgccgctggaagggcctgcagtgacgctaggacaccctctgcctgcatgtcacgttagctgggctgggcgaagtagaagaccaaggggaagaggtgcagtggggagaccaggtgggatgcaaccacaggaccagtggaggggctgtggcacgtgggcggagactgagtggctgggcatgtgttgtggctgagcatgtggtgtgggcagtggtcctagaccccgccatgtccggacaatgatatagagcgtctcagcatcgccagtctagactgtctatggagagcagaaagttgtctngggctgcctggggaactgtgaggccagctatatcaccgtcgctgatggtgacattacggtggtggcaggagcaaggagagagggaagaaggaccccgtccagctttagtcacaaaatacccaatggaagatgccagtgccaatcctgtgggtttccttgggacttcacactggctttcttatctgctccagatccattcagtagtcactgagttcctgccaaatactttgtagcgccagaagccaggagcggggtctgcagcagggcagtccccnttttcaggaaatgcctggagctgctggtccctgagagaaaggaaaacatctttcagccgtacgcaggccaagaaggccaatgtccagtagctttgtgattttttttatatttttttatttatttatttttgagatagagtcttgctctgtcgctcaggctggagtgcagtggcgtgatctccactcactgcaacttccgcctcctggggtcaagcagttctgcctcagcctcccgagtagctgggattacaggcacacgccaccacacccagctaatttttgtgtttttagtagagacggtttcaccatgtcggccaggctggtctcaaactcctgacctcagatgattcagcctcccaaagtgctgggattacaggtgtgagccactgcacccagcctgtgatgtttctgtggggttccacaaatgtgtgtgtgtgtaaaagctgatgattacagcaagaatgtgaacagtagcagttttccatttgaaggcaagttttgtctttatctgggtatcagaaggaccctctgggccattgtcgcttcctgtactcagagccaccctagtactacgggcacacacagaaaacagcagcctgcgtactttcaaaggaaaggcatctttaatcaccaatgcctggaaaaattattttgtttccctcttccttccgtcttgtttcctaacttcttaccaaagtttagagtctgagtttttcgtataataatgtcccacatccacacatcgggcctacagatgctctcccttgaatcgactggaaacatgacaccggttccatgctctggaactgtcacctgtgatgtgctgggctgtgtcccaagcacaggaatcccagcagtttcagctcgatgcagaaccaccatgctccagacacaggcttgggaaagacacgtcaaaattaaaatactaggtaagagaagcacctgattgggtagaagttggagaggaatcctggaattttgtggccagaaggagccactgccccttttgtttagtaagactagacagtaacagaagccagttgtcagctatgaaagtggtgggtgaagcaggggaggctcctctatggtgggaccctggacaagggaagccgaatgtgtgaagaaggggtgcgggggtgtgcggtgccctaggacactagggcaaaggtttcaaacctggaacaaggcactggaggaagatctgctgccagtcagcagtgcgggccctcgagttagcagtccgtgcgcagaggggccagttctgagaccagtttggagagtcaggcagtgacccattggccatgtcataattccttcagcctgcctcctctttaatcccagagagtgctctttcttcatacttcctttaaaatactaaattgttcccattccatggggagctggctaggctttacaggctaggaaatgtaggttttctgagatggaaccatctacacaaggaggaggaaggcactaagactacagatgagacccatgacagggctgagcatttggaagccaaccctggttgcttttcaagaattgctttgtggctgggtgcagtggttcacacctgtaattgcagcactttgggaggctgaggcaggtggattgcttgaacccaggagttcgagaccagcctgggcaacatatgggacaccccaccgcccccggctctgcaaaaaaattaaaaattagccaggcgtggtgtcatgagcctgtggtctcaactactcaggaggctgaggctggaggatcgcttgaacctgggaggtcaaggctccagtgaaccataattgtgccactgcactgcagcctgggcgacaatttgttttctaaattgcttttgaaagtctactgcattacatattccaaaaagcagtggttttcaaatacttttatcaccgatatccttttatgaaatgaaatcagtagaactttctctgctctgaataagcaagggtgggaacctgtctacctcccacagatagcataatgtgcctgccatagaggagccaaaaaatggtgatgggaactgagaggagagcaaatgtcacaaaagactgagcaattgagaaaacaaaacaagaccacagatgactgttaacgcctccacagtggaccaagaaaggacagagagctggcagcatgggcatcactgtctggtcggcagcaggaaggcctcgctagggaattgagtacagtcatctaactagtttaaaagtacaggaaggatgattaaggctattggagaggtcatacaaataggggaggggcaggcaatggctgataagacatgaatttgtaaggcgatgagtattgcagtcagcaaaacaaacgagactgctctcccaacacataactcagcagggaggccaggcattggtttaaccatttaatataaagaagttaaaattacaaatgcgctaagtgcctaaagaagaataagtgcaggaatgagagcagcatggactgccacagttttagaataagcactgtcactgctagattggaaacaaaaatccataaatttggcccggtgtggtggcggacgcctgtagtcccagctacttggaggctgaggcgtgagaatcgcttgaacccgggaggcggaggttgcagtgagccgagatggcgccactgcactccagcctgggcgtcagagtgagaactctgtatcaaaaaataaaaanaaaaaaaagtccataaatctgcaatgtctcagttaagaaagaaagactgggccaatgcagatttcaaaccggagaaagtcatactgtcagtgaaggccgcctgtggccggaaggcgccaggggattagcaccctggactcagtgttgctgggaaacagggccccaaggctgggagcacagtgtttaaagggcatctacccaagaagggagcacagggcaaggaggagctgcagggggncttggctgccaaagtgaattctgaggagagagctattgctgcctacgatatgcaggctgcacagaacacaagtggaatcagcaggcaggagaggcagctaacgacgcagcccgtttcttatttctgttttctcacaagcgatgaaagtggaaaagagggtgagcaggtggcccacacatgtgcctccagtgctgcggcccctccggggaccatcngccaggccccggggagggagccagccacagtgtgtccggctcttctctgaagggaagagagccttgaatagactgaagcgaagacggttctgcaaggacaaggcagaccgaaggcattggttttttttttcagataaggagaattagactcccaagtagacaccagagtcactgtttggttggtgggtgatagtggggtcacagtggctgcctgtgctcccccagggtgagcgtgactgtgctaacctgggtggggcagcatgcacacccctctggcagccctttgttgctcgctgatgacaagtttggatgatcccgccaaacagcttgctaagatgtagtccccagtgttggaggtggggcctgatgggaggtgctacccttgtgagataaggttgtgtaaaagcctgtggcacctccccacactgacgctctcacccctgctctggccatgtgccgcgcctgctcccacttccccttctgccaggagtaaaagcccccgagacctcccagaagccaagcagatgctagtgccatgcttcctctgcagcctgcagaactgtgagccaattaaacctcttttctctat

SEQ ID NO: 300114 - DNA, 8490 bp, Homo sapiens
  misc_feature (3542)..(3542): n is a, c, g, or t
  misc_feature (4480)..(4480): n is a, c, g, or t
  misc_feature (4755)..(4755): n is a, c, g, or t
  misc_feature (7448)..(7448): n is a, c, g, or t
  misc_feature (7686)..(7686): n is a, c, g, or t
  misc_feature (7901)..(7901): n is a, c, g, or t
gaagctgttctagaggatcctcttcgaggtgtctgtcccagtgcggtgcctcctcttgacttccccactgctctctgtggtgagaaatttgccttgttcaataattactgtaccctcgcatgactgttacagctttctgtgcagagatgactgtccaagtgccacatgcctacgattgaaatgaaaactctattgttacctctgagttgtgttccacggaaaatgctatccagcagatcatttaggaaaaataattctatttttagcttttcatttctcagctgtccttttttcttgtttgatttttgacagcaatggagaatgggttatataaagactgcctgctaatatgaacagaaatgcatttgtaattcatgaaaataaatgtacatcttctatcttcacattcatgttaagattcagtgttgctttcctctggatcagcgtgtctgaatggacagtcaggttcaggttgtgctgaacacagaaatgctcacaggcctcactttgccgcccaggcactggcccagcacttggatttacataagatgagttagaaaggtacttctgtagggtcctttttacctctgctcggcagagaatcgatgctgtcatgttcctttattcacaatcttaggtctcaaatattctgtcaaaccctaacaaagaagccccgacatctcaggttggattccctggttctctctaaagagggcctgcccttgtgccccagaggtgctgctgggcacagccaagagttgggaagggccgccccacagtacgcagtcctcaccacccagcccagggtgctcacgctcaccactcctgtggctgaggaaggatagctggctcatcctcggaaaacagacccacatctctattcttgccctgaaatacgcgcttttcacttgcgtgctcagagctgccgtctgaaggtccacacagcattgacgggacacagaaatgtgactgttaccggataacactgattagtcagttttcatttataaaaaagcattgacagttttattactcttgtttctttttaaatggaaagttactattataaggttaatttgcagtcctcttctaaatagaaaaccatatccttggctactaacatctggagactgtgagctccttcccattccccttcctggtactgtggagtcagattggcatgaaaccactaacttcattctagaatcattgtagccataagttgtgtgctttttattaatcatgccaaacataatgtaactgggcagagaatggtcctaaccaaggtacctatgaaaagcgctagctatcatgtgtagtagatgcatcattttggctcttcttacatttgtaaaaatgtacagattaggtcatcttaattcatattagtgacacggaacagcacctccactatttgtatgttcaaataagctttcagactaatagcttttttggtgtctaaaatgtaagcaaaaaattcctgctgaaacattccagtcctttcatttagtataaaagaaatactgaacaagccagtgggatggaattgaaagaactaatcatgaggactctgtcctgacacaggtcctcaaagctagcagagatacgcagacattgtggcatctgggtagaagaatactgtattgtgtgtgcagtgcacagtgtgtggtgtgtgcacactcattccttctgctcttgggcacaggcagtgggtgtagaggtaaccagtagctttgagaagctacatgtagctcaccagtggttttctctaaggaatcacaaaggtaaactacccaaccacatgccacgtaatatttcagccattcagaggaaactgttttctctttatttgcttatatgttaatatggtttttaaattggtaacttttatatagtatggtaacagtatgttaatacacacatacatatgcacacatgctttgggtccttccataatacttttatatttgtaaatcaatgttttggagcaatcccaagtttaagggaaatatttttgtaaatgtaatggttttgaaaatctgagcaatccttttgcttatacatttttaaagcatttgtgctttaaaattgttatgctggtgtttgaaacatgatactcctgtggtgcagatgagaagctataacagtgaatatgtggtttctcttacgtcatccaccttgacatgatgggtcagaaacaaatggaaatccagagcaagtcctccagggttgcaccaggtttacctaaagcttgttgccttttcttgtgctgtttatccgtgtagagcactcaagaaagttctgaaactgctttgtatctgctttgtactgttggtgccttcttggtattgtaccccaaaattctgcatagattatttagtataatggtaagttaaaaaatgttaaaggaagattttattaagaatctgaatgtttattcattatattgttacaatttaacattaacatttatttgtggtatttgtgatttggttaatctgtataaaaattgtaagtagaaaggtttatatttcatcttaattcttttgatgttgtaaacgtactttttaaaagatggattatttgaatgtttatggcacctgacttgtaaaaaaaaaaaactacaaaaaaatccttagaatcattaaattgtgtccctgtattaccaaaataacacagcaccgtgcatgtatagtttaattgcagtttcatctgtgaaaacgtgaaattgtctagtccttcgttatgttccccagatgtcttccagatttgctctgcatgtggtaacttgtgttagggctgtgagctgttcctcgagttgaatggggatgtcagtgctcctagggttctccaggtggttcttcagaccttcacctgtgggggggggggtaggcggtgcccacgcccatctcctcatcctcctgaacttctgcaaccccactgctgggcagacatcctgggcaaccccttttttcagagcaagaagtcataaagataggatttcttggacatttggttcttatcaatattgggcattatgtaatgacttatttacaaaacaaagatactggaaaatgttttggatgtggtgttatggaaagagcacaggccttggacccatccagctgggttcagaactaccccctgcttataactgcggctggctgtgggccagtcattctgcgtctctgctttcttcctctgcttcagactgtcagctgtaaagtggaagcaatattacttgccttgtatatggtaaagattataaaaatacatttcaactgttcagcatagtacttcaaagcaagtactcagtaaatagcaagtctttttaaatgctgctttatttcactaaattttgttgtgaggtgtcactaaaatgcctgcaaacaaacgtaactgctaatctgagaggaaaccctcttactaatcagagaagaaaccctcctgtcagaaaccttcagggaagtgagctgatcacacctaaactgggagtttgcaatggggtatttgaagcactgtgggagtattccactggcccnctccctgagagacttaacagtcttccctgttgtccagattctgtataaggcaatcagaataatcatcttccttgttcagcagaggagcctggtcccattttccccactttgtgatgggcttctctcagcggtagctcagcagttccagatggcagtttggaccagcatctaggctggccagttcgctgtgtttacttagaaccaacacgttcagagctggcctggaccatctgaggggaacaggaaacacccctaggctgtggaagcaagtgcagacccccacccccggccctgaagccaagggggcagggtttgggagtggccaaagagaagcagtgcagggatgggttttcctagggacaggcttagcattcctgactctaggaagaaggagcagtgaggcggagaaacagtggaggggatggtggcattgggccccatggggccgagatggacacagggctcgttctcttgagtctggtgccaaggacagctgaagacgacatcattttcaggtggagaggagagagtggagggagatcatgccctgtgatgtgtcttttgcaggtgaaggtgggagacaaggtctctgctgacgatgaggcagagccaccgtgaaagttgtaataggaggactgcccgccgctggaagggcctgcagtgacgctaggacaccctctgcctgcatgtcacgttagctgggctgggcgaagtagaagaccaaggggaagaggtgcagtggggagaccaggtgggatgcaaccacaggaccagtggaggggctgtggcacgtgggcggagactgagtggctgggcatgtgttgtggctgagcatgtggtgtgggcagtggtcctagaccccgccatgtccggacaatgatatagagcgtctcagcatcgccagtctagactgtctatggagagcagaaagttgtctngggctgcctggggaactgtgaggccagctatatcaccgtcgctgatggtgacattacggtggtggcaggagcaaggagagagggaagaaggaccccgtccagctttagtcacaaaatacccaatggaagatgccagtgccaatcctgtgggtttccttgggacttcacactggctttcttatctgctccagatccattcagtagtcactgagttcctgccaaatactttgtagcgccagaagccaggagcggggtctgcagcagggcagtccccnttttcaggaaatgcctggagctgctggtccctgagagaaaggaaaacatctttcagccgtacgcaggccaagaaggccaatgtccagtagctttgtgattttttttatatttttttatttatttatttttgagatagagtcttgctctgtcgctcaggctggagtgcagtggcgtgatctccactcactgcaacttccgcctcctggggtcaagcagttctgcctcagcctcccgagtagctgggattacaggcacacgccaccacacccagctaatttttgtgtttttagtagagacggtttcaccatgtcggccaggctggtctcaaactcctgacctcagatgattcagcctcccaaagtgctgggattacaggtgtgagccactgcacccagcctgtgatgtttctgtggggttccacaaatgtgtgtgtgtgtaaaagctgatgattacagcaagaatgtgaacagtagcagttttccatttgaaggcaagttttgtctttatctgggtatcagaaggaccctctgggccattgtcgcttcctgtactcagagccaccctagtactacgggcacacacagaaaacagcagcctgcgtactttcaaaggaaaggcatctttaatcaccaatgcctggaaaaattattttgtttccctcttccttccgtcttgtttcctaacttcttaccaaagtttagagtctgagtttttcgtataataatgtcccacatccacacatcgggcctacagatgctctcccttgaatcgactggaaacatgacaccggttccatgctctggaactgtcacctgtgatgtgctgggctgtgtcccaagcacaggaatcccagcagtttcagctcgatgcagaaccaccatgctccagacacaggcttgggaaagacacgtcaaaattaaaatactaggtaagagaagcacctgattgggtagaagttggagaggaatcctggaattttgtggccagaaggagccactgccccttttgtttagtaagactagacagtaacagaagccagttgtcagctatgaaagtggtgggtgaagcaggggaggctcctctatggtgggaccctggacaagggaagccgaatgtgtgaagaaggggtgcgggggtgtgcggtgccctaggacactagggcaaaggtttcaaacctggaacaaggcactggaggaagatctgctgccagtcagcagtgcgggccctcgagttagcagtccgtgcgcagaggggccagttctgagaccagtttggagagtcaggcagtgacccattggccatgtcataattccttcagcctgcctcctctttaatcccagagagtgctctttcttcatacttcctttaaaatactaaattgttcccattccatggggagctggctaggctttacaggctaggaaatgtaggttttctgagatggaaccatctacacaaggaggaggaaggcactaagactacagatgagacccatgacagggctgagcatttggaagccaaccctggttgcttttcaagaattgctttgtggctgggtgcagtggttcacacctgtaattgcagcactttgggaggctgaggcaggtggattgcttgaacccaggagttcgagaccagcctgggcaacatatgggacaccccaccgcccccggctctgcaaaaaaattaaaaattagccaggcgtggtgtcatgagcctgtggtctcaactactcaggaggctgaggctggaggatcgcttgaacctgggaggtcaaggctccagtgaaccataattgtgccactgcactgcagcctgggcgacaatttgttttctaaattgcttttgaaagtctactgcattacatattccaaaaagcagtggttttcaaatacttttatcaccgatatccttttatgaaatgaaatcagtagaactttctctgctctgaataagcaagggtgggaacctgtctacctcccacagatagcataatgtgcctgccatagaggagccaaaaaatggtgatgggaactgagaggagagcaaatgtcacaaaagactgagcaattgagaaaacaaaacaagaccacagatgactgttaacgcctccacagtggaccaagaaaggacagagagctggcagcatgggcatcactgtctggtcggcagcaggaaggcctcgctagggaattgagtacagtcatctaactagtttaaaagtacaggaaggatgattaaggctattggagaggtcatacaaataggggaggggcaggcaatggctgataagacatgaatttgtaaggcgatgagtattgcagtcagcaaaacaaacgagactgctctcccaacacataactcagcagggaggccaggcattggtttaaccatttaatataaagaagttaaaattacaaatgcgctaagtgcctaaagaagaataagtgcaggaatgagagcagcatggactgccacagttttagaataagcactgtcactgctagattggaaacaaaaatccataaatttggcccggtgtggtggcggacgcctgtagtcccagctacttggaggctgaggcgtgagaatcgcttgaacccgggaggcggaggttgcagtgagccgagatggcgccactgcactccagcctgggcgtcagagtgagaactctgtatcaaaaaataaaaanaaaaaaaagtccataaatctgcaatgtctcagttaagaaagaaagactgggccaatgcagatttcaaaccggagaaagtcatactgtcagtgaaggccgcctgtggccggaaggcgccaggggattagcaccctggactcagtgttgctgggaaacagggccccaaggctgggagcacagtgtttaaagggcatctacccaagaagggagcacagggcaaggaggagctgcagggggncttggctgccaaagtgaattctgaggagagagctattgctgcctacgatatgcaggctgcacagaacacaagtggaatcagcaggcaggagaggcagctaacgacgcagcccgtttcttatttctgttttctcacaagcgatgaaagtggaaaagagggtgagcaggtggcccacacatgtgcctccagtgctgcggcccctccggggaccatcngccaggccccggggagggagccagccacagtgtgtccggctcttctctgaagggaagagagccttgaatagactgaagcgaagacggttctgcaaggacaaggcagaccgaaggcattggttttttttttcagataaggagaattagactcccaagtagacaccagagtcactgtttggttggtgggtgatagtggggtcacagtggctgcctgtgctcccccagggtgagcgtgactgtgctaacctgggtggggcagcatgcacacccctctggcagccctttgttgctcgctgatgacaagtttggatgatcccgccaaacagcttgctaagatgtagtccccagtgttggaggtggggcctgatgggaggtgctacccttgtgagataaggttgtgtaaaagcctgtggcacctccccacactgacgctctcacccctgctctggccatgtgccgcgcctgctcccacttccccttctgccaggagtaaaagcccccgagacctcccagaagccaagcagatgctagtgccatgcttcctctgcagcctgcagaactgtgagccaattaaacctcttttctctat

SEQ ID NO: 300115 - DNA, 5079 bp, Homo sapiens
  misc_feature (4947)..(4947): n is a, c, g, or t
  misc_feature (4994)..(4994): n is a, c, g, or t
  misc_feature (5010)..(5010): n is a, c, g, or t
  misc_feature (5013)..(5013): n is a, c, g, or t
  misc_feature (5018)..(5018): n is a, c, g, or t
  misc_feature (5061)..(5061): n is a, c, g, or t
acataatttctggagccctgtaccaacgtgtggccacatattctgtcaggaaccctgtgtgatcatggtctggatctgcaacacgggccaggccaaagtcacagatcttgagatcacaggtggtgttgagcagcaggcaggcaggcaatcggtccgagtggctgtcggctcttcagctctcccgctcggcgtcttccttcctcctcccggtcagcgtcggcggctgcaccggcggcggcgcagtccctgcgggaggggcgacaagagctgagcggcggccgccgagcgtcgagctcagcgcggcggaggcggcggcggcccggcagccaacatggcggcggcggcggcggcgggcgcgggcccggagatggtccgcgggcaggtgttcgacgtggggccgcgctacaccaacctctcgtacatcggcgagggcgcctacggcatggtgtgctctgcttatgataatgtcaacaaagttcgagtagctatcaagaaaatcagcccctttgagcaccagacctactgccagagaaccctgagggagataaaaatcttactgcgcttcagacatgagaacatcattggaatcaatgacattattcgagcaccaaccatcgagcaaatgaaagatgtatatatagtacaggacctcatggaaacagatctttacaagctcttgaagacacaacacctcagcaatgaccatatctgctattttctctaccagatcctcagagggttaaaatatatccattcagctaacgttctgcaccgtgacctcaagccttccaacctgctgctcaacaccacctgtgatctcaagatctgtgactttggcctggcccgtgttgcagatccagaccatgatcacacagggttcctgacagaatatgtggccacacgttggtacagggctccagaaattatgttgaattccaagggctacaccaagtccattgatatttggtctgtaggctgcattctggcagaaatgctttctaacaggcccatctttccagggaagcattatcttgaccagctgaaccacattttgggtattcttggatccccatcacaagaagacctgaattgtataataaatttaaaagctaggaactatttgctttctcttccacacaaaaataaggtgccatggaacaggctgttcccaaatgctgactccaaagctctggacttattggacaaaatgttgacattcaacccacacaagaggattgaagtagaacaggctctggcccacccatatctggagcagtattacgacccgagtgacgagcccatcgccgaagcaccattcaagttcgacatggaattggatgacttgcctaaggaaaagctcaaagaactaatttttgaagagactgctagattccagccaggatacagatcttaaatttgtcaggacaagggctcagaggactggacgtgctcagacatcggtgttcttcttcccagttcttgacccctggtcctgtctccagcccgtcttggcttatccactttgactcctttgagccgtttggaggggcggtttctggtagttgtggcttttatgctttcaaagaatttcttcagtccagagaattcctcctggcagccctgtgtgtgtcacccattggtgacctgcggcagtatgtacttcagtgcacctactgcttactgttgctttagtcactaattgctttctggtttgaaagatgcagtggttcctccctctcctgaatccttttctacatgatgccctgctgaccatgcagccgcaccagagagagattcttccccaattggctctagtcactggcatctcactttatgatagggaaggctactacctagggcactttaagtcagtgacagccccttatttgcacttcaccttttgaccataactgtttccccagagcaggagcttgtggaaataccttggctgatgttgcagcctgcagcaagtgcttccgtctccggaatccttggggagcacttgtccacgtcttttctcatatcatggtagtcactaacatatataaggtatgtgctattggcccagcttttagaaaatgcagtcatttttctaaataaaaaggaagtactgcacccagcagtgtcactctgtagttactgtggtcacttgtaccatatagaggtgtaacacttgtcaagaagcgttatgtgcagtacttaatgtttgtaagacttacaaaaaaagatttaaagtggcagcttcactcgacatttggtgagagaagtacaaaggttgcagtgctgagctgtgggcggtttctggggatgtcccagggtggaactccacatgctggtgcatatacgcccttgagctacttcaaatgtgggtgtttcagtaaccacgttccatgcctgaggatttagcagagaggaacactgcgtctttaaatgagaaagtatacaattctttttccttctacagcatgtcagcatctcaagttcatttttcaacctacagtataacaatttgtaataaagcctccaggagctcatgacgtgaagcactgttctgtcctcaagtactcaaatatttctgatactgctgagtcagactgtcagaaaaagctagcactaactcgtgtttggagctctatccatattttactgatctctttaagtatttgttcctgccactgtgtactgtggagttgactcggtgttctgtcccagtgcggtgcctcctcttgacttccccactgctctctgtggtgagaaatttgccttgttcaataattactgtaccctcgcatgactgttacagctttctgtgcagagatgactgtccaagtgccacatgcctacgattgaaatgaaaactctattgttacctctgagttgtgttccacggaaaatgctatccagcagatcatttaggaaaaataattctatttttagcttttcatttctcagctgtccttttttcttgtttgatttttgacagcaatggagaatgggttatataaagactgcctgctaatatgaacagaaatgcatttgtaattcatgaaaataaatgtacatcttctatcttcacattcatgttaagattcagtgttgctttcctctggatcagcgtgtctgaatggacagtcaggttcaggttgtgctgaacacagaaatgctcacaggcctcactttgccgcccaggcactggcccagcacttggatttacataagatgagttagaaaggtacttctgtagggtcctttttacctctgctcggcagagaatcgatgctgtcatgttcctttattcacaatcttaggtctcaaatattctgtcaaaccctaacaaagaagccccgacatctcaggttggattccctggttctctctaaagagggcctgcccttgtgccccagaggtgctgctgggcacagccaagagttgggaagggccgccccacagtacgcagtcctcaccacccagcccagggtgctcacgctcaccactcctgtggctgaggaaggatagctggctcatcctcggaaaacagacccacatctctattcttgccctgaaatacgcgcttttcacttgcgtgctcagagctgccgtctgaaggtccacacagcattgacgggacacagaaatgtgactgttaccggataacactgattagtcagttttcatttataaaaaagcattgacagttttattactcttgtttctttttaaatggaaagttactattataaggttaatttgcagtcctcttctaaatagaaaaccatatccttggctactaacatctggagactgtgagctccttcccattccccttcctggtactgtggagtcagattggcatgaaaccactaacttcattctagaatcattgtagccataagttgtgtgctttttattaatcatgccaaacataatgtaactgggcagagaatggtcctaaccaaggtacctatgaaaagcgctagctatcatgtgtagtagatgcatcattttggctcttcttacatttgtaaaaatgtacagattaggtcatcttaattcatattagtgacacggaacagcacctccactatttgtatgttcaaataagctttcagactaatagcttttttggtgtctaaaatgtaagcaaaaaattcctgctgaaacattccagtcctttcatttagtataaaagaaatactgaacaagccagtgggatggaattgaaagaactaatcatgaggactctgtcctgacacaggtcctcaaagctagcagagatacgcagacattgtggcatctgggtagaagaatactgtattgtgtgtgcagtgcacagtgtgtggtgtgtgcacactcattccttctgctcttgggcacaggcagtgggtgtagaggtaaccagtagctttgagaagctacatgtagctcaccagtggttttctctaaggaatcacaaaggtaaactacccaaccacatgccacgtaatatttcagccattcagaggaaactgttttctctttatttgcttatatgttaatatggtttttaaattggtaacttttatatagtatggtaacagtatgttaatacacacatacatatgcacacatgctttgggtccttccataatacttttatatttgtaaatcaatgttttggagcaatcccaagtttaagggaaatatttttgtaaatgtaatggttttgaaaatctgagcaatccttttgcttatacatttttaaagcatttgtgctttaaaattgttatgctggtgtttgaaacatgatactcctgtggtgcagatgagaagctataacagtgaatatgtggtttctcttacgtcatccaccttgacatgatgggtcagaaacaaatggaaatccagagcaagtcctccagggttgcaccaggtttacctaaagcttgttgccttttcctgggccggtanatccggggagggcaccccaaaggaaagtcctggaacctgcctttggnaacctgcctttggacntgntgggngcctccctggggaatggaccccccaaaaattcctgccaaaggntaatttagggaaaaaggg

SEQ ID NO: 300116 - DNA, 3686 bp, Homo sapiens
acataatttctggagccctgtaccaacgtgtggccacatattctgtcaggaaccctgtgtgatcatggtctggatctgcaacacgggccaggccaaagtcacagatcttgagatcacaggtggtgttgagcagcaggcaggcaggcaatcggtccgagtggctgtcggctcttcagctctcccgctcggcgtcttccttcctcctcccggtcagcgtcggcggctgcaccggcggcggcgcagtccctgcgggaggggcgacaagagctgagcggcggccgccgagcgtcgagctcagcgcggcggaggcggcggcggcccggcagccaacatggcggcggcggcggcggcgggcgcgggcccggagatggtccgcgggcaggtgttcgacgtggggccgcgctacaccaacctctcgtacatcggcgagggcgcctacggcatggtgtgctctgcttatgataatgtcaacaaagttcgagtagctatcaagaaaatcagcccctttgagcaccagacctactgccagagaaccctgagggagataaaaatcttactgcgcttcagacatgagaacatcattggaatcaatgacattattcgagcaccaaccatcgagcaaatgaaagatgtatatatagtacaggacctcatggaaacagatctttacaagctcttgaagacacaacacctcagcaatgaccatatctgctattttctctaccagatcctcagagggttaaaatatatccattcagctaacgttctgcaccgtgacctcaagccttccaacctgctgctcaacaccacctgtgatctcaagatctgtgactttggcctggcccgtgttgcagatccagaccatgatcacacagggttcctgacagaatatgtggccacacgttggtacagggctccagaaattatgttgaattccaagggctacaccaagtccattgatatttggtctgtaggctgcattctggcagaaatgctttctaacaggcccatctttccagggaagcattatcttgaccagctgaaccacattttgggtattcttggatccccatcacaagaagacctgaattgtataataaatttaaaagctaggaactatttgctttctcttccacacaaaaataaggtgccatggaacaggctgttcccaaatgctgactccaaagctctggacttattggacaaaatgttgacattcaacccacacaagaggattgaagtagaacaggctctggcccacccatatctggagcagtattacgacccgagtgacgagcccatcgccgaagcaccattcaagttcgacatggaattggatgacttgcctaaggaaaagctcaaagaactaatttttgaagagactgctagattccagccaggatacagatcttaaatttgtcaggacaagggctcagaggactggacgtgctcagacatcggtgttcttcttcccagttcttgacccctggtcctgtctccagcccgtcttggcttatccactttgactcctttgagccgtttggaggggcggtttctggtagttgtggcttttatgctttcaaagaatttcttcagtccagagaattcctcctggcagccctgtgtgtgtcacccattggtgacctgcggcagtatgtacttcagtgcacctactgcttactgttgctttagtcactaattgctttctggtttgaaagatgcagtggttcctccctctcctgaatccttttctacatgatgccctgctgaccatgcagccgcaccagagagagattcttccccaattggctctagtcactggcatctcactttatgatagggaaggctactacctagggcactttaagtcagtgacagccccttatttgcacttcaccttttgaccataactgtttccccagagcaggagcttgtggaaataccttggctgatgttgcagcctgcagcaagtgcttccgtctccggaatccttggggagcacttgtccacgtcttttctcatatcatggtagtcactaacatatataaggtatgtgctattggcccagcttttagaaaatgcagtcatttttctaaataaaaaggaagtactgcacccagcagtgtcactctgtagttactgtggtcacttgtaccatatagaggtgtaacacttgtcaagaagcgttatgtgcagtacttaatgtttgtaagacttacaaaaaaagatttaaagtggcagcttcactcgacatttggtgagagaagtacaaaggttgcagtgctgagctgtgggcggtttctggggatgtcccagggtggaactccacatgctggtgcatatacgcccttgagctacttcaaatgtgggtgtttcagtaaccacgttccatgcctgaggatttagcagagaggaacactgcgtctttaaatgagaaagtatacaattctttttccttctacagcatgtcagcatctcaagttcatttttcaacctacagtataacaatttgtaataaagcctccaggagctcatgacgtgaagcactgttctgtcctcaagtactcaaatatttctgatactgctgagtcagactgtcagaaaaagctagcactaactcgtgtttggagctctatccatattttactgatctctttaagtatttgttcctgccactgtgtactgtggagttgactcggtgttctgtcccagtgcggtgcctcctcttgacttccccactgctctctgtggtgagaaatttgccttgttcaataattactgtaccctcgcatgactgttacagctttctgtgcagagatgactgtccaagtgccacatgcctacgattgaaatgaaaactctattgttacctctgagttgtgttccacggaaaatgctatccagcagatcatttaggaaaaataattctatttttagcttttcatttctcagctgtccttttttcttgtttgatttttgacagcaatggagaatgggttatataaagactgcctgctaatatgaacagaaatgcatttgtaattcatgaaaataaatgtacatcttctatcttcacattcatgttaagattcagtgttgctttcctctggatcagcgtgtctgaatggacagtcaggttcaggttgtgctgaacacagaaatgctcacaggcctcactttgccgcccaggcactggcccagcacttggatttacataagatgagttagaaaggtacttctgtagggtcctttttacctctgctcggcagagaatcgatgctgtcatgttcctttattcacaatcttaggtctcaaatattctgtcaaaccctaacaaagaagccccgacatctcaggttggattccctggttctctctaaagagggcctgcccttgtgccccagaggtgctgctgggcacagccaagagttgggaagggccgccccacagtacgcagtcctcaccacccagcccagggtgctcacgctcaccactcctgtggctgaggaaggatagctggctcatcctcggaaaacagacccacatctctattcttgccctgaaatacgcgcttttcacttgcgtgctcagagctgccgtctgaaggtccacacagcattgacgggacacaccaacttcccgtggccgaagccatgctgacttgccggcataagttccctgatgaa

SEQ ID NO: 300117 - DNA, 2496 bp, Homo sapiens
acataatttctggagccctgtaccaacgtgtggccacatattctgtcaggaaccctgtgtgatcatggtctggatctgcaacacgggccaggccaaagtcacagatcttgagatcacaggtggtgttgagcagcaggcaggcaggcaatcggtccgagtggctgtcggctcttcagctctcccgctcggcgtcttccttcctcctcccggtcagcgtcggcggctgcaccggcggcggcgcagtccctgcgggaggggcgacaagagctgagcggcggccgccgagcgtcgagctcagcgcggcggaggcggcggcggcccggcagccaacatggcggcggcggcggcggcgggcgcgggcccggagatggtccgcgggcaggtgttcgacgtggggccgcgctacaccaacctctcgtacatcggcgagggcgcctacggcatggtgtgctctgcttatgataatgtcaacaaagttcgagtagctatcaagaaaatcagcccctttgagcaccagacctactgccagagaaccctgagggagataaaaatcttactgcgcttcagacatgagaacatcattggaatcaatgacattattcgagcaccaaccatcgagcaaatgaaagatgtatatatagtacaggacctcatggaaacagatctttacaagctcttgaagacacaacacctcagcaatgaccatatctgctattttctctaccagatcctcagagggttaaaatatatccattcagctaacgttctgcaccgtgacctcaagccttccaacctgctgctcaacaccacctgtgatctcaagatctgtgactttggcctggcccgtgttgcagatccagaccatgatcacacagggttcctgacagaatatgtggccacacgttggtacagggctccagaaattatgttgaattccaagggctacaccaagtccattgatatttggtctgtaggctgcattctggcagaaatgctttctaacaggcccatctttccagggaagcattatcttgaccagctgaaccacattttgggtattcttggatccccatcacaagaagacctgaattgtataataaatttaaaagctaggaactatttgctttctcttccacacaaaaataaggtgccatggaacaggctgttcccaaatgctgactccaaagctctggacttattggacaaaatgttgacattcaacccacacaagaggattgaagtagaacaggctctggcccacccatatctggagcagtattacgacccgagtgacgagcccatcgccgaagcaccattcaagttcgacatggaattggatgacttgcctaaggaaaagctcaaagaactaatttttgaagagactgctagattccagccaggatacagatcttaaatttgtcaggacaagggctcagaggactggacgtgctcagacatcggtgttcttcttcccagttcttgacccctggtcctgtctccagcccgtcttggcttatccactttgactcctttgagccgtttggaggggcggtttctggtagttgtggcttttatgctttcaaagaatttcttcagtccagagaattcctcctggcagccctgtgtgtgtcacccattggtgacctgcggcagtatgtacttcagtgcacctactgcttactgttgctttagtcactaattgctttctggtttgaaagatgcagtggttcctccctctcctgaatccttttctacatgatgccctgctgaccatgcagccgcaccagagagagattcttccccaattggctctagtcactggcatctcactttatgatagggaaggctactacctagggcactttaagtcagtgacagccccttatttgcacttcaccttttgaccataactgtttccccagagcaggagcttgtggaaataccttggctgatgttgcagcctgcagcaagtgcttccgtctccggaatccttggggagcacttgtccacgtcttttctcatatcatggtagtcactaacatatataaggtatgtgctattggcccagcttttagaaaatgcagtcatttttctaaataaaaaggaagtactgcacccagcagtgtcactctgtagttactgtggtcacttgtaccatatagaggtgtaacacttgtcaagaagcgttatgtgcagtacttaatgtttgtaagacttacaaaaaaagatttaaagtggcagcttcactcgacatttggtgagagaagtacaaaggttgcagtgctgagctgtgggcggtttctggggatgtcccagggtggaactccacatgctggtgcatatacgcccttgagctacttcaaatgtggtttatacctcgcagatacaagaatctttatgaatatacaattctttttccttctacagcttagctccgtcttttcaaccacgaacatttaaaacccgacctactagcactgttctgtcctcaagtac

SEQ ID NO: 300118 - DNA, 6542 bp, Homo sapiens
  misc_feature (3)..(3): n is a, c, g, or t
  misc_feature (5)..(5): n is a, c, g, or t
  misc_feature (1594)..(1594): n is a, c, g, or t
  misc_feature (2532)..(2532): n is a, c, g, or t
  misc_feature (2807)..(2807): n is a, c, g, or t
  misc_feature (5500)..(5500): n is a, c, g, or t
  misc_feature (5738)..(5738): n is a, c, g, or t
  misc_feature (5953)..(5953): n is a, c, g, or t
gcngncgcctactactactaaattcgcggccgcgtcgacgcaatcccaagtttaagggaaatatttttgtaaatgtaatggttttgaaaatctgagcaatccttttgcttatacatttttaaagcatttgtgctttaaaattgttatgctggtgtttgaaacatgatactcctgtggtgcagatgagaagctataacagtgaatatgtggtttctcttacgtcatccaccttgacatgatgggtcagaaacaaatggaaatccagagcaagtcctccagggttgcaccaggtttacctaaagcttgttgccttttcttgtgctgtttatccgtgtagagcactcaagaaagttctgaaactgctttgtatctgctttgtactgttggtgccttcttggtattgtaccccaaaattctgcatagattatttagtataatggtaagttaaaaaatgttaaaggaagattttattaagaatctgaatgtttattcattatattgttacaatttaacattaacatttatttgtggtatttgtgatttggttaatctgtataaaaattgtaagtagaaaggtttatatttcatcttaattcttttgatgttgtaaacgtactttttaaaagatggattatttgaatgtttatggcacctgacttgtaaaaaaaaaaaactacaaaaaaatccttagaatcattaaattgtgtccctgtattaccaaaataacacagcaccgtgcatgtatagtttaattgcagtttcatctgtgaaaacgtgaaattgtctagtccttcgttatgttccccagatgtcttccagatttgctctgcatgtggtaacttgtgttagggctgtgagctgttcctcgagttgaatggggatgtcagtgctcctagggttctccaggtggttcttcagaccttcacctgtgggggggggggtaggcggtgcccacgcccatctcctcatcctcctgaacttctgcaaccccactgctgggcagacatcctgggcaaccccttttttcagagcaagaagtcataaagataggatttcttggacatttggttcttatcaatattgggcattatgtaatgacttatttacaaaacaaagatactggaaaatgttttggatgtggtgttatggaaagagcacaggccttggacccatccagctgggttcagaactaccccctgcttataactgcggctggctgtgggccagtcattctgcgtctctgctttcttcctctgcttcagactgtcagctgtaaagtggaagcaatattacttgccttgtatatggtaaagattataaaaatacatttcaactgttcagcatagtacttcaaagcaagtactcagtaaatagcaagtctttttaaatgctgctttatttcactaaattttgttgtgaggtgtcactaaaatgcctgcaaacaaacgtaactgctaatctgagaggaaaccctcttactaatcagagaagaaaccctcctgtcagaaaccttcagggaagtgagctgatcacacctaaactgggagtttgcaatggggtatttgaagcactgtgggagtattccactggcccnctccctgagagacttaacagtcttccctgttgtccagattctgtataaggcaatcagaataatcatcttccttgttcagcagaggagcctggtcccattttccccactttgtgatgggcttctctcagcggtagctcagcagttccagatggcagtttggaccagcatctaggctggccagttcgctgtgtttacttagaaccaacacgttcagagctggcctggaccatctgaggggaacaggaaacacccctaggctgtggaagcaagtgcagacccccacccccggccctgaagccaagggggcagggtttgggagtggccaaagagaagcagtgcagggatgggttttcctagggacaggcttagcattcctgactctaggaagaaggagcagtgaggcggagaaacagtggaggggatggtggcattgggccccatggggccgagatggacacagggctcgttctcttgagtctggtgccaaggacagctgaagacgacatcattttcaggtggagaggagagagtggagggagatcatgccctgtgatgtgtcttttgcaggtgaaggtgggagacaaggtctctgctgacgatgaggcagagccaccgtgaaagttgtaataggaggactgcccgccgctggaagggcctgcagtgacgctaggacaccctctgcctgcatgtcacgttagctgggctgggcgaagtagaagaccaaggggaagaggtgcagtggggagaccaggtgggatgcaaccacaggaccagtggaggggctgtggcacgtgggcggagactgagtggctgggcatgtgttgtggctgagcatgtggtgtgggcagtggtcctagaccccgccatgtccggacaatgatatagagcgtctcagcatcgccagtctagactgtctatggagagcagaaagttgtctngggctgcctggggaactgtgaggccagctatatcaccgtcgctgatggtgacattacggtggtggcaggagcaaggagagagggaagaaggaccccgtccagctttagtcacaaaatacccaatggaagatgccagtgccaatcctgtgggtttccttgggacttcacactggctttcttatctgctccagatccattcagtagtcactgagttcctgccaaatactttgtagcgccagaagccaggagcggggtctgcagcagggcagtccccnttttcaggaaatgcctggagctgctggtccctgagagaaaggaaaacatctttcagccgtacgcaggccaagaaggccaatgtccagtagctttgtgattttttttatatttttttatttatttatttttgagatagagtcttgctctgtcgctcaggctggagtgcagtggcgtgatctccactcactgcaacttccgcctcctggggtcaagcagttctgcctcagcctcccgagtagctgggattacaggcacacgccaccacacccagctaatttttgtgtttttagtagagacggtttcaccatgtcggccaggctggtctcaaactcctgacctcagatgattcagcctcccaaagtgctgggattacaggtgtgagccactgcacccagcctgtgatgtttctgtggggttccacaaatgtgtgtgtgtgtaaaagctgatgattacagcaagaatgtgaacagtagcagttttccatttgaaggcaagttttgtctttatctgggtatcagaaggaccctctgggccattgtcgcttcctgtactcagagccaccctagtactacgggcacacacagaaaacagcagcctgcgtactttcaaaggaaaggcatctttaatcaccaatgcctggaaaaattattttgtttccctcttccttccgtcttgtttcctaacttcttaccaaagtttagagtctgagtttttcgtataataatgtcccacatccacacatcgggcctacagatgctctcccttgaatcgactggaaacatgacaccggttccatgctctggaactgtcacctgtgatgtgctgggctgtgtcccaagcacaggaatcccagcagtttcagctcgatgcagaaccaccatgctccagacacaggcttgggaaagacacgtcaaaattaaaatactaggtaagagaagcacctgattgggtagaagttggagaggaatcctggaattttgtggccagaaggagccactgccccttttgtttagtaagactagacagtaacagaagccagttgtcagctatgaaagtggtgggtgaagcaggggaggctcctctatggtgggaccctggacaagggaagccgaatgtgtgaagaaggggtgcgggggtgtgcggtgccctaggacactagggcaaaggtttcaaacctggaacaaggcactggaggaagatctgctgccagtcagcagtgcgggccctcgagttagcagtccgtgcgcagaggggccagttctgagaccagtttggagagtcaggcagtgacccattggccatgtcataattccttcagcctgcctcctctttaatcccagagagtgctctttcttcatacttcctttaaaatactaaattgttcccattccatggggagctggctaggctttacaggctaggaaatgtaggttttctgagatggaaccatctacacaaggaggaggaaggcactaagactacagatgagacccatgacagggctgagcatttggaagccaaccctggttgcttttcaagaattgctttgtggctgggtgcagtggttcacacctgtaattgcagcactttgggaggctgaggcaggtggattgcttgaacccaggagttcgagaccagcctgggcaacatatgggacaccccaccgcccccggctctgcaaaaaaattaaaaattagccaggcgtggtgtcatgagcctgtggtctcaactactcaggaggctgaggctggaggatcgcttgaacctgggaggtcaaggctccagtgaaccataattgtgccactgcactgcagcctgggcgacaatttgttttctaaattgcttttgaaagtctactgcattacatattccaaaaagcagtggttttcaaatacttttatcaccgatatccttttatgaaatgaaatcagtagaactttctctgctctgaataagcaagggtgggaacctgtctacctcccacagatagcataatgtgcctgccatagaggagccaaaaaatggtgatgggaactgagaggagagcaaatgtcacaaaagactgagcaattgagaaaacaaaacaagaccacagatgactgttaacgcctccacagtggaccaagaaaggacagagagctggcagcatgggcatcactgtctggtcggcagcaggaaggcctcgctagggaattgagtacagtcatctaactagtttaaaagtacaggaaggatgattaaggctattggagaggtcatacaaataggggaggggcaggcaatggctgataagacatgaatttgtaaggcgatgagtattgcagtcagcaaaacaaacgagactgctctcccaacacataactcagcagggaggccaggcattggtttaaccatttaatataaagaagttaaaattacaaatgcgctaagtgcctaaagaagaataagtgcaggaatgagagcagcatggactgccacagttttagaataagcactgtcactgctagattggaaacaaaaatccataaatttggcccggtgtggtggcggacgcctgtagtcccagctacttggaggctgaggcgtgagaatcgcttgaacccgggaggcggaggttgcagtgagccgagatggcgccactgcactccagcctgggcgtcagagtgagaactctgtatcaaaaaataaaaanaaaaaaaagtccataaatctgcaatgtctcagttaagaaagaaagactgggccaatgcagatttcaaaccggagaaagtcatactgtcagtgaaggccgcctgtggccggaaggcgccaggggattagcaccctggactcagtgttgctgggaaacagggccccaaggctgggagcacagtgtttaaagggcatctacccaagaagggagcacagggcaaggaggagctgcagggggncttggctgccaaagtgaattctgaggagagagctattgctgcctacgatatgcaggctgcacagaacacaagtggaatcagcaggcaggagaggcagctaacgacgcagcccgtttcttatttctgttttctcacaagcgatgaaagtggaaaagagggtgagcaggtggcccacacatgtgcctccagtgctgcggcccctccggggaccatcngccaggccccggggagggagccagccacagtgtgtccggctcttctctgaagggaagagagccttgaatagactgaagcgaagacggttctgcaaggacaaggcagaccgaaggcattggttttttttttcagataaggagaattagactcccaagtagacaccagagtcactgtttggttggtgggtgatagtggggtcacagtggctgcctgtgctcccccagggtgagcgtgactgtgctaacctgggtggggcagcatgcacacccctctggcagccctttgttgctcgctgatgacaagtttggatgatcccgccaaacagcttgctaagatgtagtccccagtgttggaggtggggcctgatgggaggtgctacccttgtgagataaggttgtgtaaaagcctgtggcacctccccacactgacgctctcacccctgctctggccatgtgccgcgcctgctcccacttccccttctgccaggagtaaaagcccccgagacctcccagaagccaagcagatgctagtgccatgcttcctctgcagcctgcagaactgtgagccaattaaacctcttttctctat

SEQ ID NO: 300119 - DNA, 1590 bp, Homo sapiens
acataatttctggagccctgtaccaacgtgtggccacatattctgtcaggaaccctgtgtgatcatggtctggatctgcaacacgggccaggccaaagtcacagatcttgagatcacaggtggtgttgagcagcaggcaggcaggcaatcggtccgagtggctgtcggctcttcagctctcccgctcggcgtcttccttcctcctcccggtcagcgtcggcggctgcaccggcggcggcgcagtccctgcgggaggggcgacaagagctgagcggcggccgccgagcgtcgagctcagcgcggcggaggcggcggcggcccggcagccaacatggcggcggcggcggcggcgggcgcgggcccggagatggtccgcgggcaggtgttcgacgtggggccgcgctacaccaacctctcgtacatcggcgagggcgcctacggcatggtgtgctctgcttatgataatgtcaacaaagttcgagtagctatcaagaaaatcagcccctttgagcaccagacctactgccagagaaccctgagggagataaaaatcttactgcgcttcagacatgagaacatcattggaatcaatgacattattcgagcaccaaccatcgagcaaatgaaagatgtatatatagtacaggacctcatggaaacagatctttacaagctcttgaagacacaacacctcagcaatgaccatatctgctattttctctaccagatcctcagagggttaaaatatatccattcagctaacgttctgcaccgtgacctcaagccttccaacctgctgctcaacaccacctgtgatctcaagatctgtgactttggcctggcccgtgttgcagatccagaccatgatcacacagggttcctgacagaatatgtggccacacgttggtacagggctccagaaattatgttgaattccaagggctacaccaagtccattgatatttggtctgtaggctgcattctggcagaaatgctttctaacaggcccatctttccagggaagcattatcttgaccagctgaaccacattttgggtattcttggatccccatcacaagaagacctgaattgtataataaatttaaaagctaggaactatttgctttctcttccacacaaaaataaggtgccatggaacaggctgttcccaaatgctgactccaaagctctggacttattggacaaaatgttgacattcaacccacacaagaggattgaagtagaacaggctctggcccacccatatctggagcagtattacgacccgagtgacgagcccatcgccgaagcaccattcaagttcgacatggaattggatgacttgcctaaggaaaagctcaaagaactaatttttgaagagactgctagattccagccaggatacagatcttaaatttgtcaggtacctggagtttaatacagtgagctctagcaagggaggcgctgccttttgtttctagaatattatgttcctcaaggtccattattttgtattcttttccaagctccttattggaaggtatttttttaaatttagaattaaaaattatttagaaagttaaatataaa

SEQ ID NO: 300120 - DNA, 1127 bp, Homo sapiens
  misc_feature (1127)..(1127): n is a, c, g, or t
acataatttctggagccctgtaccaacgtgtggccacatattctgtcaggaaccctgtgtgatcatggtctggatctgcaacacgggccaggccaaagtcacagatcttgagatcacaggtggtgttgagcagcaggcaggcaggcaatcggtccgagtggctgtcggctcttcagctctcccgctcggcgtcttccttcctcctcccggtcagcgtcggcggctgcaccggcggcggcgcagtccctgcgggaggggcgacaagagctgagcggcggccgccgagcgtcgagctcagcgcggcggaggcggcggcggcccggcagccaacatggcggcggcggcggcggcgggcgcgggcccggagatggtccgcgggcaggtgttcgacgtggggccgcgctacaccaacctctcgtacatcggcgagggcgcctacggcatggtgtgctctgcttatgataatgtcaacaaagttcgagtagctatcaagaaaatcagcccctttgagcaccagacctactgccagagaaccctgagggagataaaaatcttactgcgcttcagacatgagaacatcattggaatcaatgacattattcgagcaccaaccatcgagcaaatgaaagatgtatatatagtacaggacctcatggaaacagatctttacaagctcttgaagacacaacacctcagcaatgaccatatctgctattttctctaccagatcctcagagggttaaaatatatccattcagctaacgttctgcaccgtgacctcaagccttccaacctgctgctcaacaccacctgtgatctcaagatctgtgactttggcctggcccgtgttgcagatccagaccatgatcacacagggttcctgacagaatatgtggccacacgttggtacagggctccagaaattatgttgaattccaagggctacaccaagtccattgatatttggtctgtaggctgcattctggcagattttggtattctggatcccatacaagagaccctgatgatataattaaagtaggactattgcttctttcaactaggtgcatggacagctgtcaatgtgctcaagtcggactatgcaatgtgcataaccagagatgagn

SEQ ID NO: 300121 - DNA, 335 bp, Homo sapiens
tcggcctcccaaagtgctgggattacaggcattagccactgtgcccagcccaagttaatcaactatgaagagaaaaataaaatcacataatcttggttgttcagcctctcataagaaagccaaattgttttttgcttttccatgttgtttacttgtatttctgaattgtagagtcaaaggagaagttcagagtcccatcagcaatgcacctgtcatacaggaagatctcatcatgtcctgtaacaccagataccattttcagtcttttctctctttctcctgcagggctacaccaagtccattgatatttggtctgtaggctgcattctggcaga

SEQ ID NO: 300122 - DNA, 2546 bp, Homo sapiens
ggctgactgagccgctttcaatttatttagcttttgacaataattccgtctaacccatcaggcccctagaagggctaactatgccctttctgagtcttccacgcggtgggggcgaaggaggatggagctagaacgaagcctcagcgcgtgccccgcacaaacatggcagcattcccagcagccctaaaccgcccgacgggagcgcgcgcgcggcgcaggcgcatttctgctcattccgcggcgtcggctgcggctgcagtggtggtggcgggtaccgcacggggtatggtccccgggtccgagggcccggcccgcgccgggagcgtggtggccgacgtggtgtttgtgattgagggtacggccaacctgggaccctacttcgaggggctccgcaagcactacctgctcccggccatcgagtattttaatggtggtcctcctgctgagacggacttcgggggagactatggggggacccagtacagcctcgtggtgttcaacacagtggactgcgctcccgagtcctacgtacaatgtcacgctcccaccagcagcgcctatgagtttgtcacctggctcgatggcattaagttcatgggcgggggtggtgagagctgcagcctcatcgcggaaggactcagcacagccttgcagctgtttgatgacttcaagaagatgcgcgagcagattggccagacgcaccgggtctgcctcctcatctgcaactcacccccatacttgttgcctgctgttgagagcaccacgtactctggatgcacaactgagaatcttgtgcagcagattggggagcgggggatccacttctccattgtgtctccccggaagctgcctgcgcttcggcttctgtttgagaaggcagcccccccggccttgctggagccgctgcagcctccgacagatgtgagccaggacccgaggcacatggtgctggttcggggactcgtgctgcctgttgggggtggctcagccccaggccccctccagtcaaagcagccagtccccctgcctcccgccgcaccctcaggtgccactctctcagcagccccccagcagcctctgccccccgtccccccgcagtaccaggttcccgggaacctgagtgcagctcaggtggccgcgcagaatgcagtggaggctgccaagaaccagaaggctgggctgggccctcgcttctcgcccatcacccctctccaacaagctgctcccggagtgggtccccccttcagccaggccccagctccccaactacccccaggaccccctggcgcccccaagccaccacctgcttcccagcccagtctggtctccactgtggcccctggctccggcctggctcccacggcacagcccggggcaccgtccatggcaggcactgtggccccaggaggggtgagcggcccttccccagcccagctgggagccccagccctcggtgggcagcagtcagtctccaataagcttctggcctggagcggggtcctggagtggcaagagaaacccaaacctgcctcagtggatgccaacaccaagctgacgcggtcactgccctgccaggtctacgtgaatcatggcgagaacctgaagacggagcagtggccccagaagctgatcatgcagctcatcccccagcagctgctgaccaccctgggccctttgttccggaactcaaggatggtccagttccatttcaccaacaaggacctggagtctctcaaaggcctctaccgcatcatgggcaacggcttcgcgggctgcgtgcacttcccccacacggcgccctgtgaggtgcgcgtgctcatgctcctgtactcgtccaagaagaagatcttcatgggcctcatcccctacgaccagagcggcttcgtcaacggcatccggcaggtcatcaccaaccacaagcaggtccagcagcagaagctggagcagcagcagcgaggaatggggggacagcaggcacccccagggctggggcccattctggaggaccaagccaggccctcacagaatctgctccagctccgcccaccgcagccccagcctcagggtaccgtaggggcctctggggccacggggcagccccagccccaaggtactgcccagcccccgccaggtgcccctcaaggccctcctggagcagcttctggcccaccccctcctggacccatccttcggccccagaaccctggggccaaccctcagctgcgaagcctcctcctcaacccaccaccgccgcagactggggtgcccccaccccaggcctccctccaccacctgcccagtcctggcccgcacaacttccccctcgggctccactgccaggtaaggggacccgggggagggcagaggtctggactgagtgtcccagcagctcctgggctagagcaccaagaccaagtgctcctgggaagtaaagacataggatccaagaatgagggttcccccagccgggcctgcagcccagcgtcatggaggacgacatcctcatggatctcatctgaatccccaacacccaataaagttccttt

SEQ ID NO: 300123 - DNA, 3475 bp, Homo sapiens
ggaacaaaagctggtactgggccgcccctcgaaggctcaggcccttacgggggatccacttctccattgtgtctccccggaagctgcctgcgcttcggcttctgtttgagaaggcagcccccccggccttgctggagccgctgcagcctccgacagatgtgagccaggacccgaggcacatggtgctggttcggggactcgtgctgcctgttgggggtggctcagccccaggccccctccagtcaaagcagccagtccccctgcctcccgccgcaccctcaggtgccactctctcagcagccccccagcagcctctgccccccgtccccccgcagtaccaggttcccgggaacctgagtgcagctcaggtggccgcgcagaatgcagtggaggctgccaagaaccagaaggctgggctgggccctcgcttctcgcccatcacccctctccaacaagctgctcccggagtgggtccccccttcagccaggccccagctccccaactacccccaggaccccctggcgcccccaagccaccacctgcttcccagcccagtctggtctccactgtggcccctggctccggcctggctcccacggcacagcccggggcaccgtccatggcaggcactgtggccccaggaggggtgagcggcccttccccagcccagctgggagccccagccctcggtgggcagcagtcagtctccaataagcttctggcctggagcggggtcctggagtggcaagagaaacccaaacctgcctcagtggatgccaacaccaagctgacgcggtcactgccctgccaggtctacgtgaatcatggcgagaacctgaagacggagcagtggccccagaagctgatcatgcagctcatcccccagcagctgctgaccaccctgggccctttgttccggaactcaaggatggtccagttccatttcaccaacaaggacctggagtctctcaaaggcctctaccgcatcatgggcaacggcttcgcgggctgcgtgcacttcccccacacggcgccctgtgaggtgcgcgtgctcatgctcctgtactcgtccaagaagaagatcttcatgggcctcatcccctacgaccagagcggcttcgtcaacggcatccggcaggtcatcaccaaccacaagcaggtccagcagcagaagctggagcagcagcagcgaggaatggggggacagcaggcacccccagggctggggcccattctggaggaccaagccaggccctcacagaatctgctccagctccgcccaccgcagccccagcctcagggtaccgtaggggcctctggggccacggggcagccccagccccaaggtactgcccagcccccgccaggtgcccctcaaggccctcctggagcagcttctggcccaccccctcctggacccatccttcggccccagaaccctggggccaaccctcagctgcgaagcctcctcctcaacccaccaccgccgcagactggggtgcccccaccccaggcctccctccaccacctccagccaccaggggctcctgcgctgctgcctccgccgcaccagggcctggggcagccccagttggggcccccactcctgcatccaccacctgcccagtcctggcccgcacaacttccccctcgggctccactgccagcggcaaaacgaaagagagaaggagagggccgtgtgtttcgagaaaaatgggagcgagcctatttctttgtggaagtgaagagcatgcctatgtgtttaatatgcaaacaaatcgtgtctgtgttgaaagaatacaacctgaaacgccactatgaatcaaagcatagtaagagctacgaccagtacacagaacagactcgagatgccatcctcaacgaactgaaaaagggactcaaatgtcaatagggtttgttttgaaaagcgaattaacagaagtggcgcggcagtggtacgccgttccggaatcacgtgagaagaatgacctgggcattcagagctacagcagatggcaagtttataaaggagcagagtgacgtgtcctgcacagaaacacatgactgttgagaccgttatttaagtctaacgggcatttgcgttgcacagtgagttggagataactcgggggatttacaagtccagttgcttgaaagagtcaaattgattgtggccttttctttcgctgctcataaactattaccacccagttagctttatttatttgtggtgttaagaatcttgatgtgaccgaagaagtctgtggcatggtgccaaggcaggcccaacactgggaaaggactaattttttttgtatattgagagaaaagtttcacatagactggccagagttccgaagcacaactacagacagcgtcatgacagggggacttggcaggacaccttgatccaaggcgacagcattttggcaaggacacggaagttgggtcgttgcatccatcatcaggagttgacttgttctgagcaactgaacagaacacaccgcgatgctctcgacacttccgctcctggacttcagtcacgagtgagttgatggtgacttgacctgagagatttcacagaagctctgtgacttggttgtggaagaaatctgaactgttcaagttaaccaacttggttcattttaaatcaggcaaaagccacagtgggttcccctgagaaggttagtcaaagacttctggtcaaggttatgaccgttctgaacactgaatatttctccgcaaggatgttccacaaacagctacttgaatgtatgatggtgtatgcttggtcctggggaatccaccggcaaggaaaaaaaacctttactctttcctgtgctgcagtcggctttcagaaatgaaagaggtggcccggactgtattcacctacgtcctggggttgaagaccaaattcccccaaaggctctcggaatccagactcatgagaaggaacagacactgtccagtttgcctttgttggcagatgtttcttgtgtgaatgcagaccataaatagtaattgaactacagtgcaatacggcgctggttcctaaatacaagtctgtgtgaagatggtgagattctacaactatctccagtagttgtcctgaatatctgtgtttgggagtacccacgcttgtgaacagctgttttccgttacgaacctgaatcaaattaaacatcgttcccagttgaaggattcaaggctgaattctaaactgcccgtccccaccgtgccacccgaggcctgacactgacatctcggtgtggaagggaagacgccagccttttggcttcaactcaaaggcgcaaaaagaattatgaaagagaaaattttaataattaaatatttctatttttcaatttgtattttttcaattttgaatttaaaaatataaactccagtaacatccatgtttgtattatgttccatgcattcaccatagttgagtaaagatccgatttgatgata

SEQ ID NO: 300124 - DNA, 4238 bp, Homo sapiens
ggctgactgagccgctttcaatttatttagcttttgacaataattccgtctaacccatcaggcccctagaagggctaactatgccctttctgagtcttccacgcggtgggggcgaaggaggatggagctagaacgaagcctcagcgcgtgccccgcacaaacatggcagcattcccagcagccctaaaccgcccgacgggagcgcgcgcgcggcgcaggcgcatttctgctcattccgcggcgtcggctgcggctgcagtggtggtggcgggtaccgcacggggtatggtccccgggtccgagggcccggcccgcgccgggagcgtggtggccgacgtggtgtttgtgattgagggtacggccaacctgggaccctacttcgaggggctccgcaagcactacctgctcccggccatcgagtattttaatggtggtcctcctgctgagacggacttcgggggagactatggggggacccagtacagcctcgtggtgttcaacacagtggactgcgctcccgagtcctacgtacaatgtcacgctcccaccagcagcgcctatgagtttgtcacctggctcgatggcattaagttcatgggcgggggtggtgagagctgcagcctcatcgcggaaggactcagcacagccttgcagctgtttgatgacttcaagaagatgcgcgagcagattggccagacgcaccgggtctgcctcctcatctgcaactcacccccatacttgttgcctgctgttgagagcaccacgtactctggatgcacaactgagaatcttgtgcagcagattggggagcgggggatccacttctccattgtgtctccccggaagctgcctgcgcttcggcttctgtttgagaaggcagcccccccggccttgctggagccgctgcagcctccgacagatgtgagccaggacccgaggcacatggtgctggttcggggactcgtgctgcctgttgggggtggctcagccccaggccccctccagtcaaagcagccagtccccctgcctcccgccgcaccctcaggtgccactctctcagcagccccccagcagcctctgccccccgtccccccgcagtaccaggttcccgggaacctgagtgcagctcaggtggccgcgcagaatgcagtggaggctgccaagaaccagaaggctgggctgggccctcgcttctcgcccatcacccctctccaacaagctgctcccggagtgggtccccccttcagccaggccccagctccccaactacccccaggaccccctggcgcccccaagccaccacctgcttcccagcccagtctggtctccactgtggcccctggctccggcctggctcccacggcacagcccggggcaccgtccatggcaggcactgtggccccaggaggggtgagcggcccttccccagcccagctgggagccccagccctcggtgggcagcagtcagtctccaataagcttctggcctggagcggggtcctggagtggcaagagaaacccaaacctgcctcagtggatgccaacaccaagctgacgcggtcactgccctgccaggtctacgtgaatcatggcgagaacctgaagacggagcagtggccccagaagctgatcatgcagctcatcccccagcagctgctgaccaccctgggccctttgttccggaactcaaggatggtccagttccatttcaccaacaaggacctggagtctctcaaaggcctctaccgcatcatgggcaacggcttcgcgggctgcgtgcacttcccccacacggcgccctgtgaggtgcgcgtgctcatgctcctgtactcgtccaagaagaagatcttcatgggcctcatcccctacgaccagagcggcttcgtcaacggcatccggcaggtcatcaccaaccacaagcaggtccagcagcagaagctggagcagcagcagcgaggaatggggggacagcaggcacccccagggctggggcccattctggaggaccaagccaggccctcacagaatctgctccagctccgcccaccgcagccccagcctcagggtaccgtaggggcctctggggccacggggcagccccagccccaaggtactgcccagcccccgccaggtgcccctcaaggccctcctggagcagcttctggcccaccccctcctggacccatccttcggccccagaaccctggggccaaccctcagctgcgaagcctcctcctcaacccaccaccgccgcagactggggtgcccccaccccaggcctccctccaccacctccagccaccaggggctcctgcgctgctgcctccgccgcaccagggcctggggcagccccagttggggcccccactcctgcatccaccacctgcccagtcctggcccgcacaacttccccctcgggctccactgccagcggcaaaacgaaagagagaaggagagggccgtgtgtttcgagaaaaatgggagcgagcctatttctttgtggaagtgaagagcatgcctatgtgtttaatatgcaaacaaatcgtgtctgtgttgaaagaatacaacctgaaacgccactatgaatcaaagcatagtaagagctacgaccagtacacagaacagactcgagatgccatcctcaacgaactgaaaaagggactcaaatgtcaatagggtttgttttgaaaagcgaattaacagaagtggcgcggcagtggtacgccgttccggaatcacgtgagaagaatgacctgggcattcagagctacagcagatggcaagtttataaaggagcagagtgacgtgtcctgcacagaaacacatgactgttgagaccgttatttaagtctaacgggcatttgcgttgcacagtgagttggagataactcgggggatttacaagtccagttgcttgaaagagtcaaattgattgtggccttttctttcgctgctcataaactattaccacccagttagctttatttatttgtggtgttaagaatcttgatgtgaccgaagaagtctgtggcatggtgccaaggcaggcccaacactgggaaaggactaattttttttgtatattgagagaaaagtttcacatagactggccagagttccgaagcacaactacagacagcgtcatgacagggggacttggcaggacaccttgatccaaggcgacagcattttggcaaggacacggaagttgggtcgttgcatccatcatcaggagttgacttgttctgagcaactgaacagaacacaccgcgatgctctcgacacttccgctcctggacttcagtcacgagtgagttgatggtgacttgacctgagagatttcacagaagctctgtgacttggttgtggaagaaatctgaactgttcaagttaaccaacttggttcattttaaatcaggcaaaagccacagtgggttcccctgagaaggttagtcaaagacttctggtcaaggttatgaccgttctgaacactgaatatttctccgcaaggatgttccacaaacagctacttgaatgtatgatggtgtatgcttggtcctggggaatccaccggcaaggaaaaaaaacctttactctttcctgtgctgcagtcggctttcagaaatgaaagaggtggcccggactgtattcacctacgtcctggggttgaagaccaaattcccccaaaggctctcggaatccagactcatgagaaggaacagacactgtccagtttgcctttgttggcagatgtttcttgtgtgaatgcagaccataaatagtaattgaactacagtgcaatacggcgctggttcctaaatacaagtctgtgtgaagatggtgagattctacaactatctccagtagttgtcctgaatatctgtgtttgggagtacccacgcttgtgaacagctgttttccgttacgaacctgaatcaaattaaacatcgttcccagttgaaggattcaaggctgaattctaaactgcccgtccccaccgtgccacccgaggcctgacactgacatctcggtgtggaagggaagacgccagccttttggcttcaactcaaaggcgcaaaaagaattatgaaagagaaaattttaataattaaatatttctatttttcaatttgtattttttcaattttgaatttaaaaatataaactccagtaacatccatgtttgtattatgttccatgcattcaccatagttgagtaaagatccgatttgatgata

SEQ ID NO: 300125 - DNA, 4069 bp, Homo sapiens
ggctgactgagccgctttcaatttatttagcttttgacaataattccgtctaacccatcaggcccctagaagggctaactatgccctttctgagtcttccacgcggtgggggcgaaggaggatggagctagaacgaagcctcagcgcgtgccccgcacaaacatggcagcattcccagcagccctaaaccgcccgacgggagcgcgcgcgcggcgcaggcgcatttctgctcattccgcggcgtcggctgcggctgcagtggtggtggcgggtaccgcacggggtatggtccccgggtccgagggcccggcccgcgccgggagcgtggtggccgacgtggtgtttgtgattgagggtacggccaacctgggaccctacttcgaggggctccgcaagcactacctgctcccggccatcgagtattttaatggtggtcctcctgctgagacggacttcgggggagacgactcagcacagccttgcagctgtttgatgacttcaagaagatgcgcgagcagattggccagacgcaccgggtctgcctcctcatctgcaactcacccccatacttgttgcctgctgttgagagcaccacgtactctggatgcacaactgagaatcttgtgcagcagattggggagcgggggatccacttctccattgtgtctccccggaagctgcctgcgcttcggcttctgtttgagaaggcagcccccccggccttgctggagccgctgcagcctccgacagatgtgagccaggacccgaggcacatggtgctggttcggggactcgtgctgcctgttgggggtggctcagccccaggccccctccagtcaaagcagccagtccccctgcctcccgccgcaccctcaggtgccactctctcagcagccccccagcagcctctgccccccgtccccccgcagtaccaggttcccgggaacctgagtgcagctcaggtggccgcgcagaatgcagtggaggctgccaagaaccagaaggctgggctgggccctcgcttctcgcccatcacccctctccaacaagctgctcccggagtgggtccccccttcagccaggccccagctccccaactacccccaggaccccctggcgcccccaagccaccacctgcttcccagcccagtctggtctccactgtggcccctggctccggcctggctcccacggcacagcccggggcaccgtccatggcaggcactgtggccccaggaggggtgagcggcccttccccagcccagctgggagccccagccctcggtgggcagcagtcagtctccaataagcttctggcctggagcggggtcctggagtggcaagagaaacccaaacctgcctcagtggatgccaacaccaagctgacgcggtcactgccctgccaggtctacgtgaatcatggcgagaacctgaagacggagcagtggccccagaagctgatcatgcagctcatcccccagcagctgctgaccaccctgggccctttgttccggaactcaaggatggtccagttccatttcaccaacaaggacctggagtctctcaaaggcctctaccgcatcatgggcaacggcttcgcgggctgcgtgcacttcccccacacggcgccctgtgaggtgcgcgtgctcatgctcctgtactcgtccaagaagaagatcttcatgggcctcatcccctacgaccagagcggcttcgtcaacggcatccggcaggtcatcaccaaccacaagcaggtccagcagcagaagctggagcagcagcagcgaggaatggggggacagcaggcacccccagggctggggcccattctggaggaccaagccaggccctcacagaatctgctccagctccgcccaccgcagccccagcctcagggtaccgtaggggcctctggggccacggggcagccccagccccaaggtactgcccagcccccgccaggtgcccctcaaggccctcctggagcagcttctggcccaccccctcctggacccatccttcggccccagaaccctggggccaaccctcagctgcgaagcctcctcctcaacccaccaccgccgcagactggggtgcccccaccccaggcctccctccaccacctccagccaccaggggctcctgcgctgctgcctccgccgcaccagggcctggggcagccccagttggggcccccactcctgcatccaccacctgcccagtcctggcccgcacaacttccccctcgggctccactgccagcggcaaaacgaaagagagaaggagagggccgtgtgtttcgagaaaaatgggagcgagcctatttctttgtggaagtgaagagcatgcctatgtgtttaatatgcaaacaaatcgtgtctgtgttgaaagaatacaacctgaaacgccactatgaatcaaagcatagtaagagctacgaccagtacacagaacagactcgagatgccatcctcaacgaactgaaaaagggactcaaatgtcaatagggtttgttttgaaaagcgaattaacagaagtggcgcggcagtggtacgccgttccggaatcacgtgagaagaatgacctgggcattcagagctacagcagatggcaagtttataaaggagcagagtgacgtgtcctgcacagaaacacatgactgttgagaccgttatttaagtctaacgggcatttgcgttgcacagtgagttggagataactcgggggatttacaagtccagttgcttgaaagagtcaaattgattgtggccttttctttcgctgctcataaactattaccacccagttagctttatttatttgtggtgttaagaatcttgatgtgaccgaagaagtctgtggcatggtgccaaggcaggcccaacactgggaaaggactaattttttttgtatattgagagaaaagtttcacatagactggccagagttccgaagcacaactacagacagcgtcatgacagggggacttggcaggacaccttgatccaaggcgacagcattttggcaaggacacggaagttgggtcgttgcatccatcatcaggagttgacttgttctgagcaactgaacagaacacaccgcgatgctctcgacacttccgctcctggacttcagtcacgagtgagttgatggtgacttgacctgagagatttcacagaagctctgtgacttggttgtggaagaaatctgaactgttcaagttaaccaacttggttcattttaaatcaggcaaaagccacagtgggttcccctgagaaggttagtcaaagacttctggtcaaggttatgaccgttctgaacactgaatatttctccgcaaggatgttccacaaacagctacttgaatgtatgatggtgtatgcttggtcctggggaatccaccggcaaggaaaaaaaacctttactctttcctgtgctgcagtcggctttcagaaatgaaagaggtggcccggactgtattcacctacgtcctggggttgaagaccaaattcccccaaaggctctcggaatccagactcatgagaaggaacagacactgtccagtttgcctttgttggcagatgtttcttgtgtgaatgcagaccataaatagtaattgaactacagtgcaatacggcgctggttcctaaatacaagtctgtgtgaagatggtgagattctacaactatctccagtagttgtcctgaatatctgtgtttgggagtacccacgcttgtgaacagctgttttccgttacgaacctgaatcaaattaaacatcgttcccagttgaaggattcaaggctgaattctaaactgcccgtccccaccgtgccacccgaggcctgacactgacatctcggtgtggaagggaagacgccagccttttggcttcaactcaaaggcgcaaaaagaattatgaaagagaaaattttaataattaaatatttctatttttcaatttgtattttttcaattttgaatttaaaaatataaactccagtaacatccatgtttgtattatgttccatgcattcaccatagttgagtaaagatccgatttgatgata

SEQ ID NO: 300126 - DNA, 4259 bp, Homo sapiens
ggctgactgagccgctttcaatttatttagcttttgacaataattccgtctaacccatcaggcccctagaagggctaactatgccctttctgagtcttccacgcggtgggggcgaaggaggatggagctagaacgaagcctcagcgcgtgccccgcacaaacatggcagcattcccagcagccctaaaccgcccgacgggagcgcgcgcgcggcgcaggcgcatttctgctcattccgcggcgtcggctgcggctgcagtggtggtggcgggtaccgcacggggtatggtccccgggtccgagggcccggcccgcgccgggagcgtggtggccgacgtggtgtttgtgattgagggtacggccaacctgggaccctacttcgaggggctccgcaagcactacctgctcccggccatcgagtattttaatggtggtcctcctgctgagacggacttcgggggagactatggggggacccagtacagcctcgtggtgttcaacacagtggactgcgctcccgagtcctacgtacaatgtcacgctcccaccagcagcgcctatgagtttgtcacctggctcgatggcattaagtgagctttcccccacttggggttcatgggcgggggtggtgagagctgcagcctcatcgcggaaggactcagcacagccttgcagctgtttgatgacttcaagaagatgcgcgagcagattggccagacgcaccgggtctgcctcctcatctgcaactcacccccatacttgttgcctgctgttgagagcaccacgtactctggatgcacaactgagaatcttgtgcagcagattggggagcgggggatccacttctccattgtgtctccccggaagctgcctgcgcttcggcttctgtttgagaaggcagcccccccggccttgctggagccgctgcagcctccgacagatgtgagccaggacccgaggcacatggtgctggttcggggactcgtgctgcctgttgggggtggctcagccccaggccccctccagtcaaagcagccagtccccctgcctcccgccgcaccctcaggtgccactctctcagcagccccccagcagcctctgccccccgtccccccgcagtaccaggttcccgggaacctgagtgcagctcaggtggccgcgcagaatgcagtggaggctgccaagaaccagaaggctgggctgggccctcgcttctcgcccatcacccctctccaacaagctgctcccggagtgggtccccccttcagccaggccccagctccccaactacccccaggaccccctggcgcccccaagccaccacctgcttcccagcccagtctggtctccactgtggcccctggctccggcctggctcccacggcacagcccggggcaccgtccatggcaggcactgtggccccaggaggggtgagcggcccttccccagcccagctgggagccccagccctcggtgggcagcagtcagtctccaataagcttctggcctggagcggggtcctggagtggcaagagaaacccaaacctgcctcagtggatgccaacaccaagctgacgcggtcactgccctgccaggtctacgtgaatcatggcgagaacctgaagacggagcagtggccccagaagctgatcatgcagctcatcccccagcagctgctgaccaccctgggccctttgttccggaactcaaggatggtccagttccatttcaccaacaaggacctggagtctctcaaaggcctctaccgcatcatgggcaacggcttcgcgggctgcgtgcacttcccccacacggcgccctgtgaggtgcgcgtgctcatgctcctgtactcgtccaagaagaagatcttcatgggcctcatcccctacgaccagagcggcttcgtcaacggcatccggcaggtcatcaccaaccacaagcaggtccagcagcagaagctggagcagcagcagcgaggaatggggggacagcaggcacccccagggctggggcccattctggaggaccaagccaggccctcacagaatctgctccagctccgcccaccgcagccccagcctcagggtaccgtaggggcctctggggccacggggcagccccagccccaaggtactgcccagcccccgccaggtgcccctcaaggccctcctggagcagcttctggcccaccccctcctggacccatccttcggccccagaaccctggggccaaccctcagctgcgaagcctcctcctcaacccaccaccgccgcagactggggtgcccccaccccaggcctccctccaccacctccagccaccaggggctcctgcgctgctgcctccgccgcaccagggcctggggcagccccagttggggcccccactcctgcatccaccacctgcccagtcctggcccgcacaacttccccctcgggctccactgccagcggcaaaacgaaagagagaaggagagggccgtgtgtttcgagaaaaatgggagcgagcctatttctttgtggaagtgaagagcatgcctatgtgtttaatatgcaaacaaatcgtgtctgtgttgaaagaatacaacctgaaacgccactatgaatcaaagcatagtaagagctacgaccagtacacagaacagactcgagatgccatcctcaacgaactgaaaaagggactcaaatgtcaatagggtttgttttgaaaagcgaattaacagaagtggcgcggcagtggtacgccgttccggaatcacgtgagaagaatgacctgggcattcagagctacagcagatggcaagtttataaaggagcagagtgacgtgtcctgcacagaaacacatgactgttgagaccgttatttaagtctaacgggcatttgcgttgcacagtgagttggagataactcgggggatttacaagtccagttgcttgaaagagtcaaattgattgtggccttttctttcgctgctcataaactattaccacccagttagctttatttatttgtggtgttaagaatcttgatgtgaccgaagaagtctgtggcatggtgccaaggcaggcccaacactgggaaaggactaattttttttgtatattgagagaaaagtttcacatagactggccagagttccgaagcacaactacagacagcgtcatgacagggggacttggcaggacaccttgatccaaggcgacagcattttggcaaggacacggaagttgggtcgttgcatccatcatcaggagttgacttgttctgagcaactgaacagaacacaccgcgatgctctcgacacttccgctcctggacttcagtcacgagtgagttgatggtgacttgacctgagagatttcacagaagctctgtgacttggttgtggaagaaatctgaactgttcaagttaaccaacttggttcattttaaatcaggcaaaagccacagtgggttcccctgagaaggttagtcaaagacttctggtcaaggttatgaccgttctgaacactgaatatttctccgcaaggatgttccacaaacagctacttgaatgtatgatggtgtatgcttggtcctggggaatccaccggcaaggaaaaaaaacctttactctttcctgtgctgcagtcggctttcagaaatgaaagaggtggcccggactgtattcacctacgtcctggggttgaagaccaaattcccccaaaggctctcggaatccagactcatgagaaggaacagacactgtccagtttgcctttgttggcagatgtttcttgtgtgaatgcagaccataaatagtaattgaactacagtgcaatacggcgctggttcctaaatacaagtctgtgtgaagatggtgagattctacaactatctccagtagttgtcctgaatatctgtgtttgggagtacccacgcttgtgaacagctgttttccgttacgaacctgaatcaaattaaacatcgttcccagttgaaggattcaaggctgaattctaaactgcccgtccccaccgtgccacccgaggcctgacactgacatctcggtgtggaagggaagacgccagccttttggcttcaactcaaaggcgcaaaaagaattatgaaagagaaaattttaataattaaatatttctatttttcaatttgtattttttcaattttgaatttaaaaatataaactccagtaacatccatgtttgtattatgttccatgcattcaccatagttgagtaaagatccgatttgatgata

SEQ ID NO: 300127 - DNA, 3857 bp, Homo sapiens
  misc_feature (26)..(26): n is a, c, g, or t
ttattattgccaagtgctgtaccccncgagtaatgggatatcgtcgaccacggcgtcgctgctgagacggacttcgggggagactatggggggacccagtacagcctcgtggtgttcaacacagtggactgcgctcccgagtcctacgtacaatgtcacgctcccaccagcagcgcctatgagtttgtcacctggctcgatggcattaagttcatgggcgggggtggtgagagctgcagcctcatcgcggaaggactcagcacagccttgcagctgtttgatgacttcaagaagatgcgcgagcagattggccagacgcaccgggtctgcctcctcatctgcaactcacccccatacttgttgcctgctgttgagagcaccacgtactctggatgcacaactgagaatcttgtgcagcagattggggagcgggggatccacttctccattgtgtctccccggaagctgcctgcgcttcggcttctgtttgagaaggcagcccccccggccttgctggagccgctgcagcctccgacagatgtgagccaggacccgaggcacatggtgctggttcggggactcgtgctgcctgttgggggtggctcagccccaggccccctccagtcaaagcagccagtccccctgcctcccgccgcaccctcaggtgccactctctcagcagccccccagcagcctctgccccccgtccccccgcagtaccaggttcccgggaacctgagtgcagctcaggtggccgcgcagaatgcagtggaggctgccaagaaccagaaggctgggctgggccctcgcttctcgcccatcacccctctccaacaagctgctcccggagtgggtccccccttcagccaggccccagctccccaactacccccaggaccccctggcgcccccaagccaccacctgcttcccagcccagtctggtctccactgtggcccctggctccggcctggctcccacggcacagcccggggcaccgtccatggcaggcactgtggccccaggaggggtgagcggcccttccccagcccagctgggagccccagccctcggtgggcagcagtcagtctccaataagcttctggcctggagcggggtcctggagtggcaagagaaacccaaacctgcctcagtggatgccaacaccaagctgacgcggtcactgccctgccaggtctacgtgaatcatggcgagaacctgaagacggagcagtggccccagaagctgatcatgcagctcatcccccagcagctgctgaccaccctgggccctttgttccggaactcaaggatggtccagttccatttcaccaacaaggacctggagtctctcaaaggcctctaccgcatcatgggcaacggcttcgcgggctgcgtgcacttcccccacacggcgccctgtgaggtgcgcgtgctcatgctcctgtactcgtccaagaagaagatcttcatgggcctcatcccctacgaccagagcggcttcgtcaacggcatccggcaggtcatcaccaaccacaagcaggtccagcagcagaagctggagcagcagcagcgaggaatggggggacagcaggcacccccagggctggggcccattctggaggaccaagccaggccctcacagaatctgctccagctccgcccaccgcagccccagcctcagggtaccgtaggggcctctggggccacggggcagccccagccccaaggtactgcccagcccccgccaggtgcccctcaaggccctcctggagcagcttctggcccaccccctcctggacccatccttcggccccagaaccctggggccaaccctcagctgcgaagcctcctcctcaacccaccaccgccgcagactggggtgcccccaccccaggcctccctccaccacctccagccaccaggggctcctgcgctgctgcctccgccgcaccagggcctggggcagccccagttggggcccccactcctgcatccaccacctgcccagtcctggcccgcacaacttccccctcgggctccactgccagcggcaaaacgaaagagagaaggagagggccgtgtgtttcgagaaaaatgggagcgagcctatttctttgtggaagtgaagagcatgcctatgtgtttaatatgcaaacaaatcgtgtctgtgttgaaagaatacaacctgaaacgccactatgaatcaaagcatagtaagagctacgaccagtacacagaacagactcgagatgccatcctcaacgaactgaaaaagggactcaaatgtcaatagggtttgttttgaaaagcgaattaacagaagtggcgcggcagtggtacgccgttccggaatcacgtgagaagaatgacctgggcattcagagctacagcagatggcaagtttataaaggagcagagtgacgtgtcctgcacagaaacacatgactgttgagaccgttatttaagtctaacgggcatttgcgttgcacagtgagttggagataactcgggggatttacaagtccagttgcttgaaagagtcaaattgattgtggccttttctttcgctgctcataaactattaccacccagttagctttatttatttgtggtgttaagaatcttgatgtgaccgaagaagtctgtggcatggtgccaaggcaggcccaacactgggaaaggactaattttttttgtatattgagagaaaagtttcacatagactggccagagttccgaagcacaactacagacagcgtcatgacagggggacttggcaggacaccttgatccaaggcgacagcattttggcaaggacacggaagttgggtcgttgcatccatcatcaggagttgacttgttctgagcaactgaacagaacacaccgcgatgctctcgacacttccgctcctggacttcagtcacgagtgagttgatggtgacttgacctgagagatttcacagaagctctgtgacttggttgtggaagaaatctgaactgttcaagttaaccaacttggttcattttaaatcaggcaaaagccacagtgggttcccctgagaaggttagtcaaagacttctggtcaaggttatgaccgttctgaacactgaatatttctccgcaaggatgttccacaaacagctacttgaatgtatgatggtgtatgcttggtcctggggaatccaccggcaaggaaaaaaaacctttactctttcctgtgctgcagtcggctttcagaaatgaaagaggtggcccggactgtattcacctacgtcctggggttgaagaccaaattcccccaaaggctctcggaatccagactcatgagaaggaacagacactgtccagtttgcctttgttggcagatgtttcttgtgtgaatgcagaccataaatagtaattgaactacagtgcaatacggcgctggttcctaaatacaagtctgtgtgaagatggtgagattctacaactatctccagtagttgtcctgaatatctgtgtttgggagtacccacgcttgtgaacagctgttttccgttacgaacctgaatcaaattaaacatcgttcccagttgaaggattcaaggctgaattctaaactgcccgtccccaccgtgccacccgaggcctgacactgacatctcggtgtggaagggaagacgccagccttttggcttcaactcaaaggcgcaaaaagaattatgaaagagaaaattttaataattaaatatttctatttttcaatttgtattttttcaattttgaatttaaaaatataaactccagtaacatccatgtttgtattatgttccatgcattcaccatagttgagtaaagatccgatttgatgata

SEQ ID NO: 300128 - DNA, 3527 bp, Homo sapiens
  misc_feature (3508)..(3509): n is a, c, g, or t
  misc_feature (3513)..(3514): n is a, c, g, or t
ggaacaaaagctggtactgggccgcccctcgaaggctcaggcccttacgggggatccacttctccattgtgtctccccggaagctgcctgcgcttcggcttctgtttgagaaggcagcccccccggccttgctggagccgctgcagcctccgacagatgtgagccaggacccgaggcacatggtgctggttcggggactcgtgctgcctgttgggggtggctcagccccaggccccctccagtcaaagcagccagtccccctgcctcccgccgcaccctcaggtgccactctctcagcagccccccagcagcctctgccccccgtccccccgcagtaccaggttcccgggaacctgagtgcagctcaggtggccgcgcagaatgcagtggaggctgccaagaaccagaaggctgggctgggccctcgcttctcgcccatcacccctctccaacaagctgctcccggagtgggtccccccttcagccaggccccagctccccaactacccccaggaccccctggcgcccccaagccaccacctgcttcccagcccagtctggtctccactgtggcccctggctccggcctggctcccacggcacagcccggggcaccgtccatggcaggcactgtggccccaggaggggtgagcggcccttccccagcccagctgggagccccagccctcggtgggcagcagtcagtctccaataagcttctggcctggagcggggtcctggagtggcaagagaaacccaaacctgcctcagtggatgccaacaccaagctgacgcggtcactgccctgccaggtctacgtgaatcatggcgagaacctgaagacggagcagtggccccagaagctgatcatgcagctcatcccccagcagctgctgaccaccctgggccctttgttccggaactcaaggatggtccagttccatttcaccaacaaggacctggagtctctcaaaggcctctaccgcatcatgggcaacggcttcgcgggctgcgtgcacttcccccacacggcgccctgtgaggtgcgcgtgctcatgctcctgtactcgtccaagaagaagatcttcatgggcctcatcccctacgaccagagcggcttcgtcaacggcatccggcaggtcatcaccaaccacaagcaggtccagcagcagaagctggagcagcagcagcgaggaatggggggacagcaggcacccccagggctggggcccattctggaggaccaagccaggccctcacagaatctgctccagctccgcccaccgcagccccagcctcagggtaccgtaggggcctctggggccacggggcagccccagccccaaggtactgcccagcccccgccaggtgcccctcaaggccctcctggagcagcttctggcccaccccctcctggacccatccttcggccccagaaccctggggccaaccctcagctgcgaagcctcctcctcaacccaccaccgccgcagactggggtgcccccaccccaggcctccctccaccacctccagccaccaggggctcctgcgctgctgcctccgccgcaccagggcctggggcagccccagttggggcccccactcctgcatccaccacctgcccagtcctggcccgcacaacttccccctcgggctccactgccagcggcaaaacgaaagagagaaggagagggccgtgtgtttcgagaaaaatgggagcgagcctatttctttgtggaagtgaagagcatgcctatgtgtttaatatgcaaacaaatcgtgtctgtgttgaaagaatacaacctgaaacgccactatgaatcaaagcatagtaagagctacgaccagtacacagaacagactcgagatgccatcctcaacgaactgaaaaagggactcaaatgtcaatagggtttgttttgaaaagcgaattaacagaagtggcgcggcagtggtacgccgttccggaatcacgtgagaagaatgacctgggcattcagagctacagcagatggcaagtttataaaggagcagagtgacgtgtcctgcacagaaacacatgactgttgagaccgttatttaagtctaacgggcatttgcgttgcacagtgagttggagataactcgggggatttacaagtccagttgcttgaaagagtcaaattgattgtggccttttctttcgctgctcataaactattaccacccagttagctttatttatttgtggtgttaagaatcttgatgtgaccgaagaagtctgtggcatggtgccaaggcaggcccaacactgggaaaggactaattttttttgtatattgagagaaaagtttcacatagactggccagagttccgaagcacaactacagacagcgtcatgacagggggacttggcaggacaccttgatccaaggcgacagcattttggcaaggacacggaagttgggtcgttgcatccatcatcaggagttgacttgttctgagcaactgaacagaacacaccgcgatgctctcgacacttccgctcctggacttcagtcacgagtgagttgatggtgacttgacctgagagatttcacagaagctctgtgacttggttgtggaagaaatctgaactgttcaagttaaccaacttggttcattttaaatcaggcaaaagccacagtgggttcccctgagaaggttagtcaaagacttctggtcaaggttatgaccgttctgaacactgaatatttctccgcaaggatgttccacaaacagctacttgaatgtatgatggtgtatgcttggtcctggggaatccaccggcaaggaaaaaaaacctttactctttcctgtgctgcagtcggctttcagaaatgaaagaggtggcccggactgtattcacctacgtcctggggttgaagaccaaattcccccaaaggctctcggaatccagactcatgagaaggaacagacactgtccagtttgcctttgttggcagatgtttcttgtgtgaatgcagaccataaatagtaattgaactacagtgcaatacggcgctggttcctaaatacaagtctgtgtgaagatggtgagattctacaactatctccagtagttgtcctgaatatctgtgtttgggagtacccacgcttgtgaacagctgttttccgttacgaacctgaatcaaattaaacatcgttcccagttgaaggattcaaggctgaattctaaactgcccgtccccaccgtgccacccgaggcctgacactgacatctcggtgtggaagggaagacgccagccttttggcttcaactcaaaggcgcaaaaagaattatgaaagagaaaattttaataattaaatatttctatttttcaatttgtattttttcaattttgaatttaaaaatataaactccagtaacatccatgtttgtattatgttccatgcattcaccatagttgagtaaagatccgatttgatgataaaaagataaatagaatagctaccagggaggganngggnntccttgggttttt

SEQ ID NO: 300129 - DNA, 2942 bp, Homo sapiens
gcgcggtggcaggcacctgcagtcccagctactcgggaggctgaggcaggagaatggcgtgaacccaggaggcggagtttgcagtgagccgagatggcaccattgcactccagcccgggcgaaggagcaaaaactccgtctcaaaaaaaaaacaaagatcccgaacagtcagtctccaataagcttctggcctggagcggggtcctggagtggcaagagaaacccaaacctgcctcagtggatgccaacaccaagctgacgcggtcactgccctgccaggtctacgtgaatcatggcgagaacctgaagacggagcagtggccccagaagctgatcatgcagctcatcccccagcagctgctgaccaccctgggccctttgttccggaactcaaggatggtccagttccatttcaccaacaaggacctggagtctctcaaaggcctctaccgcatcatgggcaacggcttcgcgggctgcgtgcacttcccccacacggcgccctgtgaggtgcgcgtgctcatgctcctgtactcgtccaagaagaagatcttcatgggcctcatcccctacgaccagagcggcttcgtcaacggcatccggcaggtcatcaccaaccacaagcaggtccagcagcagaagctggagcagcagcagcgaggaatggggggacagcaggcacccccagggctggggcccattctggaggaccaagccaggccctcacagaatctgctccagctccgcccaccgcagccccagcctcagggtaccgtaggggcctctggggccacggggcagccccagccccaaggtactgcccagcccccgccaggtgcccctcaaggccctcctggagcagcttctggcccaccccctcctggacccatccttcggccccagaaccctggggccaaccctcagctgcgaagcctcctcctcaacccaccaccgccgcagactggggtgcccccaccccaggcctccctccaccacctccagccaccaggggctcctgcgctgctgcctccgccgcaccagggcctggggcagccccagttggggcccccactcctgcatccaccacctgcccagtcctggcccgcacaacttccccctcgggctccactgccagcggcaaaacgaaagagagaaggagagggccgtgtgtttcgagaaaaatgggagcgagcctatttctttgtggaagtgaagagcatgcctatgtgtttaatatgcaaacaaatcgtgtctgtgttgaaagaatacaacctgaaacgccactatgaatcaaagcatagtaagagctacgaccagtacacagaacagactcgagatgccatcctcaacgaactgaaaaagggactcaaatgtcaatagggtttgttttgaaaagcgaattaacagaagtggcgcggcagtggtacgccgttccggaatcacgtgagaagaatgacctgggcattcagagctacagcagatggcaagtttataaaggagcagagtgacgtgtcctgcacagaaacacatgactgttgagaccgttatttaagtctaacgggcatttgcgttgcacagtgagttggagataactcgggggatttacaagtccagttgcttgaaagagtcaaattgattgtggccttttctttcgctgctcataaactattaccacccagttagctttatttatttgtggtgttaagaatcttgatgtgaccgaagaagtctgtggcatggtgccaaggcaggcccaacactgggaaaggactaattttttttgtatattgagagaaaagtttcacatagactggccagagttccgaagcacaactacagacagcgtcatgacagggggacttggcaggacaccttgatccaaggcgacagcattttggcaaggacacggaagttgggtcgttgcatccatcatcaggagttgacttgttctgagcaactgaacagaacacaccgcgatgctctcgacacttccgctcctggacttcagtcacgagtgagttgatggtgacttgacctgagagatttcacagaagctctgtgacttggttgtggaagaaatctgaactgttcaagttaaccaacttggttcattttaaatcaggcaaaagccacagtgggttcccctgagaaggttagtcaaagacttctggtcaaggttatgaccgttctgaacactgaatatttctccgcaaggatgttccacaaacagctacttgaatgtatgatggtgtatgcttggtcctggggaatccaccggcaaggaaaaaaaacctttactctttcctgtgctgcagtcggctttcagaaatgaaagaggtggcccggactgtattcacctacgtcctggggttgaagaccaaattcccccaaaggctctcggaatccagactcatgagaaggaacagacactgtccagtttgcctttgttggcagatgtttcttgtgtgaatgcagaccataaatagtaattgaactacagtgcaatacggcgctggttcctaaatacaagtctgtgtgaagatggtgagattctacaactatctccagtagttgtcctgaatatctgtgtttgggagtacccacgcttgtgaacagctgttttccgttacgaacctgaatcaaattaaacatcgttcccagttgaaggattcaaggctgaattctaaactgcccgtccccaccgtgccacccgaggcctgacactgacatctcggtgtggaagggaagacgccagccttttggcttcaactcaaaggcgcaaaaagaattatgaaagagaaaattttaataattaaatatttctatttttcaatttgtattttttcaattttgaatttaaaaatataaactccagtaacatccatgtttgtattatgttccatgcattcaccatagttgagtaaagatccgatttgatgata

SEQ ID NO: 300130 - DNA, 3205 bp, Homo sapiens
ggaacaaaagctggtactgggccgcccctcgaaggctcaggcccttacgggggatccacttctccattgtgtctccccggaagctgcctgcgcttcggcttctgtttgagaaggcagcccccccggccttgctggagccgctgcagcctccgacagatgtgagccaggacccgaggcacatggtgctggttcggggactcgtgctgcctgttgggggtggctcagccccaggccccctccagtcaaagcagccagtccccctgcctcccgccgcaccctcaggtgccactctctcagcagccccccagcagcctctgccccccgtccccccgcagtaccaggttcccgggaacctgagtgcagctcaggtggccgcgcagaatgcagtggaggctgccaagaaccagaaggctgggctgggccctcgcttctcgcccatcacccctctccaacaagctgctcccggagtgggtccccccttcagccaggccccagctccccaactacccccaggaccccctggcgcccccaagccaccacctgcttcccagcccagtctggtctccactgtggcccctggctccggcctggctcccacggcacagcccggggcaccgtccatggcaggcactgtggccccaggaggggtgagcggcccttccccagcccagctgggagccccagccctcggtgggcagcagtcagtctccaataagcttctggcctggagcggggtcctggagtggcaagagaaacccaaacctgcctcagtggatgccaacaccaagctgacgcggtcactgccctgccaggtctacgtgaatcatggcgagaacctgaagacggagcagtggccccagaagctgatcatgcagctcatcccccagcagctgctgaccaccctgggccctttgttccggaactcaaggatggtccagttccatttcaccaacaaggacctggagtctctcaaaggcctctaccgcatcatgggcaacggcttcgcgggctgcgtgcacttcccccacacggcgccctgtgaggtgcgcgtgctcatgctcctgtactcgtccaagaagaagatcttcatgggcctcatcccctacgaccagagcggcttcgtcaacggcatccggcaggtcatcaccaaccacaagcaggtccagcagcagaagctggagcagcagcagcgaggaatggggggacagcaggcacccccagggctggggcccattctggaggaccaagccaggccctcacagaatctgctccagctccgcccaccgcagccccagcctcagggtaccgtaggggcctctggggccacggggcagccccagccccaaggtactgcccagcccccgccaggtgcccctcaaggccctcctggagcagcttctggcccaccccctcctggacccatccttcggccccagaaccctggggccaaccctcagctgcgaagcctcctcctcaacccaccaccgccgcagactggggtgcccccaccccaggcctccctccaccacctccagccaccaggggctcctgcgctgctgcctccgccgcaccagggcctggggcagccccagttggggcccccactcctgcatccaccacctgcccagtcctggcccgcacaacttccccctcgggctccactgccagcggcaaaacgaaagagagaaggagagggccgtgtgtttcgagaaaaatgggagcgagcctatttctttgtggaagtgaagagcatgcctatgtgtttaatatgcaaacaaatcgtgtctgtgttgaaagaatacaacctgaaacgccactatgaatcaaagcatagtaagagctacgaccagtacacagaacagactcgagatgccatcctcaacgaactgaaaaagggactcaaatgtcaatagggtttgttttgaaaagcgaattaacagaagtggcgcggcagtggtacgccgttccggaatcacgtgagaagaatgacctgggcattcagagctacagcagatggcaagtttataaaggagcagagtgacgtgtcctgcacagaaacacatgactgttgagaccgttatttaagtctaacgggcatttgcgttgcacagtgagttggagataactcgggggatttacaagtccagttgcttgaaagagtcaaattgattgtggccttttctttcgctgctcataaactattaccacccagttagctttatttatttgtggtgttaagaatcttgatgtgaccgaagaagtctgtggcatggtgccaaggcaggcccaacactgggaaaggactaattttttttgtatattgagagaaaagtttcacatagactggccagagttccgaagcacaactacagacagcgtcatgacagggggacttggcaggacaccttgatccaaggcgacagcattttggcaaggacacggaagttgggtcgttgcatccatcatcaggagttgacttgttctgagcaactgaacagaacacaccgcgatgctctcgacacttccgctcctggacttcagtcacgagtgagttgatggtgacttgacctgagagatttcacagaagctctgtgacttggttgtggaagaaatctgaactgttcaagttaaccaacttggttcattttaaatcaggcaaaagccacagtgggttcccctgagaaggttagtcaaagacttctggtcaaggttatgaccgttctgaacactgaatatttctccgcaaggatgttccacaaacagctacttgaatgtatgatggtgtatgcttggtcctggggaatccaccggcaaggaaaaaaaacctttactctttcctgtgctgcagtcggctttcagaaatgaaagaggtggcccggactgtattcacctacgtcctggggttgaagaccaaattcccccaaaggctctcggaatccagactcatgagaaggaacagacactgtccagtttgcctttgttggcagatgtttcttgtgtgaatgcagaccataaatagtaattgaactacagtgcaatacggcgctggttcctaaatacaagtctgtgtgaagatggtgagattctacaactatctccagtagttgtcctgaatatctgtgtttgggagtacccacgcttgtgaacagctgttttccgttacgaacctggtctgtattaactgcttggggatcctcagatcatc

SEQ ID NO: 300131 - DNA, 1870 bp, Homo sapiens
ttgttctgtggtagcattcagaggaaagtgaaatctttcttgtacccatgtctctatcacaagcggcaaaacgaaagagagaaggagagggccgtgtgtttcgagaaaaatgggagcgagcctatttctttgtggaagtgaagagcatgcctatgtgtttaatatgcaaacaaatcgtgtctgtgttgaaagaatacaacctgaaacgccactatgaatcaaagcatagtaagagctacgaccagtacacagaacagactcgagatgccatcctcaacgaactgaaaaagggactcaaatgtcaatagggtttgttttgaaaagcgaattaacagaagtggcgcggcagtggtacgccgttccggaatcacgtgagaagaatgacctgggcattcagagctacagcagatggcaagtttataaaggagcagagtgacgtgtcctgcacagaaacacatgactgttgagaccgttatttaagtctaacgggcatttgcgttgcacagtgagttggagataactcgggggatttacaagtccagttgcttgaaagagtcaaattgattgtggccttttctttcgctgctcataaactattaccacccagttagctttatttatttgtggtgttaagaatcttgatgtgaccgaagaagtctgtggcatggtgccaaggcaggcccaacactgggaaaggactaattttttttgtatattgagagaaaagtttcacatagactggccagagttccgaagcacaactacagacagcgtcatgacagggggacttggcaggacaccttgatccaaggcgacagcattttggcaaggacacggaagttgggtcgttgcatccatcatcaggagttgacttgttctgagcaactgaacagaacacaccgcgatgctctcgacacttccgctcctggacttcagtcacgagtgagttgatggtgacttgacctgagagatttcacagaagctctgtgacttggttgtggaagaaatctgaactgttcaagttaaccaacttggttcattttaaatcaggcaaaagccacagtgggttcccctgagaaggttagtcaaagacttctggtcaaggttatgaccgttctgaacactgaatatttctccgcaaggatgttccacaaacagctacttgaatgtatgatggtgtatgcttggtcctggggaatccaccggcaaggaaaaaaaacctttactctttcctgtgctgcagtcggctttcagaaatgaaagaggtggcccggactgtattcacctacgtcctggggttgaagaccaaattcccccaaaggctctcggaatccagactcatgagaaggaacagacactgtccagtttgcctttgttggcagatgtttcttgtgtgaatgcagaccataaatagtaattgaactacagtgcaatacggcgctggttcctaaatacaagtctgtgtgaagatggtgagattctacaactatctccagtagttgtcctgaatatctgtgtttgggagtacccacgcttgtgaacagctgttttccgttacgaacctgaatcaaattaaacatcgttcccagttgaaggattcaaggctgaattctaaactgcccgtccccaccgtgccacccgaggcctgacactgacatctcggtgtggaagggaagacgccagccttttggcttcaactcaaaggcgcaaaaagaattatgaaagagaaaattttaataattaaatatttctatttttcaatttgtattttttcaattttgaatttaaaaatataaactccagtaacatccatgtttgtattatgttccatgcattcaccatagttgagtaaagatccgatttgatgata

SEQ ID NO: 300132 - DNA, 2677 bp, Homo sapiens
ggaacaaaagctggtactgggccgcccctcgaaggctcaggcccttacgggggatccacttctccattgtgtctccccggaagctgcctgcgcttcggcttctgtttgagaaggcagcccccccggccttgctggagccgctgcagcctccgacagatgtgagccaggacccgaggcacatggtgctggttcggggactcgtgctgcctgttgggggtggctcagccccaggccccctccagtcaaagcagccagtccccctgcctcccgccgcaccctcaggtgccactctctcagcagccccccagcagcctctgccccccgtccccccgcagtaccaggttcccgggaacctgagtgcagctcaggtggccgcgcagaatgcagtggaggctgccaagaaccagaaggctgggctgggccctcgcttctcgcccatcacccctctccaacaagctgctcccggagtgggtccccccttcagccaggccccagctccccaactacccccaggaccccctggcgcccccaagccaccacctgcttcccagcccagtctggtctccactgtggcccctggctccggcctggctcccacggcacagcccggggcaccgtccatggcaggcactgtggccccaggaggggtgagcggcccttccccagcccagctgggagccccagccctcggtgggcagcagtcagtctccaataagcttctggcctggagcggggtcctggagtggcaagagaaacccaaacctgcctcagtggatgccaacaccaagctgacgcggtcactgccctgccaggtctacgtgaatcatggcgagaacctgaagacggagcagtggccccagaagctgatcatgcagctcatcccccagcagctgctgaccaccctgggccctttgttccggaactcaaggatggtccagttccatttcaccaacaaggacctggagtctctcaaaggcctctaccgcatcatgggcaacggcttcgcgggctgcgtgcacttcccccacacggcgccctgtgaggtgcgcgtgctcatgctcctgtactcgtccaagaagaagatcttcatgggcctcatcccctacgaccagagcggcttcgtcaacggcatccggcaggtcatcaccaaccacaagcaggtccagcagcagaagctggagcagcagcagcgaggaatggggggacagcaggcacccccagggctggggcccattctggaggaccaagccaggccctcacagaatctgctccagctccgcccaccgcagccccagcctcagggtaccgtaggggcctctggggccacggggcagccccagccccaaggtactgcccagcccccgccaggtgcccctcaaggccctcctggagcagcttctggcccaccccctcctggacccatccttcggccccagaaccctggggccaaccctcagctgcgaagcctcctcctcaacccaccaccgccgcagactggggtgcccccaccccaggcctccctccaccacctccagccaccaggggctcctgcgctgctgcctccgccgcaccagggcctggggcagccccagttggggcccccactcctgcatccaccacctgcccagtcctggcccgcacaacttccccctcgggctccactgccagcggcaaaacgaaagagagaaggagagggccgtgtgtttcgagaaaaatgggagcgagcctatttctttgtggaagtgaagagcatgcctatgtgtttaatatgcaaacaaatcgtgtctgtgttgaaagaatacaacctgaaacgccactatgaatcaaagcatagtaagagctacgaccagtacacagaacagactcgagatgccatcctcaacgaactgaaaaagggactcaaatgtcaatagggtttgttttgaaaagcgaattaacagaagtggcgcggcagtggtacgccgttccggaatcacgtgagaagaatgacctgggcattcagagctacagcagatggcaagtttataaaggagcagagtgacgtgtcctgcacagaaacacatgactgttgagaccgttatttaagtctaacgggcatttgcgttgcacagtgagttggagataactcgggggatttacaagtccagttgcttgaaagagtcaaattgattgtggccttttctttcgctgctcataaactattaccacccagttagctttatttatttgtggtgttaagaatcttgatgtgaccgaagaagtctgtggcatggtgccaaggcaggcccaacactgggaaaggactaattttttttgtatattgagagaaaagtttcacatagactggccagagttcccctgagaaggttagtcaaagacttctggtcaaggttatgaccgttctgaacactgaatatttctccgcaaggatgtccaccgtgccacccgaggcctgacactgacatctcggtgtggaagggaagacgccagccttttggcttcaactcaaaggcgcaaaaagaattatgaaagagaaaattttaataattaaatatttctatttttcaatttgtattttttcaattttgaatttaaaaatataaactccagtaacatccatgtttgtattatgttccatgcattcaccatagttgagtaaagatccgatttgatgata

SEQ ID NO: 300133 - DNA, 2251 bp, Homo sapiens
ggaacaaaagctggtactgggccgcccctcgaaggctcaggcccttacgggggatccacttctccattgtgtctccccggaagctgcctgcgcttcggcttctgtttgagaaggcagcccccccggccttgctggagccgctgcagcctccgacagatgtgagccaggacccgaggcacatggtgctggttcggggactcgtgctgcctgttgggggtggctcagccccaggccccctccagtcaaagcagccagtccccctgcctcccgccgcaccctcaggtgccactctctcagcagccccccagcagcctctgccccccgtccccccgcagtaccaggttcccgggaacctgagtgcagctcaggtggccgcgcagaatgcagtggaggctgccaagaaccagaaggctgggctgggccctcgcttctcgcccatcacccctctccaacaagctgctcccggagtgggtccccccttcagccaggccccagctccccaactacccccaggaccccctggcgcccccaagccaccacctgcttcccagcccagtctggtctccactgtggcccctggctccggcctggctcccacggcacagcccggggcaccgtccatggcaggcactgtggccccaggaggggtgagcggcccttccccagcccagctgggagccccagccctcggtgggcagcagtcagtctccaataagcttctggcctggagcggggtcctggagtggcaagagaaacccaaacctgcctcagtggatgccaacaccaagctgacgcggtcactgccctgccaggtctacgtgaatcatggcgagaacctgaagacggagcagtggccccagaagctgatcatgcagctcatcccccagcagctgctgaccaccctgggccctttgttccggaactcaaggatggtccagttccatttcaccaacaaggacctggagtctctcaaaggcctctaccgcatcatgggcaacggcttcgcgggctgcgtgcacttcccccacacggcgccctgtgaggtgcgcgtgctcatgctcctgtactcgtccaagaagaagatcttcatgggcctcatcccctacgaccagagcggcttcgtcaacggcatccggcaggtcatcaccaaccacaagcaggtccagcagcagaagctggagcagcagcagcgaggaatggggggacagcaggcacccccagggctggggcccattctggaggaccaagccaggccctcacagaatctgctccagctccgcccaccgcagccccagcctcagggtaccgtaggggcctctggggccacggggcagccccagccccaaggtactgcccagcccccgccaggtgcccctcaaggccctcctggagcagcttctggcccaccccctcctggacccatccttcggccccagaaccctggggccaaccctcagctgcgaagcctcctcctcaacccaccaccgccgcagactggggtgcccccaccccaggcctccctccaccacctccagccaccaggggctcctgcgctgctgcctccgccgcaccagggcctggggcagccccagttggggcccccactcctgcatccaccacctgcccagtcctggcccgcacaacttccccctcgggctccactgccagcggcaaaacgaaagagagaaggagagggccgtgtgtttcgagaaaaatgggagcgagcctatttctttgtggaagtgaagagcatgcctatgtgtttaatatgcaaacaaatcgtgtctgtgttgaaagaatacaacctgaaacgccactatgaatcaaagcatagtaagagctacgaccagtacacagaacagactcgagatgccatcctcaacgaactgaaaaagggactcaaatgtcaatagggtttgttttgaaaagcgaattaacagaagtggcgcggcagtggtacgccgttccggaatcacgtgagaagaatgacctgggcattcagagctacagcagatggcaagtttataaaggagcagagtgacgtgtcctgcacagaaacacatgactgttgagaccgttatttaagtctaacgggcatttgcgttgcacagtgagttggagataactcgggggatttacaagtccagttgcttgaaagagtcaaattgattgtggccttttctttcgctgctcataaactattaccacccagttagctttatttatttgtgtgagctgtgcggtccgccac

SEQ ID NO: 300134 - DNA, 2556 bp, Homo sapiens
ggctgactgagccgctttcaatttatttagcttttgacaataattccgtctaacccatcaggcccctagaagggctaactatgccctttctgagtcttccacgcggtgggggcgaaggaggatggagctagaacgaagcctcagcgcgtgccccgcacaaacatggcagcattcccagcagccctaaaccgcccgacgggagcgcgcgcgcggcgcaggcgcatttctgctcattccgcggcgtcggctgcggctgcagtggtggtggcgggtaccgcacggggtatggtccccgggtccgagggcccggcccgcgccgggagcgtggtggccgacgtggtgtttgtgattgagggtacggccaacctgggaccctacttcgaggggctccgcaagcactacctgctcccggccatcgagtattttaatggtggtcctcctgctgagacggacttcgggggagactatggggggacccagtacagcctcgtggtgttcaacacagtggactgcgctcccgagtcctacgtacaatgtcacgctcccaccagcagcgcctatgagtttgtcacctggctcgatggcattaagttcatgggcgggggtggtgagagctgcagcctcatcgcggaaggactcagcacagccttgcagctgtttgatgacttcaagaagatgcgcgagcagattggccagacgcaccgggtctgcctcctcatctgcaactcacccccatacttgttgcctgctgttgagagcaccacgtactctggatgcacaactgagaatcttgtgcagcagattggggagcgggggatccacttctccattgtgtctccccggaagctgcctgcgcttcggcttctgtttgagaaggcagcccccccggccttgctggagccgctgcagcctccgacagatgtgagccaggacccgaggcacatggtgctggttcggggactcgtgctgcctgttgggggtggctcagccccaggccccctccagtcaaagcagccagtccccctgcctcccgccgcaccctcaggtgccactctctcagcagccccccagcagcctctgccccccgtccccccgcagtaccaggttcccgggaacctgagtgcagctcaggtggccgcgcagaatgcagtggaggctgccaagaaccagaaggctgggctgggccctcgcttctcgcccatcacccctctccaacaagctgctcccggagtgggtccccccttcagccaggccccagctccccaactacccccaggaccccctggcgcccccaagccaccacctgcttcccagcccagtctggtctccactgtggcccctggctccggcctggctcccacggcacagcccggggcaccgtccatggcaggcactgtggccccaggaggggtgagcggcccttccccagcccagctgggagccccagccctcggtgggcagcagtcagtctccaataagcttctggcctggagcggggtcctggagtggcaagagaaacccaaacctgcctcagtggatgccaacaccaagctgacgcggtcactgccctgccaggtctacgtgaatcatggcgagaacctgaagacggagcagtggccccagaagctgatcatgcagctcatcccccagcagctgctgaccaccctgggccctttgttccggaactcaaggatggtccagttccatttcaccaacaaggacctggagtctctcaaaggcctctaccgcatcatgggcaacggcttcgcgggctgcgtgcacttcccccacacggcgccctgtgaggtgcgcgtgctcatgctcctgtactcgtccaagaagaagatcttcatgggcctcatcccctacgaccagagcggcttcgtcaacggcatccggcaggtcatcaccaaccacaagcaggtccagcagcagaagctggagcagcagcagcgaggaatggggggacagcaggcacccccagggctggggcccattctggaggaccaagccaggccctcacagaatctgctccagctccgcccaccgcagccccagcctcagggtaccgtaggggcctctggggccacggggcagccccagccccaaggtactgcccagcccccgccaggtgcccctcaaggccctcctggagcagcttctggcccaccccctcctggacccatccttcggccccagaaccctggggccaaccctcagctgcgaagcctcctcctcaacccaccaccgccgcagactggggtgcccccaccccaggcctccctccaccacctccagccaccaggggctcctgcgctgctgcctccgccgcaccagggcctggggcagccccagttggggcccccactcctgcatccaccacctgcccagtcctggcccgcacaacttccccctcgggctccactgccaggtcagatgctgctgagcgggggtccccggggcccggtcccccagccgggcctgcagcccagcgtcatggaggacgacatcctcatggatctcatctgaatccccaacacccaataaagttccttt

SEQ ID NO: 300135 - DNA, 2995 bp, Homo sapiens
ggctgactgagccgctttcaatttatttagcttttgacaataattccgtctaacccatcaggcccctagaagggctaactatgccctttctgagtcttccacgcggtgggggcgaaggaggatggagctagaacgaagcctcagcgcgtgccccgcacaaacatggcagcattcccagcagccctaaaccgcccgacgggagcgcgcgcgcggcgcaggcgcatttctgctcattccgcggcgtcggctgcggctgcagtggtggtggcgggtaccgcacggggtatggtccccgggtccgagggcccggcccgcgccgggagcgtggtggccgacgtggtgtttgtgattgagggtacggccaacctgggaccctacttcgaggggctccgcaagcactacctgctcccggccatcgagtattttaatggtggtcctcctgctgagacggacttcgggggagactatggggggacccagtacagcctcgtggtgttcaacacagtggactgcgctcccgagtcctacgtacaatgtcacgctcccaccagcagcgcctatgagtttgtcacctggctcgatggcattaagttcatgggcgggggtggtgagagctgcagcctcatcgcggaaggactcagcacagccttgcagctgtttgatgacttcaagaagatgcgcgagcagattggccagacgcaccgggtctgcctcctcatctgcaactcacccccatacttgttgcctgctgttgagagcaccacgtactctggatgcacaactgagaatcttgtgcagcagattggggagcgggggatccacttctccattgtgtctccccggaagctgcctgcgcttcggcttctgtttgagaaggcagcccccccggccttgctggagccgctgcagcctccgacagatgtgagccaggacccgaggcacatggtgctggttcggggactcgtgctgcctgttgggggtggctcagccccaggccccctccagtcaaagcagccagtccccctgcctcccgccgcaccctcaggtgccactctctcagcagccccccagcagcctctgccccccgtccccccgcagtaccaggttcccgggaacctgagtgcagctcaggtggccgcgcagaatgcagtggaggctgccaagaaccagaaggctgggctgggccctcgcttctcgcccatcacccctctccaacaagctgctcccggagtgggtccccccttcagccaggccccagctccccaactacccccaggaccccctggcgcccccaagccaccacctgcttcccagcccagtctggtctccactgtggcccctggctccggcctggctcccacggcacagcccggggcaccgtccatggcaggcactgtggccccaggaggggtgagcggcccttccccagcccagctgggagccccagccctcggtgggcagcagtcagtctccaataagcttctggcctggagcggggtcctggagtggcaagagaaacccaaacctgcctcagtggatgccaacaccaagctgacgcggtcactgccctgccaggtctacgtgaatcatggcgagaacctgaagacggagcagtggccccagaagctgatcatgcagctcatcccccagcagctgctgaccaccctgggccctttgttccggaactcaaggatggtccagttccatttcaccaacaaggacctggagtctctcaaaggcctctaccgcatcatgggcaacggcttcgcgggctgcgtgcacttcccccacacggcgccctgtgaggtgcgcgtgctcatgctcctgtactcgtccaagaagaagatcttcatgggcctcatcccctacgaccagagcggcttcgtcaacggcatccggcaggtcatcaccaaccacaagcaggtccagcagcagaagctggagcagcagcagcgaggaatggggggacagcaggcacccccagggctggggcccattctggaggaccaagccaggccctcacagaatctgctccagctccgcccaccgcagccccagcctcagggtaccgtaggggcctctggggccacggggcagccccagccccaaggtactgcccagcccccgccaggtgcccctcaaggccctcctggagcagcttctggcccaccccctcctggacccatccttcggccccagaaccctggggccaaccctcagctgcgaagcctcctcctcaacccaccaccgccgcagactggggtgcccccaccccaggcctccctccaccacctccagccaccaggggctcctgcgctgctgcctccgccgcaccagggcctggggcagccccagttggggcccccactcctgcatccaccacctgcccagtcctggcccgcacaacttccccctcgggctccactgccaggtaaggggacccgggggagggcagaggtctggactgagtgtcccagcagctcctgggctagagcaccaagaccaagtgctcctgggaagtaaagacataggatccaagaatgagggttcccccaggcctttgcggagctctgagggctccgggaaagtacagcccatgggtccaaggacctagtgggttaagagcgtttcccatgatcctcctgtgtgtgctcctgggattgctgggaaatgtggtcttagggccagagaagtagttttggagaagggcccccaaaggctcatgggaaacagcatatttgtaactagatggggccagaaggtgcttctgttgggtcccccaagggctgcctagaaaacttagtgcctctgggccctcctgggcccaagggcctactgggagatgcagtcccttccccactgcccctcaggtcagatgctgctgagcgggggtccccggggcccggtcccccagccgggcctgcagcccagcgtcatggaggacgacatcctcatggatctcatctgaatccccaacacccaataaagttccttt

SEQ ID NO: 300136 - DNA, 1092 bp, Homo sapiens
ggctgactgagccgctttcaatttatttagcttttgacaataattccgtctaacccatcaggcccctagaagggctaactatgccctttctgagtcttccacgcggtgggggcgaaggaggatggagctagaacgaagcctcagcgcgtgccccgcacaaacatggcagcattcccagcagccctaaaccgcccgacgggagcgcgcgcgcggcgcaggcgcatttctgctcattccgcggcgtcggctgcggctgcagtggtggtggcgggtaccgcacggggtatggtccccgggtccgagggcccggcccgcgccgggagcgtggtggccgacgtggtgtttgtgattgagggtacggccaacctgggaccctacttcgaggggctccgcaagcactacctgctcccggccatcgagtattttaatggtggtcctcctgctgagacggacttcgggggagactatggggggacccagtacagcctcgtggtgttcaacacagtggactgcgctcccgagtcctacgtacaatgtcacgctcccaccagcagcgcctatgagtttgtcacctggctcgatggcattaagttcatgggcgggggtggtgagagctgcagcctcatcgcggaaggactcagcacagccttgcagctgtttgatgacttcaagaagatgcgcgagcagattggccagacgcaccgggtctgcctcctcatctgcaactcacccccatacttgttgcctgctgttgagagcaccacgtactctggatgcacaactgagaatcttgtgcagcagattggggagcgggggatccacttctccattgtgtctccccggaagctgcctgcgcttcggcttctgtttgagaaggcagcccccccggccttgctggagccgctgcagcctccgacagatgtgagccaggacccgaggcacatggtgctggttcggggactcgtgctgcctgttgggggtggctcagccccaggccccctccagtcaaagcagccagtccccctgcctcccgccgcaccctcaggtgccactctctcagcagctcgcacataagttggggggcctctagag

SEQ ID NO: 300137 - DNA, 1019 bp, Homo sapiens
ggctgactgagccgctttcaatttatttagcttttgacaataattccgtctaacccatcaggcccctagaagggctaactatgccctttctgagtcttccacgcggtgggggcgaaggaggatggagctagaacgaagcctcagcgcgtgccccgcacaaacatggcagcattcccagcagccctaaaccgcccgacgggagcgcgcgcgcggcgcaggcgcatttctgctcattccgcggcgtcggctgcggctgcagtggtggtggcgggtaccgcacggggtatggtccccgggtccgagggcccggcccgcgccgggagcgtggtggccgacgtggtgtttgtgattgagggtacggccaacctgggaccctacttcgaggggctccgcaagcactacctgctcccggccatcgagtattttaatggtggtcctcctgctgagacggacttcgggggagactatggggggacccagtacagcctcgtggtgttcaacacagtggactgcgctcccgagtcctacgtacaatgtcacgctcccaccagcagcgcctatgagtttgtcacctggctcgatggcattaagtgagctttcccccacttggggtgggttgctggtccctgtgaggggccgtgaatgagtgatggcttggggtggttggtgtccccgtgagaggctgtgaataagtgatggcttggggtggttggtgtccccgtgaggggctgtgaataagtaatggcttggggtggttggggtacctgcgaggggccgtgaatgagcgatggcttgggtttgagctgcaggaaacatctcatacattaagggattgaaaggactttgagggtgattgtgtttttgtcagaagtcacttttgtggtggcttctgtgtgctcagcaatgttgccatcagtttagaagtaggaaaaaccttcccattcagggaggcctggctgagctccagcagccaccttgtactccctgtgtgattgtcccctttctgtcctctctttttc

SEQ ID NO: 300138 - DNA, 205 bp, Homo sapiens
ctgagggagaaggggctggggccgagattgctgggtctgaggaaggaggaagctgaggagttcctggttctggaggaacgggaagctgggagccctgattccttctctaagggaaaagggaattgaggtcccagattaaaagttttctgtcctcccctcccagtatggggggacccagtacagcctcgtggtgttcaacacagtg

SEQ ID NO: 300139 - DNA, 148 bp, Homo sapiens
aaccctggggccaaccctcagctgcgaagcctcctcctcaacccaccaccggtgagatgttggggtggggtagcgagagttccagatcctggccctggtggttctggtcctgttgtctgggaggagggaggttgactgtggtcagtgg

SEQ ID NO: 300140 - DNA, 409 bp, Homo sapiens
cccaggatagagtgggggacagcatgggagcaggctcttcaagcatagcctggggatggggatgatggcaaccctgggggctgaccgctctgcccctgcaggttcatgggcgggggtggtgagagctgcagcctcatcgcggaaggactcagcacagccttgcagctgtttgatgacttcaagaagatgcgcgagcagatgtgagtgccccctccacccaggccgggccggtctctctctgcctggcctggaaccactttgcctgtcgagtggttctacctccagcctcaccctgtagggcatgggctctgtgtccccaagcacgctgagccaggaggctgcaggtgtgtccttgggggacgcctggccagtgcccggtctcagcatccccatcaggaagcagtgccaa

SEQ ID NO: 300141 - DNA, 412 bp, Homo sapiens
tctggccgtcgacttttcttatacctggctagttcactcatttatgtgacccgcctggcccctgtaggcatgtgagtttccgatccctgccctggaactgttggatccagtcgggggagggcgggggtctgggagtcgtgtgagcaagctctctaggcgatcctcaggaatgtgagtgtggagcaggaggcactggtgacagcgaagaagtgcaagtgggtgatttcccaggcagcctgtgtagcaggggtttttgaaaactcagatggcttcagggaccaggcaggtgatgaaaatgtgtgaagcggacgggtgtaagacaacagggaatgatggggactgtggcgaacttggagagtgcttgccccgcctaatggcattcaaattgaaaacaaaaacactgtgaggacca

SEQ ID NO: 300142 - DNA, 297 bp, Homo sapiens
tcaaattaaacatcgttcccagttgaaggattcaaggctgaattctaaactgcccgtccccaccgtgccacccgaggcctgacactgacatctcggtgtggaagggaagacgccagccttttggcttcaactcaaaggcgcaaaaagaattatgaaagagaaaattttaataattaaatatttctatttttcaatttgtattttttcaattttgaatttaaaaatataaactccagtaacatccatgtttgtattatgttccatgcattcaccatagttgagtaaagatccgatttg

SEQ ID NO: 300143 - DNA, 1299 bp, Homo sapiens
  misc_feature (47)..(47): n is a, c, g, or t
gggtcctgggcttgagagtctcgggcggggagtggagccacggtccncgccctgcagctcgccccgccctgctaatgggaccggccagcccgggaggcccctgacccttggggaagcccgctgggcgatggggaccctcgcctcccgccaagtgagctgtgaaccacgtcctgcgcaacctctcgctctccaaaactgtttgtaatatttaaacgatatttggcttaggagaatttcataaagttagccagatctcgggtctcaatttagactcggggtgctggggggcatagcatccctggagtacattggacagcaaaagtccaatcgttgcctgccgagtggacctgcagtgcttaaaccccgtcacccggctggcggggtcccaggccctggggtttctttcgcccgggagtccacgccctgatgctggggtggcccggtccccccgcgggtggctgggggcctggggctgcctcacacgacggtcccagcagggaatctctcgccgtcccgaccttcccggcccttggggagtcgcccggcaggttccggacccacccgcagaggaacccggcccacgcgcggcgcctttaaggcccctccgctcgctccccagtcacgtgacctggccgtcgcttggcaacaggacgccgccgagtcccgcttctcctccaggcacaatggctgaggaatgccccagagcgtgcgcggagcctgtggcgcccaaggccacggccccgccggagaggaccagcgactactaccgcgtgagcgcggacctgccgggcaggttcaacaacccggggtggttccggggctacaggacccagaaggctgtctccgtgtacaggaccagtaaccaggcttacgggagcagagcccccaccgtgcacgagatgccttgcagcgggtggaatgttccggaacaatactctcaatgtttacctggagaaaagcatcgtgactggccccgataactgcatcacctcctgtgaccggctcaacttccaccccagttacaacatcaacaggccatccatctgcgattgaggggctggaaactccctctaggagtcctctgaccccagggcctcctggaaaatcatcatccctcatcacccacagtcgcccgattgtgacggcacagactgcgctgccttccctgaaaatattattcgtctgcggagtaggaaaatatgcaaacggggccgtgaagtcctgccatttcacatctaataagtacatgggaaagatgctaatggttgactttgcattaaaaacgttgtcacatcctga

SEQ ID NO: 300144 - DNA, 598 bp, Homo sapiens
ggaagtggggataagggcagtggggggcagggccgtggggggagaaagcccagttgtggtctcagctccactgatttgtgtcgggacccagaaggctgtctccgtgtacaggaccagtaaccaggcttacgggagcagagcccccaccgtgcacgagatgcctaaagtattttatccaaattcgaataaattttcccaacaacttgcagcgggtggaatgttccggaacaatactctcaatgtttacctggagaaaagcatcgtgactggccccgataactgcatcacctcctgtgaccggctcaacttccaccccagttacaacatcaacaggccatccatctgcgattgaggggctggaaactccctctaggagtcctctgaccccagggcctcctggaaaatcatcatccctcatcacccacagtcgcccgattgtgacggcacagactgcgctgccttccctgaaaatattattcgtctgcggagtaggaaaatatgcaaacggggccgtgaagtcctgccatttcacatctaataagtacatgggaaagatgctaatggttgactttgcattaaaaacgttgtcacatcctga

SEQ ID NO: 300145 - DNA, 1340 bp, Homo sapiens
  misc_feature (47)..(47): n is a, c, g, or t
gggtcctgggcttgagagtctcgggcggggagtggagccacggtccncgccctgcagctcgccccgccctgctaatgggaccggccagcccgggaggcccctgacccttggggaagcccgctgggcgatggggaccctcgcctcccgccaagtgagctgtgaaccacgtcctgcgcaacctctcgctctccaaaactgtttgtaatatttaaacgatatttggcttaggagaatttcataaagttagccagatctcgggtctcaatttagactcggggtgctggggggcatagcatccctggagtacattggacagcaaaagtccaatcgttgcctgccgagtggacctgcagtgcttaaaccccgtcacccggctggcggggtcccaggccctggggtttctttcgcccgggagtccacgccctgatgctggggtggcccggtccccccgcgggtggctgggggcctggggctgcctcacacgacggtcccagcagggaatctctcgccgtcccgaccttcccggcccttggggagtcgcccggcaggttccggacccacccgcagaggaacccggcccacgcgcggcgcctttaaggcccctccgctcgctccccagtcacgtgacctggccgtcgcttggcaacaggacgccgccgagtcccgcttctcctccaggcacaatggctgaggaatgccccagagcgtgcgcggagcctgtggcgcccaaggccacggccccgccggagaggaccagcgactactaccgcgtgagcgcggacctgccgggcaggttcaacaacccggggtggttccggggctacaggacccagaaggctgtctccgtgtacaggaccagtaaccaggcttacgggagcagagcccccaccgtgcacgagatgcctaaagtattttatccaaattcgaataaattttcccaacaacttgcagcgggtggaatgttccggaacaatactctcaatgtttacctggagaaaagcatcgtgactggccccgataactgcatcacctcctgtgaccggctcaacttccaccccagttacaacatcaacaggccatccatctgcgattgaggggctggaaactccctctaggagtcctctgaccccagggcctcctggaaaatcatcatccctcatcacccacagtcgcccgattgtgacggcacagactgcgctgccttccctgaaaatattattcgtctgcggagtaggaaaatatgcaaacggggccgtgaagtcctgccatttcacatctaataagtacatgggaaagatgctaatggttgactttgcattaaaaacgttgtcacatcctga

SEQ ID NO: 300146 - DNA, 872 bp, Homo sapiens
ggtctggaggccaagcctccgctcctgacaagctaggttacccagaaattgcagcatgtgccgaggccctgccagggctggggatcagcacttgctggctgcctgctctttagggctttggcctgccttggaagagcagggacagtggcaagcagagggggccggggaggccgggccattcagaacggtcatcagccaggtactcccagaggctgccttcgaggccacatcaccagcccgggcatattgctctttccatgggggcatttccaggggagtgccgtcaaccaaatacaaggctgtggcttgtgcagaattagagtaaatgaatgaaaatagagtgtttctcatctaccaggacccagaaggctgtctccgtgtacaggaccagtaaccaggcttacgggagcagagcccccaccgtgcacgagatgcctaaagtattttatccaaattcgaataaattttcccaacaacttgcagcgggtggaatgttccggaacaatactctcaatgtttacctggagaaaagcatcgtgactggccccgataactgcatcacctcctgtgaccggctcaacttccaccccagttacaacatcaacaggccatccatctgcgattgaggggctggaaactccctctaggagtcctctgaccccagggcctcctggaaaatcatcatccctcatcacccacagtcgcccgattgtgacggcacagactgcgctgccttccctgaaaatattattcgtctgcggagtaggaaaatatgcaaacggggccgtgaagtcctgccatttcacatctaataagtacatgggaaagatgctaatggttgactttgcattaaaaacgttgtcacatcctga

SEQ ID NO: 300147 - DNA, 786 bp, Homo sapiens
gtggggagccgggagcccagcagccccaggaaagacctggaagcacagggaccttttcaggaaacagagggctggagccaggttctgatcccgaccttgctcctggtcacgtgacctggccgtcgcttggcaacaggacgccgccgagtcccgcttctcctccaggcacaatggctgaggaatgccccagagcgtgcgcggagcctgtggcgcccaaggccacggccccgccggagaggaccagcgactactaccgcgtgagcgcggacctgccgggcaggttcaacaacccggggtggttccggggctacaggacccagaaggctgtctccgtgtacaggaccagtaaccaggcttacgggagcagagcccccaccgtgcacgagatgccttgcagcgggtggaatgttccggaacaatactctcaatgtttacctggagaaaagcatcgtgactggccccgataactgcatcacctcctgtgaccggctcaacttccaccccagttacaacatcaacaggccatccatctgcgattgaggggctggaaactccctctaggagtcctctgaccccagggcctcctggaaaatcatcatccctcatcacccacagtcgcccgattgtgacggcacagactgcgctgccttccctgaaaatattattcgtctgcggagtaggaaaatatgcaaacggggccgtgaagtcctgccatttcacatctaataagtacatgggaaagatgctaatggttgactttgcattaaaaacgttgtcacatcctga

SEQ ID NO: 300148 - DNA, 1231 bp, Homo sapiens
  misc_feature (47)..(47): n is a, c, g, or t
gggtcctgggcttgagagtctcgggcggggagtggagccacggtccncgccctgcagctcgccccgccctgctaatgggaccggccagcccgggaggcccctgacccttggggaagcccgctgggcgatggggaccctcgcctcccgccaagtgagctgtgaaccacgtcctgcgcaacctctcgctctccaaaactgtttgtaatatttaaacgatatttggcttaggagaatttcataaagttagccagatctcgggtctcaatttagactcggggtgctggggggcatagcatccctggagtacattggacagcaaaagtccaatcgttgcctgccgagtggacctgcagtgcttaaaccccgtcacccggctggcggggtcccaggccctggggtttctttcgcccgggagtccacgccctgatgctggggtggcccggtccccccgcgggtggctgggggcctggggctgcctcacacgacggtcccagcagggaatctctcgccgtcccgaccttcccggcccttggggagtcgcccggcaggttccggacccacccgcagaggaacccggcccacgcgcggcgcctttaaggcccctccgctcgctccccagtcacgtgacctggccgtcgcttggcaacaggacgccgccgagtcccgcttctcctccaggcacaatggctgaggaatgccccagagcgtgcgcggagcctgtggcgcccaaggccacggccccgccggagaggaccagcgactactaccgcgtgagcgcggacctgccgggcaggttcaacaacccggggtggttccggggctacaggacccagaaggctgtctccgtgtacaggaccagtaaccaggcttacgggagcagagcccccaccgtgcacgagatgcctaaagtattttatccaaattcgaataaattttcccaacaactcccagttacaacatcaacaggccatccatctgcgattgaggggctggaaactccctctaggagtcctctgaccccagggcctcctggaaaatcatcatccctcatcacccacagtcgcccgattgtgacggcacagactgcgctgccttccctgaaaatattattcgtctgcggagtaggaaaatatgcaaacggggccgtgaagtcctgccatttcacatctaataagtacatgggaaagatgctaatggttgactttgcattaaaaacgttgtcacatcctga

SEQ ID NO: 300149 - DNA, 1235 bp, Homo sapiens
  misc_feature (47)..(47): n is a, c, g, or t
gggtcctgggcttgagagtctcgggcggggagtggagccacggtccncgccctgcagctcgccccgccctgctaatgggaccggccagcccgggaggcccctgacccttggggaagcccgctgggcgatggggaccctcgcctcccgccaagtgagctgtgaaccacgtcctgcgcaacctctcgctctccaaaactgtttgtaatatttaaacgatatttggcttaggagaatttcataaagttagccagatctcgggtctcaatttagactcggggtgctggggggcatagcatccctggagtacattggacagcaaaagtccaatcgttgcctgccgagtggacctgcagtgcttaaaccccgtcacccggctggcggggtcccaggccctggggtttctttcgcccgggagtccacgccctgatgctggggtggcccggtccccccgcgggtggctgggggcctggggctgcctcacacgacggtcccagcagggaatctctcgccgtcccgaccttcccggcccttggggagtcgcccggcaggttccggacccacccgcagaggaacccggcccacgcgcggcgcctttaaggcccctccgctcgctccccagtcacgtgacctggccgtcgcttggcaacaggacgccgccgagtcccgcttctcctccaggcacaatggctgaggaatgccccagagcgtgcgcggagcctgtggcgcccaaggccacggccccgccggagaggaccagcgactactaccgcgtgagcgcggacctgccgggcaggttcaacaacccggggtggttccggggctacaggacccagaaggctgtctccgtgtacaggaccagtaaccaggcttacgggagcagagcccccaccgtgcacgagatgcctaaagtattttatccaaattcgaataaattttcccaacaacttgcagcgggtggaatgttccggaacaatactctcaatgtttacctggagaaaagcatcgtgactggccccgataactgcatcacctcctggaaaatcatcatccctcatcacccacagtcgcccgattgtgacggcacagactgcgctgccttccctgaaaatattattcgtctgcggagtaggaaaatatgcaaacggggccgtgaagtcctgccatttcacatctaataagtacatgggaaagatgctaatggttgactttgcattaaaaacgttgtcacatcctga

SEQ ID NO: 300150 - DNA, 1090 bp, Homo sapiens
  misc_feature (47)..(47): n is a, c, g, or t
gggtcctgggcttgagagtctcgggcggggagtggagccacggtccncgccctgcagctcgccccgccctgctaatgggaccggccagcccgggaggcccctgacccttggggaagcccgctgggcgatggggaccctcgcctcccgccaagtgagctgtgaaccacgtcctgcgcaacctctcgctctccaaaactgtttgtaatatttaaacgatatttggcttaggagaatttcataaagttagccagatctcgggtctcaatttagactcggggtgctggggggcatagcatccctggagtacattggacagcaaaagtccaatcgttgcctgccgagtggacctgcagtgcttaaaccccgtcacccggctggcggggtcccaggccctggggtttctttcgcccgggagtccacgccctgatgctggggtggcccggtccccccgcgggtggctgggggcctggggctgcctcacacgacggtcccagcagggaatctctcgccgtcccgaccttcccggcccttggggagtcgcccggcaggttccggacccacccgcagaggaacccggcccacgcgcggcgcctttaaggcccctccgctcgctccccagtcacgtgacctggccgtcgcttggcaacaggacgccgccgagtcccgcttctcctccaggcacaatggctgaggaatgccccagagcgtgcgcggagcctgtggcgcccaaggccacggccccgccggagaggaccagcgactactaccgcgtgagcgcggacctgccgggcaggttcaacaacccggggtggttccggggctacaggacccagaaggctgtctccgtgtacaggaccagtaaccaggcttacgggagcagagcccccaccgtgcacgagatgcctaaagtattttatccaaattcgaataaattttcccaacaacttgcagcgggtggaatgttccggaacaatactctcaatgtttacctggagaaaagcatcgtgaagtcctgccatttcacatctaataagtacatgggaaagatgctaatggttgactttgcattaaaaacgttgtcacatcctga

SEQ ID NO: 300151 - DNA, 983 bp, Homo sapiens
  misc_feature (47)..(47): n is a, c, g, or t
gggtcctgggcttgagagtctcgggcggggagtggagccacggtccncgccctgcagctcgccccgccctgctaatgggaccggccagcccgggaggcccctgacccttggggaagcccgctgggcgatggggaccctcgcctcccgccaagtgagctgtgaaccacgtcctgcgcaacctctcgctctccaaaactgtttgtaatatttaaacgatatttggcttaggagaatttcataaagttagccagatctcgggtctcaatttagactcggggtgctggggggcatagcatccctggagtacattggacagcaaaagtccaatcgttgcctgccgagtggacctgcagtgcttaaaccccgtcacccggctggcggggtcccaggccctggggtttctttcgcccgggagtccacgccctgatgctggggtggcccggtccccccgcgggtggctgggggcctggggctgcctcacacgacggtcccagcagggaatctctcgccgtcccgaccttcccggcccttggggagtcgcccggcaggttccggacccacccgcagaggaacccggcccacgcgcggcgcctttaaggcccctccgctcgctccccagtcacgtgacctggccgtcgcttggcaacaggacgccgccgagtcccgcttctcctccaggcacaatggctgaggaatgccccagagcgtgcgcggagcctgtggcgcccaaggccacggccccgccggagaggaccagcgactactaccgcgtgagcgcggacctgccgggcaggttcaacaacccggggtggttccggggctacaggacccagaaggctgtctccgtgtacaggaccagtaaccaggcttacgggagcagagcccccaccgtgcacgagatgcctacccagaaggctgtctccgtgtacaggaccagtaaccaggcttacgggagcagagcccccaccgtgcacgagatgcct

SEQ ID NO: 300152 - DNA, 465 bp, Homo sapiens
cagagggatttgattttgattatgtaacatttatatatagcatttgtttttacattttcaaattgcttttcagtcattggtttattcttcacagcacacctggggagtacatctgtgcatttatcctctgttcacagctgaggcaactgagactgaaacaggcaaagtggtttgtccaagagcaaagccaggggcagggtgagaaattgttcattcattcaatcatgcatctattcttggcaaggcaccaaagtctgtgtggtggtggtgcacagagatggatattgtctatgtggcctctaccttgcaagagcctgcagtctctgagacaataagcggttcatgaattatgcctcctagagtgctcagacagcaaggaccagggttcagaggaggagagggtgagagttccctaggattcctggagaatatctgactacagcagggccgttgtggggaaagggc

SEQ ID NO: 300153 - DNA, 720 bp, Homo sapiens
cagagggatttgattttgattatgtaacatttatatatagcatttgtttttacattttcaaattgcttttcagtcattggtttattcttcacagcacacctggggagtacatctgtgcatttatcctctgttcacagctgaggcaactgagactgaaacaggcaaagtggtttgtccaagagcaaagccaggggcagggaagtttgaaagaaagaaaaatatgccaagatgattaagtttcacctaagattttaaagctcccacctaaaagatgtggaaaacaagcactataccaggatattgtaccttatttctgccctgtcttaaaaacaccatgacattttccttgatttcaagaatacagaaaatgaacatggtcctttaaattatgtgactctttcgaagcaaaatgacaacaaggaaaaaccacatttgttttctgcctccctttttcaagaagctgaaaatatagtgtaaatgaactcttggtcgtgggtcaacatccttacaatacctgcccctcgttctcaggtgttacggtgaaactgcctgctgctagctgagtttgagaacagtgaccctgacaagtgccttacaggagtttatcaagtggagaacaccatttagaacaccactcactgagatgcagctcttatctgtgcctgtcagtgaacaatgttcaatcgcagatcacagttgttagcagagctaattacagca

SEQ ID NO: 300154 - DNA, 562 bp, Homo sapiens
tttgattttgattatgtaacatttatatatagcatttgtttttacattttcaaattgcttttcagtcattggtttattcttcacagcacacctggggagtacatctgtgcatttatcctctgttcacagctgaggcaactgagactgaaacaggcaaagtggtttgtccaagagcaaagccaggggcagggtgagaaattgttcattcattcaatcatgcatctattcttggcaaggcaccaaagtctgtgtggtggtggtgcacagagatggatattgtctatgtggcctctaccttgcaagagcctgcagtctctgagacaataagcggttcatgaattatgcctcctagagtgctcagacagcaaggaccagggttcagaggaggagagggtgagagttccctaggattcctggagagagttggattcagggcccatgagggatgggtagaattttggcaaatggaagtgtggctagtgggaatgacagacatgaaggtgggcaaatttaagatgttttggagaatatctgactacagcagggccgttgtggggaaagg

SEQ ID NO: 300155 - DNA, 907 bp, Homo sapiens
acagaacttgtcacagctggtcttagggttctgccttcctttcccctgaccctatactaccttcctcttttctgctacccttagactttgacccttctaggcaatggaaactgagcacattcattcgtggtcaggttatcagtgccatcaggctcaaagagcacttgcaaagaaaagaactgtaaaacaagggcactatttcgcatgggctccgaataccagcaagaactgttccccgggaaggggcttgccactgtgcctatcgagtcacagcctacagacctcccgtttagtctattagtccagccagtagacccggggctgggggagcagatgtgcggagatgctgaggacccctctggctacgttaggaacgatttacttgggttgatagcttttctttgcctccctttcactgcttccgtctctagggggaatagaaaagggtcagaaaaaccatcaggtttgccattttttaaccatttctgtctccccaggcgtccaggtgatcccccaaacagcatgtgctcagccccagacctgccgcctgggaatcaggattccttcttccccaaggcactgagcgcctgcagatcccgcaggcttcgtttgcctccagaaccttcccgtctgattgttcctccccagccccctggcatgtttcaccacaaccctgttgctacatcagagtgtatttttgtaattcctctagctaccatttcaatagccccatctctcctgctcacccgcctcttgccccttctaggggcaggtgaaaggaataggaaattgaacctggggttttgacttgccactgccataacttgtttgtaaaagagctgttctttttgactgattgttttaaacaacgatttctccattaaacttctactgagcaaatggttaa

SEQ ID NO: 300156 - DNA, 1199 bp, Homo sapiens
gccaggaaggcttgcaggttctgctgtttggttgctgaagggggtcagtgtgtgtatgtgtcatggaggtgggcagggaaggggagggctgtgcgtgggggagatgaggatatatatgctggtgtggctgagaaagcggaaccgagcctcgcatccatcggagggagccggggactgacagctctcagcacctgcttcctgctcctgcaccatgaaagtcctgctttgtgacctgctgctgctcagtctcttctccagtgtgttcagcagttgtcagagggactgtctcacatgccaggagaagctccacccagccctggacagcttcgacctggaggtgtgcatcctcgagtgtgaagagaaggtcttccccagccccctctggactccatgcaccaaggtcatggccaggagctcttggcagctcagccctgccgccccagagcatgtggcggctgctctctaccagccgagagcttcggagatgcagcatctgcggcgaatgccccgagtccggagcttgttccaggagcaggaagagcccgagcctggcatggaggaggctggtgagatggagcagaagcagctgcagaagagatttgggggcttcaccggggcccggaagtcggccaggaagttggccaatcagaagcggttcagtgagtttatgaggcaatacttggtcctgagcatgcagtccagccagcgccggcgcaccctgcaccagaatggtaatgtgtagccggaaggggcgctcctcccagctgtaccggccactgcaacccatgagcgtccaggtgatcccccaaacagcatgtgctcagccccagacctgccgcctgggaatcaggattccttcttccccaaggcactgagcgcctgcagatcccgcaggcttcgtttgcctccagaaccttcccgtctgattgttcctccccagccccctggcatgtttcaccacaaccctgttgctacatcagagtgtatttttgtaattcctctagctaccatttcaatagccccatctctcctgctcacccgcctcttgccccttctaggggcaggtgaaaggaataggaaattgaacctggggttttgacttgccactgccataacttgtttgtaaaagagctgttctttttgactgattgttttaaacaacgatttctccattaaacttctactgagcaaatggttaa

SEQ ID NO: 300157 - DNA, 1110 bp, Homo sapiens
ttttagatctttacatggtgaccttaaaataaacctgcagatttgactacatactttcacatccccaatttctttaacccatgtgacctcccacaagcctgaagagagaacaaaataaaattctttagtgggtgacagtcatgagctgtgcttggctccaaaaacccgactaaagatgtaacaaggtgcggtgttgggcgcatttatcctgtgttaacttcctatgttaacgtgctgtgacaccagaggtgtgcatcctcgagtgtgaagagaaggtcttccccagccccctctggactccatgcaccaaggtcatggccaggagctcttggcagctcagccctgccgccccagagcatgtggcggctgctctctaccagccgagagcttcggagatgcagcatctgcggcgaatgccccgagtccggagcttgttccaggagcaggaagagcccgagcctggcatggaggaggctggtgagatggagcagaagcagctgcagaagagatttgggggcttcaccggggcccggaagtcggccaggaagttggccaatcagaagcggttcagtgagtttatgaggcaatacttggtcctgagcatgcagtccagccagcgccggcgcaccctgcaccagaatggtaatgtgtagccggaaggggcgctcctcccagctgtaccggccactgcaacccatgagcgtccaggtgatcccccaaacagcatgtgctcagccccagacctgccgcctgggaatcaggattccttcttccccaaggcactgagcgcctgcagatcccgcaggcttcgtttgcctccagaaccttcccgtctgattgttcctccccagccccctggcatgtttcaccacaaccctgttgctacatcagagtgtatttttgtaattcctctagctaccatttcaatagccccatctctcctgctcacccgcctcttgccccttctaggggcaggtgaaaggaataggaaattgaacctggggttttgacttgccactgccataacttgtttgtaaaagagctgttctttttgactgattgttttaaacaacgatttctccattaaacttctactgagcaaatggttaa

SEQ ID NO: 300158 - DNA, 1973 bp, Homo sapiens
tctgcgataacatttagaagtcagttttaattctgagaatgtggaagtcaaagcccatctgatgtcaggttgaatgaatagattaaaaattcaatcagaaacagcagagacttgtcaaggatttcaaaagcccctccaatcccttctgtgtgggcaacaaagtgtgcctagcaaaaatgcaaatcagattgttatcactcccctgtgtaaaacccttttatacccattcacaataaatctcagactgctcaccatggcttcagggcctcaagcctctttttttccccagctcgctgctttccagacccaccagcctttcagctcccacacacaccacgcttcctgtgcctctgaacagccgtgcaggcggttctcgctgcctgcggcctgcttccaccagctggtaacttttgcttgcctctccaatgagagaggcctcactcaaccatcccatcttagtcatgttttcctgaaaaagtgtctcacattgatgcttttggtaactccttcagtgcactaaagacagtctgttgagtttgtttatgccaaagtccggtctccccaactaaaatgtcagcttgcagagagcagaagaggtcgggcctgtgtagctcgctgatgaattcctgttgacagacacttacccatgagctgctcaagtcctgcacatcttgagaaagagcccttacttccggggtatcttttcaaggatgtctgtacggtgaaaacctgtggtagacagagtatctccttccaagagcaagtcaggtgcgcatgctgtgcagtatcatgaagaccatgtctccttctggaatggacaggcaggcttgctgcctgtgatttatgaagcttaaaatagcaaatataaatatcaaccaagcaaaatggtatttacgatacatgtacatagggagtaacaaacacaaaattcacaatgacgtctgcctcttgcagggaggccagggggtggaatctgtgagaagttgctggaagtttccatgccattgggtgtgcttctgccagctgatacccttggactctcaagtgagagacaccacagttgaccatcttacgttggtagcatcttcctgggttagtcccacctcgaaacgtgtgcatcctcgagtgtgaagagaaggtcttccccagccccctctggactccatgcaccaaggtcatggccaggagctcttggcagctcagccctgccgccccagagcatgtggcggctgctctctaccagccgagagcttcggagatgcagcatctgcggcgaatgccccgagtccggagcttgttccaggagcaggaagagcccgagcctggcatggaggaggctggtgagatggagcagaagcagctgcagaagagatttgggggcttcaccggggcccggaagtcggccaggaagttggccaatcagaagcggttcagtgagtttatgaggcaatacttggtcctgagcatgcagtccagccagcgccggcgcaccctgcaccagaatggtaatgtgtagccggaaggggcgctcctcccagctgtaccggccactgcaacccatgagcgtccaggtgatcccccaaacagcatgtgctcagccccagacctgccgcctgggaatcaggattccttcttccccaaggcactgagcgcctgcagatcccgcaggcttcgtttgcctccagaaccttcccgtctgattgttcctccccagccccctggcatgtttcaccacaaccctgttgctacatcagagtgtatttttgtaattcctctagctaccatttcaatagccccatctctcctgctcacccgcctcttgccccttctaggggcaggtgaaaggaataggaaattgaacctggggttttgacttgccactgccataacttgtttgtaaaagagctgttctttttgactgattgttttaaacaacgatttctccattaaacttctactgagcaaatggttaa

SEQ ID NO: 300159 - DNA, 1356 bp, Homo sapiens
ttttagatctttacatggtgaccttaaaataaacctgcagatttgactacatactttcacatccccaatttctttaacccatgtgacctcccacaagcctgaagagagaacaaaataaaattctttagtgggtgacagtcatgagctgtgcttggctccaaaaacccgactaaagatgtaacaaggtgcggtgttgggcgcatttatcctgtgttaacttcctatgttaacgtgctgtgacaccagaggtaagttacgctcacctctctgagccctggtttctttgtaaaatgatggagctgggtcagatgattctctgtttgtttccaattctgaaattctacgaacctaaaacctgtgtaaaactgctccacgttacttgataacttagatgcttcagaagcacttgcactggtgcagtgggccagatctcctccctcgccctggattaacagaggtccttgttccttctcccctcctctcacccgtatcttgtgtgcatcctcgagtgtgaagagaaggtcttccccagccccctctggactccatgcaccaaggtcatggccaggagctcttggcagctcagccctgccgccccagagcatgtggcggctgctctctaccagccgagagcttcggagatgcagcatctgcggcgaatgccccgagtccggagcttgttccaggagcaggaagagcccgagcctggcatggaggaggctggtgagatggagcagaagcagctgcagaagagatttgggggcttcaccggggcccggaagtcggccaggaagttggccaatcagaagcggttcagtgagtttatgaggcaatacttggtcctgagcatgcagtccagccagcgccggcgcaccctgcaccagaatggtaatgtgtagccggaaggggcgctcctcccagctgtaccggccactgcaacccatgagcgtccaggtgatcccccaaacagcatgtgctcagccccagacctgccgcctgggaatcaggattccttcttccccaaggcactgagcgcctgcagatcccgcaggcttcgtttgcctccagaaccttcccgtctgattgttcctccccagccccctggcatgtttcaccacaaccctgttgctacatcagagtgtatttttgtaattcctctagctaccatttcaatagccccatctctcctgctcacccgcctcttgccccttctaggggcaggtgaaaggaataggaaattgaacctggggttttgacttgccactgccataacttgtttgtaaaagagctgttctttttgactgattgttttaaacaacgatttctccattaaacttctactgagcaaatggttaa

SEQ ID NO: 300160 - DNA, 1890 bp, Homo sapiens
tctgcgataacatttagaagtcagttttaattctgagaatgtggaagtcaaagcccatctgatgtcaggttgaatgaatagattaaaaattcaatcagaaacagcagagacttgtcaaggatttcaaaagcccctccaatcccttctgtgtgggcaacaaagtgtgcctagcaaaaatgcaaatcagattgttatcactcccctgtgtaaaacccttttatacccattcacaataaatctcagactgctcaccatggcttcagggcctcaagcctctttttttccccagctcgctgctttccagacccaccagcctttcagctcccacacacaccacgcttcctgtgcctctgaacagccgtgcaggcggttctcgctgcctgcggcctgcttccaccagctggtaacttttgcttgcctctccaatgagagaggcctcactcaaccatcccatcttagtcatgttttcctgaaaaagtgtctcacattgatgcttttggtaactccttcagtgcactaaagacagtctgttgagtttgtttatgccaaagtccggtctccccaactaaaatgtcagcttgcagagagcagaagaggtcgggcctgtgtagctcgctgatgaattcctgttgacagacacttacccatgagctgctcaagtcctgcacatcttgagaaagagcccttacttccggggtatcttttcaaggatgtctgtacggtgaaaacctgtggtagacagagtatctccttccaagagcaagtcaggtgcgcatgctgtgcagtatcatgaagaccatgtctccttctggaatggacaggcaggcttgctgcctgtgatttatgaagcttaaaatagcaaatataaatatcaaccaagcaaaatggtatttacgatacatgtacatagggagtaacaaacacaaaattcacaatgacgtctgcctcttgcagggaggccagggggtggaatctgtgagaagttgctggaagtttccatgccattgggtgtgcttctgccagctgatacccttggactctcaagtgagagacaccacagttgaccatcttacgttggtagcatcttcctgggttagtcccacctcgaaacgtgtgcatcctcgagtgtgaagagaaggtcttccccagccccctctggactccatgcaccaaggtcatggccaggagctcttggcagctcagccctgccgccccagagcatgtggcggctgctctctaccagccgagagcttcggagatgcagcatctgcggcgaatgccccgagtccggagcttgttccaggagcaggaagagcccgagcctggcatggaggaggctggtgagatggagcagaagcagctgcagaagagatttgggggcttcaccggggcccggaagtcggccaggaagttggccaatcagaagcggttcagtgagtttatgaggcaatacttggtcctgagcatgcagtccagccagcgccggcgcaccctgcaccagaatggtaatgtgtagccggaaggggcgctcctcccagctgtaccggccactgcaacccatgagcgtccaggtgatcccccaaacagcatgtgctcagccccagacctgccgcctgggaatcaggattccttcttccccaaggcactgagcgcctgcagatcccgcaggcttcgtttgcctccagaaccttcccgtctgattgttcctccccagccccctggcatgtttcaccacaaccctgttgctacatcagagtgtatttttgtaattcctctagctaccatttcaatagccccatctctcctgctcaccgctttgccctctgggcggtgaggatggatgactgggttggatgcagctactgtggacacgctttgggtgtacaggtc

SEQ ID NO: 300161 - DNA, 2098 bp, Homo sapiens
ctggtcccagctcgggagcacatcagaggcttagaggcgagtgggaagggactcagacagtgcaggacgagaaacgcccgcggcaccaaagcccctcagagcgtcgcccccgcctctagttctagaaagtcagtttcccggcactggcaccccggaacctcaggggctgccgagctgggggggcgctcaagctgcgaggatccgggctgcccgcgagacgaggagcgggcgcccaggatggggtgcatgaagtccaagttcctccaggtcggaggcaatacattctcaaaaactgaaaccagcgccagcccacactgtcctgtgtacgtgccggatcccacatccaccatcaagccggggcctaatagccacaacagcaacacaccaggaatcagggaggcaggctctgaggacatcatcgtggttgccctgtatgattacgaggccattcaccacgaagacctcagcttccagaagggggaccagatggtggtcctagaggaatccggggagtggtggaaggctcgatccctggccacccggaaggagggctacatcccaagcaactatgtcgcccgcgttgactctctggagacagaggagtggtttttcaagggcatcagccggaaggacgcagagcgccaactgctggctcccggcaacatgctgggctccttcatgatccgggatagcgagaccactaaaggaagctactctttgtccgtgcgagactacgaccctcggcagggagataccgtgaaacattacaagatccggaccctggacaacgggggcttctacatatccccccgaagcaccttcagcactctgcaggagctggtggaccactacaagaaggggaacgacgggctctgccagaaactgtcggtgccctgcatgtcttccaagccccagaagccttgggagaaagatgcctgggagatccctcgggaatccctcaagctggagaagaaacttggagctgggcagtttggggaagtctggatggccacctacaacaagcacaccaaggtggcagtgaagacgatgaagccagggagcatgtcggtggaggccttcctggcagaggccaacgtgatgaaaactctgcagcatgacaagctggtcaaacttcatgcggtggtcaccaaggagcccatctacatcatcacggagttcatggccaaaggaagcttgctggactttctgaaaagtgatgagggcagcaagcagccattgccaaaactcattgacttctcagcccagattgcagaaggcatggccttcatcgagcagaggaactacatccaccgagacctccgagctgccaacatcttggtctctgcatccctggtgtgtaagattgctgactttggcctggcccgggtcattgaggacaacgagtacacggctcgggaaggggccaagttccccatcaagtggacagctcctgaagccatcaactttggctccttcaccatcaagtcagacgtctggtcctttggtatcctgctgatggagatcgtcacctacggccggatcccttacccagggatgtcaaaccctgaagtgatccgagctctggagcgtggataccggatgcctcgcccagagaactgcccagaggagctctacaacatcatgatgcgctgctggaaaaaccgtccggaggagcggccgaccttcgaatacatccagagtgtgctggatgacttctacacggccacagagagccagtaccaacagcagccatgatagggaggaccagggcagggccagggggtgcccaggtggtggctgcaaggtggctccagcaccatccgccagggcccacacccccttcctactcccagacacccaccctcgcttcagccacagtttcctcatctgtccagtgggtaggttggactggaaaatctctttttgactcttgcaatccacaatctgacattctcaggaagcccccaagttgatatttctatttcctggaatggttggattttagttacagctgtgatttggaagggaaactttcaaaatagtgaaatgaatatttaaataaaagatataaatgccaaagtctttaccaaaaaaaaaa

SEQ ID NO: 300162 - DNA, 2030 bp, Homo sapiens
cggaggcacggaagatgaggaagatgatcaggaggatgatgaaggtgaagagggagatgaagacgatgacgacgatggctctgaggggacctcaggggctgccgagctgggggggcgctcaagctgcgaggatccgggctgcccgcgagacgaggagcgggcgcccaggatggggtgcatgaagtccaagttcctccaggtcggaggcaatacattctcaaaaactgaaaccagcgccagcccacactgtcctgtgtacgtgccggatcccacatccaccatcaagccggggcctaatagccacaacagcaacacaccaggaatcagggaggcaggctctgaggacatcatcgtggttgccctgtatgattacgaggccattcaccacgaagacctcagcttccagaagggggaccagatggtggtcctagaggaatccggggagtggtggaaggctcgatccctggccacccggaaggagggctacatcccaagcaactatgtcgcccgcgttgactctctggagacagaggagtggtttttcaagggcatcagccggaaggacgcagagcgccaactgctggctcccggcaacatgctgggctccttcatgatccgggatagcgagaccactaaaggaagctactctttgtccgtgcgagactacgaccctcggcagggagataccgtgaaacattacaagatccggaccctggacaacgggggcttctacatatccccccgaagcaccttcagcactctgcaggagctggtggaccactacaagaaggggaacgacgggctctgccagaaactgtcggtgccctgcatgtcttccaagccccagaagccttgggagaaagatgcctgggagatccctcgggaatccctcaagctggagaagaaacttggagctgggcagtttggggaagtctggatggccacctacaacaagcacaccaaggtggcagtgaagacgatgaagccagggagcatgtcggtggaggccttcctggcagaggccaacgtgatgaaaactctgcagcatgacaagctggtcaaacttcatgcggtggtcaccaaggagcccatctacatcatcacggagttcatggccaaaggaagcttgctggactttctgaaaagtgatgagggcagcaagcagccattgccaaaactcattgacttctcagcccagattgcagaaggcatggccttcatcgagcagaggaactacatccaccgagacctccgagctgccaacatcttggtctctgcatccctggtgtgtaagattgctgactttggcctggcccgggtcattgaggacaacgagtacacggctcgggaaggggccaagttccccatcaagtggacagctcctgaagccatcaactttggctccttcaccatcaagtcagacgtctggtcctttggtatcctgctgatggagatcgtcacctacggccggatcccttacccagggatgtcaaaccctgaagtgatccgagctctggagcgtggataccggatgcctcgcccagagaactgcccagaggagctctacaacatcatgatgcgctgctggaaaaaccgtccggaggagcggccgaccttcgaatacatccagagtgtgctggatgacttctacacggccacagagagccagtaccaacagcagccatgatagggaggaccagggcagggccagggggtgcccaggtggtggctgcaaggtggctccagcaccatccgccagggcccacacccccttcctactcccagacacccaccctcgcttcagccacagtttcctcatctgtccagtgggtaggttggactggaaaatctctttttgactcttgcaatccacaatctgacattctcaggaagcccccaagttgatatttctatttcctggaatggttggattttagttacagctgtgatttggaagggaaactttcaaaatagtgaaatgaatatttaaataaaagatataaatgccaaagtctttaccaaaaaaaaaa

SEQ ID NO: 300163 - DNA, 1936 bp, Homo sapiens
gaattcctttctaaaatccaaccattccaggaaatagaaatatcaacttgggggcttcctgagaatgtcagattgatggggtgcatgaagtccaagttcctccaggtcggaggcaatacattctcaaaaactgaaaccagcgccagcccacactgtcctgtgtacgtgccggatcccacatccaccatcaagccggggcctaatagccacaacagcaacacaccaggaatcagggaggcaggctctgaggacatcatcgtggttgccctgtatgattacgaggccattcaccacgaagacctcagcttccagaagggggaccagatggtggtcctagaggaatccggggagtggtggaaggctcgatccctggccacccggaaggagggctacatcccaagcaactatgtcgcccgcgttgactctctggagacagaggagtggtttttcaagggcatcagccggaaggacgcagagcgccaactgctggctcccggcaacatgctgggctccttcatgatccgggatagcgagaccactaaaggaagctactctttgtccgtgcgagactacgaccctcggcagggagataccgtgaaacattacaagatccggaccctggacaacgggggcttctacatatccccccgaagcaccttcagcactctgcaggagctggtggaccactacaagaaggggaacgacgggctctgccagaaactgtcggtgccctgcatgtcttccaagccccagaagccttgggagaaagatgcctgggagatccctcgggaatccctcaagctggagaagaaacttggagctgggcagtttggggaagtctggatggccacctacaacaagcacaccaaggtggcagtgaagacgatgaagccagggagcatgtcggtggaggccttcctggcagaggccaacgtgatgaaaactctgcagcatgacaagctggtcaaacttcatgcggtggtcaccaaggagcccatctacatcatcacggagttcatggccaaaggaagcttgctggactttctgaaaagtgatgagggcagcaagcagccattgccaaaactcattgacttctcagcccagattgcagaaggcatggccttcatcgagcagaggaactacatccaccgagacctccgagctgccaacatcttggtctctgcatccctggtgtgtaagattgctgactttggcctggcccgggtcattgaggacaacgagtacacggctcgggaaggggccaagttccccatcaagtggacagctcctgaagccatcaactttggctccttcaccatcaagtcagacgtctggtcctttggtatcctgctgatggagatcgtcacctacggccggatcccttacccagggatgtcaaaccctgaagtgatccgagctctggagcgtggataccggatgcctcgcccagagaactgcccagaggagctctacaacatcatgatgcgctgctggaaaaaccgtccggaggagcggccgaccttcgaatacatccagagtgtgctggatgacttctacacggccacagagagccagtaccaacagcagccatgatagggaggaccagggcagggccagggggtgcccaggtggtggctgcaaggtggctccagcaccatccgccagggcccacacccccttcctactcccagacacccaccctcgcttcagccacagtttcctcatctgtccagtgggtaggttggactggaaaatctctttttgactcttgcaatccacaatctgacattctcaggaagcccccaagttgatatttctatttcctggaatggttggattttagttacagctgtgatttggaagggaaactttcaaaatagtgaaatgaatatttaaataaaagatataaatgccaaagtctttaccaaaaaaaaaa

SEQ ID NO: 300164 - DNA, 403 bp, Homo sapiens
gcggccgcctactactactactgctcgaattcaagcttctaacgatgtacggggccatgatagggaggaccagggcagggccagggggtgcccaggtggtggctgcaaggtggctccagcaccatccgccagggcccacacccccttcctactcccagacacccaccctcgcttcagccacagtttcctcatctgtccagtgggtaggttggactggaaaatctctttttgactcttgcaatccacaatctgacattctcaggaagcccccaagttgatatttctatttcctggaatggttggattttagttacagctgtgatttggaagggaaactttcaaaatagtgaaatgaatatttaaataaaagatataaatgccaaagtctttaccaaaaaaaaaa

SEQ ID NO: 300165 - DNA, 994 bp, Homo sapiens
actgaaatagaagcaatctattactcccaatcttccattggtgactggttagttcagcaactcagcagctgtcaggactctgggttcctgtctctatgatggtcttctccatgttgtcagctccaagtatcataagtatctcacagtgttcaaaggaagagatgaagggtgcgttctccaaagactctcctctaagcgggaggaaaaacctttccatcactttcccagcagacctccccatcagctcccattggcccaaactgggtcccaggcccatgtcctagctgcaagtgaagctgagggtggaagtctgtctttcacagtggaaggggctcagcttgcaaggtgaggtggggagtgatgcctgctggggaggccacagggcctgccacccctgggctctcatttcccaactgcttccgtttctaattccacggctccttttcagggatgtcaaaccctgaagtgatccgagctctggagcgtggataccggatgcctcgcccagagaactgcccagaggagctctacaacatcatgatgcgctgctggaaaaaccgtccggaggagcggccgaccttcgaatacatccagagtgtgctggatgacttctacacggccacagagagccagtaccaacagcagccatgatagggaggaccagggcagggccagggggtgcccaggtggtggctgcaaggtggctccagcaccatccgccagggcccacacccccttcctactcccagacacccaccctcgcttcagccacagtttcctcatctgtccagtgggtaggttggactggaaaatctctttttgactcttgcaatccacaatctgacattctcaggaagcccccaagttgatatttctatttcctggaatggttggattttagttacagctgtgatttggaagggaaactttcaaaatagtgaaatgaatatttaaataaaagatataaatgccaaagtctttaccaaaaaaaaaa

SEQ ID NO: 300166 - DNA, 468 bp, Homo sapiens
tggtaaagacccactcttgttatgttgcccaggctgctctcggactcctggcctcaagctatcctctcacctcggtcccccaaagcattggaatgacaggtgtaagccagcatacctggcctagttaatgctttttaaatcatgttcaaggaatctttgccaaaccccaaatcactagaattttctcatatgttttcttctgaaggttttatagttttaactctttttttaacacacggtctctctgtcacccagtctggagtgcagtggtgcaatcatggctcactgcaaccttgacctctctgggctcaggtgatcctcccacctcagactactgtgcagctgggactacaggtgagtgtcatcatgctcaactaattttttcatttttttgtagagacggtgtttcgctatgttgcccaggatgggtcttgtaactcctggggccaagtgatccacccgccttgg

SEQ ID NO: 300167 - DNA, 412 bp, Homo sapiens
tggtaaagacccactcttgttatgttgcccaggctgctctcggactcctggcctcaagctatcctctcacctcggtcccccaaagcattggaatgacaggtgtaagccagcatacctggcctagttaatgctttttaaatcatgttcaaggaatctttgccaaaccccaaatcactagaattttctcatatgttttcttctgaaggttttatagttttaactctttttttaacacacggtctctctgtcacccacaacaaaacaaaacaaacaactcccacccccctgccaccaaaaacacacttacatcattttaagtaatggacctatgaaaaagagcctgtatacagtacaagtatttaaaggacaagactggttgcagaacaaatgtttttctaaaaaaaaaaaacaa

SEQ ID NO: 300168 - DNA, 332 bp, Homo sapiens
ccccagcccacaccccacccacccacccacatcacacaaggtccagcgagctccccttccttgcaagtattctacaacagacctgataccataattgggcacacatccttccgaaattccttctagaaaatgatttaatctactaagaaagcccacatttgaattcattcattccaaaaagagtctccatccacttcctaggttttgagctctttttatgagtccatggaagctgccgtggttttctctgagtccatggccatattttccctctgggttcttgtttcttttaagtcttatacctctattagtattaaagatcatcagctgtg

SEQ ID NO: 300169 - DNA, 635 bp, Homo sapiens
tggtaaagacccactcttgttatgttgcccaggctgctctcggactcctggcctcaagctatcctctcacctcggtcccccaaagcattggaatgacaggtgtaagccagcatacctggcctagttaatgctttttaaatcatgttcaaggaatctttgccaaaccccaaatcactagaattttctcatatgttttcttctgaaggttttatagttttaactctttttttaacacacggtctctctgtcacccagtctggagtgcagtggtgcaatcatggctcactgcaaccttgacctctctgggctcaggtgatcctcccacctcagactactgtgcagctgggactacagaggcttcctccttgaagagtctacaacagacctgataccataattgggcacacatccttccgaaattccttctagaaaatgatttaatctactaagaaagcccacatttgaattcattcattccaaaaagagtctccatccacttcctaggttttgagctctttttatgagtccatggaagctgccgtggttttctctgagtccatggccatattttccctctgggttcttgtttcttttaagtcttatacctctattagtattaaagatcatcagctgtg

SEQ ID NO: 300170 - DNA, 948 bp, Homo sapiens
tggtaaagacccactcttgttatgttgcccaggctgctctcggactcctggcctcaagctatcctctcacctcggtcccccaaagcattggaatgacaggtgtaagccagcatacctggcctagttaatgctttttaaatcatgttcaaggaatctttgccaaaccccaaatcactagaattttctcatatgttttcttctgaaggttttatagttttaactctttttttaacacacggtctctctgtcacccagtctggagtgcagtggtgcaatcatggctcactgcaaccttgacctctctgggctcaggtgatcctcccacctcagactactgtgcagctgggactacagaggcttcctccttgaagagtctacaacagacctgataccataattgggcacacatccttccgaaattccttctagaaaatgatttaatctactaagaaagcccacatttgaattcattcattccaaaaagagtctccatccacttcctaggttttgagctctttttatgagtccatggaagctgccgtggttttctctgagtccatggccatattttccctctgggttcttgtttcttttaagtcttatacctctattagtattaaagatcatcagctgtgcttgagtgtggttaaatattcactttcacttagacttctgacctagacactaacagccaaccttgctagattcatctaagtaaagggaatgcaacaggaaaaaaagccaataatttttggtttccagagtgaaagaaaaatactgggctggacatcatgaatcacacctgtaatcccaacactttgggaggccaaggcggacagatcacttgagcccaggagtttgagactagctgaattctaatttttaattgttccttcttgtctttcagaggcttcctccttgaagagtctacaacagacctgataccat

SEQ ID NO: 300171 - DNA, 1251 bp, Homo sapiens
cgccctcctcccgcgggagtcagtgggtgagggtcgggcttgaagccatagctgcgggaccgtactcgtctcccccgacgcagaccatggagagcgcgctggcggtgccccggctgcccccgcatgatccagggacgccggtgctgtcggtggtggacatgcacacgggcggcgagcccttgcgtatcgtgctggcggggtgtccggaggtgtctgggcccaccctgctggccaagcggcgctacatgcgccagcaccttgaccacgtgcggcgacggctcatgttcgagccccgagggcaccgggacatgtacggggcggtcctagtcccgagcgagctgccggacgcgcatctgggcgtcctgttcctgcacaacgagggctacagctccatgtgcggccacgcagtgctggcgctgggccgcttcgctttggacttcgggcttgtgccggcgccccctgcgggcacccgcgaggcccgcgtcaatatccactgcccctgcgggctggtgaccgccttcgtggcatgcgaggacggccgcagccacggaccggtgcgcttccacagcgtcccggccttcgtgctggccacagatctcatggtggatgttcctggacatggaaaggtgatggtggacattgcatatggcggtgcattttatgcatttgttactgctgaaaagttaggactagacatttgttctgcaaagaccagggaccttgtggatgcagcgagtgcagtgacagaggcagtgaaagctcagtttaaaattaatcatcctgatagtgaagaccttgcctttttatatggaactatattaacagatggaaaagatgcttataccaaggaaccaaccaccaacatttgtgtttttgcagatgaacaggttgacagaagtcccactggctcaggagtgacagcccgaattgccttacagtatcacaaagggcttctggaactgaaccagatgagagccttcaaaagcagtgcaactggctcagtattcacagggaaagctgtgagggaagcgaaatgtggtgattttaaagctgttatagtggaagtatcaggacaagcccattacacgggtacagcaagctttataatagaagatgacgacccattgagggatggatttcttctcaagtgacttcttccatgattttaagggctttctttttaaagtaatcattatccttaaggactgttttctctaaattatatgaaaacaaataaattatacatataaa

SEQ ID NO: 300172 - DNA, 1577 bp, Homo sapiens
aaatttcttcactcagctctcagaagagaattttaaagcaggcctgtaaaaacttcttttcaactaggacattggttatccagtgtggtcttggggccccagcgggcccctaaggtcctttccatgggttcagagggtcaaaactgtgttcataataatgacattatttgcttttcactctcattctctcaagagtgtacagtggggttcttcagaggctacgatgtgatatgtgataacccaaccaattgaatgcagaagctagatatgagaacctagttgtcttctgttaagccagacatgaaacaggtttgcaaaaatatcaaacaatgccacttttctcataattttttttgttttggccagttattttcacaaaaatgtgttattcatatgttaatgtataatgggttatttttaaaatgaagtaatgaacagatatatccaattcctaatacagtaaatattgatagatataacttatataaagaaaaactctttggggtcctcaaatcttaaggtataaaagggtcctgagaccaaaaggtttgagaaccattaggatttggggtttttttttgtttttttgttttattttataatagtgttttatttgatataataggatgtgaaagccctgaaaagttgtggaacatcaaatttttgtaatggaataaaattttaaatgtgctaacagctaagtaatgaatcttatctcagtagtaaatgaaatctactacagaatgatctacattcagtaaattattctactcataaagagtcctttaacatagcaaacaatctatcctaatatagctgtttttaagatttggtgtttctgaatattagagtttccttaaggatctctacatcatatagtgatctgaaacatgtgaaaccatttatgttgtatgcaaaaatttggaacatactgtcttcaaaatctgaaatggaacataaaaataacaacatacatttattggatacttcactgtgcatcagtttccaagctaagcacttgatacatgccatctcatttaatcctcacaagaatcctacaaggtcagtactgtgctgttattatcgtttttcaatagatgataaaacggagaattggagaagttaggtaatttaccagaggttagttagtgagtagcagatccaggtcatgaaggtgggtctctgaacagaccacatgctgttaagcattatattatattgctgtcagacaaagcaaaaggtcaatgaggctttatattataggagctgttatgagaagaatctgggattgcaatgtccccccaaatagagagggagccgagagaccaaagaatgactcagacaagtccaggaagcgaaatgtggtgattttaaagctgttatagtggaagtatcaggacaagcccattacacgggtacagcaagctttataatagaagatgacgacccattgagggatggatttcttctcaagtgacttcttccatgattttaagggctttctttttaaagtaatcattatccttaaggactgttttctctaaattatatgaaaacaaataaattatacatataaa

SEQ ID NO: 300173 - DNA, 1412 bp, Homo sapiens
gtatgttcccagatattctctgggatatttgggttctcagggatacctgcttcttggctgggcaccatgcccttggcttaccccccagccttcagggttcaagcagtggacatacacccttacataacctggtgaaggacctgtcacactacagcagctttataaaaagatataaaaagataaagtattataccctaacaatatttgacattttacctttagcttcagttattattcttttaaaaattagaacataaaaagatatgctgaagttaatgtttccagttacttgttttatagttattgatcatgcttgccagaatgtcttcacttgcatcatgctctctccctgtctgtgtgggcccgtccaggctccctgatggtaccttctcagtttcttcccctgctgcagcttcctttccctgtccttccatttagatgttaccgtcacttcatccccaccttccttctcatctcttctacagtttgatgctgctgggcaatttcatccacttcctaggcttcagttctcaaccatctactgatgatgactcccaaatgtttatccctgccctgactacctaccctgtatgtctttctgaatataacgctcttaatcccaactgtttattatactcatctctaaatgactgtcccagaggtgtctcaaactcaccttgttaaaaagttcttcctttcttcctttctcaaatgtgctcttcctttctctccccattgtgtttaatggcatcactagcatcatttccaagctagaaactatggttataattaacttattgctagtcctcaattcccacatgcattgatcaagaggcctatcagttctacctccaaactatctctatgttagtatatattccccttctccatcttcactgaaaactcccatagtgactctggaatcaatcattcagtgaattgaggttatctcttaacatgtttctgggtctcttgtctctctcttctccagtttgatccccactttacagctacagttatctaaaacacaagtctgaccatgtcattctccttaaaaaccttccctggcccataggattaacccttggcctttccttcacatgataaaagtcaagagtacagttttcaagccagatataatacgagtgcaatattttgatagtatactcccttcatcttttttcaggaagcgaaatgtggtgattttaaagctgttatagtggaagtatcaggacaagcccattacacgggtacagcaagctttataatagaagatgacgacccattgagggatggatttcttctcaagtgacttcttccatgattttaagggctttctttttaaagtaatcattatccttaaggactgttttctctaaattatatgaaaacaaataaattatacatataaa

SEQ ID NO: 300174 - DNA, 1546 bp, Homo sapiens
aaatttcttcactcagctctcagaagagaattttaaagcaggcctgtaaaaacttcttttcaactaggacattggttatccagtgtggtcttggggccccagcgggcccctaaggtcctttccatgggttcagagggtcaaaactgtgttcataataatgacattatttgcttttcactctcattctctcaagagtgtacagtggggttcttcagaggctacgatgtgatatgtgataacccaaccaattgaatgcagaagctagatatgagaacctagttgtcttctgttaagccagacatgaaacaggtttgcaaaaatatcaaacaatgccacttttctcataattttttttgttttggccagttattttcacaaaaatgtgttattcatatgttaatgtataatgggttatttttaaaatgaagtaatgaacagatatatccaattcctaatacagtaaatattgatagatataacttatataaagaaaaactctttggggtcctcaaatcttaaggtataaaagggtcctgagaccaaaaggtttgagaaccattaggatttggggtttttttttgtttttttgttttattttataatagtgttttatttgatataataggatgtgaaagccctgaaaagttgtggaacatcaaatttttgtaatggaataaaattttaaatgtgctaacagctaagtaatgaatcttatctcagtagtaaatgaaatctactacagaatgatctacattcagtaaattattctactcataaagagtcctttaacatagcaaacaatctatcctaatatagctgtttttaagatttggtgtttctgaatattagagtttccttaaggatctctacatcatatagtgatctgaaacatgtgaaaccatttatgttgtatgcaaaaatttggaacatactgtcttcaaaatctgaaatggaacataaaaataacaacatacatttattggatacttcactgtgcatcagtttccaagctaagcacttgatacatgccatctcatttaatcctcacaagaatcctacaaggaagcgaaatgtggtgattttaaagctgttatagtggaagtatcaggacaagcccattacacgggtacagcaagctttataatagaagatgacgacccattgagggatggatttcttctcaagtgacttcttccatgattttaagggctttctttttaaagtaatcattatccttaaggactgttttctctaaattatatgaaaacaaataaattatacatataaactaactctcattctttgtaaaatactaccctgtggctaaatataaagtcattatacctcgtatttgcaactgtatttgtataaatatcacttatgtctagcatacaaaatgccagaaattcagagtctttttctagtgattaacgtatcaggtaaaattaaaacagtagttacttttaaaatattgctctatagtaattactattaatatcatattttgtattaaaggctcttcgaataatatgtggaatttaactga

SEQ ID NO: 300175 - DNA, 1670 bp, Homo sapiens
gtatgttcccagatattctctgggatatttgggttctcagggatacctgcttcttggctgggcaccatgcccttggcttaccccccagccttcagggttcaagcagtggacatacacccttacataacctggtgaaggacctgtcacactacagcagctttataaaaagatataaaaagataaagtattataccctaacaatatttgacattttacctttagcttcagttattattcttttaaaaattagaacataaaaagatatgctgaagttaatgtttccagttacttgttttatagttattgatcatgcttgccagaatgtcttcacttgcatcatgctctctccctgtctgtgtgggcccgtccaggctccctgatggtaccttctcagtttcttcccctgctgcagcttcctttccctgtccttccatttagatgttaccgtcacttcatccccaccttccttctcatctcttctacagtttgatgctgctgggcaatttcatccacttcctaggcttcagttctcaaccatctactgatgatgactcccaaatgtttatccctgccctgactacctaccctgtatgtctttctgaatataacgctcttaatcccaactgtttattatactcatctctaaatgactgtcccagaggtgtctcaaactcaccttgttaaaaagttcttcctttcttcctttctcaaatgtgctcttcctttctctccccattgtgtttaatggcatcactagcatcatttccaagctagaaactatggttataattaacttattgctagtcctcaattcccacatgcattgatcaagaggcctatcagttctacctccaaactatctctatgttagtatatattccccttctccatcttcactgaaaactcccatagtgactctggaatcaatcattcagtgaattgaggttatctcttaacatgtttctgggtctcttgtctctctcttctccagtttgatccccactttacagctacagttatctaaaacacaagtctgaccatgtcattctccttaaaaaccttccctggcccataggattaacccttggcctttccttcacatgataaaagtcaagagtacagttttcaagccagatataatacgagtgcaatattttgatagtatactcccttcatcttttttcaggaagcgaaatgtggtgattttaaagctgttatagtggaagtatcaggacaagcccattacacgggtacagcaagctttataatagaagatgacgacccattgagggatggatttcttctcaagtgacttcttccatgattttaagggctttctttttaaagtaatcattatccttaaggactgttttctctaaattatatgaaaacaaataaattatacatataaactaactctcattctttgtaaaatactaccctgtggctaaatataaagtcattatacctcgtatttgcaactgtatttgtataaatatcacttatgtctagcatacaaaatgccagaaattcagagtctttttctagtgattaacgtatcaggtaaaattaaaacagtagttacttttaaaatattgctctatagtaattactattaatatcatattttgtattaaaggctcttcgaataatatgtggaatttaactga

SEQ ID NO: 300176 - DNA, 1288 bp, Homo sapiens
aaatttcttcactcagctctcagaagagaattttaaagcaggcctgtaaaaacttcttttcaactaggacattggttatccagtgtggtcttggggccccagcgggcccctaaggtcctttccatgggttcagagggtcaaaactgtgttcataataatgacattatttgcttttcactctcattctctcaagagtgtacagtggggttcttcagaggctacgatgtgatatgtgataacccaaccaattgaatgcagaagctagatatgagaacctagttgtcttctgttaagccagacatgaaacaggtttgcaaaaatatcaaacaatgccacttttctcataattttttttgttttggccagttattttcacaaaaatgtgttattcatatgttaatgtataatgggttatttttaaaatgaagtaatgaacagatatatccaattcctaatacagtaaatattgatagatataacttatataaagaaaaactctttggggtcctcaaatcttaaggtataaaagggtcctgagaccaaaaggtttgagaaccattaggatttggggtttttttttgtttttttgttttattttataatagtgttttatttgatataataggatgtgaaagccctgaaaagttgtggaacatcaaatttttgtaatggaataaaattttaaatgtgctaacagctaagtaatgaatcttatctcagtagtaaatgaaatctactacagaatgatctacattcagtaaattattctactcataaagagtcctttaacatagcaaacaatctatcctaatatagctgtttttaagatttggtgtttctgaatattagagtttccttaaggatctctacatcatatagtgatctgaaacatgtgaaaccatttatgttgtatgcaaaaatttggaacatactgtcttcaaaatctgaaatggaacataaaaataacaacatacatttattggatacttcactgtgcatcagtttccaagctaagcacttgatacatgccatctcatttaatcctcacaagaatcctacaaggaagcgaaatgtggtgattttaaagctgttatagtggaagtatcaggacaagcccattacacgggtacagcaagctttataatagaagatgacgacccattgagggatggatttcttctcaagtgacttcttccatgattttaagggctttctttttaaagtaatcattatccttaaggactgttttctctaaattatatgaaaacaaataaattatacatataaa

SEQ ID NO: 300177 - DNA, 513 bp, Homo sapiens
  misc_feature (32)..(32): n is a, c, g, or t
ggggccccgcctggccgagggttagttttttngttactggtaacaaacggtttatttaagctgttagggaattcagacaagcccattacacgggtacagcaagctttataatagaagatgacgacccattgagggatggatttcttctcaagtgacttcttccatgattttaagggctttctttttaaagtaatcattatccttaaggactgttttctctaaattatatgaaaacaaataaattatacatataaactaactctcattctttgtaaaatactaccctgtggctaaatataaagtcattatacctcgtatttgcaactgtatttgtataaatatcacttatgtctagcatacaaaatgccagaaattcagagtctttttctagtgattaacgtatcaggtaaaattaaaacagtagttacttttaaaatattgctctatagtaattactattaatatcatattttgtattaaaggctcttcgaataatatgtggaatttaactga

SEQ ID NO: 300178 - DNA, 1509 bp, Homo sapiens
cgccctcctcccgcgggagtcagtgggtgagggtcgggcttgaagccatagctgcgggaccgtactcgtctcccccgacgcagaccatggagagcgcgctggcggtgccccggctgcccccgcatgatccagggacgccggtgctgtcggtggtggacatgcacacgggcggcgagcccttgcgtatcgtgctggcggggtgtccggaggtgtctgggcccaccctgctggccaagcggcgctacatgcgccagcaccttgaccacgtgcggcgacggctcatgttcgagccccgagggcaccgggacatgtacggggcggtcctagtcccgagcgagctgccggacgcgcatctgggcgtcctgttcctgcacaacgagggctacagctccatgtgcggccacgcagtgctggcgctgggccgcttcgctttggacttcgggcttgtgccggcgccccctgcgggcacccgcgaggcccgcgtcaatatccactgcccctgcgggctggtgaccgccttcgtggcatgcgaggacggccgcagccacggaccggtgcgcttccacagcgtcccggccttcgtgctggccacagatctcatggtggatgttcctggacatggaaaggtgatggtggacattgcatatggcggtgcattttatgcatttgttactgctgaaaagttaggactagacatttgttctgcaaagaccagggaccttgtggatgcagcgagtgcagtgacagaggcagtgaaagctcagtttaaaattaatcatcctgatagtgaagaccttgcctttttatatggaactatattaacagatggaaaagatgcttataccaaggaaccaaccaccaacatttgtgtttttgcagatgaacaggttgacagaagtcccactggctcaggagtgacagcccgaattgccttacagtatcacaaagggcttctggaactgaaccagatgagagccttcaaaagcagtgcaactggctcagtattcacagggaaagctgtgagggaagcgaaatgtggtgattttaaagctgttatagtggaagtatcaggacaagcccattacacgggtacagcaagctttataatagaagatgacgacccattgagggatggatttcttctcaagtgacttcttccatgattttaagggctttctttttaaagtaatcattatccttaaggactgttttctctaaattatatgaaaacaaataaattatacatataaactaactctcattctttgtaaaatactaccctgtggctaaatataaagtcattatacctcgtatttgcaactgtatttgtataaatatcacttatgtctagcatacaaaatgccagaaattcagagtctttttctagtgattaacgtatcaggtaaaattaaaacagtagttacttttaaaatattgctctatagtaattactattaatatcatattttgtattaaaggctcttcgaataatatgtggaatttaactga

SEQ ID NO: 300179 - DNA, 1380 bp, Homo sapiens
cgccctcctcccgcgggagtcagtgggtgagggtcgggcttgaagccatagctgcgggaccgtactcgtctcccccgacgcagaccatggagagcgcgctggcggtgccccggctgcccccgcatgatccagggacgccggtgctgtcggtggtggacatgcacacgggcggcgagcccttgcgtatcgtgctggcggggtgtccggaggtgtctgggcccaccctgctggccaagcggcgctacatgcgccagcaccttgaccacgtgcggcgacggctcatgttcgagccccgagggcaccgggacatgtacggggcggtcctagtcccgagcgagctgccggacgcgcatctgggcgtcctgttcctgcacaacgagggctacagctccatgtgcggccacgcagtgctggcgctgggccgcttcgctttggacttcgggcttgtgccggcgccccctgcgggcacccgcgaggcccgcgtcaatatccactgcccctgcgggctggtgaccgccttcgtggcatgcgaggacggccgcagccacggaccggtgcgcttccacagcgtcccggccttcgtgctggccacaggtaatgggcgggacctttccagcccagggcagagctgcaaccgggacgcgactaactacattaacggtttttctgggctggaactctggcaactaacctactccgcgaaaccttgcaattaatagaaagatctcatggtggatgttcctggacatggaaaggtgatggtggacattgcatatggcggtgcattttatgcatttgttactgctgaaaagttaggactagacatttgttctgcaaagaccagggaccttgtggatgcagcgagtgcagtgacagaggcagtgaaagctcagtttaaaattaatcatcctgatagtgaagaccttgcctttttatatggaactatattaacagatggaaaagatgcttataccaaggaaccaaccaccaacatttgtgtttttgcagatgaacaggttgacagaagtcccactggctcaggagtgacagcccgaattgccttacagtatcacaaagggcttctggaactgaaccagatgagagccttcaaaagcagtgcaactggctcagtattcacagggaaagctgtgagggaagcgaaatgtggtgattttaaagctgttatagtggaagtatcaggacaagcccattacacgggtacagcaagctttataatagaagatgacgacccattgagggatggatttcttctcaagtgacttcttccatgattttaagggctttctttttaaagtaatcattatccttaaggactgttttctctaaattatatgaaaacaaataaattatacatataaa

SEQ ID NO: 300180 - DNA, 1570 bp, Homo sapiens
cgccctcctcccgcgggagtcagtgggtgagggtcgggcttgaagccatagctgcgggaccgtactcgtctcccccgacgcagaccatggagagcgcgctggcggtgccccggctgcccccgcatgatccagggacgccggtgctgtcggtggtggacatgcacacgggcggcgagcccttgcgtatcgtgctggcggggtgtccggaggtgtctgggcccaccctgctggccaagcggcgctacatgcgccagcaccttgaccacgtgcggcgacggctcatgttcgagccccgagggcaccgggacatgtacggggcggtcctagtcccgagcgagctgccggacgcgcatctgggcgtcctgttcctgcacaacgagggctacagctccatgtgcggccacgcagtgctggcgctgggccgcttcgctttggacttcgggcttgtgccggcgccccctgcgggcacccgcgaggcccgcgtcaatatccactgcccctgcgggctggtgaccgccttcgtggcatgcgaggacggccgcagccacggaccggtgcgcttccacagcgtcccggccttcgtgctggccacaggtaatgggcgggacctttccagcccagggcagagctgcaaccgggacgcgactaactacattaacggtttttctgggctggaactctggcaactaacctactccgcgaaaccttgcaattaatagaaaggtaaatcactgccaacgtgtgtcagcagccttgcgtatttggtgcgtgtaatttcgattttccctgactcccatccgcctgtggttttgggagacccttgaggagcgaggaattgcgtgttaccctgactcagcgcctccctctgcactggtgaggcattcctagagatttcaccggtggataaagcaagatctcatggtggatgttcctggacatggaaaggtgatggtggacattgcatatggcggtgcattttatgcatttgttactgctgaaaagttaggactagacatttgttctgcaaagaccagggaccttgtggatgcagcgagtgcagtgacagaggcagtgaaagctcagtttaaaattaatcatcctgatagtgaagaccttgcctttttatatggaactatattaacagatggaaaagatgcttataccaaggaaccaaccaccaacatttgtgtttttgcagatgaacaggttgacagaagtcccactggctcaggagtgacagcccgaattgccttacagtatcacaaagggcttctggaactgaaccagatgagagccttcaaaagcagtgcaactggctcagtattcacagggaaagctgtgagggaagcgaaatgtggtgattttaaagctgttatagtggaagtatcaggacaagcccattacacgggtacagcaagctttataatagaagatgacgacccattgagggatggatttcttctcaagtgacttcttccatgattttaagggctttctttttaaagtaatcattatccttaaggactgttttctctaaattatatgaaaacaaataaattatacatataaa

SEQ ID NO: 300181 - DNA, 1355 bp, Homo sapiens
cgccctcctcccgcgggagtcagtgggtgagggtcgggcttgaagccatagctgcgggaccgtactcgtctcccccgacgcagaccatggagagcgcgctggcggtgccccggctgcccccgcatgatccagggacgccggtgctgtcggtggtggacatgcacacgggcggcgagcccttgcgtatcgtgctggcggggtgtccggaggtgtctgggcccaccctgctggccaagcggcgctacatgcgccagcaccttgaccacgtgcggcgacggctcatgttcgagccccgagggcaccgggacatgtacggggcggtcctagtcccgagcgagctgccggacgcgcatctgggcgtcctgttcctgcacaacgagggctacagctccatgtgcggccacgcagtgctggcgctgggccgcttcgctttggacttcgggcttgtgccggcgccccctgcgggcacccgcgaggcccgcgtcaatatccactgcccctgcgggctggtgaccgccttcgtggcatgcgaggacggccgcagccacggaccggtgcgcttccacagcgtaatgggcgggacctttccagcccagggcagagctgcaaccgggacgcgactaactacattaacggtttttctgggctggaactctggcaactaacctactccgcgaaaccttgcaattaatagaaagatctcatggtggatgttcctggacatggaaaggtgatggtggacattgcatatggcggtgcattttatgcatttgttactgctgaaaagttaggactagacatttgttctgcaaagaccagggaccttgtggatgcagcgagtgcagtgacagaggcagtgaaagctcagtttaaaattaatcatcctgatagtgaagaccttgcctttttatatggaactatattaacagatggaaaagatgcttataccaaggaaccaaccaccaacatttgtgtttttgcagatgaacaggttgacagaagtcccactggctcaggagtgacagcccgaattgccttacagtatcacaaagggcttctggaactgaaccagatgagagccttcaaaagcagtgcaactggctcagtattcacagggaaagctgtgagggaagcgaaatgtggtgattttaaagctgttatagtggaagtatcaggacaagcccattacacgggtacagcaagctttataatagaagatgacgacccattgagggatggatttcttctcaagtgacttcttccatgattttaagggctttctttttaaagtaatcattatccttaaggactgttttctctaaattatatgaaaacaaataaattatacatataaa

SEQ ID NO: 300182 - DNA, 1597 bp, Homo sapiens
cgccctcctcccgcgggagtcagtgggtgagggtcgggcttgaagccatagctgcgggaccgtactcgtctcccccgacgcagaccatggagagcgcgctggcggtgccccggctgcccccgcatgatccagggacgccggtgctgtcggtggtggacatgcacacgggcggcgagcccttgcgtatcgtgctggcggggtgtccggaggtgtctgggcccaccctgctggccaagcggcgctacatgcgccagcaccttgaccacgtgcggcgacggctcatgttcgagccccgagggcaccgggacatgtacggggcggtcctagtcccgagcgagctgccggacgcgcatctgggcgtcctgttcctgcacaacgagggctacagctccatgtgcggccacgcagtgctggcgctgggccgcttcgctttggacttcgggcttgtgccggcgccccctgcgggcacccgcgaggcccgcgtcaatatccactgcccctgcgggctggtgaccgccttcgtggcatgcgaggacggccgcagccacggaccggtgcgcttccacagcgtcccggccttcgtgctggccacagatctcatggtggatgttcctggacatggaaaggtgatggtggacattgcatatggcggtgcattttatgcatttgttactgctgaaaagttaggactagacatttgttctgcaaagaccagggaccttgtggatgcagcgagtgcagtgacagaggcagtgaaagctcagtttaaaattaatcatcctgatagtgaagaccttgcctttttatatggaactatattaacagatggaaaagatgcttataccaaggaaccaaccaccaacatttgtgtttttgcagatgaacaggttgacagaagtcccactggctcaggagtgacagcccgaattgccttacagtatcacaaagggcttctggaactgaaccagatgagagccttcaaaagcagtgcaactggctcagtattcacagggaaagctgtgagggagctgttatgagaagaatctgggattgcaatgtccccccaaatagagagggagccgagagaccaaagaatgactcagacaagtccaggaagcgaaatgtggtgattttaaagctgttatagtggaagtatcaggacaagcccattacacgggtacagcaagctttataatagaagatgacgacccattgagggatggatttcttctcaagtgacttcttccatgattttaagggctttctttttaaagtaatcattatccttaaggactgttttctctaaattatatgaaaacaaataaattatacatataaactaactctcattctttgtaaaatactaccctgtggctaaatataaagtcattatacctcgtatttgcaactgtatttgtataaatatcacttatgtctagcatacaaaatgccagaaattcagagtctttttctagtgattaacgtatcaggtaaaattaaaacagtagttacttttaaaatattgctctatagtaattactattaatatcatattttgtattaaaggctcttcgaataatatgtggaatttaactga

SEQ ID NO: 300183 - DNA, 1339 bp, Homo sapiens
cgccctcctcccgcgggagtcagtgggtgagggtcgggcttgaagccatagctgcgggaccgtactcgtctcccccgacgcagaccatggagagcgcgctggcggtgccccggctgcccccgcatgatccagggacgccggtgctgtcggtggtggacatgcacacgggcggcgagcccttgcgtatcgtgctggcggggtgtccggaggtgtctgggcccaccctgctggccaagcggcgctacatgcgccagcaccttgaccacgtgcggcgacggctcatgttcgagccccgagggcaccgggacatgtacggggcggtcctagtcccgagcgagctgccggacgcgcatctgggcgtcctgttcctgcacaacgagggctacagctccatgtgcggccacgcagtgctggcgctgggccgcttcgctttggacttcgggcttgtgccggcgccccctgcgggcacccgcgaggcccgcgtcaatatccactgcccctgcgggctggtgaccgccttcgtggcatgcgaggacggccgcagccacggaccggtgcgcttccacagcgtcccggccttcgtgctggccacagatctcatggtggatgttcctggacatggaaaggtgatggtggacattgcatatggcggtgcattttatgcatttgttactgctgaaaagttaggactagacatttgttctgcaaagaccagggaccttgtggatgcagcgagtgcagtgacagaggcagtgaaagctcagtttaaaattaatcatcctgatagtgaagaccttgcctttttatatggaactatattaacagatggaaaagatgcttataccaaggaaccaaccaccaacatttgtgtttttgcagatgaacaggttgacagaagtcccactggctcaggagtgacagcccgaattgccttacagtatcacaaagggcttctggaactgaaccagatgagagccttcaaaagcagtgcaactggctcagtattcacagggaaagctgtgagggagctgttatgagaagaatctgggattgcaatgtccccccaaatagagagggagccgagagaccaaagaatgactcagacaagtccaggaagcgaaatgtggtgattttaaagctgttatagtggaagtatcaggacaagcccattacacgggtacagcaagctttataatagaagatgacgacccattgagggatggatttcttctcaagtgacttcttccatgattttaagggctttctttttaaagtaatcattatccttaaggactgttttctctaaattatatgaaaacaaataaattatacatataaa

SEQ ID NO: 300184 - DNA, 1916 bp, Homo sapiens
cgccctcctcccgcgggagtcagtgggtgagggtcgggcttgaagccatagctgcgggaccgtactcgtctcccccgacgcagaccatggagagcgcgctggcggtgccccggctgcccccgcatgatccagggacgccggtgctgtcggtggtggacatgcacacgggcggcgagcccttgcgtatcgtgctggcggggtgtccggaggtgtctgggcccaccctgctggccaagcggcgctacatgcgccagcaccttgaccacgtgcggcgacggctcatgttcgagccccgagggcaccgggacatgtacggggcggtcctagtcccgagcgagctgccggacgcgcatctgggcgtcctgttcctgcacaacgagggctacagctccatgtgcggccacgcagtgctggcgctgggccgcttcgctttggacttcgggcttgtgccggcgccccctgcgggcacccgcgaggcccgcgtcaatatccactgcccctgcgggctggtgaccgccttcgtggcatgcgaggacggccgcagccacggaccggtgcgcttccacagcgtcccggccttcgtgctggccacaggtaatgggcgggacctttccagcccagggcagagctgcaaccgggacgcgactaactacattaacggtttttctgggctggaactctggcaactaacctactccgcgaaaccttgcaattaatagaaaggtaaatcactgccaacgtgtgtcagcagccttgcgtatttggtgcgtgtaatttcgattttccctgactcccatccgcctgtggttttgggagacccttgaggagcgaggaattgcgtgttaccctgactcagcgcctccctctgcactggtgaggcattcctagagatttcaccggtggataaagcaagatctcatggtggatgttcctggacatggaaaggtgatggtggacattgcatatggcggtgcattttatgcatttgttactgctgaaaagttaggactagacatttgttctgcaaagaccagggaccttgtggatgcagcgagtgcagtgacagaggcagtgaaagctcagtttaaaattaatcatcctgatagtgaagaccttgcctttttatatggaactatattaacagatggaaaagatgcttataccaaggaaccaaccaccaacatttgtgtttttgcagatgaacaggttgacagaagtcccactggctcaggagtgacagcccgaattgccttacagtatcacaaagggcttctggaactgaaccagatgagagccttcaaaagcagtgcaactggctcagtattcacagggaaagctgtgagggagctgttatgagaagaatctgggattgcaatgtccccccaaatagagagggagccgagagaccaaagaatgactcagacaagtccaggaagcgaaatgtggtgattttaaagctgttatagtggaagtatcaggacaagcccattacacgggtacagcaagctttataatagaagatgacgacccattgagggatggatttcttctcaagtgacttcttccatgattttaagggctttctttttaaagtaatcattatccttaaggactgttttctctaaattatatgaaaacaaataaattatacatataaactaactctcattctttgtaaaatactaccctgtggctaaatataaagtcattatacctcgtatttgcaactgtatttgtataaatatcacttatgtctagcatacaaaatgccagaaattcagagtctttttctagtgattaacgtatcaggtaaaattaaaacagtagttacttttaaaatattgctctatagtaattactattaatatcatattttgtattaaaggctcttcgaataatatgtggaatttaactga

SEQ ID NO: 300185 - DNA, 1043 bp, Homo sapiens
cgccctcctcccgcgggagtcagtgggtgagggtcgggcttgaagccatagctgcgggaccgtactcgtctcccccgacgcagaccatggagagcgcgctggcggtgccccggctgcccccgcatgatccagggacgccggtgctgtcggtggtggacatgcacacgggcggcgagcccttgcgtatcgtgctggcggggtgtccggaggtgtctgggcccaccctgctggccaagcggcgctacatgcgccagcaccttgaccacgtgcggcgacggctcatgttcgagccccgagggcaccgggacatgtacggggcggtcctagtcccgagcgagctgccggacgcgcatctgggcgtcctgttcctgcacaacgagggctacagctccatgtgcggccacgcagtgctggcgctgggccgcttcgctttggacttcgggcttgtgccggcgccccctgcgggcacccgcgaggcccgcgtcaatatccactgcccctgcgggctggtgaccgccttcgtggcatgcgaggacggccgcagccacggaccggtgcgcttccacagcgtcccggccttcgtgctggccacaggtaatgggcgggacctttccagcccagggcagagctgcaaccgggacgcgactaactacattaacggtttttctgggctggaactctggcaactaacctactccgcgaaaccttgcaattaatagaaaggtaaatcactgccaacgtgtgtcagcagccttgcgtatttggtgcgtgtaatttcgattttccctgactcccatccgcctgtggttttgggagacccttgaggagcgaggaattgcgtgttaccctgactcagcgcctccctctgcactggtgaggcattcctagagatttcaccggtggataaagcaaggtacggtggggtcaaggaaagagcgaagaacagccaatgtaccagggttccaggctggctgagaatatgcttggtagacacagaatcacacttaataagttactaaacctggtctcctttcctcacctcc

SEQ ID NO: 300186 - DNA, 1634 bp, Homo sapiens
aaatttcttcactcagctctcagaagagaattttaaagcaggcctgtaaaaacttcttttcaactaggacattggttatccagtgtggtcttggggccccagcgggcccctaaggtcctttccatgggttcagagggtcaaaactgtgttcataataatgacattatttgcttttcactctcattctctcaagagtgtacagtggggttcttcagaggctacgatgtgatatgtgataacccaaccaattgaatgcagaagctagatatgagaacctagttgtcttctgttaagccagacatgaaacaggtttgcaaaaatatcaaacaatgccacttttctcataattttttttgttttggccagttattttcacaaaaatgtgttattcatatgttaatgtataatgggttatttttaaaatgaagtaatgaacagatatatccaattcctaatacagtaaatattgatagatataacttatataaagaaaaactctttggggtcctcaaatcttaaggtataaaagggtcctgagaccaaaaggtttgagaaccattaggatttggggtttttttttgtttttttgttttattttataatagtgttttatttgatataataggatgtgaaagccctgaaaagttgtggaacatcaaatttttgtaatggaataaaattttaaatgtgctaacagctaagtaatgaatcttatctcagtagtaaatgaaatctactacagaatgatctacattcagtaaattattctactcataaagagtcctttaacatagcaaacaatctatcctaatatagctgtttttaagatttggtgtttctgaatattagagtttccttaaggatctctacatcatatagtgatctgaaacatgtgaaaccatttatgttgtatgcaaaaatttggaacatactgtcttcaaaatctgaaatggaacataaaaataacaacatacatttattggatacttcactgtgcatcagtttccaagctaagcacttgatacatgccatctcatttaatcctcacaagaatcctacaaggagctgttatgagaagaatctgggattgcaatgtccccccaaatagagagggagccgagagaccaaagaatgactcagacaagtccaggaagcgaaatgtggtgattttaaagctgttatagtggaagtatcaggacaagcccattacacgggtacagcaagctttataatagaagatgacgacccattgagggatggatttcttctcaagtgacttcttccatgattttaagggctttctttttaaagtaatcattatccttaaggactgttttctctaaattatatgaaaacaaataaattatacatataaactaactctcattctttgtaaaatactaccctgtggctaaatataaagtcattatacctcgtatttgcaactgtatttgtataaatatcacttatgtctagcatacaaaatgccagaaattcagagtctttttctagtgattaacgtatcaggtaaaattaaaacagtagttacttttaaaatattgctctatagtaattactattaatatcatattttgtattaaaggctcttcgaataatatgtggaatttaactga

SEQ ID NO: 300187 - DNA, 1967 bp, Homo sapiens
  misc_feature (1008)..(1008): n is a, c, g, or t
gtgcacaataaatgtaatgcatttgaatcatcccaaaaccatccctgcacccccggtctgtagaaaaattgtctttcatgaaacccgtccctggtgccaaaaaggttggagaccactactctaaaagataaagatggttgggcatggtggctcacacttgtggtcccagcattttgggaagctgaggagggcagatcacctgagaccagcctgggcaacatggggaaaccctgtttctacaaaaagtacaaaaattagctggacctggtaatgcacacctgtagtctcagctactgaggaggctgaggtgagaggatcccttgagactgggagcttgaggctgtagtcagctgtgagcatgtcattgcactccatcttgggcaatggagcaagaccctgtctcagaaaaaaaggattaaaaaattttagccacaatattatttatcacacctaaaaattaataatttcctaccatcaaactacttaatcaatgttcaaaaagtagaaaacacgtttgcaaaactgagcacctttttcacttaagaataagttaggtcagatatttgcctttccttggtcagctctagaccaaggggaaatgcaagatgtaactactgaaacatagtggttggcatttggtggaatatttttgtttaaaacatggaagttattttatcatgagttacttctatagttctaactaattttagttagacaatgtattataaatgcagtgtagaattttgaacctcaaagaatctcatctagtatcatgaaatctatgccagtatgatgtaatcagtagaatgttgcttaactgggagcctttggcataccaacagaacagaacaaaacaaaaatctttcgcgtgtggaagaagaggtttttaagttcttctgaaaattatcatttcatttagattgctaacttcaaatgaatgagacattaccgtttcttgctatcaagatatttttcagagcttagcccaaataattttgagtattattntattgtaggaaaaaattgaaattacttccttttctggatagttttctgtttgagtgagatttgtgcattgattccctgatgttgatttttgttatgggggaaaaactggggacataatgggaagaggtatgtgactagcttgaaataggtttttctacatactaatctttgctattgagttctgtgtattacagcaaaatgaattttctaaaatacttaccatactacaatagttttgccttgcatgaaaacattctaataaatgaacaattactaattttgtttaatagataaatgtatctgataggtcttggcacatgggctttattcttaacagttttaaacctttagttttttgttcttttgctttacaatgtttctttctttttcttagaatgcatctactcatgcctcgaaatctcctgacagtgttaatggaagtgaaccaagcattcctcaggtctgttactaattgttattttagaaaataacaagtcatttcagagtgttggtcagtctgtgttaattattagcatctgactttacattgaaatggtgatgtccaaatattcagtacagtatatatggtaaacacaggtttgctcatggtttcttggaaaaagttttaaatgaaagcaagactgtattatttctcattttaaaaattaatgcaaggccaggcactgtggctcccgcctgtctgtaatcccagcactttgggaggctgaggtgggcggatcgcttgaggccaagagttcgagactagcttggccaacatggcaaaactctgtctctactaaaaatagaaaaagtcagccaggagtggcgcatgcctgaaatcccagctacttagttggctgaagcgtgagaatcgcttgaacccgggaggcatacgttgtcatgagctgagtttgtgccactgcactccagcctgagcaacagagtgaggctctgtctca

SEQ ID NO: 300188 - DNA, 8178 bp, Homo sapiens
ccctggcgcctggtatcagggacttcccgacgctggaagagttcagggaagggaagcgggcccctctggcaccgaagacacagaatcctagctacagctactaaagaaaagaacactatcaattagggcccgcgtcaggttctctggatctccccttctcccatccttgacgctcatccctgtgttctttgcggtgggcccgtcggccctgctgccatcgatagaagcagcactctccccgtctgatttcgcagggccaaagcccaggtgagagtcagggtagtgttcagactagcccacgctccggttctgagccgcgacggcggtctccgcacgcaacgaaatcaggcaggaccgaaccttgcgtcctccagtgcagcgagttcggaagcgaccggccgagcgcgcatgtgcgggacccgacattgtgcttgtcccatccggtgctccgtagttagcctctgtgagctccacgtaggccgcgcaagcgcccttggcgcacagttcacctgctgccgttgtcgtcgccgccgcggctcccggggctggatggggggccgaggccagccagtggcacccggaagaaagagacgcggcggcggcgacgccgacaccctcaggacgagtgtccggacttgcccacagcctcaaggaggagacggcgaggcccggcccccgctgtccctggtgtaaagaagtcgccgtagccgtcgcggccgggactccccgggctctcgcccttcaggtttcgttgacactcaggaccgtacgtacgctgcgccatgttcaagaaactgaagcaaaagatcagcgaggagcagcagcagctccagcaggcgctggctcctgctcaggcgtcctccaattcttcaacaccaacaagaatgaggagcaggacatcttcatttacagagcaacttgatgaaggtacacccaatagagagtcaggtgacacacagtcttttgcacagaagctccagctccgggtgccctccgtggagtctttgtttcgaagtccgataaaggaatctctattccggtcttcttctaaagagtctttggtacgaacatcttccagagaatccctgaatcgacttgacctggacagttctactgccagttttgatccaccctctgatatggatagcgaggctgaagacttggtagggaattcagacagtctcaacaaagaacagttgattcagcggttgcgaagaatggaacgaagcttaagtagctacaggggaaaatattctgagcttgttacagcttatcagatgcttcagagagagaagaaaaagctacaaggtatattaagtcagagtcaggataaatcacttcggagaatagcagaattaagagaggagctccaaatggaccagcaggcaaagaaacatctgcaagaggagtttgatgcatctttagaggagaaagatcagtatatcagtgttctccaaactcaggtttctctactgaaacaacgattacgaaatggcccgatgaatgttgatgtactgaaaccacttcctcagctggaaccacaggctgaagtcttcactaaagaagagaatccagaaagtgatggagagccagtagtggaagatggaacttctgtaaaaacactggaaacactccagcaaagagtgaagcgtcaagagaacctacttaagcgttgtaaggaaacaattcagtcacataaggaacaatgtacactattaactagtgaaaaagaagctctgcaagaacaactggatgaaagacttcaagaactagaaaagataaaggaccttcatatggccgagaagactaaacttatcactcagttgcgtgatgcaaagaacttaattgaacagcttgaacaagataagggaatggtaatcgcagagacaaaacgtcagatgcatgaaaccctggaaatgaaagaagaagaaattgctcaactccgtagtcgcatcaaacagatgactacccagggagaggaattacgggaacagaaagaaaagtccgaaagagctgcttttgaggaacttgaaaaagctttgagtacagcccaaaaaacagaggaagcacggagaaaactgaaggcagaaatggatgaacaaataaaaactatcgaaaaaacaagtgaggaggaacgcatcagtcttcaacaggaattaagtcgggtgaaacaggaggttgttgatgtaatgaaaaaatcctcagaagaacaaattgctaagctacagaagcttcatgaaaaggagctggccagaaaagagcaggaactgaccaagaagcttcagacccgagaaagggaatttcaggaacaaatgaaagtagctcttgaaaagagtcaatcagaatatttgaagatcagccaagaaaaagaacagcaagaatctttggccctagaagagttagagttgcagaaaaaagcaatcctcacagaaagtgaaaataaacttcgggaccttcagcaagaagcagagacttacagaactagaattcttgaattggaaagttctttggaaaaaagcttacaagaaaacaaaaatcagtcaaaagatttggctgttcatctggaagctgaaaaaaataagcacaataaggagattacagtcatggttgaaaaacacaagacagaattggaaagccttaagcatcagcaggatgccctttggactgaaaaactccaagtcttaaagcaacaatatcagactgaaatggaaaaacttagggaaaagtgtgaacaagaaaaagaaacattgttgaaagacaaagagattatcttccaggcccacatagaagaaatgaatgaaaagactttagaaaagcttgatgtgaagcaaacagaactagaatcattatcttctgaactgtcagaagtattaaaagcccgtcacaaactagaagaggaactttctgttctgaaagatcaaacagataaaatgaagcaggaattagaggccaagatggatgaacagaaaaatcatcaccagcagcaagttgacagtatcattaaagaacacgaggtatctatccagaggactgagaaggcattaaaagatcaaattaatcaacttgagcttctcttgaaggaaagggacaagcatttgaaagagcatcaggctcatgtagaaaatttagaggcagatattaaaaggtctgaaggggaactccagcaggcatctgctaagctggacgtttttcagtcttaccagagtgccacacatgagcagacaaaagcatatgaggaacagttggcccaattgcagcagaagttgttggatttggaaacagaaagaattcttcttaccaaacaggttgctgaagttgaagcacaaaagaaagatgtttgtactgagttagatgctcacaaaatccaggtgcaggacttaatgcagcaacttgaaaaacaaaatagtgaaatggagcaaaaagtaaaatctttaacccaagtctatgagtccaaacttgaagatggtaacaaagaacaggaacagacaaagcaaatcttggtggaaaaggaaaatatgattttacaaatgagagaaggacagaagaaagaaattgagatactcacacagaaattgtcagccaaggaggacagtattcatattttgaatgaggaatatgaaaccaaatttaaaaaccaagaaaaaaagatggaaaaagttaagcagaaagcaaaggagatgcaagaaacgttaaagaaaaaattactggatcaggaagccaaacttaagaaagagcttgaaaatactgctctagagcttagtcagaaagaaaaacagtttaatgccaaaatgctggaaatggcacaggctaactcagctggaatcagtgatgcagtgtcaagactggaaacaaaccaaaaagaacaaatagaaagtcttactgaggttcatcgacgagaactcaatgatgtcatatcaatctgggaaaagaaacttaatcagcaagctgaagaacttcaggaaatacatgaaatccaattacaggaaaaagaacaagaggtagcagaactgaaacaaaagatcctcctatttgggtgtgaaaaagaagagatgaacaaggaaataacatggctgaaggaagaaggtgttaagcaggatacaacattaaatgaattacaggaacagttaaagcagaagtctgcccatgtgaattctcttgcacaagatgaaactaaactgaaagctcatcttgaaaagctagaggttgacttgaataagtctctgaaggaaaatacttttcttcaagagcagctagttgaactgaagatgctggcagaagaagataagcggaaggtttctgagttgactagcaagttgaaaaccacagatgaagaattccagagtttgaaatcttcacatgaaaaaagtaacaaaagcctagaggacaagagcttggaatttaaaaaactgtctgaggaactagcgattcagctagatatttgctgtaagaaaaccgaagccttattagaagctaaaacaaatgagctaatcaacattagtagtagtaaaactaatgccattctttctaggatttctcattgtcagcaccgtacaactaaagttaaggaggcactgttaattaaaacttgcacagtttctgaattagaagcacaacttagacagttgacagaggagcaaaatacactaaatatttcttttcaacaggctactcatcagttagaagaaaaagaaaatcaaattaagagcatgaaggctgatattgaaagtcttgtaacagaaaaagaagccttacagaaggaaggaggcaatcagcaacaggctgcttctgaaaaggagtcttgtataacacagttgaagaaagagttatctgaaaacatcaatgctgtcacattgatgaaagaagagcttaaagaaaaaaaagttgagattagcagtcttagtaaacaactaactgatttgaatgttcagcttcaaaatagcatcagcctatccgaaaaagaagcagccatttcatcactaagaaagcagtatgatgaagaaaaatgtgaattgctggatcaggtgcaagatttatcttttaaagttgacactctgagtaaagagaaaatttctgctcttgagcaggtagatgactggtccaataaattctcagaatggaagaagaaagcacagtcaagatttacacagcatcaaaacactgttaaagaattgcagatccagcttgagttaaaatcaaaggaagcttatgaaaaggatgagcagataaatttattgaaggaagagcttgatcagcaaaataaaagatttgattgtttaaagggtgaaatggaagacgacaagagcaagatggagaaaaaggagtctaatttagaaacagagttaaagtctcaaacagcaagaattatggaattagaggaccatattacccagaaaactattgaaatagagtccttaaatgaagttcttaaaaattacaatcaacaaaaggatattgaacacaaagaattggttcagaaacttcaacattttcaagagttaggagaagaaaaggacaacagggttaaagaagctgaagaaaaaatcttaacacttgaaaaccaagtttattccatgaaagctgaacttgaaactaagaagaaagaattagaacatgtgaatttaagtgtgaaaagcaaagaggaggagttaaaggcattggaagataggcttgagtcagaaagtgctgcaaaattagcagagttgaagagaaaagctgaacaaaaaattgctgccattaagaagcagttgttatctcaaatggaagagaaagaagaacagtataaaaaaggtacagaaagccatttgagtgagctaaatacaaaattgcaggaaagagaaagggaagttcacatcttggaagaaaaacttaagtcagtggaaagttcacagtcagaaacattaattgtacccagatcagcaaaaaatgtggcagcatatactgaacaagaagaagcagattcccaaggctgtgtgcagaagacatatgaagaaaaaatcagtgttttacaaagaaacttaactgaaaaagaaaagctattgcagagggtagggcaggaaaaagaagagacagtttcttctcattttgaaatgcgatgccaataccaggagcgcttaataaagctagaacatgctgaggcaaagcaacatgaagatcaaagtatgataggtcatcttcaagaggagcttgaagaaaaaaacaagaaatattccttgatagtagcccagcatgtggaaaaagaaggaggtaaaaataacatacaggcaaagcaaaacttggaaaatgtgtttgacgacgtccagaaaaccctccaggagaaggaactaacctgtcagattttggagcaaaagataaaagagctggattcctgcttagtaagacagaaagaagtacatagagttgaaatggaagagttgacctcaaaatatgaaaaattacaggctttacaacagatggatggaagaaataaacccacagaacttttggaagaaaacactgaagaaaagtccaaatcacatttggtccaacccaaattgcttagtaacatggaagcccagcacaatgatctggagtttaaattagccggggcagaacgggagaaacagaaactgggcaaggagattgttagattgcagaaagaccttcgaatgttgagaaaggagcatcagcaagaattggaaatactaaagaaagaatatgatcaagaaagggaagagaaaatcaaacaggagcaggaagatcttgaactgaagcacaattccacattaaaacagctgatgagggagtttaatacacagctggcacaaaaggaacaagagctggaaatgaccataaaagaaactatcaataaggcccaggaggtggaggctgaacttttagaaagccatcaagaagagacaaatcagttacttaaaaaaattgctgagaaagatgatgatctaaaacgaacagccaaaagatatgaagaaatccttgatgctcgtgaagaagaaatgactgcaaaagtaagggacctgcagactcaacttgaggagctgcagaagaaataccagcaaaagctagagcaggaggagaaccctggcaatgataatgtaacaattatggagctacagacacagctagcacagaagacgactttaatcagtgattcgaaattgaaagagcaagagttcagagaacagattcacaatttagaagaccgtttgaagaaatatgaaaagaatgtatatgcaacaactgtggggacaccttacaaaggtggcaatttgtaccatacggatgtctcactctttggagaacctaccgaatttgagtatttgcgaaaagtgctttttgagtatatgatgggtcgtgagactaagaccatggcaaaagttataaccaccgtactgaagttccctgatgatcagactcagaaaattttggaaagagaagatgctcggctgatgtttacttcacctcgcagtggtatcttctgagtaaaccatcagtctgtgcttagttaacatgtgtcatggctccgatcttcatcttgaagaagagtgacattgggtgactgctgcttggaaaactgtccacacttgctactctttgagaatgaagttgtcattcagggcccctcatgtagccaaaagaccaagaaaaatctggcccacagataagttgcagactgcctttaaaatagattttatcagtggagaaatggtgatagttttttcttcagttttctcttgggaagagttttatgttgtttaaaagatattttgataacttaacctgctttatgggcttacataatattcctttcatccattctttttaaagaacggcttacctttcctatttatttttagggtgattttttaaaaagacttgtgcaatacattttgaggtgaaacttagtggattttttctgataaattagagcatttaattgactattttattcaggttgatctgttgaatatttgctaaagaccagttctttaagctaagacatgtaaaaaatcccaaatggcagtacctcattgtttacttagcttttgtacttatatttttcagaggaaaaaacactactgtaaattgtgaatagccaatacataactgtattgtatgcaaatctgtgattgttggcagtgtcatctctgagaaacagataaataaagtttatttactatataa

SEQ ID NO: 300189 - DNA, 1549 bp, Homo sapiens
ccctggcgcctggtatcagggacttcccgacgctggaagagttcagggaagggaagcgggcccctctggcaccgaagacacagaatcctagctacagctactaaagaaaagaacactatcaattagggcccgcgtcaggttctctggatctccccttctcccatccttgacgctcatccctgtgttctttgcggtgggcccgtcggccctgctgccatcgatagaagcagcactctccccgtctgatttcgcagggccaaagcccaggtgagagtcagggtagtgttcagactagcccacgctccggttctgagccgcgacggcggtctccgcacgcaacgaaatcaggcaggaccgaaccttgcgtcctccagtgcagcgagttcggaagcgaccggccgagcgcgcatgtgcgggacccgacattgtgcttgtcccatccggtgctccgtagttagcctctgtgagctccacgtaggccgcgcaagcgcccttggcgcacagttcacctgctgccgttgtcgtcgccgccgcggctcccggggctggatggggggccgaggccagccagtggcacccggaagaaagagacgcggcggcggcgacgccgacaccctcaggacgagtgtccggacttgcccacagcctcaaggaggagacggcgaggcccggcccccgctgtccctggtgtaaagaagtcgccgtagccgtcgcggccgggactccccgggctctcgcccttcaggtttcgttgacactcaggaccgtacgtacgctgcgccatgttcaagaaactgaagcaaaagatcagcgaggagcagcagcagctccagcaggcgctggctcctgctcaggtacgatggccgccgctctcctccctggttccgaatatctcttgaaccggcccgcggacgaaagaggcggggggagtggggaagttcttccgtgacctttaacccctaacccgcacttttcccaaactccggacccagaaggagctccgggcggtgcaggtcgtccgtaactcctgacctggattttcccatcgcaaaacttcatccagtcaatgagtggatgggggtggctggatccctcgtgacattccatctccgttaagagttttctcctaaggccagagtccgaacttgcatgatttctgatccatatttgaggttttcccactcatctgagaccccacgctgggaatgagggcggggtggaaaaacccgggtcccttgtgatatctgacctctgctcgaggtgtccccctctcttttgccagtcgtgagattttgtatggaatggccaggatcccgcacaattgaccctcgacggaagtctcctaattccaaacccaggtccagggattgaaggctggggagtagagccatcctgggtcaggctgctggtaggagcggtgggacctgaaagacgtggcggcgtggccgcgtccagcgcccgaggctgttcacgagttagtcacttcgcataacttggttaatccgggactgggcgggcggaggggcagacactctgcctgtccggagct

SEQ ID NO: 300190 - DNA, 1524 bp, Homo sapiens
ccctggcgcctggtatcagggacttcccgacgctggaagagttcagggaagggaagcgggcccctctggcaccgaagacacagaatcctagctacagctactaaagaaaagaacactatcaattagggcccgcgtcaggttctctggatctccccttctcccatccttgacgctcatccctgtgttctttgcggtgggcccgtcggccctgctgccatcgatagaagcagcactctccccgtctgatttcgcagggccaaagcccaggtgagagtcagggtagtgttcagactagcccacgctccggttctgagccgcgacggcggtctccgcacgcaacgaaatcaggcaggaccgaaccttgcgtcctccagtgcagcgagttcggaagcgaccggccgagcgcgcatgtgcgggacccgacattgtgcttgtcccatccggtgctccgtagttagcctctgtgagctccacgtaggccgcgcaagcgcccttggcgcacagttcacctgctgccgttgtcgtcgccgccgcggctcccggggctggatggggggccgaggccagccagtggcacccggaagaaagagacgcggcggcggcgacgccgacaccctcaggacgagtgtccggacttgcccacagcctcaaggaggagacggcgaggcccggcccccgctgtccctggtgtaaagaagtcgccgtagccgtcgcggccgggactccccgggctctcgcccttcaggtttcgttgacactcaggaccgtacgtacgctgcgccatgttcaagaaactgaagcaaaagatcagcgaggagcagcagcagctccagcaggcgctggctcctgctcaggcgtcctccaattcttcaacaccaacaagaatgaggagcaggacatcttcatttacagagcaacttgatgaaggtacacccaatagagagaatgcatctactcatgcctcgaaatctcctgacagtgttaatggaagtgaaccaagcattcctcagtcaggtgacacacagtctttgcacagaagctccagctccgggtgccctccgtggagtctttgtttcgaagtccgataaaggaatctctattccggtcttcttctaaagagtctttggtacgaacatcttccagagaatccctgaatcgacttgacctggacagttctactgccagttttgatccaccctctgatatggatagcgaggctgaagacttggtagggaattcagacagtctcaacaaagaacagttgattcagcggtgcgaagaatggaacgaagcttaagtagctacagggggaaatatacgggaggggatataaggtcgagtcagggataatcacttgcgggcatagcggcacatagagggagtccccaggggccactgcggccaagacaacttttgtcacagaggaccatggaggcccctttcagcgggcacaccagcattcggggtgtccgaaccagcgtctttacgacaacgccatacgaaggagccgagcagttagttact

SEQ ID NO: 300191 - DNA, 1286 bp, Homo sapiens
ccctggcgcctggtatcagggacttcccgacgctggaagagttcagggaagggaagcgggcccctctggcaccgaagacacagaatcctagctacagctactaaagaaaagaacactatcaattagggcccgcgtcaggttctctggatctccccttctcccatccttgacgctcatccctgtgttctttgcggtgggcccgtcggccctgctgccatcgatagaagcagcactctccccgtctgatttcgcagggccaaagcccaggtgagagtcagggtagtgttcagactagcccacgctccggttctgagccgcgacggcggtctccgcacgcaacgaaatcaggcaggaccgaaccttgcgtcctccagtgcagcgagttcggaagcgaccggccgagcgcgcatgtgcgggacccgacattgtgcttgtcccatccggtgctccgtagttagcctctgtgagctccacgtaggccgcgcaagcgcccttggcgcacagttcacctgctgccgttgtcgtcgccgccgcggctcccggggctggatggggggccgaggccagccagtggcacccggaagaaagagacgcggcggcggcgacgccgacaccctcaggacgagtgtccggacttgcccacagcctcaaggaggagacggcgaggcccggcccccgctgtccctggtgtaaagaagtcgccgtagccgtcgcggccgggactccccgggctctcgcccttcaggtttcgttgacactcaggaccgtacgtacgctgcgccatgttcaagaaactgaagcaaaagatcagcgaggagcagcagcagctccagcaggcgctggctcctgctcaggcgtcctccaattcttcaacaccaacaagaatgaggagcaggacatcttcatttacagagcaacttgatgaaggtacacccaatagagaggtaagtttggaattccttttctagtatacctctcaaaagaaactaatctaaaatgtatgctgttgataacaaaatgggaaacttttgacaggtcagctatttaattcctaggtagagtttttattagtaacacaattggtcttttttttttttttttcacaaatagcagttatgatttatgtctgtctgtctgtctgtatgtatgtatgtatgtttttgagacagggtctggttctgtcacccaggctagagtgtggtggcacgatcactgcacattgcagccttgaccttctggattcaagtgatcctctaacttcagcctcctgagtagctgggactata

SEQ ID NO: 300192 - DNA, 1075 bp, Homo sapiens
ccctggcgcctggtatcagggacttcccgacgctggaagagttcagggaagggaagcgggcccctctggcaccgaagacacagaatcctagctacagctactaaagaaaagaacactatcaattagggcccgcgtcaggttctctggatctccccttctcccatccttgacgctcatccctgtgttctttgcggtgggcccgtcggccctgctgccatcgatagaagcagcactctccccgtctgatttcgcagggccaaagcccaggtgagagtcagggtagtgttcagactagcccacgctccggttctgagccgcgacggcggtctccgcacgcaacgaaatcaggcaggaccgaaccttgcgtcctccagtgcagcgagttcggaagcgaccggccgagcgcgcatgtgcgggacccgacattgtgcttgtcccatccggtgctccgtagttagcctctgtgagctccacgtaggccgcgcaagcgcccttggcgcacagttcacctgctgccgttgtcgtcgccgccgcggctcccggggctggatggggggccgaggccagccagtggcacccggaagaaagagacgcggcggcggcgacgccgacaccctcaggacgagtgtccggacttgcccacagcctcaaggaggagacggcgaggcccggcccccgctgtccctggtgtaaagaagtcgccgtagccgtcgcggccgggactccccgggctctcgcccttcaggtttcgttgacactcaggaccgtacgtacgctgcgccatgttcaagaaactgaagcaaaagatcagcgaggagcagcagcagctccagcaggcgctggctcctgctcagatgaaggagtgaggctcgaagaggtgaagtaacttgcctaatgttacgcagctagtgttagagtcttcagaaaagtattaacacagaaggatatttgtgttaaaagacagaagcagcaggtgttggagttcttggttgtaagcaacaaaaagtcaatctaggtaagcagaaaaataatttattgaagactctttaccctacagaatttccctgaggtccca

SEQ ID NO: 300193 - DNA, 559 bp, Homo sapiens
  misc_feature (312)..(312): n is a, c, g, or t
aagacccgtctgagcagctgggaagaaaaatcaaacaggagcaggaagatcttgaactgaagcacaattccacattaaaacagctgatgagggagtttaatacacagctggcacaaaaggaacaagagctggaaatgaccataaaagaaactatcaataaggcccaggaggtggaggctgaccatgtccttggggaacaggaagtctcatactatggccaggacctggacctgggcccgggcctgggcctggacctgggcccgggcctgggcctggacctggcattggaggcataaacattccaggaggtgngggaggaggaagcccaggaggagggggtgggaaaggaatcatacttggcagagcaacttcatcaacaactaggggatcatttccatgatcaaactgacaaaggtcaccaagtacacaaaatcctctttcatcataatctctgcatcgcctcttggggggtaggtttcgaccaaaagaatgggaagagctatgattgttatagtaattagaccaactctcagttgtgttttcagagtggggagcggtg

SEQ ID NO: 300194 - DNA, 8181 bp, Homo sapiens
ccctggcgcctggtatcagggacttcccgacgctggaagagttcagggaagggaagcgggcccctctggcaccgaagacacagaatcctagctacagctactaaagaaaagaacactatcaattagggcccgcgtcaggttctctggatctccccttctcccatccttgacgctcatccctgtgttctttgcggtgggcccgtcggccctgctgccatcgatagaagcagcactctccccgtctgatttcgcagggccaaagcccaggtgagagtcagggtagtgttcagactagcccacgctccggttctgagccgcgacggcggtctccgcacgcaacgaaatcaggcaggaccgaaccttgcgtcctccagtgcagcgagttcggaagcgaccggccgagcgcgcatgtgcgggacccgacattgtgcttgtcccatccggtgctccgtagttagcctctgtgagctccacgtaggccgcgcaagcgcccttggcgcacagttcacctgctgccgttgtcgtcgccgccgcggctcccggggctggatggggggccgaggccagccagtggcacccggaagaaagagacgcggcggcggcgacgccgacaccctcaggacgagtgtccggacttgcccacagcctcaaggaggagacggcgaggcccggcccccgctgtccctggtgtaaagaagtcgccgtagccgtcgcggccgggactccccgggctctcgcccttcaggtttcgttgacactcaggaccgtacgtacgctgcgccatgttcaagaaactgaagcaaaagatcagcgaggagcagcagcagctccagcaggcgctggctcctgctcaggcgtcctccaattcttcaacaccaacaagaatgaggagcaggacatcttcatttacagagcaacttgatgaaggtacacccaatagagagaatgcatctactcatgcctcgaaatctcctgacagtgttaatggaagtgaaccaagcattcctcagtcaggtgacacacagtcttttgcacagaagctccagctccgggtgccctccgtggagtctttgtttcgaagtccgataaaggaatctctattccggtcttcttctaaagagtctttggtacgaacatcttccagagaatccctgaatcgacttgacctggacagttctactgccagttttgatccaccctctgatatggatagcgaggctgaagacttggtagggaattcagacagtctcaacaaagaacagttgattcagcggttgcgaagaatggaacgaagcttaagtagctacaggggaaaatattctgagcttgttacagcttatcagatgcttcagagagagaagaaaaagctacaaggtatattaagtcagagtcaggataaatcacttcggagaatagcagaattaagagaggagctccaaatggaccagcaggcaaagaaacatctgcaagaggagtttgatgcatctttagaggagaaagatcagtatatcagtgttctccaaactcaggtttctctactgaaacaacgattacgaaatggcccgatgaatgttgatgtactgaaaccacttcctcagctggaaccacaggctgaagtcttcactaaagaagagaatccagaaagtgatggagagccagtagtggaagatggaacttctgtaaaaacactggaaacactccagcaaagagtgaagcgtcaagagaacctacttaagcgttgtaaggaaacaattcagtcacataaggaacaatgtacactattaactagtgaaaaagaagctctgcaagaacaactggatgaaagacttcaagaactagaaaagataaaggaccttcatatggccgagaagactaaacttatcactcagttgcgtgatgcaaagaacttaattgaacagcttgaacaagataagggaatggtaatcgcagagacaaaacgtcagatgcatgaaaccctggaaatgaaagaagaagaaattgctcaactccgtagtcgcatcaaacagatgactacccagggagaggaattacgggaacagaaagaaaagtccgaaagagctgcttttgaggaacttgaaaaagctttgagtacagcccaaaaaacagaggaagcacggagaaaactgaaggcagaaatggatgaacaaataaaaactatcgaaaaaacaagtgaggaggaacgcatcagtcttcaacaggaattaagtcgggtgaaacaggaggttgttgatgtaatgaaaaaatcctcagaagaacaaattgctaagctacagaagcttcatgaaaaggagctggccagaaaagagcaggaactgaccaagaagcttcagacccgagaaagggaatttcaggaacaaatgaaagtagctcttgaaaagagtcaatcagaatatttgaagatcagccaagaaaaagaacagcaagaatctttggccctagaagagttagagttgcagaaaaaagcaatcctcacagaaagtgaaaataaacttcgggaccttcagcaagaagcagagacttacagaactagaattcttgaattggaaagttctttggaaaaaagcttacaagaaaacaaaaatcagtcaaaagatttggctgttcatctggaagctgaaaaaaataagcacaataaggagattacagtcatggttgaaaaacacaagacagaattggaaagccttaagcatcagcaggatgccctttggactgaaaaactccaagtcttaaagcaacaatatcagactgaaatggaaaaacttagggaaaagtgtgaacaagaaaaagaaacattgttgaaagacaaagagattatcttccaggcccacatagaagaaatgaatgaaaagactttagaaaagcttgatgtgaagcaaacagaactagaatcattatcttctgaactgtcagaagtattaaaagcccgtcacaaactagaagaggaactttctgttctgaaagatcaaacagataaaatgaagcaggaattagaggccaagatggatgaacagaaaaatcatcaccagcagcaagttgacagtatcattaaagaacacgaggtatctatccagaggactgagaaggcattaaaagatcaaattaatcaacttgagcttctcttgaaggaaagggacaagcatttgaaagagcatcaggctcatgtagaaaatttagaggcagatattaaaaggtctgaaggggaactccagcaggcatctgctaagctggacgtttttcagtcttaccagagtgccacacatgagcagacaaaagcatatgaggaacagttggcccaattgcagcagaagttgttggatttggaaacagaaagaattcttcttaccaaacaggttgctgaagttgaagcacaaaagaaagatgtttgtactgagttagatgctcacaaaatccaggtgcaggacttaatgcagcaacttgaaaaacaaaatagtgaaatggagcaaaaagtaaaatctttaacccaagtctatgagtccaaacttgaagatggtaacaaagaacaggaacagacaaagcaaatcttggtggaaaaggaaaatatgattttacaaatgagagaaggacagaagaaagaaattgagatactcacacagaaattgtcagccaaggaggacagtattcatattttgaatgaggaatatgaaaccaaatttaaaaaccaagaaaaaaagatggaaaaagttaagcagaaagcaaaggagatgcaagaaacgttaaagaaaaaattactggatcaggaagccaaacttaagaaagagcttgaaaatactgctctagagcttagtcagaaagaaaaacagtttaatgccaaaatgctggaaatggcacaggctaactcagctggaatcagtgatgcagtgtcaagactggaaacaaaccaaaaagaacaaatagaaagtcttactgaggttcatcgacgagaactcaatgatgtcatatcaatctgggaaaagaaacttaatcagcaagctgaagaacttcaggaaatacatgaaatccaattacaggaaaaagaacaagaggtagcagaactgaaacaaaagatcctcctatttgggtgtgaaaaagaagagatgaacaaggaaataacatggctgaaggaagaaggtgttaagcaggatacaacattaaatgaattacaggaacagttaaagcagaagtctgcccatgtgaattctcttgcacaagatgaaactaaactgaaagctcatcttgaaaagctagaggttgacttgaataagtctctgaaggaaaatacttttcttcaagagcagctagttgaactgaagatgctggcagaagaagataagcggaaggtttctgagttgactagcaagttgaaaaccacagatgaagaattccagagtttgaaatcttcacatgaaaaaagtaacaaaagcctagaggacaagagcttggaatttaaaaaactgtctgaggaactagcgattcagctagatatttgctgtaagaaaaccgaagccttattagaagctaaaacaaatgagctaatcaacattagtagtagtaaaactaatgccattctttctaggatttctcattgtcagcaccgtacaactaaagttaaggaggcactgttaattaaaacttgcacagtttctgaattagaagcacaacttagacagttgacagaggagcaaaatacactaaatatttcttttcaacaggctactcatcagttagaagaaaaagaaaatcaaattaagagcatgaaggctgatattgaaagtcttgtaacagaaaaagaagccttacagaaggaaggaggcaatcagcaacaggctgcttctgaaaaggagtcttgtataacacagttgaagaaagagttatctgaaaacatcaatgctgtcacattgatgaaagaagagcttaaagaaaaaaaagttgagattagcagtcttagtaaacaactaactgatttgaatgttcagcttcaaaatagcatcagcctatccgaaaaagaagcagccatttcatcactaagaaagcagtatgatgaagaaaaatgtgaattgctggatcaggtgcaagatttatcttttaaagttgacactctgagtaaagagaaaatttctgctcttgagcaggtagatgactggtccaataaattctcagaatggaagaagaaagcacagtcaagatttacacagcatcaaaacactgttaaagaattgcagatccagcttgagttaaaatcaaaggaagcttatgaaaaggatgagcagataaatttattgaaggaagagcttgatcagcaaaataaaagatttgattgtttaaagggtgaaatggaagacgacaagagcaagatggagaaaaaggagtctaatttagaaacagagttaaagtctcaaacagcaagaattatggaattagaggaccatattacccagaaaactattgaaatagagtccttaaatgaagttcttaaaaattacaatcaacaaaaggatattgaacacaaagaattggttcagaaacttcaacattttcaagagttaggagaagaaaaggacaacagggttaaagaagctgaagaaaaaatcttaacacttgaaaaccaagtttattccatgaaagctgaacttgaaactaagaagaaagaattagaacatgtgaatttaagtgtgaaaagcaaagaggaggagttaaaggcattggaagataggcttgagtcagaaagtgctgcaaaattagcagagttgaagagaaaagctgaacaaaaaattgctgccattaagaagcagttgttatctcaaatggaagagaaagaagaacagtataaaaaaggtacagaaagccatttgagtgagctaaatacaaaattgcaggaaagagaaagggaagttcacatcttggaagaaaaacttaagtcagtggaaagttcacagtcagaaacattaattgtacccagatcagcaaaaaatgtggcagcatatactgaacaagaagaagcagattcccaaggctgtgtgcagaagacatatgaagaaaaaatcagtgttttacaaagaaacttaactgaaaaagaaaagctattgcagagggtagggcaggaaaaagaagagacagtttcttctcattttgaaatgcgatgccaataccaggagcgcttaataaagctagaacatgctgaggcaaagcaacatgaagatcaaagtatgataggtcatcttcaagaggagcttgaagaaaaaaacaagaaatattccttgatagtagcccagcatgtggaaaaagaaggaggtaaaaataacatacaggcaaagcaaaacttggaaaatgtgtttgacgacgtccagaaaaccctccaggagaaggaactaacctgtcagattttggagcaaaagataaaagagctggattcctgcttagtaagacagaaagaagtacatagagttgaaatggaagagttgacctcaaaatatgaaaaattacaggctttacaacagatggatggaagaaataaacccacagaacttttggaagaaaacactgaagaaaagtccaaatcacatttggtccaacccaaattgcttagtaacatggaagcccagcacaatgatctggagtttaaattagccggggcagaacgggagaaacagaaactgggcaaggagattgttagattgcagaaagaccttcgaatgttgagaaaggagcatcagcaagaattggaaatactaaagaaagaatatgatcaagaaagggaagagaaaatcaaacaggagcaggaagatcttgaactgaagcacaattccacattaaaacagctgatgagggagtttaatacacagctggcacaaaaggaacaagagctggaaatgaccataaaagaaactatcaataaggcccaggaggtggaggctgaacttttagaaagccatcaagaagagacaaatcagttacttaaaaaaattgctgagaaagatgatgatctaaaacgaacagccaaaagatatgaagaaatccttgatgctcgtgaagaagaaatgactgcaaaagtaagggacctgcagactcaacttgaggagctgcagaagaaataccagcaaaagctagagcaggaggagaaccctggcaatgataatgtaacaattatggagctacagacacagctagcacagaagacgactttaatcagtgattcgaaattgaaagagcaagagttcagagaacagattcacaatttagaagaccgtttgaagaaatatgaaaagaatgtatatgcaacaactgtggggacaccttacaaaggtggcaatttgtaccatacggatgtctcactctttggagaacctaccgaatttgagtatttgcgaaaagtgctttttgagtatatgatgggtcgtgagactaagaccatggcaaaagttataaccaccgtactgaagttccctgatgatcagactcagaaaattttggaaagagaagatgctcggctgatgtcatggctccgatcttcatcttgaagaagagtgacattgggtgactgctgcttggaaaactgtccacacttgctactctttgagaatgaagttgtcattcagggcccctcatgtagccaaaagaccaagaaaaatctggcccacagataagttgcagactgcctttaaaatagattttatcagtggagaaatggtgatagttttttcttcagttttctcttgggaagagttttatgttgtttaaaagatattttgataacttaacctgctttatgggcttacataatattcctttcatccattctttttaaagaacggcttacctttcctatttatttttagggtgattttttaaaaagacttgtgcaatacattttgaggtgaaacttagtggattttttctgataaattagagcatttaattgactattttattcaggttgatctgttgaatatttgctaaagaccagttctttaagctaagacatgtaaaaaatcccaaatggcagtacctcattgtttacttagcttttgtacttatatttttcagaggaaaaaacactactgtaaattgtgaatagccaatacataactgtattgtatgcaaatctgtgattgttggcagtgtcatctctgagaaacagataaataaagtttatttactatataa

SEQ ID NO: 300195 - DNA, 8180 bp, Homo sapiens
ccctggcgcctggtatcagggacttcccgacgctggaagagttcagggaagggaagcgggcccctctggcaccgaagacacagaatcctagctacagctactaaagaaaagaacactatcaattagggcccgcgtcaggttctctggatctccccttctcccatccttgacgctcatccctgtgttctttgcggtgggcccgtcggccctgctgccatcgatagaagcagcactctccccgtctgatttcgcagggccaaagcccaggtgagagtcagggtagtgttcagactagcccacgctccggttctgagccgcgacggcggtctccgcacgcaacgaaatcaggcaggaccgaaccttgcgtcctccagtgcagcgagttcggaagcgaccggccgagcgcgcatgtgcgggacccgacattgtgcttgtcccatccggtgctccgtagttagcctctgtgagctccacgtaggccgcgcaagcgcccttggcgcacagttcacctgctgccgttgtcgtcgccgccgcggctcccggggctggatggggggccgaggccagccagtggcacccggaagaaagagacgcggcggcggcgacgccgacaccctcaggacgagtgtccggacttgcccacagcctcaaggaggagacggcgaggcccggcccccgctgtccctggtgtaaagaagtcgccgtagccgtcgcggccgggactccccgggctctcgcccttcaggtttcgttgacactcaggaccgtacgtacgctgcgccatgttcaagaaactgaagcaaaagatcagcgaggagcagcagcagctccagcaggcgctggctcctgctcaggcgtcctccaattcttcaacaccaacaagaatgaggagcaggacatcttcatttacagagcaacttgatgaaggtacacccaatagagagaatgcatctactcatgcctcgaaatctcctgacagtgttaatggaagtgaaccaagcattcctcagtcaggtgacacacagtctttgcacagaagctccagctccgggtgccctccgtggagtctttgtttcgaagtccgataaaggaatctctattccggtcttcttctaaagagtctttggtacgaacatcttccagagaatccctgaatcgacttgacctggacagttctactgccagttttgatccaccctctgatatggatagcgaggctgaagacttggtagggaattcagacagtctcaacaaagaacagttgattcagcggttgcgaagaatggaacgaagcttaagtagctacaggggaaaatattctgagcttgttacagcttatcagatgcttcagagagagaagaaaaagctacaaggtatattaagtcagagtcaggataaatcacttcggagaatagcagaattaagagaggagctccaaatggaccagcaggcaaagaaacatctgcaagaggagtttgatgcatctttagaggagaaagatcagtatatcagtgttctccaaactcaggtttctctactgaaacaacgattacgaaatggcccgatgaatgttgatgtactgaaaccacttcctcagctggaaccacaggctgaagtcttcactaaagaagagaatccagaaagtgatggagagccagtagtggaagatggaacttctgtaaaaacactggaaacactccagcaaagagtgaagcgtcaagagaacctacttaagcgttgtaaggaaacaattcagtcacataaggaacaatgtacactattaactagtgaaaaagaagctctgcaagaacaactggatgaaagacttcaagaactagaaaagataaaggaccttcatatggccgagaagactaaacttatcactcagttgcgtgatgcaaagaacttaattgaacagcttgaacaagataagggaatggtaatcgcagagacaaaacgtcagatgcatgaaaccctggaaatgaaagaagaagaaattgctcaactccgtagtcgcatcaaacagatgactacccagggagaggaattacgggaacagaaagaaaagtccgaaagagctgcttttgaggaacttgaaaaagctttgagtacagcccaaaaaacagaggaagcacggagaaaactgaaggcagaaatggatgaacaaataaaaactatcgaaaaaacaagtgaggaggaacgcatcagtcttcaacaggaattaagtcgggtgaaacaggaggttgttgatgtaatgaaaaaatcctcagaagaacaaattgctaagctacagaagcttcatgaaaaggagctggccagaaaagagcaggaactgaccaagaagcttcagacccgagaaagggaatttcaggaacaaatgaaagtagctcttgaaaagagtcaatcagaatatttgaagatcagccaagaaaaagaacagcaagaatctttggccctagaagagttagagttgcagaaaaaagcaatcctcacagaaagtgaaaataaacttcgggaccttcagcaagaagcagagacttacagaactagaattcttgaattggaaagttctttggaaaaaagcttacaagaaaacaaaaatcagtcaaaagatttggctgttcatctggaagctgaaaaaaataagcacaataaggagattacagtcatggttgaaaaacacaagacagaattggaaagccttaagcatcagcaggatgccctttggactgaaaaactccaagtcttaaagcaacaatatcagactgaaatggaaaaacttagggaaaagtgtgaacaagaaaaagaaacattgttgaaagacaaagagattatcttccaggcccacatagaagaaatgaatgaaaagactttagaaaagcttgatgtgaagcaaacagaactagaatcattatcttctgaactgtcagaagtattaaaagcccgtcacaaactagaagaggaactttctgttctgaaagatcaaacagataaaatgaagcaggaattagaggccaagatggatgaacagaaaaatcatcaccagcagcaagttgacagtatcattaaagaacacgaggtatctatccagaggactgagaaggcattaaaagatcaaattaatcaacttgagcttctcttgaaggaaagggacaagcatttgaaagagcatcaggctcatgtagaaaatttagaggcagatattaaaaggtctgaaggggaactccagcaggcatctgctaagctggacgtttttcagtcttaccagagtgccacacatgagcagacaaaagcatatgaggaacagttggcccaattgcagcagaagttgttggatttggaaacagaaagaattcttcttaccaaacaggttgctgaagttgaagcacaaaagaaagatgtttgtactgagttagatgctcacaaaatccaggtgcaggacttaatgcagcaacttgaaaaacaaaatagtgaaatggagcaaaaagtaaaatctttaacccaagtctatgagtccaaacttgaagatggtaacaaagaacaggaacagacaaagcaaatcttggtggaaaaggaaaatatgattttacaaatgagagaaggacagaagaaagaaattgagatactcacacagaaattgtcagccaaggaggacagtattcatattttgaatgaggaatatgaaaccaaatttaaaaaccaagaaaaaaagatggaaaaagttaagcagaaagcaaaggagatgcaagaaacgttaaagaaaaaattactggatcaggaagccaaacttaagaaagagcttgaaaatactgctctagagcttagtcagaaagaaaaacagtttaatgccaaaatgctggaaatggcacaggctaactcagctggaatcagtgatgcagtgtcaagactggaaacaaaccaaaaagaacaaatagaaagtcttactgaggttcatcgacgagaactcaatgatgtcatatcaatctgggaaaagaaacttaatcagcaagctgaagaacttcaggaaatacatgaaatccaattacaggaaaaagaacaagaggtagcagaactgaaacaaaagatcctcctatttgggtgtgaaaaagaagagatgaacaaggaaataacatggctgaaggaagaaggtgttaagcaggatacaacattaaatgaattacaggaacagttaaagcagaagtctgcccatgtgaattctcttgcacaagatgaaactaaactgaaagctcatcttgaaaagctagaggttgacttgaataagtctctgaaggaaaatacttttcttcaagagcagctagttgaactgaagatgctggcagaagaagataagcggaaggtttctgagttgactagcaagttgaaaaccacagatgaagaattccagagtttgaaatcttcacatgaaaaaagtaacaaaagcctagaggacaagagcttggaatttaaaaaactgtctgaggaactagcgattcagctagatatttgctgtaagaaaaccgaagccttattagaagctaaaacaaatgagctaatcaacattagtagtagtaaaactaatgccattctttctaggatttctcattgtcagcaccgtacaactaaagttaaggaggcactgttaattaaaacttgcacagtttctgaattagaagcacaacttagacagttgacagaggagcaaaatacactaaatatttcttttcaacaggctactcatcagttagaagaaaaagaaaatcaaattaagagcatgaaggctgatattgaaagtcttgtaacagaaaaagaagccttacagaaggaaggaggcaatcagcaacaggctgcttctgaaaaggagtcttgtataacacagttgaagaaagagttatctgaaaacatcaatgctgtcacattgatgaaagaagagcttaaagaaaaaaaagttgagattagcagtcttagtaaacaactaactgatttgaatgttcagcttcaaaatagcatcagcctatccgaaaaagaagcagccatttcatcactaagaaagcagtatgatgaagaaaaatgtgaattgctggatcaggtgcaagatttatcttttaaagttgacactctgagtaaagagaaaatttctgctcttgagcaggtagatgactggtccaataaattctcagaatggaagaagaaagcacagtcaagatttacacagcatcaaaacactgttaaagaattgcagatccagcttgagttaaaatcaaaggaagcttatgaaaaggatgagcagataaatttattgaaggaagagcttgatcagcaaaataaaagatttgattgtttaaagggtgaaatggaagacgacaagagcaagatggagaaaaaggagtctaatttagaaacagagttaaagtctcaaacagcaagaattatggaattagaggaccatattacccagaaaactattgaaatagagtccttaaatgaagttcttaaaaattacaatcaacaaaaggatattgaacacaaagaattggttcagaaacttcaacattttcaagagttaggagaagaaaaggacaacagggttaaagaagctgaagaaaaaatcttaacacttgaaaaccaagtttattccatgaaagctgaacttgaaactaagaagaaagaattagaacatgtgaatttaagtgtgaaaagcaaagaggaggagttaaaggcattggaagataggcttgagtcagaaagtgctgcaaaattagcagagttgaagagaaaagctgaacaaaaaattgctgccattaagaagcagttgttatctcaaatggaagagaaagaagaacagtataaaaaaggtacagaaagccatttgagtgagctaaatacaaaattgcaggaaagagaaagggaagttcacatcttggaagaaaaacttaagtcagtggaaagttcacagtcagaaacattaattgtacccagatcagcaaaaaatgtggcagcatatactgaacaagaagaagcagattcccaaggctgtgtgcagaagacatatgaagaaaaaatcagtgttttacaaagaaacttaactgaaaaagaaaagctattgcagagggtagggcaggaaaaagaagagacagtttcttctcattttgaaatgcgatgccaataccaggagcgcttaataaagctagaacatgctgaggcaaagcaacatgaagatcaaagtatgataggtcatcttcaagaggagcttgaagaaaaaaacaagaaatattccttgatagtagcccagcatgtggaaaaagaaggaggtaaaaataacatacaggcaaagcaaaacttggaaaatgtgtttgacgacgtccagaaaaccctccaggagaaggaactaacctgtcagattttggagcaaaagataaaagagctggattcctgcttagtaagacagaaagaagtacatagagttgaaatggaagagttgacctcaaaatatgaaaaattacaggctttacaacagatggatggaagaaataaacccacagaacttttggaagaaaacactgaagaaaagtccaaatcacatttggtccaacccaaattgcttagtaacatggaagcccagcacaatgatctggagtttaaattagccggggcagaacgggagaaacagaaactgggcaaggagattgttagattgcagaaagaccttcgaatgttgagaaaggagcatcagcaagaattggaaatactaaagaaagaatatgatcaagaaagggaagagaaaatcaaacaggagcaggaagatcttgaactgaagcacaattccacattaaaacagctgatgagggagtttaatacacagctggcacaaaaggaacaagagctggaaatgaccataaaagaaactatcaataaggcccaggaggtggaggctgaacttttagaaagccatcaagaagagacaaatcagttacttaaaaaaattgctgagaaagatgatgatctaaaacgaacagccaaaagatatgaagaaatccttgatgctcgtgaagaagaaatgactgcaaaagtaagggacctgcagactcaacttgaggagctgcagaagaaataccagcaaaagctagagcaggaggagaaccctggcaatgataatgtaacaattatggagctacagacacagctagcacagaagacgactttaatcagtgattcgaaattgaaagagcaagagttcagagaacagattcacaatttagaagaccgtttgaagaaatatgaaaagaatgtatatgcaacaactgtggggacaccttacaaaggtggcaatttgtaccatacggatgtctcactctttggagaacctaccgaatttgagtatttgcgaaaagtgctttttgagtatatgatgggtcgtgagactaagaccatggcaaaagttataaccaccgtactgaagttccctgatgatcagactcagaaaattttggaaagagaagatgctcggctgatgtcatggctccgatcttcatcttgaagaagagtgacattgggtgactgctgcttggaaaactgtccacacttgctactctttgagaatgaagttgtcattcagggcccctcatgtagccaaaagaccaagaaaaatctggcccacagataagttgcagactgcctttaaaatagattttatcagtggagaaatggtgatagttttttcttcagttttctcttgggaagagttttatgttgtttaaaagatattttgataacttaacctgctttatgggcttacataatattcctttcatccattctttttaaagaacggcttacctttcctatttatttttagggtgattttttaaaaagacttgtgcaatacattttgaggtgaaacttagtggattttttctgataaattagagcatttaattgactattttattcaggttgatctgttgaatatttgctaaagaccagttctttaagctaagacatgtaaaaaatcccaaatggcagtacctcattgtttacttagcttttgtacttatatttttcagaggaaaaaacactactgtaaattgtgaatagccaatacataactgtattgtatgcaaatctgtgattgttggcagtgtcatctctgagaaacagataaataaagtttatttactatataa

SEQ ID NO: 300196 - DNA, 7583 bp, Homo sapiens
ccttacgctaggtacgaggctgggtttatgtccggacttgcccacagcctcaaggaggagacggcgaggcccggcccccgctgtccctggtgtaaagaagtcgccgtagccgtcgcggccgggactccccgggctctcgcccttcaggtttcgttgacactcaggaccgtacgtacgctgcgccatgttcaagaaactgaagcaaaagatcagcgaggagcagcagcagctccagcaggcgctggctcctgctcaggcgtcctccaattcttcaacaccaacaagaatgaggagcaggacatcttcatttacagagcaacttgatgaaggtacacccaatagagagaatgcatctactcatgcctcgaaatctcctgacagtgttaatggaagtgaaccaagcattcctcagtcaggtgacacacagtcttttgcacagaagctccagctccgggtgccctccgtggagtctttgtttcgaagtccgataaaggaatctctattccggtcttcttctaaagagtctttggtacgaacatcttccagagaatccctgaatcgacttgacctggacagttctactgccagttttgatccaccctctgatatggatagcgaggctgaagacttggtagggaattcagacagtctcaacaaagaacagttgattcagcggttgcgaagaatggaacgaagcttaagtagctacaggggaaaatattctgagcttgttacagcttatcagatgcttcagagagagaagaaaaagctacaaggtatattaagtcagagtcaggataaatcacttcggagaatagcagaattaagagaggagctccaaatggaccagcaggcaaagaaacatctgcaagaggagtttgatgcatctttagaggagaaagatcagtatatcagtgttctccaaactcaggtttctctactgaaacaacgattacgaaatggcccgatgaatgttgatgtactgaaaccacttcctcagctggaaccacaggctgaagtcttcactaaagaagagaatccagaaagtgatggagagccagtagtggaagatggaacttctgtaaaaacactggaaacactccagcaaagagtgaagcgtcaagagaacctacttaagcgttgtaaggaaacaattcagtcacataaggaacaatgtacactattaactagtgaaaaagaagctctgcaagaacaactggatgaaagacttcaagaactagaaaagataaaggaccttcatatggccgagaagactaaacttatcactcagttgcgtgatgcaaagaacttaattgaacagcttgaacaagataagggaatggtaatcgcagagacaaaacgtcagatgcatgaaaccctggaaatgaaagaagaagaaattgctcaactccgtagtcgcatcaaacagatgactacccagggagaggaattacgggaacagaaagaaaagtccgaaagagctgcttttgaggaacttgaaaaagctttgagtacagcccaaaaaacagaggaagcacggagaaaactgaaggcagaaatggatgaacaaataaaaactatcgaaaaaacaagtgaggaggaacgcatcagtcttcaacaggaattaagtcgggtgaaacaggaggttgttgatgtaatgaaaaaatcctcagaagaacaaattgctaagctacagaagcttcatgaaaaggagctggccagaaaagagcaggaactgaccaagaagcttcagacccgagaaagggaatttcaggaacaaatgaaagtagctcttgaaaagagtcaatcagaatatttgaagatcagccaagaaaaagaacagcaagaatctttggccctagaagagttagagttgcagaaaaaagcaatcctcacagaaagtgaaaataaacttcgggaccttcagcaagaagcagagacttacagaactagaattcttgaattggaaagttctttggaaaaaagcttacaagaaaacaaaaatcagtcaaaagatttggctgttcatctggaagctgaaaaaaataagcacaataaggagattacagtcatggttgaaaaacacaagacagaattggaaagccttaagcatcagcaggatgccctttggactgaaaaactccaagtcttaaagcaacaatatcagactgaaatggaaaaacttagggaaaagtgtgaacaagaaaaagaaacattgttgaaagacaaagagattatcttccaggcccacatagaagaaatgaatgaaaagactttagaaaagcttgatgtgaagcaaacagaactagaatcattatcttctgaactgtcagaagtattaaaagcccgtcacaaactagaagaggaactttctgttctgaaagatcaaacagataaaatgaagcaggaattagaggccaagatggatgaacagaaaaatcatcaccagcagcaagttgacagtatcattaaagaacacgaggtatctatccagaggactgagaaggcattaaaagatcaaattaatcaacttgagcttctcttgaaggaaagggacaagcatttgaaagagcatcaggctcatgtagaaaatttagaggcagatattaaaaggtctgaaggggaactccagcaggcatctgctaagctggacgtttttcagtcttaccagagtgccacacatgagcagacaaaagcatatgaggaacagttggcccaattgcagcagaagttgttggatttggaaacagaaagaattcttcttaccaaacaggttgctgaagttgaagcacaaaagaaagatgtttgtactgagttagatgctcacaaaatccaggtgcaggacttaatgcagcaacttgaaaaacaaaatagtgaaatggagcaaaaagtaaaatctttaacccaagtctatgagtccaaacttgaagatggtaacaaagaacaggaacagacaaagcaaatcttggtggaaaaggaaaatatgattttacaaatgagagaaggacagaagaaagaaattgagatactcacacagaaattgtcagccaaggaggacagtattcatattttgaatgaggaatatgaaaccaaatttaaaaaccaagaaaaaaagatggaaaaagttaagcagaaagcaaaggagatgcaagaaacgttaaagaaaaaattactggatcaggaagccaaacttaagaaagagcttgaaaatactgctctagagcttagtcagaaagaaaaacagtttaatgccaaaatgctggaaatggcacaggctaactcagctggaatcagtgatgcagtgtcaagactggaaacaaaccaaaaagaacaaatagaaagtcttactgaggttcatcgacgagaactcaatgatgtcatatcaatctgggaaaagaaacttaatcagcaagctgaagaacttcaggaaatacatgaaatccaattacaggaaaaagaacaagaggtagcagaactgaaacaaaagatcctcctatttgggtgtgaaaaagaagagatgaacaaggaaataacatggctgaaggaagaaggtgttaagcaggatacaacattaaatgaattacaggaacagttaaagcagaagtctgcccatgtgaattctcttgcacaagatgaaactaaactgaaagctcatcttgaaaagctagaggttgacttgaataagtctctgaaggaaaatacttttcttcaagagcagctagttgaactgaagatgctggcagaagaagataagcggaaggtttctgagttgactagcaagttgaaaaccacagatgaagaattccagagtttgaaatcttcacatgaaaaaagtaacaaaagcctagaggacaagagcttggaatttaaaaaactgtctgaggaactagcgattcagctagatatttgctgtaagaaaaccgaagccttattagaagctaaaacaaatgagctaatcaacattagtagtagtaaaactaatgccattctttctaggatttctcattgtcagcaccgtacaactaaagttaaggaggcactgttaattaaaacttgcacagtttctgaattagaagcacaacttagacagttgacagaggagcaaaatacactaaatatttcttttcaacaggctactcatcagttagaagaaaaagaaaatcaaattaagagcatgaaggctgatattgaaagtcttgtaacagaaaaagaagccttacagaaggaaggaggcaatcagcaacaggctgcttctgaaaaggagtcttgtataacacagttgaagaaagagttatctgaaaacatcaatgctgtcacattgatgaaagaagagcttaaagaaaaaaaagttgagattagcagtcttagtaaacaactaactgatttgaatgttcagcttcaaaatagcatcagcctatccgaaaaagaagcagccatttcatcactaagaaagcagtatgatgaagaaaaatgtgaattgctggatcaggtgcaagatttatcttttaaagttgacactctgagtaaagagaaaatttctgctcttgagcaggtagatgactggtccaataaattctcagaatggaagaagaaagcacagtcaagatttacacagcatcaaaacactgttaaagaattgcagatccagcttgagttaaaatcaaaggaagcttatgaaaaggatgagcagataaatttattgaaggaagagcttgatcagcaaaataaaagatttgattgtttaaagggtgaaatggaagacgacaagagcaagatggagaaaaaggagtctaatttagaaacagagttaaagtctcaaacagcaagaattatggaattagaggaccatattacccagaaaactattgaaatagagtccttaaatgaagttcttaaaaattacaatcaacaaaaggatattgaacacaaagaattggttcagaaacttcaacattttcaagagttaggagaagaaaaggacaacagggttaaagaagctgaagaaaaaatcttaacacttgaaaaccaagtttattccatgaaagctgaacttgaaactaagaagaaagaattagaacatgtgaatttaagtgtgaaaagcaaagaggaggagttaaaggcattggaagataggcttgagtcagaaagtgctgcaaaattagcagagttgaagagaaaagctgaacaaaaaattgctgccattaagaagcagttgttatctcaaatggaagagaaagaagaacagtataaaaaaggtacagaaagccatttgagtgagctaaatacaaaattgcaggaaagagaaagggaagttcacatcttggaagaaaaacttaagtcagtggaaagttcacagtcagaaacattaattgtacccagatcagcaaaaaatgtggcagcatatactgaacaagaagaagcagattcccaaggctgtgtgcagaagacatatgaagaaaaaatcagtgttttacaaagaaacttaactgaaaaagaaaagctattgcagagggtagggcaggaaaaagaagagacagtttcttctcattttgaaatgcgatgccaataccaggagcgcttaataaagctagaacatgctgaggcaaagcaacatgaagatcaaagtatgataggtcatcttcaagaggagcttgaagaaaaaaacaagaaatattccttgatagtagcccagcatgtggaaaaagaaggaggtaaaaataacatacaggcaaagcaaaacttggaaaatgtgtttgacgacgtccagaaaaccctccaggagaaggaactaacctgtcagattttggagcaaaagataaaagagctggattcctgcttagtaagacagaaagaagtacatagagttgaaatggaagagttgacctcaaaatatgaaaaattacaggctttacaacagatggatggaagaaataaacccacagaacttttggaagaaaacactgaagaaaagtccaaatcacatttggtccaacccaaattgcttagtaacatggaagcccagcacaatgatctggagtttaaattagccggggcagaacgggagaaacagaaactgggcaaggagattgttagattgcagaaagaccttcgaatgttgagaaaggagcatcagcaagaattggaaatactaaagaaagaatatgatcaagaaagggaagagaaaatcaaacaggagcaggaagatcttgaactgaagcacaattccacattaaaacagctgatgagggagtttaatacacagctggcacaaaaggaacaagagctggaaatgaccataaaagaaactatcaataaggcccaggaggtggaggctgaacttttagaaagccatcaagaagagacaaatcagttacttaaaaaaattgctgagaaagatgatgatctaaaacgaacagccaaaagatatgaagaaatccttgatgctcgtgaagaagaaatgactgcaaaagtaagggacctgcagactcaacttgaggagctgcagaagaaataccagcaaaagctagagcaggaggagaaccctggcaatgataatgtaacaattatggagctacagacacagctagcacagaagacgactttaatcagtgattcgaaattgaaagagcaagagttcagagaacagattcacaatttagaagaccgtttgaagaaatatgaaaagaatgtatatgcaacaactgtggggacaccttacaaaggtggcaatttgtaccatacggatgtctcactctttggagaacctaccgaatttgagtatttgcgaaaagtgctttttgagtatatgatgggtcgtgagactaagaccatggcaaaagttataaccaccgtactgaagttccctgatgatcagactcagaaaattttggaaagagaagatgctcggctgatgtcatggctccgatcttcatcttgaagaagagtgacattgggtgactgctgcttggaaaactgtccacacttgctactctttgagaatgaagttgtcattcagggcccctcatgtagccaaaagaccaagaaaaatctggcccacagataagttgcagactgcctttaaaatagattttatcagtggagaaatggtgatagttttttcttcagttttctcttgggaagagttttatgttgtttaaaagatattttgataacttaacctgctttatgggcttacataatattcctttcatccattctttttaaagaacggcttacctttcctatttatttttagggtgattttttaaaaagacttgtgcaatacattttgaggtgaaacttagtggattttttctgataaattagagcatttaattgactattttattcaggttgatctgttgaatatttgctaaagaccagttctttaagctaagacatgtaaaaaatcccaaatggcagtacctcattgtttacttagcttttgtacttatatttttcagaggaaaaaacactactgtaaattgtgaatagccaatacataactgtattgtatgcaaatctgtgattgttggcagtgtcatctctgagaaacagataaataaagtttatttactatataa

SEQ ID NO: 300197 - DNA, 8639 bp, Homo sapiens
  misc_feature (1008)..(1008): n is a, c, g, or t
gtgcacaataaatgtaatgcatttgaatcatcccaaaaccatccctgcacccccggtctgtagaaaaattgtctttcatgaaacccgtccctggtgccaaaaaggttggagaccactactctaaaagataaagatggttgggcatggtggctcacacttgtggtcccagcattttgggaagctgaggagggcagatcacctgagaccagcctgggcaacatggggaaaccctgtttctacaaaaagtacaaaaattagctggacctggtaatgcacacctgtagtctcagctactgaggaggctgaggtgagaggatcccttgagactgggagcttgaggctgtagtcagctgtgagcatgtcattgcactccatcttgggcaatggagcaagaccctgtctcagaaaaaaaggattaaaaaattttagccacaatattatttatcacacctaaaaattaataatttcctaccatcaaactacttaatcaatgttcaaaaagtagaaaacacgtttgcaaaactgagcacctttttcacttaagaataagttaggtcagatatttgcctttccttggtcagctctagaccaaggggaaatgcaagatgtaactactgaaacatagtggttggcatttggtggaatatttttgtttaaaacatggaagttattttatcatgagttacttctatagttctaactaattttagttagacaatgtattataaatgcagtgtagaattttgaacctcaaagaatctcatctagtatcatgaaatctatgccagtatgatgtaatcagtagaatgttgcttaactgggagcctttggcataccaacagaacagaacaaaacaaaaatctttcgcgtgtggaagaagaggtttttaagttcttctgaaaattatcatttcatttagattgctaacttcaaatgaatgagacattaccgtttcttgctatcaagatatttttcagagcttagcccaaataattttgagtattattntattgtaggaaaaaattgaaattacttccttttctggatagttttctgtttgagtgagatttgtgcattgattccctgatgttgatttttgttatgggggaaaaactggggacataatgggaagaggtatgtgactagcttgaaataggtttttctacatactaatctttgctattgagttctgtgtattacagcaaaatgaattttctaaaatacttaccatactacaatagttttgccttgcatgaaaacattctaataaatgaacaattactaattttgtttaatagataaatgtatctgataggtcttggcacatgggctttattcttaacagttttaaacctttagttttttgttcttttgctttacaatgtttctttctttttcttagaatgcatctactcatgcctcgaaatctcctgacagtgttaatggaagtgaaccaagcattcctcagtcaggtgacacacagtcttttgcacagaagctccagctccgggtgccctccgtggagtctttgtttcgaagtccgataaaggaatctctattccggtcttcttctaaagagtctttggtacgaacatcttccagagaatccctgaatcgacttgacctggacagttctactgccagttttgatccaccctctgatatggatagcgaggctgaagacttggtagggaattcagacagtctcaacaaagaacagttgattcagcggttgcgaagaatggaacgaagcttaagtagctacaggggaaaatattctgagcttgttacagcttatcagatgcttcagagagagaagaaaaagctacaaggtatattaagtcagagtcaggataaatcacttcggagaatagcagaattaagagaggagctccaaatggaccagcaggcaaagaaacatctgcaagaggagtttgatgcatctttagaggagaaagatcagtatatcagtgttctccaaactcaggtttctctactgaaacaacgattacgaaatggcccgatgaatgttgatgtactgaaaccacttcctcagctggaaccacaggctgaagtcttcactaaagaagagaatccagaaagtgatggagagccagtagtggaagatggaacttctgtaaaaacactggaaacactccagcaaagagtgaagcgtcaagagaacctacttaagcgttgtaaggaaacaattcagtcacataaggaacaatgtacactattaactagtgaaaaagaagctctgcaagaacaactggatgaaagacttcaagaactagaaaagataaaggaccttcatatggccgagaagactaaacttatcactcagttgcgtgatgcaaagaacttaattgaacagcttgaacaagataagggaatggtaatcgcagagacaaaacgtcagatgcatgaaaccctggaaatgaaagaagaagaaattgctcaactccgtagtcgcatcaaacagatgactacccagggagaggaattacgggaacagaaagaaaagtccgaaagagctgcttttgaggaacttgaaaaagctttgagtacagcccaaaaaacagaggaagcacggagaaaactgaaggcagaaatggatgaacaaataaaaactatcgaaaaaacaagtgaggaggaacgcatcagtcttcaacaggaattaagtcgggtgaaacaggaggttgttgatgtaatgaaaaaatcctcagaagaacaaattgctaagctacagaagcttcatgaaaaggagctggccagaaaagagcaggaactgaccaagaagcttcagacccgagaaagggaatttcaggaacaaatgaaagtagctcttgaaaagagtcaatcagaatatttgaagatcagccaagaaaaagaacagcaagaatctttggccctagaagagttagagttgcagaaaaaagcaatcctcacagaaagtgaaaataaacttcgggaccttcagcaagaagcagagacttacagaactagaattcttgaattggaaagttctttggaaaaaagcttacaagaaaacaaaaatcagtcaaaagatttggctgttcatctggaagctgaaaaaaataagcacaataaggagattacagtcatggttgaaaaacacaagacagaattggaaagccttaagcatcagcaggatgccctttggactgaaaaactccaagtcttaaagcaacaatatcagactgaaatggaaaaacttagggaaaagtgtgaacaagaaaaagaaacattgttgaaagacaaagagattatcttccaggcccacatagaagaaatgaatgaaaagactttagaaaagcttgatgtgaagcaaacagaactagaatcattatcttctgaactgtcagaagtattaaaagcccgtcacaaactagaagaggaactttctgttctgaaagatcaaacagataaaatgaagcaggaattagaggccaagatggatgaacagaaaaatcatcaccagcagcaagttgacagtatcattaaagaacacgaggtatctatccagaggactgagaaggcattaaaagatcaaattaatcaacttgagcttctcttgaaggaaagggacaagcatttgaaagagcatcaggctcatgtagaaaatttagaggcagatattaaaaggtctgaaggggaactccagcaggcatctgctaagctggacgtttttcagtcttaccagagtgccacacatgagcagacaaaagcatatgaggaacagttggcccaattgcagcagaagttgttggatttggaaacagaaagaattcttcttaccaaacaggttgctgaagttgaagcacaaaagaaagatgtttgtactgagttagatgctcacaaaatccaggtgcaggacttaatgcagcaacttgaaaaacaaaatagtgaaatggagcaaaaagtaaaatctttaacccaagtctatgagtccaaacttgaagatggtaacaaagaacaggaacagacaaagcaaatcttggtggaaaaggaaaatatgattttacaaatgagagaaggacagaagaaagaaattgagatactcacacagaaattgtcagccaaggaggacagtattcatattttgaatgaggaatatgaaaccaaatttaaaaaccaagaaaaaaagatggaaaaagttaagcagaaagcaaaggagatgcaagaaacgttaaagaaaaaattactggatcaggaagccaaacttaagaaagagcttgaaaatactgctctagagcttagtcagaaagaaaaacagtttaatgccaaaatgctggaaatggcacaggctaactcagctggaatcagtgatgcagtgtcaagactggaaacaaaccaaaaagaacaaatagaaagtcttactgaggttcatcgacgagaactcaatgatgtcatatcaatctgggaaaagaaacttaatcagcaagctgaagaacttcaggaaatacatgaaatccaattacaggaaaaagaacaagaggtagcagaactgaaacaaaagatcctcctatttgggtgtgaaaaagaagagatgaacaaggaaataacatggctgaaggaagaaggtgttaagcaggatacaacattaaatgaattacaggaacagttaaagcagaagtctgcccatgtgaattctcttgcacaagatgaaactaaactgaaagctcatcttgaaaagctagaggttgacttgaataagtctctgaaggaaaatacttttcttcaagagcagctagttgaactgaagatgctggcagaagaagataagcggaaggtttctgagttgactagcaagttgaaaaccacagatgaagaattccagagtttgaaatcttcacatgaaaaaagtaacaaaagcctagaggacaagagcttggaatttaaaaaactgtctgaggaactagcgattcagctagatatttgctgtaagaaaaccgaagccttattagaagctaaaacaaatgagctaatcaacattagtagtagtaaaactaatgccattctttctaggatttctcattgtcagcaccgtacaactaaagttaaggaggcactgttaattaaaacttgcacagtttctgaattagaagcacaacttagacagttgacagaggagcaaaatacactaaatatttcttttcaacaggctactcatcagttagaagaaaaagaaaatcaaattaagagcatgaaggctgatattgaaagtcttgtaacagaaaaagaagccttacagaaggaaggaggcaatcagcaacaggctgcttctgaaaaggagtcttgtataacacagttgaagaaagagttatctgaaaacatcaatgctgtcacattgatgaaagaagagcttaaagaaaaaaaagttgagattagcagtcttagtaaacaactaactgatttgaatgttcagcttcaaaatagcatcagcctatccgaaaaagaagcagccatttcatcactaagaaagcagtatgatgaagaaaaatgtgaattgctggatcaggtgcaagatttatcttttaaagttgacactctgagtaaagagaaaatttctgctcttgagcaggtagatgactggtccaataaattctcagaatggaagaagaaagcacagtcaagatttacacagcatcaaaacactgttaaagaattgcagatccagcttgagttaaaatcaaaggaagcttatgaaaaggatgagcagataaatttattgaaggaagagcttgatcagcaaaataaaagatttgattgtttaaagggtgaaatggaagacgacaagagcaagatggagaaaaaggagtctaatttagaaacagagttaaagtctcaaacagcaagaattatggaattagaggaccatattacccagaaaactattgaaatagagtccttaaatgaagttcttaaaaattacaatcaacaaaaggatattgaacacaaagaattggttcagaaacttcaacattttcaagagttaggagaagaaaaggacaacagggttaaagaagctgaagaaaaaatcttaacacttgaaaaccaagtttattccatgaaagctgaacttgaaactaagaagaaagaattagaacatgtgaatttaagtgtgaaaagcaaagaggaggagttaaaggcattggaagataggcttgagtcagaaagtgctgcaaaattagcagagttgaagagaaaagctgaacaaaaaattgctgccattaagaagcagttgttatctcaaatggaagagaaagaagaacagtataaaaaaggtacagaaagccatttgagtgagctaaatacaaaattgcaggaaagagaaagggaagttcacatcttggaagaaaaacttaagtcagtggaaagttcacagtcagaaacattaattgtacccagatcagcaaaaaatgtggcagcatatactgaacaagaagaagcagattcccaaggctgtgtgcagaagacatatgaagaaaaaatcagtgttttacaaagaaacttaactgaaaaagaaaagctattgcagagggtagggcaggaaaaagaagagacagtttcttctcattttgaaatgcgatgccaataccaggagcgcttaataaagctagaacatgctgaggcaaagcaacatgaagatcaaagtatgataggtcatcttcaagaggagcttgaagaaaaaaacaagaaatattccttgatagtagcccagcatgtggaaaaagaaggaggtaaaaataacatacaggcaaagcaaaacttggaaaatgtgtttgacgacgtccagaaaaccctccaggagaaggaactaacctgtcagattttggagcaaaagataaaagagctggattcctgcttagtaagacagaaagaagtacatagagttgaaatggaagagttgacctcaaaatatgaaaaattacaggctttacaacagatggatggaagaaataaacccacagaacttttggaagaaaacactgaagaaaagtccaaatcacatttggtccaacccaaattgcttagtaacatggaagcccagcacaatgatctggagtttaaattagccggggcagaacgggagaaacagaaactgggcaaggagattgttagattgcagaaagaccttcgaatgttgagaaaggagcatcagcaagaattggaaatactaaagaaagaatatgatcaagaaagggaagagaaaatcaaacaggagcaggaagatcttgaactgaagcacaattccacattaaaacagctgatgagggagtttaatacacagctggcacaaaaggaacaagagctggaaatgaccataaaagaaactatcaataaggcccaggaggtggaggctgaacttttagaaagccatcaagaagagacaaatcagttacttaaaaaaattgctgagaaagatgatgatctaaaacgaacagccaaaagatatgaagaaatccttgatgctcgtgaagaagaaatgactgcaaaagtaagggacctgcagactcaacttgaggagctgcagaagaaataccagcaaaagctagagcaggaggagaaccctggcaatgataatgtaacaattatggagctacagacacagctagcacagaagacgactttaatcagtgattcgaaattgaaagagcaagagttcagagaacagattcacaatttagaagaccgtttgaagaaatatgaaaagaatgtatatgcaacaactgtggggacaccttacaaaggtggcaatttgtaccatacggatgtctcactctttggagaacctaccgaatttgagtatttgcgaaaagtgctttttgagtatatgatgggtcgtgagactaagaccatggcaaaagttataaccaccgtactgaagttccctgatgatcagactcagaaaattttggaaagagaagatgctcggctgatgtcatggctccgatcttcatcttgaagaagagtgacattgggtgactgctgcttggaaaactgtccacacttgctactctttgagaatgaagttgtcattcagggcccctcatgtagccaaaagaccaagaaaaatctggcccacagataagttgcagactgcctttaaaatagattttatcagtggagaaatggtgatagttttttcttcagttttctcttgggaagagttttatgttgtttaaaagatattttgataacttaacctgctttatgggcttacataatattcctttcatccattctttttaaagaacggcttacctttcctatttatttttagggtgattttttaaaaagacttgtgcaatacattttgaggtgaaacttagtggattttttctgataaattagagcatttaattgactattttattcaggttgatctgttgaatatttgctaaagaccagttctttaagctaagacatgtaaaaaatcccaaatggcagtacctcattgtttacttagcttttgtacttatatttttcagaggaaaaaacactactgtaaattgtgaatagccaatacataactgtattgtatgcaaatctgtgattgttggcagtgtcatctctgagaaacagataaataaagtttatttactatataa

SEQ ID NO: 300198 - DNA, 4420 bp, Homo sapiens
atgctgaggccgactctaaggatcccatgctcatcctcctgtgcacaggctaactcagctggaatcagtgatgcagtgtcaagactggaaacaaaccaaaaagaacaaatagaaagtcttactgaggttcatcgacgagaactcaatgatgtcatatcaatctgggaaaagaaacttaatcagcaagctgaagaacttcaggaaatacatgaaatccaattacaggaaaaagaacaagaggtagcagaactgaaacaaaagatcctcctatttgggtgtgaaaaagaagagatgaacaaggaaataacatggctgaaggaagaaggtgttaagcaggatacaacattaaatgaattacaggaacagttaaagcagaagtctgcccatgtgaattctcttgcacaagatgaaactaaactgaaagctcatcttgaaaagctagaggttgacttgaataagtctctgaaggaaaatacttttcttcaagagcagctagttgaactgaagatgctggcagaagaagataagcggaaggtttctgagttgactagcaagttgaaaaccacagatgaagaattccagagtttgaaatcttcacatgaaaaaagtaacaaaagcctagaggacaagagcttggaatttaaaaaactgtctgaggaactagcgattcagctagatatttgctgtaagaaaaccgaagccttattagaagctaaaacaaatgagctaatcaacattagtagtagtaaaactaatgccattctttctaggatttctcattgtcagcaccgtacaactaaagttaaggaggcactgttaattaaaacttgcacagtttctgaattagaagcacaacttagacagttgacagaggagcaaaatacactaaatatttcttttcaacaggctactcatcagttagaagaaaaagaaaatcaaattaagagcatgaaggctgatattgaaagtcttgtaacagaaaaagaagccttacagaaggaaggaggcaatcagcaacaggctgcttctgaaaaggagtcttgtataacacagttgaagaaagagttatctgaaaacatcaatgctgtcacattgatgaaagaagagcttaaagaaaaaaaagttgagattagcagtcttagtaaacaactaactgatttgaatgttcagcttcaaaatagcatcagcctatccgaaaaagaagcagccatttcatcactaagaaagcagtatgatgaagaaaaatgtgaattgctggatcaggtgcaagatttatcttttaaagttgacactctgagtaaagagaaaatttctgctcttgagcaggtagatgactggtccaataaattctcagaatggaagaagaaagcacagtcaagatttacacagcatcaaaacactgttaaagaattgcagatccagcttgagttaaaatcaaaggaagcttatgaaaaggatgagcagataaatttattgaaggaagagcttgatcagcaaaataaaagatttgattgtttaaagggtgaaatggaagacgacaagagcaagatggagaaaaaggagtctaatttagaaacagagttaaagtctcaaacagcaagaattatggaattagaggaccatattacccagaaaactattgaaatagagtccttaaatgaagttcttaaaaattacaatcaacaaaaggatattgaacacaaagaattggttcagaaacttcaacattttcaagagttaggagaagaaaaggacaacagggttaaagaagctgaagaaaaaatcttaacacttgaaaaccaagtttattccatgaaagctgaacttgaaactaagaagaaagaattagaacatgtgaatttaagtgtgaaaagcaaagaggaggagttaaaggcattggaagataggcttgagtcagaaagtgctgcaaaattagcagagttgaagagaaaagctgaacaaaaaattgctgccattaagaagcagttgttatctcaaatggaagagaaagaagaacagtataaaaaaggtacagaaagccatttgagtgagctaaatacaaaattgcaggaaagagaaagggaagttcacatcttggaagaaaaacttaagtcagtggaaagttcacagtcagaaacattaattgtacccagatcagcaaaaaatgtggcagcatatactgaacaagaagaagcagattcccaaggctgtgtgcagaagacatatgaagaaaaaatcagtgttttacaaagaaacttaactgaaaaagaaaagctattgcagagggtagggcaggaaaaagaagagacagtttcttctcattttgaaatgcgatgccaataccaggagcgcttaataaagctagaacatgctgaggcaaagcaacatgaagatcaaagtatgataggtcatcttcaagaggagcttgaagaaaaaaacaagaaatattccttgatagtagcccagcatgtggaaaaagaaggaggtaaaaataacatacaggcaaagcaaaacttggaaaatgtgtttgacgacgtccagaaaaccctccaggagaaggaactaacctgtcagattttggagcaaaagataaaagagctggattcctgcttagtaagacagaaagaagtacatagagttgaaatggaagagttgacctcaaaatatgaaaaattacaggctttacaacagatggatggaagaaataaacccacagaacttttggaagaaaacactgaagaaaagtccaaatcacatttggtccaacccaaattgcttagtaacatggaagcccagcacaatgatctggagtttaaattagccggggcagaacgggagaaacagaaactgggcaaggagattgttagattgcagaaagaccttcgaatgttgagaaaggagcatcagcaagaattggaaatactaaagaaagaatatgatcaagaaagggaagagaaaatcaaacaggagcaggaagatcttgaactgaagcacaattccacattaaaacagctgatgagggagtttaatacacagctggcacaaaaggaacaagagctggaaatgaccataaaagaaactatcaataaggcccaggaggtggaggctgaacttttagaaagccatcaagaagagacaaatcagttacttaaaaaaattgctgagaaagatgatgatctaaaacgaacagccaaaagatatgaagaaatccttgatgctcgtgaagaagaaatgactgcaaaagtaagggacctgcagactcaacttgaggagctgcagaagaaataccagcaaaagctagagcaggaggagaaccctggcaatgataatgtaacaattatggagctacagacacagctagcacagaagacgactttaatcagtgattcgaaattgaaagagcaagagttcagagaacagattcacaatttagaagaccgtttgaagaaatatgaaaagaatgtatatgcaacaactgtggggacaccttacaaaggtggcaatttgtaccatacggatgtctcactctttggagaacctaccgaatttgagtatttgcgaaaagtgctttttgagtatatgatgggtcgtgagactaagaccatggcaaaagttataaccaccgtactgaagttccctgatgatcagactcagaaaattttggaaagagaagatgctcggctgatgtttacttcacctcgcagtggtatcttctgagtaaaccatcagtctgtgcttagttaacatgtgtcatggctccgatcttcatcttgaagaagagtgacattgggtgactgctgcttggaaaactgtccacacttgctactctttgagaatgaagttgtcattcagggcccctcatgtagccaaaagaccaagaaaaatctggcccacagataagttgcagactgcctttaaaatagattttatcagtggagaaatggtgatagttttttcttcagttttctcttgggaagagttttatgttgtttaaaagatattttgataacttaacctgctttatgggcttacataatattcctttcatccattctttttaaagaacggcttacctttcctatttatttttagggtgattttttaaaaagacttgtgcaatacattttgaggtgaaacttagtggattttttctgataaattagagcatttaattgactattttattcaggttgatctgttgaatatttgctaaagaccagttctttaagctaagacatgtaaaaaatcccaaatggcagtacctcattgtttacttagcttttgtacttatatttttcagaggaaaaaacactactgtaaattgtgaatagccaatacataactgtattgtatgcaaatctgtgattgttggcagtgtcatctctgagaaacagataaataaagtttatttactatataa

SEQ ID NO: 300199 - DNA, 4363 bp, Homo sapiens
cccgccctagcttatcaggacacagaaagcaaaacaccataagtgaaaaaaatagaaagtcttactgaggttcatcgacgagaactcaatgatgtcatatcaatctgggaaaagaaacttaatcagcaagctgaagaacttcaggaaatacatgaaatccaattacaggaaaaagaacaagaggtagcagaactgaaacaaaagatcctcctatttgggtgtgaaaaagaagagatgaacaaggaaataacatggctgaaggaagaaggtgttaagcaggatacaacattaaatgaattacaggaacagttaaagcagaagtctgcccatgtgaattctcttgcacaagatgaaactaaactgaaagctcatcttgaaaagctagaggttgacttgaataagtctctgaaggaaaatacttttcttcaagagcagctagttgaactgaagatgctggcagaagaagataagcggaaggtttctgagttgactagcaagttgaaaaccacagatgaagaattccagagtttgaaatcttcacatgaaaaaagtaacaaaagcctagaggacaagagcttggaatttaaaaaactgtctgaggaactagcgattcagctagatatttgctgtaagaaaaccgaagccttattagaagctaaaacaaatgagctaatcaacattagtagtagtaaaactaatgccattctttctaggatttctcattgtcagcaccgtacaactaaagttaaggaggcactgttaattaaaacttgcacagtttctgaattagaagcacaacttagacagttgacagaggagcaaaatacactaaatatttcttttcaacaggctactcatcagttagaagaaaaagaaaatcaaattaagagcatgaaggctgatattgaaagtcttgtaacagaaaaagaagccttacagaaggaaggaggcaatcagcaacaggctgcttctgaaaaggagtcttgtataacacagttgaagaaagagttatctgaaaacatcaatgctgtcacattgatgaaagaagagcttaaagaaaaaaaagttgagattagcagtcttagtaaacaactaactgatttgaatgttcagcttcaaaatagcatcagcctatccgaaaaagaagcagccatttcatcactaagaaagcagtatgatgaagaaaaatgtgaattgctggatcaggtgcaagatttatcttttaaagttgacactctgagtaaagagaaaatttctgctcttgagcaggtagatgactggtccaataaattctcagaatggaagaagaaagcacagtcaagatttacacagcatcaaaacactgttaaagaattgcagatccagcttgagttaaaatcaaaggaagcttatgaaaaggatgagcagataaatttattgaaggaagagcttgatcagcaaaataaaagatttgattgtttaaagggtgaaatggaagacgacaagagcaagatggagaaaaaggagtctaatttagaaacagagttaaagtctcaaacagcaagaattatggaattagaggaccatattacccagaaaactattgaaatagagtccttaaatgaagttcttaaaaattacaatcaacaaaaggatattgaacacaaagaattggttcagaaacttcaacattttcaagagttaggagaagaaaaggacaacagggttaaagaagctgaagaaaaaatcttaacacttgaaaaccaagtttattccatgaaagctgaacttgaaactaagaagaaagaattagaacatgtgaatttaagtgtgaaaagcaaagaggaggagttaaaggcattggaagataggcttgagtcagaaagtgctgcaaaattagcagagttgaagagaaaagctgaacaaaaaattgctgccattaagaagcagttgttatctcaaatggaagagaaagaagaacagtataaaaaaggtacagaaagccatttgagtgagctaaatacaaaattgcaggaaagagaaagggaagttcacatcttggaagaaaaacttaagtcagtggaaagttcacagtcagaaacattaattgtacccagatcagcaaaaaatgtggcagcatatactgaacaagaagaagcagattcccaaggctgtgtgcagaagacatatgaagaaaaaatcagtgttttacaaagaaacttaactgaaaaagaaaagctattgcagagggtagggcaggaaaaagaagagacagtttcttctcattttgaaatgcgatgccaataccaggagcgcttaataaagctagaacatgctgaggcaaagcaacatgaagatcaaagtatgataggtcatcttcaagaggagcttgaagaaaaaaacaagaaatattccttgatagtagcccagcatgtggaaaaagaaggaggtaaaaataacatacaggcaaagcaaaacttggaaaatgtgtttgacgacgtccagaaaaccctccaggagaaggaactaacctgtcagattttggagcaaaagataaaagagctggattcctgcttagtaagacagaaagaagtacatagagttgaaatggaagagttgacctcaaaatatgaaaaattacaggctttacaacagatggatggaagaaataaacccacagaacttttggaagaaaacactgaagaaaagtccaaatcacatttggtccaacccaaattgcttagtaacatggaagcccagcacaatgatctggagtttaaattagccggggcagaacgggagaaacagaaactgggcaaggagattgttagattgcagaaagaccttcgaatgttgagaaaggagcatcagcaagaattggaaatactaaagaaagaatatgatcaagaaagggaagagaaaatcaaacaggagcaggaagatcttgaactgaagcacaattccacattaaaacagctgatgagggagtttaatacacagctggcacaaaaggaacaagagctggaaatgaccataaaagaaactatcaataaggcccaggaggtggaggctgaacttttagaaagccatcaagaagagacaaatcagttacttaaaaaaattgctgagaaagatgatgatctaaaacgaacagccaaaagatatgaagaaatccttgatgctcgtgaagaagaaatgactgcaaaagtaagggacctgcagactcaacttgaggagctgcagaagaaataccagcaaaagctagagcaggaggagaaccctggcaatgataatgtaacaattatggagctacagacacagctagcacagaagacgactttaatcagtgattcgaaattgaaagagcaagagttcagagaacagattcacaatttagaagaccgtttgaagaaatatgaaaagaatgtatatgcaacaactgtggggacaccttacaaaggtggcaatttgtaccatacggatgtctcactctttggagaacctaccgaatttgagtatttgcgaaaagtgctttttgagtatatgatgggtcgtgagactaagaccatggcaaaagttataaccaccgtactgaagttccctgatgatcagactcagaaaattttggaaagagaagatgctcggctgatgtttacttcacctcgcagtggtatcttctgagtaaaccatcagtctgtgcttagttaacatgtgtcatggctccgatcttcatcttgaagaagagtgacattgggtgactgctgcttggaaaactgtccacacttgctactctttgagaatgaagttgtcattcagggcccctcatgtagccaaaagaccaagaaaaatctggcccacagataagttgcagactgcctttaaaatagattttatcagtggagaaatggtgatagttttttcttcagttttctcttgggaagagttttatgttgtttaaaagatattttgataacttaacctgctttatgggcttacataatattcctttcatccattctttttaaagaacggcttacctttcctatttatttttagggtgattttttaaaaagacttgtgcaatacattttgaggtgaaacttagtggattttttctgataaattagagcatttaattgactattttattcaggttgatctgttgaatatttgctaaagaccagttctttaagctaagacatgtaaaaaatcccaaatggcagtacctcattgtttacttagcttttgtacttatatttttcagaggaaaaaacactactgtaaattgtgaatagccaatacataactgtattgtatgcaaatctgtgattgttggcagtgtcatctctgagaaacagataaataaagtttatttactatataa

SEQ ID NO: 300200 - DNA, 4044 bp, Homo sapiens
ttagcgtggtcgcggccgaggtacgcggggatgaaactaaactgaaagctcatcttgaaaagctagaggttgacttgaataagtctctgaaggaaaatacttttcttcaagagcagctagttgaactgaagatgctggcagaagaagataagcggaaggtttctgagttgactagcaagttgaaaaccacagatgaagaattccagagtttgaaatcttcacatgaaaaaagtaacaaaagcctagaggacaagagcttggaatttaaaaaactgtctgaggaactagcgattcagctagatatttgctgtaagaaaaccgaagccttattagaagctaaaacaaatgagctaatcaacattagtagtagtaaaactaatgccattctttctaggatttctcattgtcagcaccgtacaactaaagttaaggaggcactgttaattaaaacttgcacagtttctgaattagaagcacaacttagacagttgacagaggagcaaaatacactaaatatttcttttcaacaggctactcatcagttagaagaaaaagaaaatcaaattaagagcatgaaggctgatattgaaagtcttgtaacagaaaaagaagccttacagaaggaaggaggcaatcagcaacaggctgcttctgaaaaggagtcttgtataacacagttgaagaaagagttatctgaaaacatcaatgctgtcacattgatgaaagaagagcttaaagaaaaaaaagttgagattagcagtcttagtaaacaactaactgatttgaatgttcagcttcaaaatagcatcagcctatccgaaaaagaagcagccatttcatcactaagaaagcagtatgatgaagaaaaatgtgaattgctggatcaggtgcaagatttatcttttaaagttgacactctgagtaaagagaaaatttctgctcttgagcaggtagatgactggtccaataaattctcagaatggaagaagaaagcacagtcaagatttacacagcatcaaaacactgttaaagaattgcagatccagcttgagttaaaatcaaaggaagcttatgaaaaggatgagcagataaatttattgaaggaagagcttgatcagcaaaataaaagatttgattgtttaaagggtgaaatggaagacgacaagagcaagatggagaaaaaggagtctaatttagaaacagagttaaagtctcaaacagcaagaattatggaattagaggaccatattacccagaaaactattgaaatagagtccttaaatgaagttcttaaaaattacaatcaacaaaaggatattgaacacaaagaattggttcagaaacttcaacattttcaagagttaggagaagaaaaggacaacagggttaaagaagctgaagaaaaaatcttaacacttgaaaaccaagtttattccatgaaagctgaacttgaaactaagaagaaagaattagaacatgtgaatttaagtgtgaaaagcaaagaggaggagttaaaggcattggaagataggcttgagtcagaaagtgctgcaaaattagcagagttgaagagaaaagctgaacaaaaaattgctgccattaagaagcagttgttatctcaaatggaagagaaagaagaacagtataaaaaaggtacagaaagccatttgagtgagctaaatacaaaattgcaggaaagagaaagggaagttcacatcttggaagaaaaacttaagtcagtggaaagttcacagtcagaaacattaattgtacccagatcagcaaaaaatgtggcagcatatactgaacaagaagaagcagattcccaaggctgtgtgcagaagacatatgaagaaaaaatcagtgttttacaaagaaacttaactgaaaaagaaaagctattgcagagggtagggcaggaaaaagaagagacagtttcttctcattttgaaatgcgatgccaataccaggagcgcttaataaagctagaacatgctgaggcaaagcaacatgaagatcaaagtatgataggtcatcttcaagaggagcttgaagaaaaaaacaagaaatattccttgatagtagcccagcatgtggaaaaagaaggaggtaaaaataacatacaggcaaagcaaaacttggaaaatgtgtttgacgacgtccagaaaaccctccaggagaaggaactaacctgtcagattttggagcaaaagataaaagagctggattcctgcttagtaagacagaaagaagtacatagagttgaaatggaagagttgacctcaaaatatgaaaaattacaggctttacaacagatggatggaagaaataaacccacagaacttttggaagaaaacactgaagaaaagtccaaatcacatttggtccaacccaaattgcttagtaacatggaagcccagcacaatgatctggagtttaaattagccggggcagaacgggagaaacagaaactgggcaaggagattgttagattgcagaaagaccttcgaatgttgagaaaggagcatcagcaagaattggaaatactaaagaaagaatatgatcaagaaagggaagagaaaatcaaacaggagcaggaagatcttgaactgaagcacaattccacattaaaacagctgatgagggagtttaatacacagctggcacaaaaggaacaagagctggaaatgaccataaaagaaactatcaataaggcccaggaggtggaggctgaacttttagaaagccatcaagaagagacaaatcagttacttaaaaaaattgctgagaaagatgatgatctaaaacgaacagccaaaagatatgaagaaatccttgatgctcgtgaagaagaaatgactgcaaaagtaagggacctgcagactcaacttgaggagctgcagaagaaataccagcaaaagctagagcaggaggagaaccctggcaatgataatgtaacaattatggagctacagacacagctagcacagaagacgactttaatcagtgattcgaaattgaaagagcaagagttcagagaacagattcacaatttagaagaccgtttgaagaaatatgaaaagaatgtatatgcaacaactgtggggacaccttacaaaggtggcaatttgtaccatacggatgtctcactctttggagaacctaccgaatttgagtatttgcgaaaagtgctttttgagtatatgatgggtcgtgagactaagaccatggcaaaagttataaccaccgtactgaagttccctgatgatcagactcagaaaattttggaaagagaagatgctcggctgatgtttacttcacctcgcagtggtatcttctgagtaaaccatcagtctgtgcttagttaacatgtgtcatggctccgatcttcatcttgaagaagagtgacattgggtgactgctgcttggaaaactgtccacacttgctactctttgagaatgaagttgtcattcagggcccctcatgtagccaaaagaccaagaaaaatctggcccacagataagttgcagactgcctttaaaatagattttatcagtggagaaatggtgatagttttttcttcagttttctcttgggaagagttttatgttgtttaaaagatattttgataacttaacctgctttatgggcttacataatattcctttcatccattctttttaaagaacggcttacctttcctatttatttttagggtgattttttaaaaagacttgtgcaatacattttgaggtgaaacttagtggattttttctgataaattagagcatttaattgactattttattcaggttgatctgttgaatatttgctaaagaccagttctttaagctaagacatgtaaaaaatcccaaatggcagtacctcattgtttacttagcttttgtacttatatttttcagaggaaaaaacactactgtaaattgtgaatagccaatacataactgtattgtatgcaaatctgtgattgttggcagtgtcatctctgagaaacagataaataaagtttatttactatataa

SEQ ID NO: 300201 - DNA, 8699 bp, Homo sapiens
ccctggcgcctggtatcagggacttcccgacgctggaagagttcagggaagggaagcgggcccctctggcaccgaagacacagaatcctagctacagctactaaagaaaagaacactatcaattagggcccgcgtcaggttctctggatctccccttctcccatccttgacgctcatccctgtgttctttgcggtgggcccgtcggccctgctgccatcgatagaagcagcactctccccgtctgatttcgcagggccaaagcccaggtgagagtcagggtagtgttcagactagcccacgctccggttctgagccgcgacggcggtctccgcacgcaacgaaatcaggcaggaccgaaccttgcgtcctccagtgcagcgagttcggaagcgaccggccgagcgcgcatgtgcgggacccgacattgtgcttgtcccatccggtgctccgtagttagcctctgtgagctccacgtaggccgcgcaagcgcccttggcgcacagttcacctgctgccgttgtcgtcgccgccgcggctcccggggctggatggggggccgaggccagccagtggcacccggaagaaagagacgcggcggcggcgacgccgacaccctcaggacgagtgtccggacttgcccacagcctcaaggaggagacggcgaggcccggcccccgctgtccctggtgtaaagaagtcgccgtagccgtcgcggccgggactccccgggctctcgcccttcaggtttcgttgacactcaggaccgtacgtacgctgcgccatgttcaagaaactgaagcaaaagatcagcgaggagcagcagcagctccagcaggcgctggctcctgctcaggcgtcctccaattcttcaacaccaacaagaatgaggagcaggacatcttcatttacagagcaacttgatgaaggtacacccaatagagagaatgcatctactcatgcctcgaaatctcctgacagtgttaatggaagtgaaccaagcattcctcagtcaggtgacacacagtcttttgcacagaagctccagctccgggtgccctccgtggagtctttgtttcgaagtccgataaaggaatctctattccggtcttcttctaaagagtctttggtacgaacatcttccagagaatccctgaatcgacttgacctggacagttctactgccagttttgatccaccctctgatatggatagcgaggctgaagacttggtagggaattcagacagtctcaacaaagaacagttgattcagcggttgcgaagaatggaacgaagcttaagtagctacaggggaaaatattctgagcttgttacagcttatcagatgcttcagagagagaagaaaaagctacaaggtatattaagtcagagtcaggataaatcacttcggagaatagcagaattaagagaggagctccaaatggaccagcaggcaaagaaacatctgcaagaggagtttgatgcatctttagaggagaaagatcagtatatcagtgttctccaaactcaggtttctctactgaaacaacgattacgaaatggcccgatgaatgttgatgtactgaaaccacttcctcagctggaaccacaggctgaagtcttcactaaagaagagaatccagaaagtgatggagagccagtagtggaagatggaacttctgtaaaaacactggaaacactccagcaaagagtgaagcgtcaagagaacctacttaagcgttgtaaggaaacaattcagtcacataaggaacaatgtacactattaactagtgaaaaagaagctctgcaagaacaactggatgaaagacttcaagaactagaaaagataaaggaccttcatatggccgagaagactaaacttatcactcagttgcgtgatgcaaagaacttaattgaacagcttgaacaagataagggaatggtaatcgcagagacaaaacgtcagatgcatgaaaccctggaaatgaaagaagaagaaattgctcaactccgtagtcgcatcaaacagatgactacccagggagaggaattacgggaacagaaagaaaagtccgaaagagctgcttttgaggaacttgaaaaagctttgagtacagcccaaaaaacagaggaagcacggagaaaactgaaggcagaaatggatgaacaaataaaaactatcgaaaaaacaagtgaggaggaacgcatcagtcttcaacaggaattaagtcgggtgaaacaggaggttgttgatgtaatgaaaaaatcctcagaagaacaaattgctaagctacagaagcttcatgaaaaggagctggccagaaaagagcaggaactgaccaagaagcttcagacccgagaaagggaatttcaggaacaaatgaaagtagctcttgaaaagagtcaatcagaatatttgaagatcagccaagaaaaagaacagcaagaatctttggccctagaagagttagagttgcagaaaaaagcaatcctcacagaaagtgaaaataaacttcgggaccttcagcaagaagcagagacttacagaactagaattcttgaattggaaagttctttggaaaaaagcttacaagaaaacaaaaatcagtcaaaagatttggctgttcatctggaagctgaaaaaaataagcacaataaggagattacagtcatggttgaaaaacacaagacagaattggaaagccttaagcatcagcaggatgccctttggactgaaaaactccaagtcttaaagcaacaatatcagactgaaatggaaaaacttagggaaaagtgtgaacaagaaaaagaaacattgttgaaagacaaagagattatcttccaggcccacatagaagaaatgaatgaaaagactttagaaaagcttgatgtgaagcaaacagaactagaatcattatcttctgaactgtcagaagtattaaaagcccgtcacaaactagaagaggaactttctgttctgaaagatcaaacagataaaatgaagcaggaattagaggccaagatggatgaacagaaaaatcatcaccagcagcaagttgacagtatcattaaagaacacgaggtatctatccagaggactgagaaggcattaaaagatcaaattaatcaacttgagcttctcttgaaggaaagggacaagcatttgaaagagcatcaggctcatgtagaaaatttagaggcagatattaaaaggtctgaaggggaactccagcaggcatctgctaagctggacgtttttcagtcttaccagagtgccacacatgagcagacaaaagcatatgaggaacagttggcccaattgcagcagaagttgttggatttggaaacagaaagaattcttcttaccaaacaggttgctgaagttgaagcacaaaagaaagatgtttgtactgagttagatgctcacaaaatccaggtgcaggacttaatgcagcaacttgaaaaacaaaatagtgaaatggagcaaaaagtaaaatctttaacccaagtctatgagtccaaacttgaagatggtaacaaagaacaggaacagacaaagcaaatcttggtggaaaaggaaaatatgattttacaaatgagagaaggacagaagaaagaaattgagatactcacacagaaattgtcagccaaggaggacagtattcatattttgaatgaggaatatgaaaccaaatttaaaaaccaagaaaaaaagatggaaaaagttaagcagaaagcaaaggagatgcaagaaacgttaaagaaaaaattactggatcaggaagccaaacttaagaaagagcttgaaaatactgctctagagcttagtcagaaagaaaaacagtttaatgccaaaatgctggaaatggcacaggctaactcagctggaatcagtgatgcagtgtcaagactggaaacaaaccaaaaagaacaaatagaaagtcttactgaggttcatcgacgagaactcaatgatgtcatatcaatctgggaaaagaaacttaatcagcaagctgaagaacttcaggaaatacatgaaatccaattacaggaaaaagaacaagaggtagcagaactgaaacaaaagatcctcctatttgggtgtgaaaaagaagagatgaacaaggaaataacatggctgaaggaagaaggtgttaagcaggatacaacattaaatgaattacaggaacagttaaagcagaagtctgcccatgtgaattctcttgcacaagatgaaactaaactgaaagctcatcttgaaaagctagaggttgacttgaataagtctctgaaggaaaatacttttcttcaagagcagctagttgaactgaagatgctggcagaagaagataagcggaaggtttctgagttgactagcaagttgaaaaccacagatgaagaattccagagtttgaaatcttcacatgaaaaaagtaacaaaagcctagaggacaagagcttggaatttaaaaaactgtctgaggaactagcgattcagctagatatttgctgtaagaaaaccgaagccttattagaagctaaaacaaatgagctaatcaacattagtagtagtaaaactaatgccattctttctaggatttctcattgtcagcaccgtacaactaaagttaaggaggcactgttaattaaaacttgcacagtttctgaattagaagcacaacttagacagttgacagaggagcaaaatacactaaatatttcttttcaacaggctactcatcagttagaagaaaaagaaaatcaaattaagagcatgaaggctgatattgaaagtcttgtaacagaaaaagaagccttacagaaggaaggaggcaatcagcaacaggctgcttctgaaaaggagtcttgtataacacagttgaagaaagagttatctgaaaacatcaatgctgtcacattgatgaaagaagagcttaaagaaaaaaaagttgagattagcagtcttagtaaacaactaactgatttgaatgttcagcttcaaaatagcatcagcctatccgaaaaagaagcagccatttcatcactaagaaagcagtatgatgaagaaaaatgtgaattgctggatcaggtgcaagatttatcttttaaagttgacactctgagtaaagagaaaatttctgctcttgagcaggtagatgactggtccaataaattctcagaatggaagaagaaagcacagtcaagatttacacagcatcaaaacactgttaaagaattgcagatccagcttgagttaaaatcaaaggaagcttatgaaaaggatgagcagataaatttattgaaggaagagcttgatcagcaaaataaaagatttgattgtttaaagggtgaaatggaagacgacaagagcaagatggagaaaaaggagtctaatttagaaacagagttaaagtctcaaacagcaagaattatggaattagaggaccatattacccagaaaactattgaaatagagtccttaaatgaagttcttaaaaattacaatcaacaaaaggatattgaacacaaagaattggttcagaaacttcaacattttcaagagttaggagaagaaaaggacaacagggttaaagaagctgaagaaaaaatcttaacacttgaaaaccaagtttattccatgaaagctgaacttgaaactaagaagaaagaattagaacatgtgaatttaagtgtgaaaagcaaagaggaggagttaaaggcattggaagataggcttgagtcagaaagtgctgcaaaattagcagagttgaagagaaaagctgaacaaaaaattgctgccattaagaagcagttgttatctcaaatggaagagaaagaagaacagtataaaaaaggtacagaaagccatttgagtgagctaaatacaaaattgcaggaaagagaaagggaagttcacatcttggaagaaaaacttaagtcagtggaaagttcacagtcagaaacattaattgtacccagatcagcaaaaaatgtggcagcatatactgaacaagaagaagcagattcccaaggctgtgtgcagaagacatatgaagaaaaaatcagtgttttacaaagaaacttaactgaaaaagaaaagctattgcagagggtagggcaggaaaaagaagagacagtttcttctcattttgaaatgcgatgccaataccaggagcgcttaataaagctagaacatgctgaggcaaagcaacatgaagatcaaagtatgataggtcatcttcaagaggagcttgaagaaaaaaacaagaaatattccttgatagtagcccagcatgtggaaaaagaaggaggtaaaaataacatacaggcaaagcaaaacttggaaaatgtgtttgacgacgtccagaaaaccctccaggagaaggaactaacctgtcagattttggagcaaaagataaaagagctggattcctgcttagtaagacagaaagaagtacatagagttgaaatggaagagttgacctcaaaatatgaaaaattacaggctttacaacagatggatggaagaaataaacccacagaacttttggaagaaaacactgaagaaaagtccaaatcacatttggtccaacccaaattgcttagtaacatggaagcccagcacaatgatctggagtttaaattagccggggcagaacgggagaaacagaaactgggcaaggagattgttagattgcagaaagaccttcgaatgttgagaaaggagcatcagcaagaattggaaatactaaagaaagaatatgatcaagaaagggaagagaaaatcaaacaggagcaggaagatcttgaactgaagcacaattccacattaaaacagctgatgagggagtttaatacacagctggcacaaaaggaacaagagctggaaatgaccataaaagaaactatcaataaggcccaggaggtggaggctgaacttttagaaagccatcaagaagagacaaatcagttacttaaaaaaattgctgagaaagatgatgatctaaaacgaacagccaaaagatatgaagaaatccttgatgctcgtgaagaagaaatgactgcaaaagtaagggacctgcagactcaacttgaggagctgcagaagaaataccagcaaaagctagagcaggaggagaaccctggcaatgataatgtaacaattatggagctacagacacagctagcacagaagacgactttaatcagtgattcgaaattgaaagagcaagagttcagagaacagattcacaatttagaagaccgtttgaagaaatatgaaaagaatgtatatgcaacaactgtggggacaccttacaaaggtggcaatttgtaccatacggatgtctcactctttggagaacctaccgaatttgagtatttgcgaaaagtgctttttgagtatatgatgggtcgtgagactaagaccatggcaaaagttataaccaccgtactgaagttccctgatgatcagactcagaaaattttggaaagagaagatgctcggctgatgtttacttcacctcgcagtggtatcttctgagtaaaccatcagtctgtgcttagttaacatgtgtcatggctccgatcttcatcttgaagaagagtgacattgggtgactgctgcttggaaaactgtccacacttgctactctttgagaatgaagttgtcattcagggcccctcatgtagccaaaagaccaagaaaaatctggcccacagataagttgcagactgcctttaaaatagattttatcagtggagaaatggtgatagttttttcttcagttttctcttgggaagagttttatgttgtttaaaagatattttgataacttaacctgctttatgggcttacataatattcctttcatccattctttttaaagaacggcttacctttcctatttatttttagggtgattttttaaaaagacttgtgcaatacattttgaggtgaaacttagtggattttttctgataaattagagcatttaattgactattttattcaggttgatctgttgaatatttgctaaagaccagttctttaagctaagacatgtaaaaaatcccaaatggcagtacctcattgtttacttagcttttgtacttatatttttcagaggaaaaaacactactgtaaattgtgaatagccaatacataactgtattgtatgcaaatctgtgattgttggcagtgtcatctctgagaaacagataaataaagtttatttactatataaaaaaaaaaaaaaaagacaaaacaaaacaaacacaaagaaaacacaaacagaaaaagaccagcaacaacgaagcaacagagcaaaagagaacacaccagacgagggcgcccacaggtagacaggaacgggcccccccccgcggccccgcgatccgcggcacgcggggcccctacagacacagccgtgtcacgagcgaatcacggagagtcaccactcgtgactcatagatacgaacggagagatccaaagcacacgggaccgacaaccaacctgtggggaaaaacaacaaaacatcacgcatgggcagcacatacaaaggcaagaaaaccacaaacgactcgacgaggtaaaacagccattacaagcacataccagtcacactagacgatcgacaaataaaagttgaccgcaaaacaacgaagctaacgtacggaagatagaatacccgtccgtgc

SEQ ID NO: 300202 - DNA, 8455 bp, Homo sapiens
ccctggcgcctggtatcagggacttcccgacgctggaagagttcagggaagggaagcgggcccctctggcaccgaagacacagaatcctagctacagctactaaagaaaagaacactatcaattagggcccgcgtcaggttctctggatctccccttctcccatccttgacgctcatccctgtgttctttgcggtgggcccgtcggccctgctgccatcgatagaagcagcactctccccgtctgatttcgcagggccaaagcccaggtgagagtcagggtagtgttcagactagcccacgctccggttctgagccgcgacggcggtctccgcacgcaacgaaatcaggcaggaccgaaccttgcgtcctccagtgcagcgagttcggaagcgaccggccgagcgcgcatgtgcgggacccgacattgtgcttgtcccatccggtgctccgtagttagcctctgtgagctccacgtaggccgcgcaagcgcccttggcgcacagttcacctgctgccgttgtcgtcgccgccgcggctcccggggctggatggggggccgaggccagccagtggcacccggaagaaagagacgcggcggcggcgacgccgacaccctcaggacgagtgtccggacttgcccacagcctcaaggaggagacggcgaggcccggcccccgctgtccctggtgtaaagaagtcgccgtagccgtcgcggccgggactccccgggctctcgcccttcaggtttcgttgacactcaggaccgtacgtacgctgcgccatgttcaagaaactgaagcaaaagatcagcgaggagcagcagcagctccagcaggcgctggctcctgctcaggcgtcctccaattcttcaacaccaacaagaatgaggagcaggacatcttcatttacagagcaacttgatgaaggtacacccaatagagagaatgcatctactcatgcctcgaaatctcctgacagtgttaatggaagtgaaccaagcattcctcagtcaggtgacacacagtcttttgcacagaagctccagctccgggtgccctccgtggagtctttgtttcgaagtccgataaaggaatctctattccggtcttcttctaaagagtctttggtacgaacatcttccagagaatccctgaatcgacttgacctggacagttctactgccagttttgatccaccctctgatatggatagcgaggctgaagacttggtagggaattcagacagtctcaacaaagaacagttgattcagcggttgcgaagaatggaacgaagcttaagtagctacaggggaaaatattctgagcttgttacagcttatcagatgcttcagagagagaagaaaaagctacaaggtatattaagtcagagtcaggataaatcacttcggagaatagcagaattaagagaggagctccaaatggaccagcaggcaaagaaacatctgcaagaggagtttgatgcatctttagaggagaaagatcagtatatcagtgttctccaaactcaggtttctctactgaaacaacgattacgaaatggcccgatgaatgttgatgtactgaaaccacttcctcagctggaaccacaggctgaagtcttcactaaagaagagaatccagaaagtgatggagagccagtagtggaagatggaacttctgtaaaaacactggaaacactccagcaaagagtgaagcgtcaagagaacctacttaagcgttgtaaggaaacaattcagtcacataaggaacaatgtacactattaactagtgaaaaagaagctctgcaagaacaactggatgaaagacttcaagaactagaaaagataaaggaccttcatatggccgagaagactaaacttatcactcagttgcgtgatgcaaagaacttaattgaacagcttgaacaagataagggaatggtaatcgcagagacaaaacgtcagatgcatgaaaccctggaaatgaaagaagaagaaattgctcaactccgtagtcgcatcaaacagatgactacccagggagaggaattacgggaacagaaagaaaagtccgaaagagctgcttttgaggaacttgaaaaagctttgagtacagcccaaaaaacagaggaagcacggagaaaactgaaggcagaaatggatgaacaaataaaaactatcgaaaaaacaagtgaggaggaacgcatcagtcttcaacaggaattaagtcgggtgaaacaggaggttgttgatgtaatgaaaaaatcctcagaagaacaaattgctaagctacagaagcttcatgaaaaggagctggccagaaaagagcaggaactgaccaagaagcttcagacccgagaaagggaatttcaggaacaaatgaaagtagctcttgaaaagagtcaatcagaatatttgaagatcagccaagaaaaagaacagcaagaatctttggccctagaagagttagagttgcagaaaaaagcaatcctcacagaaagtgaaaataaacttcgggaccttcagcaagaagcagagacttacagaactagaattcttgaattggaaagttctttggaaaaaagcttacaagaaaacaaaaatcagtcaaaagatttggctgttcatctggaagctgaaaaaaataagcacaataaggagattacagtcatggttgaaaaacacaagacagaattggaaagccttaagcatcagcaggatgccctttggactgaaaaactccaagtcttaaagcaacaatatcagactgaaatggaaaaacttagggaaaagtgtgaacaagaaaaagaaacattgttgaaagacaaagagattatcttccaggcccacatagaagaaatgaatgaaaagactttagaaaagcttgatgtgaagcaaacagaactagaatcattatcttctgaactgtcagaagtattaaaagcccgtcacaaactagaagaggaactttctgttctgaaagatcaaacagataaaatgaagcaggaattagaggccaagatggatgaacagaaaaatcatcaccagcagcaagttgacagtatcattaaagaacacgaggtatctatccagaggactgagaaggcattaaaagatcaaattaatcaacttgagcttctcttgaaggaaagggacaagcatttgaaagagcatcaggctcatgtagaaaatttagaggcagatattaaaaggtctgaaggggaactccagcaggcatctgctaagctggacgtttttcagtcttaccagagtgccacacatgagcagacaaaagcatatgaggaacagttggcccaattgcagcagaagttgttggatttggaaacagaaagaattcttcttaccaaacaggttgctgaagttgaagcacaaaagaaagatgtttgtactgagttagatgctcacaaaatccaggtgcaggacttaatgcagcaacttgaaaaacaaaatagtgaaatggagcaaaaagtaaaatctttaacccaagtctatgagtccaaacttgaagatggtaacaaagaacaggaacagacaaagcaaatcttggtggaaaaggaaaatatgattttacaaatgagagaaggacagaagaaagaaattgagatactcacacagaaattgtcagccaaggaggacagtattcatattttgaatgaggaatatgaaaccaaatttaaaaaccaagaaaaaaagatggaaaaagttaagcagaaagcaaaggagatgcaagaaacgttaaagaaaaaattactggatcaggaagccaaacttaagaaagagcttgaaaatactgctctagagcttagtcagaaagaaaaacagtttaatgccaaaatgctggaaatggcacaggctaactcagctggaatcagtgatgcagtgtcaagactggaaacaaaccaaaaagaacaaatagaaagtcttactgaggttcatcgacgagaactcaatgatgtcatatcaatctgggaaaagaaacttaatcagcaagctgaagaacttcaggaaatacatgaaatccaattacaggaaaaagaacaagaggtagcagaactgaaacaaaagatcctcctatttgggtgtgaaaaagaagagatgaacaaggaaataacatggctgaaggaagaaggtgttaagcaggatacaacattaaatgaattacaggaacagttaaagcagaagtctgcccatgtgaattctcttgcacaagatgaaactaaactgaaagctcatcttgaaaagctagaggttgacttgaataagtctctgaaggaaaatacttttcttcaagagcagctagttgaactgaagatgctggcagaagaagataagcggaaggtttctgagttgactagcaagttgaaaaccacagatgaagaattccagagtttgaaatcttcacatgaaaaaagtaacaaaagcctagaggacaagagcttggaatttaaaaaactgtctgaggaactagcgattcagctagatatttgctgtaagaaaaccgaagccttattagaagctaaaacaaatgagctaatcaacattagtagtagtaaaactaatgccattctttctaggatttctcattgtcagcaccgtacaactaaagttaaggaggcactgttaattaaaacttgcacagtttctgaattagaagcacaacttagacagttgacagaggagcaaaatacactaaatatttcttttcaacaggctactcatcagttagaagaaaaagaaaatcaaattaagagcatgaaggctgatattgaaagtcttgtaacagaaaaagaagccttacagaaggaaggaggcaatcagcaacaggctgcttctgaaaaggagtcttgtataacacagttgaagaaagagttatctgaaaacatcaatgctgtcacattgatgaaagaagagcttaaagaaaaaaaagttgagattagcagtcttagtaaacaactaactgatttgaatgttcagcttcaaaatagcatcagcctatccgaaaaagaagcagccatttcatcactaagaaagcagtatgatgaagaaaaatgtgaattgctggatcaggtgcaagatttatcttttaaagttgacactctgagtaaagagaaaatttctgctcttgagcaggtagatgactggtccaataaattctcagaatggaagaagaaagcacagtcaagatttacacagcatcaaaacactgttaaagaattgcagatccagcttgagttaaaatcaaaggaagcttatgaaaaggatgagcagataaatttattgaaggaagagcttgatcagcaaaataaaagatttgattgtttaaagggtgaaatggaagacgacaagagcaagatggagaaaaaggagtctaatttagaaacagagttaaagtctcaaacagcaagaattatggaattagaggaccatattacccagaaaactattgaaatagagtccttaaatgaagttcttaaaaattacaatcaacaaaaggatattgaacacaaagaattggttcagaaacttcaacattttcaagagttaggagaagaaaaggacaacagggttaaagaagctgaagaaaaaatcttaacacttgaaaaccaagtttattccatgaaagctgaacttgaaactaagaagaaagaattagaacatgtgaatttaagtgtgaaaagcaaagaggaggagttaaaggcattggaagataggcttgagtcagaaagtgctgcaaaattagcagagttgaagagaaaagctgaacaaaaaattgctgccattaagaagcagttgttatctcaaatggaagagaaagaagaacagtataaaaaaggtacagaaagccatttgagtgagctaaatacaaaattgcaggaaagagaaagggaagttcacatcttggaagaaaaacttaagtcagtggaaagttcacagtcagaaacattaattgtacccagatcagcaaaaaatgtggcagcatatactgaacaagaagaagcagattcccaaggctgtgtgcagaagacatatgaagaaaaaatcagtgttttacaaagaaacttaactgaaaaagaaaagctattgcagagggtagggcaggaaaaagaagagacagtttcttctcattttgaaatgcgatgccaataccaggagcgcttaataaagctagaacatgctgaggcaaagcaacatgaagatcaaagtatgataggtcatcttcaagaggagcttgaagaaaaaaacaagaaatattccttgatagtagcccagcatgtggaaaaagaaggaggtaaaaataacatacaggcaaagcaaaacttggaaaatgtgtttgacgacgtccagaaaaccctccaggagaaggaactaacctgtcagattttggagcaaaagataaaagagctggattcctgcttagtaagacagaaagaagtacatagagttgaaatggaagagttgacctcaaaatatgaaaaattacaggctttacaacagatggatggaagaaataaacccacagaacttttggaagaaaacactgaagaaaagtccaaatcacatttggtccaacccaaattgcttagtaacatggaagcccagcacaatgatctggagtttaaattagccggggcagaacgggagaaacagaaactgggcaaggagattgttagattgcagaaagaccttcgaatgttgagaaaggagcatcagcaagaattggaaatactaaagaaagaatatgatcaagaaagggaagagaaaatcaaacaggagcaggaagatcttgaactgaagcacaattccacattaaaacagctgatgagggagtttaatacacagctggcacaaaaggaacaagagctggaaatgaccataaaagaaactatcaataaggcccaggaggtggaggctgaacttttagaaagccatcaagaagagacaaatcagttacttaaaaaaattgctgagaaagatgatgatctaaaacgaacagccaaaagatatgaagaaatccttgatgctcgtgaagaagaaatgactgcaaaagtaagggacctgcagactcaacttgaggagctgcagaagaaataccagcaaaagctagagcaggaggagaaccctggcaatgataatgtaacaattatggagctacagacacagctagcacagaagacgactttaatcagtgattcgaaattgaaagagcaagagttcagagaacagattcacaatttagaagaccgtttgaagaaatatgaaaagaatgtatatgcaacaactgtggggacaccttacaaaggtggcaatttgtaccatacggatgtctcactctttggagaacctaccgaatttgagtatttgcgaaaagtgctttttgagtatatgatgggtcgtgagactaagaccatggcaaaagttataaccaccgtactgaagttccctgatgatcagactcagaaaattttggaaagagaagatgctcggctgatgtttacttcacctcgcagtggtatcttctgagtaaaccatcagtctgtgcttagttaacatgtgtcatggctccgatcttcatcttgaagaagagtgacattgggtgactgctgcttggaaaactgtccacacttgctactctttgagaatgaagttgtcattcagggcccctcatgtagccaaaagaccaagaaaaatctggcccacagataagttgcagactgcctttaaaatagattttatcagtggagaaatggtgatagttttttcttcagttttctcttgggaagagttttatgttgtttaaaagatattttgataacttaacctgctttatgggcttacataatattcctttcatccattctttttaaagaacggcttacctttcctatttatttttagggtgattttttaaaaagacttgtgcaatacattttgaggtgaaacttagtggattttttctgataaattagagcatttaattgactattttattcaggttgatctgttgaatatttgctaaagaccagttctttaagctaagacatgtaaaaaatcccaaatggcagtacctcattgtttacttagcttttgtacttatatttttcagaggaaaaaacactactgtaaattgtgaatagccaatacataactgtattgtatgcaaatctgtgattgttggcagtgtcatctctgagaaacagataaataaagtttatttactatataaacatttgtttattgtacttgttcctcagttgaaatctattttaaaatgtttaagaatgcatattctatttggatgaatttagtgaggaattatttgtcaatataactaaatgctgagcatttgaaaagaattttcacgttcaaatttggtatgaccaagttagaaggagcatggaaataaatactccatgatgtctgctttaggattctga

SEQ ID NO: 300203 - DNA, 8199 bp, Homo sapiens
ccctggcgcctggtatcagggacttcccgacgctggaagagttcagggaagggaagcgggcccctctggcaccgaagacacagaatcctagctacagctactaaagaaaagaacactatcaattagggcccgcgtcaggttctctggatctccccttctcccatccttgacgctcatccctgtgttctttgcggtgggcccgtcggccctgctgccatcgatagaagcagcactctccccgtctgatttcgcagggccaaagcccaggtgagagtcagggtagtgttcagactagcccacgctccggttctgagccgcgacggcggtctccgcacgcaacgaaatcaggcaggaccgaaccttgcgtcctccagtgcagcgagttcggaagcgaccggccgagcgcgcatgtgcgggacccgacattgtgcttgtcccatccggtgctccgtagttagcctctgtgagctccacgtaggccgcgcaagcgcccttggcgcacagttcacctgctgccgttgtcgtcgccgccgcggctcccggggctggatggggggccgaggccagccagtggcacccggaagaaagagacgcggcggcggcgacgccgacaccctcaggacgagtgtccggacttgcccacagcctcaaggaggagacggcgaggcccggcccccgctgtccctggtgtaaagaagtcgccgtagccgtcgcggccgggactccccgggctctcgcccttcaggtttcgttgacactcaggaccgtacgtacgctgcgccatgttcaagaaactgaagcaaaagatcagcgaggagcagcagcagctccagcaggcgctggctcctgctcaggcgtcctccaattcttcaacaccaacaagaatgaggagcaggacatcttcatttacagagcaacttgatgaaggtacacccaatagagagaatgcatctactcatgcctcgaaatctcctgacagtgttaatggaagtgaaccaagcattcctcagtcaggtgacacacagtcttttgcacagaagctccagctccgggtgccctccgtggagtctttgtttcgaagtccgataaaggaatctctattccggtcttcttctaaagagtctttggtacgaacatcttccagagaatccctgaatcgacttgacctggacagttctactgccagttttgatccaccctctgatatggatagcgaggctgaagacttggtagggaattcagacagtctcaacaaagaacagttgattcagcggttgcgaagaatggaacgaagcttaagtagctacaggggaaaatattctgagcttgttacagcttatcagatgcttcagagagagaagaaaaagctacaaggtatattaagtcagagtcaggataaatcacttcggagaatagcagaattaagagaggagctccaaatggaccagcaggcaaagaaacatctgcaagaggagtttgatgcatctttagaggagaaagatcagtatatcagtgttctccaaactcaggtttctctactgaaacaacgattacgaaatggcccgatgaatgttgatgtactgaaaccacttcctcagctggaaccacaggctgaagtcttcactaaagaagagaatccagaaagtgatggagagccagtagtggaagatggaacttctgtaaaaacactggaaacactccagcaaagagtgaagcgtcaagagaacctacttaagcgttgtaaggaaacaattcagtcacataaggaacaatgtacactattaactagtgaaaaagaagctctgcaagaacaactggatgaaagacttcaagaactagaaaagataaaggaccttcatatggccgagaagactaaacttatcactcagttgcgtgatgcaaagaacttaattgaacagcttgaacaagataagggaatggtaatcgcagagacaaaacgtcagatgcatgaaaccctggaaatgaaagaagaagaaattgctcaactccgtagtcgcatcaaacagatgactacccagggagaggaattacgggaacagaaagaaaagtccgaaagagctgcttttgaggaacttgaaaaagctttgagtacagcccaaaaaacagaggaagcacggagaaaactgaaggcagaaatggatgaacaaataaaaactatcgaaaaaacaagtgaggaggaacgcatcagtcttcaacaggaattaagtcgggtgaaacaggaggttgttgatgtaatgaaaaaatcctcagaagaacaaattgctaagctacagaagcttcatgaaaaggagctggccagaaaagagcaggaactgaccaagaagcttcagacccgagaaagggaatttcaggaacaaatgaaagtagctcttgaaaagagtcaatcagaatatttgaagatcagccaagaaaaagaacagcaagaatctttggccctagaagagttagagttgcagaaaaaagcaatcctcacagaaagtgaaaataaacttcgggaccttcagcaagaagcagagacttacagaactagaattcttgaattggaaagttctttggaaaaaagcttacaagaaaacaaaaatcagtcaaaagatttggctgttcatctggaagctgaaaaaaataagcacaataaggagattacagtcatggttgaaaaacacaagacagaattggaaagccttaagcatcagcaggatgccctttggactgaaaaactccaagtcttaaagcaacaatatcagactgaaatggaaaaacttagggaaaagtgtgaacaagaaaaagaaacattgttgaaagacaaagagattatcttccaggcccacatagaagaaatgaatgaaaagactttagaaaagcttgatgtgaagcaaacagaactagaatcattatcttctgaactgtcagaagtattaaaagcccgtcacaaactagaagaggaactttctgttctgaaagatcaaacagataaaatgaagcaggaattagaggccaagatggatgaacagaaaaatcatcaccagcagcaagttgacagtatcattaaagaacacgaggtatctatccagaggactgagaaggcattaaaagatcaaattaatcaacttgagcttctcttgaaggaaagggacaagcatttgaaagagcatcaggctcatgtagaaaatttagaggcagatattaaaaggtctgaaggggaactccagcaggcatctgctaagctggacgtttttcagtcttaccagagtgccacacatgagcagacaaaagcatatgaggaacagttggcccaattgcagcagaagttgttggatttggaaacagaaagaattcttcttaccaaacaggttgctgaagttgaagcacaaaagaaagatgtttgtactgagttagatgctcacaaaatccaggtgcaggacttaatgcagcaacttgaaaaacaaaatagtgaaatggagcaaaaagtaaaatctttaacccaagtctatgagtccaaacttgaagatggtaacaaagaacaggaacagacaaagcaaatcttggtggaaaaggaaaatatgattttacaaatgagagaaggacagaagaaagaaattgagatactcacacagaaattgtcagccaaggaggacagtattcatattttgaatgaggaatatgaaaccaaatttaaaaaccaagaaaaaaagatggaaaaagttaagcagaaagcaaaggagatgcaagaaacgttaaagaaaaaattactggatcaggaagccaaacttaagaaagagcttgaaaatactgctctagagcttagtcagaaagaaaaacagtttaatgccaaaatgctggaaatggcacaggctaactcagctggaatcagtgatgcagtgtcaagactggaaacaaaccaaaaagaacaaatagaaagtcttactgaggttcatcgacgagaactcaatgatgtcatatcaatctgggaaaagaaacttaatcagcaagctgaagaacttcaggaaatacatgaaatccaattacaggaaaaagaacaagaggtagcagaactgaaacaaaagatcctcctatttgggtgtgaaaaagaagagatgaacaaggaaataacatggctgaaggaagaaggtgttaagcaggatacaacattaaatgaattacaggaacagttaaagcagaagtctgcccatgtgaattctcttgcacaagatgaaactaaactgaaagctcatcttgaaaagctagaggttgacttgaataagtctctgaaggaaaatacttttcttcaagagcagctagttgaactgaagatgctggcagaagaagataagcggaaggtttctgagttgactagcaagttgaaaaccacagatgaagaattccagagtttgaaatcttcacatgaaaaaagtaacaaaagcctagaggacaagagcttggaatttaaaaaactgtctgaggaactagcgattcagctagatatttgctgtaagaaaaccgaagccttattagaagctaaaacaaatgagctaatcaacattagtagtagtaaaactaatgccattctttctaggatttctcattgtcagcaccgtacaactaaagttaaggaggcactgttaattaaaacttgcacagtttctgaattagaagcacaacttagacagttgacagaggagcaaaatacactaaatatttcttttcaacaggctactcatcagttagaagaaaaagaaaatcaaattaagagcatgaaggctgatattgaaagtcttgtaacagaaaaagaagccttacagaaggaaggaggcaatcagcaacaggctgcttctgaaaaggagtcttgtataacacagttgaagaaagagttatctgaaaacatcaatgctgtcacattgatgaaagaagagcttaaagaaaaaaaagttgagattagcagtcttagtaaacaactaactgatttgaatgttcagcttcaaaatagcatcagcctatccgaaaaagaagcagccatttcatcactaagaaagcagtatgatgaagaaaaatgtgaattgctggatcaggtgcaagatttatcttttaaagttgacactctgagtaaagagaaaatttctgctcttgagcaggtagatgactggtccaataaattctcagaatggaagaagaaagcacagtcaagatttacacagcatcaaaacactgttaaagaattgcagatccagcttgagttaaaatcaaaggaagcttatgaaaaggatgagcagataaatttattgaaggaagagcttgatcagcaaaataaaagatttgattgtttaaagggtgaaatggaagacgacaagagcaagatggagaaaaaggagtctaatttagaaacagagttaaagtctcaaacagcaagaattatggaattagaggaccatattacccagaaaactattgaaatagagtccttaaatgaagttcttaaaaattacaatcaacaaaaggatattgaacacaaagaattggttcagaaacttcaacattttcaagagttaggagaagaaaaggacaacagggttaaagaagctgaagaaaaaatcttaacacttgaaaaccaagtttattccatgaaagctgaacttgaaactaagaagaaagaattagaacatgtgaatttaagtgtgaaaagcaaagaggaggagttaaaggcattggaagataggcttgagtcagaaagtgctgcaaaattagcagagttgaagagaaaagctgaacaaaaaattgctgccattaagaagcagttgttatctcaaatggaagagaaagaagaacagtataaaaaaggtacagaaagccatttgagtgagctaaatacaaaattgcaggaaagagaaagggaagttcacatcttggaagaaaaacttaagtcagtggaaagttcacagtcagaaacattaattgtacccagatcagcaaaaaatgtggcagcatatactgaacaagaagaagcagattcccaaggctgtgtgcagaagacatatgaagaaaaaatcagtgttttacaaagaaacttaactgaaaaagaaaagctattgcagagggtagggcaggaaaaagaagagacagtttcttctcattttgaaatgcgatgccaataccaggagcgcttaataaagctagaacatgctgaggcaaagcaacatgaagatcaaagtatgataggtcatcttcaagaggagcttgaagaaaaaaacaagaaatattccttgatagtagcccagcatgtggaaaaagaaggaggtaaaaataacatacaggcaaagcaaaacttggaaaatgtgtttgacgacgtccagaaaaccctccaggagaaggaactaacctgtcagattttggagcaaaagataaaagagctggattcctgcttagtaagacagaaagaagtacatagagttgaaatggaagagttgacctcaaaatatgaaaaattacaggctttacaacagatggatggaagaaataaacccacagaacttttggaagaaaacactgaagaaaagtccaaatcacatttggtccaacccaaattgcttagtaacatggaagcccagcacaatgatctggagtttaaattagccggggcagaacgggagaaacagaaactgggcaaggagattgttagattgcagaaagaccttcgaatgttgagaaaggagcatcagcaagaattggaaatactaaagaaagaatatgatcaagaaagggaagagaaaatcaaacaggagcaggaagatcttgaactgaagcacaattccacattaaaacagctgatgagggagtttaatacacagctggcacaaaaggaacaagagctggaaatgaccataaaagaaactatcaataaggcccaggaggtggaggctgaacttttagaaagccatcaagaagagacaaatcagttacttaaaaaaattgctgagaaagatgatgatctaaaacgaacagccaaaagatatgaagaaatccttgatgctcgtgaagaagaaatgactgcaaaagtaagggacctgcagactcaacttgaggagctgcagaagaaataccagcaaaagctagagcaggaggagaaccctggcaatgataatgtaacaattatggagctacagacacagctagcacagaagacgactttaatcagtgattcgaaattgaaagagcaagagttcagagaacagattcacaatttagaagaccgtttgaagaaatatgaaaagaatgtatatgcaacaactgtggggacaccttacaaaggtggcaatttgtaccatacggatgtctcactctttggagaacctaccgaatttgagtatttgcgaaaagtgctttttgagtatatgatgggtcgtgagactaagaccatggcaaaagttataaccaccgtactgaagttccctgatgatcagactcagaaaattttggaaagagaagatgctcggctgatgtttacttcacctcgcagtggtatcttctgagtaaaccatcagtctgtgcttagttaacatgtgtcatggctccgatcttcatcttgaagaagagtgacattgggtgactgctgcttggaaaactgtccacacttgctactctttgagaatgaagttgtcattcagggcccctcatgtagccaaaagaccaagaaaaatctggcccacagataagttgcagactgcctttaaaatagattttatcagtggagaaatggtgatagttttttcttcagttttctcttgggaagagttttatgttgtttaaaagatattttgataacttaacctgctttatgggcttacataatattcctttcatccattctttttaaagaacggcttacctttcctatttatttttagggtgattttttaaaaagacttgtgcaatacattttgaggtgaaacttagtggattttttctgataaattagagcatttaattgactattttattcaggttgatctgttgaatatttgctaaagaccagttctttaagctaagacatgtaaaaaatcccaaatggcagtacctcattgtttacttagcttttgtacttatatttttcagaggaaaaaacactactgtgattgttggcagtgtcatctctgagaaacagataaataaagtttatttactatataa

SEQ ID NO: 300204 - DNA, 7826 bp, Homo sapiens
ccctggcgcctggtatcagggacttcccgacgctggaagagttcagggaagggaagcgggcccctctggcaccgaagacacagaatcctagctacagctactaaagaaaagaacactatcaattagggcccgcgtcaggttctctggatctccccttctcccatccttgacgctcatccctgtgttctttgcggtgggcccgtcggccctgctgccatcgatagaagcagcactctccccgtctgatttcgcagggccaaagcccaggtgagagtcagggtagtgttcagactagcccacgctccggttctgagccgcgacggcggtctccgcacgcaacgaaatcaggcaggaccgaaccttgcgtcctccagtgcagcgagttcggaagcgaccggccgagcgcgcatgtgcgggacccgacattgtgcttgtcccatccggtgctccgtagttagcctctgtgagctccacgtaggccgcgcaagcgcccttggcgcacagttcacctgctgccgttgtcgtcgccgccgcggctcccggggctggatggggggccgaggccagccagtggcacccggaagaaagagacgcggcggcggcgacgccgacaccctcaggacgagtgtccggacttgcccacagcctcaaggaggagacggcgaggcccggcccccgctgtccctggtgtaaagaagtcgccgtagccgtcgcggccgggactccccgggctctcgcccttcaggtttcgttgacactcaggaccgtacgtacgctgcgccatgttcaagaaactgaagcaaaagatcagcgaggagcagcagcagctccagcaggcgctggctcctgctcaggcgtcctccaattcttcaacaccaacaagaatgaggagcaggacatcttcatttacagagcaacttgatgaaggtacacccaatagagagaatgcatctactcatgcctcgaaatctcctgacagtgttaatggaagtgaaccaagcattcctcagtcaggtgacacacagtcttttgcacagaagctccagctccgggtgccctccgtggagtctttgtttcgaagtccgataaaggaatctctattccggtcttcttctaaagagtctttggtacgaacatcttccagagaatccctgaatcgacttgacctggacagttctactgccagttttgatccaccctctgatatggatagcgaggctgaagacttggtagggaattcagacagtctcaacaaagaacagttgattcagcggttgcgaagaatggaacgaagcttaagtagctacaggggaaaatattctgagcttgttacagcttatcagatgcttcagagagagaagaaaaagctacaaggtatattaagtcagagtcaggataaatcacttcggagaatagcagaattaagagaggagctccaaatggaccagcaggcaaagaaacatctgcaagaggagtttgatgcatctttagaggagaaagatcagtatatcagtgttctccaaactcaggtttctctactgaaacaacgattacgaaatggcccgatgaatgttgatgtactgaaaccacttcctcagctggaaccacaggctgaagtcttcactaaagaagagaatccagaaagtgatggagagccagtagtggaagatggaacttctgtaaaaacactggaaacactccagcaaagagtgaagcgtcaagagaacctacttaagcgttgtaaggaaacaattcagtcacataaggaacaatgtacactattaactagtgaaaaagaagctctgcaagaacaactggatgaaagacttcaagaactagaaaagataaaggaccttcatatggccgagaagactaaacttatcactcagttgcgtgatgcaaagaacttaattgaacagcttgaacaagataagggaatggtaatcgcagagacaaaacgtcagatgcatgaaaccctggaaatgaaagaagaagaaattgctcaactccgtagtcgcatcaaacagatgactacccagggagaggaattacgggaacagaaagaaaagtccgaaagagctgcttttgaggaacttgaaaaagctttgagtacagcccaaaaaacagaggaagcacggagaaaactgaaggcagaaatggatgaacaaataaaaactatcgaaaaaacaagtgaggaggaacgcatcagtcttcaacaggaattaagtcgggtgaaacaggaggttgttgatgtaatgaaaaaatcctcagaagaacaaattgctaagctacagaagcttcatgaaaaggagctggccagaaaagagcaggaactgaccaagaagcttcagacccgagaaagggaatttcaggaacaaatgaaagtagctcttgaaaagagtcaatcagaatatttgaagatcagccaagaaaaagaacagcaagaatctttggccctagaagagttagagttgcagaaaaaagcaatcctcacagaaagtgaaaataaacttcgggaccttcagcaagaagcagagacttacagaactagaattcttgaattggaaagttctttggaaaaaagcttacaagaaaacaaaaatcagtcaaaagatttggctgttcatctggaagctgaaaaaaataagcacaataaggagattacagtcatggttgaaaaacacaagacagaattggaaagccttaagcatcagcaggatgccctttggactgaaaaactccaagtcttaaagcaacaatatcagactgaaatggaaaaacttagggaaaagtgtgaacaagaaaaagaaacattgttgaaagacaaagagattatcttccaggcccacatagaagaaatgaatgaaaagactttagaaaagcttgatgtgaagcaaacagaactagaatcattatcttctgaactgtcagaagtattaaaagcccgtcacaaactagaagaggaactttctgttctgaaagatcaaacagataaaatgaagcaggaattagaggccaagatggatgaacagaaaaatcatcaccagcagcaagttgacagtatcattaaagaacacgaggtatctatccagaggactgagaaggcattaaaagatcaaattaatcaacttgagcttctcttgaaggaaagggacaagcatttgaaagagcatcaggctcatgtagaaaatttagaggcagatattaaaaggtctgaaggggaactccagcaggcatctgctaagctggacgtttttcagtcttaccagagtgccacacatgagcagacaaaagcatatgaggaacagttggcccaattgcagcagaagttgttggatttggaaacagaaagaattcttcttaccaaacaggttgctgaagttgaagcacaaaagaaagatgtttgtactgagttagatgctcacaaaatccaggtgcaggacttaatgcagcaacttgaaaaacaaaatagtgaaatggagcaaaaagtaaaatctttaacccaagtctatgagtccaaacttgaagatggtaacaaagaacaggaacagacaaagcaaatcttggtggaaaaggaaaatatgattttacaaatgagagaaggacagaagaaagaaattgagatactcacacagaaattgtcagccaaggaggacagtattcatattttgaatgaggaatatgaaaccaaatttaaaaaccaagaaaaaaagatggaaaaagttaagcagaaagcaaaggagatgcaagaaacgttaaagaaaaaattactggatcaggaagccaaacttaagaaagagcttgaaaatactgctctagagcttagtcagaaagaaaaacagtttaatgccaaaatgctggaaatggcacaggctaactcagctggaatcagtgatgcagtgtcaagactggaaacaaaccaaaaagaacaaatagaaagtcttactgaggttcatcgacgagaactcaatgatgtcatatcaatctgggaaaagaaacttaatcagcaagctgaagaacttcaggaaatacatgaaatccaattacaggaaaaagaacaagaggtagcagaactgaaacaaaagatcctcctatttgggtgtgaaaaagaagagatgaacaaggaaataacatggctgaaggaagaaggtgttaagcaggatacaacattaaatgaattacaggaacagttaaagcagaagtctgcccatgtgaattctcttgcacaagatgaaactaaactgaaagctcatcttgaaaagctagaggttgacttgaataagtctctgaaggaaaatacttttcttcaagagcagctagttgaactgaagatgctggcagaagaagataagcggaaggtttctgagttgactagcaagttgaaaaccacagatgaagaattccagagtttgaaatcttcacatgaaaaaagtaacaaaagcctagaggacaagagcttggaatttaaaaaactgtctgaggaactagcgattcagctagatatttgctgtaagaaaaccgaagccttattagaagctaaaacaaatgagctaatcaacattagtagtagtaaaactaatgccattctttctaggatttctcattgtcagcaccgtacaactaaagttaaggaggcactgttaattaaaacttgcacagtttctgaattagaagcacaacttagacagttgacagaggagcaaaatacactaaatatttcttttcaacaggctactcatcagttagaagaaaaagaaaatcaaattaagagcatgaaggctgatattgaaagtcttgtaacagaaaaagaagccttacagaaggaaggaggcaatcagcaacaggctgcttctgaaaaggagtcttgtataacacagttgaagaaagagttatctgaaaacatcaatgctgtcacattgatgaaagaagagcttaaagaaaaaaaagttgagattagcagtcttagtaaacaactaactgatttgaatgttcagcttcaaaatagcatcagcctatccgaaaaagaagcagccatttcatcactaagaaagcagtatgatgaagaaaaatgtgaattgctggatcaggtgcaagatttatcttttaaagttgacactctgagtaaagagaaaatttctgctcttgagcaggtagatgactggtccaataaattctcagaatggaagaagaaagcacagtcaagatttacacagcatcaaaacactgttaaagaattgcagatccagcttgagttaaaatcaaaggaagcttatgaaaaggatgagcagataaatttattgaaggaagagcttgatcagcaaaataaaagatttgattgtttaaagggtgaaatggaagacgacaagagcaagatggagaaaaaggagtctaatttagaaacagagttaaagtctcaaacagcaagaattatggaattagaggaccatattacccagaaaactattgaaatagagtccttaaatgaagttcttaaaaattacaatcaacaaaaggatattgaacacaaagaattggttcagaaacttcaacattttcaagagttaggagaagaaaaggacaacagggttaaagaagctgaagaaaaaatcttaacacttgaaaaccaagtttattccatgaaagctgaacttgaaactaagaagaaagaattagaacatgtgaatttaagtgtgaaaagcaaagaggaggagttaaaggcattggaagataggcttgagtcagaaagtgctgcaaaattagcagagttgaagagaaaagctgaacaaaaaattgctgccattaagaagcagttgttatctcaaatggaagagaaagaagaacagtataaaaaaggtacagaaagccatttgagtgagctaaatacaaaattgcaggaaagagaaagggaagttcacatcttggaagaaaaacttaagtcagtggaaagttcacagtcagaaacattaattgtacccagatcagcaaaaaatgtggcagcatatactgaacaagaagaagcagattcccaaggctgtgtgcagaagacatatgaagaaaaaatcagtgttttacaaagaaacttaactgaaaaagaaaagctattgcagagggtagggcaggaaaaagaagagacagtttcttctcattttgaaatgcgatgccaataccaggagcgcttaataaagctagaacatgctgaggcaaagcaacatgaagatcaaagtatgataggtcatcttcaagaggagcttgaagaaaaaaacaagaaatattccttgatagtagcccagcatgtggaaaaagaaggaggtaaaaataacatacaggcaaagcaaaacttggaaaatgtgtttgacgacgtccagaaaaccctccaggagaaggaactaacctgtcagattttggagcaaaagataaaagagctggattcctgcttagtaagacagaaagaagtacatagagttgaaatggaagagttgacctcaaaatatgaaaaattacaggctttacaacagatggatggaagaaataaacccacagaacttttggaagaaaacactgaagaaaagtccaaatcacatttggtccaacccaaattgcttagtaacatggaagcccagcacaatgatctggagtttaaattagccggggcagaacgggagaaacagaaactgggcaaggagattgttagattgcagaaagaccttcgaatgttgagaaaggagcatcagcaagaattggaaatactaaagaaagaatatgatcaagaaagggaagagaaaatcaaacaggagcaggaagatcttgaactgaagcacaattccacattaaaacagctgatgagggagtttaatacacagctggcacaaaaggaacaagagctggaaatgaccataaaagaaactatcaataaggcccaggaggtggaggctgaacttttagaaagccatcaagaagagacaaatcagttacttaaaaaaattgctgagaaagatgatgatctaaaacgaacagccaaaagatatgaagaaatccttgatgctcgtgaagaagaaatgactgcaaaagtaagggacctgcagactcaacttgaggagctgcagaagaaataccagcaaaagctagagcaggaggagaaccctggcaatgataatgtaacaattatggagctacagacacagctagcacagaagacgactttaatcagtgattcgaaattgaaagagcaagagttcagagaacagattcacaatttagaagaccgtttgaagaaatatgaaaagaatgtatatgcaacaactgtggggacaccttacaaaggtggcaatttgtaccatacggatgtctcactctttggagaacctaccgaatttgagtatttgcgaaaagtgctttttgagtatatgatgggtcgtgagactaagaccatggcaaaagttataaccaccgtactgaagttccctgatgatcagactcagaaaattttggaaagagaagatgctcggctgatgtttacttcacctcgcagtggtatcttctgagtaaaccatcagtctgtgcttagttaacatgtgtcatggctccgatcttcatcttgaagaagagtgacattgggtgactgctgcttggaaaactgtccacacttgctactctttgagaatgaagttgtcattcagggcccctcatgtagccaaaagacgagcactccctagggagtgctgttttaagattattttgttttcagcttctctgttcaaataatccactgttcaggttttaatcctagacacttaagacaaagaagtttcattcccaaagacgagcac

SEQ ID NO: 300205 - DNA, 8096 bp, Homo sapiens
ccctggcgcctggtatcagggacttcccgacgctggaagagttcagggaagggaagcgggcccctctggcaccgaagacacagaatcctagctacagctactaaagaaaagaacactatcaattagggcccgcgtcaggttctctggatctccccttctcccatccttgacgctcatccctgtgttctttgcggtgggcccgtcggccctgctgccatcgatagaagcagcactctccccgtctgatttcgcagggccaaagcccaggtgagagtcagggtagtgttcagactagcccacgctccggttctgagccgcgacggcggtctccgcacgcaacgaaatcaggcaggaccgaaccttgcgtcctccagtgcagcgagttcggaagcgaccggccgagcgcgcatgtgcgggacccgacattgtgcttgtcccatccggtgctccgtagttagcctctgtgagctccacgtaggccgcgcaagcgcccttggcgcacagttcacctgctgccgttgtcgtcgccgccgcggctcccggggctggatggggggccgaggccagccagtggcacccggaagaaagagacgcggcggcggcgacgccgacaccctcaggacgagtgtccggacttgcccacagcctcaaggaggagacggcgaggcccggcccccgctgtccctggtgtaaagaagtcgccgtagccgtcgcggccgggactccccgggctctcgcccttcaggtttcgttgacactcaggaccgtacgtacgctgcgccatgttcaagaaactgaagcaaaagatcagcgaggagcagcagcagctccagcaggcgctggctcctgctcaggcgtcctccaattcttcaacaccaacaagaatgaggagcaggacatcttcatttacagagcaacttgatgaaggtacacccaatagagagaatgcatctactcatgcctcgaaatctcctgacagtgttaatggaagtgaaccaagcattcctcagtcaggtgacacacagtcttttgcacagaagctccagctccgggtgccctccgtggagtctttgtttcgaagtccgataaaggaatctctattccggtcttcttctaaagagtctttggtacgaacatcttccagagaatccctgaatcgacttgacctggacagttctactgccagttttgatccaccctctgatatggatagcgaggctgaagacttggtagggaattcagacagtctcaacaaagaacagttgattcagcggttgcgaagaatggaacgaagcttaagtagctacaggggaaaatattctgagcttgttacagcttatcagatgcttcagagagagaagaaaaagctacaaggtatattaagtcagagtcaggataaatcacttcggagaatagcagaattaagagaggagctccaaatggaccagcaggcaaagaaacatctgcaagaggagtttgatgcatctttagaggagaaagatcagtatatcagtgttctccaaactcaggtttctctactgaaacaacgattacgaaatggcccgatgaatgttgatgtactgaaaccacttcctcagctggaaccacaggctgaagtcttcactaaagaagagaatccagaaagtgatggagagccagtagtggaagatggaacttctgtaaaaacactggaaacactccagcaaagagtgaagcgtcaagagaacctacttaagcgttgtaaggaaacaattcagtcacataaggaacaatgtacactattaactagtgaaaaagaagctctgcaagaacaactggatgaaagacttcaagaactagaaaagataaaggaccttcatatggccgagaagactaaacttatcactcagttgcgtgatgcaaagaacttaattgaacagcttgaacaagataagggaatggtaatcgcagagacaaaacgtcagatgcatgaaaccctggaaatgaaagaagaagaaattgctcaactccgtagtcgcatcaaacagatgactacccagggagaggaattacgggaacagaaagaaaagtccgaaagagctgcttttgaggaacttgaaaaagctttgagtacagcccaaaaaacagaggaagcacggagaaaactgaaggcagaaatggatgaacaaataaaaactatcgaaaaaacaagtgaggaggaacgcatcagtcttcaacaggaattaagtcgggtgaaacaggaggttgttgatgtaatgaaaaaatcctcagaagaacaaattgctaagctacagaagcttcatgaaaaggagctggccagaaaagagcaggaactgaccaagaagcttcagacccgagaaagggaatttcaggaacaaatgaaagtagctcttgaaaagagtcaatcagaatatttgaagatcagccaagaaaaagaacagcaagaatctttggccctagaagagttagagttgcagaaaaaagcaatcctcacagaaagtgaaaataaacttcgggaccttcagcaagaagcagagacttacagaactagaattcttgaattggaaagttctttggaaaaaagcttacaagaaaacaaaaatcagtcaaaagatttggctgttcatctggaagctgaaaaaaataagcacaataaggagattacagtcatggttgaaaaacacaagacagaattggaaagccttaagcatcagcaggatgccctttggactgaaaaactccaagtcttaaagcaacaatatcagactgaaatggaaaaacttagggaaaagtgtgaacaagaaaaagaaacattgttgaaagacaaagagattatcttccaggcccacatagaagaaatgaatgaaaagactttagaaaagcttgatgtgaagcaaacagaactagaatcattatcttctgaactgtcagaagtattaaaagcccgtcacaaactagaagaggaactttctgttctgaaagatcaaacagataaaatgaagcaggaattagaggccaagatggatgaacagaaaaatcatcaccagcagcaagttgacagtatcattaaagaacacgaggtatctatccagaggactgagaaggcattaaaagatcaaattaatcaacttgagcttctcttgaaggaaagggacaagcatttgaaagagcatcaggctcatgtagaaaatttagaggcagatattaaaaggtctgaaggggaactccagcaggcatctgctaagctggacgtttttcagtcttaccagagtgccacacatgagcagacaaaagcatatgaggaacagttggcccaattgcagcagaagttgttggatttggaaacagaaagaattcttcttaccaaacaggttgctgaagttgaagcacaaaagaaagatgtttgtactgagttagatgctcacaaaatccaggtgcaggacttaatgcagcaacttgaaaaacaaaatagtgaaatggagcaaaaagtaaaatctttaacccaagtctatgagtccaaacttgaagatggtaacaaagaacaggaacagacaaagcaaatcttggtggaaaaggaaaatatgattttacaaatgagagaaggacagaagaaagaaattgagatactcacacagaaattgtcagccaaggaggacagtattcatattttgaatgaggaatatgaaaccaaatttaaaaaccaagaaaaaaagatggaaaaagttaagcagaaagcaaaggagatgcaagaaacgttaaagaaaaaattactggatcaggaagccaaacttaagaaagagcttgaaaatactgctctagagcttagtcagaaagaaaaacagtttaatgccaaaatgctggaaatggcacaggctaactcagctggaatcagtgatgcagtgtcaagactggaaacaaaccaaaaagaacaaatagaaagtcttactgaggttcatcgacgagaactcaatgatgtcatatcaatctgggaaaagaaacttaatcagcaagctgaagaacttcaggaaatacatgaaatccaattacaggaaaaagaacaagaggtagcagaactgaaacaaaagatcctcctatttgggtgtgaaaaagaagagatgaacaaggaaataacatggctgaaggaagaaggtgttaagcaggatacaacattaaatgaattacaggaacagttaaagcagaagtctgcccatgtgaattctcttgcacaagatgaaactaaactgaaagctcatcttgaaaagctagaggttgacttgaataagtctctgaaggaaaatacttttcttcaagagcagctagttgaactgaagatgctggcagaagaagataagcggaaggtttctgagttgactagcaagttgaaaaccacagatgaagaattccagagtttgaaatcttcacatgaaaaaagtaacaaaagcctagaggacaagagcttggaatttaaaaaactgtctgaggaactagcgattcagctagatatttgctgtaagaaaaccgaagccttattagaagctaaaacaaatgagctaatcaacattagtagtagtaaaactaatgccattctttctaggatttctcattgtcagcaccgtacaactaaagttaaggaggcactgttaattaaaacttgcacagtttctgaattagaagcacaacttagacagttgacagaggagcaaaatacactaaatatttcttttcaacaggctactcatcagttagaagaaaaagaaaatcaaattaagagcatgaaggctgatattgaaagtcttgtaacagaaaaagaagccttacagaaggaaggaggcaatcagcaacaggctgcttctgaaaaggagtcttgtataacacagttgaagaaagagttatctgaaaacatcaatgctgtcacattgatgaaagaagagcttaaagaaaaaaaagttgagattagcagtcttagtaaacaactaactgatttgaatgttcagcttcaaaatagcatcagcctatccgaaaaagaagcagccatttcatcactaagaaagcagtatgatgaagaaaaatgtgaattgctggatcaggtgcaagatttatcttttaaagttgacactctgagtaaagagaaaatttctgctcttgagcaggtagatgactggtccaataaattctcagaatggaagaagaaagcacagtcaagatttacacagcatcaaaacactgttaaagaattgcagatccagcttgagttaaaatcaaaggaagcttatgaaaaggatgagcagataaatttattgaaggaagagcttgatcagcaaaataaaagatttgattgtttaaagggtgaaatggaagacgacaagagcaagatggagaaaaaggagtctaatttagaaacagagttaaagtctcaaacagcaagaattatggaattagaggaccatattacccagaaaactattgaaatagagtccttaaatgaagttcttaaaaattacaatcaacaaaaggatattgaacacaaagaattggttcagaaacttcaacattttcaagagttaggagaagaaaaggacaacagggttaaagaagctgaagaaaaaatcttaacacttgaaaaccaagtttattccatgaaagctgaacttgaaactaagaagaaagaattagaacatgtgaatttaagtgtgaaaagcaaagaggaggagttaaaggcattggaagataggcttgagtcagaaagtgctgcaaaattagcagagttgaagagaaaagctgaacaaaaaattgctgccattaagaagcagttgttatctcaaatggaagagaaagaagaacagtataaaaaaggtacagaaagccatttgagtgagctaaatacaaaattgcaggaaagagaaagggaagttcacatcttggaagaaaaacttaagtcagtggaaagttcacagtcagaaacattaattgtacccagatcagcaaaaaatgtggcagcatatactgaacaagaagaagcagattcccaaggctgtgtgcagaagacatatgaagaaaaaatcagtgttttacaaagaaacttaactgaaaaagaaaagctattgcagagggtagggcaggaaaaagaagagacagtttcttctcattttgaaatgcgatgccaataccaggagcgcttaataaagctagaacatgctgaggcaaagcaacatgaagatcaaagtatgataggtcatcttcaagaggagcttgaagaaaaaaacaagaaatattccttgatagtagcccagcatgtggaaaaagaaggaggtaaaaataacatacaggcaaagcaaaacttggaaaatgtgtttgacgacgtccagaaaaccctccaggagaaggaactaacctgtcagattttggagcaaaagataaaagagctggattcctgcttagtaagacagaaagaagtacatagagttgaaatggaagagttgacctcaaaatatgaaaaattacaggctttacaacagatggatggaagaaataaacccacagaacttttggaagaaaacactgaagaaaagtccaaatcacatttggtccaacccaaattgcttagtaacatggaagcccagcacaatgatctggagtttaaattagccggggcagaacgggagaaacagaaactgggcaaggagattgttagattgcagaaagaccttcgaatgttgagaaaggagcatcagcaagaattggaaatactaaagaaagaatatgatcaagaaagggaagagaaaatcaaacaggagcaggaagatcttgaactgaagcacaattccacattaaaacagctgatgagggagtttaatacacagctggcacaaaaggaacaagagctggaaatgaccataaaagaaactatcaataaggcccaggaggtggaggctgaacttttagaaagccatcaagaagagacaaatcagttacttaaaaaaattgctgagaaagatgatgatctaaaacgaacagccaaaagatatgaagaaatccttgatgctcgtgaagaagaaatgactgcaaaagtaagggacctgcagactcaacttgaggagctgcagaagaaataccagcaaaagctagagcaggaggagaaccctggcaatgataatgtaacaattatggagctacagacacagctagcacagaagacgactttaatcagtgattcgaaattgaaagagcaagagttcagagaacagattcacaatttagaagaccgtttgaagaaatatgaaaagaatgtatatgcaacaactgtggggacaccttacaaaggtggcaatttgtaccatacggatgtctcactctttggagaacctaccgaatttgagtatttgcgaaaagtgctttttgagtatatgatgggtcgtgagactaagaccatggcaaaagttataaccaccgtactgaagttccctgatgatcagactcagaaaattttggaaagagaagatgctcggctgatgtttacttcacctcgcagtggtatcttctgagtaaaccatcagtctgtgcttagttaacatgtggtgagtgaagaacaatgtcttgtgtcttttgtgcaaaaatcaaatgtgttgcctgatactaaccattttgctggaattcttttgctcttgtttaataaatatatgattatgctatgggttaatataagtattttctgttcattctgttatatggatcgataatagttaaaaattactaccaccagtaagagttatataattttaggaaatttcatttctttaaagagtaattgaaagtttgaaaattgctctttgaaattttgttaaagaatccaaaaaagtatttatgtaacttattttcccttttgtttttaattttccaagaatgatctttgaaattatgattgtgagagagaaatgaaaatcattttctagataaaaatgaagtggtatattccgtgagaattcaaaatcctgtaaagcctgagtcaaggccagtcagaaataatgaaaactagtaagatcaattttaaaatatagcttcattacttcctgaaatcagacagtttaacacaagacaac

SEQ ID NO: 300206 - DNA, 2270 bp, Homo sapiens
  misc_feature (578)..(578): n is a, c, g, or t
gaagaagaaatgactgcaaaagtaagggacctgcagactcaacttgaggagctgcagaagaaataccagcaaaagctagagcaggaggagaaccctggcaatgataatgtaacaattatggagctacagacacagctagcacagaagacgactttaatcagtgattcgaaattgaaagagcaagagttcagagaacagattcacaatttagaagaccgtttgaagaaatatgaaaagaatgtatatgcaacaactgtggggacaccttacaaaggtggcaatttgtaccatacggatgtctcactctttggagaacctaccgaatttgagtatttgcgaaaagtgctttttgagtatatgatgggtcgtgagactaagaccatggcaaaagttataaccaccgtactgaagttccctgatgatcagactcagaaaattttggaaagagaagatgctcggctgatgtcatggctccgatcttcatcttgaagaagagtgacattgggtgactgctgcttggaaaactgtccacacttgctactctttgagaatgaagttgtcattcagggcccctcatntagccaaaagaccaagaaaaatctggcccacagataagttgcagactgcctttaacatggaagcccagcacaatgatctggagtttaaattagccggggcagaacgggagaaacagaaactgggcaaggagattgttagattgcagaaagaccttcgaatgttgagaaaggagcatcagcaagaattggaaatactaaagaaagaatatgatcaagaaagggaagagaaaatcaaacaggagcaggaagatcttgaactgaagcacaattccacattaaaacagctgatgagggagtttaatacacagctggcacaaaaggaacaagagctggaaatgaccataaaagaaactatcaataaggcccaggaggtggaggctgaacttttagaaagccatcaagaagagacaaatcagttacttaaaaaaattgctgagaaagatgatgatctaaaacgaacagccaaaagatatgaagaaatccttgatgctcgtgaagaagaaatgactgcaaaagtaagggacctgcagactcaacttgaggagctgcagaagaaataccagcaaaagctagagcaggaggagaaccctggcaatgataatgtaacaattatggagctacagacacagctagcacagaagacgactttaatcagtgattcgaaattgaaagagcaagagttcagagaacagattcacaatttagaagaccgtttgaagaaatatgaaaagaatgtatatgcaacaactgtggggacaccttacaaaggtggcaatttgtaccatacggatgtctcactctttggagaacctaccgaatttgagtatttgcgaaaagtgctttttgagtatatgatgggtcgtgagactaagaccatggcaaaagttataaccaccgtactgaagttccctgatgatcagactcagaaaattttggaaagagaagatgctcggctgatgtttacttcacctcgcagtggtatcttctgagtaaaccatcagtctgtgcttagttaacatgtgtcatggctccgatcttcatcttgaagaagagtgacattgggtgactgctgcttggaaaactgtccacacttgctactctttgagaatgaagttgtcattcagggcccctcatgtagccaaaagaccaagaaaaatctggcccacagataagttgcagactgcctttaaaatagattttatcagtggagaaatggtgatagttttttcttcagttttctcttgggaagagttttatgttgtttaaaagatattttgataacttaacctgctttatgggcttacataatattcctttcatccattctttttaaagaacggcttacctttcctatttatttttagggtgattttttaaaaagacttgtgcaatacattttgaggtgaaacttagtggattttttctgataaattagagcatttaattgactattttattcaggttgatctgttgaatatttgctaaagaccagttctttaagctaagacatgtaaaaaatcccaaatggcagtacctcattgtttacttagcttttgtacttatatttttcagaggaaaaaacactactgtaaattgtgaatagccaatacataactgtattgtatgcaaatctgtgattgttggcagtgtcatctctgagaaacagataaataaagtttatttactatataa

SEQ ID NO: 300207 - DNA, 7692 bp, Homo sapiens
ccctggcgcctggtatcagggacttcccgacgctggaagagttcagggaagggaagcgggcccctctggcaccgaagacacagaatcctagctacagctactaaagaaaagaacactatcaattagggcccgcgtcaggttctctggatctccccttctcccatccttgacgctcatccctgtgttctttgcggtgggcccgtcggccctgctgccatcgatagaagcagcactctccccgtctgatttcgcagggccaaagcccaggtgagagtcagggtagtgttcagactagcccacgctccggttctgagccgcgacggcggtctccgcacgcaacgaaatcaggcaggaccgaaccttgcgtcctccagtgcagcgagttcggaagcgaccggccgagcgcgcatgtgcgggacccgacattgtgcttgtcccatccggtgctccgtagttagcctctgtgagctccacgtaggccgcgcaagcgcccttggcgcacagttcacctgctgccgttgtcgtcgccgccgcggctcccggggctggatggggggccgaggccagccagtggcacccggaagaaagagacgcggcggcggcgacgccgacaccctcaggacgagtgtccggacttgcccacagcctcaaggaggagacggcgaggcccggcccccgctgtccctggtgtaaagaagtcgccgtagccgtcgcggccgggactccccgggctctcgcccttcaggtttcgttgacactcaggaccgtacgtacgctgcgccatgttcaagaaactgaagcaaaagatcagcgaggagcagcagcagctccagcaggcgctggctcctgctcaggcgtcctccaattcttcaacaccaacaagaatgaggagcaggacatcttcatttacagagcaacttgatgaaggtacacccaatagagagaatgcatctactcatgcctcgaaatctcctgacagtgttaatggaagtgaaccaagcattcctcagtcaggtgacacacagtcttttgcacagaagctccagctccgggtgccctccgtggagtctttgtttcgaagtccgataaaggaatctctattccggtcttcttctaaagagtctttggtacgaacatcttccagagaatccctgaatcgacttgacctggacagttctactgccagttttgatccaccctctgatatggatagcgaggctgaagacttggtagggaattcagacagtctcaacaaagaacagttgattcagcggttgcgaagaatggaacgaagcttaagtagctacaggggaaaatattctgagcttgttacagcttatcagatgcttcagagagagaagaaaaagctacaaggtatattaagtcagagtcaggataaatcacttcggagaatagcagaattaagagaggagctccaaatggaccagcaggcaaagaaacatctgcaagaggagtttgatgcatctttagaggagaaagatcagtatatcagtgttctccaaactcaggtttctctactgaaacaacgattacgaaatggcccgatgaatgttgatgtactgaaaccacttcctcagctggaaccacaggctgaagtcttcactaaagaagagaatccagaaagtgatggagagccagtagtggaagatggaacttctgtaaaaacactggaaacactccagcaaagagtgaagcgtcaagagaacctacttaagcgttgtaaggaaacaattcagtcacataaggaacaatgtacactattaactagtgaaaaagaagctctgcaagaacaactggatgaaagacttcaagaactagaaaagataaaggaccttcatatggccgagaagactaaacttatcactcagttgcgtgatgcaaagaacttaattgaacagcttgaacaagataagggaatggtaatcgcagagacaaaacgtcagatgcatgaaaccctggaaatgaaagaagaagaaattgctcaactccgtagtcgcatcaaacagatgactacccagggagaggaattacgggaacagaaagaaaagtccgaaagagctgcttttgaggaacttgaaaaagctttgagtacagcccaaaaaacagaggaagcacggagaaaactgaaggcagaaatggatgaacaaataaaaactatcgaaaaaacaagtgaggaggaacgcatcagtcttcaacaggaattaagtcgggtgaaacaggaggttgttgatgtaatgaaaaaatcctcagaagaacaaattgctaagctacagaagcttcatgaaaaggagctggccagaaaagagcaggaactgaccaagaagcttcagacccgagaaagggaatttcaggaacaaatgaaagtagctcttgaaaagagtcaatcagaatatttgaagatcagccaagaaaaagaacagcaagaatctttggccctagaagagttagagttgcagaaaaaagcaatcctcacagaaagtgaaaataaacttcgggaccttcagcaagaagcagagacttacagaactagaattcttgaattggaaagttctttggaaaaaagcttacaagaaaacaaaaatcagtcaaaagatttggctgttcatctggaagctgaaaaaaataagcacaataaggagattacagtcatggttgaaaaacacaagacagaattggaaagccttaagcatcagcaggatgccctttggactgaaaaactccaagtcttaaagcaacaatatcagactgaaatggaaaaacttagggaaaagtgtgaacaagaaaaagaaacattgttgaaagacaaagagattatcttccaggcccacatagaagaaatgaatgaaaagactttagaaaagcttgatgtgaagcaaacagaactagaatcattatcttctgaactgtcagaagtattaaaagcccgtcacaaactagaagaggaactttctgttctgaaagatcaaacagataaaatgaagcaggaattagaggccaagatggatgaacagaaaaatcatcaccagcagcaagttgacagtatcattaaagaacacgaggtatctatccagaggactgagaaggcattaaaagatcaaattaatcaacttgagcttctcttgaaggaaagggacaagcatttgaaagagcatcaggctcatgtagaaaatttagaggcagatattaaaaggtctgaaggggaactccagcaggcatctgctaagctggacgtttttcagtcttaccagagtgccacacatgagcagacaaaagcatatgaggaacagttggcccaattgcagcagaagttgttggatttggaaacagaaagaattcttcttaccaaacaggttgctgaagttgaagcacaaaagaaagatgtttgtactgagttagatgctcacaaaatccaggtgcaggacttaatgcagcaacttgaaaaacaaaatagtgaaatggagcaaaaagtaaaatctttaacccaagtctatgagtccaaacttgaagatggtaacaaagaacaggaacagacaaagcaaatcttggtggaaaaggaaaatatgattttacaaatgagagaaggacagaagaaagaaattgagatactcacacagaaattgtcagccaaggaggacagtattcatattttgaatgaggaatatgaaaccaaatttaaaaaccaagaaaaaaagatggaaaaagttaagcagaaagcaaaggagatgcaagaaacgttaaagaaaaaattactggatcaggaagccaaacttaagaaagagcttgaaaatactgctctagagcttagtcagaaagaaaaacagtttaatgccaaaatgctggaaatggcacaggctaactcagctggaatcagtgatgcagtgtcaagactggaaacaaaccaaaaagaacaaatagaaagtcttactgaggttcatcgacgagaactcaatgatgtcatatcaatctgggaaaagaaacttaatcagcaagctgaagaacttcaggaaatacatgaaatccaattacaggaaaaagaacaagaggtagcagaactgaaacaaaagatcctcctatttgggtgtgaaaaagaagagatgaacaaggaaataacatggctgaaggaagaaggtgttaagcaggatacaacattaaatgaattacaggaacagttaaagcagaagtctgcccatgtgaattctcttgcacaagatgaaactaaactgaaagctcatcttgaaaagctagaggttgacttgaataagtctctgaaggaaaatacttttcttcaagagcagctagttgaactgaagatgctggcagaagaagataagcggaaggtttctgagttgactagcaagttgaaaaccacagatgaagaattccagagtttgaaatcttcacatgaaaaaagtaacaaaagcctagaggacaagagcttggaatttaaaaaactgtctgaggaactagcgattcagctagatatttgctgtaagaaaaccgaagccttattagaagctaaaacaaatgagctaatcaacattagtagtagtaaaactaatgccattctttctaggatttctcattgtcagcaccgtacaactaaagttaaggaggcactgttaattaaaacttgcacagtttctgaattagaagcacaacttagacagttgacagaggagcaaaatacactaaatatttcttttcaacaggctactcatcagttagaagaaaaagaaaatcaaattaagagcatgaaggctgatattgaaagtcttgtaacagaaaaagaagccttacagaaggaaggaggcaatcagcaacaggctgcttctgaaaaggagtcttgtataacacagttgaagaaagagttatctgaaaacatcaatgctgtcacattgatgaaagaagagcttaaagaaaaaaaagttgagattagcagtcttagtaaacaactaactgatttgaatgttcagcttcaaaatagcatcagcctatccgaaaaagaagcagccatttcatcactaagaaagcagtatgatgaagaaaaatgtgaattgctggatcaggtgcaagatttatcttttaaagttgacactctgagtaaagagaaaatttctgctcttgagcaggtagatgactggtccaataaattctcagaatggaagaagaaagcacagtcaagatttacacagcatcaaaacactgttaaagaattgcagatccagcttgagttaaaatcaaaggaagcttatgaaaaggatgagcagataaatttattgaaggaagagcttgatcagcaaaataaaagatttgattgtttaaagggtgaaatggaagacgacaagagcaagatggagaaaaaggagtctaatttagaaacagagttaaagtctcaaacagcaagaattatggaattagaggaccatattacccagaaaactattgaaatagagtccttaaatgaagttcttaaaaattacaatcaacaaaaggatattgaacacaaagaattggttcagaaacttcaacattttcaagagttaggagaagaaaaggacaacagggttaaagaagctgaagaaaaaatcttaacacttgaaaaccaagtttattccatgaaagctgaacttgaaactaagaagaaagaattagaacatgtgaatttaagtgtgaaaagcaaagaggaggagttaaaggcattggaagataggcttgagtcagaaagtgctgcaaaattagcagagttgaagagaaaagctgaacaaaaaattgctgccattaagaagcagttgttatctcaaatggaagagaaagaagaacagtataaaaaaggtacagaaagccatttgagtgagctaaatacaaaattgcaggaaagagaaagggaagttcacatcttggaagaaaaacttaagtcagtggaaagttcacagtcagaaacattaattgtacccagatcagcaaaaaatgtggcagcatatactgaacaagaagaagcagattcccaaggctgtgtgcagaagacatatgaagaaaaaatcagtgttttacaaagaaacttaactgaaaaagaaaagctattgcagagggtagggcaggaaaaagaagagacagtttcttctcattttgaaatgcgatgccaataccaggagcgcttaataaagctagaacatgctgaggcaaagcaacatgaagatcaaagtatgataggtcatcttcaagaggagcttgaagaaaaaaacaagaaatattccttgatagtagcccagcatgtggaaaaagaaggaggtaaaaataacatacaggcaaagcaaaacttggaaaatgtgtttgacgacgtccagaaaaccctccaggagaaggaactaacctgtcagattttggagcaaaagataaaagagctggattcctgcttagtaagacagaaagaagtacatagagttgaaatggaagagttgacctcaaaatatgaaaaattacaggctttacaacagatggatggaagaaataaacccacagaacttttggaagaaaacactgaagaaaagtccaaatcacatttggtccaacccaaattgcttagtaacatggaagcccagcacaatgatctggagtttaaattagccggggcagaacgggagaaacagaaactgggcaaggagattgttagattgcagaaagaccttcgaatgttgagaaaggagcatcagcaagaattggaaatactaaagaaagaatatgatcaagaaagggaagagaaaatcaaacaggagcaggaagatcttgaactgaagcacaattccacattaaaacagctgatgagggagtttaatacacagctggcacaaaaggaacaagagctggaaatgaccataaaagaaactatcaataaggcccaggaggtggaggctgaacttttagaaagccatcaagaagagacaaatcagttacttaaaaaaattgctgagaaagatgatgatctaaaacgaacagccaaaagatatgaagaaatccttgatgctcgtgaagaagaaatgactgcaaaagtaagggacctgcagactcaacttgaggagctgcagaagaaataccagcaaaagctagagcaggaggagaaccctggcaatgataatgtaacaattatggagctacagacacagctagcacagaagacgactttaatcagtgattcgaaattgaaagagcaagagttcagagaacagattcacaatttagaagaccgtttgaagaaatatgaaaagaatgtatatgcaacaactgtggggacaccttacaaaggtggcaatttgtaccatacggatgtctcactctttggagaacctaccgaatttgagtatttgcgaaaagtgctttttgagtatatgatgggtcgtgagactaaggtataaatcatgtctcgtgatttggtgtgtggcttaattttaaaagaaatatgttccacttttaatacacatgtgaatgccatatgtttactattagcaaatcagacatgctaatagtaggtaatagataattattttattgctcttagtttacaaagtgaattggtggatcttgcttatatttattacatttataaaacattaattttgaaaatactattgggtaacactgaacgctaaacattaaaatttcattaacataagaata

SEQ ID NO: 300208 - DNA, 1413 bp, Homo sapiens
gcattcgtggatgggagagcttggcgaagctggcacaaaaggaacaagagctggaaatgaccataaaagaaactatcaataaggcccaggaggtggaggctgaacttttagaaagccatcaagaagagacaaatcagttacttaaaaaaattgctgagaaagatgatgatctaaaacgaacagccaaaagatatgaagaaatccttgatgctcgtgaagaagaaatgactgcaaaagtaagggacctgcagactcaacttgaggagctgcagaagaaataccagcaaaagctagagcaggaggagaaccctggcaatgataatgtaacaattatggagctacagacacagctagcacagaagacgactttaatcagtgattcgaaattgaaagagcaagagttcagagaacagattcacaatttagaagaccgtttgaagaaatatgaaaagaatgtatatgcaacaactgtggggacaccttacaaaggtggcaatttgtaccatacggatgtctcactctttggagaacctaccgaatttgagtatttgcgaaaagtgctttttgagtatatgatgggtcgtgagactaagaccatggcaaaagttataaccaccgtactgaagttccctgatgatcagactcagaaaattttggaaagagaagatgctcggctgatgtttacttcacctcgcagtggtatcttctgagtaaaccatcagtctgtgcttagttaacatgtgtcatggctccgatcttcatcttgaagaagagtgacattgggtgactgctgcttggaaaactgtccacacttgctactctttgagaatgaagttgtcattcagggcccctcatgtagccaaaagaccaagaaaaatctggcccacagataagttgcagactgcctttaaaatagattttatcagtggagaaatggtgatagttttttcttcagttttctcttgggaagagttttatgttgtttaaaagatattttgataacttaacctgctttatgggcttacataatattcctttcatccattctttttaaagaacggcttacctttcctatttatttttagggtgattttttaaaaagacttgtgcaatacattttgaggtgaaacttagtggattttttctgataaattagagcatttaattgactattttattcaggttgatctgttgaatatttgctaaagaccagttctttaagctaagacatgtaaaaaatcccaaatggcagtacctcattgtttacttagcttttgtacttatatttttcagaggaaaaaacactactgtaaattgtgaatagccaatacataactgtattgtatgcaaatctgtgattgttggcagtgtcatctctgagaaacagataaataaagtttatttactatataa

SEQ ID NO: 300209 - DNA, 7266 bp, Homo sapiens
ccctggcgcctggtatcagggacttcccgacgctggaagagttcagggaagggaagcgggcccctctggcaccgaagacacagaatcctagctacagctactaaagaaaagaacactatcaattagggcccgcgtcaggttctctggatctccccttctcccatccttgacgctcatccctgtgttctttgcggtgggcccgtcggccctgctgccatcgatagaagcagcactctccccgtctgatttcgcagggccaaagcccaggtgagagtcagggtagtgttcagactagcccacgctccggttctgagccgcgacggcggtctccgcacgcaacgaaatcaggcaggaccgaaccttgcgtcctccagtgcagcgagttcggaagcgaccggccgagcgcgcatgtgcgggacccgacattgtgcttgtcccatccggtgctccgtagttagcctctgtgagctccacgtaggccgcgcaagcgcccttggcgcacagttcacctgctgccgttgtcgtcgccgccgcggctcccggggctggatggggggccgaggccagccagtggcacccggaagaaagagacgcggcggcggcgacgccgacaccctcaggacgagtgtccggacttgcccacagcctcaaggaggagacggcgaggcccggcccccgctgtccctggtgtaaagaagtcgccgtagccgtcgcggccgggactccccgggctctcgcccttcaggtttcgttgacactcaggaccgtacgtacgctgcgccatgttcaagaaactgaagcaaaagatcagcgaggagcagcagcagctccagcaggcgctggctcctgctcaggcgtcctccaattcttcaacaccaacaagaatgaggagcaggacatcttcatttacagagcaacttgatgaaggtacacccaatagagagaatgcatctactcatgcctcgaaatctcctgacagtgttaatggaagtgaaccaagcattcctcagtcaggtgacacacagtcttttgcacagaagctccagctccgggtgccctccgtggagtctttgtttcgaagtccgataaaggaatctctattccggtcttcttctaaagagtctttggtacgaacatcttccagagaatccctgaatcgacttgacctggacagttctactgccagttttgatccaccctctgatatggatagcgaggctgaagacttggtagggaattcagacagtctcaacaaagaacagttgattcagcggttgcgaagaatggaacgaagcttaagtagctacaggggaaaatattctgagcttgttacagcttatcagatgcttcagagagagaagaaaaagctacaaggtatattaagtcagagtcaggataaatcacttcggagaatagcagaattaagagaggagctccaaatggaccagcaggcaaagaaacatctgcaagaggagtttgatgcatctttagaggagaaagatcagtatatcagtgttctccaaactcaggtttctctactgaaacaacgattacgaaatggcccgatgaatgttgatgtactgaaaccacttcctcagctggaaccacaggctgaagtcttcactaaagaagagaatccagaaagtgatggagagccagtagtggaagatggaacttctgtaaaaacactggaaacactccagcaaagagtgaagcgtcaagagaacctacttaagcgttgtaaggaaacaattcagtcacataaggaacaatgtacactattaactagtgaaaaagaagctctgcaagaacaactggatgaaagacttcaagaactagaaaagataaaggaccttcatatggccgagaagactaaacttatcactcagttgcgtgatgcaaagaacttaattgaacagcttgaacaagataagggaatggtaatcgcagagacaaaacgtcagatgcatgaaaccctggaaatgaaagaagaagaaattgctcaactccgtagtcgcatcaaacagatgactacccagggagaggaattacgggaacagaaagaaaagtccgaaagagctgcttttgaggaacttgaaaaagctttgagtacagcccaaaaaacagaggaagcacggagaaaactgaaggcagaaatggatgaacaaataaaaactatcgaaaaaacaagtgaggaggaacgcatcagtcttcaacaggaattaagtcgggtgaaacaggaggttgttgatgtaatgaaaaaatcctcagaagaacaaattgctaagctacagaagcttcatgaaaaggagctggccagaaaagagcaggaactgaccaagaagcttcagacccgagaaagggaatttcaggaacaaatgaaagtagctcttgaaaagagtcaatcagaatatttgaagatcagccaagaaaaagaacagcaagaatctttggccctagaagagttagagttgcagaaaaaagcaatcctcacagaaagtgaaaataaacttcgggaccttcagcaagaagcagagacttacagaactagaattcttgaattggaaagttctttggaaaaaagcttacaagaaaacaaaaatcagtcaaaagatttggctgttcatctggaagctgaaaaaaataagcacaataaggagattacagtcatggttgaaaaacacaagacagaattggaaagccttaagcatcagcaggatgccctttggactgaaaaactccaagtcttaaagcaacaatatcagactgaaatggaaaaacttagggaaaagtgtgaacaagaaaaagaaacattgttgaaagacaaagagattatcttccaggcccacatagaagaaatgaatgaaaagactttagaaaagcttgatgtgaagcaaacagaactagaatcattatcttctgaactgtcagaagtattaaaagcccgtcacaaactagaagaggaactttctgttctgaaagatcaaacagataaaatgaagcaggaattagaggccaagatggatgaacagaaaaatcatcaccagcagcaagttgacagtatcattaaagaacacgaggtatctatccagaggactgagaaggcattaaaagatcaaattaatcaacttgagcttctcttgaaggaaagggacaagcatttgaaagagcatcaggctcatgtagaaaatttagaggcagatattaaaaggtctgaaggggaactccagcaggcatctgctaagctggacgtttttcagtcttaccagagtgccacacatgagcagacaaaagcatatgaggaacagttggcccaattgcagcagaagttgttggatttggaaacagaaagaattcttcttaccaaacaggttgctgaagttgaagcacaaaagaaagatgtttgtactgagttagatgctcacaaaatccaggtgcaggacttaatgcagcaacttgaaaaacaaaatagtgaaatggagcaaaaagtaaaatctttaacccaagtctatgagtccaaacttgaagatggtaacaaagaacaggaacagacaaagcaaatcttggtggaaaaggaaaatatgattttacaaatgagagaaggacagaagaaagaaattgagatactcacacagaaattgtcagccaaggaggacagtattcatattttgaatgaggaatatgaaaccaaatttaaaaaccaagaaaaaaagatggaaaaagttaagcagaaagcaaaggagatgcaagaaacgttaaagaaaaaattactggatcaggaagccaaacttaagaaagagcttgaaaatactgctctagagcttagtcagaaagaaaaacagtttaatgccaaaatgctggaaatggcacaggctaactcagctggaatcagtgatgcagtgtcaagactggaaacaaaccaaaaagaacaaatagaaagtcttactgaggttcatcgacgagaactcaatgatgtcatatcaatctgggaaaagaaacttaatcagcaagctgaagaacttcaggaaatacatgaaatccaattacaggaaaaagaacaagaggtagcagaactgaaacaaaagatcctcctatttgggtgtgaaaaagaagagatgaacaaggaaataacatggctgaaggaagaaggtgttaagcaggatacaacattaaatgaattacaggaacagttaaagcagaagtctgcccatgtgaattctcttgcacaagatgaaactaaactgaaagctcatcttgaaaagctagaggttgacttgaataagtctctgaaggaaaatacttttcttcaagagcagctagttgaactgaagatgctggcagaagaagataagcggaaggtttctgagttgactagcaagttgaaaaccacagatgaagaattccagagtttgaaatcttcacatgaaaaaagtaacaaaagcctagaggacaagagcttggaatttaaaaaactgtctgaggaactagcgattcagctagatatttgctgtaagaaaaccgaagccttattagaagctaaaacaaatgagctaatcaacattagtagtagtaaaactaatgccattctttctaggatttctcattgtcagcaccgtacaactaaagttaaggaggcactgttaattaaaacttgcacagtttctgaattagaagcacaacttagacagttgacagaggagcaaaatacactaaatatttcttttcaacaggctactcatcagttagaagaaaaagaaaatcaaattaagagcatgaaggctgatattgaaagtcttgtaacagaaaaagaagccttacagaaggaaggaggcaatcagcaacaggctgcttctgaaaaggagtcttgtataacacagttgaagaaagagttatctgaaaacatcaatgctgtcacattgatgaaagaagagcttaaagaaaaaaaagttgagattagcagtcttagtaaacaactaactgatttgaatgttcagcttcaaaatagcatcagcctatccgaaaaagaagcagccatttcatcactaagaaagcagtatgatgaagaaaaatgtgaattgctggatcaggtgcaagatttatcttttaaagttgacactctgagtaaagagaaaatttctgctcttgagcaggtagatgactggtccaataaattctcagaatggaagaagaaagcacagtcaagatttacacagcatcaaaacactgttaaagaattgcagatccagcttgagttaaaatcaaaggaagcttatgaaaaggatgagcagataaatttattgaaggaagagcttgatcagcaaaataaaagatttgattgtttaaagggtgaaatggaagacgacaagagcaagatggagaaaaaggagtctaatttagaaacagagttaaagtctcaaacagcaagaattatggaattagaggaccatattacccagaaaactattgaaatagagtccttaaatgaagttcttaaaaattacaatcaacaaaaggatattgaacacaaagaattggttcagaaacttcaacattttcaagagttaggagaagaaaaggacaacagggttaaagaagctgaagaaaaaatcttaacacttgaaaaccaagtttattccatgaaagctgaacttgaaactaagaagaaagaattagaacatgtgaatttaagtgtgaaaagcaaagaggaggagttaaaggcattggaagataggcttgagtcagaaagtgctgcaaaattagcagagttgaagagaaaagctgaacaaaaaattgctgccattaagaagcagttgttatctcaaatggaagagaaagaagaacagtataaaaaaggtacagaaagccatttgagtgagctaaatacaaaattgcaggaaagagaaagggaagttcacatcttggaagaaaaacttaagtcagtggaaagttcacagtcagaaacattaattgtacccagatcagcaaaaaatgtggcagcatatactgaacaagaagaagcagattcccaaggctgtgtgcagaagacatatgaagaaaaaatcagtgttttacaaagaaacttaactgaaaaagaaaagctattgcagagggtagggcaggaaaaagaagagacagtttcttctcattttgaaatgcgatgccaataccaggagcgcttaataaagctagaacatgctgaggcaaagcaacatgaagatcaaagtatgataggtcatcttcaagaggagcttgaagaaaaaaacaagaaatattccttgatagtagcccagcatgtggaaaaagaaggaggtaaaaataacatacaggcaaagcaaaacttggaaaatgtgtttgacgacgtccagaaaaccctccaggagaaggaactaacctgtcagattttggagcaaaagataaaagagctggattcctgcttagtaagacagaaagaagtacatagagttgaaatggaagagttgacctcaaaatatgaaaaattacaggctttacaacagatggatggaagaaataaacccacagaacttttggaagaaaacactgaagaaaagtccaaatcacatttggtccaacccaaattgcttagtaacatggaagcccagcacaatgatctggagtttaaattagccggggcagaacgggagaaacagaaactgggcaaggagattgttagattgcagaaagaccttcgaatgttgagaaaggagcatcagcaagaattggaaatactaaagaaagaatatgatcaagaaagggaagagaaaatcaaacaggagcaggaagatcttgaactgaagcacaattccacattaaaacagctgatgagggagtttaatacacagctggcacaaaaggaacaagagctggaaatgaccataaaagaaactatcaataaggcccaggaggtggaggctgaacttttagaaagccatcaagaagagacaaatcagttacttaaaaaaattgctgagaaagatgatgatctaaaacgaacagccaaaagatatgaagaaatccttgatgctcgtgaagaagaaatgactgcaaaagtaagggacctgcagactcaacttgaggagctgcagaagaaataccagcaaaagctagagcaggaggagaaccctggcaatgataatgtaacaaattatggagcttacagacacagtacgcacagacagagcgactatcatctctgcttcgtatattgtaagacgcccagggttccgtgatccgaggtcacaacttttg

SEQ ID NO: 300210 - DNA, 7228 bp, Homo sapiens
  misc_feature (7059)..(7059): n is a, c, g, or t
  misc_feature (7062)..(7062): n is a, c, g, or t
  misc_feature (7074)..(7074): n is a, c, g, or t
  misc_feature (7084)..(7084): n is a, c, g, or t
  misc_feature (7099)..(7099): n is a, c, g, or t
  misc_feature (7109)..(7110): n is a, c, g, or t
  misc_feature (7118)..(7118): n is a, c, g, or t
  misc_feature (7129)..(7130): n is a, c, g, or t
  misc_feature (7135)..(7135): n is a, c, g, or t
  misc_feature (7137)..(7137): n is a, c, g, or t
  misc_feature (7155)..(7156): n is a, c, g, or t
  misc_feature (7162)..(7162): n is a, c, g, or t
  misc_feature (7170)..(7170): n is a, c, g, or t
  misc_feature (7173)..(7173): n is a, c, g, or t
ccctggcgcctggtatcagggacttcccgacgctggaagagttcagggaagggaagcgggcccctctggcaccgaagacacagaatcctagctacagctactaaagaaaagaacactatcaattagggcccgcgtcaggttctctggatctccccttctcccatccttgacgctcatccctgtgttctttgcggtgggcccgtcggccctgctgccatcgatagaagcagcactctccccgtctgatttcgcagggccaaagcccaggtgagagtcagggtagtgttcagactagcccacgctccggttctgagccgcgacggcggtctccgcacgcaacgaaatcaggcaggaccgaaccttgcgtcctccagtgcagcgagttcggaagcgaccggccgagcgcgcatgtgcgggacccgacattgtgcttgtcccatccggtgctccgtagttagcctctgtgagctccacgtaggccgcgcaagcgcccttggcgcacagttcacctgctgccgttgtcgtcgccgccgcggctcccggggctggatggggggccgaggccagccagtggcacccggaagaaagagacgcggcggcggcgacgccgacaccctcaggacgagtgtccggacttgcccacagcctcaaggaggagacggcgaggcccggcccccgctgtccctggtgtaaagaagtcgccgtagccgtcgcggccgggactccccgggctctcgcccttcaggtttcgttgacactcaggaccgtacgtacgctgcgccatgttcaagaaactgaagcaaaagatcagcgaggagcagcagcagctccagcaggcgctggctcctgctcaggcgtcctccaattcttcaacaccaacaagaatgaggagcaggacatcttcatttacagagcaacttgatgaaggtacacccaatagagagaatgcatctactcatgcctcgaaatctcctgacagtgttaatggaagtgaaccaagcattcctcagtcaggtgacacacagtcttttgcacagaagctccagctccgggtgccctccgtggagtctttgtttcgaagtccgataaaggaatctctattccggtcttcttctaaagagtctttggtacgaacatcttccagagaatccctgaatcgacttgacctggacagttctactgccagttttgatccaccctctgatatggatagcgaggctgaagacttggtagggaattcagacagtctcaacaaagaacagttgattcagcggttgcgaagaatggaacgaagcttaagtagctacaggggaaaatattctgagcttgttacagcttatcagatgcttcagagagagaagaaaaagctacaaggtatattaagtcagagtcaggataaatcacttcggagaatagcagaattaagagaggagctccaaatggaccagcaggcaaagaaacatctgcaagaggagtttgatgcatctttagaggagaaagatcagtatatcagtgttctccaaactcaggtttctctactgaaacaacgattacgaaatggcccgatgaatgttgatgtactgaaaccacttcctcagctggaaccacaggctgaagtcttcactaaagaagagaatccagaaagtgatggagagccagtagtggaagatggaacttctgtaaaaacactggaaacactccagcaaagagtgaagcgtcaagagaacctacttaagcgttgtaaggaaacaattcagtcacataaggaacaatgtacactattaactagtgaaaaagaagctctgcaagaacaactggatgaaagacttcaagaactagaaaagataaaggaccttcatatggccgagaagactaaacttatcactcagttgcgtgatgcaaagaacttaattgaacagcttgaacaagataagggaatggtaatcgcagagacaaaacgtcagatgcatgaaaccctggaaatgaaagaagaagaaattgctcaactccgtagtcgcatcaaacagatgactacccagggagaggaattacgggaacagaaagaaaagtccgaaagagctgcttttgaggaacttgaaaaagctttgagtacagcccaaaaaacagaggaagcacggagaaaactgaaggcagaaatggatgaacaaataaaaactatcgaaaaaacaagtgaggaggaacgcatcagtcttcaacaggaattaagtcgggtgaaacaggaggttgttgatgtaatgaaaaaatcctcagaagaacaaattgctaagctacagaagcttcatgaaaaggagctggccagaaaagagcaggaactgaccaagaagcttcagacccgagaaagggaatttcaggaacaaatgaaagtagctcttgaaaagagtcaatcagaatatttgaagatcagccaagaaaaagaacagcaagaatctttggccctagaagagttagagttgcagaaaaaagcaatcctcacagaaagtgaaaataaacttcgggaccttcagcaagaagcagagacttacagaactagaattcttgaattggaaagttctttggaaaaaagcttacaagaaaacaaaaatcagtcaaaagatttggctgttcatctggaagctgaaaaaaataagcacaataaggagattacagtcatggttgaaaaacacaagacagaattggaaagccttaagcatcagcaggatgccctttggactgaaaaactccaagtcttaaagcaacaatatcagactgaaatggaaaaacttagggaaaagtgtgaacaagaaaaagaaacattgttgaaagacaaagagattatcttccaggcccacatagaagaaatgaatgaaaagactttagaaaagcttgatgtgaagcaaacagaactagaatcattatcttctgaactgtcagaagtattaaaagcccgtcacaaactagaagaggaactttctgttctgaaagatcaaacagataaaatgaagcaggaattagaggccaagatggatgaacagaaaaatcatcaccagcagcaagttgacagtatcattaaagaacacgaggtatctatccagaggactgagaaggcattaaaagatcaaattaatcaacttgagcttctcttgaaggaaagggacaagcatttgaaagagcatcaggctcatgtagaaaatttagaggcagatattaaaaggtctgaaggggaactccagcaggcatctgctaagctggacgtttttcagtcttaccagagtgccacacatgagcagacaaaagcatatgaggaacagttggcccaattgcagcagaagttgttggatttggaaacagaaagaattcttcttaccaaacaggttgctgaagttgaagcacaaaagaaagatgtttgtactgagttagatgctcacaaaatccaggtgcaggacttaatgcagcaacttgaaaaacaaaatagtgaaatggagcaaaaagtaaaatctttaacccaagtctatgagtccaaacttgaagatggtaacaaagaacaggaacagacaaagcaaatcttggtggaaaaggaaaatatgattttacaaatgagagaaggacagaagaaagaaattgagatactcacacagaaattgtcagccaaggaggacagtattcatattttgaatgaggaatatgaaaccaaatttaaaaaccaagaaaaaaagatggaaaaagttaagcagaaagcaaaggagatgcaagaaacgttaaagaaaaaattactggatcaggaagccaaacttaagaaagagcttgaaaatactgctctagagcttagtcagaaagaaaaacagtttaatgccaaaatgctggaaatggcacaggctaactcagctggaatcagtgatgcagtgtcaagactggaaacaaaccaaaaagaacaaatagaaagtcttactgaggttcatcgacgagaactcaatgatgtcatatcaatctgggaaaagaaacttaatcagcaagctgaagaacttcaggaaatacatgaaatccaattacaggaaaaagaacaagaggtagcagaactgaaacaaaagatcctcctatttgggtgtgaaaaagaagagatgaacaaggaaataacatggctgaaggaagaaggtgttaagcaggatacaacattaaatgaattacaggaacagttaaagcagaagtctgcccatgtgaattctcttgcacaagatgaaactaaactgaaagctcatcttgaaaagctagaggttgacttgaataagtctctgaaggaaaatacttttcttcaagagcagctagttgaactgaagatgctggcagaagaagataagcggaaggtttctgagttgactagcaagttgaaaaccacagatgaagaattccagagtttgaaatcttcacatgaaaaaagtaacaaaagcctagaggacaagagcttggaatttaaaaaactgtctgaggaactagcgattcagctagatatttgctgtaagaaaaccgaagccttattagaagctaaaacaaatgagctaatcaacattagtagtagtaaaactaatgccattctttctaggatttctcattgtcagcaccgtacaactaaagttaaggaggcactgttaattaaaacttgcacagtttctgaattagaagcacaacttagacagttgacagaggagcaaaatacactaaatatttcttttcaacaggctactcatcagttagaagaaaaagaaaatcaaattaagagcatgaaggctgatattgaaagtcttgtaacagaaaaagaagccttacagaaggaaggaggcaatcagcaacaggctgcttctgaaaaggagtcttgtataacacagttgaagaaagagttatctgaaaacatcaatgctgtcacattgatgaaagaagagcttaaagaaaaaaaagttgagattagcagtcttagtaaacaactaactgatttgaatgttcagcttcaaaatagcatcagcctatccgaaaaagaagcagccatttcatcactaagaaagcagtatgatgaagaaaaatgtgaattgctggatcaggtgcaagatttatcttttaaagttgacactctgagtaaagagaaaatttctgctcttgagcaggtagatgactggtccaataaattctcagaatggaagaagaaagcacagtcaagatttacacagcatcaaaacactgttaaagaattgcagatccagcttgagttaaaatcaaaggaagcttatgaaaaggatgagcagataaatttattgaaggaagagcttgatcagcaaaataaaagatttgattgtttaaagggtgaaatggaagacgacaagagcaagatggagaaaaaggagtctaatttagaaacagagttaaagtctcaaacagcaagaattatggaattagaggaccatattacccagaaaactattgaaatagagtccttaaatgaagttcttaaaaattacaatcaacaaaaggatattgaacacaaagaattggttcagaaacttcaacattttcaagagttaggagaagaaaaggacaacagggttaaagaagctgaagaaaaaatcttaacacttgaaaaccaagtttattccatgaaagctgaacttgaaactaagaagaaagaattagaacatgtgaatttaagtgtgaaaagcaaagaggaggagttaaaggcattggaagataggcttgagtcagaaagtgctgcaaaattagcagagttgaagagaaaagctgaacaaaaaattgctgccattaagaagcagttgttatctcaaatggaagagaaagaagaacagtataaaaaaggtacagaaagccatttgagtgagctaaatacaaaattgcaggaaagagaaagggaagttcacatcttggaagaaaaacttaagtcagtggaaagttcacagtcagaaacattaattgtacccagatcagcaaaaaatgtggcagcatatactgaacaagaagaagcagattcccaaggctgtgtgcagaagacatatgaagaaaaaatcagtgttttacaaagaaacttaactgaaaaagaaaagctattgcagagggtagggcaggaaaaagaagagacagtttcttctcattttgaaatgcgatgccaataccaggagcgcttaataaagctagaacatgctgaggcaaagcaacatgaagatcaaagtatgataggtcatcttcaagaggagcttgaagaaaaaaacaagaaatattccttgatagtagcccagcatgtggaaaaagaaggaggtaaaaataacatacaggcaaagcaaaacttggaaaatgtgtttgacgacgtccagaaaaccctccaggagaaggaactaacctgtcagattttggagcaaaagataaaagagctggattcctgcttagtaagacagaaagaagtacatagagttgaaatggaagagttgacctcaaaatatgaaaaattacaggctttacaacagatggatggaagaaataaacccacagaacttttggaagaaaacactgaagaaaagtccaaatcacatttggtccaacccaaattgcttagtaacatggaagcccagcacaatgatctggagtttaaattagccggggcagaacgggagaaacagaaactgggcaaggagattgttagattgcagaaagaccttcgaatgttgagaaaggagcatcagcaagaattggaaatactaaagaaagaatatgatcaagaaagggaagagaaaatcaaacaggagcaggaagatcttgaactgaagcacaattccacattaaaacagctgatgagggagtttaatacacagctggcacaaaaggaacaagagctggaaatgaccataaaagaaactatcaataaggcccaggaaggtgggtctaaatgcaatcatgattgcatttagactaataaaaaaaaagagaaagacacaatcagaatgacaaaggggacattaccaatgataacccagaaatagaaaaaaaaaaaaaaaccccctcggaaaactnctntaattacctttntgcacacaancaaaaaacttaaaanaaataattcnntggcaacntacaacttgtnnaattntncccaggaagagattgatnncctaancaaaccantancagtttctgaatttgcttcattaataaaaagcacacaaaccaaaacaggcccagg

SEQ ID NO: 300211 - DNA, 1198 bp, Homo sapiens
gaagaagaaatgactgcaaaagtaagggacctgcagactcaacttgaggagctgcagaagaaataccagcaaaagctagagcaggaggagaaccctggcaatgataatgtaacaattatggagctacagacacagctagcacagaagacgactttaatcagtgattcgaaattgaaagagcaagagttcagagaacagattcacaatttagaagaccgtttgaagaaatatgaaaagaatgtatatgcaacaactgtggggacaccttacaaaggtggcaatttgtaccatacggatgtctcactctttggagaacctaccgaatttgagtatttgcgaaaagtgctttttgagtatatgatgggtcgtgagactaagaccatggcaaaagttataaccaccgtactgaagttccctgatgatcagactcagaaaattttggaaagagaagatgctcggctgatgtttacttcacctcgcagtggtatcttctgagtaaaccatcagtctgtgcttagttaacatgtgtcatggctccgatcttcatcttgaagaagagtgacattgggtgactgctgcttggaaaactgtccacacttgctactctttgagaatgaagttgtcattcagggcccctcatgtagccaaaagaccaagaaaaatctggcccacagataagttgcagactgcctttaaaatagattttatcagtggagaaatggtgatagttttttcttcagttttctcttgggaagagttttatgttgtttaaaagatattttgataacttaacctgctttatgggcttacataatattcctttcatccattctttttaaagaacggcttacctttcctatttatttttagggtgattttttaaaaagacttgtgcaatacattttgaggtgaaacttagtggattttttctgataaattagagcatttaattgactattttattcaggttgatctgttgaatatttgctaaagaccagttctttaagctaagacatgtaaaaaatcccaaatggcagtacctcattgtttacttagcttttgtacttatatttttcagaggaaaaaacactactgtaaattgtgaatagccaatacataactgtattgtatgcaaatctgtgattgttggcagtgtcatctctgagaaacagataaataaagtttatttactatataa

SEQ ID NO: 300212 - DNA, 1277 bp, Homo sapiens
ggccaggctggtctcaaactcctggcctcaagtgatctttccaccttggccttccaaagtgctaggattataggcatgagccactgggtccagcctgtcatctttaattccagtccaatatttgtgagattcagccaagtcagcgtgtttactcctgggttactgtataaactggtagcattcgatatatggtaaatggttgcagttccaaatttcacttagaaatgccattttccaggattgctgactataggttggtttgcatcattgcaagaatgttaatttttagaagatacctttaagatttagtgtttagacaatttctacttttttttttttttttcagaatggggtcttgctgtgttgaccaggctggtctcgaactcctggcctcaagtgattctcccatcttggcctctcaaagtgctgggattacagtcatgagctaccacacccagccttatttctgcctctttactgcagtctctagaccatggaatagaattttatttcaaacttgaaaaaacaaatatcccaaaaagtcaacctaaatgttttggatttttttgccccctttctttattctcttttcctttttcttttccagtcatggctccgatcttcatcttgaagaagagtgacattgggtgactgctgcttggaaaactgtccacacttgctactctttgagaatgaagttgtcattcagggcccctcatgtagccaaaagaccaagaaaaatctggcccacagataagttgcagactgcctttaaaatagattttatcagtggagaaatggtgatagttttttcttcagttttctcttgggaagagttttatgttgtttaaaagatattttgataacttaacctgctttatgggcttacataatattcctttcatccattctttttaaagaacggcttacctttcctatttatttttagggtgattttttaaaaagacttgtgcaatacattttgaggtgaaacttagtggattttttctgataaattagagcatttaattgactattttattcaggttgatctgttgaatatttgctaaagaccagttctttaagctaagacatgtaaaaaatcccaaatggcagtacctcattgtttacttagcttttgtacttatatttttcagaggaaaaaacactactgtaaattgtgaatagccaatacataactgtattgtatgcaaatctgtgattgttggcagtgtcatctctgagaaacagataaataaagtttatttactatataa

SEQ ID NO: 300213 - DNA, 1104 bp, Homo sapiens
agggcttggagtttaaagtgaggcatgaaggaaagtgtttagagcacaataatgaattaaaataaaaacagtagtgtgtgtctcaaaaacttaaatgtttatttccctacagaggtagttttctctataccatgttgcctctccagagtgcttttttgatgtgtttgtttactaatgcttctttttttttcttttcctttttttctttttttttaaatcctaaaggctcgtgaagaagaaatgactgcaaaagtaagggacctgcagactcaacttgaggagctgcagaagaaataccagcaaaagctagagcaggaggagaaccctggcaatgataatgtaacaattatggagctacagacacagctagcacagaagacgactttaatcagtgattcgaaattgaaagagcaagagttcagagaacagattcacaatttagaagaccattttttcatctggcccgatctgtgtattaatgtcctacctagtccccttactgagtcctttttccctaacatagtcatctgtctgtcagagttattttctgtctggaaacaaaggtgtgatttattacttctcctcctaaatatgtgcagtggtttcccatggtcacagtgatacctcgtctagtttttttcttcagttttctcttgggaagagttttatgttgtttaaaagatattttgataacttaacctgctttatgggcttacataatattcctttcatccattctttttaaagaacggcttacctttcctatttatttttagggtgattttttaaaaagacttgtgcaatacattttgaggtgaaacttagtggattttttctgataaattagagcatttaattgactattttattcaggttgatctgttgaatatttgctaaagaccagttctttaagctaagacatgtaaaaaatcccaaatggcagtacctcattgtttacttagcttttgtacttatatttttcagaggaaaaaacactactgtaaattgtgaatagccaatacataactgtattgtatgcaaatctgtgattgttggcagtgtcatctctgagaaacagataaataaagtttatttactatataa

SEQ ID NO: 300214 - DNA, 487 bp, Homo sapiens
cgtaattcagctggtaaatatgtacttaaaatatgcagtacacctttcattacgttgtttaagtcttcaaatgaaagttgcaagtaaaatctcagctacataatattatatttacctaggatatggggggaggtattacagattccttattccttgcctgtacacccttgatttggggagatttgagaaaaatttaagtacagtctgtaatcctatgaacttcatatacacatacaatctatgtgttatattaagtcttaaaactaacccaataagctttttttcttcctggctttgtagtttacttcacctcgcagtggtatcttctgagtaaaccatcagtctgtgcttagttaacatgtggtgagtgaagaacaatgtcttgtgtcttttgtgcaaaaatcaaatgtgttgcctgatactaaccattttgctggaattcttttgctcttgtttaataaatatatgattatgctatgggttaata

SEQ ID NO: 300215 - DNA, 312 bp, Homo sapiens
gctcgtgaagaagaaatgactgcaaaagtaagggacctgcagactcaacttgaggagctgcagaagaaataccagcaaaagctagagcaggaggagaaccctggcaatgataatgtaacaaggagtttgagtttgctgcacatgtttcttgaaaacattgtcatttctgtgatttgactagcctactaacatacatacatatttatctcatttaatcctaatgaaaaccctttgagatttttacctccgttttatagacagataaactaaatgttcaaagagattaaataaaatgttcaagctcacacaata

SEQ ID NO: 300216 - DNA, 511 bp, Homo sapiens
taacatggaagcccagcacaatgatctggagtttaaattagccggggcagaacgggagaaacagaaactgggcaaggagattgttagattgcagaaagaccttcgaatgttgagaaaggagcatcagcaagaattggaaatactaaagaaagaatatgatcaagaaagggaagagaaaatcaagtaagttttatttcagcttgaatatttttatggcagtccttcttaattaagtctcctttttttgtgcctaatacagttattttaaattatttggataagtttcaccaacccaaaatattaaacataaatccaatatgttaaatatgaggagaaataaaaacaatttagggcaagtggcagtgttattccatgtccatttaggagagaaaaaccttttcttgcatataagattctggttattagggacatatccaagtaattattttctttttgttttgttgttttttagtattagcattattattatataacatagatgtgttttgaa

SEQ ID NO: 300217 - DNA, 721 bp, Homo sapiens
ggccctatgtcttctgtgggccacctaggattcacaggaaggagcagctctgattcttacatggctggctccgtggccctatgtcttctgtggagttacagtataaagcagggagctaattaagagtattaaaacttaaaaccattttttgactctgaaaaaaaaaaaaaaaaaaaaaaaaaaaaaaaaaaaaaacccggggttttttttgggggggggaaaaaagggtaaaggggcatcagggtcctatagttggtttccctggacccagtctttcttgtacaaggtgggaaaatcgggccggtccccctaatagggagtccgttataatattccaaaaaagccgggttaaccctggttttaattggattgcgcgaagagcaacactacaaccccaacgacaacaccaacagacagcatcaacaatctatctacaccaaaaaccgggggcggcggcgcaccgcacctaaaacatgagaccaacaaactaaacgaactaaaccgccgcggcgccgaacgacaagacaacaacaaagaagaacatcaaaccccgaaatcaagagagagacacgagacagataaaggagaagagaaggagacacacgagaagatagtagcagcgagctagacgaggaagaaagagacaaaccgagggacacaagagaatacgaacaagcaggacgcaacagccgagcacagaaagacagcaacaacagagagg

SEQ ID NO: 300218 - DNA, 226 bp, Homo sapiens
catttatttacatattgaccccaatgtcagaagttactcagaagtgtgtgcaactctgtatagaccccttcctgggactggacacagaggctgaaataaaaaccagtttttcagcatgacttagcacaatgttatttattttcactgcctattagcctatgggtcatgagatttgttattctagagcagttgagtattggagtggaacaagcaaaagcaaggcata

SEQ ID NO: 300219 - DNA, 5166 bp, Homo sapiens
cgcccagagcgaggctggggtagggaggccgactgagcaggagtcgtccgcttatagtggaggctgctaggagccggtcagagggtgagtggggagcaggcgagcgagccacagcaggcaggagggagcgtcgcgcggcgcagaggagcgccggggcagggccgcggcggaaccacagccggagaggggcagcccgagccgggcgccgcagggtccccacccccacccggccggacagtgcccggtgttcccccgtgcggggggcggcggcggcggctgacgggaccgccgggaccgcgggggtgttgccacctccaccgaggagccggcgcggccgcgggctcctcagagccggggccccgggcccgtgacagacgggccgaggaagggagagaggcggcggcgacaccatgtcatctcccagtccgggcaagaggcggatggacacggacgtggtcaagctcatcgagagtaaacatgaggttacgatcctgggaggacttaatgaatttgtagtgaagttttatggaccacaaggaacaccatatgaaggcggagtatggaaagttagagtggacctacctgataaataccctttcaaatctccatctataggattcatgaataaaattttccatcccaacattgatgaagcgtcaggaactgtgtgtctagatgtaattaatcaaacttggacagctctctatgatcttaccaatatatttgagtccttcctgcctcagttattggcctatcctaaccccatagatcctctcaatggtgacgctgcagccatgtacctccaccgaccagaagaatacaagcagaaaattaaagagtacatccagaaatacgccacggaggaggcgctgaaagaacaggaagagggtaccggggacagctcatcggagagctctatgtctgacttttccgaagatgaggcccaggatatggagttgtagtagaaaaagcacctgcttttcagaaagactattatttcctaaccatgagaagcagactataatattcatatttaaacaaagcaattttttttattactaaacaaggtttttatgaataatagcattgatatatatatattatatatcaccctttagatcttgatttcttggtcatttctcaacctgaggtgcatagcatattcccacattccatttggtagcaatatgcggtctgaatgcatgcattcatgagtccatgtggccaagtcagcctgtgtgctactgaactgtcgaaggaaatagccgctctgataggtagatgtgagtaaaaagaacaggaaaaaattgcttcttttattggtttccaaagaaacaaaccaaaccaaccagctcttggatgtgaagataaaatagtgcttttttgaaatggagaggaaaaacttggggaggaagaggcctgctgtgggggcatcggagccagccatgtaagaatcagagctgctccttcctgtgaatcctaggtggccctatgtcttctgtggagttacagtataaagcagggagctaattaagagtattaaaacttaaaaccattttttgactctgattttaagtacatttttatatgtcagttgctgcccttcacactaccaggccctgcagccacagtgttctgttggagaaacttggggaagtgttttctgaaccagttctttttcttggggtagagcgtgaaatccagacctgtttttgaaaggacagcacaggaggagaaaagtgactgggacgatgcttcctctcatccaaaacacatgcagagtcacatcctcatcctagtgtttggcagtttgagaccgctaccctgaacttaagagctttaaatatgagggttgtgtttctgggggggttatttttttggtgtgtgtgtgtgtgtattgtgcttagaaaggttgcagatttcatcttcacctaccaagaggcggccgcctccttggacaagccgctcatggaccattagacttgagaagacgacccacgtggtgactgcaaagccctgggtacttgccttcatgttctggtttggttttccctttttctgctgctcttggcagcagcctggtcatcatctgcttgtgggagtgggaaatgggtattttagacccaacacaggttctaaatttaaaacaaataataattggaacaaataaaggttcttgtacccagagtgattctacatgggaaaaacaaaccagcttttttcagagagtgaccgaataggaagaagggattcagaaatatgatgtagtagaacatgccctgcaggaagaaaatgttttctctcctgcgtatgttaagaggaaatcagtttaaaatgcctgctaatcaaatgtcgactcagctaaccatatgtccaggttgctgcagagtttctttcaaatctgagtgttgcctgctgaactcggaggggagtttggagaaattttagacagcagctctgtgttctttttttgccgcagccaataagataatagcagaattagccaatcctaaaaccttctaaagacgatttttgagcatcccactgggattatttaatttttctttttgacgtgtgtttttagtttagaagtgctgtattccacaaggtttaagtcagtgaggttggaagataccctatcttttttattcaaaaagcacaatcaatcttttgtttgaaaatctatataaagtacaacttgcttttagcatgattattttcctaaataaaaagacaaagaatttacttactttatgttaattacgggcatgaagcaaaaggttttctttaaaaaaaaaaaaaagtgcagtgatgtagggctgtggttagttaaccgtactgagttatccatctagcatctgtggcttgctggaagggtagtattaactatttaacatgtaatggtgtacttcactcttacctagcacgctgtcttctcattgctttgggggagggagggtctctctgctggcactgtctaacttgcttacctgctgactttgcagtttgcttgtgctatgacatttattgtaggtgctatttagggtaggcttaaagtgctgggtggtgatttgagttcaaacaataaaaaattgtattttttcaatattgtataaacaatagtgttctaattaccttaaaaaaaaataatgaccagttaagaattgcttttgatcttgtcaaaaaactgaatagaccccagtttcgggaaggtgtgtgagcagtgccatgactctgccccttacctaatcccacatctctctaatgataagacattggctcgcctctgaccagagccccagcaccagagagcggaagatgcagaattgtcaaatgacctgctgggggaggttgtaggagtttagcagatttgagtgtggctgcagagagagagagagtgtgtgtatgtgtgcacatgtgtgagagtgtgagcgagagtgtgtgtgtgtccatctaagtctgtgtgatgaaggtgggataaggctcctctgttagtgctggaagctcctgtaattgccgcatggatcccactgtgccctcttgttctgtgcaagtctgtcctgtctgggcactaaccttggtcccatgcatgtttatgttctgggtggggctttgcctctccactgggaaactgacttttgctgggttgaacagagtcccttatgctttttgtcctctccctgcgcctgggagaggtgggagtaggagcccaaacacacaggtacagaaagatctggaagaaggcctggcagtgaatccaaggactctgggcccccaacaatagatggtagcgtaagtctgggagcagcggtgtttcaccaccaaatgcctttccaggcttgcccttccaacactcaggagagcatccagatccctgggcagaggctctacattcttggctttagaggtggtggcagcggcagcaggtcagagccacttctggcggtttccctcccctttttagtgcccatagtttttggatcctcccttgagttttaccagcacaagccattctttgcccctgttcacataactgagctcaagctcttgccaaacaccaacaagcaagatggttgcaacctggcaacattgaatccaccacccttgggctccctctggaagccccagcaccggggggcttttgggcacagggtcagtggtagccatcttagacactgacatttggctttgtcgtcaatttcatcaccctccttgaggttactgtgcagtttcaaccagcattttatcctagtgaggtcattatcaggagttgccatatcatctctccagtacctaacatttctcatccacttcaaaagctgttctgactgccagctggctgatctaagctcctgaggaatgtctcctctcaaaggaatttttccctccaaaggccccctgaagtcctagttggcattggcctggcacatgctttatgttaggcctcccgttgggatggctgagaatcatgaaagacagatcctccgctagcctctgtgggtcaagtttctggacaccaagtctctgggaactagtgtttgattttaaatggcatgtggcccttccttgtttcagtgacttagaaaagtaaaagccatttaaaaaagttagcaagattttttatcgacttcccaactgggcttccagccttgttgaatgaaatcatctatctctgattgggcgcaacgaactgcatttctttggacttctgaatccatgtttgtgctttctctggcccgtgaacacctcggcgattctgttagggatgggatgagtgggaggaagccctttgagaagggggagccggccctgtcatgcgcaggttttccactcatctgaggaagagccagggctctgaatttagcctaacactcatcttggctgtgggcttgggaagaaatggccattatttacagattgtatttggtacatattgtgtgatacttgaaaagataaaagggactgccagcccctaactgaaatctgaagctttttatcgcttatttttcctcgccctgtctcctcccttccacctttctccttgcattgtgatgatctagtaggcacgtctgtcaacaggacacatgcctcctctgactataacctcttaatagttgtgtataatgaaaactgtaaacttttttaaataaacgtgtatataccttg

SEQ ID NO: 300220 - DNA, 5624 bp, Homo sapiens
cgcccagagcgaggctggggtagggaggccgactgagcaggagtcgtccgcttatagtggaggctgctaggagccggtcagagggtgagtggggagcaggcgagcgagccacagcaggcaggagggagcgtcgcgcggcgcagaggagcgccggggcagggccgcggcggaaccacagccggagaggggcagcccgagccgggcgccgcagggtccccacccccacccggccggacagtgcccggtgttcccccgtgcggggggcggcggcggcggctgacgggaccgccgggaccgcgggggtgttgccacctccaccgaggagccggcgcggccgcgggctcctcagagccggggccccgggcccgtgacagacgggccgaggaagggagagaggcggcggcgacaccatgtcatctcccagtccgggcaagaggcggatggacacggacgtggtcaagctcatcgagagtaaacatgaggttacgatcctgggaggacttaatgaatttgtagtgaagttttatggaccacaaggaacaccatatgaaggcggagtatggaaagttagagtggacctacctgataaataccctttcaaatctccatctataggattcatgaataaaattttccatcccaacattgatgaagcgtcaggaactgtgtgtctagatgtaattaatcaaacttggacagctctctatgatcttaccaatatatttgagtccttcctgcctcagttattggcctatcctaaccccatagatcctctcaatggtgacgctgcagccatgtacctccaccgaccagaagaatacaagcagaaaattaaagagtacatccagaaatacgccacggaggaggcgctgaaagaacaggaagagggtaccggggacagctcatcggagagctctatgtctgacttttccgaagatgaggcccaggatatggagttgtagtagaaaaagcacctgcttttcagaaagactattatttcctaaccatgagaagcagactataatattcatatttaaacaaagcaattttttttattactaaacaaggtttttatgaataatagcattgatatatatatattatatatcaccctttagatcttgatttcttggtcatttctcaacctgaggtgcatagcatattcccacattccatttggtagcaatatgcggtctgaatgcatgcattcatgagtccatgtggccaagtcagcctgtgtgctactgaactgtcgaaggaaatagccgctctgataggtagatgtgagtaaaaagaacaggaaaaaattgcttcttttattggtttccaaagaaacaaaccaaaccaaccagctcttggatgtgaagataaaatagtgcttttttgaaatggagaggaaaaacttggggaggaagaggcctgctgtgggggcatcggagccagccatgtaagaatcagagctgctccttcctgtgaatcctaggtggccctatgtcttctgtggagttacagtataaagcagggagctaattaagagtattaaaacttaaaaccattttttgactctgattttaagtacatttttatatgtcagttgctgcccttcacactaccaggccctgcagccacagtgttctgttggagaaacttggggaagtgttttctgaaccagttctttttcttggggtagagcgtgaaatccagacctgtttttgaaaggacagcacaggaggagaaaagtgactgggacgatgcttcctctcatccaaaacacatgcagagtcacatcctcatcctagtgtttggcagtttgagaccgctaccctgaacttaagagctttaaatatgagggttgtgtttctgggggggttatttttttggtgtgtgtgtgtgtgtattgtgcttagaaaggttgcagatttcatcttcacctaccaagaggcggccgcctccttggacaagccgctcatggaccattagacttgagaagacgacccacgtggtgactgcaaagccctgggtacttgccttcatgttctggtttggttttccctttttctgctgctcttggcagcagcctggtcatcatctgcttgtgggagtgggaaatgggtattttagacccaacacaggttctaaatttaaaacaaataataattggaacaaataaaggttcttgtacccagagtgattctacatgggaaaaacaaaccagcttttttcagagagtgaccgaataggaagaagggattcagaaatatgatgtagtagaacatgccctgcaggaagaaaatgttttctctcctgcgtatgttaagaggaaatcagtttaaaatgcctgctaatcaaatgtcgactcagctaaccatatgtccaggttgctgcagagtttctttcaaatctgagtgttgcctgctgaactcggaggggagtttggagaaattttagacagcagctctgtgttctttttttgccgcagccaataagataatagcagaattagccaatcctaaaaccttctaaagacgatttttgagcatcccactgggattatttaatttttctttttgacgtgtgtttttagtttagaagtgctgtattccacaaggtttaagtcagtgaggttggaagataccctatcttttttattcaaaaagcacaatcaatcttttgtttgaaaatctatataaagtacaacttgcttttagcatgattattttcctaaataaaaagacaaagaatttacttactttatgttaattacgggcatgaagcaaaaggttttctttaaaaaaaaaaaaaagtgcagtgatgtagggctgtggttagttaaccgtactgagttatccatctagcatctgtggcttgctggaagggtagtattaactatttaacatgtaatggtgtacttcactcttacctagcacgctgtcttctcattgctttgggggagggagggtctctctgctggcactgtctaacttgcttacctgctgactttgcagtttgcttgtgctatgacatttattgtaggtgctatttagggtaggcttaaagtgctgggtggtgatttgagttcaaacaataaaaaattgtattttttcaatattgtataaacaatagtgttctaattaccttaaaaaaaaataatgaccagttaagaattgcttttgatcttgtcaaaaaactgaatagaccccagtttcgggaaggtgtgtgagcagtgccatgactctgccccttacctaatcccacatctctctaatgataagacattggctcgcctctgaccagagccccagcaccagagagcggaagatgcagaattgtcaaatgacctgctgggggaggttgtaggagtttagcagatttgagtgtggctgcagagagagagagagtgtgtgtatgtgtgcacatgtgtgagagtgtgagcgagagtgtgtgtgtgtccatctaagtctgtgtgatgaaggtgggataaggctcctctgttagtgctggaagctcctgtaattgccgcatggatcccactgtgccctcttgttctgtgcaagtctgtcctgtctgggcactaaccttggtcccatgcatgtttatgttctgggtggggctttgcctctccactgggaaactgacttttgctgggttgaacagagtcccttatgctttttgtcctctccctgcgcctgggagaggtgggagtaggagcccaaacacacaggtacagaaagatctggaagaaggcctggcagtgaatccaaggactctgggcccccaacaatagatggtagcgtaagtctgggagcagcggtgtttcaccaccaaatgcctttccaggcttgcccttccaacactcaggagagcatccagatccctgggcagaggctctacattcttggctttagaggtggtggcagcggcagcaggtcagagccacttctggcggtttccctcccctttttagtgcccatagtttttggatcctcccttgagttttaccagcacaagccattctttgcccctgttcacataactgagctcaagctcttgccaaacaccaacaagcaagatggttgcaacctggcaacattgaatccaccacccttgggctccctctggaagccccagcaccggggggcttttgggcacagggtcagtggtagccatcttagacactgacatttggctttgtcgtcaatttcatcaccctccttgaggttactgtgcagtttcaaccagcattttatcctagtgaggtcattatcaggagttgccatatcatctctccagtacctaacatttctcatccacttcaaaagctgttctgactgccagctggctgatctaagctcctgaggaatgtctcctctcaaaggaatttttccctccaaaggccccctgaagtcctagttggcattggcctggcacatgctttatgttaggcctcccgttgggatggctgagaatcatgaaagacagatcctccgctagcctctgtgggtcaagtttctggacaccaagtctctgggaactagtgtttgattttaaatggcatgtggcccttccttgtttcagtgacttagaaaagtaaaagccatttaaaaaagttagcaagattttttatcgacttcccaactgggcttccagccttgttgaatgaaatcatctatctctgattgggcgcaacgaactgcatttctttggacttctgaatccatgtttgtgctttctctggcccgtgaacacctcggcgattctgttagggatgggatgagtgggaggaagccctttgagaagggggagccggccctgtcatgcgcaggttttccactcatctgaggaagagccagggctctgaatttagcctaacactcatcttggctgtgggcttgggaagaaatggccattatttacagattgtatttggtacatattgtgtgatacttgaaaagataaaagggactgccagcccctaactgaaatctgaagctttttatcgcttatttttcctcgccctgtctcctcccttccacctttctccttgcattgtgatgatctagtaggcacgtctgtcaacaggacacatgcctcctctgactataacctcttaatagttgtgtataatgaaaactgtaaacttttttaaataaacgtgtatataccttgaaaaaaaaaaaaaaaaaaaaaaaaaaaaaaaaaaaaacacacacaaaaaaaaaaaaccaaacaaagcaaaaaagaaaaaagaaaagaacaaaacaacaacagaaaaaagaagacggagggaacaggaggagcagagcgagcgcgagcgagacaaaaagaagaaagagaaagggacaaaaaagaagaggaagaagagagagggacagagacgaggaagcgacgaggaagagagaggaagcgggagggaatcgagaacggggagagaggagaagggaggaaaaagagaagagagcggaggagagaggagagatggaaagaggagggaggaggggaggagggacacggagagagagcgggagagaagaagaggagaagagaaggaggtgggagtgggagggggaaggggggaggagagagggagagaggggagaggaggagagggcaggaaggaaggagtg

SEQ ID NO: 300221 - DNA, 5212 bp, Homo sapiens
cgcccagagcgaggctggggtagggaggccgactgagcaggagtcgtccgcttatagtggaggctgctaggagccggtcagagggtgagtggggagcaggcgagcgagccacagcaggcaggagggagcgtcgcgcggcgcagaggagcgccggggcagggccgcggcggaaccacagccggagaggggcagcccgagccgggcgccgcagggtccccacccccacccggccggacagtgcccggtgttcccccgtgcggggggcggcggcggcggctgacgggaccgccgggaccgcgggggtgttgccacctccaccgaggagccggcgcggccgcgggctcctcagagccggggccccgggcccgtgacagacgggccgaggaagggagagaggcggcggcgacaccatgtcatctcccagtccgggcaagaggcggatggacacggacgtggtcaagctcatcgagagtaaacatgaggttacgatcctgggaggacttaatgaatttgtagtgaagttttatggaccacaaggaacaccatatgaaggcggagtatggaaagttagagtggacctacctgataaataccctttcaaatctccatctataggattcatgaataaaattttccatcccaacattgatgaagcgtcaggaactgtgtgtctagatgtaattaatcaaacttggacagctctctatgatcttaccaatatatttgagtccttcctgcctcagttattggcctatcctaaccccatagatcctctcaatggtgacgctgcagccatgtacctccaccgaccagaagaatacaagcagaaaattaaagagtacatccagaaatacgccacggaggaggcgctgaaagaacaggaagagggtaccggggacagctcatcggagagctctatgtctgacttttccgaagatgaggcccaggatatggagttgtagtagaaaaagcacctgcttttcagaaagactattatttcctaaccatgagaagcagactataatattcatatttaaacaaagcaattttttttattactaaacaaggtttttatgaataatagcattgatatatatatattatatatcaccctttagatcttgatttcttggtcatttctcaacctgaggtgcatagcatattcccacattccatttggtagcaatatgcggtctgaatgcatgcattcatgagtccatgtggccaagtcagcctgtgtgctactgaactgtcgaaggaaatagccgctctgataggtagatgtgagtaaaaagaacaggaaaaaattgcttcttttattggtttccaaagaaacaaaccaaaccaaccagctcttggatgtgaagataaaatagtgcttttttgaaatggagaggaaaaacttggggaggaagaggcctgctgtgggggcatcggagccagccatgtaagaatcagagctgctccttcctgtgaatcctaggtggccctatgtcttctgtggagttacagtataaagcagggagctaattaagagtattaaaacttaaaaccattttttgactctgattttaagtacatttttatatgtcagttgctgcccttcacactaccaggccctgcagccacagtgttctgttggagaaacttggggaagtgttttctgaaccagttctttttcttggggtagagcgtgaaatccagacctgtttttgaaaggacagcacaggaggagaaaagtgactgggacgatgcttcctctcatccaaaacacatgcagagtcacatcctcatcctagtgtttggcagtttgagaccgctaccctgaacttaagagctttaaatatgagggttgtgtttctgggggggttatttttttggtgtgtgtgtgtgtgtattgtgcttagaaaggttgcagatttcatcttcacctaccaagaggcggccgcctccttggacaagccgctcatggaccattagacttgagaagacgacccacgtggtgactgcaaagccctgggtacttgccttcatgttctggtttggttttccctttttctgctgctcttggcagcagcctggtcatcatctgcttgtgggagtgggaaatgggtattttagacccaacacaggttctaaatttaaaacaaataataattggaacaaataaaggttcttgtacccagagtgattctacatgggaaaaacaaaccagcttttttcagagagtgaccgaataggaagaagggattcagaaatatgatgtagtagaacatgccctgcaggaagaaaatgttttctctcctgcgtatgttaagaggaaatcagtttaaaatgcctgctaatcaaatgtcgactcagctaaccatatgtccaggttgctgcagagtttctttcaaatctgagtgttgcctgctgaactcggaggggagtttggagaaattttagacagcagctctgtgttctttttttgccgcagccaataagataatagcagaattagccaatcctaaaaccttctaaagacgatttttgagcatcccactgggattatttaatttttctttttgacgtgtgtttttagtttagaagtgctgtattccacaaggtttaagtcagtgaggttggaagataccctatcttttttattcaaaaagcacaatcaatcttttgtttgaaaatctatataaagtacaacttgcttttagcatgattattttcctaaataaaaagacaaagaatttacttactttatgttaattacgggcatgaagcaaaaggttttctttaaaaaaaaaaaaaagtgcagtgatgtagggctgtggttagttaaccgtactgagttatccatctagcatctgtggcttgctggaagggtagtattaactatttaacatgtaatggtgtacttcactcttacctagcacgctgtcttctcattgctttgggggagggagggtctctctgctggcactgtctaacttgcttacctgctgactttgcagtttgcttgtgctatgacatttattgtaggtgctatttagggtaggcttaaagtgctgggtggtgatttgagttcaaacaataaaaaattgtattttttcaatattgtataaacaatagtgttctaattaccttaaaaaaaaataatgaccagttaagaattgcttttgatcttgtcaaaaaactgaatagaccccagtttcgggaaggtgtgtgagcagtgccatgactctgccccttacctaatcccacatctctctaatgataagacattggctcgcctctgaccagagccccagcaccagagagcggaagatgcagaattgtcaaatgacctgctgggggaggttgtaggagtttagcagatttgagtgtggctgcagagagagagagagtgtgtgtatgtgtgcacatgtgtgagagtgtgagcgagagtgtgtgtgtgtccatctaagtctgtgtgatgaaggtgggataaggctcctctgttagtgctggaagctcctgtaattgccgcatggatcccactgtgccctcttgttctgtgcaagtctgtcctgtctgggcactaaccttggtcccatgcatgtttatgttctgggtggggctttgcctctccactgggaaactgacttttgctgggttgaacagagtcccttatgctttttgtcctctccctgcgcctgggagaggtgggagtaggagcccaaacacacaggtacagaaagatctggaagaaggcctggcagtgaatccaaggactctgggcccccaacaatagatggtagcgtaagtctgggagcagcggtgtttcaccaccaaatgcctttccaggcttgcccttccaacactcaggagagcatccagatccctgggcagaggctctacattcttggctttagaggtggtggcagcggcagcaggtcagagccacttctggcggtttccctcccctttttagtgcccatagtttttggatcctcccttgagttttaccagcacaagccattctttgcccctgttcacataactgagctcaagctcttgccaaacaccaacaagcaagatggttgcaacctggcaacattgaatccaccacccttgggctccctctggaagccccagcaccggggggcttttgggcacagggtcagtggtagccatcttagacactgacatttggctttgtcgtcaatttcatcaccctccttgaggttactgtgcagtttcaaccagcattttatcctagtgaggtcattatcaggagttgccatatcatctctccagtacctaacatttctcatccacttcaaaagctgttctgactgccagctggctgatctaagctcctgaggaatgtctcctctcaaaggaatttttccctccaaaggccccctgaagtcctagttggcattggcctggcacatgctttatgttaggcctcccgttgggatggctgagaatcatgaaagacagatcctccgctagcctctgtgggtcaagtttctggacaccaagtctctgggaactagtgtttgattttaaatggcatgtggcccttccttgtttcagtgacttagaaaagtaaaagccatttaaaaaagttagcaagattttttatcgacttcccaactgggcttccagccttgttgaatgaaatcatctatctctgattgggcgcaacgaactgcatttctttggacttctgaatccatgtttgtgctttctctggcccgtgaacacctcggcgattctgttagggatgggatgagtgggaggaagccctttgagaagggggagccggccctgtcatgcgcaggttttccactcatctgaggaagagccagggctctgaatttagcctaacactcatcttggctgtgggcttgggaagaaatggccattatttacagattgtatttggtacatattgtgtgatacttgaaaagataaaagggactgccagcccctaactgaaatctgaagctttttatcgcttatttttcctcgccctgtctcctcccttccacctttctccttgcattgtgatgatctagtaggcacgtctgtcaacaggacacatgcctcctctgactataacctcttaatagtgggtttccgcaactggcacttttaatacacgggtttccttggaaaaaaaaaaggggggctaaacccggggcacttcgacctttgtcaggcccagggg

SEQ ID NO: 300222 - DNA, 5217 bp, Homo sapiens
cgcccagagcgaggctggggtagggaggccgactgagcaggagtcgtccgcttatagtggaggctgctaggagccggtcagagggtgagtggggagcaggcgagcgagccacagcaggcaggagggagcgtcgcgcggcgcagaggagcgccggggcagggccgcggcggaaccacagccggagaggggcagcccgagccgggcgccgcagggtccccacccccacccggccggacagtgcccggtgttcccccgtgcggggggcggcggcggcggctgacgggaccgccgggaccgcgggggtgttgccacctccaccgaggagccggcgcggccgcgggctcctcagagccggggccccgggcccgtgacagacgggccgaggaagggagagaggcggcggcgacaccatgtcatctcccagtccgggcaagaggcggatggacacggacgtggtcaagctcatcgagagtaaacatgaggttacgatcctgggaggacttaatgaatttgtagtgaagttttatggaccacaaggaacaccatatgaaggcggagtatggaaagttagagtggacctacctgataaataccctttcaaatctccatctatagaattataaattacctaattcccttctgctaaaagacgcaggacagagaagggattcatgaataaaattttccatcccaacattgatgaagcgtcaggaactgtgtgtctagatgtaattaatcaaacttggacagctctctatgatcttaccaatatatttgagtccttcctgcctcagttattggcctatcctaaccccatagatcctctcaatggtgacgctgcagccatgtacctccaccgaccagaagaatacaagcagaaaattaaagagtacatccagaaatacgccacggaggaggcgctgaaagaacaggaagagggtaccggggacagctcatcggagagctctatgtctgacttttccgaagatgaggcccaggatatggagttgtagtagaaaaagcacctgcttttcagaaagactattatttcctaaccatgagaagcagactataatattcatatttaaacaaagcaattttttttattactaaacaaggtttttatgaataatagcattgatatatatatattatatatcaccctttagatcttgatttcttggtcatttctcaacctgaggtgcatagcatattcccacattccatttggtagcaatatgcggtctgaatgcatgcattcatgagtccatgtggccaagtcagcctgtgtgctactgaactgtcgaaggaaatagccgctctgataggtagatgtgagtaaaaagaacaggaaaaaattgcttcttttattggtttccaaagaaacaaaccaaaccaaccagctcttggatgtgaagataaaatagtgcttttttgaaatggagaggaaaaacttggggaggaagaggcctgctgtgggggcatcggagccagccatgtaagaatcagagctgctccttcctgtgaatcctaggtggccctatgtcttctgtggagttacagtataaagcagggagctaattaagagtattaaaacttaaaaccattttttgactctgattttaagtacatttttatatgtcagttgctgcccttcacactaccaggccctgcagccacagtgttctgttggagaaacttggggaagtgttttctgaaccagttctttttcttggggtagagcgtgaaatccagacctgtttttgaaaggacagcacaggaggagaaaagtgactgggacgatgcttcctctcatccaaaacacatgcagagtcacatcctcatcctagtgtttggcagtttgagaccgctaccctgaacttaagagctttaaatatgagggttgtgtttctgggggggttatttttttggtgtgtgtgtgtgtgtattgtgcttagaaaggttgcagatttcatcttcacctaccaagaggcggccgcctccttggacaagccgctcatggaccattagacttgagaagacgacccacgtggtgactgcaaagccctgggtacttgccttcatgttctggtttggttttccctttttctgctgctcttggcagcagcctggtcatcatctgcttgtgggagtgggaaatgggtattttagacccaacacaggttctaaatttaaaacaaataataattggaacaaataaaggttcttgtacccagagtgattctacatgggaaaaacaaaccagcttttttcagagagtgaccgaataggaagaagggattcagaaatatgatgtagtagaacatgccctgcaggaagaaaatgttttctctcctgcgtatgttaagaggaaatcagtttaaaatgcctgctaatcaaatgtcgactcagctaaccatatgtccaggttgctgcagagtttctttcaaatctgagtgttgcctgctgaactcggaggggagtttggagaaattttagacagcagctctgtgttctttttttgccgcagccaataagataatagcagaattagccaatcctaaaaccttctaaagacgatttttgagcatcccactgggattatttaatttttctttttgacgtgtgtttttagtttagaagtgctgtattccacaaggtttaagtcagtgaggttggaagataccctatcttttttattcaaaaagcacaatcaatcttttgtttgaaaatctatataaagtacaacttgcttttagcatgattattttcctaaataaaaagacaaagaatttacttactttatgttaattacgggcatgaagcaaaaggttttctttaaaaaaaaaaaaaagtgcagtgatgtagggctgtggttagttaaccgtactgagttatccatctagcatctgtggcttgctggaagggtagtattaactatttaacatgtaatggtgtacttcactcttacctagcacgctgtcttctcattgctttgggggagggagggtctctctgctggcactgtctaacttgcttacctgctgactttgcagtttgcttgtgctatgacatttattgtaggtgctatttagggtaggcttaaagtgctgggtggtgatttgagttcaaacaataaaaaattgtattttttcaatattgtataaacaatagtgttctaattaccttaaaaaaaaataatgaccagttaagaattgcttttgatcttgtcaaaaaactgaatagaccccagtttcgggaaggtgtgtgagcagtgccatgactctgccccttacctaatcccacatctctctaatgataagacattggctcgcctctgaccagagccccagcaccagagagcggaagatgcagaattgtcaaatgacctgctgggggaggttgtaggagtttagcagatttgagtgtggctgcagagagagagagagtgtgtgtatgtgtgcacatgtgtgagagtgtgagcgagagtgtgtgtgtgtccatctaagtctgtgtgatgaaggtgggataaggctcctctgttagtgctggaagctcctgtaattgccgcatggatcccactgtgccctcttgttctgtgcaagtctgtcctgtctgggcactaaccttggtcccatgcatgtttatgttctgggtggggctttgcctctccactgggaaactgacttttgctgggttgaacagagtcccttatgctttttgtcctctccctgcgcctgggagaggtgggagtaggagcccaaacacacaggtacagaaagatctggaagaaggcctggcagtgaatccaaggactctgggcccccaacaatagatggtagcgtaagtctgggagcagcggtgtttcaccaccaaatgcctttccaggcttgcccttccaacactcaggagagcatccagatccctgggcagaggctctacattcttggctttagaggtggtggcagcggcagcaggtcagagccacttctggcggtttccctcccctttttagtgcccatagtttttggatcctcccttgagttttaccagcacaagccattctttgcccctgttcacataactgagctcaagctcttgccaaacaccaacaagcaagatggttgcaacctggcaacattgaatccaccacccttgggctccctctggaagccccagcaccggggggcttttgggcacagggtcagtggtagccatcttagacactgacatttggctttgtcgtcaatttcatcaccctccttgaggttactgtgcagtttcaaccagcattttatcctagtgaggtcattatcaggagttgccatatcatctctccagtacctaacatttctcatccacttcaaaagctgttctgactgccagctggctgatctaagctcctgaggaatgtctcctctcaaaggaatttttccctccaaaggccccctgaagtcctagttggcattggcctggcacatgctttatgttaggcctcccgttgggatggctgagaatcatgaaagacagatcctccgctagcctctgtgggtcaagtttctggacaccaagtctctgggaactagtgtttgattttaaatggcatgtggcccttccttgtttcagtgacttagaaaagtaaaagccatttaaaaaagttagcaagattttttatcgacttcccaactgggcttccagccttgttgaatgaaatcatctatctctgattgggcgcaacgaactgcatttctttggacttctgaatccatgtttgtgctttctctggcccgtgaacacctcggcgattctgttagggatgggatgagtgggaggaagccctttgagaagggggagccggccctgtcatgcgcaggttttccactcatctgaggaagagccagggctctgaatttagcctaacactcatcttggctgtgggcttgggaagaaatggccattatttacagattgtatttggtacatattgtgtgatacttgaaaagataaaagggactgccagcccctaactgaaatctgaagctttttatcgcttatttttcctcgccctgtctcctcccttccacctttctccttgcattgtgatgatctagtaggcacgtctgtcaacaggacacatgcctcctctgactataacctcttaatagttgtgtataatgaaaactgtaaacttttttaaataaacgtgtatataccttg

SEQ ID NO: 300223 - DNA, 5073 bp, Homo sapiens
cgcccagagcgaggctggggtagggaggccgactgagcaggagtcgtccgcttatagtggaggctgctaggagccggtcagagggtgagtggggagcaggcgagcgagccacagcaggcaggagggagcgtcgcgcggcgcagaggagcgccggggcagggccgcggcggaaccacagccggagaggggcagcccgagccgggcgccgcagggtccccacccccacccggccggacagtgcccggtgttcccccgtgcggggggcggcggcggcggctgacgggaccgccgggaccgcgggggtgttgccacctccaccgaggagccggcgcggccgcgggctcctcagagccggggccccgggcccgtgacagacgggccgaggaagggagagaggcggcggcgacaccatgtcatctcccagtccgggcaagaggcggatggacacggacgtggtcaagctcatcgagagtaaacatgaggttacgatcctgggaggacttaatgaatttgtagtgaagttttatggaccacaaggaacaccatatgaaggcggagtatggaaagttagagtggacctacctgataaataccctttcaaatctccatctatagatcttaccaatatatttgagtccttcctgcctcagttattggcctatcctaaccccatagatcctctcaatggtgacgctgcagccatgtacctccaccgaccagaagaatacaagcagaaaattaaagagtacatccagaaatacgccacggaggaggcgctgaaagaacaggaagagggtaccggggacagctcatcggagagctctatgtctgacttttccgaagatgaggcccaggatatggagttgtagtagaaaaagcacctgcttttcagaaagactattatttcctaaccatgagaagcagactataatattcatatttaaacaaagcaattttttttattactaaacaaggtttttatgaataatagcattgatatatatatattatatatcaccctttagatcttgatttcttggtcatttctcaacctgaggtgcatagcatattcccacattccatttggtagcaatatgcggtctgaatgcatgcattcatgagtccatgtggccaagtcagcctgtgtgctactgaactgtcgaaggaaatagccgctctgataggtagatgtgagtaaaaagaacaggaaaaaattgcttcttttattggtttccaaagaaacaaaccaaaccaaccagctcttggatgtgaagataaaatagtgcttttttgaaatggagaggaaaaacttggggaggaagaggcctgctgtgggggcatcggagccagccatgtaagaatcagagctgctccttcctgtgaatcctaggtggccctatgtcttctgtggagttacagtataaagcagggagctaattaagagtattaaaacttaaaaccattttttgactctgattttaagtacatttttatatgtcagttgctgcccttcacactaccaggccctgcagccacagtgttctgttggagaaacttggggaagtgttttctgaaccagttctttttcttggggtagagcgtgaaatccagacctgtttttgaaaggacagcacaggaggagaaaagtgactgggacgatgcttcctctcatccaaaacacatgcagagtcacatcctcatcctagtgtttggcagtttgagaccgctaccctgaacttaagagctttaaatatgagggttgtgtttctgggggggttatttttttggtgtgtgtgtgtgtgtattgtgcttagaaaggttgcagatttcatcttcacctaccaagaggcggccgcctccttggacaagccgctcatggaccattagacttgagaagacgacccacgtggtgactgcaaagccctgggtacttgccttcatgttctggtttggttttccctttttctgctgctcttggcagcagcctggtcatcatctgcttgtgggagtgggaaatgggtattttagacccaacacaggttctaaatttaaaacaaataataattggaacaaataaaggttcttgtacccagagtgattctacatgggaaaaacaaaccagcttttttcagagagtgaccgaataggaagaagggattcagaaatatgatgtagtagaacatgccctgcaggaagaaaatgttttctctcctgcgtatgttaagaggaaatcagtttaaaatgcctgctaatcaaatgtcgactcagctaaccatatgtccaggttgctgcagagtttctttcaaatctgagtgttgcctgctgaactcggaggggagtttggagaaattttagacagcagctctgtgttctttttttgccgcagccaataagataatagcagaattagccaatcctaaaaccttctaaagacgatttttgagcatcccactgggattatttaatttttctttttgacgtgtgtttttagtttagaagtgctgtattccacaaggtttaagtcagtgaggttggaagataccctatcttttttattcaaaaagcacaatcaatcttttgtttgaaaatctatataaagtacaacttgcttttagcatgattattttcctaaataaaaagacaaagaatttacttactttatgttaattacgggcatgaagcaaaaggttttctttaaaaaaaaaaaaaagtgcagtgatgtagggctgtggttagttaaccgtactgagttatccatctagcatctgtggcttgctggaagggtagtattaactatttaacatgtaatggtgtacttcactcttacctagcacgctgtcttctcattgctttgggggagggagggtctctctgctggcactgtctaacttgcttacctgctgactttgcagtttgcttgtgctatgacatttattgtaggtgctatttagggtaggcttaaagtgctgggtggtgatttgagttcaaacaataaaaaattgtattttttcaatattgtataaacaatagtgttctaattaccttaaaaaaaaataatgaccagttaagaattgcttttgatcttgtcaaaaaactgaatagaccccagtttcgggaaggtgtgtgagcagtgccatgactctgccccttacctaatcccacatctctctaatgataagacattggctcgcctctgaccagagccccagcaccagagagcggaagatgcagaattgtcaaatgacctgctgggggaggttgtaggagtttagcagatttgagtgtggctgcagagagagagagagtgtgtgtatgtgtgcacatgtgtgagagtgtgagcgagagtgtgtgtgtgtccatctaagtctgtgtgatgaaggtgggataaggctcctctgttagtgctggaagctcctgtaattgccgcatggatcccactgtgccctcttgttctgtgcaagtctgtcctgtctgggcactaaccttggtcccatgcatgtttatgttctgggtggggctttgcctctccactgggaaactgacttttgctgggttgaacagagtcccttatgctttttgtcctctccctgcgcctgggagaggtgggagtaggagcccaaacacacaggtacagaaagatctggaagaaggcctggcagtgaatccaaggactctgggcccccaacaatagatggtagcgtaagtctgggagcagcggtgtttcaccaccaaatgcctttccaggcttgcccttccaacactcaggagagcatccagatccctgggcagaggctctacattcttggctttagaggtggtggcagcggcagcaggtcagagccacttctggcggtttccctcccctttttagtgcccatagtttttggatcctcccttgagttttaccagcacaagccattctttgcccctgttcacataactgagctcaagctcttgccaaacaccaacaagcaagatggttgcaacctggcaacattgaatccaccacccttgggctccctctggaagccccagcaccggggggcttttgggcacagggtcagtggtagccatcttagacactgacatttggctttgtcgtcaatttcatcaccctccttgaggttactgtgcagtttcaaccagcattttatcctagtgaggtcattatcaggagttgccatatcatctctccagtacctaacatttctcatccacttcaaaagctgttctgactgccagctggctgatctaagctcctgaggaatgtctcctctcaaaggaatttttccctccaaaggccccctgaagtcctagttggcattggcctggcacatgctttatgttaggcctcccgttgggatggctgagaatcatgaaagacagatcctccgctagcctctgtgggtcaagtttctggacaccaagtctctgggaactagtgtttgattttaaatggcatgtggcccttccttgtttcagtgacttagaaaagtaaaagccatttaaaaaagttagcaagattttttatcgacttcccaactgggcttccagccttgttgaatgaaatcatctatctctgattgggcgcaacgaactgcatttctttggacttctgaatccatgtttgtgctttctctggcccgtgaacacctcggcgattctgttagggatgggatgagtgggaggaagccctttgagaagggggagccggccctgtcatgcgcaggttttccactcatctgaggaagagccagggctctgaatttagcctaacactcatcttggctgtgggcttgggaagaaatggccattatttacagattgtatttggtacatattgtgtgatacttgaaaagataaaagggactgccagcccctaactgaaatctgaagctttttatcgcttatttttcctcgccctgtctcctcccttccacctttctccttgcattgtgatgatctagtaggcacgtctgtcaacaggacacatgcctcctctgactataacctcttaatagttgtgtataatgaaaactgtaaacttttttaaataaacgtgtatataccttg

SEQ ID NO: 300224 - DNA, 4787 bp, Homo sapiens
cgcccagagcgaggctggggtagggaggccgactgagcaggagtcgtccgcttatagtggaggctgctaggagccggtcagaggcatcgagagtaaacatgaggttacgatcctgggaggacttaatgaatttgtagtgaagttttatggaccacaaggaacaccatatgaaggcggagtatggaaagttagagtggacctacctgataaataccctttcaaatctccatctataggattcatgaataaaattttccatcccaacattgatgaagcgtcaggaactgtgtgtctagatgtaattaatcaaacttggacagctctctatgatcttaccaatatatttgagtccttcctgcctcagttattggcctatcctaaccccatagatcctctcaatggtgacgctgcagccatgtacctccaccgaccagaagaatacaagcagaaaattaaagagtacatccagaaatacgccacggaggaggcgctgaaagaacaggaagagggtaccggggacagctcatcggagagctctatgtctgacttttccgaagatgaggcccaggatatggagttgtagtagaaaaagcacctgcttttcagaaagactattatttcctaaccatgagaagcagactataatattcatatttaaacaaagcaattttttttattactaaacaaggtttttatgaataatagcattgatatatatatattatatatcaccctttagatcttgatttcttggtcatttctcaacctgaggtgcatagcatattcccacattccatttggtagcaatatgcggtctgaatgcatgcattcatgagtccatgtggccaagtcagcctgtgtgctactgaactgtcgaaggaaatagccgctctgataggtagatgtgagtaaaaagaacaggaaaaaattgcttcttttattggtttccaaagaaacaaaccaaaccaaccagctcttggatgtgaagataaaatagtgcttttttgaaatggagaggaaaaacttggggaggaagaggcctgctgtgggggcatcggagccagccatgtaagaatcagagctgctccttcctgtgaatcctaggtggccctatgtcttctgtggagttacagtataaagcagggagctaattaagagtattaaaacttaaaaccattttttgactctgattttaagtacatttttatatgtcagttgctgcccttcacactaccaggccctgcagccacagtgttctgttggagaaacttggggaagtgttttctgaaccagttctttttcttggggtagagcgtgaaatccagacctgtttttgaaaggacagcacaggaggagaaaagtgactgggacgatgcttcctctcatccaaaacacatgcagagtcacatcctcatcctagtgtttggcagtttgagaccgctaccctgaacttaagagctttaaatatgagggttgtgtttctgggggggttatttttttggtgtgtgtgtgtgtgtattgtgcttagaaaggttgcagatttcatcttcacctaccaagaggcggccgcctccttggacaagccgctcatggaccattagacttgagaagacgacccacgtggtgactgcaaagccctgggtacttgccttcatgttctggtttggttttccctttttctgctgctcttggcagcagcctggtcatcatctgcttgtgggagtgggaaatgggtattttagacccaacacaggttctaaatttaaaacaaataataattggaacaaataaaggttcttgtacccagagtgattctacatgggaaaaacaaaccagcttttttcagagagtgaccgaataggaagaagggattcagaaatatgatgtagtagaacatgccctgcaggaagaaaatgttttctctcctgcgtatgttaagaggaaatcagtttaaaatgcctgctaatcaaatgtcgactcagctaaccatatgtccaggttgctgcagagtttctttcaaatctgagtgttgcctgctgaactcggaggggagtttggagaaattttagacagcagctctgtgttctttttttgccgcagccaataagataatagcagaattagccaatcctaaaaccttctaaagacgatttttgagcatcccactgggattatttaatttttctttttgacgtgtgtttttagtttagaagtgctgtattccacaaggtttaagtcagtgaggttggaagataccctatcttttttattcaaaaagcacaatcaatcttttgtttgaaaatctatataaagtacaacttgcttttagcatgattattttcctaaataaaaagacaaagaatttacttactttatgttaattacgggcatgaagcaaaaggttttctttaaaaaaaaaaaaaagtgcagtgatgtagggctgtggttagttaaccgtactgagttatccatctagcatctgtggcttgctggaagggtagtattaactatttaacatgtaatggtgtacttcactcttacctagcacgctgtcttctcattgctttgggggagggagggtctctctgctggcactgtctaacttgcttacctgctgactttgcagtttgcttgtgctatgacatttattgtaggtgctatttagggtaggcttaaagtgctgggtggtgatttgagttcaaacaataaaaaattgtattttttcaatattgtataaacaatagtgttctaattaccttaaaaaaaaataatgaccagttaagaattgcttttgatcttgtcaaaaaactgaatagaccccagtttcgggaaggtgtgtgagcagtgccatgactctgccccttacctaatcccacatctctctaatgataagacattggctcgcctctgaccagagccccagcaccagagagcggaagatgcagaattgtcaaatgacctgctgggggaggttgtaggagtttagcagatttgagtgtggctgcagagagagagagagtgtgtgtatgtgtgcacatgtgtgagagtgtgagcgagagtgtgtgtgtgtccatctaagtctgtgtgatgaaggtgggataaggctcctctgttagtgctggaagctcctgtaattgccgcatggatcccactgtgccctcttgttctgtgcaagtctgtcctgtctgggcactaaccttggtcccatgcatgtttatgttctgggtggggctttgcctctccactgggaaactgacttttgctgggttgaacagagtcccttatgctttttgtcctctccctgcgcctgggagaggtgggagtaggagcccaaacacacaggtacagaaagatctggaagaaggcctggcagtgaatccaaggactctgggcccccaacaatagatggtagcgtaagtctgggagcagcggtgtttcaccaccaaatgcctttccaggcttgcccttccaacactcaggagagcatccagatccctgggcagaggctctacattcttggctttagaggtggtggcagcggcagcaggtcagagccacttctggcggtttccctcccctttttagtgcccatagtttttggatcctcccttgagttttaccagcacaagccattctttgcccctgttcacataactgagctcaagctcttgccaaacaccaacaagcaagatggttgcaacctggcaacattgaatccaccacccttgggctccctctggaagccccagcaccggggggcttttgggcacagggtcagtggtagccatcttagacactgacatttggctttgtcgtcaatttcatcaccctccttgaggttactgtgcagtttcaaccagcattttatcctagtgaggtcattatcaggagttgccatatcatctctccagtacctaacatttctcatccacttcaaaagctgttctgactgccagctggctgatctaagctcctgaggaatgtctcctctcaaaggaatttttccctccaaaggccccctgaagtcctagttggcattggcctggcacatgctttatgttaggcctcccgttgggatggctgagaatcatgaaagacagatcctccgctagcctctgtgggtcaagtttctggacaccaagtctctgggaactagtgtttgattttaaatggcatgtggcccttccttgtttcagtgacttagaaaagtaaaagccatttaaaaaagttagcaagattttttatcgacttcccaactgggcttccagccttgttgaatgaaatcatctatctctgattgggcgcaacgaactgcatttctttggacttctgaatccatgtttgtgctttctctggcccgtgaacacctcggcgattctgttagggatgggatgagtgggaggaagccctttgagaagggggagccggccctgtcatgcgcaggttttccactcatctgaggaagagccagggctctgaatttagcctaacactcatcttggctgtgggcttgggaagaaatggccattatttacagattgtatttggtacatattgtgtgatacttgaaaagataaaagggactgccagcccctaactgaaatctgaagctttttatcgcttatttttcctcgccctgtctcctcccttccacctttctccttgcattgtgatgatctagtaggcacgtctgtcaacaggacacatgcctcctctgactataacctcttaatagttgtgtataatgaaaactgtaaacttttttaaataaacgtgtatataccttg

SEQ ID NO: 300225 - DNA, 4517 bp, Homo sapiens
aagtgaattttaggtgaacttgcatttcccatgtgtgacatgtttgtttggtttttcagatcttaccaatatatttgagtccttcctgcctcagttattggcctatcctaaccccatagatcctctcaatggtgacgctgcagccatgtacctccaccgaccagaagaatacaagcagaaaattaaagagtacatccagaaatacgccacggaggaggcgctgaaagaacaggaagagggtaccggggacagctcatcggagagctctatgtctgacttttccgaagatgaggcccaggatatggagttgtagtagaaaaagcacctgcttttcagaaagactattatttcctaaccatgagaagcagactataatattcatatttaaacaaagcaattttttttattactaaacaaggtttttatgaataatagcattgatatatatatattatatatcaccctttagatcttgatttcttggtcatttctcaacctgaggtgcatagcatattcccacattccatttggtagcaatatgcggtctgaatgcatgcattcatgagtccatgtggccaagtcagcctgtgtgctactgaactgtcgaaggaaatagccgctctgataggtagatgtgagtaaaaagaacaggaaaaaattgcttcttttattggtttccaaagaaacaaaccaaaccaaccagctcttggatgtgaagataaaatagtgcttttttgaaatggagaggaaaaacttggggaggaagaggcctgctgtgggggcatcggagccagccatgtaagaatcagagctgctccttcctgtgaatcctaggtggccctatgtcttctgtggagttacagtataaagcagggagctaattaagagtattaaaacttaaaaccattttttgactctgattttaagtacatttttatatgtcagttgctgcccttcacactaccaggccctgcagccacagtgttctgttggagaaacttggggaagtgttttctgaaccagttctttttcttggggtagagcgtgaaatccagacctgtttttgaaaggacagcacaggaggagaaaagtgactgggacgatgcttcctctcatccaaaacacatgcagagtcacatcctcatcctagtgtttggcagtttgagaccgctaccctgaacttaagagctttaaatatgagggttgtgtttctgggggggttatttttttggtgtgtgtgtgtgtgtattgtgcttagaaaggttgcagatttcatcttcacctaccaagaggcggccgcctccttggacaagccgctcatggaccattagacttgagaagacgacccacgtggtgactgcaaagccctgggtacttgccttcatgttctggtttggttttccctttttctgctgctcttggcagcagcctggtcatcatctgcttgtgggagtgggaaatgggtattttagacccaacacaggttctaaatttaaaacaaataataattggaacaaataaaggttcttgtacccagagtgattctacatgggaaaaacaaaccagcttttttcagagagtgaccgaataggaagaagggattcagaaatatgatgtagtagaacatgccctgcaggaagaaaatgttttctctcctgcgtatgttaagaggaaatcagtttaaaatgcctgctaatcaaatgtcgactcagctaaccatatgtccaggttgctgcagagtttctttcaaatctgagtgttgcctgctgaactcggaggggagtttggagaaattttagacagcagctctgtgttctttttttgccgcagccaataagataatagcagaattagccaatcctaaaaccttctaaagacgatttttgagcatcccactgggattatttaatttttctttttgacgtgtgtttttagtttagaagtgctgtattccacaaggtttaagtcagtgaggttggaagataccctatcttttttattcaaaaagcacaatcaatcttttgtttgaaaatctatataaagtacaacttgcttttagcatgattattttcctaaataaaaagacaaagaatttacttactttatgttaattacgggcatgaagcaaaaggttttctttaaaaaaaaaaaaaagtgcagtgatgtagggctgtggttagttaaccgtactgagttatccatctagcatctgtggcttgctggaagggtagtattaactatttaacatgtaatggtgtacttcactcttacctagcacgctgtcttctcattgctttgggggagggagggtctctctgctggcactgtctaacttgcttacctgctgactttgcagtttgcttgtgctatgacatttattgtaggtgctatttagggtaggcttaaagtgctgggtggtgatttgagttcaaacaataaaaaattgtattttttcaatattgtataaacaatagtgttctaattaccttaaaaaaaaataatgaccagttaagaattgcttttgatcttgtcaaaaaactgaatagaccccagtttcgggaaggtgtgtgagcagtgccatgactctgccccttacctaatcccacatctctctaatgataagacattggctcgcctctgaccagagccccagcaccagagagcggaagatgcagaattgtcaaatgacctgctgggggaggttgtaggagtttagcagatttgagtgtggctgcagagagagagagagtgtgtgtatgtgtgcacatgtgtgagagtgtgagcgagagtgtgtgtgtgtccatctaagtctgtgtgatgaaggtgggataaggctcctctgttagtgctggaagctcctgtaattgccgcatggatcccactgtgccctcttgttctgtgcaagtctgtcctgtctgggcactaaccttggtcccatgcatgtttatgttctgggtggggctttgcctctccactgggaaactgacttttgctgggttgaacagagtcccttatgctttttgtcctctccctgcgcctgggagaggtgggagtaggagcccaaacacacaggtacagaaagatctggaagaaggcctggcagtgaatccaaggactctgggcccccaacaatagatggtagcgtaagtctgggagcagcggtgtttcaccaccaaatgcctttccaggcttgcccttccaacactcaggagagcatccagatccctgggcagaggctctacattcttggctttagaggtggtggcagcggcagcaggtcagagccacttctggcggtttccctcccctttttagtgcccatagtttttggatcctcccttgagttttaccagcacaagccattctttgcccctgttcacataactgagctcaagctcttgccaaacaccaacaagcaagatggttgcaacctggcaacattgaatccaccacccttgggctccctctggaagccccagcaccggggggcttttgggcacagggtcagtggtagccatcttagacactgacatttggctttgtcgtcaatttcatcaccctccttgaggttactgtgcagtttcaaccagcattttatcctagtgaggtcattatcaggagttgccatatcatctctccagtacctaacatttctcatccacttcaaaagctgttctgactgccagctggctgatctaagctcctgaggaatgtctcctctcaaaggaatttttccctccaaaggccccctgaagtcctagttggcattggcctggcacatgctttatgttaggcctcccgttgggatggctgagaatcatgaaagacagatcctccgctagcctctgtgggtcaagtttctggacaccaagtctctgggaactagtgtttgattttaaatggcatgtggcccttccttgtttcagtgacttagaaaagtaaaagccatttaaaaaagttagcaagattttttatcgacttcccaactgggcttccagccttgttgaatgaaatcatctatctctgattgggcgcaacgaactgcatttctttggacttctgaatccatgtttgtgctttctctggcccgtgaacacctcggcgattctgttagggatgggatgagtgggaggaagccctttgagaagggggagccggccctgtcatgcgcaggttttccactcatctgaggaagagccagggctctgaatttagcctaacactcatcttggctgtgggcttgggaagaaatggccattatttacagattgtatttggtacatattgtgtgatacttgaaaagataaaagggactgccagcccctaactgaaatctgaagctttttatcgcttatttttcctcgccctgtctcctcccttccacctttctccttgcattgtgatgatctagtaggcacgtctgtcaacaggacacatgcctcctctgactataacctcttaatagttgtgtataatgaaaactgtaaacttttttaaataaacgtgtatataccttg

SEQ ID NO: 300226 - DNA, 5006 bp, Homo sapiens
cgcccagagcgaggctggggtagggaggccgactgagcaggagtcgtccgcttatagtggaggctgctaggagccggtcagagggtgagtggggagcaggcgagcgagccacagcaggcaggagggagcgtcgcgcggcgcagaggagcgccggggcagggccgcggcggaaccacagccggagaggggcagcccgagccgggcgccgcagggtccccacccccacccggccggacagtgcccggtgttcccccgtgcggggggcggcggcggcggctgacgggaccgccgggaccgcgggggtgttgccacctccaccgaggagccggcgcggccgcgggctcctcagagccggggccccgggcccgtgacagacgggccgaggaagggagagaggcggcggcgacaccatgtcatctcccagtccgggcaagaggcggatggacacggacgtggtcaagctcatcgagagtaaacatgaggttacgatcctgggaggacttaatgaatttgtagtgaagttttatggaccacaaggaacaccatatgaaggcggagtatggaaagttagagtggacctacctgataaataccctttcaaatctccatctataggattcatgaataaaattttccatcccaacattgatgaagcgtcaggaactgtgtgtctagatgtaattaatcaaacttggacagctctctatgatcttaccaatatatttgagtccttcctgcctcagttattggcctatcctaaccccatagatcctctcaatggtgacgctgcagccatgtacctccaccgaccagaagaatacaagcagaaaattaaagagtacatccagaaatacgccacggaggaggcgctgaaagaacaggaagagggtaccggggacagctcatcggagagctctatgtctgacttttccgaagatgaggcccaggatatggagttgtagtagaaaaagcacctgcttttcagaaagactattatttcctaaccatgagaagcagactataatattcatatttaaacaaagcaattttttttattactaaacaaggtttttatgaataatagcattgatatatatatattatatatcaccctttagatcttgatttcttggtcatttctcaacctgaggtgcatagcatattcccacattccatttggtagcaatatgcggtctgaatgcatgcattcatgagtccatgtggccaagtcagcctgtgtgctactgaactgtcgaaggaaatagccgctctgataggtagatgtgagtaaaaagaacaggaaaaaattgcttcttttattggtttccaaagaaacaaaccaaaccaaccagctcttggatgtgaagataaaatagtgcttttttgaaatggagaggaaaaacttggggaggaagaggcctgctgtgggggcatcggagccagccatgtaagaatcagagctgctccttcctgtgaatcctaggtggccctatgtcttctgtggagttacagtataaagcagggagctaattaagagtattaaaacttaaaaccattttttgactctgattttaagtacatttttatatgtcagttgctgcccttcacactaccaggccctgcagccacagtgttctgttggagaaacttggggaagtgttttcctgaacttaagagctttaaatatgagggttgtgtttctgggggggttatttttttggtgtgtgtgtgtgtgtattgtgcttagaaaggttgcagatttcatcttcacctaccaagaggcggccgcctccttggacaagccgctcatggaccattagacttgagaagacgacccacgtggtgactgcaaagccctgggtacttgccttcatgttctggtttggttttccctttttctgctgctcttggcagcagcctggtcatcatctgcttgtgggagtgggaaatgggtattttagacccaacacaggttctaaatttaaaacaaataataattggaacaaataaaggttcttgtacccagagtgattctacatgggaaaaacaaaccagcttttttcagagagtgaccgaataggaagaagggattcagaaatatgatgtagtagaacatgccctgcaggaagaaaatgttttctctcctgcgtatgttaagaggaaatcagtttaaaatgcctgctaatcaaatgtcgactcagctaaccatatgtccaggttgctgcagagtttctttcaaatctgagtgttgcctgctgaactcggaggggagtttggagaaattttagacagcagctctgtgttctttttttgccgcagccaataagataatagcagaattagccaatcctaaaaccttctaaagacgatttttgagcatcccactgggattatttaatttttctttttgacgtgtgtttttagtttagaagtgctgtattccacaaggtttaagtcagtgaggttggaagataccctatcttttttattcaaaaagcacaatcaatcttttgtttgaaaatctatataaagtacaacttgcttttagcatgattattttcctaaataaaaagacaaagaatttacttactttatgttaattacgggcatgaagcaaaaggttttctttaaaaaaaaaaaaaagtgcagtgatgtagggctgtggttagttaaccgtactgagttatccatctagcatctgtggcttgctggaagggtagtattaactatttaacatgtaatggtgtacttcactcttacctagcacgctgtcttctcattgctttgggggagggagggtctctctgctggcactgtctaacttgcttacctgctgactttgcagtttgcttgtgctatgacatttattgtaggtgctatttagggtaggcttaaagtgctgggtggtgatttgagttcaaacaataaaaaattgtattttttcaatattgtataaacaatagtgttctaattaccttaaaaaaaaataatgaccagttaagaattgcttttgatcttgtcaaaaaactgaatagaccccagtttcgggaaggtgtgtgagcagtgccatgactctgccccttacctaatcccacatctctctaatgataagacattggctcgcctctgaccagagccccagcaccagagagcggaagatgcagaattgtcaaatgacctgctgggggaggttgtaggagtttagcagatttgagtgtggctgcagagagagagagagtgtgtgtatgtgtgcacatgtgtgagagtgtgagcgagagtgtgtgtgtgtccatctaagtctgtgtgatgaaggtgggataaggctcctctgttagtgctggaagctcctgtaattgccgcatggatcccactgtgccctcttgttctgtgcaagtctgtcctgtctgggcactaaccttggtcccatgcatgtttatgttctgggtggggctttgcctctccactgggaaactgacttttgctgggttgaacagagtcccttatgctttttgtcctctccctgcgcctgggagaggtgggagtaggagcccaaacacacaggtacagaaagatctggaagaaggcctggcagtgaatccaaggactctgggcccccaacaatagatggtagcgtaagtctgggagcagcggtgtttcaccaccaaatgcctttccaggcttgcccttccaacactcaggagagcatccagatccctgggcagaggctctacattcttggctttagaggtggtggcagcggcagcaggtcagagccacttctggcggtttccctcccctttttagtgcccatagtttttggatcctcccttgagttttaccagcacaagccattctttgcccctgttcacataactgagctcaagctcttgccaaacaccaacaagcaagatggttgcaacctggcaacattgaatccaccacccttgggctccctctggaagccccagcaccggggggcttttgggcacagggtcagtggtagccatcttagacactgacatttggctttgtcgtcaatttcatcaccctccttgaggttactgtgcagtttcaaccagcattttatcctagtgaggtcattatcaggagttgccatatcatctctccagtacctaacatttctcatccacttcaaaagctgttctgactgccagctggctgatctaagctcctgaggaatgtctcctctcaaaggaatttttccctccaaaggccccctgaagtcctagttggcattggcctggcacatgctttatgttaggcctcccgttgggatggctgagaatcatgaaagacagatcctccgctagcctctgtgggtcaagtttctggacaccaagtctctgggaactagtgtttgattttaaatggcatgtggcccttccttgtttcagtgacttagaaaagtaaaagccatttaaaaaagttagcaagattttttatcgacttcccaactgggcttccagccttgttgaatgaaatcatctatctctgattgggcgcaacgaactgcatttctttggacttctgaatccatgtttgtgctttctctggcccgtgaacacctcggcgattctgttagggatgggatgagtgggaggaagccctttgagaagggggagccggccctgtcatgcgcaggttttccactcatctgaggaagagccagggctctgaatttagcctaacactcatcttggctgtgggcttgggaagaaatggccattatttacagattgtatttggtacatattgtgtgatacttgaaaagataaaagggactgccagcccctaactgaaatctgaagctttttatcgcttatttttcctcgccctgtctcctcccttccacctttctccttgcattgtgatgatctagtaggcacgtctgtcaacaggacacatgcctcctctgactataacctcttaatagttgtgtataatgaaaactgtaaacttttttaaataaacgtgtatataccttg

SEQ ID NO: 300227 - DNA, 4513 bp, Homo sapiens
gttcttggggtgctgcagcacacacattcccctgcaagctgagcctgctgtgttgctcttcccaatacccctttcctcagggggcaaaatgcagaaaccctgtcccaaagaagtctccctatgggattctccttagctgtagtgatcatgattactgtcatctttgtcccccctggtgttcaagagtacatccagaaatacgccacggaggaggcgctgaaagaacaggaagagggtaccggggacagctcatcggagagctctatgtctgacttttccgaagatgaggcccaggatatggagttgtagtagaaaaagcacctgcttttcagaaagactattatttcctaaccatgagaagcagactataatattcatatttaaacaaagcaattttttttattactaaacaaggtttttatgaataatagcattgatatatatatattatatatcaccctttagatcttgatttcttggtcatttctcaacctgaggtgcatagcatattcccacattccatttggtagcaatatgcggtctgaatgcatgcattcatgagtccatgtggccaagtcagcctgtgtgctactgaactgtcgaaggaaatagccgctctgataggtagatgtgagtaaaaagaacaggaaaaaattgcttcttttattggtttccaaagaaacaaaccaaaccaaccagctcttggatgtgaagataaaatagtgcttttttgaaatggagaggaaaaacttggggaggaagaggcctgctgtgggggcatcggagccagccatgtaagaatcagagctgctccttcctgtgaatcctaggtggccctatgtcttctgtggagttacagtataaagcagggagctaattaagagtattaaaacttaaaaccattttttgactctgattttaagtacatttttatatgtcagttgctgcccttcacactaccaggccctgcagccacagtgttctgttggagaaacttggggaagtgttttctgaaccagttctttttcttggggtagagcgtgaaatccagacctgtttttgaaaggacagcacaggaggagaaaagtgactgggacgatgcttcctctcatccaaaacacatgcagagtcacatcctcatcctagtgtttggcagtttgagaccgctaccctgaacttaagagctttaaatatgagggttgtgtttctgggggggttatttttttggtgtgtgtgtgtgtgtattgtgcttagaaaggttgcagatttcatcttcacctaccaagaggcggccgcctccttggacaagccgctcatggaccattagacttgagaagacgacccacgtggtgactgcaaagccctgggtacttgccttcatgttctggtttggttttccctttttctgctgctcttggcagcagcctggtcatcatctgcttgtgggagtgggaaatgggtattttagacccaacacaggttctaaatttaaaacaaataataattggaacaaataaaggttcttgtacccagagtgattctacatgggaaaaacaaaccagcttttttcagagagtgaccgaataggaagaagggattcagaaatatgatgtagtagaacatgccctgcaggaagaaaatgttttctctcctgcgtatgttaagaggaaatcagtttaaaatgcctgctaatcaaatgtcgactcagctaaccatatgtccaggttgctgcagagtttctttcaaatctgagtgttgcctgctgaactcggaggggagtttggagaaattttagacagcagctctgtgttctttttttgccgcagccaataagataatagcagaattagccaatcctaaaaccttctaaagacgatttttgagcatcccactgggattatttaatttttctttttgacgtgtgtttttagtttagaagtgctgtattccacaaggtttaagtcagtgaggttggaagataccctatcttttttattcaaaaagcacaatcaatcttttgtttgaaaatctatataaagtacaacttgcttttagcatgattattttcctaaataaaaagacaaagaatttacttactttatgttaattacgggcatgaagcaaaaggttttctttaaaaaaaaaaaaaagtgcagtgatgtagggctgtggttagttaaccgtactgagttatccatctagcatctgtggcttgctggaagggtagtattaactatttaacatgtaatggtgtacttcactcttacctagcacgctgtcttctcattgctttgggggagggagggtctctctgctggcactgtctaacttgcttacctgctgactttgcagtttgcttgtgctatgacatttattgtaggtgctatttagggtaggcttaaagtgctgggtggtgatttgagttcaaacaataaaaaattgtattttttcaatattgtataaacaatagtgttctaattaccttaaaaaaaaataatgaccagttaagaattgcttttgatcttgtcaaaaaactgaatagaccccagtttcgggaaggtgtgtgagcagtgccatgactctgccccttacctaatcccacatctctctaatgataagacattggctcgcctctgaccagagccccagcaccagagagcggaagatgcagaattgtcaaatgacctgctgggggaggttgtaggagtttagcagatttgagtgtggctgcagagagagagagagtgtgtgtatgtgtgcacatgtgtgagagtgtgagcgagagtgtgtgtgtgtccatctaagtctgtgtgatgaaggtgggataaggctcctctgttagtgctggaagctcctgtaattgccgcatggatcccactgtgccctcttgttctgtgcaagtctgtcctgtctgggcactaaccttggtcccatgcatgtttatgttctgggtggggctttgcctctccactgggaaactgacttttgctgggttgaacagagtcccttatgctttttgtcctctccctgcgcctgggagaggtgggagtaggagcccaaacacacaggtacagaaagatctggaagaaggcctggcagtgaatccaaggactctgggcccccaacaatagatggtagcgtaagtctgggagcagcggtgtttcaccaccaaatgcctttccaggcttgcccttccaacactcaggagagcatccagatccctgggcagaggctctacattcttggctttagaggtggtggcagcggcagcaggtcagagccacttctggcggtttccctcccctttttagtgcccatagtttttggatcctcccttgagttttaccagcacaagccattctttgcccctgttcacataactgagctcaagctcttgccaaacaccaacaagcaagatggttgcaacctggcaacattgaatccaccacccttgggctccctctggaagccccagcaccggggggcttttgggcacagggtcagtggtagccatcttagacactgacatttggctttgtcgtcaatttcatcaccctccttgaggttactgtgcagtttcaaccagcattttatcctagtgaggtcattatcaggagttgccatatcatctctccagtacctaacatttctcatccacttcaaaagctgttctgactgccagctggctgatctaagctcctgaggaatgtctcctctcaaaggaatttttccctccaaaggccccctgaagtcctagttggcattggcctggcacatgctttatgttaggcctcccgttgggatggctgagaatcatgaaagacagatcctccgctagcctctgtgggtcaagtttctggacaccaagtctctgggaactagtgtttgattttaaatggcatgtggcccttccttgtttcagtgacttagaaaagtaaaagccatttaaaaaagttagcaagattttttatcgacttcccaactgggcttccagccttgttgaatgaaatcatctatctctgattgggcgcaacgaactgcatttctttggacttctgaatccatgtttgtgctttctctggcccgtgaacacctcggcgattctgttagggatgggatgagtgggaggaagccctttgagaagggggagccggccctgtcatgcgcaggttttccactcatctgaggaagagccagggctctgaatttagcctaacactcatcttggctgtgggcttgggaagaaatggccattatttacagattgtatttggtacatattgtgtgatacttgaaaagataaaagggactgccagcccctaactgaaatctgaagctttttatcgcttatttttcctcgccctgtctcctcccttccacctttctccttgcattgtgatgatctagtaggcacgtctgtcaacaggacacatgcctcctctgactataacctcttaatagttgtgtataatgaaaactgtaaacttttttaaataaacgtgtatataccttg

SEQ ID NO: 300228 - DNA, 4830 bp, Homo sapiens
cgcccagagcgaggctggggtagggaggccgactgagcaggagtcgtccgcttatagtggaggctgctaggagccggtcagagggtgagtggggagcaggcgagcgagccacagcaggcaggagggagcgtcgcgcggcgcagaggagcgccggggcagggccgcggcggaaccacagccggagaggggcagcccgagccgggcgccgcagggtccccacccccacccggccggacagtgcccggtgttcccccgtgcggggggcggcggcggcggctgacgggaccgccgggaccgcgggggtgttgccacctccaccgaggagccggcgcggccgcgggctcctcagagccggggccccgggcccgtgacagacgggccgaggaagggagagaggcggcggcgacaccatgtcatctcccagtccgggcaagaggcggatggacacggacgtggtcaagctcatcgagagtaaacatgaggttacgatcctgggaggacttaatgaatttgtagtgaagttttatggaccacaaggaacaccatatgaaggcggagtatggaaagttagagtggacctacctgataaataccctttcaaatctccatctataggattcatgaataaaattttccatcccaacattgatgaagcgtcaggaactgtgtgtctagatgtaattaatcaaacttggacagctctctatgatcttaccaatatatttgagtccttcctgcctcagttattggcctatcctaaccccatagatcctctcaatggtgacgctgcagccatgtacctccaccgaccagaagaatacaagcagaaaattaaagagtacatccagaaatacgccacggaggaggcgctgaaagaacaggaagagggtaccggggacagctcatcggagagctctatgtctgacttttccgaagatgaggcccaggatatggagttgtagtagaaaaagcacctgcttttcagaaagactattatttcctaaccatgagaagcagactataatattcatatttaaacaaagcaattttttttattactaaacaaggtttttatgaataatagcattgatatatatatattatatatcaccctttagatcttgatttcttggtcatttctcaacctgaggtgcatagcatattcccacattccatttggtagcaatatgcggtctgaatgcatgcattcatgagtccatgtggccaagtcagcctgtgtgctactgaactgtcgaaggaaatagccgctctgataggtagatgtgagtaaaaagaacaggaaaaaattgcttcttttattggtttccaaagaaacaaaccaaaccaaccagctcttggatgtgaagataaaatagtgcttttttgaaatggagaggagaaaagtgactgggacgatgcttcctctcatccaaaacacatgcagagtcacatcctcatcctagtgtttggcagtttgagaccgctaccctgaacttaagagctttaaatatgagggttgtgtttctgggggggttatttttttggtgtgtgtgtgtgtgtattgtgcttagaaaggttgcagatttcatcttcacctaccaagaggcggccgcctccttggacaagccgctcatggaccattagacttgagaagacgacccacgtggtgactgcaaagccctgggtacttgccttcatgttctggtttggttttccctttttctgctgctcttggcagcagcctggtcatcatctgcttgtgggagtgggaaatgggtattttagacccaacacaggttctaaatttaaaacaaataataattggaacaaataaaggttcttgtacccagagtgattctacatgggaaaaacaaaccagcttttttcagagagtgaccgaataggaagaagggattcagaaatatgatgtagtagaacatgccctgcaggaagaaaatgttttctctcctgcgtatgttaagaggaaatcagtttaaaatgcctgctaatcaaatgtcgactcagctaaccatatgtccaggttgctgcagagtttctttcaaatctgagtgttgcctgctgaactcggaggggagtttggagaaattttagacagcagctctgtgttctttttttgccgcagccaataagataatagcagaattagccaatcctaaaaccttctaaagacgatttttgagcatcccactgggattatttaatttttctttttgacgtgtgtttttagtttagaagtgctgtattccacaaggtttaagtcagtgaggttggaagataccctatcttttttattcaaaaagcacaatcaatcttttgtttgaaaatctatataaagtacaacttgcttttagcatgattattttcctaaataaaaagacaaagaatttacttactttatgttaattacgggcatgaagcaaaaggttttctttaaaaaaaaaaaaaagtgcagtgatgtagggctgtggttagttaaccgtactgagttatccatctagcatctgtggcttgctggaagggtagtattaactatttaacatgtaatggtgtacttcactcttacctagcacgctgtcttctcattgctttgggggagggagggtctctctgctggcactgtctaacttgcttacctgctgactttgcagtttgcttgtgctatgacatttattgtaggtgctatttagggtaggcttaaagtgctgggtggtgatttgagttcaaacaataaaaaattgtattttttcaatattgtataaacaatagtgttctaattaccttaaaaaaaaataatgaccagttaagaattgcttttgatcttgtcaaaaaactgaatagaccccagtttcgggaaggtgtgtgagcagtgccatgactctgccccttacctaatcccacatctctctaatgataagacattggctcgcctctgaccagagccccagcaccagagagcggaagatgcagaattgtcaaatgacctgctgggggaggttgtaggagtttagcagatttgagtgtggctgcagagagagagagagtgtgtgtatgtgtgcacatgtgtgagagtgtgagcgagagtgtgtgtgtgtccatctaagtctgtgtgatgaaggtgggataaggctcctctgttagtgctggaagctcctgtaattgccgcatggatcccactgtgccctcttgttctgtgcaagtctgtcctgtctgggcactaaccttggtcccatgcatgtttatgttctgggtggggctttgcctctccactgggaaactgacttttgctgggttgaacagagtcccttatgctttttgtcctctccctgcgcctgggagaggtgggagtaggagcccaaacacacaggtacagaaagatctggaagaaggcctggcagtgaatccaaggactctgggcccccaacaatagatggtagcgtaagtctgggagcagcggtgtttcaccaccaaatgcctttccaggcttgcccttccaacactcaggagagcatccagatccctgggcagaggctctacattcttggctttagaggtggtggcagcggcagcaggtcagagccacttctggcggtttccctcccctttttagtgcccatagtttttggatcctcccttgagttttaccagcacaagccattctttgcccctgttcacataactgagctcaagctcttgccaaacaccaacaagcaagatggttgcaacctggcaacattgaatccaccacccttgggctccctctggaagccccagcaccggggggcttttgggcacagggtcagtggtagccatcttagacactgacatttggctttgtcgtcaatttcatcaccctccttgaggttactgtgcagtttcaaccagcattttatcctagtgaggtcattatcaggagttgccatatcatctctccagtacctaacatttctcatccacttcaaaagctgttctgactgccagctggctgatctaagctcctgaggaatgtctcctctcaaaggaatttttccctccaaaggccccctgaagtcctagttggcattggcctggcacatgctttatgttaggcctcccgttgggatggctgagaatcatgaaagacagatcctccgctagcctctgtgggtcaagtttctggacaccaagtctctgggaactagtgtttgattttaaatggcatgtggcccttccttgtttcagtgacttagaaaagtaaaagccatttaaaaaagttagcaagattttttatcgacttcccaactgggcttccagccttgttgaatgaaatcatctatctctgattgggcgcaacgaactgcatttctttggacttctgaatccatgtttgtgctttctctggcccgtgaacacctcggcgattctgttagggatgggatgagtgggaggaagccctttgagaagggggagccggccctgtcatgcgcaggttttccactcatctgaggaagagccagggctctgaatttagcctaacactcatcttggctgtgggcttgggaagaaatggccattatttacagattgtatttggtacatattgtgtgatacttgaaaagataaaagggactgccagcccctaactgaaatctgaagctttttatcgcttatttttcctcgccctgtctcctcccttccacctttctccttgcattgtgatgatctagtaggcacgtctgtcaacaggacacatgcctcctctgactataacctcttaatagttgtgtataatgaaaactgtaaacttttttaaataaacgtgtatataccttg

SEQ ID NO: 300229 - DNA, 3328 bp, Homo sapiens
  misc_feature (3297)..(3297): n is a, c, g, or t
cgcccagagcgaggctggggtagggaggccgactgagcaggagtcgtccgcttatagtggaggctgctaggagccggtcagagggtgagtggggagcaggcgagcgagccacagcaggcaggagggagcgtcgcgcggcgcagaggagcgccggggcagggccgcggcggaaccacagccggagaggggcagcccgagccgggcgccgcagggtccccacccccacccggccggacagtgcccggtgttcccccgtgcggggggcggcggcggcggctgacgggaccgccgggaccgcgggggtgttgccacctccaccgaggagccggcgcggccgcgggctcctcagagccggggccccgggcccgtgacagacgggccgaggaagggagagaggcggcggcgacaccatgtcatctcccagtccgggcaagaggcggatggacacggacgtggtcaagctcatcgagagtaaacatgaggttacgatcctgggaggacttaatgaatttgtagtgaagttttatggaccacaaggaacaccatatgaaggcggagtatggaaagttagagtggacctacctgataaataccctttcaaatctccatctataggattcatgaataaaattttccatcccaacattgatgaagcgtcaggaactgtgtgtctagatgtaattaatcaaacttggacagctctctatgatcttaccaatatatttgagtccttcctgcctcagttattggcctatcctaaccccatagatcctctcaatggtgacgctgcagccatgtacctccaccgaccagaagaatacaagcagaaaattaaagagtacatccagaaatacgccacggaggaggcgctgaaagaacaggaagagggtaccggggacagctcatcggagagctctatgtctgacttttccgaagatgaggcccaggatatggagttgtagtagaaaaagcacctgcttttcagaaagactattatttcctaaccatgagaagcagactataatattcatatttaaacaaagcaattttttttattactaaacaaggtttttatgaataatagcattgatatatatatattatatatcaccctttagatcttgatttcttggtcatttctcaacctgaggtgcatagcatattcccacattccatttggtagcaatatgcggtctgaatgcatgcattcatgagtccatgtggccaagtcagcctgtgtgctactgaactgtcgaaggaaatagccgctctgataggtagatgtgagtaaaaagaacaggaaaaaattgcttcttttattggtttccaaagaaacaaaccaaaccaaccagctcttggatgtgaagataaaatagtgcttttttgaaatggagaggaaaaacttggggaggaagaggcctgctgtgggggcatcggagccagccatgtaagaatcagagctgctccttcctgtgaatcctaggtggccctatgtcttctgtggagttacagtataaagcagggagctaattaagagtattaaaacttaaaaccattttttgactctgattttaagtacatttttatatgtcagttgctgcccttcacactaccaggccctgcagccacagtgttctgttggagaaacttggggaagtgttttctgaaccagttctttttcttggggtagagcgtgaaatccagacctgtttttgaaaggacagcacaggaggagaaaagtgactgggacgatgcttcctctcatccaaaacacatgcagagtcacatcctcatcctagtgtttggcagtttgagaccgctaccctgaacttaagagctttaaatatgagggttgtgtttctgggggggttatttttttggtgtgtgtgtgtgtgtattgtgcttagaaaggttgcagatttcatcttcacctaccaagaggcggccgcctccttggacaagccgctcatggaccattagacttgagaagacgacccacgtggtgactgcaaagccctgggtacttgccttcatgttctggtttggttttccctttttctgctgctcttggcagcagcctggtcatcatctgcttgtgggagtgggaaatgggtattttagacccaacacaggttctaaatttaaaacaaataataattggaacaaataaaggttcttgtacccagagtgattctacatgggaaaaacaaaccagcttttttcagagagtgaccgaataggaagaagggattcagaaatatgatgtagtagaacatgccctgcaggaagaaaatgttttctctcctgcgtatgttaagaggaaatcagtttaaaatgcctgctaatcaaatgtcgactcagctaaccatatgtccaggttgctgcagagtttctttcaaatctgagtgttgcctgctgaactcggaggggagtttggagaaattttagacagcagctctgtgttctttttttgccgcagccaataagataatagcagaattagccaatcctaaaaccttctaaagacgatttttgagcatcccactgggattatttaatttttctttttgacgtgtgtttttagtttagaagtgctgtattccacaaggtttaagtcagtgaggttggaagataccctatcttttttattcaaaaagcacaatcaatcttttgtttgaaaatctatataaagtacaacttgcttttagcatgattattttcctaaataaaaagacaaagaatttacttactttatgttaattacgggcatgaagcaaaaggttttctttaaaaaaaaaaaaaagtgcagtgatgtagggctgtggttagttaaccgtactgagttatccatctagcatctgtggcttgctggaagggtagtattaactatttaacatgtaatggtgtacttcactcttacctagcacgctgtcttctcattgctttgggggagggagggtctctctgctggcactgtctaacttgcttacctgctgactttgcagtttgcttgtgctatgacatttattgtaggtgctatttagggtaggcttaaagtgctgggtggtgatttgagttcaaacaataaaaaattgtattttttcaatattgtataaacaatagtgttctaattaccttaaaaaaaaataatgaccagttaagaattgcttttgatcttgtcaaaaaactgaatagaccccagtttcgggaagggcaagtgtgagcctcgctcagttcctgagttgtacgtccagtgactagcaggtgagaagagaggcagcgaggacttcttacaancctgagccctccctagaccctaggatcctct

SEQ ID NO: 300230 - DNA, 3112 bp, Homo sapiens
cgcccagagcgaggctggggtagggaggccgactgagcaggagtcgtccgcttatagtggaggctgctaggagccggtcagagggtgagtggggagcaggcgagcgagccacagcaggcaggagggagcgtcgcgcggcgcagaggagcgccggggcagggccgcggcggaaccacagccggagaggggcagcccgagccgggcgccgcagggtccccacccccacccggccggacagtgcccggtgttcccccgtgcggggggcggcggcggcggctgacgggaccgccgggaccgcgggggtgttgccacctccaccgaggagccggcgcggccgcgggctcctcagagccggggccccgggcccgtgacagacgggccgaggaagggagagaggcggcggcgacaccatgtcatctcccagtccgggcaagaggcggatggacacggacgtggtcaagctcatcgagagtaaacatgaggttacgatcctgggaggacttaatgaatttgtagtgaagttttatggaccacaaggaacaccatatgaaggcggagtatggaaagttagagtggacctacctgataaataccctttcaaatctccatctataggattcatgaataaaattttccatcccaacattgatgaagcgtcaggaactgtgtgtctagatgtaattaatcaaacttggacagctctctatgatcttaccaatatatttgagtccttcctgcctcagttattggcctatcctaaccccatagatcctctcaatggtgacgctgcagccatgtacctccaccgaccagaagaatacaagcagaaaattaaagagtacatccagaaatacgccacggaggaggcgctgaaagaacaggaagagggtaccggggacagctcatcggagagctctatgtctgacttttccgaagatgaggcccaggatatggagttgtagtagaaaaagcacctgcttttcagaaagactattatttcctaaccatgagaagcagactataatattcatatttaaacaaagcaattttttttattactaaacaaggtttttatgaataatagcattgatatatatatattatatatcaccctttagatcttgatttcttggtcatttctcaacctgaggtgcatagcatattcccacattccatttggtagcaatatgcggtctgaatgcatgcattcatgagtccatgtggccaagtcagcctgtgtgctactgaactgtcgaaggaaatagccgctctgataggtagatgtgagtaaaaagaacaggaaaaaattgcttcttttattggtttccaaagaaacaaaccaaaccaaccagctcttggatgtgaagataaaatagtgcttttttgaaatggagaggaaaaacttggggaggaagaggcctgctgtgggggcatcggagccagccatgtaagaatcagagctgctccttcctgtgaatcctaggtggccctatgtcttctgtggagttacagtataaagcagggagctaattaagagtattaaaacttaaaaccattttttgactctgattttaagtacatttttatatgtcagttgctgcccttcacactaccaggccctgcagccacagtgttctgttggagaaacttggggaagtgttttctgaaccagttctttttcttggggtagagcgtgaaatccagacctgtttttgaaaggacagcacaggaggagaaaagtgactgggacgatgcttcctctcatccaaaacacatgcagagtcacatcctcatcctagtgtttggcagtttgagaccgctaccctgaacttaagagctttaaatatgagggttgtgtttctgggggggttatttttttggtgtgtgtgtgtgtgtattgtgcttagaaaggttgcagatttcatcttcacctaccaagaggcggccgcctccttggacaagccgctcatggaccattagacttgagaagacgacccacgtggtgactgcaaagccctgggtacttgccttcatgttctggtttggttttccctttttctgctgctcttggcagcagcctggtcatcatctgcttgtgggagtgggaaatgggtattttagacccaacacaggttctaaatttaaaacaaataataattggaacaaataaaggttcttgtacccagagtgattctacatgggaaaaacaaaccagcttttttcagagagtgaccgaataggaagaagggattcagaaatatgatgtagtagaacatgccctgcaggaagaaaatgttttctctcctgcgtatgttaagaggaaatcagtttaaaatgcctgctaatcaaatgtcgactcagctaaccatatgtccaggttgctgcagagtttctttcaaatctgagtgttgcctgctgaactcggaggggagtttggagaaattttagacagcagctctgtgttctttttttgccgcagccaataagataatagcagaattagccaatcctaaaaccttctaaagacgatttttgagcatcccactgggattatttaatttttctttttgacgtgtgtttttagtttagaagtgctgtattccacaaggtttaagtcagtgaggttggaagataccctatcttttttattcaaaaagcacaatcaatcttttgtttgaaaatctatataaagtacaacttgcttttagcatgattattttcctaaataaaaagacaaagaatttacttactttatgttaattacgggcatgaagcaaaaggttttctttaaaaaaaaaaaaaagtgcagtgatgtagggctgtggttagttaaccgtactgagttatccatctagcatctgtggcttgctggaagggtagtattaactatttaacatgtaatggtgtacttcactcttacctagcacgctgtcttctcattgctttgggggagggagggtctctctgctggcactgtctaacttgcttacctgctgactttgcagtttgcttgtgctatgacatttattgtaggtgctatttagggtaggcttaaagtgctgggtggtgatttgagttcaaacaataaaaaattgtattttttcaatattgt

SEQ ID NO: 300231 - DNA, 3122 bp, Homo sapiens
cgcccagagcgaggctggggtagggaggccgactgagcaggagtcgtccgcttatagtggaggctgctaggagccggtcagagggtgagtggggagcaggcgagcgagccacagcaggcaggagggagcgtcgcgcggcgcagaggagcgccggggcagggccgcggcggaaccacagccggagaggggcagcccgagccgggcgccgcagggtccccacccccacccggccggacagtgcccggtgttcccccgtgcggggggcggcggcggcggctgacgggaccgccgggaccgcgggggtgttgccacctccaccgaggagccggcgcggccgcgggctcctcagagccggggccccgggcccgtgacagacgggccgaggaagggagagaggcggcggcgacaccatgtcatctcccagtccgggcaagaggcggatggacacggacgtggtcaagctcatcgagagtaaacatgaggttacgatcctgggaggacttaatgaatttgtagtgaagttttatggaccacaaggaacaccatatgaaggcggagtatggaaagttagagtggacctacctgataaataccctttcaaatctccatctataggattcatgaataaaattttccatcccaacattgatgaagcgtcaggaactgtgtgtctagatgtaattaatcaaacttggacagctctctatgatcttaccaatatatttgagtccttcctgcctcagttattggcctatcctaaccccatagatcctctcaatggtgacgctgcagccatgtacctccaccgaccagaagaatacaagcagaaaattaaagagtacatccagaaatacgccacggaggaggcgctgaaagaacaggaagagggtaccggggacagctcatcggagagctctatgtctgacttttccgaagatgaggcccaggatatggagttgtagtagaaaaagcacctgcttttcagaaagactattatttcctaaccatgagaagcagactataatattcatatttaaacaaagcaattttttttattactaaacaaggtttttatgaataatagcattgatatatatatattatatatcaccctttagatcttgatttcttggtcatttctcaacctgaggtgcatagcatattcccacattccatttggtagcaatatgcggtctgaatgcatgcattcatgagtccatgtggccaagtcagcctgtgtgctactgaactgtcgaaggaaatagccgctctgataggtagatgtgagtaaaaagaacaggaaaaaattgcttcttttattggtttccaaagaaacaaaccaaaccaaccagctcttggatgtgaagataaaatagtgcttttttgaaatggagaggaaaaacttggggaggaagaggcctgctgtgggggcatcggagccagccatgtaagaatcagagctgctccttcctgtgaatcctaggtggccctatgtcttctgtggagttacagtataaagcagggagctaattaagagtattaaaacttaaaaccattttttgactctgattttaagtacatttttatatgtcagttgctgcccttcacactaccaggccctgcagccacagtgttctgttggagaaacttggggaagtgttttctgaaccagttctttttcttggggtagagcgtgaaatccagacctgtttttgaaaggacagcacaggaggagaaaagtgactgggacgatgcttcctctcatccaaaacacatgcagagtcacatcctcatcctagtgtttggcagtttgagaccgctaccctgaacttaagagctttaaatatgagggttgtgtttctgggggggttatttttttggtgtgtgtgtgtgtgtattgtgcttagaaaggttgcagatttcatcttcacctaccaagaggcggccgcctccttggacaagccgctcatggaccattagacttgagaagacgacccacgtggtgactgcaaagccctgggtacttgccttcatgttctggtttggttttccctttttctgctgctcttggcagcagcctggtcatcatctgcttgtgggagtgggaaatgggtattttagacccaacacaggttctaaatttaaaacaaataataattggaacaaataaaggttcttgtacccagagtgattctacatgggaaaaacaaaccagcttttttcagagagtgaccgaataggaagaagggattcagaaatatgatgtagtagaacatgccctgcaggaagaaaatgttttctctcctgcgtatgttaagaggaaatcagtttaaaatgcctgctaatcaaatgtcgactcagctaaccatatgtccaggttgctgcagagtttctttcaaatctgagtgttgcctgctgaactcggaggggagtttggagaaattttagacagcagctctgtgttctttttttgccgcagccaataagataatagcagaattagccaatcctaaaaccttctaaagacgatttttgagcatcccactgggattatttaatttttctttttgacgtgtgtttttagtttagaagtgctgtattccacaaggtttaagtcagtgaggttggaagataccctatcttttttattcaaaaagcacaatcaatcttttgtttgaaaatctatataaagtacaacttgcttttagcatgattattttcctaaataaaaagacaaagaatttacttactttatgttaattacgggcatgaagcaaaaggttttctttaaaaaaaaaaaaaagtgcagtgatgtagggctgtggttagttaaccgtactgagttatccatctagcatctgtggcttgctggaagggtagtattaactatttaacatgtaatggtgtacttcactcttacctagcacgctgtcttctcattgctttgggggagggagggttctttattgttcacttttcttaacttgtgtaaccttggtgatcttatgcattcttgtttatgctcattttaatctttttcatattgtttcggttccatattatttattgtgtatataactttcataaatgtgtgcttaacgtcaaggaatgcagttaataca

SEQ ID NO: 300232 - DNA, 2178 bp, Homo sapiens
cgcccagagcgaggctggggtagggaggccgactgagcaggagtcgtccgcttatagtggaggctgctaggagccggtcagagggtgagtggggagcaggcgagcgagccacagcaggcaggagggagcgtcgcgcggcgcagaggagcgccggggcagggccgcggcggaaccacagccggagaggggcagcccgagccgggcgccgcagggtccccacccccacccggccggacagtgcccggtgttcccccgtgcggggggcggcggcggcggctgacgggaccgccgggaccgcgggggtgttgccacctccaccgaggagccggcgcggccgcgggctcctcagagccggggccccgggcccgtgacagacgggccgaggaagggagagaggcggcggcgacaccatgtcatctcccagtccgggcaagaggcggatggacacggacgtggtcaagctcatcgagagtaaacatgaggttacgatcctgggaggacttaatgaatttgtagtgaagttttatggaccacaaggaacaccatatgaaggcggagtatggaaagttagagtggacctacctgataaataccctttcaaatctccatctataggattcatgaataaaattttccatcccaacattgatgaagcgtcaggaactgtgtgtctagatgtaattaatcaaacttggacagctctctatgatcttaccaatatatttgagtccttcctgcctcagttattggcctatcctaaccccatagatcctctcaatggtgacgctgcagccatgtacctccaccgaccagaagaatacaagcagaaaattaaagagtacatccagaaatacgccacggaggaggcgctgaaagaacaggaagagggtaccggggacagctcatcggagagctctatgtctgacttttccgaagatgaggcccaggatatggagttgtagtagaaaaagcacctgcttttcagaaagactattatttcctaaccatgagaagcagactataatattcatatttaaacaaagcaattttttttattactaaacaaggtttttatgaataatagcattgatatatatatattatatatcaccctttagatcttgatttcttggtcatttctcaacctgaggtgcatagcatattcccacattccatttggtagcaatatgcggtctgaatgcatgcattcatgagtccatgtggccaagtcagcctgtgtgctactgaactgtcgaaggaaatagccgctctgataggtagatgtgagtaaaaagaacaggaaaaaattgcttcttttattggtttccaaagaaacaaaccaaaccaaccagctcttggatgtgaagataaaatagtgcttttttgaaatggagaggaaaaacttggggaggaagaggcctgctgtgggggcatcggagccagccatgtaagaatcagagctgctccttcctgtgaatcctaggtggccctatgtcttctgtggagttacagtataaagcagggagctaattaagagtattaaaacttaaaaccattttttgactctgattttaagtacatttttatatgtcagttgctgcccttcacactaccaggccctgcagccacagtgttctgttggagaaacttggggaagtgttttctgaaccagttctttttcttggggtagagcgtgaaatccagacctgtttttgaaaggacagcacaggaggagaaaagtgactgggacgatgcttcctctcatccaaaacacatgcagagtcacatcctcatcctagtgtttggcagtttgagaccgctaccctgaacttaagagctttaaatatgagggttgtgtttctgggggggttatttttttggtgtgtgtgtgtgtgtattgtgcttagaaaggttgcagatttcatcttcacctaccaagaggcggccgcctccttggacaagccgctcatggaccattagacttgagaagacgacccacgtggtgactgcaaagccctgggtacttgccttcatgttctggtttggttttccctttttctgctgctcttggcagcagcctggttatatatgtatgacgagagccgagtaatggtataattaagacaccagtcccggtactgaaataaacaacagagtgtcgcctcgtaatacgttcgt

SEQ ID NO: 300233 - DNA, 1206 bp, Homo sapiens
cgcccagagcgaggctggggtagggaggccgactgagcaggagtcgtccgcttatagtggaggctgctaggagccggtcagagggtgagtggggagcaggcgagcgagccacagcaggcaggagggagcgtcgcgcggcgcagaggagcgccggggcagggccgcggcggaaccacagccggagaggggcagcccgagccgggcgccgcagggtccccacccccacccggccggacagtgcccggtgttcccccgtgcggggggcggcggcggcggctgacgggaccgccgggaccgcgggggtgttgccacctccaccgaggagccggcgcggccgcgggctcctcagagccggggccccgggcccgtgacagacgggccgaggaagggagagaggcggcggcgacaccatgtcatctcccagtccgggcaagaggcggatggacacggacgtggtcaagctcatcgagagtaaacatgaggttacgatcctgggaggacttaatgaatttgtagtgaagttttatggaccacaaggaacaccatatgaaggcggagtatggaaagttagagtggacctacctgataaataccctttcaaatctccatctataggattcatgaataaaattttccatcccaacattgatgaagcgtcaggaactgtgtgtctagatgtaattaatcaaacttggacagctctctatgatcttaccaatatatttgagtccttcctgcctcagttattggcctatcctaaccccatagatcctctcaatggtgacgctgcagccatgtacctccaccgaccagaagaatacaagcagaaaattaaagagtacatccagaaatacgccacggaggaggcgctgaaagaacaggaagagggtaccggggacagctcatcggagagctctatgtctgacttttccgaagatgaggcccaggatatggagttgtagtagaaaaagcacctgcttttcagaaagactattatttcctaaccatgagaagcagactataatattcatatttaaacaaagcaattttttttattactaaacaaggtttttatgaataatagcattgatatatatatattatatatcaccctttagatcttgatttcttggtcatttctcaacctgaggtgcatgtgtataatgaaaactgtaaacttttttaaataaacgtgtatataccttg

SEQ ID NO: 300234 - DNA, 596 bp, Homo sapiens
  misc_feature (86)..(86): n is a, c, g, or t
aacactagttcccagagacttggtgtccagaaacttgacccacagaggctagcggaggatctgtctttcatgattctcagccatcncaacgggaggcctaacataaagcatgtgccaggccaatgccaactaggacttctgaatccatgtttgtgctttctctggcccgtgaacacctcggcgattctgttagggatgggatgagtgggaggaagccctttgagaagggggagccggccctgtcatgcgcaggttttccactcatctgaggaagagccagggctctgaatttagcctaacactcatcttggctgtgggcttgggaagaaatggccattatttacagattgtatttggtacatattgtgtgatacttgaaaagataaaagggactgccagcccctaactgaaatctgaagctttttatcgcttatttttcctcgccctgtctcctcccttccacctttctccttgcattgtgatgatctagtaggcacgtctgtcaacaggacacatgcctcctctgactataacctcttaatagttgtgtataatgaaaactgtaaacttttttaaataaacgtgtatataccttg

SEQ ID NO: 300235 - DNA, 498 bp, Homo sapiens
aggcgttgaatggcccggaggcgttgaatggcccggaggcgttgaatggcccggaggcgttgaatggcccgtgaacacctcggcgattctgttagggatgggatgagtgggaggaagccctttgagaagggggagccggccctgtcatgcgcaggttttccactcatctgaggaagagccagggctctgaatttagcctaacactcatcttggctgtgggcttgggaagaaatggccattatttacagattgtatttggtacatattgtgtgatacttgaaaagataaaagggactgccagcccctaactgaaatctgaagctttttatcgcttatttttcctcgccctgtctcctcccttccacctttctccttgcattgtgatgatctagtaggcacgtctgtcaacaggacacatgcctcctctgactataacctcttaatagttgtgtataatgaaaactgtaaacttttttaaataaacgtgtatataccttg

SEQ ID NO: 300236 - DNA, 913 bp, Homo sapiens
cgcccagagcgaggctggggtagggaggccgactgagcaggagtcgtccgcttatagtggaggctgctaggagccggtcagagggtgagtggggagcaggcgagcgagccacagcaggcaggagggagcgtcgcgcggcgcagaggagcgccggggcagggccgcggcggaaccacagccggagaggggcagcccgagccgggcgccgcagggtccccacccccacccggccggacagtgcccggtgttcccccgtgcggggggcggcggcggcggctgacgggaccgccgggaccgcgggggtgttgccacctccaccgaggagccggcgcggccgcgggctcctcagagccggggccccgggcccgtgacagacgggccgaggaagggagagaggcggcggcgacaccatgtcatctcccagtccgggcaagaggcggatggacacggacgtggtcaagctcatcgagagtaaacatgaggttacgatcctgggaggacttaatgaatttgtagtgaagttttatggaccacaaggaacaccatatgaaggcggagtatggaaagttagagtggacctacctgataaataccctttcaaatctccatctataggattcatgaataaaattttccatcccaacattgatgaagcgtaagtaactattttaaaatgtttcaattttagcagcaactgctcatgattagtgtttctctgtgttataaaaagcctcggttatctttttggaccttatcaggaggtaggactgtatgaatggtcatgtaaatgatagaatccaaaggatatgaggttctcaatcacttagttcacattctgctgttgtaccacttatttttttccattgtcgtgactgggtccttcatttttcttgttacccagcaaacagtagta

SEQ ID NO: 300237 - DNA, 1057 bp, Homo sapiens
cgcccagagcgaggctggggtagggaggccgactgagcaggagtcgtccgcttatagtggaggctgctaggagccggtcagagggtgagtggggagcaggcgagcgagccacagcaggcaggagggagcgtcgcgcggcgcagaggagcgccggggcagggccgcggcggaaccacagccggagaggggcagcccgagccgggcgccgcagggtccccacccccacccggccggacagtgcccggtgttcccccgtgcggggggcggcggcggcggctgacgggaccgccgggaccgcgggggtgttgccacctccaccgaggagccggcgcggccgcgggctcctcagagccggggccccgggcccgtgacagacgggccgaggaagggagagaggcggcggcgacaccatgtcatctcccagtccgggcaagaggcggatggacacggacgtggtcaagcttggcccctgctgaaggctagagctgcttgttttggaaaagcgtatgcaggcaaaaggccgcaggcaccgctcctcagcgctcattggccgccctgttactacccggaaaaggaggaggggaggagctaccaaacagctgatggacatcgagagtaaacatgaggttacgatcctgggaggacttaatgaatttgtagtgaagttttatggaccacaaggaacaccatatgaaggcggagtatggaaagttagagtggacctacctgataaataccctttcaaatctccatctataggattcatgaataaaattttccatcccaacattgatgaagcgtaagtaactattttaaaatgtttcaattttagcagcaactgctcatgattagtgtttctctgtgttataaaaagcctcggttatctttttggaccttatcaggaggtaggactgtatgaatggtcatgtaaatgatagaatccaaaggatatgaggttctcaatcacttagttcacattctgctgttgtaccacttatttttttccattgtcgtgactgggtccttcatttttcttgttacccagcaaacagtagta

SEQ ID NO: 300238 - DNA, 171 bp, Homo sapiens
acttttttaaataaacgtgtatataccttggcaaatggctggaccttgatcaataagataatagccctcatgattactctcagctggttttctaaaataccctctctgttctggctcctttgagcagcagacgctggcttcttttggctgagcagctcttagaatgcagat

SEQ ID NO: 300239 - DNA, 264 bp, Homo sapiens
ccgccctgttactacccggaaaaggaggaggggaggagctaccaaacagctgatggagtatgtgacaagagagtgtgtttatatacaaaagaggtgggggctggggaggccctctgagtggtgttacaggaacaagtgtgttttcgaggggtaaaaagagaagaggaaaacctgacctgttagagtacaagaaatgtttagaaaaattaaggttaaatcagaaaagtagatcggataataatggggaccggcatacaccatatg

SEQ ID NO: 300240 - DNA, 573 bp, Homo sapiens
gcggccgcgggctcctcagagccggggccccgggcccgtgacagacgggccgaggaagggagagaggcggcggcgacaccatgtcatctcccagtccgggcaagaggcggatggacacggacgtggtcaagctgtatccttcgtggaggggaattcgggctgtgtgtggggggcggtgtggggatgcccagggcacccccggaaccactgcaagggccctggggcactccaggccactgtccgagactcccctcctcccccagtgcctacggcggctccttggcacctcccaggggccgagagccttttcagctcgccttttctccgcagcaccccgaaatacgcgttgctgctcgctcttcctgtatccccagagcctgtgactttcctccgcgacgtttggactcccgagacggccttttttctttttgcacgaccagtcgcctcactctctaccaccgagcccattttcagggtttctctctcctgtttgctcgctttggatttagggaatcaaggcagaaattcccgagagggaagcctttctccgtttcttgagatgcccccatttcc

SEQ ID NO: 300241 - DNA, 695 bp, Homo sapiens
aaccaccttagcctaggcttattttatccctgggatgtagctgctgttttggcctttggtgatcttcacccgtttaccgtagggtggatttaccttgattcacaagtcgtttgtctaacctctccttttgtcaagataattctgacaggtgaaatttctggtgattggcccaaagtatttcatctacccacaaatttgatcattaatatcctctcaaataaagggaacaaagatggaaaaataggtgaagcttggcctcatttatttacatattgaccccaatgtcagaagttactcagaagtgtgtgcaactctgtatagaccccttcctgggactggacacagaggctgaaataaaaaccagtttttcagcatgacttagcacaatgttatttattttcactgcctattagcctatgggtcatgagatttgttattctagagcagttgagtattggagtggaacaagcaaaagcaaggcatatttttctgttgtaatctgtactttttattttttaagatatataataatagttttacattaagtgtgatttggattccttctccagaattataaattacctaattcccttctgctaaaagacgcaggacagagaagggtaagcattttagctggacatttattcctgttgtacgatcctccccatcccctttaacgagtgctagaactacgc

SEQ ID NO: 300242 - DNA, 882 bp, Homo sapiens
ttctcaaccagccaaaggagccattttccaatctcttatcttgttggggtgtgttagaaaaatataccagtgcaagaacctgtaagcctggggttcattaacctgcttaaaaccagttttacttcaaataggtgatctttagtgtcaaccgttgtacttttgtctgcagggaacaactcaagtttcgtcctgtcctcagtaagcagatgagaggtagggttgacgttagaagccaagtttttgtggagcaataaggtaaaattatgaaggaagcctatagaattccaggagagtttaaagaaaacagtagaatactttcttagcaagggtatgggtgggcttctgagtggaggaagcaggctagaccttgggatgttccagtccaaattctgtttcggaagctccctaaatgtatgcagaggttgtgtaattgtattcatcactgttgaatgtattattggtttgatttggtttcactgctcctaagttccttttgtcttatcttgcaagcatatcactgtgagtacttaaatcattaacaactcattaaaactcttgaccattttcattttctaccaagctgaagcctgggtgtggtggaaacttgtgcaggcctgcttggctgtgccgcaactgagcagctcctagcagtttggctgtcaaaaggtcactgaataaacaaattgataggaatggcggacataatctctgcagttccttgaaaagaaggaaggggctgcaggatacaggatagtgaaggatccttctcttcaacctgaaagactcttcagcaattaacaccttgactctctttttatgcaacactttttttttgtcctctcagagactctatttgtacttggtcttttcttctttcaggat

SEQ ID NO: 300243 - DNA, 1112 bp, Homo sapiens
tcccgggttcatgccattctcctgcctcagcctcctgagtagctgggactacaggagccttttagtagagacaggatttcaccatgttagccaggatgctctctatctcctgacctcgtgatccacccgccttggtctcccaaagtgctgggattacaggcatgagataccccacctggcctaaaaacagagatcttatcagattgtcttttggttgaggctcccctttggaaacttcaaagggtattgtgtcttcagcacactctcctatgttttcttggtcctgggtggtagaatggggtgacctaatattcccacagctgccatgtctcttggagggtctagtgagtatcagcccctgagtcactcctcccaggggacagactgaggtaggagaatggggactcccaagagagcagctgaatgccttacgatggaaggagactcctagtatactctgcatctagatagccaacccctcgagatgctcagcttttctttcccagtcccagttttcgtaagttggagacacatggctggtcagccagttggatggtgctattgagggaaaggagaaatgattcctgtcctctggattgtgtcaactgtgaaggaagacaaaaccccaaaagacaaggaaagcccaccccaacggggtggaccagtagcctgcaaatcagaatatgaaattgaggttcacagcggggcatagtgcggtgttggtggaaagtagtcatgagcgcttcggtgagcaggatgggggtggagagatgtctcatgtgatagggtgacctgtgctgacacatgagtcagacatcactgtgttccagccagtattgcccctctgtgggcttgtcccttgtaaagaatagttcatagattgcagcttgagtatttcaaattaactttacgttgcatttttcactagagccaaatccaagaatgattgcatagatcaggtaagacacagaagaggcaactcaacaaagcccatgacatacagtgcatggctcacaatcccaggagatgagggcagcacagctgcagagcaacacagagtggggagaacatccaggatgcacattcaaccagcaggtggggagcaagacaga

SEQ ID NO: 300244 - DNA, 1937 bp, Homo sapiens
ccaaaagtttcatatgaaaaaaattggattataaaccagtaacttaaatattaataaggatattttatgttttaaaaaagtatttacacagaatcataatcagtgaaattgaccatttgaaaactaaaagtttttacctacctgctcaatttattaacatcattgctttggggactgtttgaatataggtacgtgttttcttgtgcattctctataatttcaggaaaagtactaatgcgaattctcttccaaaattgtgatgtttcttgtatttttgatgaaggagaaatactgtaatgatcactgtttacactatgtacactttaggccagccctttgtagcgttatataaaactgaaggtcttttgtgctttcagtttgtataaaaaagctttgagattaaaggaaaaaaaaaatttttacactgtggttataaatttcaagtttcttaaagcttttgtagacttgtaacagagtctttaaattttagttggattttgtaaattgttttgtatattttatttaatgtactcttaacaactgatgtatctggctttaaaacatcagaattggtttgttgttttgtttggtacagaggagcatttggtagtgttcattttaattttattatataggagctgaaacatcaaatatatattttatctatcattatgctacacaatcagtgctataaatttttttatgcaaagaaactttcttaatgttttaatcatgtttcctcagagtgacactttttgttgttgttaataccaagtatgaacactctgcatcattattccatgaaccagttctaatgcaaacctatgtatgtccattagaaatggaagttattttttaatcaacaatgaggcctattataaatttatcagatgaatctagatagctttatagcatataaaatatgttaatttgtgttagcaggtgcacatttcaccactgaaattagaaatattttgacagtctgttctgcataccattctgagtctacttttctgtctttagaagaatcgtaaatttcagtgtcctttatttgactcagtgggatatagctgttataagtaatagggcacagatgtgcagtagagtcttgtttaatggcatttcactgttcattccctttaccaccgttataaaacttttctttattgtaattatcagtgcaaagctatgtatttatcatggtaaaactccagtgttagaatagttttttcttacagtatactttctttggttaggtttgtgtatgtgttgctgattacattagaacttgatgttaagtcatttatcacactctcatgagagcagtaataaaagtgtgtaatctaggagaaaaagttaatttgtcaaacttagataagcatgatgtttaggtcctatttttcaattttataactgttttattgcaacaatatttgtatttaagtctccattttaatgccttgtggtgtttttttatgcatgtcactaagttgtcatcccacataaattgatgtgcagcatagggtattaaatctacataatgattttaaaacagaaatagttgatggtaaaatgtaaatgttttgcaaaaattccttataaaaagttttgtagtaacatttcacttgtaaattttttttgtaaaaaaaaaaaaatgaaaaaaaaagatgaatccagaaaaaaacctgtttcccatattctagaatttagacaattattctgccagcaaagcctctggggctgtaattgacatttttacagtgctgatttgtataaaatttgttttttgtggatttggaaataaaatcatgtacaagttgttgcctgcaataacaattgcaagtaacctattaaaaattcccttgagtttaacatgtttcatttaattatgtatactataaagcagcaataaattatttgaactatcaacctactta

SEQ ID NO: 300245 - DNA, 1677 bp, Homo sapiens
ccaaaagtttcatatgaaaaaaattggattataaaccagtaacttaaatattaataaggatattttatgttttaaaaaagtatttacacagaatcataatcagtgaaattgaccatttgaaaactaaaagtttttacctacctgctcaatttattaacatcattgctttggggactgtttgaatataggtacgtgttttcttgtgcattctctataatttcaggaaaagtactaatgcgaattctcttccaaaattgtgatgtttcttgtatttttgatgaaggagaaatactgtaatgatcactgtttacactatgtacactttaggccagccctttgtagcgttatataaaactgaaggtcttttgtgctttcagtttgtataaaaaagctttgagattaaaggaaaaaaaaaatttttacactgtggttataaatttcaagtttcttaaagcttttgtagacttgtaacagagtctttaaattttagttggattttgtaaattgttttgtatattttatttaatgtactcttaacaactgatgtatctggctttaaaacatcagaattggtttgttgttttgtttggtacagaggagcatttggtagtgttcattttaattttattatataggagctgaaacatcaaatatatattttatctatcattatgctacacaatcagtgctataaatttttttatgcaaagaaactttcttaatgttttaatcatgtttcctcagagtgacactttttgttgttgttaataccaagtatgaacactctgcatcattattccatgaaccagttctaatgcaaacctatgtatgtccattagaaatggaagttattttttaatcaacaatgaggcctattataaatttatcagatgaatctagatagctttatagcatataaaatatgttaatttgtgttagcaggtgcacatttcaccactgaaattagaaatattttgacagtctgttctgcataccattctgagtctacttttctgtctttagaagaatcgtaaatttcagtgtcctttatttgactcagtgggatatagctgttataagtaatagggcacagatgtgcagtagagtcttgtttaatggcatttcactgttcattccctttaccaccgttataaaacttttctttattgtaattatcagtgcaaagctatgtatttatcatggtaaaactccagtgttagaatagttttttcttacagtatactttctttggttaggtttgtgtatgtgttgctgattacattagaacttgatgttaagtcatttatcacactctcatgagagcagtaataaaagtgtgtaatctaggagaaaaagttaatttgtcaaacttagataagcatgatgtttaggtcctatttttcaattttataactgttttattgcaacaatatttgtatttaagtctccattttaatgccttgtggtgtttttttatgcatgtcactaagttgtcatcccacataaattgatgtgcagcatagggtattaaatctacataatgattttaaaacagaaatagttgatggtaaaatgtaaatgttttgcaaaaattccttataaaaagttttgtagtaacatttcacttgtaaattttttttgtaaaagtcgacgcggccgcgaatttagtagtaaaca

SEQ ID NO: 300246 - DNA, 965 bp, Homo sapiens
  misc_feature (32)..(32): n is a, c, g, or t
  misc_feature (904)..(904): n is a, c, g, or t
taggcatagctcgaggccgcgggcgaatcggncgaggctataggctcggggaggtagaattgggctatttgctgaagcttcttggtggcccttgctagcccaggaagaaacttacattttgatttttttgtaccatggctttggttcacaaattgctgcgtggtacttattttctcagaaaattctctaagccaacttctgccttgtatccatttttgggtattcgctttgcagagtattccagtagtcttcagaaaccagtggcttctcctggcaaagcctcctcacagaggaagactgaaggggatttgcaaggagatcaccagaaagaagttgctttggatataacttcttctgaggagaagcctgatgttagtttcgataaagcaattagagatgaagcaatataccattttaggcttttgaaggatgaaattgtggatcattggagaggaccggaaggccaccctctgcatgaggtcttgctggaacaagccaaggttgtctggcaattccgggggaaagaagatttggataagtggacagtgacttctgataagacgattggaggcagaagtgaagtgtttttgaaaatgggcaagaataaccaaagtgcactgctatatggaactctgagctctgaggcgcctcaggacggggagtctacccgaagtgggtactgtgcaatgatatccaggattccaaggggtgcttttgagaggaagatgtcttacgattggtcccagttcaatactctgtatctccgtgtacgtggggatggtcggccttggatggtgaatatcaaggaggacacagatttcttccagaggacgaatcagatgtatagttacttcatgttcacccgcgggggaccctactggcaggaggtcaagttctttccaanttctcttaatcaagagaccggtgcaacgaatcgtgaaagttactgtgaaaagggcaatcga

SEQ ID NO: 300247 - DNA, 451 bp, Homo sapiens
aagaccctgtctcaaaaaaaaaaatttttttttcttaactggttcttcattatgtacatgtagatttagattgttttcagagttttctactgtcggaacaaactctgagattcctttttccaaatttttcttctctaatcgaggaagaatccgggatgttcagcatgagcttccgcttgataagatctcttctataggattcaccttggctgataaagtggatggtccattcttcctggagatagattttattggcgtgtttactgatccagctcatacagaagaatttgcctatgaaaattctccagagcttaacccaaggctttttaaataaagatcatatggtagttttgttttactaatctaagggtactagcatctacaatgatatagacaaaataaaatatttctttaatggcatccaaaaaaaaaatagtatgtattctctctc

SEQ ID NO: 300248 - DNA, 1569 bp, Homo sapiens
tgtttggcatcggaagggaaaagcagatggacctatacgggtaaagtggcttctgggcggaaggtacactataggctcggggaggtaagcggcggcaggccggcggttggtgtgtcccgggtgtggggaggcgacagagccctggcacttgagggttgagggggcctccccagcgcggcgaaccgtctagcctccggaggccaggccgtgagtgcgggaggtatacgccaaggcggaagaattttgccactcactacctgtgtgacctcgggtaaattagccttggaacgtcagtttcttcgtctctataattgaaataataatagtacctctctcaggattgttgtgagccgtcagtgaaacacttagagcagtttctggcacatggtagaattgggctatttgctgaagcttcttggtggcccttgctagcccaggaagaaacttacattttgatttttttgtaccatggctttggttcacaaattgctgcgtggtacttattttctcagaaaattctctaagccaacttctgccttgtatccatttttgggtattcgctttgcagagtattccagtagtcttcagaaaccagtggcttctcctggcaaagcctcctcacagaggaagactgaaggggatttgcaaggagatcaccagaaagaagttgctttggatataacttcttctgaggagaagcctgatgttagtttcgataaagcaattagagatgaagcaatataccattttaggcttttgaaggatgaaattgtggatcattggagaggaccggaaggccaccctctgcatgaggtcttgctggaacaagccaaggttgtctggcaattccgggggaaagaagatttggataagtggacagtgacttctgataagacgattggaggcagaagtgaagtgtttttgaaaatgggcaagaataaccaaagtgcactgctatatggaactctgagctctgaggcgcctcaggacggggagtctacccgaagtgggtactgtgcaatgatatccaggattccaaggggtgcttttgagaggaagatgtcttacgattggtcccagttcaatactctgtatctccgtgtacgtggggatggtcggccttggatggtgaatatcaaggaggacacagatttcttccagaggacgaatcagatgtatagttacttcatgttcacccgcgggggaccctactggcaggaggtcaagattcctttttccaaatttttcttctctaatcgaggaagaatccgggatgttcagcatgagcttccgcttgataagatctcttctataggattcaccttggctgataaagtggatggtccattcttcctggagatagattttattggcgtgtttactgatccagctcatacagaagaatttgcctatgaaaattctccagagcttaacccaaggctttttaaataaagatcatatggtagttttgttttactaatctaagggtactagcatctacaatgatatagacaaaataaaatatttctttaatggcatccaaaaaaaaaatagtatgtattctctctc

SEQ ID NO: 300249 - DNA, 1266 bp, Homo sapiens
tgtttggcatcggaagggaaaagcagatggacctatacgggtaaagtggcttctgggcggaaggtacactataggctcggggaggtagaattgggctatttgctgaagcttcttggtggcccttgctagcccaggaagaaacttacattttgatttttttgtaccatggctttggttcacaaattgctgcgtggtacttattttctcagaaaattctctaagccaacttctgccttgtatccatttttgggtattcgctttgcagagtattccagtagtcttcagaaaccagtggcttctcctggcaaagcctcctcacagaggaagactgaaggggatttgcaaggagatcaccagaaagaagttgctttggatataacttcttctgaggagaagcctgatgttagtttcgataaagcaattagagatgaagcaatataccattttaggcttttgaaggatgaaattgtggatcattggagaggaccggaaggccaccctctgcatgaggtcttgctggaacaagccaaggttgtctggcaattccgggggaaagaagatttggataagtggacagtgacttctgataagacgattggaggcagaagtgaagtgtttttgaaaatgggcaagaataaccaaagtgcactgctatatggaactctgagctctgaggcgcctcaggacggggagtctacccgaagtgggtactgtgcaatgatatccaggattccaaggggtgcttttgagaggaagatgtcttacgattggtcccagttcaatactctgtatctccgtgtacgtggggatggtcggccttggatggtgaatatcaaggaggacacagatttcttccagaggacgaatcagatgtatagttacttcatgttcacccgcgggggaccctactggcaggaggtcaagattcctttttccaaatttttcttctctaatcgaggaagaatccgggatgttcagcatgagcttccgcttgataagatctcttctataggattcaccttggctgataaagtggatggtccattcttcctggagatagattttattggcgtgtttactgatccagctcatacagaagaatttgcctatgaaaattctccagagcttaacccaaggctttttaaataaagatcatatggtagttttgttttactaatctaagggtactagcatctacaatgatatagacaaaataaaatatttctttaatggcatccaaaaaaaaaatagtatgtattctctctc

SEQ ID NO: 300250 - DNA, 1235 bp, Homo sapiens
  misc_feature (32)..(32): n is a, c, g, or t
taggcatagctcgaggccgcgggcgaatcggncgaggctataggctcggggaggtagaattgggctatttgctgaagcttcttggtggcccttgctagcccaggaagaaacttacattttgatttttttgtaccatggctttggttcacaaattgctgcgtggtacttattttctcagaaaattctctaagccaacttctgccttgtatccatttttgggtattcgctttgcagagtattccagtagtcttcagaaaccagtggcttctcctggcaaagcctcctcacagaggaagactgaaggggatttgcaaggagatcaccagaaagaagttgctttggatataacttcttctgaggagaagcctgatgttagtttcgataaagcaattagagatgaagcaatataccattttaggcttttgaaggatgaaattgtggatcattggagaggaccggaaggccaccctctgcatgaggtcttgctggaacaagccaaggttgtctggcaattccgggggaaagaagatttggataagtggacagtgacttctgataagacgattggaggcagaagtgaagtgtttttgaaaatgggcaagaataaccaaagtgcactgctatatggaactctgagctctgaggcgcctcaggacggggagtctacccgaagtgggtactgtgcaatgatatccaggattccaaggggtgcttttgagaggaagatgtcttacgattggtcccagttcaatactctgtatctccgtgtacgtggggatggtcggccttggatggtgaatatcaaggaggacacagatttcttccagaggacgaatcagatgtatagttacttcatgttcacccgcgggggaccctactggcaggaggtcaagattcctttttccaaatttttcttctctaatcgaggaagaatccgggatgttcagcatgagcttccgcttgataagatctcttctataggattcaccttggctgataaagtggatggtccattcttcctggagatagattttattggcgtgtttactgatccagctcatacagaagaatttgcctatgaaaattctccagagcttaacccaaggctttttaaataaagatcatatggtagttttgttttactaatctaagggtactagcatctacaatgatatagacaaaataaaatatttctttaatggcatccaaaaaaaaaatagtatgtattctctctc

SEQ ID NO: 300251 - DNA, 1222 bp, Homo sapiens
tgtttggcatcggaagggaaaagcagatggacctatacgggtagaattgggctatttgctgaagcttcttggtggcccttgctagcccaggaagaaacttacattttgatttttttgtaccatggctttggttcacaaattgctgcgtggtacttattttctcagaaaattctctaagccaacttctgccttgtatccatttttgggtattcgctttgcagagtattccagtagtcttcagaaaccagtggcttctcctggcaaagcctcctcacagaggaagactgaaggggatttgcaaggagatcaccagaaagaagttgctttggatataacttcttctgaggagaagcctgatgttagtttcgataaagcaattagagatgaagcaatataccattttaggcttttgaaggatgaaattgtggatcattggagaggaccggaaggccaccctctgcatgaggtcttgctggaacaagccaaggttgtctggcaattccgggggaaagaagatttggataagtggacagtgacttctgataagacgattggaggcagaagtgaagtgtttttgaaaatgggcaagaataaccaaagtgcactgctatatggaactctgagctctgaggcgcctcaggacggggagtctacccgaagtgggtactgtgcaatgatatccaggattccaaggggtgcttttgagaggaagatgtcttacgattggtcccagttcaatactctgtatctccgtgtacgtggggatggtcggccttggatggtgaatatcaaggaggacacagatttcttccagaggacgaatcagatgtatagttacttcatgttcacccgcgggggaccctactggcaggaggtcaagattcctttttccaaatttttcttctctaatcgaggaagaatccgggatgttcagcatgagcttccgcttgataagatctcttctataggattcaccttggctgataaagtggatggtccattcttcctggagatagattttattggcgtgtttactgatccagctcatacagaagaatttgcctatgaaaattctccagagcttaacccaaggctttttaaataaagatcatatggtagttttgttttactaatctaagggtactagcatctacaatgatatagacaaaataaaatatttctttaatggcatccaaaaaaaaaatagtatgtattctctctc

SEQ ID NO: 300252 - DNA, 1453 bp, Homo sapiens
tgtttggcatcggaagggaaaagcagatggacctatacgggtaaagtggcttctgggcggaaggtacactataggctcggggaggtaagcggcggcaggccggcggttggtgtgtcccgggtgtggggaggcgacagagccctggcacttgagggttgagggggcctccccagcgcggcgaaccgtctagcctccggaggccaggccgtgagtgcgggaggtatacgccaaggcggaagaattttgccactcactacctgtgtgacctcgggtagaattgggctatttgctgaagcttcttggtggcccttgctagcccaggaagaaacttacattttgatttttttgtaccatggctttggttcacaaattgctgcgtggtacttattttctcagaaaattctctaagccaacttctgccttgtatccatttttgggtattcgctttgcagagtattccagtagtcttcagaaaccagtggcttctcctggcaaagcctcctcacagaggaagactgaaggggatttgcaaggagatcaccagaaagaagttgctttggatataacttcttctgaggagaagcctgatgttagtttcgataaagcaattagagatgaagcaatataccattttaggcttttgaaggatgaaattgtggatcattggagaggaccggaaggccaccctctgcatgaggtcttgctggaacaagccaaggttgtctggcaattccgggggaaagaagatttggataagtggacagtgacttctgataagacgattggaggcagaagtgaagtgtttttgaaaatgggcaagaataaccaaagtgcactgctatatggaactctgagctctgaggcgcctcaggacggggagtctacccgaagtgggtactgtgcaatgatatccaggattccaaggggtgcttttgagaggaagatgtcttacgattggtcccagttcaatactctgtatctccgtgtacgtggggatggtcggccttggatggtgaatatcaaggaggacacagatttcttccagaggacgaatcagatgtatagttacttcatgttcacccgcgggggaccctactggcaggaggtcaagattcctttttccaaatttttcttctctaatcgaggaagaatccgggatgttcagcatgagcttccgcttgataagatctcttctataggattcaccttggctgataaagtggatggtccattcttcctggagatagattttattggcgtgtttactgatccagctcatacagaagaatttgcctatgaaaattctccagagcttaacccaaggctttttaaataaagatcatatggtagttttgttttactaatctaagggtactagcatctacaatgatatagacaaaataaaatatttctttaatggcatccaaaaaaaaaatagtatgtattctctctc

SEQ ID NO: 300253 - DNA, 1581 bp, Homo sapiens
  misc_feature (375)..(375): n is a, c, g, or t
  misc_feature (391)..(392): n is a, c, g, or t
  misc_feature (394)..(394): n is a, c, g, or t
  misc_feature (396)..(396): n is a, c, g, or t
tgtttggcatcggaagggaaaagcagatggacctatacgggtaaagtggcttctgggcggaaggtacactataggctcggggaggtaagcggcggcaggccggcggttggtgtgtcccgggtgtggggaggcgacagagccctggcacttgagggttgagggggcctccccagcgcggcgaaccgtctagcctccggaggccaggccgtgagtgcgggaggtatacgccaaggcggaagaattttgccactcactacctgtgtgacctcgggtaaattagccttggaacgtcagtttcttcgtctctataattgaaataataataaataaaaacataaaaaaaaaaaaaaaagaaaaagaaaaaaaaaacaaaanaaaagaaagataatanngnanatggtagaattgggctatttgctgaagcttcttggtggcccttgctagcccaggaagaaacttacattttgatttttttgtaccatggctttggttcacaaattgctgcgtggtacttattttctcagaaaattctctaagccaacttctgccttgtatccatttttgggtattcgctttgcagagtattccagtagtcttcagaaaccagtggcttctcctggcaaagcctcctcacagaggaagactgaaggggatttgcaaggagatcaccagaaagaagttgctttggatataacttcttctgaggagaagcctgatgttagtttcgataaagcaattagagatgaagcaatataccattttaggcttttgaaggatgaaattgtggatcattggagaggaccggaaggccaccctctgcatgaggtcttgctggaacaagccaaggttgtctggcaattccgggggaaagaagatttggataagtggacagtgacttctgataagacgattggaggcagaagtgaagtgtttttgaaaatgggcaagaataaccaaagtgcactgctatatggaactctgagctctgaggcgcctcaggacggggagtctacccgaagtgggtactgtgcaatgatatccaggattccaaggggtgcttttgagaggaagatgtcttacgattggtcccagttcaatactctgtatctccgtgtacgtggggatggtcggccttggatggtgaatatcaaggaggacacagatttcttccagaggacgaatcagatgtatagttacttcatgttcacccgcgggggaccctactggcaggaggtcaagattcctttttccaaatttttcttctctaatcgaggaagaatccgggatgttcagcatgagcttccgcttgataagatctcttctataggattcaccttggctgataaagtggatggtccattcttcctggagatagattttattggcgtgtttactgatccagctcatacagaagaatttgcctatgaaaattctccagagcttaacccaaggctttttaaataaagatcatatggtagttttgttttactaatctaagggtactagcatctacaatgatatagacaaaataaaatatttctttaatggcatccaaaaaaaaaatagtatgtattctctctc

SEQ ID NO: 300254 - DNA, 708 bp, Homo sapiens
ggattacaggcgtgagccaccgcgcctggcacaaaaatactatttttaatatgtatcttctacacttttctagtcacacttttcccttccagtggtgttttataacatatatacagtattttcactgaactattgtttacaactttctcttcaaatatatttctacatcatttttaatgtctgcatgatattatataagtagacaacaattttggctgggtccagtggctcacatctgtaatcctagcactttgggaggctaaggcagtgaatcatttgaagctaggagtctaagacaagcctgagcaacatggcaaaaccctgtctctacaaaaatacaaaaattagcccagtgtggtggcatgtgcctttagtcccacctactcaggaggctgaggtgggaggattgcttgagcctgggaggtcaaggctgcagtgagctgagatcaccctactgcatgcacttcagcctgggtgacagagtaagaccctgtctcaaaaaaaaaaatttttttttcttaactggttcttcattatgtacatgtagatttagattgttttcagagttttctactgtcggaacaaactctgaggtaaacatccttaactattttcataggctatattcctagagataaaattactggaataactattaatatgtataattcatttttatttatgttcattaaaatttatttacttatt

SEQ ID NO: 300255 - DNA, 338 bp, Homo sapiens
cccagttataatcatcacctgatgggattttaaactcctggaataatctcagtacgtcactgtatgagattttaatcaatttctgtattttaaatttagatctcttctataggattcaccttggctgataaagtggatggtccattcttcctggagatagattttattggcgtgtttactgatccagctcatacagaagaatttgcctatgaaaattctccagagcttaacccaaggctttttaaataaagatcatatggtagttttgttttactaatctaagggtactagcatctacaatgatatagacaaaataaaatatttctttaatggcatcc

SEQ ID NO: 300256 - DNA, 344 bp, Homo sapiens
aaacaaataagttaacaaacttcaaaatacctgatttctgttgaatttgaaattgtgatgcattcattgctatgctgataattcttcaatgtctcttctgttataggtagaattgggctatttgctgaagcttcttggtggcccttgctagcccaggaagaaacttacattttgatttttttgtaccatggctttggttcacaaattgctgcgtggtacttattttctcagaaaattctctaagccaacttctgccttgtatccatttttgggtattcgctttgcagagtattccagtagtcttcagaaaccagtggcttctcctggcaaagcctcctcacaga

SEQ ID NO: 300257 - DNA, 2392 bp, Homo sapiens
atgcaaaaattagctgggtgtggtggcagcttcctgtaatcccagttactcaggaggctgaggcaggagaatcacttgaacccgtgaggcagaggctgcagtaagctgagatcgcaccgctgcacattccagcctgagtgacagagcaagactccatctagaaagaaagaaagaaaaagaaagaaagaaagaaagaaaggaaggaagggggagagagagagagacagagagagagagaaagaaagaaaggaaggaaggaaggaaggaaggagaggaaggaaggaaggaaggaaggaagaagagagagagagaaagaaagaaagagagaaagaaagaaggaaaagaaagaaggattccctagaagctcaatacatagaatagatgaaagggactagctgcctggggctgggggctcagctcagcatctcatccctctactactcttgacagtatacctcaatcctggggcatcataaagcatcacttgaaaagtagcaactcaacactctcacaggacaagggaaaggctcagagagggcaagcaatctgctcaaggtcacacattaagtttggatgaatgcatggctccctgcccagcactccatgccctgcaggaggggcaatgcccatctatctgtcaaccaggctgcagacctgacccacatgtccaggagcctgtatgctggccccctctacccttgagtgcccaggaggggatctcatacactctcaggctaacagagaggctgggctttatgctaagaccagaagaggatggaggtgtcctagtgtacattttaaggtcattttaagatatcatggaaagaagccagatttgaggcctgtcaatgctggggcaagttttaattccattctttattaagtcactagaccactctttctgctgtttttgtttttgtctttaatgaacatagtcatatgtgccttcctgggtgttctcatggaaggattggcaagaggaggtgttgagggctgtgcacaccctgcagtctccgtggctcaccaccacactgacgcaaggggctcagtgacccagacgtgtcagtacagtgagtgggcgtcttatgaagagctgtctggcatacggaggcgggcagcagaagccattcctgacgtggctttgatagttcatggaaataaaaagagcccatttctttctttctagatagactttctgtacacagaggcccccaacacagggatggtgaggtggggcaccacccagtcagactgtggctctgttggaccagaacaaatttgctgacaaaaccaggctataaatggggtttggcctaggccaggtcctggatacctctagatcatataagcaggctggcctagcaaacattggcaatgaagaaagagtggtaaagacaattattttaatcctagccattacatagaatggggaaacagtgactaggaaacaggccttttcttttcatttcaagtgtggatacttgagaaaggcaggtttcatcacagaaggtggaggtagatggaaactttcatgaacatcctaaaggtcacccaggcttctaggcacagggactataaagtccgtgatttctttattgcatcgtatttcccagcaagagttacttttcctttttattcgtacatgtgaatcacagcattactcataaacttatcaagcaagatgggaatcagcatttcacctgacacagcatttgccagtgacctgatctgggatctcccctcactgtcagtcacttgtccagggacatggaccccagaaccccacactctacagctcccaggcatttggtctaatggggcttggtctctctaaagagatctccatgatgtttttaatttgctattaatgtgctcctccttagctcctgttccctccttagctcctcaggaaagccaattgccttagggtgggtcacaattcgacggtcatttgtgtgactgagtggtgagtgaccgtctcccctactggactataagtgccttgagagcagccagcaggtttgtttctactctcggctggggctcagtagatgctccatagggaaataaaagggaacagttagaaacagaagaaaaaggccaggtgtggtggctcatgcctataatcccagcactttaggaggctgaggcaggcggatcatttgaggtcaggagttcaagaccagcccggccaacatggcaaaaatctcatcttgactaaaaatacaaaaatcagctgggcgtggtggcaggtgctgaaatcccagctacttgggaggctgaggcaggagaaatgcttgaacccaggagatggaggttgcagtgagccgagattgtgccactgaacttcagtctgggtgacagagcaaggctccagctccaaaaaaaaaaa

SEQ ID NO: 300258 - DNA, 3887 bp, Homo sapiens
  misc_feature (2555)..(2555): n is a, c, g, or t
gattacaggtgtaaatcaccacacctgggctgctttattttatagcacgtgaccctggaacgcaaaccctgatgcctgttccccaccacccgagcgctcctttctctgatatttggccccaagccgatgcatcacaggatgaatgaaatgaacctgagtccagtggggatggagcagctgacttcatcctctgtgagcaatgccttgccagtctcaggaagtcacctgggattggctgcctcacccactcacagtgccatccctgccccaggcctcccagtggcaattccaaacctgggtccctccctgagctctctgccttctgctctgtctttaatgctaccaatgggtattggggatcgaggggtgatgtgtgggttacctgaaagaaactacaccctacctccaccaccttaccctcacctggagagcagttatttcagaaccattctacctggcattttatcttatttagctgacagaccacctccacagtacatccaccctaactctataaatgttgatggtaatacagcattatctatcaccaataacccttcagcactagatccctatcagtccaatggaaatgttggattagaaccaggcattgtttcaatagactctcgctctgtgaacacacatggtgcccaaagtcttcatcccagtgatggccatgaggtggccttggacacagcaatcactatggagaacgtttctagggttaccagcccaatttcgacagatggaatggcagaggagcttacgatggacggtgttgcaggcgagcattcccaaatcccaaatggctccagaagtcatgaacctctgtctgtggattctgtgagcaacaaccttgcagcagacgctgtaggacatggtggtgtgatacccatgcatgggaatggcctggagctccctgtggtcatggagacagaccacattgcaagtcgggtcaatggcatgtctgacagtgccctcagtgactccattcacactgtggccatgagcaccaactctgtaagcgtggcactctctacctcacacaaccttgcctccctagaatctgtttccctccatgaagttggcctcagcctagaacctgtggctgtctcctccatcacccaggaggttgctatggggacaggtcatgtagatgtatcttcagacagtctttcttttgtatcaccttcactgcaaatggaagactccaattcaaacaaggagaacatggcaaccttgtttacaatttggtgtactctgtgtgaccgcgcctatccctcggactgtcccgaacatggaccagtgacttttgttcctgacactccaatagagagcagagcaaggctttctctcccaaagcagcttgttctccgtcagtcaattgtgggagcagaagttggtgtatggactggagaaaccattcctgtgcggacttgctttggacctctaattggccagcagagtcactccatggaagtagcagaatggacagacaaggcagttaaccatatctggaagatataccacaatggtgtcctagaattctgcatcattacaactgatgaaaatgaatgtaattggatgatgtttgtgcgcaaagccaggaaccgggaagagcagaatttggtggcttatcctcatgatggaaaaatctttttctgcacctcacaagatatccctcctgaaaatgaactgcttttttattatagccgagattatgctcaacagattggtgttcctgaacacccagatgtgcatctctgtaactgtggcaaggagtgcaattcttacacagagttcaaagcccatctgaccagccacatccataaccatcttcctacccagggacatagcggcagccatgggccaagtcacagcaaagaaaggaagtggaagtgctcaatgtgcccccaagcttttatctctccttccaaacttcatgtccactttatgggtcacatgggtatgaagccccacaagtgtgatttctgtagcaaggcttttagtgatcccagcaacctgcggacccacctcaagatacatacaggtcagaagaactacaggtgtaccttgtgtgacaagtctttcacccagaaggctcacctgggagtcccacatggttatccacactggggagaagaatcttaagtgtgattactgtgacaagttgtttatgcggaggcaggacctcaagcagcacgtgctcatccacactcaagaacgccagatcaagtgtcccaagtgtgataagctgttcttgagaacaaatcacttaaagaagcatctcaattctcatgaaggaaaacgggattatgtctgtgaaaaatgtacaaaggcttatctaaccaaataccatctcacccgccacctgaaaacctgcaaagggcccacctccagttcgtcagcaccagaggaggaagaagaggatgactcagaagaggaagatctagcagactctgtggggacagaagactgtaggattaacagtgctgtgtattcagcggatgagtctctttctgcacataaataaaaggaaaagaaacaagcaattntggatgaaaatgcaaatggaaaaatacacataaccagttatctactataatggtttttatataaaatggttcctgatttattttcagccagtaatcaaaacagactgggaatgaataaagcacttacagaagagtatcctaatgaaaacactttaaaacagattgggaaaactgagcatgtgtcctgttttaagtggtggactgggagggaagtgtcaacttctgaggtctttatttacatgataatctgggagatgcatttatgcctgaatcaaagctgccttctgctcaaacaaatcagatttatttcacattcttccattattccattttcctgctggtcctgtgacttggtaacattctaaacggtccttgccccatagccatcctgattgctgatagtgttttatgcagactcttgtgacttatactcaccacagaatggattgggacacagcagcataagtgtgctacttggcagctagtaagtttaaagcaggacctgccttaactgctcctggccacttggaagtttagggtagatcttgttttccaaagtttcggcaggtgcctggagggcaaataaaaaagcagcagtcagtcagtagtcagtgatggagagaacaagaggagagatgcctggcctctgcccaagaaattagctttgatggaagcctgagcaagtcacctggttattgtaacgtggagatctttgtaggtttagacatggctccctgtctccagtaaacatccagccattcagacaaagggggcctggagatacagagagcccaaataatgcctgctggattgtctcctgatgagtacatgtggactcacctgaggaagggaaggaagggaataatcttttatgtttcatttaccttatgaaaagtgttaaaacattgccaactcaaaataacattatttaatgcatgtgcaaagttaggtcttcccagttgtctcagtgctgaggaacctcatcagagaagcatggaagatgccaaaggatttttggaaggtaaagaaggctgaatagtgaccacatgggcctgttttcagggtcccagcttagttaagtcacccatgcacctggtcattgtgtctcccatgcacatccagcgtttctcagaagcagacccacccttaagttgacaggattgatggaacatgctctcctgctcaaggcacaacctctgggctggagtagaggactctggtgggaaggttttgctgctaatgtatttatggaatgaatgtatttcattcaaatctgtattcctctaggaaggattaaaattaaacttttttaaaatacaggaaaaacctctg

SEQ ID NO: 300259 - DNA, 411 bp, Homo sapiens
atgttcaatggggaaaaaagtcttaacaaatggggctgggcgcggtggctcatgcctataatcccagcactttgcaaggcagaggcaggcagatcacttgaggtccggagtttgagacaagcctggcctacatggtgaaaccctgtctctattaaaaatacaaaaattagccaggcatggtggcatgcaccagtaatcccagctactcaggaggctgaggcaggagaatcacttgaaccccagaggtggggggtgcagtgagctgagatcacaccactcactctagcctgggtgacagagtaagaccctgtctcacacaaaacaaaaacaaatggttcagggacaaatgaatcatcctcatgaaaaagaatgaagttggacccctacctcacaccatacacacaaaaaaaa

SEQ ID NO: 300260 - DNA, 306 bp, Homo sapiens
gattacaggtgtaaatcaccacacctgggctgctttattttatagcacgtgaccctggaacgcaaaccctgatgcctgttccccaccacccgagcgctcctttctctgatatttggccccaagccgatgcatcacaggtgagtagggaggtgggcttcagcactggtgacatcgttggaaactctggcgagtgagtgtccagggtcagtgccgttgtttttggtgccattgagaaggttacaggtgtgatttgcaaaggaaacaaatccagaaactagtgttgggtggaatgtaatctcatgcatc

SEQ ID NO: 300261 - DNA, 4135 bp, Homo sapiens
  misc_feature (2803)..(2803): n is a, c, g, or t
agaagggcgacgcggtgcgcgggcgccgcttgcgggccgcggcggggagggcgcacgcacgaggggcggagcggcgggcgctgagagtggctgaggatccggaaacgcgccgcagagggttgggcagcccccttcccgaagcttctggacggaaggccccaggtgttccccgagatgccccaacccgtggcggggtgcacggccaccggccctcgggagaagttgggcggccccgggcgaccccggggacgagtggccgcgtcggtgcagcggttgtgagcaagatgtggtagcacgtgaccctggaacgcaaaccctgatgcctgttccccaccacccgagcgctcctttctctgatatttggccccaagccgatgcatcacaggatgaatgaaatgaacctgagtccagtggggatggagcagctgacttcatcctctgtgagcaatgccttgccagtctcaggaagtcacctgggattggctgcctcacccactcacagtgccatccctgccccaggcctcccagtggcaattccaaacctgggtccctccctgagctctctgccttctgctctgtctttaatgctaccaatgggtattggggatcgaggggtgatgtgtgggttacctgaaagaaactacaccctacctccaccaccttaccctcacctggagagcagttatttcagaaccattctacctggcattttatcttatttagctgacagaccacctccacagtacatccaccctaactctataaatgttgatggtaatacagcattatctatcaccaataacccttcagcactagatccctatcagtccaatggaaatgttggattagaaccaggcattgtttcaatagactctcgctctgtgaacacacatggtgcccaaagtcttcatcccagtgatggccatgaggtggccttggacacagcaatcactatggagaacgtttctagggttaccagcccaatttcgacagatggaatggcagaggagcttacgatggacggtgttgcaggcgagcattcccaaatcccaaatggctccagaagtcatgaacctctgtctgtggattctgtgagcaacaaccttgcagcagacgctgtaggacatggtggtgtgatacccatgcatgggaatggcctggagctccctgtggtcatggagacagaccacattgcaagtcgggtcaatggcatgtctgacagtgccctcagtgactccattcacactgtggccatgagcaccaactctgtaagcgtggcactctctacctcacacaaccttgcctccctagaatctgtttccctccatgaagttggcctcagcctagaacctgtggctgtctcctccatcacccaggaggttgctatggggacaggtcatgtagatgtatcttcagacagtctttcttttgtatcaccttcactgcaaatggaagactccaattcaaacaaggagaacatggcaaccttgtttacaatttggtgtactctgtgtgaccgcgcctatccctcggactgtcccgaacatggaccagtgacttttgttcctgacactccaatagagagcagagcaaggctttctctcccaaagcagcttgttctccgtcagtcaattgtgggagcagaagttggtgtatggactggagaaaccattcctgtgcggacttgctttggacctctaattggccagcagagtcactccatggaagtagcagaatggacagacaaggcagttaaccatatctggaagatataccacaatggtgtcctagaattctgcatcattacaactgatgaaaatgaatgtaattggatgatgtttgtgcgcaaagccaggaaccgggaagagcagaatttggtggcttatcctcatgatggaaaaatctttttctgcacctcacaagatatccctcctgaaaatgaactgcttttttattatagccgagattatgctcaacagattggtgttcctgaacacccagatgtgcatctctgtaactgtggcaaggagtgcaattcttacacagagttcaaagcccatctgaccagccacatccataaccatcttcctacccagggacatagcggcagccatgggccaagtcacagcaaagaaaggaagtggaagtgctcaatgtgcccccaagcttttatctctccttccaaacttcatgtccactttatgggtcacatgggtatgaagccccacaagtgtgatttctgtagcaaggcttttagtgatcccagcaacctgcggacccacctcaagatacatacaggtcagaagaactacaggtgtaccttgtgtgacaagtctttcacccagaaggctcacctgggagtcccacatggttatccacactggggagaagaatcttaagtgtgattactgtgacaagttgtttatgcggaggcaggacctcaagcagcacgtgctcatccacactcaagaacgccagatcaagtgtcccaagtgtgataagctgttcttgagaacaaatcacttaaagaagcatctcaattctcatgaaggaaaacgggattatgtctgtgaaaaatgtacaaaggcttatctaaccaaataccatctcacccgccacctgaaaacctgcaaagggcccacctccagttcgtcagcaccagaggaggaagaagaggatgactcagaagaggaagatctagcagactctgtggggacagaagactgtaggattaacagtgctgtgtattcagcggatgagtctctttctgcacataaataaaaggaaaagaaacaagcaattntggatgaaaatgcaaatggaaaaatacacataaccagttatctactataatggtttttatataaaatggttcctgatttattttcagccagtaatcaaaacagactgggaatgaataaagcacttacagaagagtatcctaatgaaaacactttaaaacagattgggaaaactgagcatgtgtcctgttttaagtggtggactgggagggaagtgtcaacttctgaggtctttatttacatgataatctgggagatgcatttatgcctgaatcaaagctgccttctgctcaaacaaatcagatttatttcacattcttccattattccattttcctgctggtcctgtgacttggtaacattctaaacggtccttgccccatagccatcctgattgctgatagtgttttatgcagactcttgtgacttatactcaccacagaatggattgggacacagcagcataagtgtgctacttggcagctagtaagtttaaagcaggacctgccttaactgctcctggccacttggaagtttagggtagatcttgttttccaaagtttcggcaggtgcctggagggcaaataaaaaagcagcagtcagtcagtagtcagtgatggagagaacaagaggagagatgcctggcctctgcccaagaaattagctttgatggaagcctgagcaagtcacctggttattgtaacgtggagatctttgtaggtttagacatggctccctgtctccagtaaacatccagccattcagacaaagggggcctggagatacagagagcccaaataatgcctgctggattgtctcctgatgagtacatgtggactcacctgaggaagggaaggaagggaataatcttttatgtttcatttaccttatgaaaagtgttaaaacattgccaactcaaaataacattatttaatgcatgtgcaaagttaggtcttcccagttgtctcagtgctgaggaacctcatcagagaagcatggaagatgccaaaggatttttggaaggtaaagaaggctgaatagtgaccacatgggcctgttttcagggtcccagcttagttaagtcacccatgcacctggtcattgtgtctcccatgcacatccagcgtttctcagaagcagacccacccttaagttgacaggattgatggaacatgctctcctgctcaaggcacaacctctgggctggagtagaggactctggtgggaaggttttgctgctaatgtatttatggaatgaatgtatttcattcaaatctgtattcctctaggaaggattaaaattaaacttttttaaaatacaggaaaaacctctg

SEQ ID NO: 300262 - DNA, 4177 bp, Homo sapiens
  misc_feature (2845)..(2845): n is a, c, g, or t
agcggggcggggcgcggcggcccggcctgcgggccgcgggcgggctaatccacagcccttgggtggcggtgtcggcagcgcctggggctttcgggtagctgggatgggggctgcgaccttgttgtggttttggtgaccgctcttgtccccactcccccaggttgggcagcccccttcccgaagcttctggacggaaggccccaggtgttccccgagatgccccaacccgtggcggggtgcacggccaccggccctcgggagaagttgggcggccccgggcgaccccggggacgagtggccgcgtcggtgcagcggttgtgagcaagatgtggtagcacgtgaccctggaacgcaaaccctgatgcctgttccccaccacccgagcgctcctttctctgatatttggccccaagccgatgcatcacaggatgaatgaaatgaacctgagtccagtggggatggagcagctgacttcatcctctgtgagcaatgccttgccagtctcaggaagtcacctgggattggctgcctcacccactcacagtgccatccctgccccaggcctcccagtggcaattccaaacctgggtccctccctgagctctctgccttctgctctgtctttaatgctaccaatgggtattggggatcgaggggtgatgtgtgggttacctgaaagaaactacaccctacctccaccaccttaccctcacctggagagcagttatttcagaaccattctacctggcattttatcttatttagctgacagaccacctccacagtacatccaccctaactctataaatgttgatggtaatacagcattatctatcaccaataacccttcagcactagatccctatcagtccaatggaaatgttggattagaaccaggcattgtttcaatagactctcgctctgtgaacacacatggtgcccaaagtcttcatcccagtgatggccatgaggtggccttggacacagcaatcactatggagaacgtttctagggttaccagcccaatttcgacagatggaatggcagaggagcttacgatggacggtgttgcaggcgagcattcccaaatcccaaatggctccagaagtcatgaacctctgtctgtggattctgtgagcaacaaccttgcagcagacgctgtaggacatggtggtgtgatacccatgcatgggaatggcctggagctccctgtggtcatggagacagaccacattgcaagtcgggtcaatggcatgtctgacagtgccctcagtgactccattcacactgtggccatgagcaccaactctgtaagcgtggcactctctacctcacacaaccttgcctccctagaatctgtttccctccatgaagttggcctcagcctagaacctgtggctgtctcctccatcacccaggaggttgctatggggacaggtcatgtagatgtatcttcagacagtctttcttttgtatcaccttcactgcaaatggaagactccaattcaaacaaggagaacatggcaaccttgtttacaatttggtgtactctgtgtgaccgcgcctatccctcggactgtcccgaacatggaccagtgacttttgttcctgacactccaatagagagcagagcaaggctttctctcccaaagcagcttgttctccgtcagtcaattgtgggagcagaagttggtgtatggactggagaaaccattcctgtgcggacttgctttggacctctaattggccagcagagtcactccatggaagtagcagaatggacagacaaggcagttaaccatatctggaagatataccacaatggtgtcctagaattctgcatcattacaactgatgaaaatgaatgtaattggatgatgtttgtgcgcaaagccaggaaccgggaagagcagaatttggtggcttatcctcatgatggaaaaatctttttctgcacctcacaagatatccctcctgaaaatgaactgcttttttattatagccgagattatgctcaacagattggtgttcctgaacacccagatgtgcatctctgtaactgtggcaaggagtgcaattcttacacagagttcaaagcccatctgaccagccacatccataaccatcttcctacccagggacatagcggcagccatgggccaagtcacagcaaagaaaggaagtggaagtgctcaatgtgcccccaagcttttatctctccttccaaacttcatgtccactttatgggtcacatgggtatgaagccccacaagtgtgatttctgtagcaaggcttttagtgatcccagcaacctgcggacccacctcaagatacatacaggtcagaagaactacaggtgtaccttgtgtgacaagtctttcacccagaaggctcacctgggagtcccacatggttatccacactggggagaagaatcttaagtgtgattactgtgacaagttgtttatgcggaggcaggacctcaagcagcacgtgctcatccacactcaagaacgccagatcaagtgtcccaagtgtgataagctgttcttgagaacaaatcacttaaagaagcatctcaattctcatgaaggaaaacgggattatgtctgtgaaaaatgtacaaaggcttatctaaccaaataccatctcacccgccacctgaaaacctgcaaagggcccacctccagttcgtcagcaccagaggaggaagaagaggatgactcagaagaggaagatctagcagactctgtggggacagaagactgtaggattaacagtgctgtgtattcagcggatgagtctctttctgcacataaataaaaggaaaagaaacaagcaattntggatgaaaatgcaaatggaaaaatacacataaccagttatctactataatggtttttatataaaatggttcctgatttattttcagccagtaatcaaaacagactgggaatgaataaagcacttacagaagagtatcctaatgaaaacactttaaaacagattgggaaaactgagcatgtgtcctgttttaagtggtggactgggagggaagtgtcaacttctgaggtctttatttacatgataatctgggagatgcatttatgcctgaatcaaagctgccttctgctcaaacaaatcagatttatttcacattcttccattattccattttcctgctggtcctgtgacttggtaacattctaaacggtccttgccccatagccatcctgattgctgatagtgttttatgcagactcttgtgacttatactcaccacagaatggattgggacacagcagcataagtgtgctacttggcagctagtaagtttaaagcaggacctgccttaactgctcctggccacttggaagtttagggtagatcttgttttccaaagtttcggcaggtgcctggagggcaaataaaaaagcagcagtcagtcagtagtcagtgatggagagaacaagaggagagatgcctggcctctgcccaagaaattagctttgatggaagcctgagcaagtcacctggttattgtaacgtggagatctttgtaggtttagacatggctccctgtctccagtaaacatccagccattcagacaaagggggcctggagatacagagagcccaaataatgcctgctggattgtctcctgatgagtacatgtggactcacctgaggaagggaaggaagggaataatcttttatgtttcatttaccttatgaaaagtgttaaaacattgccaactcaaaataacattatttaatgcatgtgcaaagttaggtcttcccagttgtctcagtgctgaggaacctcatcagagaagcatggaagatgccaaaggatttttggaaggtaaagaaggctgaatagtgaccacatgggcctgttttcagggtcccagcttagttaagtcacccatgcacctggtcattgtgtctcccatgcacatccagcgtttctcagaagcagacccacccttaagttgacaggattgatggaacatgctctcctgctcaaggcacaacctctgggctggagtagaggactctggtgggaaggttttgctgctaatgtatttatggaatgaatgtatttcattcaaatctgtattcctctaggaaggattaaaattaaacttttttaaaatacaggaaaaacctctg

SEQ ID NO: 300263 - DNA, 4059 bp, Homo sapiens
agaagggcgacgcggtgcgcgggcgccgcttgcgggccgcggcggggagggcgcacgcacgaggggcggagcggcgggcgctgagagtggctgaggatccggaaacgcgccgcagagggttgggcagcccccttcccgaagcttctggacggaaggccccaggtgttccccgagatgccccaacccgtggcggggtgcacggccaccggccctcgggagaagttgggcggccccgggcgaccccggggacgagtggccgcgtcggtgcagcggttgtgagcaagatgtggtagcacgtgaccctggaacgcaaaccctgatgcctgttccccaccacccgagcgctcctttctctgatatttggccccaagccgatgcatcacaggatgaatgaaatgaacctgagtccagtggggatggagcagctgacttcatcctctgtgagcaatgccttgccagtctcaggaagtcacctgggattggctgcctcacccactcacagtgccatccctgccccaggcctcccagtggcaattccaaacctgggtccctccctgagctctctgccttctgctctgtctttaatgctaccaatgggtattggggatcgaggggtgatgtgtgggttacctgaaagaaactacaccctacctccaccaccttaccctcacctggagagcagttatttcagaaccattctacctggcattttatcttatttagctgacagaccacctccacagtacatccaccctaactctataaatgttgatggtaatacagcattatctatcaccaataacccttcagcactagatccctatcagtccaatggaaatgttggattagaaccaggcattgtttcaatagactctcgctctgtgaacacacatggtgcccaaagtcttcatcccagtgatggccatgaggtggccttggacacagcaatcactatggagaacgtttctagggttaccagcccaatttcgacagatggaatggcagaggagcttacgatggacggtgttgcaggcgagcattcccaaatcccaaatggctccagaagtcatgaacctctgtctgtggattctgtgagcaacaaccttgcagcagacgctgtaggacatggtggtgtgatacccatgcatgggaatggcctggagctccctgtggtcatggagacagaccacattgcaagtcgggtcaatggcatgtctgacagtgccctcagtgactccattcacactgtggccatgagcaccaactctgtaagcgtggcactctctacctcacacaaccttgcctccctagaatctgtttccctccatgaagttggcctcagcctagaacctgtggctgtctcctccatcacccaggaggttgctatggggacaggtcatgtagatgtatcttcagacagtctttcttttgtatcaccttcactgcaaatggaagactccaattcaaacaaggagaacatggcaaccttgtttacaatttggtgtactctgtgtgaccgcgcctatccctcggactgtcccgaacatggaccagtgacttttgttcctgacactccaatagagagcagagcaaggctttctctcccaaagcagcttgttctccgtcagtcaattgtgggagcagaagttggtgtatggactggagaaaccattcctgtgcggacttgctttggacctctaattggccagcagagtcactccatggaagtagcagaatggacagacaaggcagttaaccatatctggaagatataccacaatggtgtcctagaattctgcatcattacaactgatgaaaatgaatgtaattggatgatgtttgtgcgcaaagccaggaaccgggaagagcagaatttggtggcttatcctcatgatggaaaaatctttttctgcacctcacaagatatccctcctgaaaatgaactgcttttttattatagccgagattatgctcaacagattggtgttcctgaacacccagatgtgcatctctgtaactgtggcaaggagtgcaattcttacacagagttcaaagcccatctgaccagccacatccataaccatcttcctacccagggacatagcggcagccatgggccaagtcacagcaaagaaaggaagtggaagtgctcaatgtgcccccaagcttttatctctccttccaaacttcatgtccactttatgggtcacatgggtatgaagccccacaagtgtgatttctgtagcaaggcttttagtgatcccagcaacctgcggacccacctcaagatacatacaggtcagaagaactacaggtgtaccttgtgtgacaagtctttcacccagaaggctcacctgggagtcccacatggttatccacactggggagaagaatcttaagtgtgattactgtgacaagttgtttatgcggaggcaggacctcaagcagcacgtgctcatccacactcaagaacgccagatcaagtgtcccaagtgtgataagctgttcttgagaacaaatcacttaaagaagcatctcaattctcatgaaggaaaacgggattatgtctgtgaaaaatgtacaaaggcttatctaaccaaataccatctcacccgccacctgaaaacctgcaaagggcccacctccagttcgtcagcaccagaggaggaagaagaggatgactcagaagaggaagatctagcagactctgtggggacagaagactgtaggattaacagtgctgtgtattcagcggatgagtctctttctgcacataaataaaaggatataaaatggttcctgatttattttcagccagtaatcaaaacagactgggaatgaataaagcacttacagaagagtatcctaatgaaaacactttaaaacagattgggaaaactgagcatgtgtcctgttttaagtggtggactgggagggaagtgtcaacttctgaggtctttatttacatgataatctgggagatgcatttatgcctgaatcaaagctgccttctgctcaaacaaatcagatttatttcacattcttccattattccattttcctgctggtcctgtgacttggtaacattctaaacggtccttgccccatagccatcctgattgctgatagtgttttatgcagactcttgtgacttatactcaccacagaatggattgggacacagcagcataagtgtgctacttggcagctagtaagtttaaagcaggacctgccttaactgctcctggccacttggaagtttagggtagatcttgttttccaaagtttcggcaggtgcctggagggcaaataaaaaagcagcagtcagtcagtagtcagtgatggagagaacaagaggagagatgcctggcctctgcccaagaaattagctttgatggaagcctgagcaagtcacctggttattgtaacgtggagatctttgtaggtttagacatggctccctgtctccagtaaacatccagccattcagacaaagggggcctggagatacagagagcccaaataatgcctgctggattgtctcctgatgagtacatgtggactcacctgaggaagggaaggaagggaataatcttttatgtttcatttaccttatgaaaagtgttaaaacattgccaactcaaaataacattatttaatgcatgtgcaaagttaggtcttcccagttgtctcagtgctgaggaacctcatcagagaagcatggaagatgccaaaggatttttggaaggtaaagaaggctgaatagtgaccacatgggcctgttttcagggtcccagcttagttaagtcacccatgcacctggtcattgtgtctcccatgcacatccagcgtttctcagaagcagacccacccttaagttgacaggattgatggaacatgctctcctgctcaaggcacaacctctgggctggagtagaggactctggtgggaaggttttgctgctaatgtatttatggaatgaatgtatttcattcaaatctgtattcctctaggaaggattaaaattaaacttttttaaaatacaggaaaaacctctg

SEQ ID NO: 300264 - DNA, 2556 bp, Homo sapiens
  misc_feature (1224)..(1224): n is a, c, g, or t
gattctagaggaccccgggaatacctctaatcgattccaataacagactgtagtgtttttgactacaaaaggtcatcagctaatatgttgaagtaagaattctgtttctctacaactgccttctcatagataggacgggaaattacaaaaacattccagaggaaatagtaaatagttctgcctaagctttcatataggattttgcaatgggggaatgttgtacttagtacgcatttcaaaattaatgtgcttgatctattaaatgtgataactcaggaaccgggaagagcagaatttggtggcttatcctcatgatggaaaaatctttttctgcacctcacaagatatccctcctgaaaatgaactgcttttttattatagccgagattatgctcaacagattggtgttcctgaacacccagatgtgcatctctgtaactgtggcaaggagtgcaattcttacacagagttcaaagcccatctgaccagccacatccataaccatcttcctacccagggacatagcggcagccatgggccaagtcacagcaaagaaaggaagtggaagtgctcaatgtgcccccaagcttttatctctccttccaaacttcatgtccactttatgggtcacatgggtatgaagccccacaagtgtgatttctgtagcaaggcttttagtgatcccagcaacctgcggacccacctcaagatacatacaggtcagaagaactacaggtgtaccttgtgtgacaagtctttcacccagaaggctcacctgggagtcccacatggttatccacactggggagaagaatcttaagtgtgattactgtgacaagttgtttatgcggaggcaggacctcaagcagcacgtgctcatccacactcaagaacgccagatcaagtgtcccaagtgtgataagctgttcttgagaacaaatcacttaaagaagcatctcaattctcatgaaggaaaacgggattatgtctgtgaaaaatgtacaaaggcttatctaaccaaataccatctcacccgccacctgaaaacctgcaaagggcccacctccagttcgtcagcaccagaggaggaagaagaggatgactcagaagaggaagatctagcagactctgtggggacagaagactgtaggattaacagtgctgtgtattcagcggatgagtctctttctgcacataaataaaaggaaaagaaacaagcaattntggatgaaaatgcaaatggaaaaatacacataaccagttatctactataatggtttttatataaaatggttcctgatttattttcagccagtaatcaaaacagactgggaatgaataaagcacttacagaagagtatcctaatgaaaacactttaaaacagattgggaaaactgagcatgtgtcctgttttaagtggtggactgggagggaagtgtcaacttctgaggtctttatttacatgataatctgggagatgcatttatgcctgaatcaaagctgccttctgctcaaacaaatcagatttatttcacattcttccattattccattttcctgctggtcctgtgacttggtaacattctaaacggtccttgccccatagccatcctgattgctgatagtgttttatgcagactcttgtgacttatactcaccacagaatggattgggacacagcagcataagtgtgctacttggcagctagtaagtttaaagcaggacctgccttaactgctcctggccacttggaagtttagggtagatcttgttttccaaagtttcggcaggtgcctggagggcaaataaaaaagcagcagtcagtcagtagtcagtgatggagagaacaagaggagagatgcctggcctctgcccaagaaattagctttgatggaagcctgagcaagtcacctggttattgtaacgtggagatctttgtaggtttagacatggctccctgtctccagtaaacatccagccattcagacaaagggggcctggagatacagagagcccaaataatgcctgctggattgtctcctgatgagtacatgtggactcacctgaggaagggaaggaagggaataatcttttatgtttcatttaccttatgaaaagtgttaaaacattgccaactcaaaataacattatttaatgcatgtgcaaagttaggtcttcccagttgtctcagtgctgaggaacctcatcagagaagcatggaagatgccaaaggatttttggaaggtaaagaaggctgaatagtgaccacatgggcctgttttcagggtcccagcttagttaagtcacccatgcacctggtcattgtgtctcccatgcacatccagcgtttctcagaagcagacccacccttaagttgacaggattgatggaacatgctctcctgctcaaggcacaacctctgggctggagtagaggactctggtgggaaggttttgctgctaatgtatttatggaatgaatgtatttcattcaaatctgtattcctctaggaaggattaaaattaaacttttttaaaatacaggaaaaacctctg

SEQ ID NO: 300265 - DNA, 2533 bp, Homo sapiens
  misc_feature (1201)..(1201): n is a, c, g, or t
taaatcccacgtccagaagtagacagtagtgtgtaggagaatcagtaggtcatcagctaatatgttgaagtaagaattctgtttctctacaactgccttctcatagataggacgggaaattacaaaaacattccagaggaaatagtaaatagttctgcctaagctttcatataggattttgcaatgggggaatgttgtacttagtacgcatttcaaaattaatgtgcttgatctattaaatgtgataactcaggaaccgggaagagcagaatttggtggcttatcctcatgatggaaaaatctttttctgcacctcacaagatatccctcctgaaaatgaactgcttttttattatagccgagattatgctcaacagattggtgttcctgaacacccagatgtgcatctctgtaactgtggcaaggagtgcaattcttacacagagttcaaagcccatctgaccagccacatccataaccatcttcctacccagggacatagcggcagccatgggccaagtcacagcaaagaaaggaagtggaagtgctcaatgtgcccccaagcttttatctctccttccaaacttcatgtccactttatgggtcacatgggtatgaagccccacaagtgtgatttctgtagcaaggcttttagtgatcccagcaacctgcggacccacctcaagatacatacaggtcagaagaactacaggtgtaccttgtgtgacaagtctttcacccagaaggctcacctgggagtcccacatggttatccacactggggagaagaatcttaagtgtgattactgtgacaagttgtttatgcggaggcaggacctcaagcagcacgtgctcatccacactcaagaacgccagatcaagtgtcccaagtgtgataagctgttcttgagaacaaatcacttaaagaagcatctcaattctcatgaaggaaaacgggattatgtctgtgaaaaatgtacaaaggcttatctaaccaaataccatctcacccgccacctgaaaacctgcaaagggcccacctccagttcgtcagcaccagaggaggaagaagaggatgactcagaagaggaagatctagcagactctgtggggacagaagactgtaggattaacagtgctgtgtattcagcggatgagtctctttctgcacataaataaaaggaaaagaaacaagcaattntggatgaaaatgcaaatggaaaaatacacataaccagttatctactataatggtttttatataaaatggttcctgatttattttcagccagtaatcaaaacagactgggaatgaataaagcacttacagaagagtatcctaatgaaaacactttaaaacagattgggaaaactgagcatgtgtcctgttttaagtggtggactgggagggaagtgtcaacttctgaggtctttatttacatgataatctgggagatgcatttatgcctgaatcaaagctgccttctgctcaaacaaatcagatttatttcacattcttccattattccattttcctgctggtcctgtgacttggtaacattctaaacggtccttgccccatagccatcctgattgctgatagtgttttatgcagactcttgtgacttatactcaccacagaatggattgggacacagcagcataagtgtgctacttggcagctagtaagtttaaagcaggacctgccttaactgctcctggccacttggaagtttagggtagatcttgttttccaaagtttcggcaggtgcctggagggcaaataaaaaagcagcagtcagtcagtagtcagtgatggagagaacaagaggagagatgcctggcctctgcccaagaaattagctttgatggaagcctgagcaagtcacctggttattgtaacgtggagatctttgtaggtttagacatggctccctgtctccagtaaacatccagccattcagacaaagggggcctggagatacagagagcccaaataatgcctgctggattgtctcctgatgagtacatgtggactcacctgaggaagggaaggaagggaataatcttttatgtttcatttaccttatgaaaagtgttaaaacattgccaactcaaaataacattatttaatgcatgtgcaaagttaggtcttcccagttgtctcagtgctgaggaacctcatcagagaagcatggaagatgccaaaggatttttggaaggtaaagaaggctgaatagtgaccacatgggcctgttttcagggtcccagcttagttaagtcacccatgcacctggtcattgtgtctcccatgcacatccagcgtttctcagaagcagacccacccttaagttgacaggattgatggaacatgctctcctgctcaaggcacaacctctgggctggagtagaggactctggtgggaaggttttgctgctaatgtatttatggaatgaatgtatttcattcaaatctgtattcctctaggaaggattaaaattaaacttttttaaaatacaggaaaaacctctg

SEQ ID NO: 300266 - DNA, 2441 bp, Homo sapiens
  misc_feature (1109)..(1109): n is a, c, g, or t
tttatggagatggggtcttgctgtgttgcccaggctgatcttaaactcctggcctcaaatgatcatgccactttgggctctcaaagcactaagattgcaggcctgagccactgtgcctggcccatagtacattattttagatgcccttagtacattattttagttttataggaagtgggcaaattggaaatatggagagaaaggagaactggaagcaatgattgttaatatcaagaacaagttttaagattcaagtattgggagataatgagtaatttttttttaaaaggtgttcctgaacacccagatgtgcatctctgtaactgtggcaaggagtgcaattcttacacagagttcaaagcccatctgaccagccacatccataaccatcttcctacccagggacatagcggcagccatgggccaagtcacagcaaagaaaggaagtggaagtgctcaatgtgcccccaagcttttatctctccttccaaacttcatgtccactttatgggtcacatgggtatgaagccccacaagtgtgatttctgtagcaaggcttttagtgatcccagcaacctgcggacccacctcaagatacatacaggtcagaagaactacaggtgtaccttgtgtgacaagtctttcacccagaaggctcacctgggagtcccacatggttatccacactggggagaagaatcttaagtgtgattactgtgacaagttgtttatgcggaggcaggacctcaagcagcacgtgctcatccacactcaagaacgccagatcaagtgtcccaagtgtgataagctgttcttgagaacaaatcacttaaagaagcatctcaattctcatgaaggaaaacgggattatgtctgtgaaaaatgtacaaaggcttatctaaccaaataccatctcacccgccacctgaaaacctgcaaagggcccacctccagttcgtcagcaccagaggaggaagaagaggatgactcagaagaggaagatctagcagactctgtggggacagaagactgtaggattaacagtgctgtgtattcagcggatgagtctctttctgcacataaataaaaggaaaagaaacaagcaattntggatgaaaatgcaaatggaaaaatacacataaccagttatctactataatggtttttatataaaatggttcctgatttattttcagccagtaatcaaaacagactgggaatgaataaagcacttacagaagagtatcctaatgaaaacactttaaaacagattgggaaaactgagcatgtgtcctgttttaagtggtggactgggagggaagtgtcaacttctgaggtctttatttacatgataatctgggagatgcatttatgcctgaatcaaagctgccttctgctcaaacaaatcagatttatttcacattcttccattattccattttcctgctggtcctgtgacttggtaacattctaaacggtccttgccccatagccatcctgattgctgatagtgttttatgcagactcttgtgacttatactcaccacagaatggattgggacacagcagcataagtgtgctacttggcagctagtaagtttaaagcaggacctgccttaactgctcctggccacttggaagtttagggtagatcttgttttccaaagtttcggcaggtgcctggagggcaaataaaaaagcagcagtcagtcagtagtcagtgatggagagaacaagaggagagatgcctggcctctgcccaagaaattagctttgatggaagcctgagcaagtcacctggttattgtaacgtggagatctttgtaggtttagacatggctccctgtctccagtaaacatccagccattcagacaaagggggcctggagatacagagagcccaaataatgcctgctggattgtctcctgatgagtacatgtggactcacctgaggaagggaaggaagggaataatcttttatgtttcatttaccttatgaaaagtgttaaaacattgccaactcaaaataacattatttaatgcatgtgcaaagttaggtcttcccagttgtctcagtgctgaggaacctcatcagagaagcatggaagatgccaaaggatttttggaaggtaaagaaggctgaatagtgaccacatgggcctgttttcagggtcccagcttagttaagtcacccatgcacctggtcattgtgtctcccatgcacatccagcgtttctcagaagcagacccacccttaagttgacaggattgatggaacatgctctcctgctcaaggcacaacctctgggctggagtagaggactctggtgggaaggttttgctgctaatgtatttatggaatgaatgtatttcattcaaatctgtattcctctaggaaggattaaaattaaacttttttaaaatacaggaaaaacctctg

SEQ ID NO: 300267 - DNA, 2602 bp, Homo sapiens
agaagggcgacgcggtgcgcgggcgccgcttgcgggccgcggcggggagggcgcacgcacgaggggcggagcggcgggcgctgagagtggctgaggatccggaaacgcgccgcagagggttgggcagcccccttcccgaagcttctggacggaaggccccaggtgttccccgagatgccccaacccgtggcggggtgcacggccaccggccctcgggagaagttgggcggccccgggcgaccccggggacgagtggccgcgtcggtgcagcggttgtgagcaagatgtggtagcacgtgaccctggaacgcaaaccctgatgcctgttccccaccacccgagcgctcctttctctgatatttggccccaagccgatgcatcacaggatgaatgaaatgaacctgagtccagtggggatggagcagctgacttcatcctctgtgagcaatgccttgccagtctcaggaagtcacctgggattggctgcctcacccactcacagtgccatccctgccccaggcctcccagtggcaattccaaacctgggtccctccctgagctctctgccttctgctctgtctttaatgctaccaatgggtattggggatcgaggggtgatgtgtgggttacctgaaagaaactacaccctacctccaccaccttaccctcacctggagagcagttatttcagaaccattctacctggcattttatcttatttagctgacagaccacctccacagtacatccaccctaactctataaatgttgatggtaatacagcattatctatcaccaataacccttcagcactagatccctatcagtccaatggaaatgttggattagaaccaggcattgtttcaatagactctcgctctgtgaacacacatggtgcccaaagtcttcatcccagtgatggccatgaggtggccttggacacagcaatcactatggagaacgtttctagggttaccagcccaatttcgacagatggaatggcagaggagcttacgatggacggtgttgcaggcgagcattcccaaatcccaaatggctccagaagtcatgaacctctgtctgtggattctgtgagcaacaaccttgcagcagacgctgtaggacatggtggtgtgatacccatgcatgggaatggcctggagctccctgtggtcatggagacagaccacattgcaagtcgggtcaatggcatgtctgacagtgccctcagtgactccattcacactgtggccatgagcaccaactctgtaagcgtggcactctctacctcacacaaccttgcctccctagaatctgtttccctccatgaagttggcctcagcctagaacctgtggctgtctcctccatcacccaggaggttgctatggggacaggtcatgtagatgtatcttcagacagtctttcttttgtatcaccttcactgcaaatggaagactccaattcaaacaaggagaacatggcaaccttgtttacaatttggtgtactctgtgtgaccgcgcctatccctcggactgtcccgaacatggaccagtgacttttgttcctgacactccaatagagagcagagcaaggctttctctcccaaagcagcttgttctccgtcagtcaattgtgggagcagaagttggtgtatggactggagaaaccattcctgtgcggacttgctttggacctctaattggccagcagagtcactccatggaagtagcagaatggacagacaaggcagttaaccatatctggaagatataccacaatggtgtcctagaattctgcatcattacaactgatgaaaatgaatgtaattggatgatgtttgtgcgcaaagccaggaaccgggaagagcagaatttggtggcttatcctcatgatggaaaaatctttttctgcacctcacaagatatccctcctgaaaatgaactgcttttttattatagccgagattatgctcaacagattggtgttcctgaacacccagatgtgcatctctgtaactgtggcaaggagtgcaattcttacacagagttcaaagcccatctgaccagccacatccataaccatcttcctacccagggacatagcggcagccatgggccaagtcacagcaaagaaaggaagtggaagtgctcaatgtgcccccaagcttttatctctccttccaaacttcatgtccactttatgggtcacatgggtatgaagccccacaagtgtgatttctgtagcaaggcttttagtgatcccagcaacctgcggacccacctcaagatacatacaggtcagaagaactacaggtgtaccttgtgtgacaagtctttcacccagaaggctcacctgggagtcccacatggttatccacactggggagaagaatcttaagtgtgattactgtgacaagttgtttatgcggaggcaggacctcaagcagcacgtgctcatccacactcatcactctagcctgggtgacagagtaagaccctgtctcacacaaaacaaaaacaaatggttcagggacaaatgaatcatcctcatgaaaaagaatgaagttggacccctacctcacaccatacacacaaaaaaaa

SEQ ID NO: 300268 - DNA, 2499 bp, Homo sapiens
agaagggcgacgcggtgcgcgggcgccgcttgcgggccgcggcggggagggcgcacgcacgaggggcggagcggcgggcgctgagagtggctgaggatccggaaacgcgccgcagagggttgggcagcccccttcccgaagcttctggacggaaggccccaggtgttccccgagatgccccaacccgtggcggggtgcacggccaccggccctcgggagaagttgggcggccccgggcgaccccggggacgagtggccgcgtcggtgcagcggttgtgagcaagatgtggtagcacgtgaccctggaacgcaaaccctgatgcctgttccccaccacccgagcgctcctttctctgatatttggccccaagccgatgcatcacaggatgaatgaaatgaacctgagtccagtggggatggagcagctgacttcatcctctgtgagcaatgccttgccagtctcaggaagtcacctgggattggctgcctcacccactcacagtgccatccctgccccaggcctcccagtggcaattccaaacctgggtccctccctgagctctctgccttctgctctgtctttaatgctaccaatgggtattggggatcgaggggtgatgtgtgggttacctgaaagaaactacaccctacctccaccaccttaccctcacctggagagcagttatttcagaaccattctacctggcattttatcttatttagctgacagaccacctccacagtacatccaccctaactctataaatgttgatggtaatacagcattatctatcaccaataacccttcagcactagatccctatcagtccaatggaaatgttggattagaaccaggcattgtttcaatagactctcgctctgtgaacacacatggtgcccaaagtcttcatcccagtgatggccatgaggtggccttggacacagcaatcactatggagaacgtttctagggttaccagcccaatttcgacagatggaatggcagaggagcttacgatggacggtgttgcaggcgagcattcccaaatcccaaatggctccagaagtcatgaacctctgtctgtggattctgtgagcaacaaccttgcagcagacgctgtaggacatggtggtgtgatacccatgcatgggaatggcctggagctccctgtggtcatggagacagaccacattgcaagtcgggtcaatggcatgtctgacagtgccctcagtgactccattcacactgtggccatgagcaccaactctgtaagcgtggcactctctacctcacacaaccttgcctccctagaatctgtttccctccatgaagttggcctcagcctagaacctgtggctgtctcctccatcacccaggaggttgctatggggacaggtcatgtagatgtatcttcagacagtctttcttttgtatcaccttcactgcaaatggaagactccaattcaaacaaggagaacatggcaaccttgtttacaatttggtgtactctgtgtgaccgcgcctatccctcggactgtcccgaacatggaccagtgacttttgttcctgacactccaatagagagcagagcaaggctttctctcccaaagcagcttgttctccgtcagtcaattgtgggagcagaagttggtgtatggactggagaaaccattcctgtgcggacttgctttggacctctaattggccagcagagtcactccatggaagtagcagaatggacagacaaggcagttaaccatatctggaagatataccacaatggtgtcctagaattctgcatcattacaactgatgaaaatgaatgtaattggatgatgtttgtgcgcaaagccaggaaccgggaagagcagaatttggtggcttatcctcatgatggaaaaatctttttctgcacctcacaagatatccctcctgaaaatgaactgcttttttattatagccgagattatgctcaacagattggtgttcctgaacacccagatgtgcatctctgtaactgtggcaaggagtgcaattcttacacagagttcaaagcccatctgaccagccacatccataaccatcttcctacccagggacatagcggcagccatgggccaagtcacagcaaagaaaggaagtggaagtgctcaatgtgcccccaagcttttatctctccttccaaacttcatgtccactttatgggtcacatgggtatgaagccccacaagtgtgatttctgtagcaaggcttttagtgatcccagcaacctgcggacccacctcaagatacatacaggtcagaagaactacaggtgtaccttgtgtgacaagtctttcacccagaaggctcacctgggagtcccacatggttatccacactggggagaagaatcttaagtgtgattactgtgacaagttgtttatgcggaggcaggacctcaagcagcacgtgctcatccacactcaactcagtaagttaccctgcagccaagacgtc

SEQ ID NO: 300269 - DNA, 831 bp, Homo sapiens
taaatcccacgtccagaagtagacagtagtgtgtaggagaatcagtaggtcatcagctaatatgttgaagtaagaattctgtttctctacaactgccttctcatagataggacgggaaattacaaaaacattccagaggaaatagtaaatagttctgcctaagctttcatataggattttgcaatgggggaatgttgtacttagtacgcatttcaaaattaatgtgcttgatctattaaatgtgataactcaggaaccgggaagagcagaatttggtggcttatcctcatgatggaaaaatctttttctgcacctcacaagatatccctcctgaaaatgaactgcttttttattatagccgagattatgctcaacagattggtaagttaatatgtgtttataatgaatctggcttagtaaaaataccaaagaccaggattaaagttttggtaatgatttacatgttagctgaagcaaatcatatacctttgtttgtataaatgcaaactattacttgtatttgaggtgttaaaatctgtgagattcttcacaagctgaatgttattgaccaagcaataattcatatgatacggtcttttatggtaggactttggtttggggcattgaagttccttaggctacttttcgagctagcaccattgagatataaattcatgaaggacagcgaagtccctcggtttgatttaacctgcatatgctttctctttgctgtgctgtttcatgatgacagctaatgtttaagagtttgggtatgctataaaacctaaatattttgcttacaaaagaggccttataatccagtatttacca

SEQ ID NO: 300270 - DNA, 219 bp, Homo sapiens
agaagggcgacgcggtgcgcgggcgccgcttgcgggccgcggcggggagggcgcacgcacgaggggcggagcggcgggcgctgagagtggctgaggatccggaaacgcgccgcagagggtgcggcccagaggaggccgcgggccgggaagggccgggcgggacgggaaacgttagggcagcggcccccggggtgagggggccgagcggacgggcagggc

SEQ ID NO: 300271 - DNA, 300 bp, Homo sapiens
gattacaggtgtaaatcaccacacctgggctgctttattttatagcacgtgaccctggaacgcaaaccctgatgcctgttccccaccacccgagcgctcctttctctgatatttggccccaagccgatgcatcacaggatgaatgaaatgaacctgagtccagtggggatggagcagctgacttcatcctctgtgagcaatgccttgccagtctcaggaagtcacctgggattggctgcctcacccgtagctgtacgtcccccgtagctgtacctcacccgtagctgtacctcacccgta

SEQ ID NO: 300272 - DNA, 533 bp, Homo sapiens
cacatgggtatgaagccccacaagtgtgatttctgtagcaaggcttttagtgatcccagcaacctgcggacccacctcaagatacatacaggtaagttgtgttggcccatcagaatggaatttttgcaacaattagaaaatgcggtagtaaaggctttgtagagggattgtaggtggagttgagatttgatgtcagagaaagaaaccttcgtggtttaactgagattccttggaggctgtcacttccaattattaggatgttctgctttccaggtctccccaccatagttggaaggtgcctgggaaaatgcacttaataatcaggaagttgatcaatgtgtttggtcttaaatagaagcttctgagtctgagtctgagcctctcattagagctcaccccccagtcaccagccagagccagtttctctcctttaatattattgctcaataaatattgccacagtttattttttgagcttccattttctaaatcccatgcaaaccaacacctttcttttagtactttttaagaaa

SEQ ID NO: 300273 - DNA, 744 bp, Homo sapiens
tcatcgtttcgtctcccacgtggagtgacgatacgtgcggtcgccagccgccttcagggcacaaccatattaatttccctgacttctgtgctacatgacaacaaagaatttcccaacccagagatgtttgaccctcatcactttctggatgaaggtggcaattttaagaaaagtaaatacttcatgcctttctcagcaggaaaacggatttgtgtgggagaagccctggccggcatggagctgtttttattcctgacctccattttacagaactttaacctgaaatctctggttgacccaaagaaccttgacaccactccagttgtcaatggatttgcctctgtgccgcccttctaccagctgtgcttcattcctgtctgaagaagagcagatggcctggctgctgctgtgcagtccctgcagctctctttcctctggggcattatccatctttcactatctgtaatgccttttctcacctgtcatctcacattttcccttccctgaagatctagtgaacattcgacctccattacggagagtttcctatgtttcactgtgcaaatatatctgctattctccatactctgtaacagttgcattgactgtcacataatgctcatacttatctaatgttgagttattaatatgttattattaaatagagaaatatgatttgtgtattataattcaaaggcatttcttttctgcatgttctaaataaaaagcattattatttgctga

SEQ ID NO: 300274 - DNA, 805 bp, Homo sapiens
cgaattagcatggagtgttataaaaggcttggagtgcaagctcatggttgtcttaacaagaagagaaggcttcaatggattctcttgtggtccttgtgctctgtctctcatgtttgcttctcctttcactctggagacagagctctgggagaggaaaactccctcctggccccactcctctcccagtgattggaaatatcctacagataggtattaaggacatcagcaaatccttaaccaatgtaagtatgctccttcagtggcttgcaaaaggtaagtaaattcacctgtattttttaaataaagtgtatccctagaggtacatgttacaagaggtaatggtaaagtaaaatactttgaaaggcttttgttgccttttccagtctgtcagtgtcagaaatagtggaatgaaaccatgtattttgtgagtagagaaagatttgggtctttgcatgttagattcaaaataacaagtgtcaatagtttgaaaagctgtgttccttcttcatttcataaccatttgctataatttttggctgaaggtaaatggtaaggtattgtgggatctggtcagcagcccacaaagcaactgggctctctcttttttcccaggtggatcggcaggttgagaaataatagacacacaagatagtgaaagctgggtccaggggggtcaccgccttctggtcccatggtgccaagaatgcactggatataccagcatttattattaagtttagtgagggcaggggtaggttagtgagggatttagggtcatttgattatgaggtgagatggtcacatg

SEQ ID NO: 300275 - DNA, 1910 bp, Homo sapiens
cgaattagcatggagtgttataaaaggcttggagtgcaagctcatggttgtcttaacaagaagagaaggcttcaatggattctcttgtggtccttgtgctctgtctctcatgtttgcttctcctttcactctggagacagagctctgggagaggaaaactccctcctggccccactcctctcccagtgattggaaatatcctacagataggtattaaggacatcagcaaatccttaaccaatctctcaaaggtctatggccctgtgttcactctgtattttggcctgaaacccatagtggtgctgcatggatatgaagcagtgaaggaagccctgattgatcttggagaggagttttctggaagaggcattttcccactggctgaaagagctaacagaggatttggaattgttttcagcaatggaaagaaatggaaggagatccggcgtttctccctcatgacgctgcggaattttgggatggggaagaggagcattgaggaccgtgttcaagaggaagcccgctgccttgtggaggagttgagaaaaaccaaggcctcaccctgtgatcccactttcatcctgggctgtgctccctgcaatgtgatctgctccattattttccataaacgttttgattataaagatcagcaatttcttaacttaatggaaaagttgaatgaaaacatcaagattttgagcagcccctggatccagatctgcaataatttttctcctatcattgattacttcccgggaactcacaacaaattacttaaaaacgttgcttttatgaaaagttatattttggaaaaagtaaaagaacaccaagaatcaatggacatgaacaaccctcaggactttattgattgcttcctgatgaaaatggagaaggaaaagcacaaccaaccatctgaatttactattgaaagcttggaaaacactgcagttgacttgtttggagctgggacagagacgacaagcacaaccctgagatatgctctccttctcctgctgaagcacccagaggtcacagctaaagtccaggaagagattgaacgtgtgattggcagaaaccggagcccctgcatgcaagacaggagccacatgccctacacagatgctgtggtgcacgaggtccagagatacattgaccttctccccaccagcctgccccatgcagtgacctgtgacattaaattcagaaactatctcattcccaagggcacaaccatattaatttccctgacttctgtgctacatgacaacaaagaatttcccaacccagagatgtttgaccctcatcactttctggatgaaggtggcaattttaagaaaagtaaatacttcatgcctttctcagcaggaaaacggatttgtgtgggagaagccctggccggcatggagctgtttttattcctgacctccattttacagaactttaacctgaaatctctggttgacccaaagaaccttgacaccactccagttgtcaatggatttgcctctgtgccgcccttctaccagctgtgcttcattcctgtctgaagaagagcagatggcctggctgctgctgtgcagtccctgcagctctctttcctctggggcattatccatctttcactatctgtaatgccttttctcacctgtcatctcacattttcccttccctgaagatctagtgaacattcgacctccattacggagagtttcctatgtttcactgtgcaaatatatctgctattctccatactctgtaacagttgcattgactgtcacataatgctcatacttatctaatgttgagttattaatatgttattattaaatagagaaatatgatttgtgtattataattcaaaggcatttcttttctgcatgttctaaataaaaagcattattatttgctga

SEQ ID NO: 300276 - DNA, 1994 bp, Homo sapiens
  misc_feature (1923)..(1923): n is a, c, g, or t
  misc_feature (1930)..(1932): n is a, c, g, or t
  misc_feature (1938)..(1938): n is a, c, g, or t
  misc_feature (1940)..(1940): n is a, c, g, or t
cgaattagcatggagtgttataaaaggcttggagtgcaagctcatggttgtcttaacaagaagagaaggcttcaatggattctcttgtggtccttgtgctctgtctctcatgtttgcttctcctttcactctggagacagagctctgggagaggaaaactccctcctggccccactcctctcccagtgattggaaatatcctacagataggtattaaggacatcagcaaatccttaaccaatctctcaaaggtctatggccctgtgttcactctgtattttggcctgaaacccatagtggtgctgcatggatatgaagcagtgaaggaagccctgattgatcttggagaggagttttctggaagaggcattttcccactggctgaaagagctaacagaggatttggaattgttttcagcaatggaaagaaatggaaggagatccggcgtttctccctcatgacgctgcggaattttgggatggggaagaggagcattgaggaccgtgttcaagaggaagcccgctgccttgtggaggagttgagaaaaaccaaggcctcaccctgtgatcccactttcatcctgggctgtgctccctgcaatgtgatctgctccattattttccataaacgttttgattataaagatcagcaatttcttaacttaatggaaaagttgaatgaaaacatcaagattttgagcagcccctggatccagatctgcaataatttttctcctatcattgattacttcccgggaactcacaacaaattacttaaaaacgttgcttttatgaaaagttatattttggaaaaagtaaaagaacaccaagaatcaatggacatgaacaaccctcaggactttattgattgcttcctgatgaaaatggagaaggaaaagcacaaccaaccatctgaatttactattgaaagcttggaaaacactgcagttgacttgtttggagctgggacagagacgacaagcacaaccctgagatatgctctccttctcctgctgaagcacccagaggtcacagctaaagtccaggaagagattgaacgtgtgattggcagaaaccggagcccctgcatgcaagacaggagccacatgccctacacagatgctgtggtgcacgaggtccagagatacattgaccttctccccaccagcctgccccatgcagtgacctgtgacattaaattcagaaactatctcattcccaagggcacaaccatattaatttccctgacttctgtgctacatgacaacaaagaatttcccaacccagagatgtttgaccctcatcactttctggatgaaggtggcaattttaagaaaagtaaatacttcatgcctttctcagcaggaaaacggatttgtgtgggagaagccctggccggcatggagctgtttttattcctgacctccattttacagaactttaacctgaaatctctggttgacccaaagaaccttgacaccactccagttgtcaatggatttgcctctgtgccgcccttctaccagctgtgcttcattcctgtctgaagaagagcagatggcctggctgctgctgtgcagtccctgcagctctctttcctctggggcattatccatctttcactatctgtaatgccttttctcacctgtcatctcacattttcccttccctgaagatctagtgaacattcgacctccattacggagagtttcctatgtttcactgtgcaaatatatctgctattctccatactctgtaacagttgcattgactgtcacataatgctcatacttatctaatgttgagttattaatatgttattattaaatagagaaatatgatttgtgtattataattcaaaggcatttcttttctgcatgttctaaataaaaagcattattatttgctgaaaaaaaaaaaaanatggccnnnttggcntnacgtggagctttgctgcccgttcctttagtgaggcgtatccatgacccccttat

SEQ ID NO: 300277 - DNA, 1856 bp, Homo sapiens
cgaattagcatggagtgttataaaaggcttggagtgcaagctcatggttgtcttaacaagaagagaaggcttcaatggattctcttgtggtccttgtgctctgtctctcatgtttgcttctcctttcactctggagacagagctctgggagaggaagtattaaggacatcagcaaatccttaaccaatctctcaaaggtctatggccctgtgttcactctgtattttggcctgaaacccatagtggtgctgcatggatatgaagcagtgaaggaagccctgattgatcttggagaggagttttctggaagaggcattttcccactggctgaaagagctaacagaggatttggaattgttttcagcaatggaaagaaatggaaggagatccggcgtttctccctcatgacgctgcggaattttgggatggggaagaggagcattgaggaccgtgttcaagaggaagcccgctgccttgtggaggagttgagaaaaaccaaggcctcaccctgtgatcccactttcatcctgggctgtgctccctgcaatgtgatctgctccattattttccataaacgttttgattataaagatcagcaatttcttaacttaatggaaaagttgaatgaaaacatcaagattttgagcagcccctggatccagatctgcaataatttttctcctatcattgattacttcccgggaactcacaacaaattacttaaaaacgttgcttttatgaaaagttatattttggaaaaagtaaaagaacaccaagaatcaatggacatgaacaaccctcaggactttattgattgcttcctgatgaaaatggagaaggaaaagcacaaccaaccatctgaatttactattgaaagcttggaaaacactgcagttgacttgtttggagctgggacagagacgacaagcacaaccctgagatatgctctccttctcctgctgaagcacccagaggtcacagctaaagtccaggaagagattgaacgtgtgattggcagaaaccggagcccctgcatgcaagacaggagccacatgccctacacagatgctgtggtgcacgaggtccagagatacattgaccttctccccaccagcctgccccatgcagtgacctgtgacattaaattcagaaactatctcattcccaagggcacaaccatattaatttccctgacttctgtgctacatgacaacaaagaatttcccaacccagagatgtttgaccctcatcactttctggatgaaggtggcaattttaagaaaagtaaatacttcatgcctttctcagcaggaaaacggatttgtgtgggagaagccctggccggcatggagctgtttttattcctgacctccattttacagaactttaacctgaaatctctggttgacccaaagaaccttgacaccactccagttgtcaatggatttgcctctgtgccgcccttctaccagctgtgcttcattcctgtctgaagaagagcagatggcctggctgctgctgtgcagtccctgcagctctctttcctctggggcattatccatctttcactatctgtaatgccttttctcacctgtcatctcacattttcccttccctgaagatctagtgaacattcgacctccattacggagagtttcctatgtttcactgtgcaaatatatctgctattctccatactctgtaacagttgcattgactgtcacataatgctcatacttatctaatgttgagttattaatatgttattattaaatagagaaatatgatttgtgtattataattcaaaggcatttcttttctgcatgttctaaataaaaagcattattatttgctga

SEQ ID NO: 300278 - DNA, 2672 bp, Homo sapiens
gcttatggaaaagtaatgagtgattttagatcagtttggcacagacaaaaggagcttgttatgattatttctcaaaaggatagtaagaaggaggaataagctataaactctgttagggggttaagaattaaggtgatttgtataatcctatagccatctaattttaggagtactgctgtgaggactattgacctggcaattgcggcctctatgtgggcttttgggagtcctaggtggagtccatagagagatatttttagtataaatgctatgatgcatgctaatcataaaaggctattaaaccaggaaattgttagttcttgaagctgggtattggtcttaaggtagactcgaaagtgctgataaatttctcaagcatcagtgtttgaataagcggagtttcaaattttggtctgctgtacattagctgtgagacactggagacagagtcttactctgtagctcaggctggagtgcagtggtacaatcttggctcactgcaacctccatctcccaggtccccattcaagaaattctcctgcctcagtcccccaagtagctagcattacaggcatgcaccaccatgctcagctaatttttgtatttttagtagagacgtggtatcaccttgttggccaggctggtcttgaactcctgaccttgtgatccacctgccttggcctcccaaagtgttgggattacaggcaggagccaccacacctggccgtttgtttaaaatagagtaaatagacctgctgaatatgttgatgtgagtattaattgtaatctgcatagcaattgtctgaccattgccttgaacatcacaggccatctgagtggcaagtataatcatcatcatgtttctatttaaaattcagaaatatttgaagcctgtgtggctgaataaaagcatacaaatacaatgaaaatatcatgctaaatcaggcttagcaaatggacaaaatagtaacttcgtttgctgttatctctgtctactttcctagctctcaaaggtctatggccctgtgttcactctgtattttggcctgaaacccatagtggtgctgcatggatatgaagcagtgaaggaagccctgattgatcttggagaggagttttctggaagaggcattttcccactggctgaaagagctaacagaggatttggaattgttttcagcaatggaaagaaatggaaggagatccggcgtttctccctcatgacgctgcggaattttgggatggggaagaggagcattgaggaccgtgttcaagaggaagcccgctgccttgtggaggagttgagaaaaaccaaggcctcaccctgtgatcccactttcatcctgggctgtgctccctgcaatgtgatctgctccattattttccataaacgttttgattataaagatcagcaatttcttaacttaatggaaaagttgaatgaaaacatcaagattttgagcagcccctggatccagatctgcaataatttttctcctatcattgattacttcccgggaactcacaacaaattacttaaaaacgttgcttttatgaaaagttatattttggaaaaagtaaaagaacaccaagaatcaatggacatgaacaaccctcaggactttattgattgcttcctgatgaaaatggagaaggaaaagcacaaccaaccatctgaatttactattgaaagcttggaaaacactgcagttgacttgtttggagctgggacagagacgacaagcacaaccctgagatatgctctccttctcctgctgaagcacccagaggtcacagctaaagtccaggaagagattgaacgtgtgattggcagaaaccggagcccctgcatgcaagacaggagccacatgccctacacagatgctgtggtgcacgaggtccagagatacattgaccttctccccaccagcctgccccatgcagtgacctgtgacattaaattcagaaactatctcattcccaagggcacaaccatattaatttccctgacttctgtgctacatgacaacaaagaatttcccaacccagagatgtttgaccctcatcactttctggatgaaggtggcaattttaagaaaagtaaatacttcatgcctttctcagcaggaaaacggatttgtgtgggagaagccctggccggcatggagctgtttttattcctgacctccattttacagaactttaacctgaaatctctggttgacccaaagaaccttgacaccactccagttgtcaatggatttgcctctgtgccgcccttctaccagctgtgcttcattcctgtctgaagaagagcagatggcctggctgctgctgtgcagtccctgcagctctctttcctctggggcattatccatctttcactatctgtaatgccttttctcacctgtcatctcacattttcccttccctgaagatctagtgaacattcgacctccattacggagagtttcctatgtttcactgtgcaaatatatctgctattctccatactctgtaacagttgcattgactgtcacataatgctcatacttatctaatgttgagttattaatatgttattattaaatagagaaatatgatttgtgtattataattcaaaggcatttcttttctgcatgttctaaataaaaagcattattatttgctga

SEQ ID NO: 300279 - DNA, 2618 bp, Homo sapiens
gcttatggaaaagtaatgagtgattttagatcagtttggcacagacaaaaggagcttgttatgattatttctcaaaaggatagtaagaaggaggaataagctataaactctgttagggggttaagaattaaggtgatttgtataatcctatagccatctaattttaggagtactgctgtgaggactattgacctggcaattgcggcctctatgtgggcttttgggagtcctaggtggagtccatagagagatatttttagtataaatgctatgatgcatgctaatcataaaaggctattaaaccaggaaattgttagttcttgaagctgggtattggtcttaaggtagactcgaaagtgctgataaatttctcaagcatcagtgtttgaataagcggagtttcaaattttggtctgctgtacattagctgtgagacactggagacagagtcttactctgtagctcaggctggagtgcagtggtacaatcttggctcactgcaacctccatctcccaggtccccattcaagaaattctcctgcctcagtcccccaagtagctagcattacaggcatgcaccaccatgctcagctaatttttgtatttttagtagagacgtggtatcaccttgttggccaggctggtcttgaactcctgaccttgtgatccacctgccttggcctcccaaagtgttgggattacaggcaggagccaccacacctggccgtttgtttaaaatagagtaaatagacctgctgaatatgttgatgtgagtattaattgtaatctgcatagcaattgtctgaccattgccttgaacatcacaggccatctgagtggcaagtataatcatcatcatgtttctatttaaaattcagaaatatttgaagcctgtgtggctgaataaaaatagtaacttcgtttgctgttatctctgtctactttcctagctctcaaaggtctatggccctgtgttcactctgtattttggcctgaaacccatagtggtgctgcatggatatgaagcagtgaaggaagccctgattgatcttggagaggagttttctggaagaggcattttcccactggctgaaagagctaacagaggatttggaattgttttcagcaatggaaagaaatggaaggagatccggcgtttctccctcatgacgctgcggaattttgggatggggaagaggagcattgaggaccgtgttcaagaggaagcccgctgccttgtggaggagttgagaaaaaccaaggcctcaccctgtgatcccactttcatcctgggctgtgctccctgcaatgtgatctgctccattattttccataaacgttttgattataaagatcagcaatttcttaacttaatggaaaagttgaatgaaaacatcaagattttgagcagcccctggatccagatctgcaataatttttctcctatcattgattacttcccgggaactcacaacaaattacttaaaaacgttgcttttatgaaaagttatattttggaaaaagtaaaagaacaccaagaatcaatggacatgaacaaccctcaggactttattgattgcttcctgatgaaaatggagaaggaaaagcacaaccaaccatctgaatttactattgaaagcttggaaaacactgcagttgacttgtttggagctgggacagagacgacaagcacaaccctgagatatgctctccttctcctgctgaagcacccagaggtcacagctaaagtccaggaagagattgaacgtgtgattggcagaaaccggagcccctgcatgcaagacaggagccacatgccctacacagatgctgtggtgcacgaggtccagagatacattgaccttctccccaccagcctgccccatgcagtgacctgtgacattaaattcagaaactatctcattcccaagggcacaaccatattaatttccctgacttctgtgctacatgacaacaaagaatttcccaacccagagatgtttgaccctcatcactttctggatgaaggtggcaattttaagaaaagtaaatacttcatgcctttctcagcaggaaaacggatttgtgtgggagaagccctggccggcatggagctgtttttattcctgacctccattttacagaactttaacctgaaatctctggttgacccaaagaaccttgacaccactccagttgtcaatggatttgcctctgtgccgcccttctaccagctgtgcttcattcctgtctgaagaagagcagatggcctggctgctgctgtgcagtccctgcagctctctttcctctggggcattatccatctttcactatctgtaatgccttttctcacctgtcatctcacattttcccttccctgaagatctagtgaacattcgacctccattacggagagtttcctatgtttcactgtgcaaatatatctgctattctccatactctgtaacagttgcattgactgtcacataatgctcatacttatctaatgttgagttattaatatgttattattaaatagagaaatatgatttgtgtattataattcaaaggcatttcttttctgcatgttctaaataaaaagcattattatttgctga

SEQ ID NO: 300280 - DNA, 1812 bp, Homo sapiens
cgaattagcatggagtgttataaaaggcttggagtgcaagctcatggttgtcttaacaagaagagaaggcttcaatggattctcttgtggtccttgtgctctgtctctcatgtttgcttctcctttcactctggagacagagctctgggagaggaagtattaaggacatcagcaaatccttaaccaatctctcaaaggtctatggccctgtgttcactctgtattttggcctgaaacccatagtggtgctgcatggatatgaagcagtgaaggaagccctgattgatcttggagaggagttttctggaagaggcattttcccactggctgaaagagctaacagaggatttggaattgttttcagcaatggaaagaaatggaaggagatccggcgtttctccctcatgacgctgcggaattttgggatggggaagaggagcattgaggaccgtgttcaagaggaagcccgctgccttgtggaggagttgagaaaaaccaaggaatgtgatctgctccattattttccataaacgttttgattataaagatcagcaatttcttaacttaatggaaaagttgaatgaaaacatcaagattttgagcagcccctggatccagatctgcaataatttttctcctatcattgattacttcccgggaactcacaacaaattacttaaaaacgttgcttttatgaaaagttatattttggaaaaagtaaaagaacaccaagaatcaatggacatgaacaaccctcaggactttattgattgcttcctgatgaaaatggagaaggaaaagcacaaccaaccatctgaatttactattgaaagcttggaaaacactgcagttgacttgtttggagctgggacagagacgacaagcacaaccctgagatatgctctccttctcctgctgaagcacccagaggtcacagctaaagtccaggaagagattgaacgtgtgattggcagaaaccggagcccctgcatgcaagacaggagccacatgccctacacagatgctgtggtgcacgaggtccagagatacattgaccttctccccaccagcctgccccatgcagtgacctgtgacattaaattcagaaactatctcattcccaagggcacaaccatattaatttccctgacttctgtgctacatgacaacaaagaatttcccaacccagagatgtttgaccctcatcactttctggatgaaggtggcaattttaagaaaagtaaatacttcatgcctttctcagcaggaaaacggatttgtgtgggagaagccctggccggcatggagctgtttttattcctgacctccattttacagaactttaacctgaaatctctggttgacccaaagaaccttgacaccactccagttgtcaatggatttgcctctgtgccgcccttctaccagctgtgcttcattcctgtctgaagaagagcagatggcctggctgctgctgtgcagtccctgcagctctctttcctctggggcattatccatctttcactatctgtaatgccttttctcacctgtcatctcacattttcccttccctgaagatctagtgaacattcgacctccattacggagagtttcctatgtttcactgtgcaaatatatctgctattctccatactctgtaacagttgcattgactgtcacataatgctcatacttatctaatgttgagttattaatatgttattattaaatagagaaatatgatttgtgtattataattcaaaggcatttcttttctgcatgttctaaataaaaagcattattatttgctga

SEQ ID NO: 300281 - DNA, 1866 bp, Homo sapiens
cgaattagcatggagtgttataaaaggcttggagtgcaagctcatggttgtcttaacaagaagagaaggcttcaatggattctcttgtggtccttgtgctctgtctctcatgtttgcttctcctttcactctggagacagagctctgggagaggaaaactccctcctggccccactcctctcccagtgattggaaatatcctacagataggtattaaggacatcagcaaatccttaaccaatctctcaaaggtctatggccctgtgttcactctgtattttggcctgaaacccatagtggtgctgcatggatatgaagcagtgaaggaagccctgattgatcttggagaggagttttctggaagaggcattttcccactggctgaaagagctaacagaggatttggaattgttttcagcaatggaaagaaatggaaggagatccggcgtttctccctcatgacgctgcggaattttgggatggggaagaggagcattgaggaccgtgttcaagaggaagcccgctgccttgtggaggagttgagaaaaaccaaggaatgtgatctgctccattattttccataaacgttttgattataaagatcagcaatttcttaacttaatggaaaagttgaatgaaaacatcaagattttgagcagcccctggatccagatctgcaataatttttctcctatcattgattacttcccgggaactcacaacaaattacttaaaaacgttgcttttatgaaaagttatattttggaaaaagtaaaagaacaccaagaatcaatggacatgaacaaccctcaggactttattgattgcttcctgatgaaaatggagaaggaaaagcacaaccaaccatctgaatttactattgaaagcttggaaaacactgcagttgacttgtttggagctgggacagagacgacaagcacaaccctgagatatgctctccttctcctgctgaagcacccagaggtcacagctaaagtccaggaagagattgaacgtgtgattggcagaaaccggagcccctgcatgcaagacaggagccacatgccctacacagatgctgtggtgcacgaggtccagagatacattgaccttctccccaccagcctgccccatgcagtgacctgtgacattaaattcagaaactatctcattcccaagggcacaaccatattaatttccctgacttctgtgctacatgacaacaaagaatttcccaacccagagatgtttgaccctcatcactttctggatgaaggtggcaattttaagaaaagtaaatacttcatgcctttctcagcaggaaaacggatttgtgtgggagaagccctggccggcatggagctgtttttattcctgacctccattttacagaactttaacctgaaatctctggttgacccaaagaaccttgacaccactccagttgtcaatggatttgcctctgtgccgcccttctaccagctgtgcttcattcctgtctgaagaagagcagatggcctggctgctgctgtgcagtccctgcagctctctttcctctggggcattatccatctttcactatctgtaatgccttttctcacctgtcatctcacattttcccttccctgaagatctagtgaacattcgacctccattacggagagtttcctatgtttcactgtgcaaatatatctgctattctccatactctgtaacagttgcattgactgtcacataatgctcatacttatctaatgttgagttattaatatgttattattaaatagagaaatatgatttgtgtattataattcaaaggcatttcttttctgcatgttctaaataaaaagcattattatttgctga

SEQ ID NO: 300282 - DNA, 1856 bp, Homo sapiens
cgaattagcatggagtgttataaaaggcttggagtgcaagctcatggttgtcttaacaagaagagaaggcttcaatggattctcttgtggtccttgtgctctgtctctcatgtttgcttctcctttcactctggagacagagctctgggagaggaaaactccctcctggccccactcctctcccagtgattggaaatatcctacagataggtattaaggacatcagcaaatccttaaccaatctctcaaaggtctatggccctgtgttcactctgtattttggcctgaaacccatagtggtgctgcatggatatgaagcagtgaaggaagccctgattgatcttggagaggagttttctggaagaggcattttcccactggctgaaagagctaacagaggatttggaattgttttcagcaatggaaagaaatggaaggagatccggcgtttctccctcatgacgctgcggaattttgggatggggaagaggagcattgaggaccgtgttcaagaggaagcccgctgccttgtggaggagttgagaaaaaccaaggcctcaccctgtgatcccactttcatcctgggctgtgctccctgcaatgtgatctgctccattattttccataaacgttttgattataaagatcagcaatttcttaacttaatggaaaagttgaatgctatcattgattacttcccgggaactcacaacaaattacttaaaaacgttgcttttatgaaaagttatattttggaaaaagtaaaagaacaccaagaatcaatggacatgaacaaccctcaggactttattgattgcttcctgatgaaaatggagaaggaaaagcacaaccaaccatctgaatttactattgaaagcttggaaaacactgcagttgacttgtttggagctgggacagagacgacaagcacaaccctgagatatgctctccttctcctgctgaagcacccagaggtcacagctaaagtccaggaagagattgaacgtgtgattggcagaaaccggagcccctgcatgcaagacaggagccacatgccctacacagatgctgtggtgcacgaggtccagagatacattgaccttctccccaccagcctgccccatgcagtgacctgtgacattaaattcagaaactatctcattcccaagggcacaaccatattaatttccctgacttctgtgctacatgacaacaaagaatttcccaacccagagatgtttgaccctcatcactttctggatgaaggtggcaattttaagaaaagtaaatacttcatgcctttctcagcaggaaaacggatttgtgtgggagaagccctggccggcatggagctgtttttattcctgacctccattttacagaactttaacctgaaatctctggttgacccaaagaaccttgacaccactccagttgtcaatggatttgcctctgtgccgcccttctaccagctgtgcttcattcctgtctgaagaagagcagatggcctggctgctgctgtgcagtccctgcagctctctttcctctggggcattatccatctttcactatctgtaatgccttttctcacctgtcatctcacattttcccttccctgaagatctagtgaacattcgacctccattacggagagtttcctatgtttcactgtgcaaatatatctgctattctccatactctgtaacagttgcattgactgtcacataatgctcatacttatctaatgttgagttattaatatgttattattaaatagagaaatatgatttgtgtattataattcaaaggcatttcttttctgcatgttctaaataaaaagcattattatttgctga

SEQ ID NO: 300283 - DNA, 2505 bp, Homo sapiens
cgaattagcatggagtgttataaaaggcttggagtgcaagctcatggttgtcttaacaagaagagaaggcttcaatggattctcttgtggtccttgtgctctgtctctcatgtttgcttctcctttcactctggagacagagctctgggagaggaagtattaaggacatcagcaaatccttaaccaatctctcaaaggtctatggccctgtgttcactctgtattttggcctgaaacccatagtggtgctgcatggatatgaagcagtgaaggaagccctgattgatcttggagaggagttttctggaagaggcattttcccactggctgaaagagctaacagaggatttggaattgttttcagcaatggaaagaaatggaaggagatccggcgtttctccctcatgacgctgcggaattttgggatggggaagaggagcattgaggaccgtgttcaagaggaagcccgctgccttgtggaggagttgagaaaaaccaaggcctcaccctgtgatcccactttcatcctgggctgtgctccctgcaatgtgatctgctccattattttccataaacgttttgattataaagatcagcaatttcttaacttaatggaaaagttgaatgaaaacatcaagattttgagcagcccctggatccagatctgcaataatttttctcctatcattgattacttcccgggaactcacaacaaattacttaaaaacgttgcttttatgaaaagttatattttggaaaaagtaaaagaacaccaagaatcaatggacatgaacaaccctcaggactttattgattgcttcctgatgaaaatggagaaggaaaagcacaaccaaccatctgaatttactattgaaagcttggaaaacactgcagttgacttgtttggagctgggacagagacgacaagcacaaccctgagatatgctctccttctcctgctgaagcacccagaggtcacagctaaagtccaggaagagattgaacgtgtgattggcagaaaccggagcccctgcatgcaagacaggagccacatgccctacacagatgctgtggtgcacgaggtccagagatacattgaccttctccccaccagcctgccccatgcagtgacctgtgacattaaattcagaaactatctcattcccaagggcacaaccatattaatttccctgacttctgtgctacatgacaacaaagaatttcccaacccagagatgtttgaccctcatcactttctggatgaaggtggcaattttaagaaaagtaaatacttcatgcctttctcagcaggaaaacggatttgtgtgggagaagccctggccggcatggagctgtttttattcctgacctccattttacagaactttaacctgaaatctctggttgacccaaagaaccttgacaccactccagttgtcaatggatttgcctctgtgccgcccttctaccagctgtgcttcattcctgtctgaagaagagcagatggcctggctgctgctgtgcagtccctgcagctctctttcctctggggcattatccatctttcactatctgtaatgccttttctcacctgtcatctcacattttcccttccctgaagatctagtgaacattcgacctccattacggagagtttcctatgtttcactgtgcaaatatatctgctattctccatactctgtaacagttgcattgactgtcacataatgctcatacttatctaatgttgagttattaatatgttattattaaatagagaaatatgatttgtgtattataattcaaaggcatttcttttctgcatgttctaaataaaaagcattattatttgctgatgagtcagtttattagaccttccttcttttatgcataatgtaggtcagaaattaaagaaaatagagttccaggaggccatgctggttctcgtgagtgttagagttacttgaggattggatttgaaagtgagaaactgtgtccaggggcagctctaacctctagggaaatattcagaggatcagtcaaagggtggaatggacattaaatgctagaattcttatatccacattggtgttcctttttttttgagacaaagtcttgctctgtcacccaggctggagtgcagtggtgtgatctcagctctctataacctccgcctcccaggttcaagtgattctcctgcctcagcctcctgagtagctgggattacaggtgcatgccaccacacctggctaattttttgtatttttagtacagacgggttttcaccgtgttagccaggatggtcttaatctcctgaccttgtgatctgcctgcctcagcctcccaaagtgctgggattacaggtgtgagccactgcgcctggcctggtgttactttgaagtgtcattactttatctctaaataaagaatcagattacttttattacttcatgtttccaacttagaatgatgtaatgaagtataaatacatgctttcatatcgct

SEQ ID NO: 300284 - DNA, 1796 bp, Homo sapiens
cgaattagcatggagtgttataaaaggcttggagtgcaagctcatggttgtcttaacaagaagagaaggcttcaatggattctcttgtggtccttgtgctctgtctctcatgtttgcttctcctttcactctggagacagagctctgggagaggaagtattaaggacatcagcaaatccttaaccaatctctcaaaggtctatggccctgtgttcactctgtattttggcctgaaacccatagtggtgctgcatggatatgaagcagtgaaggaagccctgattgatcttggagaggagttttctggaagaggcattttcccactggctgaaagagctaacagaggatttggaattgttttcagcaatggaaagaaatggaaggagatccggcgtttctccctcatgacgctgcggaattttgggatggggaagaggagcattgaggaccgtgttcaagaggaagcccgctgccttgtggaggagttgagaaaaaccaaggcctcaccctgtgatcccactttcatcctgggctgtgctccctgcaatgtgatctgctccattattttccataaacgttttgattataaagatcagcaatttcttaacttaatggaaaagttgaatgaaaacatcaagattttgagcagcccctggatccagatctgcaataatttttctcctatcattgattacttcccgggaactcacaacaaattacttaaaaacgttgcttttatgaaaagttatattttggaaaaagtaaaagaacaccaagaatcaatggacatgaacaaccctcaggactttattgattgcttcctgatgaaaatggagaaggaaaagcacaaccaaccatctgaatttactattgaaagcttggaaaacactgcagttgacttgtttggagctgggacagagacgacaagcacaaccctgagatatgctctccttctcctgctgaagcacccagaggtcacagctaaagtccaggaagagattgaacgtgtgattggcagaaaccggagcccctgcatgcaagacaggagccacatgccctacacagatgctgtggtgcacgaggtccagagatacattgaccttctccccaccagcctgccccatgcagtgacctgtgacattaaattcagaaactatctcattcccaagggcacaaccatattaatttccctgacttctgtgctacatgacaacaaagaatttcccaacccagagatgtttgaccctcatcactttctggatgaaggtggcaattttaagaaaagtaaatacttcatgcctttctcagcaggaaaacggatttgtgtgggagaagccctggccggcatggagctgtttttattcctgacctccattttacagaactttaacctgaaatctctggttgacccaaagaaccttgacaccactccagttgtcaatggatttgcctctgtgccgcccttctaccagctgtgcttcattcctgtctgaagaagagcagatggcctggctgctgctgtgcagtccctgcagctctctttcctctggggcattatccatctttcactatctgtaatgccttttctcacctgtcatctcacattttcccttccctgaagatctagtgaacattcgacctccattacggagagtttcctatgtttcactgtgcaaatatatctgctttgagttattaatatgttattattaaatagagaaatatgatttgtgtattataattcaaaggcatttcttttctgcatgttctaaataaaaagcattattatttgctga

SEQ ID NO: 300285 - DNA, 1802 bp, Homo sapiens
cgaattagcatggagtgttataaaaggcttggagtgcaagctcatggttgtcttaacaagaagagaaggcttcaatggattctcttgtggtccttgtgctctgtctctcatgtttgcttctcctttcactctggagacagagctctgggagaggaagtattaaggacatcagcaaatccttaaccaatctctcaaaggtctatggccctgtgttcactctgtattttggcctgaaacccatagtggtgctgcatggatatgaagcagtgaaggaagccctgattgatcttggagaggagttttctggaagaggcattttcccactggctgaaagagctaacagaggatttggaattgttttcagcaatggaaagaaatggaaggagatccggcgtttctccctcatgacgctgcggaattttgggatggggaagaggagcattgaggaccgtgttcaagaggaagcccgctgccttgtggaggagttgagaaaaaccaaggcctcaccctgtgatcccactttcatcctgggctgtgctccctgcaatgtgatctgctccattattttccataaacgttttgattataaagatcagcaatttcttaacttaatggaaaagttgaatgaaaacatcaagattttgagcagcccctggatccagatctgcaataatttttctcctatcattgattacttcccgggaactcacaacaaattacttaaaaacgttgcttttatgaaaagttatattttggaaaaagtaaaagaacaccaagaatcaatggacatgaacaaccctcaggactttattgattgcttcctgatgaaaatggagaaggaaaagcacaaccaaccatctgaatttactattgaaagcttggtgagatatgctctccttctcctgctgaagcacccagaggtcacagctaaagtccaggaagagattgaacgtgtgattggcagaaaccggagcccctgcatgcaagacaggagccacatgccctacacagatgctgtggtgcacgaggtccagagatacattgaccttctccccaccagcctgccccatgcagtgacctgtgacattaaattcagaaactatctcattcccaagggcacaaccatattaatttccctgacttctgtgctacatgacaacaaagaatttcccaacccagagatgtttgaccctcatcactttctggatgaaggtggcaattttaagaaaagtaaatacttcatgcctttctcagcaggaaaacggatttgtgtgggagaagccctggccggcatggagctgtttttattcctgacctccattttacagaactttaacctgaaatctctggttgacccaaagaaccttgacaccactccagttgtcaatggatttgcctctgtgccgcccttctaccagctgtgcttcattcctgtctgaagaagagcagatggcctggctgctgctgtgcagtccctgcagctctctttcctctggggcattatccatctttcactatctgtaatgccttttctcacctgtcatctcacattttcccttccctgaagatctagtgaacattcgacctccattacggagagtttcctatgtttcactgtgcaaatatatctgctattctccatactctgtaacagttgcattgactgtcacataatgctcatacttatctaatgttgagttattaatatgttattattaaatagagaaatatgatttgtgtattataattcaaaggcatttcttttctgcatgttctaaataaaaagcattattatttgctga

SEQ ID NO: 300286 - DNA, 1667 bp, Homo sapiens
cgaattagcatggagtgttataaaaggcttggagtgcaagctcatggttgtcttaacaagaagagaaggcttcaatggattctcttgtggtccttgtgctctgtctctcatgtttgcttctcctttcactctggagacagagctctgggagaggaaaactccctcctggccccactcctctcccagtgattggaaatatcctacagataggtattaaggacatcagcaaatccttaaccaatctctcaaaggtctatggccctgtgttcactctgtattttggcctgaaacccatagtggtgctgcatggatatgaagcagtgaaggaagccctgattgatcttggagaggagttttctggaagaggcattttcccactggctgaaagagctaacagaggatttggaattgttttcagcaatggaaagaaatggaaggagatccggcgtttctccctcatgacgctgcggaattttgggatggggaagaggagcattgaggaccgtgttcaagaggaagcccgctgccttgtggaggagttgagaaaaaccaaggcctcaccctgtgatcccactttcatcctgggctgtgctccctgcaatgtgatctgctccattattttccataaacgttttgattataaagatcagcaatttcttaacttaatggaaaagttgaatgaaaacatcaagattttgagcagcccctggatccagatctgcaataatttttctcctatcattgattacttcccgggaactcacaacaaattacttaaaaacgttgcttttatgaaaagttatattttggaaaaagtaaaagaacaccaagaatcaatggacatgaacaaccctcaggactttattgattgcttcctgatgaaaatggagaaggaaaagcacaaccaaccatctgaatttactattgaaagcttggaaaacactgcagttgacttgtttggagctgggacagagacgacaagcacaaccctgagatatgctctccttctcctgctgaagcacccagaggtcacagctaaagtccaggaagagattgaacgtgtgattggcagaaaccggagcccctgcatgcaagacaggagccacatgccctacacagatgctgtggtgcacgaggtccagagatacattgaccttctccccaccagcctgccccatgcagtgacctgtgacattaaattcagaaactatctcattcccaagggcacaaccatattaatttccctgacttctgtgctacatgacaacaaagaatttcccaacccagagatgtttgaccctcatcactttctggatgaaggtggcaattttaagaaaagtaaatacttcatgcctttctcagcaggaaaacggatttgtgtgggagaagccctggccggcatggagctgtttttattcctgacctccattttacagaactttaacctgaaatctctggttgacccaaagaaccttgacaccactccagttgtcaatggatttgcctctgtgccgcccttctaccagctgtgcttcattcctgtctgaagaagagcagatggcctggctgctgctgtgcagtccctgcagctctctttcctctggggcattatccatctttgctacattacagaaatggagatgctgctgagatgagaaagggaattc

SEQ ID NO: 300287 - DNA, 2397 bp, Homo sapiens
cgaattagcatggagtgttataaaaggcttggagtgcaagctcatggttgtcttaacaagaagagaaggcttcaatggattctcttgtggtccttgtgctctgtctctcatgtttgcttctcctttcactctggagacagagctctgggagaggaagtattaaggacatcagcaaatccttaaccaatctctcaaaggtctatggccctgtgttcactctgtattttggcctgaaacccatagtggtgctgcatggatatgaagcagtgaaggaagccctgattgatcttggagaggagttttctggaagaggcattttcccactggctgaaagagctaacagaggatttggaattgttttcagcaatggaaagaaatggaaggagatccggcgtttctccctcatgacgctgcggaattttgggatggggaagaggagcattgaggaccgtgttcaagaggaagcccgctgccttgtggaggagttgagaaaaaccaaggcctcaccctgtgatcccactttcatcctgggctgtgctccctgcaatgtgatctgctccattattttccataaacgttttgattataaagatcagcaatttcttaacttaatggaaaagttgaatgaaaacatcaagattttgagcagcccctggatccagatctgcaataatttttctcctatcattgattacttcccgggaactcacaacaaattacttaaaaacgttgcttttatgaaaagttatattttggaaaaagtaaaagaacaccaagaatcaatggacatgaacaaccctcaggactttattgattgcttcctgatgaaaatggagaaggaaaagcacaaccaaccatctgaatttactattgaaagcttggtgagatatgctctccttctcctgctgaagcacccagaggtcacagctaaagtccaggaagagattgaacgtgtgattggcagaaaccggagcccctgcatgcaagacaggagccacatgccctacacagatgctgtggtgcacgaggtccagagatacattgaccttctccccaccagcctgccccatgcagtgacctgtgacattaaattcagaaactatctcattcccaagggcacaaccatattaatttccctgacttctgtgctacatgacaacaaagaatttcccaacccagagatgtttgaccctcatcactttctggatgaaggtggcaattttaagaaaagtaaatacttcatgcctttctcagcagtgacctccattttacagaactttaacctgaaatctctggttgacccaaagaaccttgacaccactccagttgtcaatggatttgcctctgtgccgcccttctaccagctgtgcttcattcctgtctgaagaagagcagatggcctggctgctgctgtgcagtccctgcagctctctttcctctggggcattatccatctttcactatctgtaatgccttttctcacctgtcatctcacattttcccttccctgaagatctagtgaacattcgacctccattacggagagtttcctatgtttcactgtgcaaatatatctgctattctccatactctgtaacagttgcattgactgtcacataatgctcatacttatctaatgttgagttattaatatgttattattaaatagagaaatatgatttgtgtattataattcaaaggcatttcttttctgcatgttctaaataaaaagcattattatttgctgatgagtcagtttattagaccttccttcttttatgcataatgtaggtcagaaattaaagaaaatagagttccaggaggccatgctggttctcgtgagtgttagagttacttgaggattggatttgaaagtgagaaactgtgtccaggggcagctctaacctctagggaaatattcagaggatcagtcaaagggtggaatggacattaaatgctagaattcttatatccacattggtgttcctttttttttgagacaaagtcttgctctgtcacccaggctggagtgcagtggtgtgatctcagctctctataacctccgcctcccaggttcaagtgattctcctgcctcagcctcctgagtagctgggattacaggtgcatgccaccacacctggctaattttttgtatttttagtacagacgggttttcaccgtgttagccaggatggtcttaatctcctgaccttgtgatctgcctgcctcagcctcccaaagtgctgggattacaggtgtgagccactgcgcctggcctggtgttactttgaagtgtcattactttatctctaaataaagaatcagattacttttattacttcatgtttccaacttagaatgatgtaatgaagtataaatacatgctttcatatcgct

SEQ ID NO: 300288 - DNA, 2451 bp, Homo sapiens
cgaattagcatggagtgttataaaaggcttggagtgcaagctcatggttgtcttaacaagaagagaaggcttcaatggattctcttgtggtccttgtgctctgtctctcatgtttgcttctcctttcactctggagacagagctctgggagaggaagtattaaggacatcagcaaatccttaaccaatctctcaaaggtctatggccctgtgttcactctgtattttggcctgaaacccatagtggtgctgcatggatatgaagcagtgaaggaagccctgattgatcttggagaggagttttctggaagaggcattttcccactggctgaaagagctaacagaggatttggaattgttttcagcaatggaaagaaatggaaggagatccggcgtttctccctcatgacgctgcggaattttgggatggggaagaggagcattgaggaccgtgttcaagaggaagcccgctgccttgtggaggagttgagaaaaaccaaggcctcaccctgtgatcccactttcatcctgggctgtgctccctgcaatgtgatctgctccattattttccataaacgttttgattataaagatcagcaatttcttaacttaatggaaaagttgaatgaaaacatcaagattttgagcagcccctggatccagatctgcaataatttttctcctatcattgattacttcccgggaactcacaacaaattacttaaaaacgttgcttttatgaaaagttatattttggaaaaagtaaaagaacaccaagaatcaatggacatgaacaaccctcaggactttattgattgcttcctgatgaaaatggagaaggaaaagcacaaccaaccatctgaatttactattgaaagcttggaaaacactgcagttgacttgtttggagctgggacagagacgacaagcacaaccctgagatatgctctccttctcctgctgaagcacccagaggtcacagctaaagtccaggaagagattgaacgtgtgattggcagaaaccggagcccctgcatgcaagacaggagccacatgccctacacagatgctgtggtgcacgaggtccagagatacattgaccttctccccaccagcctgccccatgcagtgacctgtgacattaaattcagaaactatctcattcccaagggcacaaccatattaatttccctgacttctgtgctacatgacaacaaagaatttcccaacccagagatgtttgaccctcatcactttctggatgaaggtggcaattttaagaaaagtaaatacttcatgcctttctcagcagtgacctccattttacagaactttaacctgaaatctctggttgacccaaagaaccttgacaccactccagttgtcaatggatttgcctctgtgccgcccttctaccagctgtgcttcattcctgtctgaagaagagcagatggcctggctgctgctgtgcagtccctgcagctctctttcctctggggcattatccatctttcactatctgtaatgccttttctcacctgtcatctcacattttcccttccctgaagatctagtgaacattcgacctccattacggagagtttcctatgtttcactgtgcaaatatatctgctattctccatactctgtaacagttgcattgactgtcacataatgctcatacttatctaatgttgagttattaatatgttattattaaatagagaaatatgatttgtgtattataattcaaaggcatttcttttctgcatgttctaaataaaaagcattattatttgctgatgagtcagtttattagaccttccttcttttatgcataatgtaggtcagaaattaaagaaaatagagttccaggaggccatgctggttctcgtgagtgttagagttacttgaggattggatttgaaagtgagaaactgtgtccaggggcagctctaacctctagggaaatattcagaggatcagtcaaagggtggaatggacattaaatgctagaattcttatatccacattggtgttcctttttttttgagacaaagtcttgctctgtcacccaggctggagtgcagtggtgtgatctcagctctctataacctccgcctcccaggttcaagtgattctcctgcctcagcctcctgagtagctgggattacaggtgcatgccaccacacctggctaattttttgtatttttagtacagacgggttttcaccgtgttagccaggatggtcttaatctcctgaccttgtgatctgcctgcctcagcctcccaaagtgctgggattacaggtgtgagccactgcgcctggcctggtgttactttgaagtgtcattactttatctctaaataaagaatcagattacttttattacttcatgtttccaacttagaatgatgtaatgaagtataaatacatgctttcatatcgct

SEQ ID NO: 300289 - DNA, 1585 bp, Homo sapiens
cgaattagcatggagtgttataaaaggcttggagtgcaagctcatggttgtcttaacaagaagagaaggcttcaatggattctcttgtggtccttgtgctctgtctctcatgtttgcttctcctttcactctggagacagagctctgggagaggaaaactccctcctggccccactcctctcccagtgattggaaatatcctacagataggtattaaggacatcagcaaatccttaaccaatctctcaaaggtctatggccctgtgttcactctgtattttggcctgaaacccatagtggtgctgcatggatatgaagcagtgaaggaagccctgattgatcttggagaggagttttctggaagaggcattttcccactggctgaaagagctaacagaggatttggaattgttttcagcaatggaaagaaatggaaggagatccggcgtttctccctcatgacgctgcggaattttgggatggggaagaggagcattgaggaccgtgttcaagaggaagcccgctgccttgtggaggagttgagaaaaaccaagggggtgggtgaccctactccatatcactgaccttactggactactatcttctctactgacattcttggaaacatttcaggggtggccatatctttcattatgagtcctggttgttagctcatgtgaagcgggggtttgaagctgagagccaagggaatttgcacatatttgtgctgtgtgtgtacaggcatgattgtgcgtacagtgtgggtataaaaggttcatttaatcccatgttctcctgaactttgcttttttgctttcaaataagaaatgatgaatatagattttgagttcattttttgaaagagttaaagagcagtgtttttcccattacctattccagaacatgtcaccagagaatacttgacaagtcaacatggtgggaatggccctatcatacccatatggagcatgaaccaaatggcatgtgcttttatttaattggactgtgtttgtatggtcagcctcactgacttctctggggtttcttttaggcccgtgcttgccattctggccagtaatgacattctacagtttttattgcttaggcatatcttagtgcagttctcatcaattattatttctctgtaaacacagcattattttaaaaatagtattaattatttcttgttactgtattgatttatatattttcagtaaatacatcctgtagcataattctgtgaaatacccaaatgtcaatttataaaatgatttatttaacaagattttacttattagtaatagctctgtaatctgcattccctatgtatgatttggctctgtttcagttttgcttatctctttccaaccatatttatgaaattttggcttagaaatttatgttaattattttttttccatggccaactctactcatctatgaagttttacaatgaatctgtttatcagcttggataccaaattaccttggttttaaattctgttttcccaatgaagttaaagactgaaaatcagatttatctgtgaatgacacacacaaactaacagatttccaactgttcaat

SEQ ID NO: 300290 - DNA, 1149 bp, Homo sapiens
cgaattagcatggagtgttataaaaggcttggagtgcaagctcatggttgtcttaacaagaagagaaggcttcaatggattctcttgtggtccttgtgctctgtctctcatgtttgcttctcctttcactctggagacagagctctgggagaggaagtattaaggacatcagcaaatccttaaccaatctctcaaaggtctatggccctgtgttcactctgtattttggcctgaaacccatagtggtgctgcatggatatgaagcagtgaaggaagccctgattgatcttggagaggagttttctggaagaggcattttcccactggctgaaagagctaacagaggatttggaattgttttcagcaatggaaagaaatggaaggagatccggcgtttctccctcatgacgctgcggaattttgggatggggaagaggagcattgaggaccgtgttcaagaggaagcccgctgccttgtggaggagttgagaaaaaccaaggcctcaccctgtgatcccactttcatcctgggctgtgctccctgcaatgtgatctgctccattattttccataaacgttttgattataaagatcagcaatttcttaacttaatggaaaagttgaatgaaaacatcaagattttgagcagcccctggatccagatctgcaataatttttctcctatcattgattacttcccgggaactcacaacaaattacttaaaaacgttgcttttatgaaaagttatattttggaaaaagtaaaagaacaccaagaatcaatggacatgaacaaccctcaggactttattgattgcttcctgatgaaaatggagaaggtaaaatgtaaacaaaagcttagttatgtgactgcttgtgaatttgtgatttgttgactagttctgtgtttactaaggatgtttaactggtcaatcagtaatgcttgagaagcactttaagtttttattgtatgaatgaataacaaaatagaccactagctagactaataaagaagaaaaaagagaagaatcaaatagacacaataaaaatgataaaggggagatcaccactagcccacagaaatataaatacatcagagaatagtataaacacctctatgctaataaactagaaaatctagaagaaatg

SEQ ID NO: 300291 - DNA, 1531 bp, Homo sapiens
cgaattagcatggagtgttataaaaggcttggagtgcaagctcatggttgtcttaacaagaagagaaggcttcaatggattctcttgtggtccttgtgctctgtctctcatgtttgcttctcctttcactctggagacagagctctgggagaggaaaactccctcctggccccactcctctcccagtgattggaaatatcctacagataggtattaaggacatcagcaaatccttaaccaatctctcaaaggtctatggccctgtgttcactctgtattttggcctgaaacccatagtggtgctgcatggatatgaagcagtgaaggaagccctgattgatcttggagaggagttttctggaagaggcattttcccactggctgaaagagctaacagaggatttggaattgttttcagcaatggaaagaaatggaaggagatccggcgtttctccctcatgacgctgcggaattttgggatggggaagaggagcattgaggaccgtgttcaagaggaagcccgctgccttgtggaggagttgagaaaaaccaagggggtgggtgaccctactccatatcactgaccttactggactactatcttctctactgacattcttggaaacatttcaggggtggccatatctttcattatgagtcctggttgttagctcatgtgaagcgggggtttgaagctgagagccaagggaatttgcacatatttgtgctgtgtgtgtacaggcatgattgtgcgtacagtgtgggtataaaaggttcatttaatcccatgttctcctgaactttgcttttttgctttcaaataagaaatgatgaatatagattttgagttcattttttgaaagagttaaagagcagtgtttttcccattacctattccagaacatgtcaccagagaatacttgacaagtcaacatggtgggaatggccctatcatacccatatggagcatgaaccaaatggcatgtgcttttatttaattggactgtgtttgtatggtcagcctcactgacttctctggggtttcttttaggcccgtgcttgccattctggccagtaatgacattctacagtttttattgcttaggcatatcttagtgcagttctcatcaattattatttctctgtaaacacagcattattttaaaaatagtattaattatttcttgttactgtattgatttatatattttcagtaaatacatcctgtagcataattctgtgaaatacccaaatgtcaatttatttccctatgtatgatttggctctgtttcagttttgcttatctctttccaaccatatttatgaaattttggcttagaaatttatgttaattattttttttccatggccaactctactcatctatgaagttttacaatgaatctgtttatcagcttggataccaaattaccttggttttaaattctgttttcccaatgaagttaaagactgaaaatcagatttatctgtgaatgacacacacaaactaacagatttccaactgttcaat

SEQ ID NO: 300292 - DNA, 1652 bp, Homo sapiens
  misc_feature (1637)..(1637): n is a, c, g, or t
gaacatgacggcgccctgggtggccctcgccctcctctggggatcgctgtggcccggctctgggcgtggggaggctgagacacgggagtgcatctactacaacgccaactgggagctggagcgcaccaaccagagcggcctggagcgctgcgaaggcgagcaggacaagcggctgcactgctacgcctcctggcgcaacagctctggcaccatcgagctcgtgaagaagggctgctggctagatgacttcaactgctacgataggcaggagtgtgtggccactgaggagaacccccaggtgtacttctgctgctgtgaaggcaacttctgcaacgagcgcttcactcatttgccagaggctgggggcccggaagtcacgtacgagccacccccgacagcccccaccctgctcacggtgctggcctactcactgctgcccatcgggggcctttccctcatcgtcctgctggccttttggatgtaccggcatcgcaagcccccctacggtcatgtggacatccatgaggaccctgggcctccaccaccatcccctctggtgggcctgaagccactgcagctgctggagatcaaggctcgggggcgctttggctgtgtctggaaggcccagctcatgaatgactttgtagctgtcaagatcttcccactccaggacaagcagtcgtggcagagtgaacgggagatcttcagcacacctggcatgaagcacgagaacctgctacagttcattgctgccgagaagcgaggctccaacctcgaagtagagctgtggctcatcacggccttccatgacaagggctccctcacggattacctcaaggggaacatcatcacatggaacgaactgtgtcatgtagcagagacgatgtcacgaggcctctcatacctgcatgaggatgtgccctggtgccgtggcgagggccacaagccgtctattgcccacagggactttaaaagtaagaatgtattgctgaagagcgacctcacagccgtgctggctgactttggcttggctgttcgatttgagccagggaaacctccaggggacacccacggacaggtaggcacgagacggtacatggctcctgaggtgctcgagggagccatcaacttccagagagatgccttcctgcgcattgacatgtatgccatggggttggtgctgtgggagcttgtgtctcgctgcaaggctgcagacggacccgtggatgagtacatgctgccctttgaggaagagattggccagcacccttcgttggaggagctgcaggaggtggtggtgcacaagaagatgaggcccaccattaaagatcactggttgaaacacccgggcctggcccagctttgtgtgaccatcgaggagtgctgggaccatgatgcagaggctcgcttgtccgcgggctgtgtggaggagcgggtgtccctgattcggaggtcggtcaacggcactacctcggactgtctcgtttccctggtgacctctgtcaccaatgtggacctgccccctaaagagtcaagcatctaagcccaggacatgagtgtctgtccagactcagtggatctgaagaaaaaaaaaaaacctcgtgccgaattttttgggcttcgaggggccaaatttncctatagtgagtcgt

SEQ ID NO: 300293 - DNA, 489 bp, Homo sapiens
  misc_feature (474)..(474): n is a, c, g, or t
catgaaggcaggcatgctgattcctgaagttttccccaggcctctgctggtggacctgctgctgtggttggggctggtgggctctgcctgatccttgggaatatcaagtttactgtcccccaaagcttttcctcactgaagggtcctaacaaaggtgtctttcctgtctgccctatgctgcttagggcctggcccagctttgtgtgaccatcgaggagtgctgggaccatgatgcagaggctcgcttgtccgcgggctgtgtggaggagcgggtgtccctgattcggaggtcggtcaacggcactacctcggactgtctcgtttccctggtgacctctgtcaccaatgtggacctgccccctaaagagtcaagcatctaagcccaggacatgagtgtctgtccagactcagtggatctgaagaaaaaaaaaaaacctcgtgccgaattttttgggcttcgaggggccaaatttncctatagtgagtcgt

SEQ ID NO: 300294 - DNA, 458 bp, Homo sapiens
aaatgtactaaggatccaaacaaagaacctggaaaaagtaactaaaaattaaacttaggaaatcattcctaaaacaatcactgttattattttttaagtgttctccttccctctttgtttttggtcttaatctcagtcagatacatatcatctgtagttccttgtattaatttggtaacaattccattttagattactattatctccaggatatagtatttaaaaattattatccaagtataattgatgctgtgacctcttgtaactgtggtgaatgtggtgaatcgaggttggctatcattgataacctgtctgaattgctctgtcttgcccgccatctggtgcacagaggctgtaactcccatgtcccagctgtgtgtgtatggccagtcactgtaaatcctgccctcctctgtcctcacataggtaggcacgagacggtacatggctcctgaggt

SEQ ID NO: 300295 - DNA, 592 bp, Homo sapiens
atggtttgggcttccaataagattttgtttgaatatcagcgcttcaaggcaagtagtcgtgtctatcctagtaggggccttggtgtctcctttcccctcctgtgtatgtagaggttcaatgaacctttcctagggctgtggagtgaggccagtaagctcagaaagatgactgccatgaaggcaggcatgctgattcctgaagttttccccaggcctctgctggtggacctgctgctgtggttggggctggtgggctctgcctgatccttgggaatatcaagtttactgtcccccaaagcttttcctcactgaagggtcctaacaaaggtgtctttcctgtctgccctatgctgcttagggcctggcccagctttgtgtgaccatcgaggagtgctgggaccatgatgcagaggctcgcttgtccgcgggctgtgtggaggagcgggtgtccctgattcggaggtcggtcaacggcactacctcggactgtctcgtttccctggtgacctctgtcaccaatgtggacctgccccctaaagagtcaagcatctaagcccaggacatgagtgtctgtccagactcagtggatctg

SEQ ID NO: 300296 - DNA, 1988 bp, Homo sapiens
cagttaccttcctggtgtcattgccatcctgggttgacaagctgagagtagaggatacaagtgatgtgaataaaatggaaattgcattgtgcagaagaagaaacaactggaagcagaatcacatgcagcccaactacagattcttatggaattcctcaaggttgcaagaagaaataagagagagcaactggaacagatccagaaggagctaagtgttttggaagaggatattaagagagtggaagaaatgagtggcttatactctcctgtcagtgaggatagcacagtgcctcaatttgaagctccttctccatcacacagtagtattattgattccacagaatacagccaacctccaggtttcagtggcagttctcaggctggagtgcaatggcgctatcttggctcactgcaacctccacctcccaggtacaagcgattctcctgcctcaccctcccaagtagctgggattaccggcgcctgcctccacacctgacaaagaaacagccttggtataatagcacgttagcatcaagacgaaaacgacttactgctcattttgaagacttggagcagtgttacttttctacaaggatgtctcgtatctcagatgacagtcgaactgcaagccagttggatgaatttcaggaatgcttgtccaagtttactcgatataattcagtacgacctttagccacattgtcatatgctagtgatctctataatggttccagtatagtctctagtattgaatttgaccgggattgtgactattttgcgattgctggagttacaaagaagattaaagtctatgaatatgacactgtcatccaggatgcagtggatattcattaccctgagaatgaaatgacctgcaattcgaaaatcagctgtatcagttggagtagttaccataagaacctgttagctagcagtgattatgaaggcactgttattttatgggatggattcacaggacagaggtcaaaggtctatcaggagcatgagaagaggtgttggagtgttgactttaatttgatggatcctaaactcttggcttcaggttctgatgatgcaaaagtgaagctgtggtctaccaatctagacaactcagtggcaagcattgaggcaaaggctaatgtgtgctgtgttaaattcagcccctcttccagataccatttggctttcggctgtgcagatcactgtgtccactactatgatcttcgtaacactaaacagccaatcatggtattcaaaggacaccgtaaagcagtctcttatgcaaagtttgtgagtggtgaggaaattgtctctgcctcaacagacagtcagctaaaactgtggaatgtagggaaaccatactgcctacgttccttcaagggtcatatcaatgaaaaaaactttgtaggcctggcttccaatggagattatatagcttgtggaagtgaaaataactctctctacctgtactataaaggactttctaagactttgctaacttttaagtttgatacagtcaaaagtgttctcgacaaagaccgaaaagaagatgatacaaatgaatttgttagtgctgtgtgctggagggcactaccagatggggagtccaatgtgctgattgctgctaacagtcagggtacaattaaggtgctagaattggtatgaagggttaactcaagtcaaattgtacttgatcctgctgaaatacatctgcagctgacaatgagagaagaaacagaaaatgtcatgtgatgtctctccccaaagtcatcatgggttttggatttgttttgaatatttttttctttttttcttttccctcctttatgacctttgggacattgggaatacccagccaactctccaccatcaatgtaactccatggacattgctgctcttggtggtgttatctaatttttgtgatagggaaacaaattcttttgaataaaaataaataacaaaacaataaaagtttattgagccaca

SEQ ID NO: 300297 - DNA, 430 bp, Homo sapiens
  misc_feature (13)..(13): n is a, c, g, or t
attgaactcctangtcgttcatcatcatttcagccctttgccgccagggccaaaggtggaaagtgatttggaagagaagagcttgtattggtgctagaattggtatgaagggttaactcaagtcaaattgtacttgatcctgctgaaatacatctgcagctgacaatgagagaagaaacagaaaatgtcatgtgatgtctctccccaaagtcatcatgggttttggatttgttttgaatatttttttctttttttcttttccctcctttatgacctttgggacattgggaatacccagccaactctccaccatcaatgtaactccatggacattgctgctcttggtggtgttatctaatttttgtgatagggaaacaaattcttttgaataaaaataaataacaaaacaataaaagtttattgagccaca

SEQ ID NO: 300298 - DNA, 2965 bp, Homo sapiens
ccattcattccagtctcctcaattctttcactgtattaagacggcctgccctctggcacgttttctggaacgaaagcggcttgggacagacagactcccttcgccagggagccccgaccccgagggcgcgccctgagcgtctgagcgcagccccgctgcgtccccagttgtatcccccgccacgcccgcctcttccgccgctcgcgcgcgcgcgcacggccggccacggcgcgccggggttggctgctacagggaccgcggtggcggcggcggcctcgacagcggtagtgccttctactccgcttttttagtttcctccgccccctcccgtgggacgctgttgtgtggctgccttaaaaaaaaacgcaactttattgttcctcagccccacctccggctcggcgggcgtcctcaggatgcactgaggctgaggggaggggaggcggcggagggtcgaggtcgcggtccctctcctccgagcgcccggctggaggggagggagtcacgatgtctggtagccgccaggccgggtcgggctccgctgggacaagccccgggtcctcggcggcctcctcggtgacttccgcctcctcgtctttatcctcttccccgtcgccgccttccgtggcggtttcggcggcagcgctggtgtccggcggggtggcccaggccgccggctcgggcggcctcgggggcccggtgcggcctgtgttggtggcgcccgccgtatcgggtagcggcggcggggcggtgtccacgggcctgtcccggcacagctgcgcggccaggcccagcgccggcgtaggaggcagcagctccagcctaggcagcggcagcaggaagcgacctctcctcgcccccctctgcaacgggctcatcaactcctacgaggacaaaagcaacgacttcgtatgccccatctgctttgatatgattgaagaagcatacatgacaaaatgtggccacagcttttgctacaagtgtattcatcagagtttggaggacaataatagatgtcccaagtgtaactatgttgtggacaatattgaccatctgtatcctaatttcttggtgaatgaactcattcttaaacagaagcaaagatttgaggaaaagaggttcaaattggaccactcagtgagtagcaccaatggccacaggtggcagatatttcaagattggttgggaactgaccaagataaccttgatttggccaatgtcaatcttatgttggagttactagtgcagaagaagaaacaactggaagcagaatcacatgcagcccaactacagattcttatggaattcctcaaggttgcaagaagaaataagagagaggaaatgagtggcttatactctcctgtcagtgaggatagcacagtgcctcaatttgaagctccttctccatcacacagtagtattattgattccacagaatacagccaacctccaggtttcagtggcagttctcagacaaagaaacagccttggtataatagcacgttagcatcaagacgaaaacgacttactgctcattttgaagacttggagcagtgttacttttctacaaggatgtctcgtatctcagatgacagtcgaactgcaagccagttggatgaatttcaggaatgcttgtccaagtttactcgatataattcagtacgacctttagccacattgtcatatgctagtgatctctataatggttccagtatagtctctagtattgaatttgaccgggattgtgactattttgcgattgctggagttacaaagaagattaaagtctatgaatatgacactgtcatccaggatgcagtggatattcattaccctgagaatgaaatgacctgcaattcgaaaatcagctgtatcagttggagtagttaccataagaacctgttagctagcagtgattatgaaggcactgttattttatgggatggattcacaggacagaggtcaaaggtctatcaggagcatgagaagaggtgttggagtgttgactttaatttgatggatcctaaactcttggcttcaggttctgatgatgcaaaagtgaagctgtggtctaccaatctagacaactcagtggcaagcattgaggcaaaggctaatgtgtgctgtgttaaattcagcccctcttccagataccatttggctttcggctgtgcagatcactgtgtccactactatgatcttcgtaacactaaacagccaatcatggtattcaaaggacaccgtaaagcagtctcttatgcaaagtttgtgagtggtgaggaaattgtctctgcctcaacagacagtcagctaaaactgtggaatgtagggaaaccatactgcctacgttccttcaagggtcatatcaatgaaaaaaactttgtaggcctggcttccaatggagattatatagcttgtggaagtgaaaataactctctctacctgtactataaaggactttctaagactttgctaacttttaagtttgatacagtcaaaagtgttctcgacaaagaccgaaaagaagatgatacaaatgaatttgttagtgctgtgtgctggagggcactaccagatggggagtccaatgtgctgattgctgctaacagtcagggtacaattaaggtgctagaattggtatgaagggttaactcaagtcaaattgtacttgatcctgctgaaatacatctgcagctgacaatgagagaagaaacagaaaatgtcatgtgatgtctctccccaaagtcatcatgggttttggatttgttttgaatatttttttctttttttcttttccctcctttatgacctttgggacattgggaatacccagccaactctccaccatcaatgtaactccatggacattgctgctcttggtggtgttatctaatttttgtgatagggaaacaaattcttttgaataaaaataaataacaaaacaataaaagtttattgagccaca

SEQ ID NO: 300299 - DNA, 3142 bp, Homo sapiens
ccattcattccagtctcctcaattctttcactgtattaagacggcctgccctctggcacgttttctggaacgaaagcggcttgggacagacagactcccttcgccagggagccccgaccccgagggcgcgccctgagcgtctgagcgcagccccgctgcgtccccagttgtatcccccgccacgcccgcctcttccgccgctcgcgcgcgcgcgcacggccggccacggcgcgccggggttggctgctacagggaccgcggtggcggcggcggcctcgacagcggtagtgccttctactccgcttttttagtttcctccgccccctcccgtgggacgctgttgtgtggctgccttaaaaaaaaacgcaactttattgttcctcagccccacctccggctcggcgggcgtcctcaggatgcactgaggctgaggggaggggaggcggcggagggtcgaggtcgcggtccctctcctccgagcgcccggctggaggggagggagtcacgatgtctggtagccgccaggccgggtcgggctccgctgggacaagccccgggtcctcggcggcctcctcggtgacttccgcctcctcgtctttatcctcttccccgtcgccgccttccgtggcggtttcggcggcagcgctggtgtccggcggggtggcccaggccgccggctcgggcggcctcgggggcccggtgcggcctgtgttggtggcgcccgccgtatcgggtagcggcggcggggcggtgtccacgggcctgtcccggcacagctgcgcggccaggcccagcgccggcgtaggaggcagcagctccagcctaggcagcggcagcaggaagcgacctctcctcgcccccctctgcaacgggctcatcaactcctacgaggacaaaagcaacgacttcgtatgccccatctgctttgatatgattgaagaagcatacatgacaaaatgtggccacagcttttgctacaagtgtattcatcagagtttggaggacaataatagatgtcccaagtgtaactatgttgtggacaatattgaccatctgtatcctaatttcttggtgaatgaactcattcttaaacagaagcaaagatttgaggaaaagaggttcaaattggaccactcagtgagtagcaccaatggccacaggtggcagatatttcaagattggttgggaactgaccaagataaccttgatttggccaatgtcaatcttatgttggagttactagtgcagaagaagaaacaactggaagcagaatcacatgcagcccaactacagattcttatggaattcctcaaggttgcaagaagaaataagagagagcaactggaacagatccagaaggagctaagtgttttggaagaggatattaagagagtggaagaaatgagtggcttatactctcctgtcagtgaggatagcacagtgcctcaatttgaagctccttctccatcacacagtagtattattgattccacagaatacagccaacctccaggtttcagtggcagttctcaggctggagtgcaatggcgctatcttggctcactgcaacctccacctcccaggtacaagcgattctcctgcctcaccctcccaagtagctgggattaccggcgcctgcctccacacctgacaaagaaacagccttggtataatagcacgttagcatcaagacgaaaacgacttactgctcattttgaagacttggagcagtgttacttttctacaaggatgtctcgtatctcagatgacagtcgaactgcaagccagttggatgaatttcaggaatgcttgtccaagtttactcgatataattcagtacgacctttagccacattgtcatatgctagtgatctctataatggttccagtatagtctctagtattgaatttgaccgggattgtgactattttgcgattgctggagttacaaagaagattaaagtctatgaatatgacactgtcatccaggatgcagtggatattcattaccctgagaatgaaatgacctgcaattcgaaaatcagctgtatcagttggagtagttaccataagaacctgttagctagcagtgattatgaaggcactgttattttatgggatggattcacaggacagaggtcaaaggtctatcaggagcatgagaagaggtgttggagtgttgactttaatttgatggatcctaaactcttggcttcaggttctgatgatgcaaaagtgaagctgtggtctaccaatctagacaactcagtggcaagcattgaggcaaaggctaatgtgtgctgtgttaaattcagcccctcttccagataccatttggctttcggctgtgcagatcactgtgtccactactatgatcttcgtaacactaaacagccaatcatggtattcaaaggacaccgtaaagcagtctcttatgcaaagtttgtgagtggtgaggaaattgtctctgcctcaacagacagtcagctaaaactgtggaatgtagggaaaccatactgcctacgttccttcaagggtcatatcaatgaaaaaaactttgtaggcctggcttccaatggagattatatagcttgtggaagtgaaaataactctctctacctgtactataaaggactttctaagactttgctaacttttaagtttgatacagtcaaaagtgttctcgacaaagaccgaaaagaagatgatacaaatgaatttgttagtgctgtgtgctggagggcactaccagatggggagtccaatgtgctgattgctgctaacagtcagggtacaattaaggtgctagaattggtatgaagggttaactcaagtcaaattgtacttgatcctgctgaaatacatctgcagctgacaatgagagaagaaacagaaaatgtcatgtgatgtctctccccaaagtcatcatgggttttggatttgttttgaatatttttttctttttttcttttccctcctttatgacctttgggacattgggaatacccagccaactctccaccatcaatgtaactccatggacattgctgctcttggtggtgttatctaatttttgtgatagggaaacaaattcttttgaataaaaataaataacaaaacaataaaagtttattgagccaca

SEQ ID NO: 300300 - DNA, 2146 bp, Homo sapiens
tgcagagggaatcgagcgtttgcaggcattcgagctcctggttggtggggtgaaggaatgttggagtagcgaggcagggtggggataataaagagccccatctgctttgatatgattgaagaagcatacatgacaaaatgtggccacagcttttgctacaagtgtattcatcagagtttggaggacaataatagatgtcccaagtgtaactatgttgtggacaatattgaccatctgtatcctaatttcttggtgaatgaactcattcttaaacagaagcaaagatttgaggaaaagaggttcaaattggaccactcagtgagtagcaccaatggccacaggtggcagatatttcaagattggttgggaactgaccaagataaccttgatttggccaatgtcaatcttatgttggagttactagtgcagaagaagaaacaactggaagcagaatcacatgcagcccaactacagattcttatggaattcctcaaggttgcaagaagaaataagagagaggaaatgagtggcttatactctcctgtcagtgaggatagcacagtgcctcaatttgaagctccttctccatcacacagtagtattattgattccacagaatacagccaacctccaggtttcagtggcagttctcagacaaagaaacagccttggtataatagcacgttagcatcaagacgaaaacgacttactgctcattttgaagacttggagcagtgttacttttctacaaggatgtctcgtatctcagatgacagtcgaactgcaagccagttggatgaatttcaggaatgcttgtccaagtttactcgatataattcagtacgacctttagccacattgtcatatgctagtgatctctataatggttccagtatagtctctagtattgaatttgaccgggattgtgactattttgcgattgctggagttacaaagaagattaaagtctatgaatatgacactgtcatccaggatgcagtggatattcattaccctgagaatgaaatgacctgcaattcgaaaatcagctgtatcagttggagtagttaccataagaacctgttagctagcagtgattatgaaggcactgttattttatgggatggattcacaggacagaggtcaaaggtctatcaggagcatgagaagaggtgttggagtgttgactttaatttgatggatcctaaactcttggcttcaggttctgatgatgcaaaagtgaagctgtggtctaccaatctagacaactcagtggcaagcattgaggcaaaggctaatgtgtgctgtgttaaattcagcccctcttccagataccatttggctttcggctgtgcagatcactgtgtccactactatgatcttcgtaacactaaacagccaatcatggtattcaaaggacaccgtaaagcagtctcttatgcaaagtttgtgagtggtgaggaaattgtctctgcctcaacagacagtcagctaaaactgtggaatgtagggaaaccatactgcctacgttccttcaagggtcatatcaatgaaaaaaactttgtaggcctggcttccaatggagattatatagcttgtggaagtgaaaataactctctctacctgtactataaaggactttctaagactttgctaacttttaagtttgatacagtcaaaagtgttctcgacaaagaccgaaaagaagatgatacaaatgaatttgttagtgctgtgtgctggagggcactaccagatggggagtccaatgtgctgattgctgctaacagtcagggtacaattaaggtgctagaattggtatgaagggttaactcaagtcaaattgtacttgatcctgctgaaatacatctgcagctgacaatgagagaagaaacagaaaatgtcatgtgatgtctctccccaaagtcatcatgggttttggatttgttttgaatatttttttctttttttcttttccctcctttatgacctttgggacattgggaatacccagccaactctccaccatcaatgtaactccatggacattgctgctcttggtggtgttatctaatttttgtgatagggaaacaaattcttttgaataaaaataaataacaaaacaataaaagtttattgagccaca

SEQ ID NO: 300301 - DNA, 3025 bp, Homo sapiens
ccattcattccagtctcctcaattctttcactgtattaagacggcctgccctctggcacgttttctggaacgaaagcggcttgggacagacagactcccttcgccagggagccccgaccccgagggcgcgccctgagcgtctgagcgcagccccgctgcgtccccagttgtatcccccgccacgcccgcctcttccgccgctcgcgcgcgcgcgcacggccggccacggcgcgccggggttggctgctacagggaccgcggtggcggcggcggcctcgacagcggtagtgccttctactccgcttttttagtttcctccgccccctcccgtgggacgctgttgtgtggctgccttaaaaaaaaacgcaactttattgttcctcagccccacctccggctcggcgggcgtcctcaggatgcactgaggctgaggggaggggaggcggcggagggtcgaggtcgcggtccctctcctccgagcgcccggctggaggggagggagtcacgatgtctggtagccgccaggccgggtcgggctccgctgggacaagccccgggtcctcggcggcctcctcggtgacttccgcctcctcgtctttatcctcttccccgtcgccgccttccgtggcggtttcggcggcagcgctggtgtccggcggggtggcccaggccgccggctcgggcggcctcgggggcccggtgcggcctgtgttggtggcgcccgccgtatcgggtagcggcggcggggcggtgtccacgggcctgtcccggcacagctgcgcggccaggcccagcgccggcgtaggaggcagcagctccagcctaggcagcggcagcaggaagcgacctctcctcgcccccctctgcaacgggctcatcaactcctacgaggacaaaagcaacgacttcgtatgccccatctgctttgatatgattgaagaagcatacatgacaaaatgtggccacagcttttgctacaagtgtattcatcagagtttggaggacaataatagatgtcccaagtgtaactatgttgtggacaatattgaccatctgtatcctaatttcttggtgaatgaactcattcttaaacagaagcaaagatttgaggaaaagaggttcaaattggaccactcagtgagtagcaccaatggccacaggtggcagatatttcaagattggttgggaactgaccaagataaccttgatttggccaatgtcaatcttatgttggagttactagtgcagaagaagaaacaactggaagcagaatcacatgcagcccaactacagattcttatggaattcctcaaggttgcaagaagaaataagagagagcaactggaacagatccagaaggagctaagtgttttggaagaggatattaagagagtggaagaaatgagtggcttatactctcctgtcagtgaggatagcacagtgcctcaatttgaagctccttctccatcacacagtagtattattgattccacagaatacagccaacctccaggtttcagtggcagttctcagacaaagaaacagccttggtataatagcacgttagcatcaagacgaaaacgacttactgctcattttgaagacttggagcagtgttacttttctacaaggatgtctcgtatctcagatgacagtcgaactgcaagccagttggatgaatttcaggaatgcttgtccaagtttactcgatataattcagtacgacctttagccacattgtcatatgctagtgatctctataatggttccagtatagtctctagtattgaatttgaccgggattgtgactattttgcgattgctggagttacaaagaagattaaagtctatgaatatgacactgtcatccaggatgcagtggatattcattaccctgagaatgaaatgacctgcaattcgaaaatcagctgtatcagttggagtagttaccataagaacctgttagctagcagtgattatgaaggcactgttattttatgggatggattcacaggacagaggtcaaaggtctatcaggagcatgagaagaggtgttggagtgttgactttaatttgatggatcctaaactcttggcttcaggttctgatgatgcaaaagtgaagctgtggtctaccaatctagacaactcagtggcaagcattgaggcaaaggctaatgtgtgctgtgttaaattcagcccctcttccagataccatttggctttcggctgtgcagatcactgtgtccactactatgatcttcgtaacactaaacagccaatcatggtattcaaaggacaccgtaaagcagtctcttatgcaaagtttgtgagtggtgaggaaattgtctctgcctcaacagacagtcagctaaaactgtggaatgtagggaaaccatactgcctacgttccttcaagggtcatatcaatgaaaaaaactttgtaggcctggcttccaatggagattatatagcttgtggaagtgaaaataactctctctacctgtactataaaggactttctaagactttgctaacttttaagtttgatacagtcaaaagtgttctcgacaaagaccgaaaagaagatgatacaaatgaatttgttagtgctgtgtgctggagggcactaccagatggggagtccaatgtgctgattgctgctaacagtcagggtacaattaaggtgctagaattggtatgaagggttaactcaagtcaaattgtacttgatcctgctgaaatacatctgcagctgacaatgagagaagaaacagaaaatgtcatgtgatgtctctccccaaagtcatcatgggttttggatttgttttgaatatttttttctttttttcttttccctcctttatgacctttgggacattgggaatacccagccaactctccaccatcaatgtaactccatggacattgctgctcttggtggtgttatctaatttttgtgatagggaaacaaattcttttgaataaaaataaataacaaaacaataaaagtttattgagccaca

SEQ ID NO: 300302 - DNA, 3104 bp, Homo sapiens
ccattcattccagtctcctcaattctttcactgtattaagacggcctgccctctggcacgttttctggaacgaaagcggcttgggacagacagactcccttcgccagggagccccgaccccgagggcgcgccctgagcgtctgagcgcagccccgctgcgtccccagttgtatcccccgccacgcccgcctcttccgccgctcgcgcgcgcgcgcacggccggccacggcgcgccggggttggctgctacagggaccgcggtggcggcggcggcctcgacagcggtagtgccttctactccgcttttttagtttcctccgccccctcccgtgggacgctgttgtgtggctgccttaaaaaaaaacgcaactttattgttcctcagccccacctccggctcggcgggcgtcctcaggatgcactgaggctgaggggaggggaggcggcggagggtcgaggtcgcggtccctctcctccgagcgcccggctggaggggagggagtcacgatgtctggtagccgccaggccgggtcgggctccgctgggacaagccccgggtcctcggcggcctcctcggtgacttccgcctcctcgtctttatcctcttccccgtcgccgccttccgtggcggtttcggcggcagcgctggtgtccggcggggtggcccaggccgccggctcgggcggcctcgggggcccggtgcggcctgtgttggtggcgcccgccgtatcgggtagcggcggcggggcggtgtccacgggcctgtcccggcacagctgcgcggccaggcccagcgccggcgtaggaggcagcagctccagcctaggcagcggcagcaggaagcgacctctcctcgcccccctctgcaacgggctcatcaactcctacgaggacaaaagcaacgacttcgtatgccccatctgctttgatatgattgaagaagcatacatgacaaaatgtggccacagcttttgctacaagtgtattcatcagagtttggaggacaataatagatgtcccaagtgtaactatgttgtggacaatattgaccatctgtatcctaatttcttggtgaatgaactcattcttaaacagaagcaaagatttgaggaatggccacaggtggcagatatttcaagattggttgggaactgaccaagataaccttgatttggccaatgtcaatcttatgttggagttactagtgcagaagaagaaacaactggaagcagaatcacatgcagcccaactacagattcttatggaattcctcaaggttgcaagaagaaataagagagagcaactggaacagatccagaaggagctaagtgttttggaagaggatattaagagagtggaagaaatgagtggcttatactctcctgtcagtgaggatagcacagtgcctcaatttgaagctccttctccatcacacagtagtattattgattccacagaatacagccaacctccaggtttcagtggcagttctcaggctggagtgcaatggcgctatcttggctcactgcaacctccacctcccaggtacaagcgattctcctgcctcaccctcccaagtagctgggattaccggcgcctgcctccacacctgacaaagaaacagccttggtataatagcacgttagcatcaagacgaaaacgacttactgctcattttgaagacttggagcagtgttacttttctacaaggatgtctcgtatctcagatgacagtcgaactgcaagccagttggatgaatttcaggaatgcttgtccaagtttactcgatataattcagtacgacctttagccacattgtcatatgctagtgatctctataatggttccagtatagtctctagtattgaatttgaccgggattgtgactattttgcgattgctggagttacaaagaagattaaagtctatgaatatgacactgtcatccaggatgcagtggatattcattaccctgagaatgaaatgacctgcaattcgaaaatcagctgtatcagttggagtagttaccataagaacctgttagctagcagtgattatgaaggcactgttattttatgggatggattcacaggacagaggtcaaaggtctatcaggagcatgagaagaggtgttggagtgttgactttaatttgatggatcctaaactcttggcttcaggttctgatgatgcaaaagtgaagctgtggtctaccaatctagacaactcagtggcaagcattgaggcaaaggctaatgtgtgctgtgttaaattcagcccctcttccagataccatttggctttcggctgtgcagatcactgtgtccactactatgatcttcgtaacactaaacagccaatcatggtattcaaaggacaccgtaaagcagtctcttatgcaaagtttgtgagtggtgaggaaattgtctctgcctcaacagacagtcagctaaaactgtggaatgtagggaaaccatactgcctacgttccttcaagggtcatatcaatgaaaaaaactttgtaggcctggcttccaatggagattatatagcttgtggaagtgaaaataactctctctacctgtactataaaggactttctaagactttgctaacttttaagtttgatacagtcaaaagtgttctcgacaaagaccgaaaagaagatgatacaaatgaatttgttagtgctgtgtgctggagggcactaccagatggggagtccaatgtgctgattgctgctaacagtcagggtacaattaaggtgctagaattggtatgaagggttaactcaagtcaaattgtacttgatcctgctgaaatacatctgcagctgacaatgagagaagaaacagaaaatgtcatgtgatgtctctccccaaagtcatcatgggttttggatttgttttgaatatttttttctttttttcttttccctcctttatgacctttgggacattgggaatacccagccaactctccaccatcaatgtaactccatggacattgctgctcttggtggtgttatctaatttttgtgatagggaaacaaattcttttgaataaaaataaataacaaaacaataaaagtttattgagccaca

SEQ ID NO: 300303 - DNA, 3079 bp, Homo sapiens
ccattcattccagtctcctcaattctttcactgtattaagacggcctgccctctggcacgttttctggaacgaaagcggcttgggacagacagactcccttcgccagggagccccgaccccgagggcgcgccctgagcgtctgagcgcagccccgctgcgtccccagttgtatcccccgccacgcccgcctcttccgccgctcgcgcgcgcgcgcacggccggccacggcgcgccggggttggctgctacagggaccgcggtggcggcggcggcctcgacagcggtagtgccttctactccgcttttttagtttcctccgccccctcccgtgggacgctgttgtgtggctgccttaaaaaaaaacgcaactttattgttcctcagccccacctccggctcggcgggcgtcctcaggatgcactgaggctgaggggaggggaggcggcggagggtcgaggtcgcggtccctctcctccgagcgcccggctggaggggagggagtcacgatgtctggtagccgccaggccgggtcgggctccgctgggacaagccccgggtcctcggcggcctcctcggtgacttccgcctcctcgtctttatcctcttccccgtcgccgccttccgtggcggtttcggcggcagcgctggtgtccggcggggtggcccaggccgccggctcgggcggcctcgggggcccggtgcggcctgtgttggtggcgcccgccgtatcgggtagcggcggcggggcggtgtccacgggcctgtcccggcacagctgcgcggccaggcccagcgccggcgtaggaggcagcagctccagcctaggcagcggcagcaggaagcgacctctcctcgcccccctctgcaacgggctcatcaactcctacgaggacaaaagcaacgacttcgtatgccccatctgctttgatatgattgaagaagcatacatgacaaaatgtggccacagcttttgctacaagtgtattcatcagagtttggaggacaataatagatgtcccaagtgtaactatgttgtggacaatattgaccatctgtatcctaatttcttggtgaatgaactcattcttaaacagaagcaaagatttgaggaaaagaggttcaaattggaccactcagtgagtagcaccaatggccacaggtggcagatatttcaagattggttgggaactgaccaagataaccttgatttggccaatgtcaatcttatgttggagttactagtgcagaagaagaaacaactggaagcagaatcacatgcagcccaactacagattcttatggaattcctcaaggttgcaagaagaaataagagagagcaactggaacagatccagaaggagctaagtgttttggaagaggatattaagagagtggaagaaatgagtggcttatactctcctgtcagtgaggatagcacagtgcctcaatttgaagctccttctccatcacacagccttgaattcagttctgatatgcacaggatctttgtcaatggaatacttattattagtattattgattccacagaatacagccaacctccaggtttcagtggcagttctcagacaaagaaacagccttggtataatagcacgttagcatcaagacgaaaacgacttactgctcattttgaagacttggagcagtgttacttttctacaaggatgtctcgtatctcagatgacagtcgaactgcaagccagttggatgaatttcaggaatgcttgtccaagtttactcgatataattcagtacgacctttagccacattgtcatatgctagtgatctctataatggttccagtatagtctctagtattgaatttgaccgggattgtgactattttgcgattgctggagttacaaagaagattaaagtctatgaatatgacactgtcatccaggatgcagtggatattcattaccctgagaatgaaatgacctgcaattcgaaaatcagctgtatcagttggagtagttaccataagaacctgttagctagcagtgattatgaaggcactgttattttatgggatggattcacaggacagaggtcaaaggtctatcaggagcatgagaagaggtgttggagtgttgactttaatttgatggatcctaaactcttggcttcaggttctgatgatgcaaaagtgaagctgtggtctaccaatctagacaactcagtggcaagcattgaggcaaaggctaatgtgtgctgtgttaaattcagcccctcttccagataccatttggctttcggctgtgcagatcactgtgtccactactatgatcttcgtaacactaaacagccaatcatggtattcaaaggacaccgtaaagcagtctcttatgcaaagtttgtgagtggtgaggaaattgtctctgcctcaacagacagtcagctaaaactgtggaatgtagggaaaccatactgcctacgttccttcaagggtcatatcaatgaaaaaaactttgtaggcctggcttccaatggagattatatagcttgtggaagtgaaaataactctctctacctgtactataaaggactttctaagactttgctaacttttaagtttgatacagtcaaaagtgttctcgacaaagaccgaaaagaagatgatacaaatgaatttgttagtgctgtgtgctggagggcactaccagatggggagtccaatgtgctgattgctgctaacagtcagggtacaattaaggtgctagaattggtatgaagggttaactcaagtcaaattgtacttgatcctgctgaaatacatctgcagctgacaatgagagaagaaacagaaaatgtcatgtgatgtctctccccaaagtcatcatgggttttggatttgttttgaatatttttttctttttttcttttccctcctttatgacctttgggacattgggaatacccagccaactctccaccatcaatgtaactccatggacattgctgctcttggtggtgttatctaatttttgtgatagggaaacaaattcttttgaataaaaataaataacaaaacaataaaagtttattgagccaca

SEQ ID NO: 300304 - DNA, 2828 bp, Homo sapiens
ccattcattccagtctcctcaattctttcactgtattaagacggcctgccctctggcacgttttctggaacgaaagcggcttgggacagacagactcccttcgccagggagccccgaccccgagggcgcgccctgagcgtctgagcgcagccccgctgcgtccccagttgtatcccccgccacgcccgcctcttccgccgctcgcgcgcgcgcgcacggccggccacggcgcgccggggttggctgctacagggaccgcggtggcggcggcggcctcgacagcggtagtgccttctactccgcttttttagtttcctccgccccctcccgtgggacgctgttgtgtggctgccttaaaaaaaaacgcaactttattgttcctcagccccacctccggctcggcgggcgtcctcaggatgcactgaggctgaggggaggggaggcggcggagggtcgaggtcgcggtccctctcctccgagcgcccggctggaggggagggagtcacgatgtctggtagccgccaggccgggtcgggctccgctgggacaagccccgggtcctcggcggcctcctcggtgacttccgcctcctcgtctttatcctcttccccgtcgccgccttccgtggcggtttcggcggcagcgctggtgtccggcggggtggcccaggccgccggctcgggcggcctcgggggcccggtgcggcctgtgttggtggcgcccgccgtatcgggtagcggcggcggggcggtgtccacgggcctgtcccggcacagctgcgcggccaggcccagcgccggcgtaggaggcagcagctccagcctaggcagcggcagcaggaagcgacctctcctcgcccccctctgcaacgggctcatcaactcctacgaggacaaaagcaacgacttcgtatgccccatctgctttgatatgattgaagaagcatacatgacaaaatgtggccacagcttttgctacaagtgtattcatcagagtttggaggacaataatagatgtcccaagtgtaactatgttgtggacaatattgaccatctgtatcctaatttcttgggaatcacatgcagcccaactacagattcttatggaattcctcaaggttgcaagaagaaataagagagagcaactggaacagatccagaaggagctaagtgttttggaagaggatattaagagagtggaagaaatgagtggcttatactctcctgtcagtgaggatagcacagtgcctcaatttgaagctccttctccatcacacagtagtattattgattccacagaatacagccaacctccaggtttcagtggcagttctcagacaaagaaacagccttggtataatagcacgttagcatcaagacgaaaacgacttactgctcattttgaagacttggagcagtgttacttttctacaaggatgtctcgtatctcagatgacagtcgaactgcaagccagttggatgaatttcaggaatgcttgtccaagtttactcgatataattcagtacgacctttagccacattgtcatatgctagtgatctctataatggttccagtatagtctctagtattgaatttgaccgggattgtgactattttgcgattgctggagttacaaagaagattaaagtctatgaatatgacactgtcatccaggatgcagtggatattcattaccctgagaatgaaatgacctgcaattcgaaaatcagctgtatcagttggagtagttaccataagaacctgttagctagcagtgattatgaaggcactgttattttatgggatggattcacaggacagaggtcaaaggtctatcaggagcatgagaagaggtgttggagtgttgactttaatttgatggatcctaaactcttggcttcaggttctgatgatgcaaaagtgaagctgtggtctaccaatctagacaactcagtggcaagcattgaggcaaaggctaatgtgtgctgtgttaaattcagcccctcttccagataccatttggctttcggctgtgcagatcactgtgtccactactatgatcttcgtaacactaaacagccaatcatggtattcaaaggacaccgtaaagcagtctcttatgcaaagtttgtgagtggtgaggaaattgtctctgcctcaacagacagtcagctaaaactgtggaatgtagggaaaccatactgcctacgttccttcaagggtcatatcaatgaaaaaaactttgtaggcctggcttccaatggagattatatagcttgtggaagtgaaaataactctctctacctgtactataaaggactttctaagactttgctaacttttaagtttgatacagtcaaaagtgttctcgacaaagaccgaaaagaagatgatacaaatgaatttgttagtgctgtgtgctggagggcactaccagatggggagtccaatgtgctgattgctgctaacagtcagggtacaattaaggtgctagaattggtatgaagggttaactcaagtcaaattgtacttgatcctgctgaaatacatctgcagctgacaatgagagaagaaacagaaaatgtcatgtgatgtctctccccaaagtcatcatgggttttggatttgttttgaatatttttttctttttttcttttccctcctttatgacctttgggacattgggaatacccagccaactctccaccatcaatgtaactccatggacattgctgctcttggtggtgttatctaatttttgtgatagggaaacaaattcttttgaataaaaataaataacaaaacaataaaagtttattgagccaca

SEQ ID NO: 300305 - DNA, 2407 bp, Homo sapiens
tgcagagggaatcgagcgtttgcaggcattcgagctcctggttggtggggtgaaggaatgttggagtagcgaggcagggtggggataataaagagccccatctgctttgatatgattgaagaagcatacatgacaaaatgtggccacagcttttgctacaagtgtattcatcagagtttggaggacaataatagatgtcccaagtgtaactatgttgtggacaatattgaccatctgtatcctaatttcttggtgtgcatactctgtctgctcctctctgcctcccttggttttgaatgctctctttccctctcctgatcctgaaaggctgattcagtgaatgaactcattcttaaacagaagcaaagatttgaggaaaagaggttcaaattggaccactcagtgagtagcaccaatggccacaggtggcagatatttcaagattggttgggaactgaccaagataaccttgatttggccaatgtcaatcttatgttggagttactagtgcagaagaagaaacaactggaagcagaatcacatgcagcccaactacagattcttatggaattcctcaaggttgcaagaagaaataagagagagcaactggaacagatccagaaggagctaagtgttttggaagaggatattaagagagtggaagaaatgagtggcttatactctcctgtcagtgaggatagcacagtgcctcaatttgaagctccttctccatcacacagtagtattattgattccacagaatacagccaacctccaggtttcagtggcagttctcaggctggagtgcaatggcgctatcttggctcactgcaacctccacctcccaggtacaagcgattctcctgcctcaccctcccaagtagctgggattaccggcgcctgcctccacacctgacaaagaaacagccttggtataatagcacgttagcatcaagacgaaaacgacttactgctcattttgaagacttggagcagtgttacttttctacaaggatgtctcgtatctcagatgacagtcgaactgcaagccagttggatgaatttcaggaatgcttgtccaagtttactcgatataattcagtacgacctttagccacattgtcatatgctagtgatctctataatggttccagtatagtctctagtattgaatttgaccgggattgtgactattttgcgattgctggagttacaaagaagattaaagtctatgaatatgacactgtcatccaggatgcagtggatattcattaccctgagaatgaaatgacctgcaattcgaaaatcagctgtatcagttggagtagttaccataagaacctgttagctagcagtgattatgaaggcactgttattttatgggatggattcacaggacagaggtcaaaggtctatcaggagcatgagaagaggtgttggagtgttgactttaatttgatggatcctaaactcttggcttcaggttctgatgatgcaaaagtgaagctgtggtctaccaatctagacaactcagtggcaagcattgaggcaaaggctaatgtgtgctgtgttaaattcagcccctcttccagataccatttggctttcggctgtgcagatcactgtgtccactactatgatcttcgtaacactaaacagccaatcatggtattcaaaggacaccgtaaagcagtctcttatgcaaagtttgtgagtggtgaggaaattgtctctgcctcaacagacagtcagctaaaactgtggaatgtagggaaaccatactgcctacgttccttcaagggtcatatcaatgaaaaaaactttgtaggcctggcttccaatggagattatatagcttgtggaagtgaaaataactctctctacctgtactataaaggactttctaagactttgctaacttttaagtttgatacagtcaaaagtgttctcgacaaagaccgaaaagaagatgatacaaatgaatttgttagtgctgtgtgctggagggcactaccagatggggagtccaatgtgctgattgctgctaacagtcagggtacaattaaggtgctagaattggtatgaagggttaactcaagtcaaattgtacttgatcctgctgaaatacatctgcagctgacaatgagagaagaaacagaaaatgtcatgtgatgtctctccccaaagtcatcatgggttttggatttgttttgaatatttttttctttttttcttttccctcctttatgacctttgggacattgggaatacccagccaactctccaccatcaatgtaactccatggacattgctgctcttggtggtgttatctaatttttgtgatagggaaacaaattcttttgaataaaaataaataacaaaacaataaaagtttattgagccaca

SEQ ID NO: 300306 - DNA, 1713 bp, Homo sapiens
ggctggcgttctagaggatccggaagcaactggaacagatccagaaggagctaagtgttttggaagaggatattaagagagtggaagaaatgagtggcttatactctcctgtcagtgaggatagcacagtgcctcaatttgaagctccttctccatcacacagtagtattattgattccacagaatacagccaacctccaggtttcagtggcagttctcagacaaagaaacagccttggtataatagcacgttagcatcaagacgaaaacgacttactgctcattttgaagacttggagcagtgttacttttctacaaggatgtctcgtatctcagatgacagtcgaactgcaagccagttggatgaatttcaggaatgcttgtccaagtttactcgatataattcagtacgacctttagccacattgtcatatgctagtgatctctataatggttccagtatagtctctagtattgaatttgaccgggattgtgactattttgcgattgctggagttacaaagaagattaaagtctatgaatatgacactgtcatccaggatgcagtggatattcattaccctgagaatgaaatgacctgcaattcgaaaatcagctgtatcagttggagtagttaccataagaacctgttagctagcagtgattatgaaggcactgttattttatgggatggattcacaggacagaggtcaaaggtctatcaggagcatgagaagaggtgttggagtgttgactttaatttgatggatcctaaactcttggcttcaggttctgatgatgcaaaagtgaagctgtggtctaccaatctagacaactcagtggcaagcattgaggcaaaggctaatgtgtgctgtgttaaattcagcccctcttccagataccatttggctttcggctgtgcagatcactgtgtccactactatgatcttcgtaacactaaacagccaatcatggtattcaaaggacaccgtaaagcagtctcttatgcaaagtttgtgagtggtgaggaaattgtctctgcctcaacagacagtcagctaaaactgtggaatgtagggaaaccatactgcctacgttccttcaagggtcatatcaatgaaaaaaactttgtaggcctggcttccaatggagattatatagcttgtggaagtgaaaataactctctctacctgtactataaaggactttctaagactttgctaacttttaagtttgatacagtcaaaagtgttctcgacaaagaccgaaaagaagatgatacaaatgaatttgttagtgctgtgtgctggagggcactaccagatggggagtccaatgtgctgattgctgctaacagtcagggtacaattaaggtgctagaattggtatgaagggttaactcaagtcaaattgtacttgatcctgctgaaatacatctgcagctgacaatgagagaagaaacagaaaatgtcatgtgatgtctctccccaaagtcatcatgggttttggatttgttttgaatatttttttctttttttcttttccctcctttatgacctttgggacattgggaatacccagccaactctccaccatcaatgtaactccatggacattgctgctcttggtggtgttatctaatttttgtgatagggaaacaaattcttttgaataaaaataaataacaaaacaataaaagtttattgagccaca

SEQ ID NO: 300307 - DNA, 1696 bp, Homo sapiens
  misc_feature (44)..(44): n is a, c, g, or t
tctagaggatctccctgtcagtcgctctgggagctaagtgtgtnggaagaggatattaagagagtggaagaaatgagtggcttatactctcctgtcagtgaggatagcacagtgcctcaatttgaagctccttctccatcacacagtagtattattgattccacagaatacagccaacctccaggtttcagtggcagttctcagacaaagaaacagccttggtataatagcacgttagcatcaagacgaaaacgacttactgctcattttgaagacttggagcagtgttacttttctacaaggatgtctcgtatctcagatgacagtcgaactgcaagccagttggatgaatttcaggaatgcttgtccaagtttactcgatataattcagtacgacctttagccacattgtcatatgctagtgatctctataatggttccagtatagtctctagtattgaatttgaccgggattgtgactattttgcgattgctggagttacaaagaagattaaagtctatgaatatgacactgtcatccaggatgcagtggatattcattaccctgagaatgaaatgacctgcaattcgaaaatcagctgtatcagttggagtagttaccataagaacctgttagctagcagtgattatgaaggcactgttattttatgggatggattcacaggacagaggtcaaaggtctatcaggagcatgagaagaggtgttggagtgttgactttaatttgatggatcctaaactcttggcttcaggttctgatgatgcaaaagtgaagctgtggtctaccaatctagacaactcagtggcaagcattgaggcaaaggctaatgtgtgctgtgttaaattcagcccctcttccagataccatttggctttcggctgtgcagatcactgtgtccactactatgatcttcgtaacactaaacagccaatcatggtattcaaaggacaccgtaaagcagtctcttatgcaaagtttgtgagtggtgaggaaattgtctctgcctcaacagacagtcagctaaaactgtggaatgtagggaaaccatactgcctacgttccttcaagggtcatatcaatgaaaaaaactttgtaggcctggcttccaatggagattatatagcttgtggaagtgaaaataactctctctacctgtactataaaggactttctaagactttgctaacttttaagtttgatacagtcaaaagtgttctcgacaaagaccgaaaagaagatgatacaaatgaatttgttagtgctgtgtgctggagggcactaccagatggggagtccaatgtgctgattgctgctaacagtcagggtacaattaaggtgctagaattggtatgaagggttaactcaagtcaaattgtacttgatcctgctgaaatacatctgcagctgacaatgagagaagaaacagaaaatgtcatgtgatgtctctccccaaagtcatcatgggttttggatttgttttgaatatttttttctttttttcttttccctcctttatgacctttgggacattgggaatacccagccaactctccaccatcaatgtaactccatggacattgctgctcttggtggtgttatctaatttttgtgatagggaaacaaattcttttgaataaaaataaataacaaaacaataaaagtttattgagccaca

SEQ ID NO: 300308 - DNA, 1636 bp, Homo sapiens
ataattttctattgtaggaatcacatgcagcccaactacagattcttatggaattcctcaaggttgcaagaagaaataagagagagtagtattattgattccacagaatacagccaacctccaggtttcagtggcagttctcagacaaagaaacagccttggtataatagcacgttagcatcaagacgaaaacgacttactgctcattttgaagacttggagcagtgttacttttctacaaggatgtctcgtatctcagatgacagtcgaactgcaagccagttggatgaatttcaggaatgcttgtccaagtttactcgatataattcagtacgacctttagccacattgtcatatgctagtgatctctataatggttccagtatagtctctagtattgaatttgaccgggattgtgactattttgcgattgctggagttacaaagaagattaaagtctatgaatatgacactgtcatccaggatgcagtggatattcattaccctgagaatgaaatgacctgcaattcgaaaatcagctgtatcagttggagtagttaccataagaacctgttagctagcagtgattatgaaggcactgttattttatgggatggattcacaggacagaggtcaaaggtctatcaggagcatgagaagaggtgttggagtgttgactttaatttgatggatcctaaactcttggcttcaggttctgatgatgcaaaagtgaagctgtggtctaccaatctagacaactcagtggcaagcattgaggcaaaggctaatgtgtgctgtgttaaattcagcccctcttccagataccatttggctttcggctgtgcagatcactgtgtccactactatgatcttcgtaacactaaacagccaatcatggtattcaaaggacaccgtaaagcagtctcttatgcaaagtttgtgagtggtgaggaaattgtctctgcctcaacagacagtcagctaaaactgtggaatgtagggaaaccatactgcctacgttccttcaagggtcatatcaatgaaaaaaactttgtaggcctggcttccaatggagattatatagcttgtggaagtgaaaataactctctctacctgtactataaaggactttctaagactttgctaacttttaagtttgatacagtcaaaagtgttctcgacaaagaccgaaaagaagatgatacaaatgaatttgttagtgctgtgtgctggagggcactaccagatggggagtccaatgtgctgattgctgctaacagtcagggtacaattaaggtgctagaattggtatgaagggttaactcaagtcaaattgtacttgatcctgctgaaatacatctgcagctgacaatgagagaagaaacagaaaatgtcatgtgatgtctctccccaaagtcatcatgggttttggatttgttttgaatatttttttctttttttcttttccctcctttatgacctttgggacattgggaatacccagccaactctccaccatcaatgtaactccatggacattgctgctcttggtggtgttatctaatttttgtgatagggaaacaaattcttttgaataaaaataaataacaaaacaataaaagtttattgagccaca

SEQ ID NO: 300309 - DNA, 3499 bp, Homo sapiens
  misc_feature (3153)..(3155): n is a, c, g, or t
  misc_feature (3157)..(3157): n is a, c, g, or t
  misc_feature (3176)..(3178): n is a, c, g, or t
  misc_feature (3197)..(3197): n is a, c, g, or t
ccattcattccagtctcctcaattctttcactgtattaagacggcctgccctctggcacgttttctggaacgaaagcggcttgggacagacagactcccttcgccagggagccccgaccccgagggcgcgccctgagcgtctgagcgcagccccgctgcgtccccagttgtatcccccgccacgcccgcctcttccgccgctcgcgcgcgcgcgcacggccggccacggcgcgccggggttggctgctacagggaccgcggtggcggcggcggcctcgacagcggtagtgccttctactccgcttttttagtttcctccgccccctcccgtgggacgctgttgtgtggctgccttaaaaaaaaacgcaactttattgttcctcagccccacctccggctcggcgggcgtcctcaggatgcactgaggctgaggggaggggaggcggcggagggtcgaggtcgcggtccctctcctccgagcgcccggctggaggggagggagtcacgatgtctggtagccgccaggccgggtcgggctccgctgggacaagccccgggtcctcggcggcctcctcggtgacttccgcctcctcgtctttatcctcttccccgtcgccgccttccgtggcggtttcggcggcagcgctggtgtccggcggggtggcccaggccgccggctcgggcggcctcgggggcccggtgcggcctgtgttggtggcgcccgccgtatcgggtagcggcggcggggcggtgtccacgggcctgtcccggcacagctgcgcggccaggcccagcgccggcgtaggaggcagcagctccagcctaggcagcggcagcaggaagcgacctctcctcgcccccctctgcaacgggctcatcaactcctacgaggacaaaagcaacgacttcgtatgccccatctgctttgatatgattgaagaagcatacatgacaaaatgtggccacagcttttgctacaagtgtattcatcagagtttggaggacaataatagatgtcccaagtgtaactatgttgtggacaatattgaccatctgtatcctaatttcttggtgaatgaactcattcttaaacagaagcaaagatttgaggaaaagaggttcaaattggaccactcagtgagtagcaccaatggccacaggtggcagatatttcaagattggttgggaactgaccaagataaccttgatttggccaatgtcaatcttatgttggagttactagtgcagaagaagaaacaactggaagcagaatcacatgcagcccaactacagattcttatggaattcctcaaggttgcaagaagaaataagagagagcaactggaacagatccagaaggagctaagtgttttggaagaggatattaagagagtggaagaaatgagtggcttatactctcctgtcagtgaggatagcacagtgcctcaatttgaagctccttctccatcacacagtagtattattgattccacagaatacagccaacctccaggtttcagtggcagttctcaggctggagtgcaatggcgctatcttggctcactgcaacctccacctcccaggtacaagcgattctcctgcctcaccctcccaagtagctgggattaccggcgcctgcctccacacctgacaaagaaacagccttggtataatagcacgttagcatcaagacgaaaacgacttactgctcattttgaagacttggagcagtgttacttttctacaaggatgtctcgtatctcagatgacagtcgaactgcaagccagttggatgaatttcaggaatgcttgtccaagtttactcgatataattcagtacgacctttagccacattgtcatatgctagtgatctctataatggttccagtatagtctctagtattgaatttgaccgggattgtgactattttgcgattgctggagttacaaagaagattaaagtctatgaatatgacactgtcatccaggatgcagtggatattcattaccctgagaatgaaatgacctgcaattcgaaaatcagctgtatcagttggagtagttaccataagaacctgttagctagcagtgattatgaaggcactgttattttatgggatggattcacaggacagaggtcaaaggtctatcaggagcatgagaagaggtgttggagtgttgactttaatttgatggatcctaaactcttggcttcaggttctgatgatgcaaaagtgaagctgtggtctaccaatctagacaactcagtggcaagcattgaggcaaaggctaatgtgtgctgtgttaaattcagcccctcttccagataccatttggctttcggctgtgcagatcactgtgtccactactatgatcttcgtaacactaaacagccaatcatggtattcaaaggacaccgtaaagcagtctcttatgcaaagtttgtgagtggtgaggaaattgtctctgcctcaacagacagtcagctaaaactgtggaatgtagggaaaccatactgcctacgttccttcaagggtcatatcaatgaaaaaaactttgtaggcctggcttccaatggagattatatagcttgtggaagtgaaaataactctctctacctgtactataaaggactttctaagactttgctaacttttaagtttgatacagtcaaaagtgttctcgacaaagaccgaaaagaagatgatacaaatgaatttgttagtgctgtgtgctggagggcactaccagatggggagtccaatgtgctgattgctgctaacagtcagggtacaattaaggtgctagaattggtatgaagggttaactcaagtcaaattgtacttgatcctgctgaaatacatctgcagctgacaatgagagaagaaacagaaaatgtcatgtgatgtctctccccaaagtcatcatgggttttggatttgttttgaatatttttttctttttttcttttccctcctttatgacctttgggacattgggaatacccagccaactctccaccatcaatgtaactccatggacattgctgctcttggtggtgttatctaatttttgtgatagggaaacaaattcttttgaataaaaataaataacaaaacaataaaagtttattgagccacaaaaaaaaaatnnnanaaactcgagtttttttttnnnttttttgtcgcagctgttntaattctcccacgcccctgtccagcaggaaaccccttatagcccaaatccttatcttggagtttctctttagccagggcagcacttgaaagaggttgatgtgatccactactccccagcttgttacaccaacttgaatgaaacgactttctttgggaactattaatgggccgccagaatcacctttgcaagtattgtggtcagcatagggactaattccttcagtccaaaggaacctcagggtgaccccctttggtgcccttgactttgcataacccggggcccttggccatttgtttcccg

SEQ ID NO: 300310 - DNA, 3087 bp, Homo sapiens
ccattcattccagtctcctcaattctttcactgtattaagacggcctgccctctggcacgttttctggaacgaaagcggcttgggacagacagactcccttcgccagggagccccgaccccgagggcgcgccctgagcgtctgagcgcagccccgctgcgtccccagttgtatcccccgccacgcccgcctcttccgccgctcgcgcgcgcgcgcacggccggccacggcgcgccggggttggctgctacagggaccgcggtggcggcggcggcctcgacagcggtagtgccttctactccgcttttttagtttcctccgccccctcccgtgggacgctgttgtgtggctgccttaaaaaaaaacgcaactttattgttcctcagccccacctccggctcggcgggcgtcctcaggatgcactgaggctgaggggaggggaggcggcggagggtcgaggtcgcggtccctctcctccgagcgcccggctggaggggagggagtcacgatgtctggtagccgccaggccgggtcgggctccgctgggacaagccccgggtcctcggcggcctcctcggtgacttccgcctcctcgtctttatcctcttccccgtcgccgccttccgtggcggtttcggcggcagcgctggtgtccggcggggtggcccaggccgccggctcgggcggcctcgggggcccggtgcggcctgtgttggtggcgcccgccgtatcgggtagcggcggcggggcggtgtccacgggcctgtcccggcacagctgcgcggccaggcccagcgccggcgtaggaggcagcagctccagcctaggcagcggcagcaggaagcgacctctcctcgcccccctctgcaacgggctcatcaactcctacgaggacaaaagcaacgacttcgtatgccccatctgctttgatatgattgaagaagcatacatgacaaaatgtggccacagcttttgctacaagtgtattcatcagagtttggaggacaataatagatgtcccaagtgtaactatgttgtggacaatattgaccatctgtatcctaatttcttggtgaatgaactcattcttaaacagaagcaaagatttgaggaaaagaggttcaaattggaccactcagtgagtagcaccaatggccacaggtggcagatatttcaagattggttgggaactgaccaagataaccttgatttggccaatgtcaatcttatgttggagttactagtgcagaagaagaaacaactggaagcagaatcacatgcagcccaactacagattcttatggaattcctcaaggttgcaagaagaaataagagagagcaactggaacagatccagaaggagctaagtgttttggaagaggatattaagagagtggaagaaatgagtggcttatactctcctgtcagtgaggatagcacagtgcctcaatttgaagctccttctccatcacacagtagtattattgattccacagaatacagccaacctccaggtttcagtggcagttctcaggctggagtgcaatggcgctatcttggctcactgcaacctccacctcccaggtacaagcgattctcctgcctcaccctcccaagtagctgggattaccggcgcctgcctccacacctgacaaagaaacagccttggtataatagcacgttagcatcaagacgaaaacgacttactgctcattttgaagacttggagcagtgttacttttctacaaggatgtctcgtatctcagatgacagtcgaactgcaagccagttggatgaatttcaggaatgcttgtccaagtttactcgatataattcagtacgacctttagccacattgtcatatgctagtgatctctataatggttccagtatagtctctagtattgaatttgaccgggattgtgactattttgcgattgctggagttacaaagaagattaaagtctatgaatatgacactgtcatccaggatgcagtggatattcattaccctgagaatgaaatgacctgcaattcgaaaatcagctgtatcagttggagtagttaccataagaacctgttagctagcagtgattatgaaggcactgttattttatgggatggattcacaggacagaggtcaaaggtctatcaggagcatgagaagaggtgttggagtgttgactttaatttgatggatcctaaactcttggcttcaggttctgatgatgcaaaagtgaagctgtggtctaccaatctagacaactcagtggcaagcattgaggcaaaggctaatgtgtgctgtgttaaattcagcccctcttccagataccatttggctttcggctgtgcagatcactgtgtccactactatgatcttcgtaacactaaacagccaatcatggtattcaaaggacaccgtaaagcagtctcttatgcaaagtttgtgagtggtgaggaaattgtctctgcctcaacagacagtcagctaaaactgtggaatgtagggaaaccatactgcctacgttccttcaagggtcatatcaatgaaaaaaactttgtaggcctggcttccaatggagattatatagcttgtggaagtgaaaataactctctctacctgtactataaaggactttctaagactttgctaacttttaagtttgatacagtcaaaagtgttctcgacaaagaccgaaaagaagatgatacaaatgaatttgttagtgctgtgtgctggagggcactaccagatggggagtccaatgtgctgattgctgctaacagtcagggtacaattaaggtgctagaattggtatgaagggttaactcaagtcaaattgtacttgatcctgctgaaatacatctgcagctgacaatgagagaagaaacagaaaatgtcatgtgatgtctctccccaaagtcatcatgggttttggatttgttttgaatatttttttctttttttcttttccctcctttatgacctttgggacattgggaatacccagccaactctccaccatcaatgtaactccatggacattgctgctcttggtggtatagggtgtataggcgatcctctaga

SEQ ID NO: 300311 - DNA, 842 bp, Homo sapiens
  misc_feature (21)..(22): n is a, c, g, or t
  misc_feature (25)..(25): n is a, c, g, or t
cgactctagaggactcccccnntcnagataccatttggctttcggctgtgcagatcactgtgtccactactatgatcttcgtaacactaaacagccaatcatggtattcaaaggacaccgtaaagcagtctcttatgcaaagtttgtgagtggtgaggaaattgtctctgcctcaacagacagtcagctaaaactgtggaatgtagggaaaccatactgcctacgttccttcaagggtcatatcaatgaaaaaaactttgtaggcctggcttccaatggagattatatagcttgtggaagtgaaaataactctctctacctgtactataaaggactttctaagactttgctaacttttaagtttgatacagtcaaaagtgttctcgacaaagaccgaaaagaagatgatacaaatgaatttgttagtgctgtgtgctggagggcactaccagatggggagtccaatgtgctgattgctgctaacagtcagggtacaattaaggtgctagaattggtatgaagggttaactcaagtcaaattgtacttgatcctgctgaaatacatctgcagctgacaatgagagaagaaacagaaaatgtcatgtgatgtctctccccaaagtcatcatgggttttggatttgttttgaatatttttttctttttttcttttccctcctttatgacctttgggacattgggaatacccagccaactctccaccatcaatgtaactccatggacattgctgctcttggtggtgttatctaatttttgtgatagggaaacaaattcttttgaataaaaataaataacaaaacaataaaagtttattgagccaca

SEQ ID NO: 300312 - DNA, 2806 bp, Homo sapiens
  misc_feature (2652)..(2652): n is a, c, g, or t
  misc_feature (2743)..(2743): n is a, c, g, or t
ccattcattccagtctcctcaattctttcactgtattaagacggcctgccctctggcacgttttctggaacgaaagcggcttgggacagacagactcccttcgccagggagccccgaccccgagggcgcgccctgagcgtctgagcgcagccccgctgcgtccccagttgtatcccccgccacgcccgcctcttccgccgctcgcgcgcgcgcgcacggccggccacggcgcgccggggttggctgctacagggaccgcggtggcggcggcggcctcgacagcggtagtgccttctactccgcttttttagtttcctccgccccctcccgtgggacgctgttgtgtggctgccttaaaaaaaaacgcaactttattgttcctcagccccacctccggctcggcgggcgtcctcaggatgcactgaggctgaggggaggggaggcggcggagggtcgaggtcgcggtccctctcctccgagcgcccggctggaggggagggagtcacgatgtctggtagccgccaggccgggtcgggctccgctgggacaagccccgggtcctcggcggcctcctcggtgacttccgcctcctcgtctttatcctcttccccgtcgccgccttccgtggcggtttcggcggcagcgctggtgtccggcggggtggcccaggccgccggctcgggcggcctcgggggcccggtgcggcctgtgttggtggcgcccgccgtatcgggtagcggcggcggggcggtgtccacgggcctgtcccggcacagctgcgcggccaggcccagcgccggcgtaggaggcagcagctccagcctaggcagcggcagcaggaagcgacctctcctcgcccccctctgcaacgggctcatcaactcctacgaggacaaaagcaacgacttcgtatgccccatctgctttgatatgattgaagaagcatacatgacaaaatgtggccacagcttttgctacaagtgtattcatcagagtttggaggacaataatagatgtcccaagtgtaactatgttgtggacaatattgaccatctgtatcctaatttcttggtgaatgaactcattcttaaacagaagcaaagatttgaggaaaagaggttcaaattggaccactcagtgagtagcaccaatggccacaggtggcagatatttcaagattggttgggaactgaccaagataaccttgatttggccaatgtcaatcttatgttggagttactagtgcagaagaagaaacaactggaagcagaatcacatgcagcccaactacagattcttatggaattcctcaaggttgcaagaagaaataagagagagcaactggaacagatccagaaggagctaagtgttttggaagaggatattaagagagtggaagaaatgagtggcttatactctcctgtcagtgaggatagcacagtgcctcaatttgaagctccttctccatcacacagtagtattattgattccacagaatacagccaacctccaggtttcagtggcagttctcagacaaagaaacagccttggtataatagcacgttagcatcaagacgaaaacgacttactgctcattttgaagacttggagcagtgttacttttctacaaggatgtctcgtatctcagatgacagtcgaactgcaagccagttggatgaatttcaggaatgcttgtccaagtttactcgatataattcagtacgacctttagccacattgtcatatgctagtgatctctataatggttccagtatagtctctagtattgaatttgaccgggattgtgactattttgcgattgctggagttacaaagaagattaaagtctatgaatatgacactgtcatccaggatgcagtggatattcattaccctgagaatgaaatgacctgcaattcgaaaatcagctgtatcagttggagtagttaccataagaacctgttagctagcagtgattatgaaggcactgttattttatgggatggattcacaggacagaggtcaaaggtctatcaggagcatgagaagaggtgttggagtgttgactttaatttgatggatcctaaactcttggcttcaggttctgatgatgcaaaagtgaagctgtggtctaccaatctagacaactcagtggcaagcattgaggcaaaggctaatgtgtgctgtgttaaattcagcccctcttccagataccatttggctttcggctgtgcagatcactgtgtccactactatgatcttcgtaacactaaacagccaatcatggtattcaaaggacaccgtaaagcagtctcttatgcaaagtttgtgagtggtgaggaaattgtctctgcctcaacagacagtcagctaaaactgtggaatgtagggaaaccatactgcctacgttccttcaagggtcatatcaatgaaaaaaactttgtaggcctggcttccaatggagattatatagcttgtggaagtgaaaataactctctctacctgtactataaaggactttctaagactttgctaacttttaagtttgatacagtcaaaagtgttctcgacaaagaccgaaaagaagatgatacaaatgaatttgttagtgctgtgtgctggagggcactaccagatggggagtccaatgtnctgattgctgctaacattcagagtgtgtgccctccgttgtcttgataaagggaggggagcacctcctgccgtctggccggtgccccttctngtggcagagcacccttgggtcagcgagcgcttttctgctcctgcaaagttcccgccagcctct

SEQ ID NO: 300313 - DNA, 2703 bp, Homo sapiens
ccattcattccagtctcctcaattctttcactgtattaagacggcctgccctctggcacgttttctggaacgaaagcggcttgggacagacagactcccttcgccagggagccccgaccccgagggcgcgccctgagcgtctgagcgcagccccgctgcgtccccagttgtatcccccgccacgcccgcctcttccgccgctcgcgcgcgcgcgcacggccggccacggcgcgccggggttggctgctacagggaccgcggtggcggcggcggcctcgacagcggtagtgccttctactccgcttttttagtttcctccgccccctcccgtgggacgctgttgtgtggctgccttaaaaaaaaacgcaactttattgttcctcagccccacctccggctcggcgggcgtcctcaggatgcactgaggctgaggggaggggaggcggcggagggtcgaggtcgcggtccctctcctccgagcgcccggctggaggggagggagtcacgatgtctggtagccgccaggccgggtcgggctccgctgggacaagccccgggtcctcggcggcctcctcggtgacttccgcctcctcgtctttatcctcttccccgtcgccgccttccgtggcggtttcggcggcagcgctggtgtccggcggggtggcccaggccgccggctcgggcggcctcgggggcccggtgcggcctgtgttggtggcgcccgccgtatcgggtagcggcggcggggcggtgtccacgggcctgtcccggcacagctgcgcggccaggcccagcgccggcgtaggaggcagcagctccagcctaggcagcggcagcaggaagcgacctctcctcgcccccctctgcaacgggctcatcaactcctacgaggacaaaagcaacgacttcgtatgccccatctgctttgatatgattgaagaagcatacatgacaaaatgtggccacagcttttgctacaagtgtattcatcagagtttggaggacaataatagatgtcccaagtgtaactatgttgtggacaatattgaccatctgtatcctaatttcttggtgaatgaactcattcttaaacagaagcaaagatttgaggaaaagaggttcaaattggaccactcagtgagtagcaccaatggccacaggtggcagatatttcaagattggttgggaactgaccaagataaccttgatttggccaatgtcaatcttatgttggagttactagtgcagaagaagaaacaactggaagcagaatcacatgcagcccaactacagattcttatggaattcctcaaggttgcaagaagaaataagagagagcaactggaacagatccagaaggagctaagtgttttggaagaggatattaagagagtggaagaaatgagtggcttatactctcctgtcagtgaggatagcacagtgcctcaatttgaagctccttctccatcacacagtagtattattgattccacagaatacagccaacctccaggtttcagtggcagttctcagacaaagaaacagccttggtataatagcacgttagcatcaagacgaaaacgacttactgctcattttgaagacttggagcagtgttacttttctacaaggatgtctcgtatctcagatgacagtcgaactgcaagccagttggatgaatttcaggaatgcttgtccaagtttactcgatataattcagtacgacctttagccacattgtcatatgctagtgatctctataatggttccagtatagtctctagtattgaatttgaccgggattgtgactattttgcgattgctggagttacaaagaagattaaagtctatgaatatgacactgtcatccaggatgcagtggatattcattaccctgagaatgaaatgacctgcaattcgaaaatcagctgtatcagttggagtagttaccataagaacctgttagctagcagtgattatgaaggcactgttattttatgggatggattcacaggacagaggtcaaaggtctatcaggagcatgagaagaggtgttggagtgttgactttaatttgatggatcctaaactcttggcttcaggttctgatgatgcaaaagtgaagctgtggtctaccaatctagacaactcagtggcaagcattgaggcaaaggctaatgtgtgctgtgttaaattcagcccctcttccagataccatttggctttcggctgtgcagatcactgtgtccactactatgatcttcgtaacactaaacagccaatcatggtattcaaaggacaccgtaaagcagtctcttatgcaaagtttgtgagtggtgaggaaattgtctctgcctcaacagacagtcagctaaaactgtggaatgtagggaaaccatactgcctacgttccttcaagggtcatatcaatgaaaaaaactttgtaggcctggcttccaatggagattatatagcttgtggttgagtgaaaccatcgtttccaggaactttttaacaggtgtttgttattgaaattgaactcagtggaaatagaataaatactaagtcaagaaatggtctgtgcactcagaagatagtataatagacatgatgccccagcactactgattttccttgtgttgtactagaagagcattagtccttcccttttttattgtgtagaaaccctgaacacctcaaatac

SEQ ID NO: 300314 - DNA, 306 bp, Homo sapiens
cattgggaatacccagccaactctccaccatcaatgtaactccatggacattgctgctcttggtggtgttatctaatttttgtgatagggaaacaaattcttttgaataaaaataaataacaaaacaataaaagtttattgagccacacagttgagcttggaaagtttttgtcaaatgcagcaagagataactctttttaagaagtagcatatgtgaactataatgtaacagtgaataatttgtaaagttcgtatttcccaacctctttgggaattacacatatcaatgtaaacaaaatataaagt

SEQ ID NO: 300315 - DNA, 518 bp, Homo sapiens
taataaattacccagtttcaggtatctttttattagcagtgcgagaacagacaaatacattcagctttaacacttttagtcctagtaaaccaaatgttttagagtggcacaaaaagatttctggagcaataagccaactttcccaagttacagaagcatttactaatgtattacttgtttctctttttgtttttattgtcctttgcccttagtgaagctgtggtctaccaatctagacaactcagtggcaagcattgaggcaaaggctaatgtgtgctgtgttaaattcagcccctcttccagataccatttggctttcggctgtgcaggtaagaaatgaaagcagatttgtcttcctttgatgttggttaaatatcatggtaaggataggagagcattttaaaacaaataactcttttgtaggtttaaatgttgtttttattattaggctctaaattagaagtatacagtatgccatcattactcatttagtgctgtaccttaattgcactattctg

SEQ ID NO: 300316 - DNA, 644 bp, Homo sapiens
aaaaaacatgccagggagcgggggtgacaaaagcctgatatgtcttttgaatgcttgaatccagggagaaaacatggagatatgaatgactgtgtggagcagaacccaccttctcccagctcagctttggactgtgaggtgacagaaataaacatttgttgtgctaagccactgagattttgagtcataacagctgttagcatcaatgattctgactaatacagtagcccaccatatgattgttcactagtatgtctaaaattccagggctgtgatcaaccactctccccgtccccactctgacagttaattgacctgtgaatttgccttttatgtaaattctctttctatccttactgcattattgtatttcagcctttggtttcctgacagatgtaattgtcctgtgtgtcctttctccaggcagagtgatgttcctggaatgttcatctaatcatatcatgcatctgtttgtaactttctttcttcaaccttatctcctgctagtccctgctatacctctctatgcttggaacatatttttctttagcccttgttttccaaggactgaatctgtctcatcttttgggggctctgtgtaaatattcctttatccagtaagcctgccaaagaacatttagtct

SEQ ID NO: 300317 - DNA, 410 bp, Homo sapiens
gctgtgaagttcaagatcaagatgccggaactcagtgtctcataagggctttcttgctgtgtcctcatgtaaccatccaataggtttttcttgccggcagaggcgcggggaaacctggcgtactggctgtggcttctctagcgggactcggcatgaggctggcgcggctgcttcgcggagccgccttggccggcccgggcccggggctgcgcgccgccggcttcagccgcagcttcagctcggactcgggctccagcccggcgtccgagcgcggcgttccgggccaggtggacttctacgcgcgcttctcgccgtccccgctctccatgaagcagttcctggacttcggtgagtgcggcccgggaccttgggcctttttgcgcggtcccgggcggggagctgcggccgct

SEQ ID NO: 300318 - DNA, 4518 bp, Homo sapiens
gatccccgcccctgctgcccgccacgtccctcacgtaccactcggcagaggcgcggggaaacctggcgtactggctgtggcttctctagcgggactcggcatgaggctggcgcggctgcttcgcggagccgccttggccggcccgggcccggggctgcgcgccgccggcttcagccgcagcttcagctcggactcgggctccagcccggcgtccgagcgcggcgttccgggccaggtggacttctacgcgcgcttctcgccgtccccgctctccatgaagcagttcctggacttcggatcagtgaatgcttgtgaaaagacctcatttatgtttctgcggcaagagttgcctgtcagactggcaaatataatgaaagaaataagtctccttccagataatcttctcaggacaccatccgttcaattggtacaaagctggtatatccagagtcttcaggagcttcttgattttaaggacaaaagtgctgaggatgctaaagctatttatgactttacagatactgtgatacggatcagaaaccgacacaatgatgtcattcccacaatggcccagggtgtgattgaatacaaggagagctttggggtggatcctgtcaccagccagaatgttcagtactttttggatcgattctacatgagtcgcatttcaattagaatgttactcaatcagcactctttattgtttggtggaaaaggcaaaggaagtccatctcatcgaaaacacattggaagcataaatccaaactgcaatgtacttgaagttattaaagatggctatgaaaatgctaggcgtctgtgtgatttgtattatattaactctcccgaactagaacttgaagaactaaatgcaaaatcaccaggacagccaatacaagtggtttatgtaccatcccatctctatcacatggtgtttgaacttttcaagaatccattttcttaccttagatgagtgaccgaggaggtggcgttcctttgaggaaaattgacagacttttcaactacatgtattcaactgcaccaagacctcgtgttgagacctcccgcgcagtgcctctggctggttttggttatggattgcccatatcacgtctttacgcacaatacttccaaggagacctgaagctgtattccctagagggttacgggacagatgcagttatctacattaaggctctgtcaacagactcaatagaaagactcccagtgtataacaaagctgcctggaagcattacaacaccaaccacgaggctgatgactggtgcgtccccagcagagaacccaaagacatgacgacgttccgcagtgcctagacacacttgggacatcggaaaatccaaatgtggcttttgtattaaatttggaaggtatggtgttcagaactatattataccaagtactttatttatcgttttcacaaaactatttgagtagaataaatggaaactgaattccatttgtgcccgttaaacctcctaaaggatgaaattgcacctattttacacttatattttcacagttaattgaacatatttttaaacaactgtagttttgggcaacttttcactttgtggtagacttcagaagtgtggaaatcttcgggtttctataggaaactagtttttttttttttaagaaatactttcatttatgtttgctagaaacattttctaaatgatagtgattagctggttagccatcttcctgttatttggaggagttctgccatcttttattcggtagtgacagctgtaatatggtcttcatgtttatcagtgacttgactacaagtaaagcagaaaacagttggcctgtaatcacagaaccagccacccttcggcgtctacatgcattgtcttagctctgaggttaatttaccatttttaaattttattgtaaagaagtgtaatgactagctctctgtggatctatgccaaaatcatgggccatcttttctaagtgtacttctgattaatgcaaggggaaatttttatactgaaaacaaacaaacaaactagcagctactaaaatagagaagaaattgagggcaaagtaatatgtctccaaaactgaactgattgcttgttgagattacctagaaagcttttggaaaaaaatagagcttttctgcatcctactccagatacactgaatcggaatccctagggctagagcctagaaatctcactttttaaaatgcttccaaggtaagtctgatgcctaccctaggttgggaaccactctttcaaagtaaacagtgatgacacagcatttgctaaagtaacatctgtaggttttggtttccacctatttaaagtcagatttatagactcgaggagacagaaactgaatcccacacctggtgcaattagaagcataattagaagcagaagaacaaaatgccacgtaaccaaagcatcagagccatcattgcacgtgtctttttttcttttttcttttttttttttcaagacagggtctcgctcttttgcccaggatggagtacagtggcatggtcaaggctcactgcagcttcaatcttctgggctcaagtaatccttccacctcagcctcccatatagctggaactacagttgtgcactaccacacccagctaattttttgatttcttgtggagatgaggtctcagtatgttcccaggctagtgttgaactcctgagctcaagaaatcctcctgcctgagtctctgaaagtgctgggattacaggcgtgaccccacacatggcctattgcacaagtcttgacaaacaacatatattttctaaaactatccagatttcattatcagggaaaagtttgcttaggtttattacagcagtcctttgcatttgtatggtaatttgtactttacaaatactttgatatattataactctattggtctttgaaacaaagcgatacagtgtaggtggtatcattctctttctcactcagtgtggcccagagttgctcagaattggagcagagcctgagacgtatctgcagatcctgtcatcagctggcaagtccaggagactgtgtcatttagagactgtgttgttagttatccctcaacatcttctaaggtggcaggaaataatattggaaataacattttaaagtaaaaattttaaagtttaaagaagagttttgccacttaaacaggggagctttgtctggaaaatacactgagttgaaacacttcatccttggaaggattatataagatgaacagttgtgataaatgtgtagattagagggatgtgaatgggcagttagtccagtgccctcatttaagaggccaagatcctgattcagaggaggcatcctttgcccagagctgcttagctaatctgaccaaatgttgggaaaaatgtctcacctaacccactattccttaattatggattttgtgaaaaacaatagaacatgttaatgagtaatttatattagttcgatgtattacaattttttagctttaaattacagttttcttataatgttgaaatgttttagaatcctttgaatctaagtatttgtttcctaaatgaaacatttgtacaacatttgatgtttttacttatgaaatattctcctcccccaagaaaatttaaactttttctctctatttaaaagctaagaaatgttttaaaggaaaaatgaaattatcttcctttagcttatttttaaggtaaaacagctttttactctgttattgtggtaatggacagaatattacatacaaaaatattctgggagagctttttcctagttggttttaaatcattgtgccacctgaaaggtttttagattttataggagctaatttgtccaccagcattaatgtaacacagtgtagttatgaaaatatattgaaggacaggaagtggacacgaagtgatttttgtaacctgagcagttaatgaatgtgccaacattttctaggaagggacagcaagaatattctgctctgtagttaaaatactggctggcttttgatgtcttcatgcttaattgtgatcactttcttgcactgtgatgtttttacgtgaatatgttgaagtagaagtctaccatattattttataaaatgttttctgtatggcaataaactgaaaacatggatcaacccttcttttgaaaataaactgagtcaatttagccttttaaaaatatagtcatctcttttaaatagaatcctcttccaccatcaaggctcaacattttgtaagcatccaaaaaattggtaattagggggcttgcactaaatttcactatcttcagtagagaggaactgtttggaacttagatttccaatgtgtatattctaatggagaaagcaagaggtagagtttgtatgtttgacttaccttagatttttattttccatacatactgcaaatgattgacttgttgcataaatgaagatcttctgttgtgtgcttttcaaacactgtaaataaatttgaaatttgaataactttccacagtataactgt

SEQ ID NO: 300319 - DNA, 4176 bp, Homo sapiens
  misc_feature (8)..(8): n is a, c, g, or t
acccgcangctatccggttcaattggtacaaagctggtatatccagagtcttcaggagcttcttgattttaaggacaaaagtgctgaggatgctaaagctatttatgaaaggcctagaagaacatggttgcaggtctctagtttatgctgtatggcctgcaagatgatctttacagatactgtgatacggatcagaaaccgacacaatgatgtcattcccacaatggcccagggtgtgattgaatacaaggagagctttggggtggatcctgtcaccagccagaatgttcagtactttttggatcgattctacatgagtcgcatttcaattagaatgttactcaatcagcactctttattgtttggtggaaaaggcaaaggaagtccatctcatcgaaaacacattggaagcataaatccaaactgcaatgtacttgaagttattaaagatggctatgaaaatgctaggcgtctgtgtgatttgtattatattaactctcccgaactagaacttgaagaactaaatgcaaaatcaccaggacagccaatacaagtggtttatgtaccatcccatctctatcacatggtgtttgaacttttcaagaatccattttcttaccttagatgagtgaccgaggaggtggcgttcctttgaggaaaattgacagacttttcaactacatgtattcaactgcaccaagacctcgtgttgagacctcccgcgcagtgcctctggctggttttggttatggattgcccatatcacgtctttacgcacaatacttccaaggagacctgaagctgtattccctagagggttacgggacagatgcagttatctacattaaggctctgtcaacagactcaatagaaagactcccagtgtataacaaagctgcctggaagcattacaacaccaaccacgaggctgatgactggtgcgtccccagcagagaacccaaagacatgacgacgttccgcagtgcctagacacacttgggacatcggaaaatccaaatgtggcttttgtattaaatttggaaggtatggtgttcagaactatattataccaagtactttatttatcgttttcacaaaactatttgagtagaataaatggaaactgaattccatttgtgcccgttaaacctcctaaaggatgaaattgcacctattttacacttatattttcacagttaattgaacatatttttaaacaactgtagttttgggcaacttttcactttgtggtagacttcagaagtgtggaaatcttcgggtttctataggaaactagtttttttttttttaagaaatactttcatttatgtttgctagaaacattttctaaatgatagtgattagctggttagccatcttcctgttatttggaggagttctgccatcttttattcggtagtgacagctgtaatatggtcttcatgtttatcagtgacttgactacaagtaaagcagaaaacagttggcctgtaatcacagaaccagccacccttcggcgtctacatgcattgtcttagctctgaggttaatttaccatttttaaattttattgtaaagaagtgtaatgactagctctctgtggatctatgccaaaatcatgggccatcttttctaagtgtacttctgattaatgcaaggggaaatttttatactgaaaacaaacaaacaaactagcagctactaaaatagagaagaaattgagggcaaagtaatatgtctccaaaactgaactgattgcttgttgagattacctagaaagcttttggaaaaaaatagagcttttctgcatcctactccagatacactgaatcggaatccctagggctagagcctagaaatctcactttttaaaatgcttccaaggtaagtctgatgcctaccctaggttgggaaccactctttcaaagtaaacagtgatgacacagcatttgctaaagtaacatctgtaggttttggtttccacctatttaaagtcagatttatagactcgaggagacagaaactgaatcccacacctggtgcaattagaagcataattagaagcagaagaacaaaatgccacgtaaccaaagcatcagagccatcattgcacgtgtctttttttcttttttcttttttttttttcaagacagggtctcgctcttttgcccaggatggagtacagtggcatggtcaaggctcactgcagcttcaatcttctgggctcaagtaatccttccacctcagcctcccatatagctggaactacagttgtgcactaccacacccagctaattttttgatttcttgtggagatgaggtctcagtatgttcccaggctagtgttgaactcctgagctcaagaaatcctcctgcctgagtctctgaaagtgctgggattacaggcgtgaccccacacatggcctattgcacaagtcttgacaaacaacatatattttctaaaactatccagatttcattatcagggaaaagtttgcttaggtttattacagcagtcctttgcatttgtatggtaatttgtactttacaaatactttgatatattataactctattggtctttgaaacaaagcgatacagtgtaggtggtatcattctctttctcactcagtgtggcccagagttgctcagaattggagcagagcctgagacgtatctgcagatcctgtcatcagctggcaagtccaggagactgtgtcatttagagactgtgttgttagttatccctcaacatcttctaaggtggcaggaaataatattggaaataacattttaaagtaaaaattttaaagtttaaagaagagttttgccacttaaacaggggagctttgtctggaaaatacactgagttgaaacacttcatccttggaaggattatataagatgaacagttgtgataaatgtgtagattagagggatgtgaatgggcagttagtccagtgccctcatttaagaggccaagatcctgattcagaggaggcatcctttgcccagagctgcttagctaatctgaccaaatgttgggaaaaatgtctcacctaacccactattccttaattatggattttgtgaaaaacaatagaacatgttaatgagtaatttatattagttcgatgtattacaattttttagctttaaattacagttttcttataatgttgaaatgttttagaatcctttgaatctaagtatttgtttcctaaatgaaacatttgtacaacatttgatgtttttacttatgaaatattctcctcccccaagaaaatttaaactttttctctctatttaaaagctaagaaatgttttaaaggaaaaatgaaattatcttcctttagcttatttttaaggtaaaacagctttttactctgttattgtggtaatggacagaatattacatacaaaaatattctgggagagctttttcctagttggttttaaatcattgtgccacctgaaaggtttttagattttataggagctaatttgtccaccagcattaatgtaacacagtgtagttatgaaaatatattgaaggacaggaagtggacacgaagtgatttttgtaacctgagcagttaatgaatgtgccaacattttctaggaagggacagcaagaatattctgctctgtagttaaaatactggctggcttttgatgtcttcatgcttaattgtgatcactttcttgcactgtgatgtttttacgtgaatatgttgaagtagaagtctaccatattattttataaaatgttttctgtatggcaataaactgaaaacatggatcaacccttcttttgaaaataaactgagtcaatttagccttttaaaaatatagtcatctcttttaaatagaatcctcttccaccatcaaggctcaacattttgtaagcatccaaaaaattggtaattagggggcttgcactaaatttcactatcttcagtagagaggaactgtttggaacttagatttccaatgtgtatattctaatggagaaagcaagaggtagagtttgtatgtttgacttaccttagatttttattttccatacatactgcaaatgattgacttgttgcataaatgaagatcttctgttgtgtgcttttcaaacactgtaaataaatttgaaatttgaataactttccacagtataactgt

SEQ ID NO: 300320 - DNA, 4003 bp, Homo sapiens
tgtggaatttaaagattttaacacttctctatttggaaagtaaaattcctacccgaaagttaagcgatcttaaaaaagactttaccatcctagagaaaaatgggcgcatgggttggttcgattgtgatgcaagattgtgagaagtgaccacaggactcttgtcatcatcagttgtaaatatttgtgggtatgggttcaaacactaatacattgaagaaatggtgtggcagttctcccccaggtaatactgtcctccgtagttaatgttttcttttcatcactacacagtttattcttaaaaatgctttaagcacatctctctgtactttcatatttttctcttctgctctgtagcaaaatcaccaggacagccaatacaagtggtttatgtaccatcccatctctatcacatggtgtttgaacttttcaagaatccattttcttaccttagatgagtgaccgaggaggtggcgttcctttgaggaaaattgacagacttttcaactacatgtattcaactgcaccaagacctcgtgttgagacctcccgcgcagtgcctctggctggttttggttatggattgcccatatcacgtctttacgcacaatacttccaaggagacctgaagctgtattccctagagggttacgggacagatgcagttatctacattaaggctctgtcaacagactcaatagaaagactcccagtgtataacaaagctgcctggaagcattacaacaccaaccacgaggctgatgactggtgcgtccccagcagagaacccaaagacatgacgacgttccgcagtgcctagacacacttgggacatcggaaaatccaaatgtggcttttgtattaaatttggaaggtatggtgttcagaactatattataccaagtactttatttatcgttttcacaaaactatttgagtagaataaatggaaactgaattccatttgtgcccgttaaacctcctaaaggatgaaattgcacctattttacacttatattttcacagttaattgaacatatttttaaacaactgtagttttgggcaacttttcactttgtggtagacttcagaagtgtggaaatcttcgggtttctataggaaactagtttttttttttttaagaaatactttcatttatgtttgctagaaacattttctaaatgatagtgattagctggttagccatcttcctgttatttggaggagttctgccatcttttattcggtagtgacagctgtaatatggtcttcatgtttatcagtgacttgactacaagtaaagcagaaaacagttggcctgtaatcacagaaccagccacccttcggcgtctacatgcattgtcttagctctgaggttaatttaccatttttaaattttattgtaaagaagtgtaatgactagctctctgtggatctatgccaaaatcatgggccatcttttctaagtgtacttctgattaatgcaaggggaaatttttatactgaaaacaaacaaacaaactagcagctactaaaatagagaagaaattgagggcaaagtaatatgtctccaaaactgaactgattgcttgttgagattacctagaaagcttttggaaaaaaatagagcttttctgcatcctactccagatacactgaatcggaatccctagggctagagcctagaaatctcactttttaaaatgcttccaaggtaagtctgatgcctaccctaggttgggaaccactctttcaaagtaaacagtgatgacacagcatttgctaaagtaacatctgtaggttttggtttccacctatttaaagtcagatttatagactcgaggagacagaaactgaatcccacacctggtgcaattagaagcataattagaagcagaagaacaaaatgccacgtaaccaaagcatcagagccatcattgcacgtgtctttttttcttttttcttttttttttttcaagacagggtctcgctcttttgcccaggatggagtacagtggcatggtcaaggctcactgcagcttcaatcttctgggctcaagtaatccttccacctcagcctcccatatagctggaactacagttgtgcactaccacacccagctaattttttgatttcttgtggagatgaggtctcagtatgttcccaggctagtgttgaactcctgagctcaagaaatcctcctgcctgagtctctgaaagtgctgggattacaggcgtgaccccacacatggcctattgcacaagtcttgacaaacaacatatattttctaaaactatccagatttcattatcagggaaaagtttgcttaggtttattacagcagtcctttgcatttgtatggtaatttgtactttacaaatactttgatatattataactctattggtctttgaaacaaagcgatacagtgtaggtggtatcattctctttctcactcagtgtggcccagagttgctcagaattggagcagagcctgagacgtatctgcagatcctgtcatcagctggcaagtccaggagactgtgtcatttagagactgtgttgttagttatccctcaacatcttctaaggtggcaggaaataatattggaaataacattttaaagtaaaaattttaaagtttaaagaagagttttgccacttaaacaggggagctttgtctggaaaatacactgagttgaaacacttcatccttggaaggattatataagatgaacagttgtgataaatgtgtagattagagggatgtgaatgggcagttagtccagtgccctcatttaagaggccaagatcctgattcagaggaggcatcctttgcccagagctgcttagctaatctgaccaaatgttgggaaaaatgtctcacctaacccactattccttaattatggattttgtgaaaaacaatagaacatgttaatgagtaatttatattagttcgatgtattacaattttttagctttaaattacagttttcttataatgttgaaatgttttagaatcctttgaatctaagtatttgtttcctaaatgaaacatttgtacaacatttgatgtttttacttatgaaatattctcctcccccaagaaaatttaaactttttctctctatttaaaagctaagaaatgttttaaaggaaaaatgaaattatcttcctttagcttatttttaaggtaaaacagctttttactctgttattgtggtaatggacagaatattacatacaaaaatattctgggagagctttttcctagttggttttaaatcattgtgccacctgaaaggtttttagattttataggagctaatttgtccaccagcattaatgtaacacagtgtagttatgaaaatatattgaaggacaggaagtggacacgaagtgatttttgtaacctgagcagttaatgaatgtgccaacattttctaggaagggacagcaagaatattctgctctgtagttaaaatactggctggcttttgatgtcttcatgcttaattgtgatcactttcttgcactgtgatgtttttacgtgaatatgttgaagtagaagtctaccatattattttataaaatgttttctgtatggcaataaactgaaaacatggatcaacccttcttttgaaaataaactgagtcaatttagccttttaaaaatatagtcatctcttttaaatagaatcctcttccaccatcaaggctcaacattttgtaagcatccaaaaaattggtaattagggggcttgcactaaatttcactatcttcagtagagaggaactgtttggaacttagatttccaatgtgtatattctaatggagaaagcaagaggtagagtttgtatgtttgacttaccttagatttttattttccatacatactgcaaatgattgacttgttgcataaatgaagatcttctgttgtgtgcttttcaaacactgtaaataaatttgaaatttgaataactttccacagtataactgt

SEQ ID NO: 300321 - DNA, 3393 bp, Homo sapiens
  misc_feature (8)..(8): n is a, c, g, or t
acccgcangctatccggttcaattggtacaaagctggtatatccagagtcttcaggagcttcttgattttaaggacaaaagtgctgaggatgctaaagctatttatgaaaggcctagaagaacatggttgcaggtctctagtttatgctgtatggcctgcaagatgatctttacagatactgtgatacggatcagaaaccgacacaatgatgtcattcccacaatggcccagggtgtgattgaatacaaggagagctttggggtggatcctgtcaccagccagaatgttcatactttatttatcgttttcacaaaactatttgagtagaataaatggaaactgaattccatttgtgcccgttaaacctcctaaaggatgaaattgcacctattttacacttatattttcacagttaattgaacatatttttaaacaactgtagttttgggcaacttttcactttgtggtagacttcagaagtgtggaaatcttcgggtttctataggaaactagtttttttttttttaagaaatactttcatttatgtttgctagaaacattttctaaatgatagtgattagctggttagccatcttcctgttatttggaggagttctgccatcttttattcggtagtgacagctgtaatatggtcttcatgtttatcagtgacttgactacaagtaaagcagaaaacagttggcctgtaatcacagaaccagccacccttcggcgtctacatgcattgtcttagctctgaggttaatttaccatttttaaattttattgtaaagaagtgtaatgactagctctctgtggatctatgccaaaatcatgggccatcttttctaagtgtacttctgattaatgcaaggggaaatttttatactgaaaacaaacaaacaaactagcagctactaaaatagagaagaaattgagggcaaagtaatatgtctccaaaactgaactgattgcttgttgagattacctagaaagcttttggaaaaaaatagagcttttctgcatcctactccagatacactgaatcggaatccctagggctagagcctagaaatctcactttttaaaatgcttccaaggtaagtctgatgcctaccctaggttgggaaccactctttcaaagtaaacagtgatgacacagcatttgctaaagtaacatctgtaggttttggtttccacctatttaaagtcagatttatagactcgaggagacagaaactgaatcccacacctggtgcaattagaagcataattagaagcagaagaacaaaatgccacgtaaccaaagcatcagagccatcattgcacgtgtctttttttcttttttcttttttttttttcaagacagggtctcgctcttttgcccaggatggagtacagtggcatggtcaaggctcactgcagcttcaatcttctgggctcaagtaatccttccacctcagcctcccatatagctggaactacagttgtgcactaccacacccagctaattttttgatttcttgtggagatgaggtctcagtatgttcccaggctagtgttgaactcctgagctcaagaaatcctcctgcctgagtctctgaaagtgctgggattacaggcgtgaccccacacatggcctattgcacaagtcttgacaaacaacatatattttctaaaactatccagatttcattatcagggaaaagtttgcttaggtttattacagcagtcctttgcatttgtatggtaatttgtactttacaaatactttgatatattataactctattggtctttgaaacaaagcgatacagtgtaggtggtatcattctctttctcactcagtgtggcccagagttgctcagaattggagcagagcctgagacgtatctgcagatcctgtcatcagctggcaagtccaggagactgtgtcatttagagactgtgttgttagttatccctcaacatcttctaaggtggcaggaaataatattggaaataacattttaaagtaaaaattttaaagtttaaagaagagttttgccacttaaacaggggagctttgtctggaaaatacactgagttgaaacacttcatccttggaaggattatataagatgaacagttgtgataaatgtgtagattagagggatgtgaatgggcagttagtccagtgccctcatttaagaggccaagatcctgattcagaggaggcatcctttgcccagagctgcttagctaatctgaccaaatgttgggaaaaatgtctcacctaacccactattccttaattatggattttgtgaaaaacaatagaacatgttaatgagtaatttatattagttcgatgtattacaattttttagctttaaattacagttttcttataatgttgaaatgttttagaatcctttgaatctaagtatttgtttcctaaatgaaacatttgtacaacatttgatgtttttacttatgaaatattctcctcccccaagaaaatttaaactttttctctctatttaaaagctaagaaatgttttaaaggaaaaatgaaattatcttcctttagcttatttttaaggtaaaacagctttttactctgttattgtggtaatggacagaatattacatacaaaaatattctgggagagctttttcctagttggttttaaatcattgtgccacctgaaaggtttttagattttataggagctaatttgtccaccagcattaatgtaacacagtgtagttatgaaaatatattgaaggacaggaagtggacacgaagtgatttttgtaacctgagcagttaatgaatgtgccaacattttctaggaagggacagcaagaatattctgctctgtagttaaaatactggctggcttttgatgtcttcatgcttaattgtgatcactttcttgcactgtgatgtttttacgtgaatatgttgaagtagaagtctaccatattattttataaaatgttttctgtatggcaataaactgaaaacatggatcaacccttcttttgaaaataaactgagtcaatttagccttttaaaaatatagtcatctcttttaaatagaatcctcttccaccatcaaggctcaacattttgtaagcatccaaaaaattggtaattagggggcttgcactaaatttcactatcttcagtagagaggaactgtttggaacttagatttccaatgtgtatattctaatggagaaagcaagaggtagagtttgtatgtttgacttaccttagatttttattttccatacatactgcaaatgattgacttgttgcataaatgaagatcttctgttgtgtgcttttcaaacactgtaaataaatttgaaatttgaataactttccacagtataactgt

SEQ ID NO: 300322 - DNA, 2162 bp, Homo sapiens
gatccccgcccctgctgcccgccacgtccctcacgtaccactcggcagaggcgcggggaaacctggcgtactggctgtggcttctctagcgggactcggcatgaggctggcgcggctgcttcgcggagccgccttggccggcccgggcccggggctgcgcgccgccggcttcagccgcagcttcagctcggactcgggctccagcccggcgtccgagcgcggcgttccgggccaggtggacttctacgcgcgcttctcgccgtccccgctctccatgaagcagttcctggacttcggatcagtgaatgcttgtgaaaagacctcatttatgtttctgcggcaagagttgcctgtcagactggcaaatataatgaaagaaataagtctccttccagataatcttctcaggacaccatccgttcaattggtacaaagctggtatatccagagtcttcaggagcttcttgattttaaggacaaaagtgctgaggatgctaaagctatttatgactttacagatactgtgatacggatcagaaaccgacacaatgatgtcattcccacaatggcccagggtgtgattgaatacaaggagagctttggggtggatcctgtcaccagccagaatgttcagtactttttggatcgattctacatgagtcgcatttcaattagaatgttactcaatcagcactctttattgtttggtggaaaaggcaaaggaagtccatctcatcgaaaacacattggaagcataaatccaaactgcaatgtacttgaagttattaaagatggctatgaaaatgctaggcgtctgtgtgatttgtattatattaactctcccgaactagaacttgaagaactaaatgcaaaatcaccaggacagccaatacaagtggtttatgtaccatcccatctctatcacatggtgtttgaacttttcaagaatccattttcttaccttagatgagtgaccgaggaggtggcgttcctttgaggaaaattgacagacttttcaactacatgtattcaactgcaccaagacctcgtgttgagacctcccgcgcagtgcctctggctggttttggttatggattgcccatatcacgtctttacgcacaatacttccaaggagacctgaagctgtattccctagagggttacgggacagatgcagttatctacattaaggctctgtcaacagactcaatagaaagactcccagtgtataacaaagctgcctggaagcattacaacaccaaccacgaggctgatgactggtgcgtccccagcagagaacccaaagacatgacgacgttccgcagtgcctagacacacttgggacatcggaaaatccaaatgtggcttttgtattaaatttggaagattcttcagttttgggacttggactggctttccttgcccctcagcttgcagatggcctgttgtgggaccttgtgatcatgaactcctcctcccacatctgatggagctaccaatcatcagatctcctctgcctctggggtgcgtctcaggctggccaatcacgttcttcatccacgtggactatgactggccctagggagaaaacatggagatatgaatgactgtgtggagcagaacccaccttctcccagctcagctttggactgtgaggtgacagaaataaacatttgttgtgctaagccactgagattttgagtcataacagctgttagcatcaatgattctgactaatacagtagcccaccatatgattgttcactagtatgtctaaaattccagggctgtgatcaaccactctccccgtccccactctgacagttaattgacctgtgaatttgccttttatgtaaattctctttctatccttactgcattattgtatttcagcctttggtttcctgacagatgtaattgtcctgtgtgtcctttctccaggcagagtgatgttcctggaatgttcatctaatcatatcatgcatctgtttgtaactttctttcttcaaccttatctcctgctagtccctgctatacctctctatgcttggaacatatttttctttagcccttgttttccaaggactgaatctgtctcatcttttgggggctctgtgtaaatattcctttatccagtaagcctgccaaagaacatttagtct

SEQ ID NO: 300323 - DNA, 1679 bp, Homo sapiens
gatccccgcccctgctgcccgccacgtccctcacgtaccactcggcagaggcgcggggaaacctggcgtactggctgtggcttctctagcgggactcggcatgaggctggcgcggctgcttcgcggagccgccttggccggcccgggcccggggctgcgcgccgccggcttcagccgcagcttcagctcggactcgggctccagcccggcgtccgagcgcggcgttccgggccaggtggacttctacgcgcgcttctcgccgtccccgctctccatgaagcagttcctggacttcggatcagtgaatgcttgtgaaaagacctcatttatgtttctgcggcaagagttgcctgtcagactggcaaatataatgaaagaaataagtctccttccagataatcttctcaggacaccatccgttcaattggtacaaagctggtatatccagagtcttcaggagcttcttgattttaaggacaaaagtgctgaggatgctaaagctatttatgactttacagatactgtgatacggatcagaaaccgacacaatgatgtcattcccacaatggcccagggtgtgattgaatacaaggagagctttggggtggatcctgtcaccagccagaatgttcagtactttttggatcgattctacatgagtcgcatttcaattagaatgttactcaatcagcactctttattgtttggtggaaaaggcaaaggaagtccatctcatcgaaaacacattggaagcataaatccaaactgcaatgtacttgaagttattaaagatggctatgaaaatgctaggcgtctgtgtgatttgtattatattaactctcccgaactagaacttgaagaactaaatgcaaaatcaccaggacagccaatacaagtggtttatgtaccatcccatctctatcacatggtgtttgaacttttcaagaatgcaatgagagccactatggaacaccatgccaacagaggtgtttacccccctattcaagttcatgtcacgctgggtaatgaggatttgactgtgaagatgagtgaccgaggaggtggcgttcctttgaggaaaattgacagacttttcaactacatgtattcaactgcaccaagacctcgtgttgagacctcccgcgcagtgcctctggctggttttggttatggattgcccatatcacgtctttacgcacaatacttccaaggagacctgaagctgtattccctagagggttacgggacagatgcagttatctacattaaggctctgtcaacagactcaatagaaagactcccagtgtataacaaagctgcctggaagcattacaacaccaaccacgaggctgatgactggtgcgtccccagcagagaacccaaagacatgacgacgttccgcagtgcctagacacacttgggacatcggaaaatccaaatgtggcttttgtattaaatttggaagaaaccgaaccctcaccaaacagatctgcttgcacatccacttgcacgtagacctcagataagtgagatctgggacctgaactctgaccaccatcttttgttctaaatttcttcccgcggggcgtggagaaagtcacacccatgagctggacctaacattcttttctgctgaccccaaattattaaaccttctcaaaccaattgcaaatcagaaa

SEQ ID NO: 300324 - DNA, 1371 bp, Homo sapiens
gatccccgcccctgctgcccgccacgtccctcacgtaccactcggcagaggcgcggggaaacctggcgtactggctgtggcttctctagcgggactcggcatgaggctggcgcggctgcttcgcggagccgccttggccggcccgggcccggggctgcgcgccgccggcttcagccgcagcttcagctcggactcgggctccagcccggcgtccgagcgcggcgttccgggccaggtggacttctacgcgcgcttctcgccgtccccgctctccatgaagcagttcctggacttcggatcagtgaatgcttgtgaaaagacctcatttatgtttctgcggcaagagttgcctgtcagactggcaaatataatgaaagaaataagtctccttccagataatcttctcaggacaccatccgttcaattggtacaaagctggtatatccagagtcttcaggagcttcttgattttaaggacaaaagtgctgaggatgctaaagctatttatgactttacagatactgtgatacggatcagaaaccgacacaatgatgtcattcccacaatggcccagggtgtgattgaatacaaggagagctttggggtggatcctgtcaccagccagaatgttcagtactttttggatcgattctacatgagtcgcatttcaattagaatgttactcaatcagcactctttattgtttggtggaaaaggcaaaggaagtccatctcatcgaaaacacattggaagcataaatccaaactgcaatgtacttgaagttattaaagatggctatgaaaatgctaggcgtctgtgtgatttgtattatattaactctcccgaactagaacttgaagaactaaatgcaaaatcaccaggacagccaatacaagtggtttatgtaccatcccatctctatcacatggtgtttgaacttttcaagaatgcaatgagagccactatggaacaccatgccaacagaggtgtttacccccctattcaagttcatgtcacgctgggtaatgaggatttgactgtgaagatgagtgaccgaggaggtggcgttcctttgaggaaaattgacagacttttcaactacatgtattcaactgcaccaagacctcgtgttgagacctcccgcgcagtgcctctggctggttttggttatggattgcccatatcacgtctttacgcacaatacttccaaggagacctgaagctgtattccctagagggttacgggacagatgcagttatctacattaaggctctgtcaacagactcaatagaaagactcccagtgtataacaaagctgcctggaagcattacaacaccaaccacgaggctgatgactggtgcgtccccag

SEQ ID NO: 300325 - DNA, 153 bp, Homo sapiens
aatccttttttgttttgttttgattcacactagatggctatgaaaatgctaggcgtctgtgtgatttgtattatattaactctcccgaactagaacttgaagaactaaatggtaagcctgatgttgtctttttctcaataattagtgctttga

SEQ ID NO: 300326 - DNA, 473 bp, Homo sapiens
agctcactcaaaggcacagagccagtacatggcagtacatctcttctcccggggccgccgtcgcggtgatactatttagggccacacgtcccagtgttcagctttcgtatttacgtactactgtttggcaagcggggactcctgaagctctctgacccggcagaggcgcggggaaacctggcgtactggctgtggcttctctagcgggactcggcatgaggctggcgcggctgcttcgcggagccgccttggccggcccgggcccggggctgcgcgccgccggcttcagccgcagcttcagctcggactcgggctccagcccggcgtccgagcgcggcgttccgggccaggtggacttctacgcgcgcttctcgccgtccccgctctccatgaagcagttcctggacttcggtgagtgcggcccgggaccttgggcctttttgcgcggtcccgggcggggagctgcggccgct

SEQ ID NO: 300327 - DNA, 4630 bp, Homo sapiens
ctctagaggatcccctttattccccactttacctggctaattgaagtgtaacaaaagcttcatccaggaacattgcggcagaggcgcggggaaacctggcgtactggctgtggcttctctagcgggactcggcatgaggctggcgcggctgcttcgcggagccgccttggccggcccgggcccggggctgcgcgccgccggcttcagccgcagcttcagctcggactcgggctccagcccggcgtccgagcgcggcgttccgggccaggtggacttctacgcgcgcttctcgccgtccccgctctccatgaagcagttcctggacttcggatcagtgaatgcttgtgaaaagacctcatttatgtttctgcggcaagagttgcctgtcagactggcaaatataatgaaagaaataagtctccttccagataatcttctcaggacaccatccgttcaattggtacaaagctggtatatccagagtcttcaggagcttcttgattttaaggacaaaagtgctgaggatgctaaagctatttatgactttacagatactgtgatacggatcagaaaccgacacaatgatgtcattcccacaatggcccagggtgtgattgaatacaaggagagctttggggtggatcctgtcaccagccagaatgttcagtactttttggatcgattctacatgagtcgcatttcaattagaatgttactcaatcagcactctttattgtttggtggaaaaggcaaaggaagtccatctcatcgaaaacacattggaagcataaatccaaactgcaatgtacttgaagttattaaagatggctatgaaaatgctaggcgtctgtgtgatttgtattatattaactctcccgaactagaacttgaagaactaaatgcaaaatcaccaggacagccaatacaagtggtttatgtaccatcccatctctatcacatggtgtttgaacttttcaagaatgcaatgagagccactatggaacaccatgccaacagaggtgtttacccccctattcaagttcatgtcacgctgggtaatgaggatttgactgtgaagatgagtgaccgaggaggtggcgttcctttgaggaaaattgacagacttttcaactacatgtattcaactgcaccaagacctcgtgttgagacctcccgcgcagtgcctctggctggttttggttatggattgcccatatcacgtctttacgcacaatacttccaaggagacctgaagctgtattccctagagggttacgggacagatgcagttatctacattaaggctctgtcaacagactcaatagaaagactcccagtgtataacaaagctgcctggaagcattacaacaccaaccacgaggctgatgactggtgcgtccccagcagagaacccaaagacatgacgacgttccgcagtgcctagacacacttgggacatcggaaaatccaaatgtggcttttgtattaaatttggaaggtatggtgttcagaactatattataccaagtactttatttatcgttttcacaaaactatttgagtagaataaatggaaactgaattccatttgtgcccgttaaacctcctaaaggatgaaattgcacctattttacacttatattttcacagttaattgaacatatttttaaacaactgtagttttgggcaacttttcactttgtggtagacttcagaagtgtggaaatcttcgggtttctataggaaactagtttttttttttttaagaaatactttcatttatgtttgctagaaacattttctaaatgatagtgattagctggttagccatcttcctgttatttggaggagttctgccatcttttattcggtagtgacagctgtaatatggtcttcatgtttatcagtgacttgactacaagtaaagcagaaaacagttggcctgtaatcacagaaccagccacccttcggcgtctacatgcattgtcttagctctgaggttaatttaccatttttaaattttattgtaaagaagtgtaatgactagctctctgtggatctatgccaaaatcatgggccatcttttctaagtgtacttctgattaatgcaaggggaaatttttatactgaaaacaaacaaacaaactagcagctactaaaatagagaagaaattgagggcaaagtaatatgtctccaaaactgaactgattgcttgttgagattacctagaaagcttttggaaaaaaatagagcttttctgcatcctactccagatacactgaatcggaatccctagggctagagcctagaaatctcactttttaaaatgcttccaaggtaagtctgatgcctaccctaggttgggaaccactctttcaaagtaaacagtgatgacacagcatttgctaaagtaacatctgtaggttttggtttccacctatttaaagtcagatttatagactcgaggagacagaaactgaatcccacacctggtgcaattagaagcataattagaagcagaagaacaaaatgccacgtaaccaaagcatcagagccatcattgcacgtgtctttttttcttttttcttttttttttttcaagacagggtctcgctcttttgcccaggatggagtacagtggcatggtcaaggctcactgcagcttcaatcttctgggctcaagtaatccttccacctcagcctcccatatagctggaactacagttgtgcactaccacacccagctaattttttgatttcttgtggagatgaggtctcagtatgttcccaggctagtgttgaactcctgagctcaagaaatcctcctgcctgagtctctgaaagtgctgggattacaggcgtgaccccacacatggcctattgcacaagtcttgacaaacaacatatattttctaaaactatccagatttcattatcagggaaaagtttgcttaggtttattacagcagtcctttgcatttgtatggtaatttgtactttacaaatactttgatatattataactctattggtctttgaaacaaagcgatacagtgtaggtggtatcattctctttctcactcagtgtggcccagagttgctcagaattggagcagagcctgagacgtatctgcagatcctgtcatcagctggcaagtccaggagactgtgtcatttagagactgtgttgttagttatccctcaacatcttctaaggtggcaggaaataatattggaaataacattttaaagtaaaaattttaaagtttaaagaagagttttgccacttaaacaggggagctttgtctggaaaatacactgagttgaaacacttcatccttggaaggattatataagatgaacagttgtgataaatgtgtagattagagggatgtgaatgggcagttagtccagtgccctcatttaagaggccaagatcctgattcagaggaggcatcctttgcccagagctgcttagctaatctgaccaaatgttgggaaaaatgtctcacctaacccactattccttaattatggattttgtgaaaaacaatagaacatgttaatgagtaatttatattagttcgatgtattacaattttttagctttaaattacagttttcttataatgttgaaatgttttagaatcctttgaatctaagtatttgtttcctaaatgaaacatttgtacaacatttgatgtttttacttatgaaatattctcctcccccaagaaaatttaaactttttctctctatttaaaagctaagaaatgttttaaaggaaaaatgaaattatcttcctttagcttatttttaaggtaaaacagctttttactctgttattgtggtaatggacagaatattacatacaaaaatattctgggagagctttttcctagttggttttaaatcattgtgccacctgaaaggtttttagattttataggagctaatttgtccaccagcattaatgtaacacagtgtagttatgaaaatatattgaaggacaggaagtggacacgaagtgatttttgtaacctgagcagttaatgaatgtgccaacattttctaggaagggacagcaagaatattctgctctgtagttaaaatactggctggcttttgatgtcttcatgcttaattgtgatcactttcttgcactgtgatgtttttacgtgaatatgttgaagtagaagtctaccatattattttataaaatgttttctgtatggcaataaactgaaaacatggatcaacccttcttttgaaaataaactgagtcaatttagccttttaaaaatatagtcatctcttttaaatagaatcctcttccaccatcaaggctcaacattttgtaagcatccaaaaaattggtaattagggggcttgcactaaatttcactatcttcagtagagaggaactgtttggaacttagatttccaatgtgtatattctaatggagaaagcaagaggtagagtttgtatgtttgacttaccttagatttttattttccatacatactgcaaatgattgacttgttgcataaatgaagatcttctgttgtgtgcttttcaaacactgtaaataaatttgaaatttgaataactttccacagtataactgt

SEQ ID NO: 300328 - DNA, 4611 bp, Homo sapiens
ctctagaggatcccctttattccccactttacctggctaattgaagtgtaacaaaagcttcatccaggaacattgcggcagaggcgcggggaaacctggcgtactggctgtggcttctctagcgggactcggcatgaggctggcgcggctgcttcgcggagccgccttggccggcccgggcccggggctgcgcgccgccggcttcagccgcagcttcagctcggactcgggctccagcccggcgtccgagcgcggcgttccgggccaggtggacttctacgcgcgcttctcgccgtccccgctctccatgaagcagttcctggacttcggatcagtgaatgcttgtgaaaagacctcatttatgtttctgcggcaagagttgcctgtcagactggcaaatataatgaaagaaataagtctccttccagataatcttctcaggacaccatccgttcaattggtacaaagctggtatatccagagtcttcaggagcttcttgattttaaggacaaaagtgctgaggatgctaaagctatttatgaaaggcctagaagaacatggttgcaggtctctagtttatgctgtatggcctgcaagatgatctttacagatactgtgatacggatcagaaaccgacacaatgatgtcattcccacaatggcccagggtgtgattgaatacaaggagagctttggggtggatcctgtcaccagccagaatgttcagtactttttggatcgattctacatgagtcgcatttcaattagaatgttactcaatcagcactctttattgtttggtggaaaaggcaaaggaagtccatctcatcgaaaacacattggaagcataaatccaaactgcaatgtacttgaagttattaaagatggctatgaaaatgctaggcgtctgtgtgatttgtattatattaactctcccgaactagaacttgaagaactaaatgcaaaatcaccaggacagccaatacaagtggtttatgtaccatcccatctctatcacatggtgtttgaacttttcaagaatccattttcttaccttagatgagtgaccgaggaggtggcgttcctttgaggaaaattgacagacttttcaactacatgtattcaactgcaccaagacctcgtgttgagacctcccgcgcagtgcctctggctggttttggttatggattgcccatatcacgtctttacgcacaatacttccaaggagacctgaagctgtattccctagagggttacgggacagatgcagttatctacattaaggctctgtcaacagactcaatagaaagactcccagtgtataacaaagctgcctggaagcattacaacaccaaccacgaggctgatgactggtgcgtccccagcagagaacccaaagacatgacgacgttccgcagtgcctagacacacttgggacatcggaaaatccaaatgtggcttttgtattaaatttggaaggtatggtgttcagaactatattataccaagtactttatttatcgttttcacaaaactatttgagtagaataaatggaaactgaattccatttgtgcccgttaaacctcctaaaggatgaaattgcacctattttacacttatattttcacagttaattgaacatatttttaaacaactgtagttttgggcaacttttcactttgtggtagacttcagaagtgtggaaatcttcgggtttctataggaaactagtttttttttttttaagaaatactttcatttatgtttgctagaaacattttctaaatgatagtgattagctggttagccatcttcctgttatttggaggagttctgccatcttttattcggtagtgacagctgtaatatggtcttcatgtttatcagtgacttgactacaagtaaagcagaaaacagttggcctgtaatcacagaaccagccacccttcggcgtctacatgcattgtcttagctctgaggttaatttaccatttttaaattttattgtaaagaagtgtaatgactagctctctgtggatctatgccaaaatcatgggccatcttttctaagtgtacttctgattaatgcaaggggaaatttttatactgaaaacaaacaaacaaactagcagctactaaaatagagaagaaattgagggcaaagtaatatgtctccaaaactgaactgattgcttgttgagattacctagaaagcttttggaaaaaaatagagcttttctgcatcctactccagatacactgaatcggaatccctagggctagagcctagaaatctcactttttaaaatgcttccaaggtaagtctgatgcctaccctaggttgggaaccactctttcaaagtaaacagtgatgacacagcatttgctaaagtaacatctgtaggttttggtttccacctatttaaagtcagatttatagactcgaggagacagaaactgaatcccacacctggtgcaattagaagcataattagaagcagaagaacaaaatgccacgtaaccaaagcatcagagccatcattgcacgtgtctttttttcttttttcttttttttttttcaagacagggtctcgctcttttgcccaggatggagtacagtggcatggtcaaggctcactgcagcttcaatcttctgggctcaagtaatccttccacctcagcctcccatatagctggaactacagttgtgcactaccacacccagctaattttttgatttcttgtggagatgaggtctcagtatgttcccaggctagtgttgaactcctgagctcaagaaatcctcctgcctgagtctctgaaagtgctgggattacaggcgtgaccccacacatggcctattgcacaagtcttgacaaacaacatatattttctaaaactatccagatttcattatcagggaaaagtttgcttaggtttattacagcagtcctttgcatttgtatggtaatttgtactttacaaatactttgatatattataactctattggtctttgaaacaaagcgatacagtgtaggtggtatcattctctttctcactcagtgtggcccagagttgctcagaattggagcagagcctgagacgtatctgcagatcctgtcatcagctggcaagtccaggagactgtgtcatttagagactgtgttgttagttatccctcaacatcttctaaggtggcaggaaataatattggaaataacattttaaagtaaaaattttaaagtttaaagaagagttttgccacttaaacaggggagctttgtctggaaaatacactgagttgaaacacttcatccttggaaggattatataagatgaacagttgtgataaatgtgtagattagagggatgtgaatgggcagttagtccagtgccctcatttaagaggccaagatcctgattcagaggaggcatcctttgcccagagctgcttagctaatctgaccaaatgttgggaaaaatgtctcacctaacccactattccttaattatggattttgtgaaaaacaatagaacatgttaatgagtaatttatattagttcgatgtattacaattttttagctttaaattacagttttcttataatgttgaaatgttttagaatcctttgaatctaagtatttgtttcctaaatgaaacatttgtacaacatttgatgtttttacttatgaaatattctcctcccccaagaaaatttaaactttttctctctatttaaaagctaagaaatgttttaaaggaaaaatgaaattatcttcctttagcttatttttaaggtaaaacagctttttactctgttattgtggtaatggacagaatattacatacaaaaatattctgggagagctttttcctagttggttttaaatcattgtgccacctgaaaggtttttagattttataggagctaatttgtccaccagcattaatgtaacacagtgtagttatgaaaatatattgaaggacaggaagtggacacgaagtgatttttgtaacctgagcagttaatgaatgtgccaacattttctaggaagggacagcaagaatattctgctctgtagttaaaatactggctggcttttgatgtcttcatgcttaattgtgatcactttcttgcactgtgatgtttttacgtgaatatgttgaagtagaagtctaccatattattttataaaatgttttctgtatggcaataaactgaaaacatggatcaacccttcttttgaaaataaactgagtcaatttagccttttaaaaatatagtcatctcttttaaatagaatcctcttccaccatcaaggctcaacattttgtaagcatccaaaaaattggtaattagggggcttgcactaaatttcactatcttcagtagagaggaactgtttggaacttagatttccaatgtgtatattctaatggagaaagcaagaggtagagtttgtatgtttgacttaccttagatttttattttccatacatactgcaaatgattgacttgttgcataaatgaagatcttctgttgtgtgcttttcaaacactgtaaataaatttgaaatttgaataactttccacagtataactgt

SEQ ID NO: 300329 - DNA, 2930 bp, Homo sapiens
gatccccgcccctgctgcccgccacgtccctcacgtaccactcggcagaggcgcggggaaacctggcgtactggctgtggcttctctagcgggactcggcatgaggctggcgcggctgcttcgcggagccgccttggccggcccgggcccggggctgcgcgccgccggcttcagccgcagcttcagctcggactcgggctccagcccggcgtccgagcgcggcgttccgggccaggtggacttctacgcgcgcttctcgccgtccccgctctccatgaagcagttcctggacttcggatcagtgaatgcttgtgaaaagacctcatttatgtttctgcggcaagagttgcctgtcagactggcaaatataatgaaagaaataagtctccttccagataatcttctcaggacaccatccgttcaattggtacaaagctggtatatccagagtcttcaggagcttcttgattttaaggacaaaagtgctgaggatgctaaagctatttatgactttacagatactgtgatacggatcagaaaccgacacaatgatgtcattcccacaatggcccagggtgtgattgaatacaaggagagctttggggtggatcctgtcaccagccagaatgttcagtactttttggatcgattctacatgagtcgcatttcaattagaatgttactcaatcagcactctttattgtttggtggaaaaggcaaaggaagtccatctcatcgaaaacacattggaagcataaatccaaactgcaatgtacttgaagttattaaagatggctatgaaaatgctaggcgtctgtgtgatttgtattatattaactctcccgaactagaacttgaagaactaaatgcaaaatcaccaggacagccaatacaagtggtttatgtaccatcccatctctatcacatggtgtttgaacttttcaagaatccattttcttaccttagatgagtgaccgaggaggtggcgttcctttgaggaaaattgacagacttttcaactacatgtattcaactgcaccaagacctcgtgttgagacctcccgcgcagtgcctctggctggttttggttatggattgcccatatcacgtctttacgcacaatacttccaaggagacctgaagctgtattccctagagggttacgggacagatgcagttatctacattaaggctctgtcaacagactcaatagaaagactcccagtgtataacaaagctgcctggaagcattacaacaccaaccacgaggctgatgactggtgcgtccccagcagagaacccaaagacatgacgacgttccgcagtgcctagacacacttgggacatcggaaaatccaaatgtggcttttgtattaaatttggaagtgtggcccagagttgctcagaattggagcagagcctgagacgtatctgcagatcctgtcatcagctggcaagtccaggagactgtgtcatttagagactgtgttgttagttatccctcaacatcttctaaggtggcaggaaataatattggaaataacattttaaagtaaaaattttaaagtttaaagaagagttttgccacttaaacaggggagctttgtctggaaaatacactgagttgaaacacttcatccttggaaggattatataagatgaacagttgtgataaatgtgtagattagagggatgtgaatgggcagttagtccagtgccctcatttaagaggccaagatcctgattcagaggaggcatcctttgcccagagctgcttagctaatctgaccaaatgttgggaaaaatgtctcacctaacccactattccttaattatggattttgtgaaaaacaatagaacatgttaatgagtaatttatattagttcgatgtattacaattttttagctttaaattacagttttcttataatgttgaaatgttttagaatcctttgaatctaagtatttgtttcctaaatgaaacatttgtacaacatttgatgtttttacttatgaaatattctcctcccccaagaaaatttaaactttttctctctatttaaaagctaagaaatgttttaaaggaaaaatgaaattatcttcctttagcttatttttaaggtaaaacagctttttactctgttattgtggtaatggacagaatattacatacaaaaatattctgggagagctttttcctagttggttttaaatcattgtgccacctgaaaggtttttagattttataggagctaatttgtccaccagcattaatgtaacacagtgtagttatgaaaatatattgaaggacaggaagtggacacgaagtgatttttgtaacctgagcagttaatgaatgtgccaacattttctaggaagggacagcaagaatattctgctctgtagttaaaatactggctggcttttgatgtcttcatgcttaattgtgatcactttcttgcactgtgatgtttttacgtgaatatgttgaagtagaagtctaccatattattttataaaatgttttctgtatggcaataaactgaaaacatggatcaacccttcttttgaaaataaactgagtcaatttagccttttaaaaatatagtcatctcttttaaatagaatcctcttccaccatcaaggctcaacattttgtaagcatccaaaaaattggtaattagggggcttgcactaaatttcactatcttcagtagagaggaactgtttggaacttagatttccaatgtgtatattctaatggagaaagcaagaggtagagtttgtatgtttgacttaccttagatttttattttccatacatactgcaaatgattgacttgttgcataaatgaagatcttctgttgtgtgcttttcaaacactgtaaataaatttgaaatttgaataactttccacagtataactgt

SEQ ID NO: 300330 - DNA, 3582 bp, Homo sapiens
  misc_feature (3538)..(3539): n is a, c, g, or t
  misc_feature (3557)..(3560): n is a, c, g, or t
  misc_feature (3563)..(3569): n is a, c, g, or t
  misc_feature (3573)..(3574): n is a, c, g, or t
  misc_feature (3576)..(3580): n is a, c, g, or t
ctctagaggatcccctttattccccactttacctggctaattgaagtgtaacaaaagcttcatccaggaacattgcggcagaggcgcggggaaacctggcgtactggctgtggcttctctagcgggactcggcatgaggctggcgcggctgcttcgcggagccgccttggccggcccgggcccggggctgcgcgccgccggcttcagccgcagcttcagctcggactcgggctccagcccggcgtccgagcgcggcgttccgggccaggtggacttctacgcgcgcttctcgccgtccccgctctccatgaagcagttcctggacttcggatcagtgaatgcttgtgaaaagacctcatttatgtttctgcggcaagagttgcctgtcagactggcaaatataatgaaagaaataagtctccttccagataatcttctcaggacaccatccgttcaattggtacaaagctggtatatccagagtcttcaggagcttcttgattttaaggacaaaagtgctgaggatgctaaagctatttatgactttacagatactgtgatacggatcagaaaccgacacaatgatgtcattcccacaatggcccagggtgtgattgaatacaaggagagctttggggtggatcctgtcaccagccagaatgttcagtactttttggatcgattctacatgagtcgcatttcaattagaatgttactcaatcagcactctttattgtttggtggaaaaggcaaaggaagtccatctcatcgaaaacacattggaagcataaatccaaactgcaatgtacttgaagttattaaagatggctatgaaaatgctaggcgtctgtgtgatttgtattatattaactctcccgaactagaacttgaagaactaaatgcaaaatcaccaggacagccaatacaagtggtttatgtaccatcccatctctatcacatggtgtttgaacttttcaagaatgcaatgagagccactatggaacaccatgccaacagaggtgtttacccccctattcaagttcatgtcacgctgggtaatgaggatttgactgtgaagatgagtgaccgaggaggtggcgttcctttgaggaaaattgacagacttttcaactacatgtattcaactgcaccaagacctcgtgttgagacctcccgcgcagtgcctctggctggttttggttatggattgcccatatcacgtctttacgcacaatacttccaaggagacctgaagctgtattccctagagggttacgggacagatgcagttatctacattaaggctctgtcaacagactcaatagaaagactcccagtgtataacaaagctgcctggaagcattacaacaccaaccacgaggctgatgactggtgcgtccccagcagagaacccaaagacatgacgacgttccgcagtgcctagacacacttgggacatcggaaaatccaaatgtggcttttgtattaaatttggaaggtatggtgttcagaactatattataccaagtactttatttatcgttttcacaaaactatttgagtagaataaatggaaactgaattccatttgtgcccgttaaacctcctaaaggatgaaattgcacctattttacacttatattttcacagttaattgaacatatttttaaacaactgtagttttgggcaacttttcactttgtggtagacttcagaagtgtggaaatcttcgggtttctataggaaactagtttttttttttttaagaaatactttcatttatgtttgctagaaacattttctaaatgatagtgattagctggttagccatcttcctgttatttggaggagttctgccatcttttattcggtagtgacagctgtaatatggtcttcatgtttatcagtgacttgactacaagtaaagcagaaaacagttggcctgtaatcacagaaccagccacccttcggcgtctacatgcattgtcttagctctgaggttaatttaccatttttaaattttattgtaaagaagtgtaatgactagctctctgtggatctatgccaaaatcatgggccatcttttctaagtgtacttctgattaatgcaaggggaaatttttatactgaaaacaaacaaacaaactagcagctactaaaatagagaagaaattgagggcaaagtaatatgtctccaaaactgaactgattgcttgttgagattacctagaaagcttttggaaaaaaatagagcttttctgcatcctactccagatacactgaatcggaatccctagggctagagcctagaaatctcactttttaaaatgcttccaaggtaagtctgatgcctaccctaggttgggaaccactctttcaaagtaaacagtgatgacacagcatttgctaaagtaacatctgtaggttttggtttccacctatttaaagtcagatttatagactcgaggagacagaaactgaatcccacacctggtgcaattagaagcataattagaagcagaagaacaaaatgccacgtaaccaaagcatcagagccatcattgcacgtgtctttttttcttttttcttttttttttttcaagacagggtctcgctcttttgcccaggatggagtacagtggcatggtcaaggctcactgcagcttcaatcttctgggctcaagtaatccttccacctcagcctcccatatagctggaactacagttgtgcactaccacacccagctaattttttgatttcttgtggagatgaggtctcagtatgttcccaggctagtgttgaactcctgagctcaagaaatcctcctgcctgagtctctgaaagtgctgggattacaggcgtgaccccacacatggcctattgcacaagtcttgacaaacaacatatattttctaaaactatccagatttcattatcagggaaaagtttgcttaggtttattacagcagtcctttgcatttgtatggtaatttgtactttacaaatactttgatatattataactctattggtctttgaaacaaagcgatacagtgtaggtggtatcattctctttctcactcagtgtggcccagagttgctcagaattggagcagagcctgagacgtatctgcagatcctgtcatcagctggcaagtccaggagactgtgtcatttagagactgtgttgttagttatccctcaacatcttctaaggtggcaggaaataatattggaaataacattttaaagtaaaaattttaaagtttaaagaagagttttgccacttaaacaggggagctttgtctggaaaatacactgagttgaaacacttcatccttggaaggattatataagatgaacagttgtgataaatgtgtagattagagggatgtgaatgggcagttagtccagtgccctcatttaagaggccaagatcctgattcagaggaggcatcctttgcccagagctgcttagctaatctgaccaaatgttgggaaaaatgtctcacctaacccatacggattcagtttggnntaccagtgccaaaaaaannnnggnnnnnnncccnncnnnnnct

SEQ ID NO: 300331 - DNA, 1562 bp, Homo sapiens
gatccccgcccctgctgcccgccacgtccctcacgtaccactcggcagaggcgcggggaaacctggcgtactggctgtggcttctctagcgggactcggcatgaggctggcgcggctgcttcgcggagccgccttggccggcccgggcccggggctgcgcgccgccggcttcagccgcagcttcagctcggactcgggctccagcccggcgtccgagcgcggcgttccgggccaggtggacttctacgcgcgcttctcgccgtccccgctctccatgaagcagttcctggacttcggatcagtgaatgcttgtgaaaagacctcatttatgtttctgcggcaagagttgcctgtcagactggcaaatataatgaaagaaataagtctccttccagataatcttctcaggacaccatccgttcaattggtacaaagctggtatatccagagtcttcaggagcttcttgattttaaggacaaaagtgctgaggatgctaaagctatttatgactttacagatactgtgatacggatcagaaaccgacacaatgatgtcattcccacaatggcccagggtgtgattgaatacaaggagagctttggggtggatcctgtcaccagccagaatgttcagtactttttggatcgattctacatgagtcgcatttcaattagaatgttactcaatcagcactctttattgtttggtggaaaaggcaaaggaagtccatctcatcgaaaacacattggaagcataaatccaaactgcaatgtacttgaagttattaaagatggctatgaaaatgctaggcgtctgtgtgatttgtattatattaactctcccgaactagaacttgaagaactaaatgcaaaatcaccaggacagccaatacaagtggtttatgtaccatcccatctctatcacatggtgtttgaacttttcaagaatgcaatgagagccactatggaacaccatgccaacagaggtgtttacccccctattcaagttcatgtcacgctgggtaatgaggatttgactgtgaagatgagtgaccgaggaggtggcgttcctttgaggaaaattgacagacttttcaactacatgtattcaactgcaccaagacctcgtgttgagacctcccgcgcagtgcctctggctggttttggttatggattgcccatatcacgtctttacgcacaatacttccaaggagacctgaagctgtattccctagagggttacgggacagatgcagttatctacattaaggctctgtcaacagactcaatagaaagactcccagtgtataacaaagctgcctggaagcattacaacaccaaccacgaggctgatgactggtgcgtccccagcagagaacccaaagacatgacgacgttccgcagtgcctagacacacttgggacatcggaaaatccaaatgtggcttttgtattaaatttggaagacagggtctcgctcttttgcccaggatggagtacagtgagccaagatcgcgccactgcactccagtctgggcaacagagcaagactccgtctcaaaa

SEQ ID NO: 300332 - DNA, 929 bp, Homo sapiens
ggaagggggggggacaaagcttacggctaaggtagcgaggctgggtggtgctgagcagaaagggtgaagaagagccatgggacacagagttgacccagccagggggaaagcccagctctctttaaaccagctaagccattccagtctcctgtgaagccaaaaagggaccaggaaccgtgcaaaggaaactggaaacttttccccgctgggtagagcatgttgctgatactcttctgttttcaagggaaacaatcacattgtttgattccaaatggtaaatgaacactcactattcttcaggcttcagtaaatctttttttcttccttcatatatatatacacaacacacacacacatatgtatatctatacacacatgtgtgttgtgtgtgttgtgtatatgcatgtgtgtgtgtgcgtgtgtgtatagttttagctccaagccaagcaagtttgtgtttggatagaggggaacttaactattaactacaagttgtatgtctgtggtatcttgattttcccatttctaaagatgaatttcacaaagccataaagcgtgaaattagagctggacttaagactcattggccgaccatcctgtgtcctggcctggccctgcagtaagaagcgtgtctgggtctggagaagggtgcttccgagagtgtgcaggtggcccttccccttggaggcgagaagagagaatgtgctgtctatcttcctggttttcagtccacagagtcggtagaccaggggttacgtgactggggaaaatctcacatctccttgtctgaaaacatttcccctgctgttctctttctaacatgttgtggtaaatctgttcagatactgctcatctgactgttttgtacatgtgacaattgccttaaaacctagcacagtcctcagaaatgaataccgtgtttccactgg

SEQ ID NO: 300333 - DNA, 851 bp, Homo sapiens
ttcccgtgattgcccaggctggtctcgaactcctgggctcaagtgatcctcccacctcggccttccgaatagctgtgattacaggcatgcacagccacaccaagcctcacatgatttcttaaaatgaccagccccaaagcttttctgtattcccctggggtgggtttctgtttcatttactattctactgaagttacctcattctcttctccctcttgctccttagaggtcagcagatcattagttagcccagctgcgggtccctcaccctaattaggaagacctttccctgagtaaaagaaggcagcccacctaactcaaaaatgcattgcagggaagtttctagaatggttcctgcccaattctccctttctggatatgtgaattagaaaacgagtctgaggcaccgtggtgagggatggatgcttagccctctaggagtccacaatagtgtgggattgtctcatttggcacaagagatgcatcctgtcattcactggaaaaccttaaaaaaaaaaaaaaacactgggttttccaaatatgttaaaactttcaaaggacggcagcacgtcgtttcattcacacatttagttttgcctctactgctcacttcctcccaatctggatggctatttatataacacagaggtgggagtaaaaaaaaaaaaaaaattagggaaggaagttcctctggcctagacaaaaacctgtttctcagctgcaccaactaacctctgcagagcccgcagagccagctagagggagcaggtactgttcttatggttatctacttagttattcttccaagctcacagagccatttctgggttttggcctaaaagaaaaaaaaa

SEQ ID NO: 300334 - DNA, 126 bp, Homo sapiens
ccaaccatcagaaggtaacagcaggggaaatgttttcagatactgctcatctgactgttttgtacatgtgacaattgccttaaaacctagcacagtcctcagaaatgaataccgtgtttccactgg

SEQ ID NO: 300335 - DNA, 4984 bp, Homo sapiens
ttctaagttctcccgggccctctggccccgaggactcagatcccggccgcgggagagggcccggcaggtgccaaggagcccgggcggtccttcagcccgcacttccccgcggtcgcccggagccggcctccgttagccgggcgggtaggcggctattggcgccaggattggccggcgccgcccgcgcccccgcggcctcgggtggagcctcccgcccggccgccccctgcggcacccgcgacacgggtggggaccagaggctcccggcggcggctcccggcggcggctcccgggctgtgattggccagcgccacagggggcgggacggcgggcgtgaagtgagcgggctggggccgctggcgcgccctcctacttccccgtctgcgtccgcgttcgcggctcccgtttgcatcatctccagccggcggctgctccagggaggctgggcgcgatcctctccgcccgcggctccaacccgcactctgcgcctctcctcgcctttctcgcacctgctcctgcgccaggcccggagacccccggggcggcttcccagaacctgcggagcacaactggccgaccgacccattcattgggaaccccgtcttttgccagagcccacgtcccctgccacctctagctcggagcggcgtgtagcgccatggagaagagcaacgagaccaacggctaccttgacagcgctcaggcggggcctgcggccgggcccggagctccggggaccgcggcgggacgcgcacggcgttgcgcgggcttcctgcggcgccaagcgctggtgctgctcaccgtgtccggggtgctggcgggcgcgggcctgggcgcggcgttgcgcgggctcagcctgagccgcacgcaggtcacctacctggccttccccggcgagatgctgctccgcatgctgcgcatgatcatcctgccgctggtggtctgcagcctggtgtcgggcgccgcctcgctcgatgccagctgcctcgggcgtctgggcggcatcgctgtcgcctactttggcctcaccacactgagtgcctcggcgctcgccgtggccttggcgttcatcatcaagccaggatccggtgcgcagacccttcagtccagcgacctggggctggaggactcggggcctcctcctgtccccaaagagacggtggactctttcctcgacctggccagaaacctgtttccctccaatcttgtggttgcagctttccgtacgtatgcaaccgattataaagtcgtgacccagaacagcagctctggaaatgtaacccatgaaaagatccccataggcactgagatagaagggatgaacattttaggattggtcctgtttgctctggtgttaggagtggccttaaagaaactaggctccgaaggagaagacctcatccgtttcttcaattccctcaacgaggcgacgatggtgctggtgtcctggattatgtggtacgtacctgtgggcatcatgttccttgttggaagcaagatcgtggaaatgaaagacatcatcgtgctggtgaccagcctggggaaatacatcttcgcatctatattgggccatgttattcatggaggaattgttctgccacttatttattttgttttcacacgaaaaaacccattcagattcctcctgggcctcctcgccccatttgcgacagcatttgctacctgctccagctcagcgacccttccctctatgatgaagtgcattgaagagaacaatggtgtggacaagaggatcagcaggtttattctccccatcggggccaccgtgaacatggacggagcagccatcttccagtgtgtggccgcggtgttcattgcgcaactcaacaacgtagagctcaacgcaggacagattttcaccattctagtgactgccacagcgtccagtgttggagcagcaggcgtgccagctggaggggtcctcaccattgccattatcctggaggccattgggctgcctactcatgacctgcctctgatcctggctgtggactggattgtggaccggaccaccacggtggtgaatgtggaaggggatgccctgggtgcaggcattctccaccacctgaatcagaaggcaacaaagaaaggcgagcaggaacttgctgaggtgaaagtggaagccatccccaactgcaagtctgaggaggagacatcgcccctggtgacacaccagaaccccgctggccccgtggccagtgccccagaactggaatccaaggagtcggttctgtgatggggctgggctttgggcttgcctgccagcagtgatgtcccaccctgttcacccagccgccagtcatggacacagggcactgcccttgccaacttttaccctcccaagcaatgctttggcccagtcgctggcctgaggcttacctctcggcactggcattgggctccccagccggaactggttaccaaggacaaggacactctgacattcggcttgatccatgtccaggtgcaactgtgtgtacaccagggatctgtttggaaacaaccccttgagctgccaggctcaagaaatcatggactcacagggtcctgtgtggttacatcttggaaaaaatgcagatgtatttcactctccccggtcagctctgcatcaggtgttttctgagcaaaccaagggggtttatagtcatctgtcgcattgcctcgagttgcagtaattgaaaaaatgctcaaattcttagccatggctggcctttgctgagctgggactcaggtgtttaaagagtttgtgctatagctaggtgtggatagcttctgatccctgggttctgggagactgcaggtgccgcacattgtcaagttagaaatactccaggtgggtgttagcactgtggtggtctctggtccacagccttaggtaaacaacttagattctgaggtcaaagaaaaaaggagagggaatgcagccttgtgggggagaagcggggcagagggttctctaatctaatcaggacaggacaggtttcacatacaattgtcccagttcgcatcccagccctggggcacttttctgcttccttccagaggcctgggcctctgataacactttggctttttctccattcacgctgatttggcaaaaggccagagatgggcctccttccctggggaggtgtgatgtagttatcacattcaggacccttgttgatttatcatctattatttgaattcaactggacactctgtaaaatgctgcactgcagcaaaaacaaaaccaccaccaccccagagaaaaccatgtactaattggagtggggtacccccattcacaggttcccaggtcccctggctttggctgatttcaaaatatagagccctttcttgccagtacatccaagtttaaaattatcagcgaaatggtccatgtttttccaattacctgctgacacggttctaagctaagtgaaggggaagatctgagagcgtgctgtttgtggctgttgatgcatattcgtgatgtaacaggtcctggggcctcactttaccccatttgtaaaatggggctaatgtcacctgcctcttacctacctcagagggatttggtgaagcaaactgttaatcttcgaaaacgaccatttcacttcttggatatcaagtgctaacccagtatgttcttcttttttatgtaagggacagctttctccacagagtcctttctgctggtgaggacagcatttctgagcagggctttgttctctatgtgcattaggacttttatcatgcccttgttctgtgtgtagttacttgacagcatcaaatgccgcctcttcctaatgtccttcaagttttcatgaactagcaaccccaccttccaccatggttctgggcgcctgattttgctgtgactcccagacccagccactgtttctgccaccctgtaacaggccattaaagctccccagtgttcagcctccttcactcccttgttttccctgttgctatgtgtcacctgggccctacagacaggggcacacgcttatggatgtgtgtaccattgagatgagaatgggtagatggaacggagaccatcaagccacacccccttcttaaaactggggacatgagcctgagcagaaagggtgaagaagagccatgggacacagagttgacccagccagggggaaagcccagctctctttaaaccagctaagccattccagtctcctgtgaagccaaaaagggaccaggaaccgtgcaaaggaaactggaaacttttccccgctgggtagagcatgttgctgatactcttctgttttcaagggaaacaatcacattgtttgattccaaatggtaaatgaacactcactattcttcaggcttcagtaaatctttttttcttccttcatatatatatacacaacacacacacacatatgtatatctatacacacatgtgtgttgtgtgtgttgtgtatatgcatgtgtgtgtgtgcgtgtgtgtatagttttagctccaagccaagcaagtttgtgtttggatagaggggaacttaactattaactacaagttgtatgtctgtggtatcttgattttcccatttctaaagatgaatttcacaaagccataaagcgtgaaattagagctggacttaagactcattggccgaccatcctgtgtcctggcctggccctgcagtaagaagcgtgtctgggtctggagaagggtgcttccgagagtgtgcaggtggcccttccccttggaggcgagaagagagaatgtgctgtctatcttcctggttttcagtccacagagtcggtagaccaggggttacgtgactggggaaaatctcacatctccttgtctgaaaacatttcccctgctgttctctttctaacatgttgtggtaaatctgttcagatactgctcatctgactgttttgtacatgtgacaattgccttaaaacctagcacagtcctcagaaatgaataccgtgtttccactgg

SEQ ID NO: 300336 - DNA, 4060 bp, Homo sapiens
ttcccgtgattgcccaggctggtctcgaactcctgggctcaagtgatcctcccacctcggccttccgaatagctgtgattacaggcatgcacagccacaccaagcctcacatgatttcttaaaatgaccagccccaaagcttttctgtattcccctggggtgggtttctgtttcatttactattctactgaagttacctcattctcttctccctcttgctccttagaggtcagcagatcattagttagcccagctgcgggtccctcaccctaattaggaagacctttccctgagtaaaagaaggcagcccacctaactcaaaaatgcattgcagggaagtttctagaatggttcctgcccaattctccctttctggatatgtgaattagaaaacgagtctgaggcaccgtggtgagggatggatgcttagccctctaggagtccacaatagtgtgggattgtctcatttggcacaagagatgcatcctgtcattcactggaaaaccttaaaaaaaaaaaaaaacactgggttttccaaatatgttaaaactttcaaaggacggcagcacgtcgtttcattcacacatttagttttgcctctactgctcacttcctcccaatctggatggctatttatataacacagaggtgggagtaaaaaaaaaaaaaaaattagggaaggaagttcctctggcctagacaaaaacctgtttctcagctgcaccaactaacctctgcagagcccgcagagccagctagagggagcagctcagcgacccttccctctatgatgaagtgcattgaagagaacaatggtgtggacaagaggatcagcaggtttattctccccatcggggccaccgtgaacatggacggagcagccatcttccagtgtgtggccgcggtgttcattgcgcaactcaacaacgtagagctcaacgcaggacagattttcaccattctagtgactgccacagcgtccagtgttggagcagcaggcgtgccagctggaggggtcctcaccattgccattatcctggaggccattgggctgcctactcatgacctgcctctgatcctggctgtggactggattgtggaccggaccaccacggtggtgaatgtggaaggggatgccctgggtgcaggcattctccaccacctgaatcagaaggcaacaaagaaaggcgagcaggaacttgctgaggtgaaagtggaagccatccccaactgcaagtctgaggaggagacatcgcccctggtgacacaccagaaccccgctggccccgtggccagtgccccagaactggaatccaaggagtcggttctgtgatggggctgggctttgggcttgcctgccagcagtgatgtcccaccctgttcacccagccgccagtcatggacacagggcactgcccttgccaacttttaccctcccaagcaatgctttggcccagtcgctggcctgaggcttacctctcggcactggcattgggctccccagccggaactggttaccaaggacaaggacactctgacattcggcttgatccatgtccaggtgcaactgtgtgtacaccagggatctgtttggaaacaaccccttgagctgccaggctcaagaaatcatggactcacagggtcctgtgtggttacatcttggaaaaaatgcagatgtatttcactctccccggtcagctctgcatcaggtgttttctgagcaaaccaagggggtttatagtcatctgtcgcattgcctcgagttgcagtaattgaaaaaatgctcaaattcttagccatggctggcctttgctgagctgggactcaggtgtttaaagagtttgtgctatagctaggtgtggatagcttctgatccctgggttctgggagactgcaggtgccgcacattgtcaagttagaaatactccaggtgggtgttagcactgtggtggtctctggtccacagccttaggtaaacaacttagattctgaggtcaaagaaaaaaggagagggaatgcagccttgtgggggagaagcggggcagagggttctctaatctaatcaggacaggacaggtttcacatacaattgtcccagttcgcatcccagccctggggcacttttctgcttccttccagaggcctgggcctctgataacactttggctttttctccattcacgctgatttggcaaaaggccagagatgggcctccttccctggggaggtgtgatgtagttatcacattcaggacccttgttgatttatcatctattatttgaattcaactggacactctgtaaaatgctgcactgcagcaaaaacaaaaccaccaccaccccagagaaaaccatgtactaattggagtggggtacccccattcacaggttcccaggtcccctggctttggctgatttcaaaatatagagccctttcttgccagtacatccaagtttaaaattatcagcgaaatggtccatgtttttccaattacctgctgacacggttctaagctaagtgaaggggaagatctgagagcgtgctgtttgtggctgttgatgcatattcgtgatgtaacaggtcctggggcctcactttaccccatttgtaaaatggggctaatgtcacctgcctcttacctacctcagagggatttggtgaagcaaactgttaatcttcgaaaacgaccatttcacttcttggatatcaagtgctaacccagtatgttcttcttttttatgtaagggacagctttctccacagagtcctttctgctggtgaggacagcatttctgagcagggctttgttctctatgtgcattaggacttttatcatgcccttgttctgtgtgtagttacttgacagcatcaaatgccgcctcttcctaatgtccttcaagttttcatgaactagcaaccccaccttccaccatggttctgggcgcctgattttgctgtgactcccagacccagccactgtttctgccaccctgtaacaggccattaaagctccccagtgttcagcctccttcactcccttgttttccctgttgctatgtgtcacctgggccctacagacaggggcacacgcttatggatgtgtgtaccattgagatgagaatgggtagatggaacggagaccatcaagccacacccccttcttaaaactggggacatgagcctgagcagaaagggtgaagaagagccatgggacacagagttgacccagccagggggaaagcccagctctctttaaaccagctaagccattccagtctcctgtgaagccaaaaagggaccaggaaccgtgcaaaggaaactggaaacttttccccgctgggtagagcatgttgctgatactcttctgttttcaagggaaacaatcacattgtttgattccaaatggtaaatgaacactcactattcttcaggcttcagtaaatctttttttcttccttcatatatatatacacaacacacacacacatatgtatatctatacacacatgtgtgttgtgtgtgttgtgtatatgcatgtgtgtgtgtgcgtgtgtgtatagttttagctccaagccaagcaagtttgtgtttggatagaggggaacttaactattaactacaagttgtatgtctgtggtatcttgattttcccatttctaaagatgaatttcacaaagccataaagcgtgaaattagagctggacttaagactcattggccgaccatcctgtgtcctggcctggccctgcagtaagaagcgtgtctgggtctggagaagggtgcttccgagagtgtgcaggtggcccttccccttggaggcgagaagagagaatgtgctgtctatcttcctggttttcagtccacagagtcggtagaccaggggttacgtgactggggaaaatctcacatctccttgtctgaaaacatttcccctgctgttctctttctaacatgttgtggtaaatctgttcagatactgctcatctgactgttttgtacatgtgacaattgccttaaaacctagcacagtcctcagaaatgaataccgtgtttccactgg

SEQ ID NO: 300337 - DNA, 3950 bp, Homo sapiens
ttctaagttctcccgggccctctggccccgaggactcagatcccggccgcgggagagggcccggcaggtgccaaggagcccgggcggtccttcagcccgcacttccccgcggtcgcccggagccggcctccgttagccgggcgggtaggcggctattggcgccaggattggccggcgccgcccgcgcccccgcggcctcgggtggagcctcccgcccggccgccccctgcggcacccgcgacacgggtggggaccagaggctcccggcggcggctcccggcggcggctcccgggctgtgattggccagcgccacagggggcgggacggcgggcgtgaagtgagcgggctggggccgctggcgcgccctcctacttccccgtctgcgtccgcgttcgcggctcccgtttgcatcatctccagccggcggctgctccagggaggctgggcgcgatcctctccgcccgcggctccaacccgcactctgcgcctctcctcgcctttctcgcacctgctcctgcgccaggcccggagacccccggggcggcttcccagaacctgcggagcacaactggccgaccgacccattcattgggaaccccgtcttttgccagagcccacgtcccctgccacctctagctcggagcggcgtgtagcgccatggagaagagcaacgagaccaacggctaccttgacagcgctcaggcggggcctgcggccgggcccggagctccggggaccgcggcgggacgcgcacggcgttgcgcgggcttcctgcggcgccaagcgctggtgctgctcaccgtgtccggggtgctggcgggcgcgggcctgggcgcggcgttgcgcgggctcagcctgagccgcacgcaggtcacctacctggccttccccggcgagatgctgctccgcatgctgcgcatgatcatcctgccgctggtggtctgcagcctggtgtcgggcgccgcctcgctcgatgccagctgcctcgggcgtctgggcggcatcgctgtcgcctactttggcctcaccacactgagtgcctcggcgctcgccgtggccttggcgttcatcatcaagccaggatccggtgcgcagacccttcagtccagcgacctggggctggaggactcggggcctcctcctgtccccaaagagacggtggactctttcctcgacctggccagaaacctgtttccctccaatcttgtggttgcagctttccgtacgtatgcaaccgattataaagtcgtgacccagaacagcagctctggaaatgtaacccatgaaaagatccccataggcactgagatagaagggatgaacattttaggattggtcctgtttgctctggtgttaggagtggccttaaagaaactaggctccgaaggagaagacctcatccgtttcttcaattccctcaacgaggcgacgatggtgctggtgtcctggattatgtggtacgtacctgtgggcatcatgttccttgttggaagcaagatcgtggaaatgaaagacatcatcgtgctggtgaccagcctggggaaatacatcttcgcatctatattgggccatgttattcatggaggaattgttctgccacttatttattttgttttcacacgaaaaaacccattcagattcctcctgggcctcctcgccccatttgcgacagcatttgctacctgctccagctcagcgacccttccctctatgatgaagtgcattgaagagaacaatggtgtggacaagaggatcagcaggtttattctccccatcggggccaccgtgaacatggacggagcagccatcttccagtgtgtggccgcggtgttcattgcgcaactcaacaacgtagagctcaacgcaggacagattttcaccattctagtgactgccacagcgtccagtgttggagcagcaggcgtgccagctggaggggtcctcaccattgccattatcctggaggccattgggctgcctactcatgacctgcctctgatcctggctgtggactggattgtggaccggaccaccacggtggtgaatgtggaaggggatgccctgggtgcaggcattctccaccacctgaatcagaaggcaacaaagaaaggcgagcaggaacttgctgaggtgaaagtggaagccatccccaactgcaagtctgaggaggagacatcgcccctggtgacacaccagaaccccgctggccccgtggccagtgccccagaactggaatccaaggagtcggttctgtgatggggctgggctttgggcttgcctgccagcagtgatgtcccaccctgttcacccagccgccagtcatggacacagggcactgcccttgccaacttttaccctcccaagcaatgctttggcccagtcgctggcctgaggcttacctctcggcactggcattgggctccccagccggaactggttaccaaggacaaggacactctgacattcggcttgatccatgtccaggtgcaactgtgtgtacaccagggatctgtttggaaacaaccccttgagctgccaggctcaagaaatcatggactcacagggtcctgtgtggttacatcttggaaaaaatgcagatgtatttcactctccccggtcagctctgcatcaggtgttttctgagcaaaccaagggggtttatagtcatctgtcgcattgcctcgagttgcagtaattgaaaaaatgctcaaattcttagccatggctggcctttgctgagctgggactcaggtgtttaaagagtttgtgctatagctaggtgtggatagcttctgatccctgggttctgggagactgcaggtgccgcacattgtcaagttagaaatactccaggtgggtgttagcactgtggtggtctctggtccacagccttaggtaaacaacttagattctgaggtcaaagaaaaaaggagagggaatgcagccttgtgggggagaagcggggcagagggttctctaatctaatcaggacaggacaggtttcacatacaattgtcccagttcgcatcccagccctggggcacttttctgcttccttccagaggcctgggcctctgataacactttggctttttctccattcacgctgatttggcaaaaggccagagatgggcctccttccctggggaggtgtgatgtagttatcacattcaggacccttgttgatttatcatctattatttgaattcaactggacactctgtaaaatgctgcactgcagcaaaaacaaaaccaccaccaccccagagaaaaccatgtactaattggagtggggtacccccattcacaggttcccaggtcccctggctttggctgatttcaaaatatagagccctttcttgccagtacatccaagtttaaaattatcagcgaaatggtccatgtttttccaattacctgctgacacggttctaagctaagtgaaggggaagatctgagagcgtgctgtttgtggctgttgatgcatattcgtgatgtaacaggtcctggggcctcactttaccccatttgtaaaatggggctaatgtcacctgcctcttacctacctcagagggatttggtgaagcaaactgttaatcttcgaaaacgaccatttcacttcttggatatcaagtgctaacccagtatgttcttcttttttatgtaagggacagctttctccacagagtcctttctgctggtgaggacagcatttctgagcagggctttgttctctatgtgcattaggacttttatcatgcccttgttctgtgtgtagttacttgacagcatcaaatgccgcctcttcctaatgtccttcaagttttcatgaactagcaaccccaccttccaccatggttctgggcgcctgattttgctgtgactcccagacccagccactgtttctgccaccctgtaacaggccattaaagctccccagtgttcagcc

SEQ ID NO: 300338 - DNA, 4343 bp, Homo sapiens
  misc_feature (4343)..(4343): n is a, c, g, or t
ttctaagttctcccgggccctctggccccgaggactcagatcccggccgcgggagagggcccggcaggtgccaaggagcccgggcggtccttcagcccgcacttccccgcggtcgcccggagccggcctccgttagccgggcgggtaggcggctattggcgccaggattggccggcgccgcccgcgcccccgcggcctcgggtggagcctcccgcccggccgccccctgcggcacccgcgacacgggtggggaccagaggctcccggcggcggctcccggcggcggctcccgggctgtgattggccagcgccacagggggcgggacggcgggcgtgaagtgagcgggctggggccgctggcgcgccctcctacttccccgtctgcgtccgcgttcgcggctcccgtttgcatcatctccagccggcggctgctccagggaggctgggcgcgatcctctccgcccgcggctccaacccgcactctgcgcctctcctcgcctttctcgcacctgctcctgcgccaggcccggagacccccggggcggcttcccagaacctgcggagcacaactggccgaccgacccattcattgggaaccccgtcttttgccagagcccacgtcccctgccacctctagctcggagcggcgtgtagcgccatggagaagagcaacgagaccaacggctaccttgacagcgctcaggcggggcctgcggccgggcccggagctccggggaccgcggcgggacgcgcacggcgttgcgcgggcttcctgcggcgccaagcgctggtgctgctcaccgtgtccggggtgctggcgggcgcgggcctgggcgcggcgttgcgcgggctcagcctgagccgcacgcaggtcacctacctggccttccccggcgagatgctgctccgcatgctgcgcatgatcatcctgccgctggtggtctgcagcctggtgtcgggcgccgcctcgctcgatgccagctgcctcgggcgtctgggcggcatcgctgtcgcctactttggcctcaccacactgagtgcctcggcgctcgccgtggccttggcgttcatcatcaagccaggatccggtgcgcagacccttcagtccagcgacctggggctggaggactcggggcctcctcctgtccccaaagagacggtggactctttcctcgacctggccagaaacctgtttccctccaatcttgtggttgcagctttccgtacgtatgcaaccgattataaagtcgtgacccagaacagcagctctggaaatgtaacccatgaaaagatccccataggcactgagatagaagggatgaacattttaggattggtcctgtttgctctggtgttaggagtggccttaaagaaactaggctccgaaggagaagacctcatccgtttcttcaattccctcaacgaggcgacgatggtgctggtgtcctggattatgtggtacgtacctgtgggcatcatgttccttgttggaagcaagatcgtggaaatgaaagacatcatcgtgctggtgaccagcctggggaaatacatcttcgcatctatattgggccatgttattcatggaggaattgttctgccacttatttattttgttttcacacgaaaaaacccattcagattcctcctgggcctcctcgccccatttgcgacagcatttgctacctgctccagctcagcgacccttccctctatgatgaagtgcattgaagagaacaatggtgtggacaagaggatcagcaggtttattctccccatcggggccaccgtgaacatggacggagcagccatcttccagtgtgtggccgcggtgttcattgcgcaactcaacaacgtagagctcaacgcaggacagattttcaccattctagtgactgccacagcgtccagtgttggagcagcaggcgtgccagctggaggggtcctcaccattgccattatcctggaggccattgggctgcctactcatgacctgcctctgatcctggctgtggactggattgtggaccggaccaccacggtggtgaatgtggaaggggatgccctgggtgcaggcattctccaccacctgaatcagaaggcaacaaagaaaggcgagcaggaacttgctgaggtgaaagtggaagccatccccaactgcaagtctgaggaggagacatcgcccctggtgacacaccagaaccccgctggccccgtggccagtgccccagaactggaatccaaggagtcggttctgtgatggggctgggctttgggcttgcctgccagcagtgatgtcccaccctgttcacccagccgccagtcatggacacagggcactgcccttgccaacttttaccctcccaagcaatgctttggcccagtcgctggcctgaggcttacctctcggcactggcattgggctccccagccggaactggttaccaaggacaaggacactctgacattcggcttgatccatgtccaggtgcaactgtgtgtacaccagggatctgtttggaaacaaccccttgagctgccaggctcaagaaatcatggactcacagggtcctgtgtggttacatcttggaaaaaatgcagatgtatttcactctccccggtcagctctgcatcaggtgttttctgagcaaaccaagggggtttatagtcatctgtcgcattgcctcgagttgcagtaattgaaaaaatgctcaaattcttagccatggctggcctttgctgagctgggactcaggtgtttaaagagtttgtgctatagctaggtgtggatagcttctgatccctgggttctgggagactgcaggtgccgcacattgtcaagttagaaatactccaggtgggtgttagcactgtggtggtctctggtccacagccttaggtaaacaacttagattctgaggtcaaagaaaaaaggagagggaatgcagccttgtgggggagaagcggggcagagggttctctaatctaatcaggacaggacaggtttcacatacaattgtcccagttcgcatcccagccctggggcacttttctgcttccttccagaggcctgggcctctgataacactttggctttttctccattcacgctgatttggcaaaaggccagagatgggcctccttccctggggaggtgtgatgtagttatcacattcaggacccttgttgatttatcatctattatttgaattcaactggacactctgtaaaatgctgcactgcagcaaaaacaaaaccaccaccaccccagagaaaaccatgtactaattggagtggggtacccccattcacaggttcccaggtcccctggctttggctgatttcaaaatatagagccctttcttgccagtacatccaagtttaaaattatcagcgaaatggtccatgtttttccaattacctgctgacacggttctaagctaagtgaaggggaagatctgagagcgtgctgtttgtggctgttgatgcatattcgtgatgtaacaggtcctggggcctcactttaccccatttgtaaaatggggctaatgtcacctgcctcttacctacctcagagggatttggtgaagcaaactgttaatcttcgaaaacgaccatttcacttcttggatatcaagtgctaacccagtatgttcttcttttttatgtaagggacagctttctccacagagtcctttctgctggtgaggacagcatttctgagcagggctttgttctctatgtgcattaggacttttatcatgcccttgttctgtgtgtagttacttgacagcatcaaatgccgcctcttcctaatgtccttcaagttttcatgaactagcaaccccaccttccaccatggttctgggcgcctgattttgctgtgactcccagacccagccactgtttctgccaccctgtaacaggccattaaagctccccagtgttcagccaaaaaaaaaaaaaaaaaaaaaaaaaaaaaaaaaaaaaaaaaaaaaacaaaagagcaaacaccaacaaaaaaaaaaaaaaacaagagggggggggggggcgccgcgggcccccagaaagacctcccaacaaccacgggggggggcgcgggcccccacggagagaacgacacagcggcgcacgcgcggccacaagagaacccgcgggacccaacacacgcgggggggccacacacacaataaaaacaacgcgccggggcgggccccccagacctgtctggggacaccactccaggaggggcgcaacagaggagaaccaaagcgggcgcatacaccaagagagggcaacaagagcgagcgcagcaaaaaaatccccgcacagagggggggggtgan

SEQ ID NO: 300339 - DNA, 3882 bp, Homo sapiens
ttctaagttctcccgggccctctggccccgaggactcagatcccggccgcgggagagggcccggcaggtgccaaggagcccgggcggtccttcagcccgcacttccccgcggtcgcccggagccggcctccgttagccgggcgggtaggcggctattggcgccaggattggccggcgccgcccgcgcccccgcggcctcgggtggagcctcccgcccggccgccccctgcggcacccgcgacacgggtggggaccagaggctcccggcggcggctcccggcggcggctcccgggctgtgattggccagcgccacagggggcgggacggcgggcgtgaagtgagcgggctggggccgctggcgcgccctcctacttccccgtctgcgtccgcgttcgcggctcccgtttgcatcatctccagccggcggctgctccagggaggctgggcgcgatcctctccgcccgcggctccaacccgcactctgcgcctctcctcgcctttctcgcacctgctcctgcgccaggcccggagacccccggggcggcttcccagaacctgcggagcacaactggccgaccgacccattcattgggaaccccgtcttttgccagagcccacgtcccctgccacctctagctcggagcggcgtgtagcgccatggagaagagcaacgagaccaacggctaccttgacagcgctcaggcggggcctgcggccgggcccggagctccggggaccgcggcgggacgcgcacggcgttgcgcgggcttcctgcggcgccaagcgctggtgctgctcaccgtgtccggggtgctggcgggcgcgggcctgggcgcggcgttgcgcgggctcagcctgagccgcacgcaggtcacctacctggccttccccggcgagatgctgctccgcatgctgcgcatgatcatcctgccgctggtggtctgcagcctggtgtcgggcgccgcctcgctcgatgccagctgcctcgggcgtctgggcggcatcgctgtcgcctactttggcctcaccacactgagtgcctcggcgctcgccgtggccttggcgttcatcatcaagccaggatccggtgcgcagacccttcagtccagcgacctggggctggaggactcggggcctcctcctgtccccaaagagacggtggactctttcctcgacctggccagaaacctgtttccctccaatcttgtggttgcagctttccgtacgtatgcaaccgattataaagtcgtgacccagaacagcagctctggaaatgtaacccatgaaaagatccccataggcactgagatagaagggatgaacattttaggattggtcctgtttgctctggtgttaggagtggccttaaagaaactaggctccgaaggagaagacctcatccgtttcttcaattccctcaacgaggcgacgatggtgctggtgtcctggattatgtggtacgtacctgtgggcatcatgttccttgttggaagcaagatcgtggaaatgaaagacatcatcgtgctggtgaccagcctggggaaatacatcttcgcatctatattgggccatgttattcatggaggaattgttctgccacttatttattttgttttcacacgaaaaaacccattcagattcctcctgggcctcctcgccccatttgcgacagcatttgctacctgctccagctcagcgacccttccctctatgatgaagtgcattgaagagaacaatggtgtggacaagaggatcagcaggtttattctccccatcggggccaccgtgaacatggacggagcagccatcttccagtgtgtggccgcggtgttcattgcgcaactcaacaacgtagagctcaacgcaggacagattttcaccattctagtgactgccacagcgtccagtgttggagcagcaggcgtgccagctggaggggtcctcaccattgccattatcctggaggccattgggctgcctactcatgacctgcctctgatcctggctgtggactggattgtggaccggaccaccacggtggtgaatgtggaaggggatgccctgggtgcaggcattctccaccacctgaatcagaaggcaacaaagaaaggcgagcaggaacttgctgaggtgaaagtggaagccatccccaactgcaagtctgaggaggagacatcgcccctggtgacacaccagaaccccgctggccccgtggccagtgccccagaactggaatccaaggagtcggttctgtgatggggctgggctttgggcttgcctgccagcagtgatgtcccaccctgttcacccagccgccagtcatggacacagggcactgcccttgccaacttttaccctcccaagcaatgctttggcccagtcgctggcctgaggcttacctctcggcactggcattgggctccccagccggaactggttaccaaggacaaggacactctgacattcggcttgatccatgtccaggtgcaactgtgtgtacaccagggatctgtttggaaacaaccccttgagctgccaggctcaagaaatcatggactcacagggtcctgtgtggttacatcttggaaaaaatgcagatgtatttcactctccccggtcagctctgcatcaggtgttttctgagcaaaccaagggggtttatagtcatctgtcgcattgcctcgagttgcagtaattgaaaaaatgctcaaattcttagccatggctggcctttgctgagctgggactcaggtgtttaaagagtttgtgctatagctaggtgtggatagcttctgatccctgggttctgggagactgcaggtgccgcacattgtcaagttagaaatactccaggtgggtgttagcactgtggtggtctctggtccacagccttaggtaaacaacttagattctgaggtcaaagaaaaaaggagagggaatgcagccttgtgggggagaagcggggcagagggttctctaatctaatcaggacaggacaggtttcacatacaattgtcccagttcgcatcccagccctggggcacttttctgcttccttccagaggcctgggcctctgataacactttggctttttctccattcacgctgatttggcaaaaggccagagatgggcctccttccctggggaggtgtgatgtagttatcacattcaggacccttgttgatttatcatctattatttgaattcaactggacactctgtaaaatgctgcactgcagcaaaaacaaaaccaccaccaccccagagaaaaccatgtactaattggagtggggtacccccattcacaggttcccaggtcccctggctttggctgatttcaaaatatagagccctttcttgccagtacatccaagtttaaaattatcagcgaaatggtccatgtttttccaattacctgctgacacggttctaagctaagtgaaggggaagatctgagagcgtgctgtttgtggctgttgatgcatattcgtgatgtaacaggtcctggggcctcactttaccccatttgtaaaatggggctaatgtcacctgcctcttacctacctcagagggatttggtgaagcaaactgttaatcttcgaaaacgaccatttcacttcttggatatcaagtgctaacccagtatgttcttcttttttatgtaagggacagctttctccacagaagtcggtagaccaggggttacgtgactggggaaaatctcacatctccttgtctgaaaacatttcccctgctgttctctttctaacatgttgtggtaaatctgttcagatactgctcatctgactgttttgtacatgtgacaattgccttaaaacctagcacagtcctcagaaatgaataccgtgtttccactgg

SEQ ID NO: 300340 - DNA, 3771 bp, Homo sapiens
ttctaagttctcccgggccctctggccccgaggactcagatcccggccgcgggagagggcccggcaggtgccaaggagcccgggcggtccttcagcccgcacttccccgcggtcgcccggagccggcctccgttagccgggcgggtaggcggctattggcgccaggattggccggcgccgcccgcgcccccgcggcctcgggtggagcctcccgcccggccgccccctgcggcacccgcgacacgggtggggaccagaggctcccggcggcggctcccggcggcggctcccgggctgtgattggccagcgccacagggggcgggacggcgggcgtgaagtgagcgggctggggccgctggcgcgccctcctacttccccgtctgcgtccgcgttcgcggctcccgtttgcatcatctccagccggcggctgctccagggaggctgggcgcgatcctctccgcccgcggctccaacccgcactctgcgcctctcctcgcctttctcgcacctgctcctgcgccaggcccggagacccccggggcggcttcccagaacctgcggagcacaactggccgaccgacccattcattgggaaccccgtcttttgccagagcccacgtcccctgccacctctagctcggagcggcgtgtagcgccatggagaagagcaacgagaccaacggctaccttgacagcgctcaggcggggcctgcggccgggcccggagctccggggaccgcggcgggacgcgcacggcgttgcgcgggcttcctgcggcgccaagcgctggtgctgctcaccgtgtccggggtgctggcgggcgcgggcctgggcgcggcgttgcgcgggctcagcctgagccgcacgcaggtcacctacctggccttccccggcgagatgctgctccgcatgctgcgcatgatcatcctgccgctggtggtctgcagcctggtgtcgggcgccgcctcgctcgatgccagctgcctcgggcgtctgggcggcatcgctgtcgcctactttggcctcaccacactgagtgcctcggcgctcgccgtggccttggcgttcatcatcaagccaggatccggtgcgcagacccttcagtccagcgacctggggctggaggactcggggcctcctcctgtccccaaagagacggtggactctttcctcgacctggccagaaacctgtttccctccaatcttgtggttgcagctttccgtacgtatgcaaccgattataaagtcgtgacccagaacagcagctctggaaatgtaacccatgaaaagatccccataggcactgagatagaagggatgaacattttaggattggtcctgtttgctctggtgttaggagtggccttaaagaaactaggctccgaaggagaagacctcatccgtttcttcaattccctcaacgaggcgacgatggtgctggtgtcctggattatgtggtacgtacctgtgggcatcatgttccttgttggaagcaagatcgtggaaatgaaagacatcatcgtgctggtgaccagcctggggaaatacatcttcgcatctatattgggccatgttattcatggaggaattgttctgccacttatttattttgttttcacacgaaaaaacccattcagattcctcctgggcctcctcgccccatttgcgacagcatttgctacctgctccagctcagcgacccttccctctatgatgaagtgcattgaagagaacaatggtgtggacaagaggatcagcaggtttattctccccatcggggccaccgtgaacatggacggagcagccatcttccagtgtgtggccgcggtgttcattgcgcaactcaacaacgtagagctcaacgcaggacagattttcaccattctagtgactgccacagcgtccagtgttggagcagcaggcgtgccagctggaggggtcctcaccattgccattatcctggaggccattgggctgcctactcatgacctgcctctgatcctggctgtggactggattgtggaccggaccaccacggtggtgaatgtggaaggggatgccctgggtgcaggcattctccaccacctgaatcagaaggcaacaaagaaaggcgagcaggaacttgctgaggtgaaagtggaagccatccccaactgcaagtctgaggaggagacatcgcccctggtgacacaccagaaccccgctggccccgtggccagtgccccagaactggaatccaaggagtcggttctgtgatggggctgggctttgggcttgcctgccagcagtgatgtcccaccctgttcacccagccgccagtcatggacacagggcactgcccttgccaacttttaccctcccaagcaatgctttggcccagtcgctggcctgaggcttacctctcggcactggcattgggctccccagccggaactggttaccaaggacaaggacactctgacattcggcttgatccatgtccaggtgcaactgtgtgtacaccagggatctgtttggaaacaaccccttgagctgccaggctcaagaaatcatggactcacagggtcctgtgtggttacatcttggaaaaaatgcagatgtatttcactctccccggtcagctctgcatcaggtgttttctgagcaaaccaagggggtttatagtcatctgtcgcattgcctcgagttgcagtaattgaaaaaatgctcaaattcttagccatggctggcctttgctgagctgggactcaggtgtttaaagagtttgtgctatagctaggtgtggatagcttctgatccctgggttctgggagactgcaggtgccgcacattgtcaagttagaaatactccaggtgggtgttagcactgtggtggtctctggtccacagccttaggtaaacaacttagattctgaggtcaaagaaaaaaggagagggaatgcagccttgtgggggagaagcggggcagagggttctctaatctaatcaggacaggacaggtttcacatacaattgtcccagttcgcatcccagccctggggcacttttctgcttccttccagaggcctgggcctctgataacactttggctttttctccattcacgctgatttggcaaaaggccagagatgggcctccttccctggggaggtgtgatgtagttatcacattcaggacccttgttgatttatcatctattatttgaattcaactggacactctgtaaaatgctgcactgcagcaaaaacaaaaccaccaccaccccagagaaaaccatgtactaattggagtggggtacccccattcacaggttcccaggtcccctggctttggctgatttcaaaatatagagccctttcttgccagtacatccaagtttaaaattatcagcgaaatggtccatgtttttccaattacctgctgacacggttctaagctaagtgaaggggaagatctgagagcgtgctgtttgtggctgttgatgcatattcgtgactcactgcagcctccgcctcctgggttcaagcggtgcttgtgcctcagccacctgagtagctgggactacaggtgcagaacaccgtgcctgggtaatttttgtatttttggtggagacggggtttcaccatgttggccaggctggtctcggactcctggcctcaagtgatctgcgcacctcagcctcctaaggtgttgggattacaggggtgagccactgcacctgggcccatacataaggtttgagttgagatagaaaaactctggcagggctg

SEQ ID NO: 300341 - DNA, 367 bp, Homo sapiens
agcaaaaggtgcagtgtcagctaggggtggagagagaacactgtgttagggttttagaagtggacatctcaaagcagatactttgcacactgaattttaagaatactgatgaagacaggtaccatggctcacgcctgtagtcccaacactttgggaggctgaggcaggaggatcacttgagcccaaaagttcaaggctgcagtgagctgcaatcacaccactgcactccagcctgggcaacagggacctcatctctaaaaaattgttttaaaagaatactgacagaatgctttcttttccaacagaaacctgtttccctccaatcttgtggttgcagctttccgtacggtaaggcttgatactttgc

SEQ ID NO: 300342 - DNA, 467 bp, Homo sapiens
ctcatctctaaaaaattgttttaaaagaatactgacagaatgctttcttttccaacagaaacctgtttccctccaatcttgtggttgcagctttccgtacggtaaggcttgatactttgctaaaaatatgaaactttgatggaagaaatgtaccaattactgctatagagttaggtaaggtagaacagggagagatggtggtgttaacaaaacttggtaagattggcctaaacttttatcaatgggtacctagagttaaaaaacaacaacaataaaataaataaataaagactgaacaaacaaaactttccaaaatgtcccactggttccaaaatttgtttacattacctaagaaataccctcaaatcacattttggggatgtcttaaatattgtacacttttttaaaaaaatacacttttatctttttttctgactataaagataatatgtgctcactgcaaaaaa

SEQ ID NO: 300343 - DNA, 723 bp, Homo sapiens
ttttgatcttctttctttttacaggaacaattggcttctttgcatgcttttggtttgttaccaaaatatacagtgtggtgaaggttgactgaagaagtccagtgtgtccagttaaaacagaaataaattaaactcttcatcaacaaagacctgtttttgtgactgccttgagttttatcagaattattggcctagtaatccttcagaaacaccgtaattctaaataaacctcttcccatacacctttcccccataagatgtgtcttcaacactataaagcatttgtattgtgatttgattaagtatatatttggttgttctcaatgaagagcaaatttaaatattatgtgcatttgtaaatacagtagctataaaattttccatacttctaatggcagaatagaggaggccatattaaataatactgatgaaaggcaggacactgcattgtaaataggattttctaggctcggtaggcagaaagaattatttttctttgaaggaaataactttttatcatggtaattttgaaggatgattcctatgatgtgttcaccaggggaatgtggcttttaaagaaaatcttctattggttgtaactgttcatatcttcttacttttctgtgttgacttcattattcccatggtattggccttttaaactatgtgcctctgagtctttcaatttataaatttgttatcttaataaatattataaaaatg

SEQ ID NO: 300344 - DNA, 998 bp, Homo sapiens
ctatgcaaaaggtatatttgtatgtcctccaaaacacacattgtgctttgcatatagtagggcctcaatacatgtacaatgtaaggatggatataatgatgtttgtaatttcccacggtaatgtcccatgtatagtctcttgatttagaaaatctcctttaatattttctcagagtactgcatttaaaacaatggtgaaaaccattgggactttaaatgtaaaatttatacaaggattatttatagtcccttatgtgtgcatgtgcaaggagtactatgcttgaagtcagaaaaaacgcatttgatttctggccacaagtaccatccatgtgaccatgagacagtcacttaacccctttgaacctcatttttgtctcattgaaagagtgtccccatctagcattcaaattctttggaatctagactgatacctgaaaatcaagccatacattgttttcatgaattatctcatttactctacataatagtctatggaggcaatgaggacagataaatttctccctagttaatatgataaatgggcttggagatgtcagtggacttgcccaaggatgacacacacagtttgtgacagagctgctctgttctctgctaccatgctgtccctcattttcagctaggatgcatttttgttactatctaatcatgtcacttttaacattttgtaaaaacttactgagttattttattataattctttgaagactgataacttccaataactgtacttagaaaatatccccatttaatcattatttgaacctgttttaatgtattcatctcataccttaaaaaattctagtagcgttttccattttgttgtaaaatattcttaaataggaaaggacagttgacatccttcagtcttttctatgtagtaaggaaaataatgtgtattgtagaaagcttaggtaatcttatagtagaacagacgtgctcatagatctgtagtatattcccggtgggtaatagtttat

SEQ ID NO: 300345 - DNA, 892 bp, Homo sapiens
gtttccgattgggagattgtcttagaaaattgaagggagtatttttattagcgaagtttcttaaaatgcaagtttatcattaaaatgcaagaatcttaggcagtgttccaactctattttttaaaacttttggcaatccaatatagttgtgatgtttaatatccccgtataatgtttcattttgcaaacctggtgcagtaaatagtatatatttctagatattaagagctcagtgtgcctggaatgactggtctagagtaatagctgcccccggcataaagaaaagaataattattccattccattccattattttcttaaaaaaaaaaaaaaacctacatataggtctaaatgttgacatctaaacatctagttataatttaaagcaatacttttagtaggtattactaggaattcttttttttttttttttgggttgcataatcttactctgatttcccctagactttagtaaatctgaaactctccaaatctcaggactaaccaaagttagataatttagaaattgcagttgttgactcaatggaaggacaagctttgaatgggatttttttttgttcttaatgtgctgtcagcagatgtttacttaaagagattttttaatctcctctaggaagatgataagatcagatgggcgtctagatgggactatattctggagtctatgcctcatacccacattcagtggtttagcattatgaattccctggtcattgttctcttcttatctggaatggtagctatgattatgttacggacactgcacaaagatattgctagatataatcagatggactctacggtaagtggaaacattttagtctttagtctgccaaggacactgtttattgttattttgcaaaaaggtaaa

SEQ ID NO: 300346 - DNA, 2831 bp, Homo sapiens
atgtgcagacggcggtgcgcatgctctgttgcggtccgcttcggtttctgttgcgggacccggggtgtctcctagcgcaaccggaactagccttctgggggccggcttcctttatctctggcggccttgtagtcgtctccgagactccccacccctccttccctcttgaccccctaggtttgattgccctttccccgaaacaactatcatgagcgcgaggctgccggtgttgtctccacctcggtggccgcggctgttgctgctgtcgctgctcctgctgggggcggttcctggcccgcgccggagcggcgctttctacctgcccggcctggcgcccgtcaacttctgcgacgaagaaaaaaagagcgacgagtgcaaggccgaaatagaactatttgtgaacagacttgattcagtggaatcagttcttccttatgaatacacagcgtttgatttttgccaagcatcagaaggaaagcgcccatctgaaaatcttggtcaggtactattcggggaaagaattgaaccttcaccatataagtttacgtttaataagaaggagacctgtaagcttgtttgtacaaaaacataccatacagagaaagctgaagacaaacaaaagttagaattcttgaaaaaaagcatgttattgaattatcaacatcactggattgtggataatatgcctgtaacgtggtgttacgatgttgaagatggtcagaggttctgtaatcctggatttcctattggctgttacattacagataaaggccatgcaaaagatgcctgtgttattagttcagatttccatgaaagagatacattttacatcttcaaccatgttgacatcaaaatatactatcatgttgttgaaactgggtccatgggagcaagattagtggctgctaaacttgaaccgaaaagcttcaaacatacccatatagataaaccagactgctcagggccccccatggacataagtaacaaggcttctggggagataaaaattgcctatacttactctgttagcttcgaggaagatgataagatcagatgggcgtctagatgggactatattctggagtctatgcctcatacccacattcagtggtttagcattatgaattccctggtcattgttctcttcttatctggaatggtagctatgattatgttacggacactgcacaaagatattgctagatataatcagatggactctacggaagatgcccaggaagaatttggctggaaacttgttcatggtgatatattccgtcctccaagaaaagggatgctgctatcagtctttctaggatccgggacacagattttaattatgacctttgtgactctatttttcgcttgcctgggatttttgtcacctgccaaccgaggagcgctgatgacgtgtgctgtggtcctgtgggtgctgctgggcacccctgcaggctatgttgctgccagattctataagtcctttggaggtgagaagtggaaaacaaatgttttattaacatcatttctttgtcctgggattgtatttgctgacttctttataatgaatctgatcctctggggagaaggatcttcagcagctattccttttgggacactggttgccatattggccctttggttctgcatatctgtgcctctgacgtttattggtgcatactttggttttaagaagaatgccattgaacacccagttcgaaccaatcagattccacgtcagattcctgaacagtcgttctacacgaagcccttgcctggtattatcatgggagggattttgccctttggctgcatctttatacaacttttcttcattctgaatagtatttggtcacaccagatgtattacatgtttggcttcctatttctggtgtttatcattttggttattacctgttctgaagcaactatacttctttgctatttccacctatgtgcagaggattatcattggcaatggcgttcattccttacgagtggctttactgcagtttatttcttaatctatgcagtacactacttcttttcaaaactgcagatcacgggaacagcaagcacaattctgtactttggttataccatgataatggttttgatcttctttctttttacaggaacaattggcttctttgcatgcttttggtttgttaccaaaatatacagtgtggtgaaggttgactgaagaagtccagtgtgtccagttaaaacagaaataaattaaactcttcatcaacaaagacctgtttttgtgactgccttgagttttatcagaattattggcctagtaatccttcagaaacaccgtaattctaaataaacctcttcccatacacctttcccccataagatgtgtcttcaacactataaagcatttgtattgtgatttgattaagtatatatttggttgttctcaatgaagagcaaatttaaatattatgtgcatttgtaaatacagtagctataaaattttccatacttctaatggcagaatagaggaggccatattaaataatactgatgaaaggcaggacactgcattgtaaataggattttctaggctcggtaggcagaaagaattatttttctttgaaggaaataactttttatcatggtaattttgaaggatgattcctatgatgtgttcaccaggggaatgtggcttttaaagaaaatcttctattggttgtaactgttcatatcttcttacttttctgtgttgacttcattattcccatggtattggccttttaaactatgtgcctctgagtctttcaatttataaatttgttatcttaataaatattataaaaatg

SEQ ID NO: 300347 - DNA, 3442 bp, Homo sapiens
atgtgcagacggcggtgcgcatgctctgttgcggtccgcttcggtttctgttgcgggacccggggtgtctcctagcgcaaccggaactagccttctgggggccggcttcctttatctctggcggccttgtagtcgtctccgagactccccacccctccttccctcttgaccccctaggtttgattgccctttccccgaaacaactatcatgagcgcgaggctgccggtgttgtctccacctcggtggccgcggctgttgctgctgtcgctgctcctgctgggggcggttcctggcccgcgccggagcggcgctttctacctgcccggcctggcgcccgtcaacttctgcgacgaagaaaaaaagagcgacgagtgcaaggccgaaatagaactatttgtgaacagacttgattcagtggaatcagttcttccttatgaatacacagcgtttgatttttgccaagcatcagaaggaaagcgcccatctgaaaatcttggtcaggtactattcggggaaagaattgaaccttcaccatataagtttacgtttaataagaaggagacctgtaagcttgtttgtacaaaaacataccatacagagaaagctgaagacaaacaaaagttagaattcttgaaaaaaagcatgttattgaattatcaacatcactggattgtggataatatgcctgtaacgtggtgttacgatgttgaagatggtcagaggttctgtaatcctggatttcctattggctgttacattacagataaaggccatgcaaaagatgcctgtgttattagttcagatttccatgaaagagatacattttacatcttcaaccatgttgacatcaaaatatactatcatgttgttgaaactgggtccatgggagcaagattagtggctgctaaacttgaaccgaaaagcttcaaacatacccatatagataaaccagactgctcagggccccccatggacataagtaacaaggcttctggggagataaaaattgcctatacttactctgttagcttcgaggaagatgataagatcagatgggcgtctagatgggactatattctggagtctatgcctcatacccacattcagtggtttagcattatgaattccctggtcattgttctcttcttatctggaatggtagctatgattatgttacggacactgcacaaagatattgctagatataatcagatggactctacggaagatgcccaggaagaatttggctggaaacttgttcatggtgatatattccgtcctccaagaaaagggatgctgctatcagtctttctaggatccgggacacagattttaattatgacctttgtgactctatttttcgcttgcctgggatttttgtcacctgccaaccgaggagcgctgatgacgtgtgctgtggtcctgtgggtgctgctgggcacccctgcaggctatgttgctgccagattctataagtcctttggaggtgagaagtggaaaacaaatgttttattaacatcatttctttgtcctgggattgtatttgctgacttctttataatgaatctgatcctctggggagaaggatcttcagcagctattccttttgggacactggttgccatattggccctttggttctgcatatctgtgcctctgacgtttattggtgcatactttggttttaagaagaatgccattgaacacccagttcgaaccaatcagattccacgtcagattcctgaacagtcgttctacacgaagcccttgcctggtattatcatgggagggattttgccctttggctgcatctttatacaacttttcttcattctgaatagtatttggtcacaccagatgtattacatgtttggcttcctatttctggtgtttatcattttggttattacctgttctgaagcaactatacttctttgctatttccacctatgtgcagaggattatcattggcaatggcgttcattccttacgagtggctttactgcagtttatttcttaatctatgcagtacactacttcttttcaaaactgcagatcacgggaacagcaagcacaattctgtactttggttataccatgataatggttttgatcttctttctttttacaggaacaattggcttctttgcatgcttttggtttgttaccaaaatatacagtgtggtgaaggttgactgaagaagtccagtgtgtccagttaaaacagaaataaattaaactcttcatcaacaaagacctgtttttgtgactgccttgagttttatcagaattattggcctagtaatccttcagaaacaccgtaattctaaataaacctcttcccatacacctttcccccataagatgtgtcttcaacactataaagcatttgtattgtgatttgattaagtatatatttggttgttctcaatgaagagcaaatttaaatattatgtgcatttgtaaatacagtagctataaaattttccatacttctaatggcagaatagaggaggccatattaaataatactgatgaaaggcaggacactgcattgtaaataggattttctaggctcggtaggcagaaagaattatttttctttgaaggaaataactttttatcatggtaattttgaaggatgattcctatgatgtgttcaccaggggaatgtggcttttaaagaaaatcttctattggttgtaactgttcatatcttcttacttttctgtgttgacttcattattcccatggtattggccttttaaactatgtgcctctgagtctttcaatttataaatttgttatcttaataaatattataaaaatgtcttcattgcatcattacctattatatattcaaggaggttctgtaaatacagatctatttaccaaggtgttttgaaatgatttatactattttatcagattttactggattttgttaatgtaacactttctgagttttgatctgaatggaatttcactgtgtaaggcattgtctaaaatgttcactgtgaggcagtagaggaggttgaagtcatgcatatctagacagatgaattatctgcaagtacttaaggtggagccttactacattgtcattaaggagtttctatttttgacttgtttttcaaaatacagtgttttaagtcaggttttattacctggacattagcaatcactagcaagtcttcatctttatgatttcattgttttaatttagatttcacaaacagttttacttctaagagttaagaaatgcactgtctttcacattcatctgactaattgaaatccatttatgtagaatataggaatggggggtgattctgaagtatcggtctgcttgtatctgtgagcatattcatttgtattttagggtctctctgcttgctgcttaggagagcaaatcagatactgtcattaaacttacaacta

SEQ ID NO: 300348 - DNA, 3290 bp, Homo sapiens
  misc_feature (2873)..(2873): n is a, c, g, or t
atgtgcagacggcggtgcgcatgctctgttgcggtccgcttcggtttctgttgcgggacccggggtgtctcctagcgcaaccggaactagccttctgggggccggcttcctttatctctggcggccttgtagtcgtctccgagactccccacccctccttccctcttgaccccctaggtttgattgccctttccccgaaacaactatcatgagcgcgaggctgccggtgttgtctccacctcggtggccgcggctgttgctgctgtcgctgctcctgctgggggcggttcctggcccgcgccggagcggcgctttctacctgcccggcctggcgcccgtcaacttctgcgacgaagaaaaaaagagcgacgagtgcaaggccgaaatagaactatttgtgaacagacttgattcagtggaatcagttcttccttatgaatacacagcgtttgatttttgccaagcatcagaaggaaagcgcccatctgaaaatcttggtcaggtactattcggggaaagaattgaaccttcaccatataagtttacgtttaataagaaggagacctgtaagcttgtttgtacaaaaacataccatacagagaaagctgaagacaaacaaaagttagaattcttgaaaaaaagcatgttattgaattatcaacatcactggattgtggataatatgcctgtaacgtggtgttacgatgttgaagatggtcagaggttctgtaatcctggatttcctattggctgttacattacagataaaggccatgcaaaagatgcctgtgttattagttcagatttccatgaaagagatacattttacatcttcaaccatgttgacatcaaaatatactatcatgttgttgaaactgggtccatgggagcaagattagtggctgctaaacttgaaccgaaaagcttcaaacatacccatatagataaaccagactgctcagggccccccatggacataagtaacaaggcttctggggagataaaaattgcctatacttactctgttagcttcgaggaagatgataagatcagatgggcgtctagatgggactatattctggagtctatgcctcatacccacattcagtggtttagcattatgaattccctggtcattgttctcttcttatctggaatggtagctatgattatgttacggacactgcacaaagatattgctagatataatcagatggactctacggaagatgcccaggaagaatttggctggaaacttgttcatggtgatatattccgtcctccaagaaaagggatgctgctatcagtctttctaggatccgggacacagattttaattatgacctttgtgactctatttttcgcttgcctgggatttttgtcacctgccaaccgaggagcgctgatgacgtgtgctgtggtcctgtgggtgctgctgggcacccctgcaggctatgttgctgccagattctataagtcctttggaggtgagaagtggaaaacaaatgttttattaacatcatttctttgtcctgggattgtatttgctgacttctttataatgaatctgatcctctggggagaaggatcttcagcagctattccttttgggacactggttgccatattggccctttggttctgcatatctgtgcctctgacgtttattggtgcatactttggttttaagaagaatgccattgaacacccagttcgaaccaatcagattccacgtcagattcctgaacagtcgttctacacgaagcccttgcctggtattatcatgggagggattttgccctttggctgcatctttatacaacttttcttcattctgaatagtatttggtcacaccagatgtattacatgtttggcttcctatttctggtgtttatcattttggttattacctgttctgaagcaactatacttctttgctatttccacctatgtgcagaggattatcattggcaatggcgttcattccttacgagtggctttactgcagtttatttcttaatctatgcagtacactacttcttttcaaaactgcagatcacgggaacagcaagcacaattctgtactttggttataccatgataatggttttgatcttctttctttttacaggaacaattggcttctttgcatgcttttggtttgttaccaaaatatacagtgtggtgaaggttgactgaagaagtccagtgtgtccagttaaaacagaaataaattaaactcttcatcaacaaagacctgtttttgtgactgccttgagttttatcagaattattggcctagtaatccttcagaaacaccgtaattctaaataaacctcttcccatacacctttcccccataagatgtgtcttcaacactataaagcatttgtattgtgatttgattaagtatatatttggttgttctcaatgaagagcaaatttaaatattatgtgcatttgtaaatacagtagctataaaattttccatacttctaatggcagaatagaggaggccatattaaataatactgatgaaaggcaggacactgcattgtaaataggattttctaggctcggtaggcagaaagaattatttttctttgaaggaaataactttttatcatggtaattttgaaggatgattcctatgatgtgttcaccaggggaatgtggcttttaaagaaaatcttctattggttgtaactgttcatatcttcttacttttctgtgttgacttcattattcccatggtattggccttttaaactatgtgcctctgagtctttcaatttataaatttgttatcttaataaatattataaaaatgaaaaaaaaaaaaaaaaaaaaaaaaaaaaagaaaaaagaaaanaaaaaaaaaaaaaaaaaaaaaaaaaaaaaaccttgtggcccgcttggcccaagtggattttaaattgggccaggtttatgaatgcgcccgaatttggggctaattggcccaattcgccttatggggggcggtttaacaatcaatggcccgcggtttaacaccgtcggaattggaaaaccctgggggttcccaacttaaatcgcttggaagaaaatccccttttggccagttggggaaaaaccaaaaagccccgaccggatggcctttccaaaaagttgcccaccctgatgggcaatggaaaattgaagcgcgtaatatttggtaaaaatcccggtaaatttttggtccacttaatttttaacccaataggccgaaatcgcgtttggaccaagagtcccttatggccgggcctccggt

SEQ ID NO: 300349 - DNA, 3596 bp, Homo sapiens
atgtgcagacggcggtgcgcatgctctgttgcggtccgcttcggtttctgttgcgggacccggggtgtctcctagcgcaaccggaactagccttctgggggccggcttcctttatctctggcggccttgtagtcgtctccgagactccccacccctccttccctcttgaccccctaggtttgattgccctttccccgaaacaactatcatgagcgcgaggctgccggtgttgtctccacctcggtggccgcggctgttgctgctgtcgctgctcctgctgggggcggttcctggcccgcgccggagcggcgctttctacctgcccggcctggcgcccgtcaacttctgcgacgaagaaaaaaagagcgacgagtgcaaggccgaaatagaactatttgtgaacagacttgattcagtggaatcagttcttccttatgaatacacagcgtttgatttttgccaagcatcagaaggaaagcgcccatctgaaaatcttggtcaggtactattcggggaaagaattgaaccttcaccatataagtttacgtttaataagaaggagacctgtaagcttgtttgtacaaaaacataccatacagagaaagctgaagacaaacaaaagttagaattcttgaaaaaaagcatgttattgaattatcaacatcactggattgtggataatatgcctgtaacgtggtgttacgatgttgaagatggtcagaggttctgtaatcctggatttcctattggctgttacattacagataaaggccatgcaaaagatgcctgtgttattagttcagatttccatgaaagagatacattttacatcttcaaccatgttgacatcaaaatatactatcatgttgttgaaactgggtccatgggagcaagattagtggctgctaaacttgaaccgaaaagcttcaaacatacccatatagataaaccagactgctcagggccccccatggacataagtaacaaggcttctggggagataaaaattgcctatacttactctgttagcttcgaggaagatgataagatcagatgggcgtctagatgggactatattctggagtctatgcctcatacccacattcagtggtttaggtaagagtacagagttagcctgcttttgctttctacttttctaccctctgtccctttgaacatctcatttactctcaaatcctctctactttattcaaaagtctggccttgggttcaaatcctggctttcagccactgattgtgagtcacagcaggtcccttaatttctcagcgtctgtttctttatctagaaatacccaccttatgggattgttgtgaggattaaaggacatcatgggacagaatatttgaggacattgtctggcacataagagtgttcagaaacagaagccgctgttgttgctatgactttattattatccccttcaaacatgattcaaaacttttatctagagttgttcatgttgccataactctccttttcctattgctgtctgatctttttgacactcactaatttactgagtaaagttgttcttcagtaaatttcttgagggcacaagccagtcctttgttgtggcagtgatttgggcacagtagttatttcataatattgaccatgtaccaaaaaattctagttctaaacagactatgaaactgtattatgataagtatataatgttatttatctactggagggaaacatgaaagaacacagttcattgaatttgttggatttcagatagctttcattttgattttgatcaagactgttttaatgttactcaataaacagtttttaaaagagttttactgttcctaggattaagctacagattactcatgatgtgcttatttctacagcattatgaattccctggtcattgttctcttcttatctggaatggtagctatgattatgttacggacactgcacaaagatattgctagatataatcagatggactctacggaagatgcccaggaagaatttggctggaaacttgttcatggtgatatattccgtcctccaagaaaagggatgctgctatcagtctttctaggatccgggacacagattttaattatgacctttgtgactctatttttcgcttgcctgggatttttgtcacctgccaaccgaggagcgctgatgacgtgtgctgtggtcctgtgggtgctgctgggcacccctgcaggctatgttgctgccagattctataagtcctttggaggtgagaagtggaaaacaaatgttttattaacatcatttctttgtcctgggattgtatttgctgacttctttataatgaatctgatcctctggggagaaggatcttcagcagctattccttttgggacactggttgccatattggccctttggttctgcatatctgtgcctctgacgtttattggtgcatactttggttttaagaagaatgccattgaacacccagttcgaaccaatcagattccacgtcagattcctgaacagtcgttctacacgaagcccttgcctggtattatcatgggagggattttgccctttggctgcatctttatacaacttttcttcattctgaatagtatttggtcacaccagatgtattacatgtttggcttcctatttctggtgtttatcattttggttattacctgttctgaagcaactatacttctttgctatttccacctatgtgcagaggattatcattggcaatggcgttcattccttacgagtggctttactgcagtttatttcttaatctatgcagtacactacttcttttcaaaactgcagatcacgggaacagcaagcacaattctgtactttggttataccatgataatggttttgatcttctttctttttacaggaacaattggcttctttgcatgcttttggtttgttaccaaaatatacagtgtggtgaaggttgactgaagaagtccagtgtgtccagttaaaacagaaataaattaaactcttcatcaacaaagacctgtttttgtgactgccttgagttttatcagaattattggcctagtaatccttcagaaacaccgtaattctaaataaacctcttcccatacacctttcccccataagatgtgtcttcaacactataaagcatttgtattgtgatttgattaagtatatatttggttgttctcaatgaagagcaaatttaaatattatgtgcatttgtaaatacagtagctataaaattttccatacttctaatggcagaatagaggaggccatattaaataatactgatgaaaggcaggacactgcattgtaaataggattttctaggctcggtaggcagaaagaattatttttctttgaaggaaataactttttatcatggtaattttgaaggatgattcctatgatgtgttcaccaggggaatgtggcttttaaagaaaatcttctattggttgtaactgttcatatcttcttacttttctgtgttgacttcattattcccatggtattggccttttaaactatgtgcctctgagtctttcaatttataaatttgttatcttaataaatattataaaaatg

SEQ ID NO: 300350 - DNA, 2774 bp, Homo sapiens
atgtgcagacggcggtgcgcatgctctgttgcggtccgcttcggtttctgttgcgggacccggggtgtctcctagcgcaaccggaactagccttctgggggccggcttcctttatctctggcggccttgtagtcgtctccgagactccccacccctccttccctcttgaccccctaggtttgattgccctttccccgaaacaactatcatgagcgcgaggctgccggtgttgtctccacctcggtggccgcggctgttgctgctgtcgctgctcctgctgggggcggttcctggcccgcgccggagcggcgctttctacctgcccggcctggcgcccgtcaacttctgcgacgaagaaaaaaagagcgacgagtgcaaggccgaaatagaactatttgtgaacagacttgattcagtggaatcagttcttccttatgaatacacagcgtttgatttttgccaagcatcagaaggaaagcgcccatctgaaaatcttggtcaggtactattcggggaaagaattgaaccttcaccatataagtttacgtttaataagaaggagacctgtaagcttgtttgtacaaaaacataccatacagagaaagctgaagacaaacaaaagttagaattcttgaagtggtgttacgatgttgaagatggtcagaggttctgtaatcctggatttcctattggctgttacattacagataaaggccatgcaaaagatgcctgtgttattagttcagatttccatgaaagagatacattttacatcttcaaccatgttgacatcaaaatatactatcatgttgttgaaactgggtccatgggagcaagattagtggctgctaaacttgaaccgaaaagcttcaaacatacccatatagataaaccagactgctcagggccccccatggacataagtaacaaggcttctggggagataaaaattgcctatacttactctgttagcttcgaggaagatgataagatcagatgggcgtctagatgggactatattctggagtctatgcctcatacccacattcagtggtttagcattatgaattccctggtcattgttctcttcttatctggaatggtagctatgattatgttacggacactgcacaaagatattgctagatataatcagatggactctacggaagatgcccaggaagaatttggctggaaacttgttcatggtgatatattccgtcctccaagaaaagggatgctgctatcagtctttctaggatccgggacacagattttaattatgacctttgtgactctatttttcgcttgcctgggatttttgtcacctgccaaccgaggagcgctgatgacgtgtgctgtggtcctgtgggtgctgctgggcacccctgcaggctatgttgctgccagattctataagtcctttggaggtgagaagtggaaaacaaatgttttattaacatcatttctttgtcctgggattgtatttgctgacttctttataatgaatctgatcctctggggagaaggatcttcagcagctattccttttgggacactggttgccatattggccctttggttctgcatatctgtgcctctgacgtttattggtgcatactttggttttaagaagaatgccattgaacacccagttcgaaccaatcagattccacgtcagattcctgaacagtcgttctacacgaagcccttgcctggtattatcatgggagggattttgccctttggctgcatctttatacaacttttcttcattctgaatagtatttggtcacaccagatgtattacatgtttggcttcctatttctggtgtttatcattttggttattacctgttctgaagcaactatacttctttgctatttccacctatgtgcagaggattatcattggcaatggcgttcattccttacgagtggctttactgcagtttatttcttaatctatgcagtacactacttcttttcaaaactgcagatcacgggaacagcaagcacaattctgtactttggttataccatgataatggttttgatcttctttctttttacaggaacaattggcttctttgcatgcttttggtttgttaccaaaatatacagtgtggtgaaggttgactgaagaagtccagtgtgtccagttaaaacagaaataaattaaactcttcatcaacaaagacctgtttttgtgactgccttgagttttatcagaattattggcctagtaatccttcagaaacaccgtaattctaaataaacctcttcccatacacctttcccccataagatgtgtcttcaacactataaagcatttgtattgtgatttgattaagtatatatttggttgttctcaatgaagagcaaatttaaatattatgtgcatttgtaaatacagtagctataaaattttccatacttctaatggcagaatagaggaggccatattaaataatactgatgaaaggcaggacactgcattgtaaataggattttctaggctcggtaggcagaaagaattatttttctttgaaggaaataactttttatcatggtaattttgaaggatgattcctatgatgtgttcaccaggggaatgtggcttttaaagaaaatcttctattggttgtaactgttcatatcttcttacttttctgtgttgacttcattattcccatggtattggccttttaaactatgtgcctctgagtctttcaatttataaatttgttatcttaataaatattataaaaatg

SEQ ID NO: 300351 - DNA, 2705 bp, Homo sapiens
atgtgcagacggcggtgcgcatgctctgttgcggtccgcttcggtttctgttgcgggacccggggtgtctcctagcgcaaccggaactagccttctgggggccggcttcctttatctctggcggccttgtagtcgtctccgagactccccacccctccttccctcttgaccccctaggtttgattgccctttccccgaaacaactatcatgagcgcgaggctgccggtgttgtctccacctcggtggccgcggctgttgctgctgtcgctgctcctgctgggggcggttcctggcccgcgccggagcggcgctttctacctgcccggcctggcgcccgtcaacttctgcgacgaagaaaaaaagagcgacgagtgcaaggccgaaatagaactatttgtgaacagacttgattcagtggaatcagttcttccttatgaatacacagcgtttgatttttgccaagcatcagaaggaaagcgcccatctgaaaatcttggtcaggtactattcggggaaagaattgaaccttcaccatataagtttacgtttaataagaaggagacctgtaagcttgtttgtacaaaaacataccatacagagaaagctgaagacaaacaaaagttagaattcttgaaaaaaagcatgttattgaattatcaacatcactggattgtggataatatgcctgtaacgtggtgttacgatgttgaagatggtcagaggttctgtaatcctggatttcctattggctgttacattacagataaaggccatgcaaaagatgcctgtgttattagttcagatttccatgaaagagatacattttacatcttcaaccatgttgacatcaaaatatactatcatgttgttgaaactgggtccatgggagcaagattagtggctgctaaacttgaaccgaaaagcttcaaacatacccatatagataaaccagactgctcagggccccccatggacataagtaacaaggcttctggggagataaaaattgcctatacttactctgttagcttcgaggaagatgataagatcagatgggcgtctagatgggactatattctggagtctatgcctcatacccacattcagtggtttagcattatgaattccctggtcattgttctcttcttatctggaatggtagctatgattatgttacggacactgcacaaagatattgctagatataatcagatggactctacggaagatgcccaggaagaatttggctggaaacttgttcatggtgatatattccgtcctccaagaaaagggatgctgctatcagtctttctaggatccgggacacagattttaattatgacctttgtgactctatttttcgcttgcctgggatttttgtcacctgccaaccgaggagcgctgatgacgtgtgctgtggtcctgtgggtgctgctgggcacccctgcaggctatgttgctgccagattctataagtcctttggaggtgagaagtggaaaacaaatgttttattaacatcatttctttgtcctgggattgtatttgctgacttctttataatgaatctgatcctctggggagaaggatcttcagcagctattccttttgggacactggttgccatattggccctttggttctgcatatctgtgcctctgacgtttattggtgcatactttggttttaagaagaatgccattgaacacccagttcgaaccaatcagattccacgtcagattcctgaacagtcgttctacacgaagcccttgcctggtattatcatgggagggattttgccctttggctgcatctttatacaacttttcttcattctgaatagtatttggtcacaccagatgtattacatgtttggcttcctatttctggtgtttatcattttggttattacctgttctgaagcaactatacttctttgctatttccacctatgtgcagaggattatcattggcaatggcgttcattccttacgagtggctttactgcagtttatttcttaatctatgcagtacactacttcttttcaaaactgcagatcacgggaacagcaagcacaattctgtactttggttataccatgataatggttttgatcttctttctttttacaggaacaattggcttctttgcatgcttttggtttgttaccaaaatatacagtgtggtgaaggttgactgaagaagtccagtgtgtccagttaaaacagaaataaattaaactcttcatcaacaaagacctgtttttgtgactgccttgagttttatcagaattattggcctagtaatccttcagaaacaccgtaattctaaataaacctcttcccatacacctttcccccataagatgtgtcttcaacactataaagcatttgtattgtgatttgattaagtatatatttggttgttctcaatgaagagcaaatttaaatattatgtgcatttgtaaatacagtagctataaaattttccatacttctaatacttttcctaaaatttgggggccaaagcgaaaacaactctcaaccaaaccggggaaaccgggccccccaatttaaatttttctcacacaaacttataaattaacctttggaaattgcaccacacgggccaaggggaaccaaacctttggcccatttgttacaacttagcgatttttcttaggctcggtaggcagaaccagaatc

SEQ ID NO: 300352 - DNA, 2562 bp, Homo sapiens
agcggacagtgtgtaagtctacagttgtgtacagtagtgtcctaggccttcacattcattcaccgctcactcacccagagcagcttccagccttgcaagttctattcatggccgaaatagaactatttgtgaacagacttgattcagtggaatcagttcttccttatgaatacacagcgtttgatttttgccaagcatcagaaggaaagcgcccatctgaaaatcttggtcaggtactattcggggaaagaattgaaccttcaccatataagtttacgtttaataagaaggagacctgtaagcttgtttgtacaaaaacataccatacagagaaagctgaagacaaacaaaagttagaattcttgaaaaaaagcatgttattgaattatcaacatcactggattgtggataatatgcctgtaacgtggtgttacgatgttgaagatggtcagaggttctgtaatcctggatttcctattggctgttacattacagataaaggccatgcaaaagatgcctgtgttattagttcagatttccatgaaagagatacattttacatcttcaaccatgttgacatcaaaatatactatcatgttgttgaaactgggtccatgggagcaagattagtggctgctaaacttgaaccgaaaagcttcaaacatacccatatagataaaccagactgctcagggccccccatggacataagtaacaaggcttctggggagataaaaattgcctatacttactctgttagcttcgaggaagatgataagatcagatgggcgtctagatgggactatattctggagtctatgcctcatacccacattcagtggtttagcattatgaattccctggtcattgttctcttcttatctggaatggtagctatgattatgttacggacactgcacaaagatattgctagatataatcagatggactctacggaagatgcccaggaagaatttggctggaaacttgttcatggtgatatattccgtcctccaagaaaagggatgctgctatcagtctttctaggatccgggacacagattttaattatgacctttgtgactctatttttcgcttgcctgggatttttgtcacctgccaaccgaggagcgctgatgacgtgtgctgtggtcctgtgggtgctgctgggcacccctgcaggctatgttgctgccagattctataagtcctttggaggtgagaagtggaaaacaaatgttttattaacatcatttctttgtcctgggattgtatttgctgacttctttataatgaatctgatcctctggggagaaggatcttcagcagctattccttttgggacactggttgccatattggccctttggttctgcatatctgtgcctctgacgtttattggtgcatactttggttttaagaagaatgccattgaacacccagttcgaaccaatcagattccacgtcagattcctgaacagtcgttctacacgaagcccttgcctggtattatcatgggagggattttgccctttggctgcatctttatacaacttttcttcattctgaatagtatttggtcacaccagatgtattacatgtttggcttcctatttctggtgtttatcattttggttattacctgttctgaagcaactatacttctttgctatttccacctatgtgcagaggattatcattggcaatggcgttcattccttacgagtggctttactgcagtttatttcttaatctatgcagtacactacttcttttcaaaactgcagatcacgggaacagcaagcacaattctgtactttggttataccatgataatggttttgatcttctttctttttacaggaacaattggcttctttgcatgcttttggtttgttaccaaaatatacagtgtggtgaaggttgactgaagaagtccagtgtgtccagttaaaacagaaataaattaaactcttcatcaacaaagacctgtttttgtgactgccttgagttttatcagaattattggcctagtaatccttcagaaacaccgtaattctaaataaacctcttcccatacacctttcccccataagatgtgtcttcaacactataaagcatttgtattgtgatttgattaagtatatatttggttgttctcaatgaagagcaaatttaaatattatgtgcatttgtaaatacagtagctataaaattttccatacttctaatggcagaatagaggaggccatattaaataatactgatgaaaggcaggacactgcattgtaaataggattttctaggctcggtaggcagaaagaattatttttctttgaaggaaataactttttatcatggtaattttgaaggatgattcctatgatgtgttcaccaggggaatgtggcttttaaagaaaatcttctattggttgtaactgttcatatcttcttacttttctgtgttgacttcattattcccatggtattggccttttaaactatgtgcctctgagtctttcaatttataaatttgttatcttaataaatattataaaaatg

SEQ ID NO: 300353 - DNA, 2777 bp, Homo sapiens
atgtgcagacggcggtgcgcatgctctgttgcggtccgcttcggtttctgttgcgggacccggggtgtctcctagcgcaaccggaactagccttctgggggccggcttcctttatctctggcggccttgtagtcgtctccgagactccccacccctccttccctcttgaccccctaggtttgattgccctttccccgaaacaactatcatgagcgcgaggctgccggtgttgtctccacctcggtggccgcggctgttgctgctgtcgctgctcctgctgggggcggttcctggcccgcgccggagcggcgctttctacctgcccggcctggcgcccgtcaacttctgcgacgaagaaacagtggaatcagttcttccttatgaatacacagcgtttgatttttgccaagcatcagaaggaaagcgcccatctgaaaatcttggtcaggtactattcggggaaagaattgaaccttcaccatataagtttacgtttaataagaaggagacctgtaagcttgtttgtacaaaaacataccatacagagaaagctgaagacaaacaaaagttagaattcttgaaaaaaagcatgttattgaattatcaacatcactggattgtggataatatgcctgtaacgtggtgttacgatgttgaagatggtcagaggttctgtaatcctggatttcctattggctgttacattacagataaaggccatgcaaaagatgcctgtgttattagttcagatttccatgaaagagatacattttacatcttcaaccatgttgacatcaaaatatactatcatgttgttgaaactgggtccatgggagcaagattagtggctgctaaacttgaaccgaaaagcttcaaacatacccatatagataaaccagactgctcagggccccccatggacataagtaacaaggcttctggggagataaaaattgcctatacttactctgttagcttcgaggaagatgataagatcagatgggcgtctagatgggactatattctggagtctatgcctcatacccacattcagtggtttagcattatgaattccctggtcattgttctcttcttatctggaatggtagctatgattatgttacggacactgcacaaagatattgctagatataatcagatggactctacggaagatgcccaggaagaatttggctggaaacttgttcatggtgatatattccgtcctccaagaaaagggatgctgctatcagtctttctaggatccgggacacagattttaattatgacctttgtgactctatttttcgcttgcctgggatttttgtcacctgccaaccgaggagcgctgatgacgtgtgctgtggtcctgtgggtgctgctgggcacccctgcaggctatgttgctgccagattctataagtcctttggaggtgagaagtggaaaacaaatgttttattaacatcatttctttgtcctgggattgtatttgctgacttctttataatgaatctgatcctctggggagaaggatcttcagcagctattccttttgggacactggttgccatattggccctttggttctgcatatctgtgcctctgacgtttattggtgcatactttggttttaagaagaatgccattgaacacccagttcgaaccaatcagattccacgtcagattcctgaacagtcgttctacacgaagcccttgcctggtattatcatgggagggattttgccctttggctgcatctttatacaacttttcttcattctgaatagtatttggtcacaccagatgtattacatgtttggcttcctatttctggtgtttatcattttggttattacctgttctgaagcaactatacttctttgctatttccacctatgtgcagaggattatcattggcaatggcgttcattccttacgagtggctttactgcagtttatttcttaatctatgcagtacactacttcttttcaaaactgcagatcacgggaacagcaagcacaattctgtactttggttataccatgataatggttttgatcttctttctttttacaggaacaattggcttctttgcatgcttttggtttgttaccaaaatatacagtgtggtgaaggttgactgaagaagtccagtgtgtccagttaaaacagaaataaattaaactcttcatcaacaaagacctgtttttgtgactgccttgagttttatcagaattattggcctagtaatccttcagaaacaccgtaattctaaataaacctcttcccatacacctttcccccataagatgtgtcttcaacactataaagcatttgtattgtgatttgattaagtatatatttggttgttctcaatgaagagcaaatttaaatattatgtgcatttgtaaatacagtagctataaaattttccatacttctaatggcagaatagaggaggccatattaaataatactgatgaaaggcaggacactgcattgtaaataggattttctaggctcggtaggcagaaagaattatttttctttgaaggaaataactttttatcatggtaattttgaaggatgattcctatgatgtgttcaccaggggaatgtggcttttaaagaaaatcttctattggttgtaactgttcatatcttcttacttttctgtgttgacttcattattcccatggtattggccttttaaactatgtgcctctgagtctttcaatttataaatttgttatcttaataaatattataaaaatg

SEQ ID NO: 300354 - DNA, 2643 bp, Homo sapiens
agcggacagtgtgtaagtctacagttgtgtacagtagtgtcctaggccttcacattcattcaccgctcactcacccagagcagcttccagccttgcaagttctattcatggccgaaatagaactatttgtgaacagacttgattcagtggaatcagttcttccttatgaatacacagccactcttcacagagggtctttttagccatgcttcacatattgggatgtgttggcaagtgtactgagatgagacaactgcaggtttgatttttgccaagcatcagaaggaaagcgcccatctgaaaatcttggtcaggtactattcggggaaagaattgaaccttcaccatataagtttacgtttaataagaaggagacctgtaagcttgtttgtacaaaaacataccatacagagaaagctgaagacaaacaaaagttagaattcttgaaaaaaagcatgttattgaattatcaacatcactggattgtggataatatgcctgtaacgtggtgttacgatgttgaagatggtcagaggttctgtaatcctggatttcctattggctgttacattacagataaaggccatgcaaaagatgcctgtgttattagttcagatttccatgaaagagatacattttacatcttcaaccatgttgacatcaaaatatactatcatgttgttgaaactgggtccatgggagcaagattagtggctgctaaacttgaaccgaaaagcttcaaacatacccatatagataaaccagactgctcagggccccccatggacataagtaacaaggcttctggggagataaaaattgcctatacttactctgttagcttcgaggaagatgataagatcagatgggcgtctagatgggactatattctggagtctatgcctcatacccacattcagtggtttagcattatgaattccctggtcattgttctcttcttatctggaatggtagctatgattatgttacggacactgcacaaagatattgctagatataatcagatggactctacggaagatgcccaggaagaatttggctggaaacttgttcatggtgatatattccgtcctccaagaaaagggatgctgctatcagtctttctaggatccgggacacagattttaattatgacctttgtgactctatttttcgcttgcctgggatttttgtcacctgccaaccgaggagcgctgatgacgtgtgctgtggtcctgtgggtgctgctgggcacccctgcaggctatgttgctgccagattctataagtcctttggaggtgagaagtggaaaacaaatgttttattaacatcatttctttgtcctgggattgtatttgctgacttctttataatgaatctgatcctctggggagaaggatcttcagcagctattccttttgggacactggttgccatattggccctttggttctgcatatctgtgcctctgacgtttattggtgcatactttggttttaagaagaatgccattgaacacccagttcgaaccaatcagattccacgtcagattcctgaacagtcgttctacacgaagcccttgcctggtattatcatgggagggattttgccctttggctgcatctttatacaacttttcttcattctgaatagtatttggtcacaccagatgtattacatgtttggcttcctatttctggtgtttatcattttggttattacctgttctgaagcaactatacttctttgctatttccacctatgtgcagaggattatcattggcaatggcgttcattccttacgagtggctttactgcagtttatttcttaatctatgcagtacactacttcttttcaaaactgcagatcacgggaacagcaagcacaattctgtactttggttataccatgataatggttttgatcttctttctttttacaggaacaattggcttctttgcatgcttttggtttgttaccaaaatatacagtgtggtgaaggttgactgaagaagtccagtgtgtccagttaaaacagaaataaattaaactcttcatcaacaaagacctgtttttgtgactgccttgagttttatcagaattattggcctagtaatccttcagaaacaccgtaattctaaataaacctcttcccatacacctttcccccataagatgtgtcttcaacactataaagcatttgtattgtgatttgattaagtatatatttggttgttctcaatgaagagcaaatttaaatattatgtgcatttgtaaatacagtagctataaaattttccatacttctaatggcagaatagaggaggccatattaaataatactgatgaaaggcaggacactgcattgtaaataggattttctaggctcggtaggcagaaagaattatttttctttgaaggaaataactttttatcatggtaattttgaaggatgattcctatgatgtgttcaccaggggaatgtggcttttaaagaaaatcttctattggttgtaactgttcatatcttcttacttttctgtgttgacttcattattcccatggtattggccttttaaactatgtgcctctgagtctttcaatttataaatttgttatcttaataaatattataaaaatg

SEQ ID NO: 300355 - DNA, 2020 bp, Homo sapiens
cctgtcagtcgctcgtggacaattagggaagttcagcaagtcaggacaaaatctgtttatcccccaaattactacaaagcatagcgggctctatgttggctctgttcgtagctccggtcagtcgctctgggcctgtaaccagactgctcagggccccccatggacataagtaacaaggcttctggggagataaaaattgcctatacttactctgttagcttcgaggaagatgataagatcagatgggcgtctagatgggactatattctggagtctatgcctcatacccacattcagtggtttagcattatgaattccctggtcattgttctcttcttatctggaatggtagctatgattatgttacggacactgcacaaagatattgctagatataatcagatggactctacggaagatgcccaggaagaatttggctggaaacttgttcatggtgatatattccgtcctccaagaaaagggatgctgctatcagtctttctaggatccgggacacagattttaattatgacctttgtgactctatttttcgcttgcctgggatttttgtcacctgccaaccgaggagcgctgatgacgtgtgctgtggtcctgtgggtgctgctgggcacccctgcaggctatgttgctgccagattctataagtcctttggaggtgagaagtggaaaacaaatgttttattaacatcatttctttgtcctgggattgtatttgctgacttctttataatgaatctgatcctctggggagaaggatcttcagcagctattccttttgggacactggttgccatattggccctttggttctgcatatctgtgcctctgacgtttattggtgcatactttggttttaagaagaatgccattgaacacccagttcgaaccaatcagattccacgtcagattcctgaacagtcgttctacacgaagcccttgcctggtattatcatgggagggattttgccctttggctgcatctttatacaacttttcttcattctgaatagtatttggtcacaccagatgtattacatgtttggcttcctatttctggtgtttatcattttggttattacctgttctgaagcaactatacttctttgctatttccacctatgtgcagaggattatcattggcaatggcgttcattccttacgagtggctttactgcagtttatttcttaatctatgcagtacactacttcttttcaaaactgcagatcacgggaacagcaagcacaattctgtactttggttataccatgataatggttttgatcttctttctttttacaggaacaattggcttctttgcatgcttttggtttgttaccaaaatatacagtgtggtgaaggttgactgaagaagtccagtgtgtccagttaaaacagaaataaattaaactcttcatcaacaaagacctgtttttgtgactgccttgagttttatcagaattattggcctagtaatccttcagaaacaccgtaattctaaataaacctcttcccatacacctttcccccataagatgtgtcttcaacactataaagcatttgtattgtgatttgattaagtatatatttggttgttctcaatgaagagcaaatttaaatattatgtgcatttgtaaatacagtagctataaaattttccatacttctaatggcagaatagaggaggccatattaaataatactgatgaaaggcaggacactgcattgtaaataggattttctaggctcggtaggcagaaagaattatttttctttgaaggaaataactttttatcatggtaattttgaaggatgattcctatgatgtgttcaccaggggaatgtggcttttaaagaaaatcttctattggttgtaactgttcatatcttcttacttttctgtgttgacttcattattcccatggtattggccttttaaactatgtgcctctgagtctttcaatttataaatttgttatcttaataaatattataaaaatg

SEQ ID NO: 300356 - DNA, 2429 bp, Homo sapiens
gtttccgattgggagattgtcttagaaaattgaagggagtatttttattagcgaagtttcttaaaatgcaagtttatcattaaaatgcaagaatcttaggcagtgttccaactctattttttaaaacttttggcaatccaatatagttgtgatgtttaatatccccgtataatgtttcattttgcaaacctggtgcagtaaatagtatatatttctagatattaagagctcagtgtgcctggaatgactggtctagagtaatagctgcccccggcataaagaaaagaataattattccattccattccattattttcttaaaaaaaaaaaaaaacctacatataggtctaaatgttgacatctaaacatctagttataatttaaagcaatacttttagtaggtattactaggaattcttttttttttttttttgggttgcataatcttactctgatttcccctagactttagtaaatctgaaactctccaaatctcaggactaaccaaagttagataatttagaaattgcagttgttgactcaatggaaggacaagctttgaatgggatttttttttgttcttaatgtgctgtcagcagatgtttacttaaagagattttttaatctcctctaggaagatgataagatcagatgggcgtctagatgggactatattctggagtctatgcctcatacccacattcagtggtttagcattatgaattccctggtcattgttctcttcttatctggaatggtagctatgattatgttacggacactgcacaaagatattgctagatataatcagatggactctacggaagatgcccaggaagaatttggctggaaacttgttcatggtgatatattccgtcctccaagaaaagggatgctgctatcagtctttctaggatccgggacacagattttaattatgacctttgtgactctatttttcgcttgcctgggatttttgtcacctgccaaccgaggagcgctgatgacgtgtgctgtggtcctgtgggtgctgctgggcacccctgcaggctatgttgctgccagattctataagtcctttggaggtgagaagtggaaaacaaatgttttattaacatcatttctttgtcctgggattgtatttgctgacttctttataatgaatctgatcctctggggagaaggatcttcagcagctattccttttgggacactggttgccatattggccctttggttctgcatatctgtgcctctgacgtttattggtgcatactttggttttaagaagaatgccattgaacacccagttcgaaccaatcagattccacgtcagattcctgaacagtcgttctacacgaagcccttgcctggtattatcatgggagggattttgccctttggctgcatctttatacaacttttcttcattctgaatagtatttggtcacaccagatgtattacatgtttggcttcctatttctggtgtttatcattttggttattacctgttctgaagcaactatacttctttgctatttccacctatgtgcagaggattatcattggcaatggcgttcattccttacgagtggctttactgcagtttatttcttaatctatgcagtacactacttcttttcaaaactgcagatcacgggaacagcaagcacaattctgtactttggttataccatgataatggttttgatcttctttctttttacaggaacaattggcttctttgcatgcttttggtttgttaccaaaatatacagtgtggtgaaggttgactgaagaagtccagtgtgtccagttaaaacagaaataaattaaactcttcatcaacaaagacctgtttttgtgactgccttgagttttatcagaattattggcctagtaatccttcagaaacaccgtaattctaaataaacctcttcccatacacctttcccccataagatgtgtcttcaacactataaagcatttgtattgtgatttgattaagtatatatttggttgttctcaatgaagagcaaatttaaatattatgtgcatttgtaaatacagtagctataaaattttccatacttctaatggcagaatagaggaggccatattaaataatactgatgaaaggcaggacactgcattgtaaataggattttctaggctcggtaggcagaaagaattatttttctttgaaggaaataactttttatcatggtaattttgaaggatgattcctatgatgtgttcaccaggggaatgtggcttttaaagaaaatcttctattggttgtaactgttcatatcttcttacttttctgtgttgacttcattattcccatggtattggccttttaaactatgtgcctctgagtctttcaatttataaatttgttatcttaataaatattataaaaatg

SEQ ID NO: 300357 - DNA, 3194 bp, Homo sapiens
gtttccgattgggagattgtcttagaaaattgaagggagtatttttattagcgaagtttcttaaaatgcaagtttatcattaaaatgcaagaatcttaggcagtgttccaactctattttttaaaacttttggcaatccaatatagttgtgatgtttaatatccccgtataatgtttcattttgcaaacctggtgcagtaaatagtatatatttctagatattaagagctcagtgtgcctggaatgactggtctagagtaatagctgcccccggcataaagaaaagaataattattccattccattccattattttcttaaaaaaaaaaaaaaacctacatataggtctaaatgttgacatctaaacatctagttataatttaaagcaatacttttagtaggtattactaggaattcttttttttttttttttgggttgcataatcttactctgatttcccctagactttagtaaatctgaaactctccaaatctcaggactaaccaaagttagataatttagaaattgcagttgttgactcaatggaaggacaagctttgaatgggatttttttttgttcttaatgtgctgtcagcagatgtttacttaaagagattttttaatctcctctaggaagatgataagatcagatgggcgtctagatgggactatattctggagtctatgcctcatacccacattcagtggtttaggtaagagtacagagttagcctgcttttgctttctacttttctaccctctgtccctttgaacatctcatttactctcaaatcctctctactttattcaaaagtctggccttgggttcaaatcctggctttcagccactgattgtgagtcacagcaggtcccttaatttctcagcgtctgtttctttatctagaaatacccaccttatgggattgttgtgaggattaaaggacatcatgggacagaatatttgaggacattgtctggcacataagagtgttcagaaacagaagccgctgttgttgctatgactttattattatccccttcaaacatgattcaaaacttttatctagagttgttcatgttgccataactctccttttcctattgctgtctgatctttttgacactcactaatttactgagtaaagttgttcttcagtaaatttcttgagggcacaagccagtcctttgttgtggcagtgatttgggcacagtagttatttcataatattgaccatgtaccaaaaaattctagttctaaacagactatgaaactgtattatgataagtatataatgttatttatctactggagggaaacatgaaagaacacagttcattgaatttgttggatttcagatagctttcattttgattttgatcaagactgttttaatgttactcaataaacagtttttaaaagagttttactgttcctaggattaagctacagattactcatgatgtgcttatttctacagcattatgaattccctggtcattgttctcttcttatctggaatggtagctatgattatgttacggacactgcacaaagatattgctagatataatcagatggactctacggaagatgcccaggaagaatttggctggaaacttgttcatggtgatatattccgtcctccaagaaaagggatgctgctatcagtctttctaggatccgggacacagattttaattatgacctttgtgactctatttttcgcttgcctgggatttttgtcacctgccaaccgaggagcgctgatgacgtgtgctgtggtcctgtgggtgctgctgggcacccctgcaggctatgttgctgccagattctataagtcctttggaggtgagaagtggaaaacaaatgttttattaacatcatttctttgtcctgggattgtatttgctgacttctttataatgaatctgatcctctggggagaaggatcttcagcagctattccttttgggacactggttgccatattggccctttggttctgcatatctgtgcctctgacgtttattggtgcatactttggttttaagaagaatgccattgaacacccagttcgaaccaatcagattccacgtcagattcctgaacagtcgttctacacgaagcccttgcctggtattatcatgggagggattttgccctttggctgcatctttatacaacttttcttcattctgaatagtatttggtcacaccagatgtattacatgtttggcttcctatttctggtgtttatcattttggttattacctgttctgaagcaactatacttctttgctatttccacctatgtgcagaggattatcattggcaatggcgttcattccttacgagtggctttactgcagtttatttcttaatctatgcagtacactacttcttttcaaaactgcagatcacgggaacagcaagcacaattctgtactttggttataccatgataatggttttgatcttctttctttttacaggaacaattggcttctttgcatgcttttggtttgttaccaaaatatacagtgtggtgaaggttgactgaagaagtccagtgtgtccagttaaaacagaaataaattaaactcttcatcaacaaagacctgtttttgtgactgccttgagttttatcagaattattggcctagtaatccttcagaaacaccgtaattctaaataaacctcttcccatacacctttcccccataagatgtgtcttcaacactataaagcatttgtattgtgatttgattaagtatatatttggttgttctcaatgaagagcaaatttaaatattatgtgcatttgtaaatacagtagctataaaattttccatacttctaatggcagaatagaggaggccatattaaataatactgatgaaaggcaggacactgcattgtaaataggattttctaggctcggtaggcagaaagaattatttttctttgaaggaaataactttttatcatggtaattttgaaggatgattcctatgatgtgttcaccaggggaatgtggcttttaaagaaaatcttctattggttgtaactgttcatatcttcttacttttctgtgttgacttcattattcccatggtattggccttttaaactatgtgcctctgagtctttcaatttataaatttgttatcttaataaatattataaaaatg

SEQ ID NO: 300358 - DNA, 2816 bp, Homo sapiens
atgtgcagacggcggtgcgcatgctctgttgcggtccgcttcggtttctgttgcgggacccggggtgtctcctagcgcaaccggaactagccttctgggggccggcttcctttatctctggcggccttgtagtcgtctccgagactccccacccctccttccctcttgaccccctaggtttgattgccctttccccgaaacaactatcatgagcgcgaggctgccggtgttgtctccacctcggtggccgcggctgttgctgctgtcgctgctcctgctgggggcggttcctggcccgcgccggagcggcgctttctacctgcccggcctggcgcccgtcaacttctgcgacgaagaaaaaaagagcgacgagtgcaaggccgaaatagaactatttgtgaacagacttgattcagtggaatcagttcttccttatgaatacacagcgtttgatttttgccaagcatcagaaggaaagcgcccatctgaaaatcttggtcaggtactattcggggaaagaattgaaccttcaccatataagtttacgtttaataagaaggagacctgtaagcttgtttgtacaaaaacataccatacagagaaagctgaagacaaacaaaagttagaattcttgaaaaaaagcatgttattgaattatcaacatcactggattgtggataatatgcctgtaacgtggtgttacgatgttgaagatggtcagaggttctgtaatcctggatttcctattggctgttacattacagataaaggccatgcaaaagatgcctgtgttattagttcagatttccatgaaagagatacattttacatcttcaaccatgttgacatcaaaatatactatcatgttgttgaaactgggtccatgggagcaagattagtggctgctaaacttgaaccgaaaagcttcaaacatacccatatagataaaccagactgctcagggccccccatggacataagtaacaaggcttctggggagataaaaattgcctatacttactctgttagcttcgaggaagatgataagatcagatgggcgtctagatgggactatattctggagtctatgcctcatacccacattcagtggtttagcattatgaattccctggtcattgttctcttcttatctggaatggtagctatgattatgttacggacactgcacaaagatattgctagatataatcagatggactctacggaagatgcccaggaagaatttggctggaaacttgttcatggtgatatattccgtcctccaagaaaagggatgctgctatcagtctttctaggatccgggacacagattttaattatgacctttgtgactctatttttcgcttgcctgggatttttgtcacctgccaaccgaggagcgctgatgacgtgtgctgtggtcctgtgggtgctgctgggcacccctgcaggctatgttgctgccagattctataagtcctttggaggtgagaagtggaaaacaaatgttttattaacatcatttctttgtcctgggattgtatttgctgacttctttataatgaatctgatcctctggggagaaggatcttcagcagctattccttttgggacactggttgccatattggccctttggttctgcatatctgtgcctctgacgtttattggtgcatactttggttttaagaagaatgccattgaacacccagttcgaaccaatcagattccacgtcagattcctgaacagtcgttctacacgaagcccttgcctgggattttgccctttggctgcatctttatacaacttttcttcattctgaatagtatttggtcacaccagatgtattacatgtttggcttcctatttctggtgtttatcattttggttattacctgttctgaagcaactatacttctttgctatttccacctatgtgcagaggattatcattggcaatggcgttcattccttacgagtggctttactgcagtttatttcttaatctatgcagtacactacttcttttcaaaactgcagatcacgggaacagcaagcacaattctgtactttggttataccatgataatggttttgatcttctttctttttacaggaacaattggcttctttgcatgcttttggtttgttaccaaaatatacagtgtggtgaaggttgactgaagaagtccagtgtgtccagttaaaacagaaataaattaaactcttcatcaacaaagacctgtttttgtgactgccttgagttttatcagaattattggcctagtaatccttcagaaacaccgtaattctaaataaacctcttcccatacacctttcccccataagatgtgtcttcaacactataaagcatttgtattgtgatttgattaagtatatatttggttgttctcaatgaagagcaaatttaaatattatgtgcatttgtaaatacagtagctataaaattttccatacttctaatggcagaatagaggaggccatattaaataatactgatgaaaggcaggacactgcattgtaaataggattttctaggctcggtaggcagaaagaattatttttctttgaaggaaataactttttatcatggtaattttgaaggatgattcctatgatgtgttcaccaggggaatgtggcttttaaagaaaatcttctattggttgtaactgttcatatcttcttacttttctgtgttgacttcattattcccatggtattggccttttaaactatgtgcctctgagtctttcaatttataaatttgttatcttaataaatattataaaaatg

SEQ ID NO: 300359 - DNA, 2659 bp, Homo sapiens
atgtgcagacggcggtgcgcatgctctgttgcggtccgcttcggtttctgttgcgggacccggggtgtctcctagcgcaaccggaactagccttctgggggccggcttcctttatctctggcggccttgtagtcgtctccgagactccccacccctccttccctcttgaccccctaggtttgattgccctttccccgaaacaactatcatgagcgcgaggctgccggtgttgtctccacctcggtggccgcggctgttgctgctgtcgctgctcctgctgggggcggttcctggcccgcgccggagcggcgctttctacctgcccggcctggcgcccgtcaacttctgcgacgaagaaaaaaagagcgacgagtgcaaggccgaaatagaactatttgtgaacagacttgattcagtggaatcagttcttccttatgaatacacagcgtttgatttttgccaagcatcagaaggaaagcgcccatctgaaaatcttggtcaggtactattcggggaaagaattgaaccttcaccatataagtttacgtttaataagaaggagacctgtaagcttgtttgtacaaaaacataccatacagagaaagctgaagacaaacaaaagttagaattcttgaaaaaaagcatgttattgaattatcaacatcactggattgtggataatatgcctgtaacgtggtgttacgatgttgaagatggtcagaggttctgtaatcctggatttcctattggctgttacattacagataaaggccatgcaaaagatgcctgtgttattagttcagatttccatgaaagagatacattttacatcttcaaccatgttgacatcaaaatatactatcatgttgttgaaactgggtccatgggagcaagattagtggctgctaaacttgaaccgaaaagcttcaaacatacccatatagataaaccagactgctcagggccccccatggacataagtaacaaggcttctggggagataaaaattgcctatacttactctgttagcttcgaggaagatgataagatcagatgggcgtctagatgggactatattctggagtctatgcctcatacccacattcagtggtttagcattatgaattccctggtcattgttctcttcttatctggaatggtagctatgattatgttacggacactgcacaaagatattgctagatataatcagatggactctacggaagatgcccaggaagaatttggctggaaacttgttcatggtgatatattccgtcctccaagaaaagggatgctgctatcagtctttctaggatccgggacacagattttaattatgacctttgtgactctatttttcgcttgcctgggatttttgtcacctgccaaccgaggagcgctgatgacgtgtgctgtggtcctgtgggtgctgctgggcacccctgcaggctatgttgctgccagattctataagtcctttggaggtgagaagtggaaaacaaatgttttattaacatcatttctttgtcctgggattgtatttgctgacttctttataatgaatctgatcctctggggagaaggatcttcagcagctattccttttgggacactggttgccatattggccctttggttctgcatatctgtgcctctgacgtttattggtgcatactttggttttaagaagaatgccattgaacacccagttcgaaccaatcagattccacgtcagattcctgaacagtcgttctacacgaagcccttgcctggtattatcatgggagggattttgccctttggctgcatctttatacaacttttcttcattctgaatagtatttggtcacaccagatgtattacatgtttggcttcctatttctggtgtttatcattttggttattacctgttctgaagcaactatacttctttgctatttccacctatgtgcagaggaacaattggcttctttgcatgcttttggtttgttaccaaaatatacagtgtggtgaaggttgactgaagaagtccagtgtgtccagttaaaacagaaataaattaaactcttcatcaacaaagacctgtttttgtgactgccttgagttttatcagaattattggcctagtaatccttcagaaacaccgtaattctaaataaacctcttcccatacacctttcccccataagatgtgtcttcaacactataaagcatttgtattgtgatttgattaagtatatatttggttgttctcaatgaagagcaaatttaaatattatgtgcatttgtaaatacagtagctataaaattttccatacttctaatggcagaatagaggaggccatattaaataatactgatgaaaggcaggacactgcattgtaaataggattttctaggctcggtaggcagaaagaattatttttctttgaaggaaataactttttatcatggtaattttgaaggatgattcctatgatgtgttcaccaggggaatgtggcttttaaagaaaatcttctattggttgtaactgttcatatcttcttacttttctgtgttgacttcattattcccatggtattggccttttaaactatgtgcctctgagtctttcaatttataaatttgttatcttaataaatattataaaaatg

SEQ ID NO: 300360 - DNA, 1534 bp, Homo sapiens
aaaacatgtaaggaactgactttcataggctgctgggaggagtttaactcaggcaaacccaatctgaagagcaattgggtagtttctagtcaagttttacattcagacatcctgtgatgcagcaattccactttctttgtatatatatattagaaacatagaagttgtcatattaattacatactactgttgcattttgttatctctggttttacccaaaagcctgttgtgtctttcaggattgtatttgctgacttctttataatgaatctgatcctctggggagaaggatcttcagcagctattccttttgggacactggttgccatattggccctttggttctgcatatctgtgcctctgacgtttattggtgcatactttggttttaagaagaatgccattgaacacccagttcgaaccaatcagattccacgtcagattcctgaacagtcgttctacacgaagcccttgcctggtattatcatgggagggattttgccctttggctgcatctttatacaacttttcttcattctgaatagtatttggtcacaccagatgtattacatgtttggcttcctatttctggtgtttatcattttggttattacctgttctgaagcaactatacttctttgctatttccacctatgtgcagaggattatcattggcaatggcgttcattccttacgagtggctttactgcagtttatttcttaatctatgcagtacactacttcttttcaaaactgcagatcacgggaacagcaagcacaattctgtactttggttataccatgataatggttttgatcttctttctttttacaggaacaattggcttctttgcatgcttttggtttgttaccaaaatatacagtgtggtgaaggttgactgaagaagtccagtgtgtccagttaaaacagaaataaattaaactcttcatcaacaaagacctgtttttgtgactgccttgagttttatcagaattattggcctagtaatccttcagaaacaccgtaattctaaataaacctcttcccatacacctttcccccataagatgtgtcttcaacactataaagcatttgtattgtgatttgattaagtatatatttggttgttctcaatgaagagcaaatttaaatattatgtgcatttgtaaatacagtagctataaaattttccatacttctaatggcagaatagaggaggccatattaaataatactgatgaaaggcaggacactgcattgtaaataggattttctaggctcggtaggcagaaagaattatttttctttgaaggaaataactttttatcatggtaattttgaaggatgattcctatgatgtgttcaccaggggaatgtggcttttaaagaaaatcttctattggttgtaactgttcatatcttcttacttttctgtgttgacttcattattcccatggtattggccttttaaactatgtgcctctgagtctttcaatttataaatttgttatcttaataaatattataaaaatg

SEQ ID NO: 300361 - DNA, 2981 bp, Homo sapiens
  misc_feature (2297)..(2297): n is a, c, g, or t
atgtgcagacggcggtgcgcatgctctgttgcggtccgcttcggtttctgttgcgggacccggggtgtctcctagcgcaaccggaactagccttctgggggccggcttcctttatctctggcggccttgtagtcgtctccgagactccccacccctccttccctcttgaccccctaggtttgattgccctttccccgaaacaactatcatgagcgcgaggctgccggtgttgtctccacctcggtggccgcggctgttgctgctgtcgctgctcctgctgggggcggttcctggcccgcgccggagcggcgctttctacctgcccggcctggcgcccgtcaacttctgcgacgaagaaaaaaagagcgacgagtgcaaggccgaaatagaactatttgtgaacagacttgattcagtggaatcagttcttccttatgaatacacagcgtttgatttttgccaagcatcagaaggaaagcgcccatctgaaaatcttggtcaggtactattcggggaaagaattgaaccttcaccatataagtttacgtttaataagaaggagacctgtaagcttgtttgtacaaaaacataccatacagagaaagctgaagacaaacaaaagttagaattcttgaaaaaaagcatgttattgaattatcaacatcactggattgtggataatatgcctgtaacgtggtgttacgatgttgaagatggtcagaggttctgtaatcctggatttcctattggctgttacattacagataaaggccatgcaaaagatgcctgtgttattagttcagatttccatgaaagagatacattttacatcttcaaccatgttgacatcaaaatatactatcatgttgttgaaactgggtccatgggagcaagattagtggctgctaaacttgaaccgaaaagcttcaaacatacccatatagataaaccagactgctcagggccccccatggacataagtaacaaggcttctggggagataaaaattgcctatacttactctgttagcttcgaggaagatgataagatcagatgggcgtctagatgggactatattctggagtctatgcctcatacccacattcagtggtttagcattatgaattccctggtcattgttctcttcttatctggaatggtagctatgattatgttacggacactgcacaaagatattgctagatataatcagatggactctacggaagatgcccaggaagaatttggctggaaacttgttcatggtgatatattccgtcctccaagaaaagggatgctgctatcagtctttctaggatccgggacacagattttaattatgacctttgtgactctatttttcgcttgcctgggatttttgtcacctgccaaccgaggagcgctgatgacgtgtgctgtggtcctgtgggtgctgctgggcacccctgcaggctatgttgctgccagattctataagtcctttggaggtgagaagtggaaaacaaatgttttattaacatcatttctttgtcctgggattgtatttgctgacttctttataatgaatctgatcctctggggagaaggatcttcagcagctattccttttgggacactggttgccatattggccctttggttctgcatatctgtgcctctgacgtttattggtgcatactttggttttaagaagaatgccattgaacacccagttcgaaccaatcagattccacgtcagattcctgaacagtcgttctacacgaagcccttgcctggtattatcatgggagggattttgccctttggctgcatctttatacaacttttcttcattctgaatagtatttggtcacaccagatgtattacatgtttggcttcctatttctggtgtttatcattttggttattacctgttctgaagcaactatacttctttgctatttccacctatgtgcagaggattatcattggcaatggcgttcattccttacgagtggctttactgcagtttatttcttaatctatgcagtacactacttcttttcaaaactgcagatcacgggaacagcaagcacaattctgtactttggttataccatgataatggttttgatcttctttctttttacaggaacaattggcttctttgcatgcttttggtttgttaccaaaatatacagtgtggtgaaggttgactgaagaagtccagtgtgtccagttaaaacagaaataaattaaactcttcatcaacaaaaaaaaaaaaaaaaaaaaaaaaaaaaaaaagaaaaaagaaaanaaaaaaaaaaaaaaaaaaaaaaaaaaaaaaaaaaagaaaaaaaaaataaaaaaattacgaaaaatcaaataaggatataaaatgaggtggagcagtaggtctaaataacacaaacacagcggaaaggcaaataataacaagcaactgcttattacaaagaggagatgggtctctatgttggacccctccataaaagcgctcaagagtacttacgagtaatccacttacacccagtttaacgacaagcaaatctacggctcaagcattttatacggtagccacaggcttcttagggggcttcaaggtcattatggctcaacctatctacataatctgggttcatcagccaaacaataattccgtttgagcgttcacacaaccactcgcgcctcgaaagccgggagccgaaatacgggccactcggctaaaatcttagaaacaaaatgtcgccggcggcccgcacaatggaaaacggaaccaccaaacaaacgcaaagagcgcgccggcaccagacccaggagccacacgcacccactggtgaaggcccccaggaggatatcacgcagaggacaaacaagcacaaccacaccaaagacgcacacgagaacagcaacgcgaacagacgacctgaatagcaacgtcacgaagcgcacaatccaactcagagacaaaaagaacacaaaa

SEQ ID NO: 300362 - DNA, 1254 bp, Homo sapiens
tccatttaggtccattgtccatttaggtccattgtccatttaggtccatttaggtcctttggttctgcatatctgtgcctctgacgtttattggtgcatactttggttttaagaagaatgccattgaacacccagttcgaaccaatcagattccacgtcagattcctgaacagtcgttctacacgaagcccttgcctggtattatcatgggagggattttgccctttggctgcatctttatacaacttttcttcattctgaatagtatttggtcacaccagatgtattacatgtttggcttcctatttctggtgtttatcattttggttattacctgttctgaagcaactatacttctttgctatttccacctatgtgcagaggattatcattggcaatggcgttcattccttacgagtggctttactgcagtttatttcttaatctatgcagtacactacttcttttcaaaactgcagatcacgggaacagcaagcacaattctgtactttggttataccatgataatggttttgatcttctttctttttacaggaacaattggcttctttgcatgcttttggtttgttaccaaaatatacagtgtggtgaaggttgactgaagaagtccagtgtgtccagttaaaacagaaataaattaaactcttcatcaacaaagacctgtttttgtgactgccttgagttttatcagaattattggcctagtaatccttcagaaacaccgtaattctaaataaacctcttcccatacacctttcccccataagatgtgtcttcaacactataaagcatttgtattgtgatttgattaagtatatatttggttgttctcaatgaagagcaaatttaaatattatgtgcatttgtaaatacagtagctataaaattttccatacttctaatggcagaatagaggaggccatattaaataatactgatgaaaggcaggacactgcattgtaaataggattttctaggctcggtaggcagaaagaattatttttctttgaaggaaataactttttatcatggtaattttgaaggatgattcctatgatgtgttcaccaggggaatgtggcttttaaagaaaatcttctattggttgtaactgttcatatcttcttacttttctgtgttgacttcattattcccatggtattggccttttaaactatgtgcctctgagtctttcaatttataaatttgttatcttaataaatattataaaaatg

SEQ ID NO: 300363 - DNA, 1237 bp, Homo sapiens
cgtggcagacgcacgtgttttagagagcacaggattgggggtaaggtcgtagatcaacaggatcccaaggcagaagaatttttcttagtacagaacaaaatgaaaagtctcccatgtctacctccctctacacagacacagcaaccatccgatttctcaatcttttccccacctttcccccctttctattccacaaaaccgccattgtcatcatggcccgttctcaatgaagagcaaatttaaatattatgtgcatttgtaaatacagtagctataaaattttccatacttctaatggcagaatagaggaggccatattaaataatactgatgaaaggcaggacactgcattgtaaataggattttctaggctcggtaggcagaaagaattatttttctttgaaggaaataactttttatcatggtaattttgaaggatgattcctatgatgtgttcaccaggggaatgtggcttttaaagaaaatcttctattggttgtaactgttcatatcttcttacttttctgtgttgacttcattattcccatggtattggccttttaaactatgtgcctctgagtctttcaatttataaatttgttatcttaataaatattataaaaatgtcttcattgcatcattacctattatatattcaaggaggttctgtaaatacagatctatttaccaaggtgttttgaaatgatttatactattttatcagattttactggattttgttaatgtaacactttctgagttttgatctgaatggaatttcactgtgtaaggcattgtctaaaatgttcactgtgaggcagtagaggaggttgaagtcatgcatatctagacagatgaattatctgcaagtacttaaggtggagccttactacattgtcattaaggagtttctatttttgacttgtttttcaaaatacagtgttttaagtcaggttttattacctggacattagcaatcactagcaagtcttcatctttatgatttcattgttttaatttagatttcacaaacagttttacttctaagagttaagaaatgcactgtctttcacattcatctgactaattgaaatccatttatgtagaatataggaatggggggtgattctgaagtatcggtctgcttgtatctgtgagcatattcatttgtattttagggtctctctgcttgctgcttaggagagcaaatcagatactgtcattaaacttacaacta

SEQ ID NO: 300364 - DNA, 418 bp, Homo sapiens
agcttccaggcaggaaaagtgtttaaatgtataagcattagtgtgctcataatattttaaattttattttgtttcattttaaatgaaaggctagaaaatactagattagtgttcttttgaattggtacttattagattttatgtaaaaaaactgtaagaagcatataccttccccaattaatttttggcttaaaaagagtttaagtataaaattgaaacatgttaatgtgaaaggcttaaaattccattcaaacttaaattttcttacttgttgtagcccattttaaagttttaagttttgactcttatgtagtcagttttctacctttaacttttaagttctgttctgcagtcagatttccatgaaagagatacattttacatcttcaaccatgttgacatcaaaatatactatcat

SEQ ID NO: 300365 - DNA, 542 bp, Homo sapiens
aataactgtacttagaaaatatccccatttaatcattatttgaacctgttttaatgtattcatctcataccttaaaaaattctagtagcgttttccattttgttgtaaaatattcttaaataggaaaggacagttgacatccttcagtcttttctatgtagtaaggaaaataatgtgtattgtagaaagcttaggtaatcttatagtagaaaaaagttctaccaatttttgtaagaaacttgatttgaggtggtcgtatatttttcagacgtgctcatagatctgtagtatattcccggtgggtaatagtttatagttttgcgacttttttaaggaaccagtcattgtaagtctgtatttttgtgtaaagtatgaaacttcctttgaaaaggggtttattttgatcttctttctttttacaggaacaattggcttctttgcatgcttttggtttgttaccaaaatatacagtgtggtgaaggttgactgaagaagtccagtgtgtccagttaaaacagaaataaattaaactcttcatcaac

SEQ ID NO: 300366 - DNA, 1145 bp, Homo sapiens
cactttattcaggttattaggtttccaggtgtagacaaatgggtgtgttaaaatggggtgaattggactgttattagagaaaccagggtacatttcaagctgtggcatgacttggacccattaccccctggtgccaccctgggcgtttgcctggaatgggagaattccaggcaaccctggccaacccaggcttcctgcaccacccaagggtccctgcaagcttgctttgttaaagctttttttggagacctggaggcaactccccaggctggaaacggtcgatggtgagccaagccttgaagatttggaagaaagtacaacttgtctgggaacaagggatgggtttcaaccctgtcttgaagatcccgaaggtataatgttaacctttccctgttcgttcaaggtttacaattcgcgcaatagtgttcctgggaagaaagcctgggaccacttgaaccattgttcaaacatccaatttctgtctaattttttggtcaactgaagggtgcttggaacgtcaaattggcttccctcgcgttaataccctccgtgacctttcggttgcaaacctttttccctccccccatccctggagaaatgaacaagcaattcgcaagggtaaccaatcaaaaagcggaaaggcgagcaatggacccttggtgacggagtttaatagctcactgcaaatctaacttcatcatggtgaactaatttagagcatcctccagagctgaagcagaacattccagaacccgttgtggaaaaaccctttcaagaagctgttttaagaggctcgggcagcgtcttgaaaatgggcaccgctgggaggaggtggatgacttctttacaaaggaaaatggtagcagcttcagtgagaaactgcccttacaaacagtcccttctctgctgtcaatccaatactgctcccaaatcctgttttcagtgttcatttccctcaaggcaggcgctgggctcccacgacccctcaggacagatctggccgtcagccgcgggccgctgggaactccactcggggaactcctttccaagctgacctcagttttctcacaagaacccagttagctgatgttttattgtaattgtcttaatttgctaagaacaagtaataagtaaatttttaaaaa

SEQ ID NO: 300367 - DNA, 2244 bp, Homo sapiens
cgcctcgcgcatgcgccgcgctcgctcgcgggagggcatggcgggggccgtgccgggcgccatcatggacgaggactactacgggagcgcggccgagtggggcgacgaggctgacggcggccagcaggaggatgattctggagaaggagaggatgatgcggaggttcagcaagaatgcctgcataaattttccacccgggattatatcatggaaccctccatcttcaacactctgaagaggtattttcaggcaggagggtctccagagaatgttatccagctcttatctgaaaactacaccgctgtggcccagactgtgaacctgctggccgagtggctcattcagacaggtgttgagccagtgcaggttcaggaaactgtggaaaatcacttgaagagtttgctgatcaaacattttgacccccgcaaagcagattctatttttactgaagaaggagagaccccagcgtggctggaacagatgattgcacataccacgtggcgggaccttttttataaactggctgaagcccatccagactgtttgatgctgaacttcaccgttaagcttatttctgacgcagggtaccagggggagatcaccagtgtgtccacagcatgccagcagctagaagtgttctcgagagtgctccggacctctctagctacaattttagatggaggagaagaaaaccttgaaaaaaatctccctgagtttgccaagatggtgtgccacggggagcacacgtacctgtttgcccaggccatgatgtccgtgctggcccaggaggagcaggggggctccgctgtgcgcaggatcgcccaggaagtgcagcgctttgcccaggagaaaggtcatgacgccagtcagatcacactagccttgggcacagctgcctcctaccccagggcctgccaggctctcggggccatgctgtccaaaggagccctgaaccctgctgacatcaccgtcctgttcaagatgttcacaagcatggaccctcctccggttgaacttatccgcgttccagccttcctggacctgttcatgcagtcactctttaaaccaggggctcggatcaaccaggaccacaagcacaaatacatccacatcttggcgtacgcagcaagcgtggttgagacctggaagaagaacaagcgagtgagcatcaataaagatgagctgaagtcaacgtcaaaagctgtcgaaaccgttcacaatttgtgttgcaacgagaacaaaggggcctctgaactagtggcagaattgagcacactttatcagtgtattaggtttccagtggtagcaatgggtgtgctgaagtgggtggattggactgtatcagaaccaaggtactttcagctgcagactgaccatacccctgtccacctggcgttgctggatgagatcagcacctgccaccagctcctgcacccccaggtcctgcagctgcttgttaagctttttgagactgagcactcccagctggacgtgatggagcagcttgagttgaagaagacactgctggacaggatggttcacctgctgagtcgaggttatgtacttcctgttgtcagttacatccgaaagtgtctggagaagctggacactgacatttcactcattcgctattttgtcactgaggtgctggacgtcattgctcctccttatacctctgacttcgtgcaacttttcctccccatcctggagaatgacagcatcgcaggtaccatcaaaacggaaggcgagcatgaccctgtgacggagtttatagctcactgcaaatctaacttcatcatggtgaactaatttagagcatcctccagagctgaagcagaacattccagaacccgttgtggaaaaaccctttcaagaagctgttttaagaggctcgggcagcgtcttgaaaatgggcaccgctgggaggaggtggatgacttctttacaaaggaaaatggtagcagcttcagtgagaaactgcccttacaaacagtcccttctctgctgtcaatccaatactgctcccaaatcctgttttcagtgttcatttccctcaaggcaggcgctgggctcccacgacccctcaggacagatctggccgtcagccgcgggccgctgggaactccactcggggaactcctttccaagctgacctcagttttctcacaagaacccagttagctgatgttttattgtaattgtcttaatttgctaagaacaagtaataagtaaatttttaaaaa

SEQ ID NO: 300368 - DNA, 1772 bp, Homo sapiens
  misc_feature (66)..(66): n is a, c, g, or t
ataggctagtacgaggctgggtgtgaatcggccgaggccatccagacgttgatgctgaacttcacngttaagcttatttctgacgcagggtaccagggggagatcaccagtgtgtccacagcatgccagcagctagaagtgttctcgagagtgctccggacctctctagctacaattttagatggaggagaagaaaaccttgaaaaaaatctccctgagtttgccaagatggtgtgccacggggagcacacgtacctgtttgcccaggccatgatgtccgtgctggcccaggaggagcaggggggctccgctgtgcgcaggatcgcccaggaagtgcagcgctttgcccaggagaaaggtcatgacgccagtcagatcacactagccttgggcacagctgcctcctaccccagggcctgccaggctctcggggccatgctgtccaaaggagccctgaaccctgctgacatcaccgtcctgttcaagatgttcacaagcatggaccctcctccggttgaacttatccgcgttccagccttcctggacctgttcatgcagtcactctttaaaccaggggctcggatcaaccaggaccacaagcacaaatacatccacatcttggcgtacgcagcaagcgtggttgagacctggaagaagaacaagcgagtgagcatcaataaagatgagctgaagtcaacgtcaaaagctgtcgaaaccgttcacaatttgtgttgcaacgagaacaaaggggcctctgaactagtggcagaattgagcacactttatcagtgtattaggtttccagtggtagcaatgggtgtgctgaagtgggtggattggactgtatcagaaccaaggtactttcagctgcagactgaccatacccctgtccacctggcgttgctggatgagatcagcacctgccaccagctcctgcacccccaggtcctgcagctgcttgttaagctttttgagactgagcactcccagctggacgtgatggagcagcttgagttgaagaagacactgctggacaggatggttcacctgctgagtcgaggttatgtacttcctgttgtcagttacatccgaaagtgtctggagaagctggacactgacatttcactcattcgctattttgtcactgaggtgctggacgtcattgctcctccttatacctctgacttcgtgcaacttttcctccccatcctggagaatgacagcatcgcaggtaccatcaaaacggaaggcgagcatgaccctgtgacggagtttatagctcactgcaaatctaacttcatcatggtgaactaatttagagcatcctccagagctgaagcagaacattccagaacccgttgtggaaaaaccctttcaagaagctgttttaagaggctcgggcagcgtcttgaaaatgggcaccgctgggaggaggtggatgacttctttacaaaggaaaatggtagcagcttcagtgagaaactgcccttacaaacagtcccttctctgctgtcaatccaatactgctcccaaatcctgttttcagtgttcatttccctcaaggcaggcgctgggctcccacgacccctcaggacagatctggccgtcagccgcgggccgctgggaactccactcggggaactcctttccaagctgacctcagttttctcacaagaacccagttagctgatgttttattgtaattgtcttaatttgctaagaacaagtaataagtaaatttttaaaaagcctttctgctgggttggattaaa

SEQ ID NO: 300369 - DNA, 3400 bp, Homo sapiens
cgagcatgaccctgtgacggagtttatagctcactgcaaatctaaattagttcaccatgatgaagttagatttgcagtgagctataaactccgtcacagggtcatgctcgccttccgttttgatggtacctgcgatgctgtcattctccagaatcatcctcctgctggccgtgccgggcgccatcatggacgaggactactacgggagcgcggccgagtggggcgacgaggctgacggcggccagcaggaggatgattctggagaaggagaggatgatgcggaggttcagcaagaatgcctgcataaattttccacccgggattatatcatggaaccctccatcttcaacactctgaagaggtatgtgagaaaggtgtctgtattgggaggaggctgggggtaatttagagaaagttttgtaatacacccagaaggtgctatgtaaagcaagagtaacgcgaactgaactaaaggcttcaagggggggtcccctctgccactttttttttttttttaaatttttttaagacagagtcttgctctgttgcagtggcacaatcaccgctcactgcagcttcagcctcctggaatcaagcagttctcccacctcagccttgcaagctggccaccacaggcgtctgccatcatgcctggctatttttgtttttgttttttgggagagacagggctccttacgttgccctggctgctcttgaactcctaggctcaagtgattctcccacctctgcctcccaaagtgctgggattacaggtgtgcaccactgcacccagccccctccgctgctttaaaaattttgaaacctgattctcttcctccttccttaccttcctgttgtccatcattccattcattcgggtgtaattgctgttgttactttccctaggtattttcaggcaggagggtctccagagaatgttatccagctcttatctgaaaactacaccgctgtggcccagactgtgaacctgctggccgagtggctcattcagacaggtgttgagccagtgcaggttcaggaaactgtggaaaatcacttgaagagtttgctgatcaaacattttgacccccgcaaagcagattctatttttactgaagaaggagagaccccagcgtggctggaacagatgattgcacataccacgtggcgggaccttttttataaactggctgaagcccatccagactgtttgatgctgaacttcaccgttaaggtaggaagagttctagagttaaggagaaaagtgtttatgaatgtttatttttggttgttggtctgtttcctttgacagttcatatttgctttttttccataaaggtctttattgttttattttcataagccttacactgagaaagaaaagtgtaaaatttgtatctgtttttgggtcagtgttgactgtgttttaggatttagcagggatacaagaattctcttgtggttggagaggagctttaggcgtgcctgcttgatcttcctcttgcatatgaagaaacgatggagaggtggtcagcccagggcacacacctaggtgatagcagggtgagggcggagtgaaggcctgagacccacgaccagcgcacacttactccacctcaccatgaacactgacaagccagcttcccgtggaggtgcggtcactgcatgcctcccctctgacttcttgttttgtgtcctagcttatttctgacgcagggtaccagggggagatcaccagtgtgtccacagcatgccagcagctagaagtgttctcgagagtgctccggacctctctagctacaattttagatggaggagaagaaaaccttgaaaaaaatctccctgagtttgccaagatggtgtgccacggggagcacacgtacctgtttgcccaggccatgatgtccgtgctggcccaggaggagcaggggggctccgctgtgcgcaggatcgcccaggaagtgcagcgctttgcccaggagaaaggtcatgacgccagtcagatcacactagccttgggcacagctgcctcctaccccagggcctgccaggctctcggggccatgctgtccaaaggagccctgaaccctgctgacatcaccgtcctgttcaagatgttcacaagcatggaccctcctccggttgaacttatccgcgttccagccttcctggacctgttcatgcagtcactctttaaaccaggggctcggatcaaccaggaccacaagcacaaatacatccacatcttggcgtacgcagcaagcgtggttgagacctggaagaagaacaagcgagtgagcatcaataaagatgagctgaagtcaacgtcaaaagctgtcgaaaccgttcacaatttgtgttgcaacgagaacaaaggggcctctgaactagtggcagaattgagcacactttatcagtgtattaggtttccagtggtagcaatgggtgtgctgaagtgggtggattggactgtatcagaaccaaggtactttcagctgcagactgaccatacccctgtccacctggcgttgctggatgagatcagcacctgccaccagctcctgcacccccaggtcctgcagctgcttgttaagctttttgagactgagcactcccagctggacgtgatggagcagcttgagttgaagaagacactgctggacaggatggttcacctgctgagtcgaggttatgtacttcctgttgtcagttacatccgaaagtgtctggagaagctggacactgacatttcactcattcgctattttgtcactgaggtgctggacgtcattgctcctccttatacctctgacttcgtgcaacttttcctccccatcctggagaatgacagcatcgcaggtaccatcaaaacggaaggcgagcatgaccctgtgacggagtttatagctcactgcaaatctaacttcatcatggtgaactaatttagagcatcctccagagctgaagcagaacattccagaacccgttgtggaaaaaccctttcaagaagctgttttaagaggctcgggcagcgtcttgaaaatgggcaccgctgggaggaggtggatgacttctttacaaaggaaaatggtagcagcttcagtgagaaactgcccttacaaacagtcccttctctgctgtcaatccaatactgctcccaaatcctgttttcagtgttcatttccctcaaggcaggcgctgggctcccacgacccctcaggacagatctggccgtcagccgcgggccgctgggaactccactcggggaactcctttccaagctgacctcagttttctcacaagaacccagttagctgatgttttattgtaattgtcttaatttgctaagaacaagtaataagtaaatttttaaaaagcctttctgctgggttggattaaa

SEQ ID NO: 300370 - DNA, 4321 bp, Homo sapiens
cgagcatgaccctgtgacggagtttatagctcactgcaaatctaaattagttcaccatgatgaagttagatttgcagtgagctataaactccgtcacagggtcatgctcgccttccgttttgatggtacctgcgatgctgtcattctccagaatcatcctcctgctggccgtgccgggcgccatcatggacgaggactactacgggagcgcggccgagtggggcgacgaggctgacggcggccagcaggaggatgattctggagaaggagaggatgatgcggaggttcagcaagaatgcctgcataaattttccacccgggattatatcatggaaccctccatcttcaacactctgaagaggtatgtgagaaaggtgtctgtattgggaggaggctgggggtaatttagagaaagttttgtaatacacccagaaggtgctatgtaaagcaagagtaacgcgaactgaactaaaggcttcaagggggggtcccctctgccactttttttttttttttaaatttttttaagacagagtcttgctctgttgcagtggcacaatcaccgctcactgcagcttcagcctcctggaatcaagcagttctcccacctcagccttgcaagctggccaccacaggcgtctgccatcatgcctggctatttttgtttttgttttttgggagagacagggctccttacgttgccctggctgctcttgaactcctaggctcaagtgattctcccacctctgcctcccaaagtgctgggattacaggtgtgcaccactgcacccagccccctccgctgctttaaaaattttgaaacctgattctcttcctccttccttaccttcctgttgtccatcattccattcattcgggtgtaattgctgttgttactttccctaggtattttcaggcaggagggtctccagagaatgttatccagctcttatctgaaaactacaccgctgtggcccagactgtgaacctgctggccgagtggctcattcagacaggtgttgagccagtgcaggttcaggaaactgtggaaaatcacttgaagagtttgctgatcaaacattttgacccccgcaaagcagattctatttttactgaagaaggagagaccccagcgtggctggaacagatgattgcacataccacgtggcgggaccttttttataaactggctgaagcccatccagactgtttgatgctgaacttcaccgttaaggtaggaagagttctagagttaaggagaaaagtgtttatgaatgtttatttttggttgttggtctgtttcctttgacagttcatatttgctttttttccataaaggtctttattgttttattttcataagccttacactgagaaagaaaagtgtaaaatttgtatctgtttttgggtcagtgttgactgtgttttaggatttagcagggatacaagaattctcttgtggttggagaggagctttaggcgtgcctgcttgatcttcctcttgcatatgaagaaacgatggagaggtggtcagcccagggcacacacctaggtgatagcagggtgagggcggagtgaaggcctgagacccacgaccagcgcacacttactccacctcaccatgaacactgacaagccagcttcccgtggaggtgcggtcactgcatgcctcccctctgacttcttgttttgtgtcctagcttatttctgacgcagggtaccagggggagatcaccagtgtgtccacagcatgccagcagctagaagtgttctcgagagtgctccggacctctctagctacaattttagatggaggagaagaaaaccttgaaaaaaatctccctgagtttgccaagatggtgtgccacggggagcacacgtacctgtttgcccaggccatgatgtccgtgctggcccaggaggagcaggggggctccgctgtgcgcaggatcgcccaggaagtgcagcgctttgcccaggagaagtgagaggccctgtttctgctcagcccttccttcctagtgctccccacaaaacccttcccatggcccgtgttccacagccaaagctgctagctccttctgttcaacgtagaggtaaacttgcttttggctgggcgtggtggctcacgcctgtaatcccagcactttgggaggccgaggcggatggatcacctaaggtcaggagtttgagaccagcttgaccaacatggagaaaccccatctctggtaaacaaaaatacaaaattagccgggtgtggcggcacatgcctgtaatcccagctacttgggaggctgaggcaggagaatcgcttgaacctgggaggtggaggttgtggtcagccaagattgcaccattgcactccagcctgggcaacaagagcaaaactctgtctcaaaaaaaaaaaaaaaaattaaaaacttccttttatccagcagagctggaaaagttggagttgtttttggtatacttggagagctggctttctaaagtgctgctttgaggactgttgtgtaaagcacttgattcgtcttccctttgctggagttatgggcctgggcttttacactggggttctgaagtaacaaacaaagtcagtccagaaatagttgctcagcaatctcattgttacagtgtcgcaaaatgagctcatattagctttattttctgctaccaatagagtgttcctaagtatttaaagtgtgtgactcctttcttatagagccagcaagctgtattggaatcacttttccagtgttgtaaatgttatttttgtgggtcagtcagtatactcgtgaatgacagaaaaacagatcccaacaatgcaaagtattatatgtgtaaaaaagaacagaaaaaagaagctgccttgttagtaacgggctctatggtttttctcatcaagaggtcatgacgccagtcagatcacactagccttgggcacagctgcctcctaccccagggcctgccaggctctcggggccatgctgtccaaaggagccctgaaccctgctgacatcaccgtcctgttcaagatgttcacaagcatggaccctcctccggttgaacttatccgcgttccagccttcctggacctgttcatgcagtcactctttaaaccaggggctcggatcaaccaggaccacaagcacaaatacatccacatcttggcgtacgcagcaagcgtggttgagacctggaagaagaacaagcgagtgagcatcaataaagatgagctgaagtcaacgtcaaaagctgtcgaaaccgttcacaatttgtgttgcaacgagaacaaaggggcctctgaactagtggcagaattgagcacactttatcagtgtattaggtttccagtggtagcaatgggtgtgctgaagtgggtggattggactgtatcagaaccaaggtactttcagctgcagactgaccatacccctgtccacctggcgttgctggatgagatcagcacctgccaccagctcctgcacccccaggtcctgcagctgcttgttaagctttttgagactgagcactcccagctggacgtgatggagcagcttgagttgaagaagacactgctggacaggatggttcacctgctgagtcgaggttatgtacttcctgttgtcagttacatccgaaagtgtctggagaagctggacactgacatttcactcattcgctattttgtcactgaggtgctggacgtcattgctcctccttatacctctgacttcgtgcaacttttcctccccatcctggagaatgacagcatcgcaggtaccatcaaaacggaaggcgagcatgaccctgtgacggagtttatagctcactgcaaatctaacttcatcatggtgaactaatttagagcatcctccagagctgaagcagaacattccagaacccgttgtggaaaaaccctttcaagaagctgttttaagaggctcgggcagcgtcttgaaaatgggcaccgctgggaggaggtggatgacttctttacaaaggaaaatggtagcagcttcagtgagaaactgcccttacaaacagtcccttctctgctgtcaatccaatactgctcccaaatcctgttttcagtgttcatttccctcaaggcaggcgctgggctcccacgacccctcaggacagatctggccgtcagccgcgggccgctgggaactccactcggggaactcctttccaagctgacctcagttttctcacaagaacccagttagctgatgttttattgtaattgtcttaatttgctaagaacaagtaataagtaaatttttaaaaagcctttctgctgggttggattaaa

SEQ ID NO: 300371 - DNA, 2117 bp, Homo sapiens
  misc_feature (66)..(66): n is a, c, g, or t
ataggctagtacgaggctgggtgtgaatcggccgaggccatccagacgttgatgctgaacttcacngttaagcttatttctgacgcagggtaccagggggagatcaccagtgtgtccacagcatgccagcagctagaagtgttctcgagagtgctccggacctctctagctacaattttagatggaggagaagaaaaccttgaaaaaaatctccctgagtttgccaagatggtgtgccacggggagcacacgtacctgtttgcccaggccatgatgtccgtgctggcccaggaggagcaggggggctccgctgtgcgcaggatcgcccaggaagtgcagcgctttgcccaggagaaaggtcatgacgccagtcagatcacactagccttgggcacagctgcctcctaccccagggcctgccaggctctcggggccatgctgtccaaaggagccctgaaccctgctgacatcaccgtcctgttcaagatgttcacaagcatggaccctcctccggttgaacttatccgcgttccagccttcctggacctgttcatgcagtcactctttaaaccaggggctcggatcaaccaggaccacaagcacaaatacatccacatcttggcgtacgcagcaagcgtggttgagacctggaagaagaacaagcgagtgagcatcaataaagatgagctgaagtcaacgtcaaaagctgtcgaaaccgttcacaatttgtgttgcaacgagaacaaaggggcctctgaactagtggcagaattgagcacactttatcagtgtattaggtttccagtggtagcaatgggtgtgctgaagtgggtggattggactgtatcagaaccaaggtactttcagctgcagactgaccatacccctgtccacctggcgttgctggatgagatcagcacctgccaccagctcctgcacccccaggtcctgcagctgcttgttaagctttttgagactgagcactcccagctggacgtgatggagcagcttgagttgaagaagacactgctggacaggatggttcacctgctgagtcgaggttatgtacttcctgttgtcagttacatccgaaagtgtctggagaagctggacactgacatttcactcattcgctattttgtcactgaggtcagcaatgcaccgttggtttcatgtttcatactgtttacactagcactgccctttttggcttaatttagttcattttgtacctaactgagaactgtgctttctgatgtagtgatgacaatgacagatactcgtttaccaaaaagcaccttctgcctgcagcagctgtatgacacactttacctccattaccaccctgggcatctgaatgttggagatgggtggtgtcaccggccggtgggggtggggagggattttttccaaactgatggccatttcacccggatgtcggtggatgccccgcactagtgtgcggaagaagtcaccctgtgctcccccacgcaggtgctggacgtcattgctcctccttatacctctgacttcgtgcaacttttcctccccatcctggagaatgacagcatcgcaggtaccatcaaaacggaaggcgagcatgaccctgtgacggagtttatagctcactgcaaatctaacttcatcatggtgaactaatttagagcatcctccagagctgaagcagaacattccagaacccgttgtggaaaaaccctttcaagaagctgttttaagaggctcgggcagcgtcttgaaaatgggcaccgctgggaggaggtggatgacttctttacaaaggaaaatggtagcagcttcagtgagaaactgcccttacaaacagtcccttctctgctgtcaatccaatactgctcccaaatcctgttttcagtgttcatttccctcaaggcaggcgctgggctcccacgacccctcaggacagatctggccgtcagccgcgggccgctgggaactccactcggggaactcctttccaagctgacctcagttttctcacaagaacccagttagctgatgttttattgtaattgtcttaatttgctaagaacaagtaataagtaaatttttaaaaagcctttctgctgggttggattaaa

SEQ ID NO: 300372 - DNA, 4557 bp, Homo sapiens
cgagcatgaccctgtgacggagtttatagctcactgcaaatctaaattagttcaccatgatgaagttagatttgcagtgagctataaactccgtcacagggtcatgctcgccttccgttttgatggtacctgcgatgctgtcattctccagaatcatcctcctgctggccgtgccgggcgccatcatggacgaggactactacgggagcgcggccgagtggggcgacgaggctgacggcggccagcaggaggatgattctggagaaggagaggatgatgcggaggttcagcaagaatgcctgcataaattttccacccgggattatatcatggaaccctccatcttcaacactctgaagaggtatgtgagaaaggtgtctgtattgggaggaggctgggggtaatttagagaaagttttgtaatacacccagaaggtgctatgtaaagcaagagtaacgcgaactgaactaaaggcttcaagggggggtcccctctgccactttttttttttttttaaatttttttaagacagagtcttgctctgttgcagtggcacaatcaccgctcactgcagcttcagcctcctggaatcaagcagttctcccacctcagccttgcaagctggccaccacaggcgtctgccatcatgcctggctatttttgtttttgttttttgggagagacagggctccttacgttgccctggctgctcttgaactcctaggctcaagtgattctcccacctctgcctcccaaagtgctgggattacaggtgtgcaccactgcacccagccccctccgctgctttaaaaattttgaaacctgattctcttcctccttccttaccttcctgttgtccatcattccattcattcgggtgtaattgctgttgttactttccctaggtattttcaggcaggagggtctccagagaatgttatccagctcttatctgaaaactacaccgctgtggcccagactgtgaacctgctggccgagtggctcattcagacaggtgttgagccagtgcaggttcaggaaactgtggaaaatcacttgaagagtttgctgatcaaacattttgacccccgcaaagcagattctatttttactgaagaaggagagaccccagcgtggctggaacagatgattgcacataccacgtggcgggaccttttttataaactggctgaagcccatccagactgtttgatgctgaacttcaccgttaaggtaggaagagttctagagttaaggagaaaagtgtttatgaatgtttatttttggttgttggtctgtttcctttgacagttcatatttgctttttttccataaaggtctttattgttttattttcataagccttacactgagaaagaaaagtgtaaaatttgtatctgtttttgggtcagtgttgactgtgttttaggatttagcagggatacaagaattctcttgtggttggagaggagctttaggcgtgcctgcttgatcttcctcttgcatatgaagaaacgatggagaggtggtcagcccagggcacacacctaggtgatagcagggtgagggcggagtgaaggcctgagacccacgaccagcgcacacttactccacctcaccatgaacactgacaagccagcttcccgtggaggtgcggtcactgcatgcctcccctctgacttcttgttttgtgtcctagcttatttctgacgcagggtaccagggggagatcaccagtgtgtccacagcatgccagcagctagaagtgttctcgagagtgctccggacctctctagctacaattttagatggaggagaagaaaaccttgaaaaaaatctccctgagtttgccaagatggtgtgccacggggagcacacgtacctgtttgcccaggccatgatgtccgtgctggcccaggaggagcaggggggctccgctgtgcgcaggatcgcccaggaagtgcagcgctttgcccaggagaagtgagaggccctgtttctgctcagcccttccttcctagtgctccccacaaaacccttcccatggcccgtgttccacagccaaagctgctagctccttctgttcaacgtagaggtaaacttgcttttggctgggcgtggtggctcacgcctgtaatcccagcactttgggaggccgaggcggatggatcacctaaggtcaggagtttgagaccagcttgaccaacatggagaaaccccatctctggtaaacaaaaatacaaaattagccgggtgtggcggcacatgcctgtaatcccagctacttgggaggctgaggcaggagaatcgcttgaacctgggaggtggaggttgtggtcagccaagattgcaccattgcactccagcctgggcaacaagagcaaaactctgtctcaaaaaaaaaaaaaaaaattaaaaacttccttttatccagcagagctggaaaagttggagttgtttttggtatacttggagagctggctttctaaagtgctgctttgaggactgttgtgtaaagcacttgattcgtcttccctttgctggagttatgggcctgggcttttacactggggttctgaagtaacaaacaaagtcagtccagaaatagttgctcagcaatctcattgttacagtgtcgcaaaatgagctcatattagctttattttctgctaccaatagagtgttcctaagtatttaaagtgtgtgactcctttcttatagagccagcaagctgtattggaatcacttttccagtgttgtaaatgttatttttgtgggtcagtcagtatactcgtgaatgacagaaaaacagatcccaacaatgcaaagtattatatgtgtaaaaaagaacagaaaaaagaagctgccttgttagtaacgggctctatggtttttctcatcaagaggtcatgacgccagtcagatcacactagccttgggcacagctgcctcctaccccagggcctgccaggctctcggggccatgctgtccaaaggagccctgaaccctgctgacatcaccgtcctgttcaagatgttcacaagcatggaccctcctccggttgaacttgtaagttgcttctcaagaatccccaatgtcagctggtaaggtgactttggaaagtctgtgcttgtctgattgtctgaaggctgtgaatgcaaatccatcattgtcctggtccttcctcagtcacactctctgcctggagcctgttgggcccctgctgtgtagggaaccctgaggggaggtgggtgagcagtgccctcacgcctgccatcccgaactgggcatatgcttctcctcagatccgcgttccagccttcctggacctgttcatgcagtcactctttaaaccaggggctcggatcaaccaggaccacaagcacaaatacatccacatcttggcgtacgcagcaagcgtggttgagacctggaagaagaacaagcgagtgagcatcaataaagatgagctgaagtcaacgtcaaaagctgtcgaaaccgttcacaatttgtgttgcaacgagaacaaaggggcctctgaactagtggcagaattgagcacactttatcagtgtattaggtttccagtggtagcaatgggtgtgctgaagtgggtggattggactgtatcagaaccaaggtactttcagctgcagactgaccatacccctgtccacctggcgttgctggatgagatcagcacctgccaccagctcctgcacccccaggtcctgcagctgcttgttaagctttttgagactgagcactcccagctggacgtgatggagcagcttgagttgaagaagacactgctggacaggatggttcacctgctgagtcgaggttatgtacttcctgttgtcagttacatccgaaagtgtctggagaagctggacactgacatttcactcattcgctattttgtcactgaggtgctggacgtcattgctcctccttatacctctgacttcgtgcaacttttcctccccatcctggagaatgacagcatcgcaggtaccatcaaaacggaaggcgagcatgaccctgtgacggagtttatagctcactgcaaatctaacttcatcatggtgaactaatttagagcatcctccagagctgaagcagaacattccagaacccgttgtggaaaaaccctttcaagaagctgttttaagaggctcgggcagcgtcttgaaaatgggcaccgctgggaggaggtggatgacttctttacaaaggaaaatggtagcagcttcagtgagaaactgcccttacaaacagtcccttctctgctgtcaatccaatactgctcccaaatcctgttttcagtgttcatttccctcaaggcaggcgctgggctcccacgacccctcaggacagatctggccgtcagccgcgggccgctgggaactccactcggggaactcctttccaagctgacctcagttttctcacaagaacccagttagctgatgttttattgtaattgtcttaatttgctaagaacaagtaataagtaaatttttaaaaagcctttctgctgggttggattaaa

SEQ ID NO: 300373 - DNA, 1696 bp, Homo sapiens
  misc_feature (66)..(66): n is a, c, g, or t
ataggctagtacgaggctgggtgtgaatcggccgaggccatccagacgttgatgctgaacttcacngttaagcttatttctgacgcagggtaccagggggagatcaccagtgtgtccacagcatgccagcagctagaagtgttctcgagagtgctccggacctctctagctacaattttagatggaggagaagaaaaccttgaaaaaaatctccctgagtttgccggggctccgctgtgcgcaggatcgcccaggaagtgcagcgctttgcccaggagaaaggtcatgacgccagtcagatcacactagccttgggcacagctgcctcctaccccagggcctgccaggctctcggggccatgctgtccaaaggagccctgaaccctgctgacatcaccgtcctgttcaagatgttcacaagcatggaccctcctccggttgaacttatccgcgttccagccttcctggacctgttcatgcagtcactctttaaaccaggggctcggatcaaccaggaccacaagcacaaatacatccacatcttggcgtacgcagcaagcgtggttgagacctggaagaagaacaagcgagtgagcatcaataaagatgagctgaagtcaacgtcaaaagctgtcgaaaccgttcacaatttgtgttgcaacgagaacaaaggggcctctgaactagtggcagaattgagcacactttatcagtgtattaggtttccagtggtagcaatgggtgtgctgaagtgggtggattggactgtatcagaaccaaggtactttcagctgcagactgaccatacccctgtccacctggcgttgctggatgagatcagcacctgccaccagctcctgcacccccaggtcctgcagctgcttgttaagctttttgagactgagcactcccagctggacgtgatggagcagcttgagttgaagaagacactgctggacaggatggttcacctgctgagtcgaggttatgtacttcctgttgtcagttacatccgaaagtgtctggagaagctggacactgacatttcactcattcgctattttgtcactgaggtgctggacgtcattgctcctccttatacctctgacttcgtgcaacttttcctccccatcctggagaatgacagcatcgcaggtaccatcaaaacggaaggcgagcatgaccctgtgacggagtttatagctcactgcaaatctaacttcatcatggtgaactaatttagagcatcctccagagctgaagcagaacattccagaacccgttgtggaaaaaccctttcaagaagctgttttaagaggctcgggcagcgtcttgaaaatgggcaccgctgggaggaggtggatgacttctttacaaaggaaaatggtagcagcttcagtgagaaactgcccttacaaacagtcccttctctgctgtcaatccaatactgctcccaaatcctgttttcagtgttcatttccctcaaggcaggcgctgggctcccacgacccctcaggacagatctggccgtcagccgcgggccgctgggaactccactcggggaactcctttccaagctgacctcagttttctcacaagaacccagttagctgatgttttattgtaattgtcttaatttgctaagaacaagtaataagtaaatttttaaaaagcctttctgctgggttggattaaa

SEQ ID NO: 300374 - DNA, 3253 bp, Homo sapiens
cgagcatgaccctgtgacggagtttatagctcactgcaaatctaaattagttcaccatgatgaagttagatttgcagtgagctataaactccgtcacagggtcatgctcgccttccgttttgatggtacctgcgatgctgtcattctccagaatcatcctcctgctggccgtgccgggcgccatcatggacgaggactactacgggagcgcggccgagtggggcgacgaggctgacggcggccagcaggaggatgattctggagaaggagaggatgatgcggaggttcagcaagaatgcctgcataaattttccacccgggattatatcatggaaccctccatcttcaacactctgaagaggtatgtgagaaaggtgtctgtattgggaggaggctgggggtaatttagagaaagttttgtaatacacccagaaggtgctatgtaaagcaagagtaacgcgaactgaactaaaggcttcaagggggggtcccctctgccactttttttttttttttaaatttttttaagacagagtcttgctctgttgcagtggcacaatcaccgctcactgcagcttcagcctcctggaatcaagcagttctcccacctcagccttgcaagctggccaccacaggcgtctgccatcatgcctggctatttttgtttttgttttttgggagagacagggctccttacgttgccctggctgctcttgaactcctaggctcaagtgattctcccacctctgcctcccaaagtgctgggattacaggtgtgcaccactgcacccagccccctccgctgctttaaaaattttgaaacctgattctcttcctccttccttaccttcctgttgtccatcattccattcattcgggtgtaattgctgttgttactttccctaggtattttcaggcaggagggtctccagagaatgttatccagctcttatctgaaaactacaccgctgtggcccagactgtgaacctgctggccgagtggctcattcagacaggtgttgagccagtgcaggttcaggaaactgtggaaaatcacttgaagagtttgctgatcaaacattttgacccccgcaaagcagattctatttttactgaagaaggagagaccccagcgtggctggaacagatgattgcacataccacgtggcgggaccttttttataaactggctgaagcccatccagactgtttgatgctgaacttcaccgttaaggtaggaagagttctagagttaaggagaaaagtgtttatgaatgtttatttttggttgttggtctgtttcctttgacagttcatatttgctttttttccataaaggtctttattgttttattttcataagccttacactgagaaagaaaagtgtaaaatttgtatctgtttttgggtcagtgttgactgtgttttaggatttagcagggatacaagaattctcttgtggttggagaggagctttaggcgtgcctgcttgatcttcctcttgcatatgaagaaacgatggagaggtggtcagcccagggcacacacctaggtgatagcagggtgagggcggagtgaaggcctgagacccacgaccagcgcacacttactccacctcaccatgaacactgacaagccagcttcccgtggaggtgcggtcactgcatgcctcccctctgacttcttgttttgtgtcctagcttatttctgacgcagggtaccagggggagatcaccagtgtgtccacagcatgccagcagctagaagtgttctcgagagtgctccggacctctctagctacaattttagatggaggagaagaaaaccttgaaaaaaatctccctgagtttgccaagatggtgtgccacggggagcacacgtacctgtttgcccaggccatgatgtccgtgctggcccaggaggagcagggagccctgaaccctgctgacatcaccgtcctgttcaagatgttcacaagcatggaccctcctccggttgaacttatccgcgttccagccttcctggacctgttcatgcagtcactctttaaaccaggggctcggatcaaccaggaccacaagcacaaatacatccacatcttggcgtacgcagcaagcgtggttgagacctggaagaagaacaagcgagtgagcatcaataaagatgagctgaagtcaacgtcaaaagctgtcgaaaccgttcacaatttgtgttgcaacgagaacaaaggggcctctgaactagtggcagaattgagcacactttatcagtgtattaggtttccagtggtagcaatgggtgtgctgaagtgggtggattggactgtatcagaaccaaggtactttcagctgcagactgaccatacccctgtccacctggcgttgctggatgagatcagcacctgccaccagctcctgcacccccaggtcctgcagctgcttgttaagctttttgagactgagcactcccagctggacgtgatggagcagcttgagttgaagaagacactgctggacaggatggttcacctgctgagtcgaggttatgtacttcctgttgtcagttacatccgaaagtgtctggagaagctggacactgacatttcactcattcgctattttgtcactgaggtgctggacgtcattgctcctccttatacctctgacttcgtgcaacttttcctccccatcctggagaatgacagcatcgcaggtaccatcaaaacggaaggcgagcatgaccctgtgacggagtttatagctcactgcaaatctaacttcatcatggtgaactaatttagagcatcctccagagctgaagcagaacattccagaacccgttgtggaaaaaccctttcaagaagctgttttaagaggctcgggcagcgtcttgaaaatgggcaccgctgggaggaggtggatgacttctttacaaaggaaaatggtagcagcttcagtgagaaactgcccttacaaacagtcccttctctgctgtcaatccaatactgctcccaaatcctgttttcagtgttcatttccctcaaggcaggcgctgggctcccacgacccctcaggacagatctggccgtcagccgcgggccgctgggaactccactcggggaactcctttccaagctgacctcagttttctcacaagaacccagttagctgatgttttattgtaattgtcttaatttgctaagaacaagtaataagtaaatttttaaaaagcctttctgctgggttggattaaa

SEQ ID NO: 300375 - DNA, 4991 bp, Homo sapiens
cgagcatgaccctgtgacggagtttatagctcactgcaaatctaaattagttcaccatgatgaagttagatttgcagtgagctataaactccgtcacagggtcatgctcgccttccgttttgatggtacctgcgatgctgtcattctccagaatcatcctcctgctggccgtgccgggcgccatcatggacgaggactactacgggagcgcggccgagtggggcgacgaggctgacggcggccagcaggaggatgattctggagaaggagaggatgatgcggaggttcagcaagaatgcctgcataaattttccacccgggattatatcatggaaccctccatcttcaacactctgaagaggtatgtgagaaaggtgtctgtattgggaggaggctgggggtaatttagagaaagttttgtaatacacccagaaggtgctatgtaaagcaagagtaacgcgaactgaactaaaggcttcaagggggggtcccctctgccactttttttttttttttaaatttttttaagacagagtcttgctctgttgcagtggcacaatcaccgctcactgcagcttcagcctcctggaatcaagcagttctcccacctcagccttgcaagctggccaccacaggcgtctgccatcatgcctggctatttttgtttttgttttttgggagagacagggctccttacgttgccctggctgctcttgaactcctaggctcaagtgattctcccacctctgcctcccaaagtgctgggattacaggtgtgcaccactgcacccagccccctccgctgctttaaaaattttgaaacctgattctcttcctccttccttaccttcctgttgtccatcattccattcattcgggtgtaattgctgttgttactttccctaggtattttcaggcaggagggtctccagagaatgttatccagctcttatctgaaaactacaccgctgtggcccagactgtgaacctgctggccgagtggctcattcagacaggtgttgagccagtgcaggttcaggaaactgtggaaaatcacttgaagagtttgctgatcaaacattttgacccccgcaaagcagattctatttttactgaagaaggagagaccccagcgtggctggaacagatgattgcacataccacgtggcgggaccttttttataaactggctgaagcccatccagactgtttgatgctgaacttcaccgttaaggtaggaagagttctagagttaaggagaaaagtgtttatgaatgtttatttttggttgttggtctgtttcctttgacagttcatatttgctttttttccataaaggtctttattgttttattttcataagccttacactgagaaagaaaagtgtaaaatttgtatctgtttttgggtcagtgttgactgtgttttaggatttagcagggatacaagaattctcttgtggttggagaggagctttaggcgtgcctgcttgatcttcctcttgcatatgaagaaacgatggagaggtggtcagcccagggcacacacctaggtgatagcagggtgagggcggagtgaaggcctgagacccacgaccagcgcacacttactccacctcaccatgaacactgacaagccagcttcccgtggaggtgcggtcactgcatgcctcccctctgacttcttgttttgtgtcctagcttatttctgacgcagggtaccagggggagatcaccagtgtgtccacagcatgccagcagctagaagtgttctcgagagtgctccggacctctctagctacaattttagatggaggagaagaaaaccttgaaaaaaatctccctgagtttgccaagatggtgtgccacggggagcacacgtacctgtttgcccaggccatgatgtccgtgctggcccaggaggagcaggggggctccgctgtgcgcaggatcgcccaggaagtgcagcgctttgcccaggagaagtgagaggccctgtttctgctcagcccttccttcctagtgctccccacaaaacccttcccatggcccgtgttccacagccaaagctgctagctccttctgttcaacgtagaggtaaacttgcttttggctgggcgtggtggctcacgcctgtaatcccagcactttgggaggccgaggcggatggatcacctaaggtcaggagtttgagaccagcttgaccaacatggagaaaccccatctctggtaaacaaaaatacaaaattagccgggtgtggcggcacatgcctgtaatcccagctacttgggaggctgaggcaggagaatcgcttgaacctgggaggtggaggttgtggtcagccaagattgcaccattgcactccagcctgggcaacaagagcaaaactctgtctcaaaaaaaaaaaaaaaaattaaaaacttccttttatccagcagagctggaaaagttggagttgtttttggtatacttggagagctggctttctaaagtgctgctttgaggactgttgtgtaaagcacttgattcgtcttccctttgctggagttatgggcctgggcttttacactggggttctgaagtaacaaacaaagtcagtccagaaatagttgctcagcaatctcattgttacagtgtcgcaaaatgagctcatattagctttattttctgctaccaatagagtgttcctaagtatttaaagtgtgtgactcctttcttatagagccagcaagctgtattggaatcacttttccagtgttgtaaatgttatttttgtgggtcagtcagtatactcgtgaatgacagaaaaacagatcccaacaatgcaaagtattatatgtgtaaaaaagaacagaaaaaagaagctgccttgttagtaacgggctctatggtttttctcatcaagaggtcatgacgccagtcagatcacactagccttgggcacagctgcctcctaccccagggcctgccaggctctcggggccatgctgtccaaaggagccctgaaccctgctgacatcaccgtcctgttcaagatgttcacaagcatggaccctcctccggttgaacttgtaagttgcttctcaagaatccccaatgtcagctggtaaggtgactttggaaagtctgtgcttgtctgattgtctgaaggctgtgaatgcaaatccatcattgtcctggtccttcctcagtcacactctctgcctggagcctgttgggcccctgctgtgtagggaaccctgaggggaggtgggtgagcagtgccctcacgcctgccatcccgaactgggcatatgcttctcctcagatccgcgttccagccttcctggacctgttcatgcagtcactctttaaaccaggggctcggatcaaccaggaccacaagcacaaatacatccacatcttggcgtacgcagcaagcgtggttgagacctggaagaaggtaccatcggttctgggaatttgtggattttttaggagacaaatatcctcctctgctttgatattattttggaattttggctgcaagaaatcttgaccctccctagtatcaggcatgtgttttcttgtgtttctgtgtagagaaagcactaaacgtctccagaaaatgtgcgtaatgtctccaatgctctgcaaaccgtaaattgaaatgtgactaaagaaatgaaactgatttccgtaagacatggacaaacactagtctcattgcttttcagtttctgtacactgtgtgactgtgaagtttgacagctgaattgactcccaacttaagtagaaatagggaaagtgctttgcaagaagtggccgacaccagaacaccccgacagcagggatatctgccctgtcaggctcaccagcttgtgtgtgtgttttcagaacaagcgagtgagcatcaataaagatgagctgaagtcaacgtcaaaagctgtcgaaaccgttcacaatttgtgttgcaacgagaacaaaggggcctctgaactagtggcagaattgagcacactttatcagtgtattaggtttccagtggtagcaatgggtgtgctgaagtgggtggattggactgtatcagaaccaaggtactttcagctgcagactgaccatacccctgtccacctggcgttgctggatgagatcagcacctgccaccagctcctgcacccccaggtcctgcagctgcttgttaagctttttgagactgagcactcccagctggacgtgatggagcagcttgagttgaagaagacactgctggacaggatggttcacctgctgagtcgaggttatgtacttcctgttgtcagttacatccgaaagtgtctggagaagctggacactgacatttcactcattcgctattttgtcactgaggtgctggacgtcattgctcctccttatacctctgacttcgtgcaacttttcctccccatcctggagaatgacagcatcgcaggtaccatcaaaacggaaggcgagcatgaccctgtgacggagtttatagctcactgcaaatctaacttcatcatggtgaactaatttagagcatcctccagagctgaagcagaacattccagaacccgttgtggaaaaaccctttcaagaagctgttttaagaggctcgggcagcgtcttgaaaatgggcaccgctgggaggaggtggatgacttctttacaaaggaaaatggtagcagcttcagtgagaaactgcccttacaaacagtcccttctctgctgtcaatccaatactgctcccaaatcctgttttcagtgttcatttccctcaaggcaggcgctgggctcccacgacccctcaggacagatctggccgtcagccgcgggccgctgggaactccactcggggaactcctttccaagctgacctcagttttctcacaagaacccagttagctgatgttttattgtaattgtcttaatttgctaagaacaagtaataagtaaatttttaaaaagcctttctgctgggttggattaaa

SEQ ID NO: 300376 - DNA, 4755 bp, Homo sapiens
cgagcatgaccctgtgacggagtttatagctcactgcaaatctaaattagttcaccatgatgaagttagatttgcagtgagctataaactccgtcacagggtcatgctcgccttccgttttgatggtacctgcgatgctgtcattctccagaatcatcctcctgctggccgtgccgggcgccatcatggacgaggactactacgggagcgcggccgagtggggcgacgaggctgacggcggccagcaggaggatgattctggagaaggagaggatgatgcggaggttcagcaagaatgcctgcataaattttccacccgggattatatcatggaaccctccatcttcaacactctgaagaggtatgtgagaaaggtgtctgtattgggaggaggctgggggtaatttagagaaagttttgtaatacacccagaaggtgctatgtaaagcaagagtaacgcgaactgaactaaaggcttcaagggggggtcccctctgccactttttttttttttttaaatttttttaagacagagtcttgctctgttgcagtggcacaatcaccgctcactgcagcttcagcctcctggaatcaagcagttctcccacctcagccttgcaagctggccaccacaggcgtctgccatcatgcctggctatttttgtttttgttttttgggagagacagggctccttacgttgccctggctgctcttgaactcctaggctcaagtgattctcccacctctgcctcccaaagtgctgggattacaggtgtgcaccactgcacccagccccctccgctgctttaaaaattttgaaacctgattctcttcctccttccttaccttcctgttgtccatcattccattcattcgggtgtaattgctgttgttactttccctaggtattttcaggcaggagggtctccagagaatgttatccagctcttatctgaaaactacaccgctgtggcccagactgtgaacctgctggccgagtggctcattcagacaggtgttgagccagtgcaggttcaggaaactgtggaaaatcacttgaagagtttgctgatcaaacattttgacccccgcaaagcagattctatttttactgaagaaggagagaccccagcgtggctggaacagatgattgcacataccacgtggcgggaccttttttataaactggctgaagcccatccagactgtttgatgctgaacttcaccgttaaggtaggaagagttctagagttaaggagaaaagtgtttatgaatgtttatttttggttgttggtctgtttcctttgacagttcatatttgctttttttccataaaggtctttattgttttattttcataagccttacactgagaaagaaaagtgtaaaatttgtatctgtttttgggtcagtgttgactgtgttttaggatttagcagggatacaagaattctcttgtggttggagaggagctttaggcgtgcctgcttgatcttcctcttgcatatgaagaaacgatggagaggtggtcagcccagggcacacacctaggtgatagcagggtgagggcggagtgaaggcctgagacccacgaccagcgcacacttactccacctcaccatgaacactgacaagccagcttcccgtggaggtgcggtcactgcatgcctcccctctgacttcttgttttgtgtcctagcttatttctgacgcagggtaccagggggagatcaccagtgtgtccacagcatgccagcagctagaagtgttctcgagagtgctccggacctctctagctacaattttagatggaggagaagaaaaccttgaaaaaaatctccctgagtttgccaagatggtgtgccacggggagcacacgtacctgtttgcccaggccatgatgtccgtgctggcccaggaggagcaggggggctccgctgtgcgcaggatcgcccaggaagtgcagcgctttgcccaggagaagtgagaggccctgtttctgctcagcccttccttcctagtgctccccacaaaacccttcccatggcccgtgttccacagccaaagctgctagctccttctgttcaacgtagaggtaaacttgcttttggctgggcgtggtggctcacgcctgtaatcccagcactttgggaggccgaggcggatggatcacctaaggtcaggagtttgagaccagcttgaccaacatggagaaaccccatctctggtaaacaaaaatacaaaattagccgggtgtggcggcacatgcctgtaatcccagctacttgggaggctgaggcaggagaatcgcttgaacctgggaggtggaggttgtggtcagccaagattgcaccattgcactccagcctgggcaacaagagcaaaactctgtctcaaaaaaaaaaaaaaaaattaaaaacttccttttatccagcagagctggaaaagttggagttgtttttggtatacttggagagctggctttctaaagtgctgctttgaggactgttgtgtaaagcacttgattcgtcttccctttgctggagttatgggcctgggcttttacactggggttctgaagtaacaaacaaagtcagtccagaaatagttgctcagcaatctcattgttacagtgtcgcaaaatgagctcatattagctttattttctgctaccaatagagtgttcctaagtatttaaagtgtgtgactcctttcttatagagccagcaagctgtattggaatcacttttccagtgttgtaaatgttatttttgtgggtcagtcagtatactcgtgaatgacagaaaaacagatcccaacaatgcaaagtattatatgtgtaaaaaagaacagaaaaaagaagctgccttgttagtaacgggctctatggtttttctcatcaagaggtcatgacgccagtcagatcacactagccttgggcacagctgcctcctaccccagggcctgccaggctctcggggccatgctgtccaaaggagccctgaaccctgctgacatcaccgtcctgttcaagatgttcacaagcatggaccctcctccggttgaacttatccgcgttccagccttcctggacctgttcatgcagtcactctttaaaccaggggctcggatcaaccaggaccacaagcacaaatacatccacatcttggcgtacgcagcaagcgtggttgagacctggaagaaggtaccatcggttctgggaatttgtggattttttaggagacaaatatcctcctctgctttgatattattttggaattttggctgcaagaaatcttgaccctccctagtatcaggcatgtgttttcttgtgtttctgtgtagagaaagcactaaacgtctccagaaaatgtgcgtaatgtctccaatgctctgcaaaccgtaaattgaaatgtgactaaagaaatgaaactgatttccgtaagacatggacaaacactagtctcattgcttttcagtttctgtacactgtgtgactgtgaagtttgacagctgaattgactcccaacttaagtagaaatagggaaagtgctttgcaagaagtggccgacaccagaacaccccgacagcagggatatctgccctgtcaggctcaccagcttgtgtgtgtgttttcagaacaagcgagtgagcatcaataaagatgagctgaagtcaacgtcaaaagctgtcgaaaccgttcacaatttgtgttgcaacgagaacaaaggggcctctgaactagtggcagaattgagcacactttatcagtgtattaggtttccagtggtagcaatgggtgtgctgaagtgggtggattggactgtatcagaaccaaggtactttcagctgcagactgaccatacccctgtccacctggcgttgctggatgagatcagcacctgccaccagctcctgcacccccaggtcctgcagctgcttgttaagctttttgagactgagcactcccagctggacgtgatggagcagcttgagttgaagaagacactgctggacaggatggttcacctgctgagtcgaggttatgtacttcctgttgtcagttacatccgaaagtgtctggagaagctggacactgacatttcactcattcgctattttgtcactgaggtgctggacgtcattgctcctccttatacctctgacttcgtgcaacttttcctccccatcctggagaatgacagcatcgcaggtaccatcaaaacggaaggcgagcatgaccctgtgacggagtttatagctcactgcaaatctaacttcatcatggtgaactaatttagagcatcctccagagctgaagcagaacattccagaacccgttgtggaaaaaccctttcaagaagctgttttaagaggctcgggcagcgtcttgaaaatgggcaccgctgggaggaggtggatgacttctttacaaaggaaaatggtagcagcttcagtgagaaactgcccttacaaacagtcccttctctgctgtcaatccaatactgctcccaaatcctgttttcagtgttcatttccctcaaggcaggcgctgggctcccacgacccctcaggacagatctggccgtcagccgcgggccgctgggaactccactcggggaactcctttccaagctgacctcagttttctcacaagaacccagttagctgatgttttattgtaattgtcttaatttgctaagaacaagtaataagtaaatttttaaaaagcctttctgctgggttggattaaa

SEQ ID NO: 300377 - DNA, 1683 bp, Homo sapiens
  misc_feature (66)..(66): n is a, c, g, or t
ataggctagtacgaggctgggtgtgaatcggccgaggccatccagacgttgatgctgaacttcacngttaagcttatttctgacgcagggtaccagggggagatcaccagtgtgtccacagcatgccagcagctagaagtgttctcgagagtgctccggacctctctagctacaattttagatggaggagaagaaaaccttgaaaaaaatctccctgagtttgccaagatggtgtgccacggggagcacacgtacctgtttgcccaggccatgatgtccgtgctggcccaggaggagcaggggggctccgctgtgcgcaggatcgcccaggaagtgcagcgctttgcccaggagaaaggtcatgacgccagtcagatcacactagccttgggcacagctgcctcctaccccagggcctgccaggctctcggggccatgctgtccaaaggagccctgaaccctgctgacatcaccgtcctgttcaagatgttcacaagcatggaccctcctccggttgaacttatccgcgttccagccttcctggacctgttcatgcagtcactctttaaaccaggggctcggatcaaccaggaccacaagcacaaatacatccacatcttggcgtacgcagcaagcgtggttgagacctggaagaagaacaagcgagtgagcatcaataaagatgagctgaagtcaacgtcaaaagctgtcgaaaccgttcacaatttgtgttgcaacgagaacaaaggggcctctgaactagtggcagaattgagcacactttatcagtgtattaggtttccagtggtagcaatgggtgtgctgaagtgggtggattggactgtatcagaaccaaggtactttcagctgcagactgaccatacccctgtccacctggcgttgctggatgagatcagcacctgccaccagctcctgcacccccaggtcctgcagctgcttgttaagctttttgagactgagcactcccagctggacgtgatggagcagcttgagttgaagaagacactgctggacaggatggttcacctgctgagtcgaggtgctggacgtcattgctcctccttatacctctgacttcgtgcaacttttcctccccatcctggagaatgacagcatcgcaggtaccatcaaaacggaaggcgagcatgaccctgtgacggagtttatagctcactgcaaatctaacttcatcatggtgaactaatttagagcatcctccagagctgaagcagaacattccagaacccgttgtggaaaaaccctttcaagaagctgttttaagaggctcgggcagcgtcttgaaaatgggcaccgctgggaggaggtggatgacttctttacaaaggaaaatggtagcagcttcagtgagaaactgcccttacaaacagtcccttctctgctgtcaatccaatactgctcccaaatcctgttttcagtgttcatttccctcaaggcaggcgctgggctcccacgacccctcaggacagatctggccgtcagccgcgggccgctgggaactccactcggggaactcctttccaagctgacctcagttttctcacaagaacccagttagctgatgttttattgtaattgtcttaatttgctaagaacaagtaataagtaaatttttaaaaagcctttctgctgggttggattaaa

SEQ ID NO: 300378 - DNA, 3367 bp, Homo sapiens
cgagcatgaccctgtgacggagtttatagctcactgcaaatctaaattagttcaccatgatgaagttagatttgcagtgagctataaactccgtcacagggtcatgctcgccttccgttttgatggtacctgcgatgctgtcattctccagaatcatcctcctgctggccgtgccgggcgccatcatggacgaggactactacgggagcgcggccgagtggggcgacgaggctgacggcggccagcaggaggatgattctggagaaggagaggatgatgcggaggttcagcaagaatgcctgcataaattttccacccgggattatatcatggaaccctccatcttcaacactctgaagaggtatgtgagaaaggtgtctgtattgggaggaggctgggggtaatttagagaaagttttgtaatacacccagaaggtgctatgtaaagcaagagtaacgcgaactgaactaaaggcttcaagggggggtcccctctgccactttttttttttttttaaatttttttaagacagagtcttgctctgttgcagtggcacaatcaccgctcactgcagcttcagcctcctggaatcaagcagttctcccacctcagccttgcaagctggccaccacaggcgtctgccatcatgcctggctatttttgtttttgttttttgggagagacagggctccttacgttgccctggctgctcttgaactcctaggctcaagtgattctcccacctctgcctcccaaagtgctgggattacaggtgtgcaccactgcacccagccccctccgctgctttaaaaattttgaaacctgattctcttcctccttccttaccttcctgttgtccatcattccattcattcgggtgtaattgctgttgttactttccctaggtattttcaggcaggagggtctccagagaatgttatccagctcttatctgaaaactacaccgctgtggcccagactgtgaacctgctggccgagtggctcattcagacaggtgttgagccagtgcaggttcaggaaactgtggaaaatcacttgaagagtttgctgatcaaacattttgacccccgcaaagcagattctatttttactgaagaaggagagaccccagcgtggctggaacagatgattgcacataccacgtggcgggaccttttttataaactggctgaagcccatccagactgtttgatgctgaacttcaccgttaaggtaggaagagttctagagttaaggagaaaagtgtttatgaatgtttatttttggttgttggtctgtttcctttgacagttcatatttgctttttttccataaaggtctttattgttttattttcataagccttacactgagaaagaaaagtgtaaaatttgtatctgtttttgggtcagtgttgactgtgttttaggatttagcagggatacaagaattctcttgtggttggagaggagctttaggcgtgcctgcttgatcttcctcttgcatatgaagaaacgatggagaggtggtcagcccagggcacacacctaggtgatagcagggtgagggcggagtgaaggcctgagacccacgaccagcgcacacttactccacctcaccatgaacactgacaagccagcttcccgtggaggtgcggtcactgcatgcctcccctctgacttcttgttttgtgtcctagcttatttctgacgcagggtaccagggggagatcaccagtgtgtccacagcatgccagcagctagaagtgttctcgagagtgctccggacctctctagctacaattttagatggaggagaagaaaaccttgaaaaaaatctccctgagtttgccaagatggtgtgccacggggagcacacgtacctgtttgcccaggccatgatgtccgtgctggcccaggaggagcaggggggctccgctgtgcgcaggatcgcccaggaagtgcagcgctttgcccaggagaaaggtcatgacgccagtcagatcacactagccttgggcacagctgcctcctaccccagggcctgccaggctctcggggccatgctgtccaaaggagccctgaaccctgctgacatcaccgtcctgttcaagatgttcacaagcatggaccctcctccggttgaacttatccgcgttccagccttcctggacctgttcatgcagtcactctttaaaccaggggctcggatcaaccaggaccacaagcacaaatacatccacatcttggcgtacgcagcaagcgtggttgagacctggaagaagaacaagcgagtgagcatcaataaagatgagctgaagtcaacgtcaaaagctgtcgaaaccgttcacaatttgtgttgcaacgagaacaaaggggcctctgaactagtggcagaattgagcacactttatcagtgtattaggtttccagtggtagcaatgggtgtgctgaagtgggtggattggactgtatcagaaccaaggtactttcagctgcagactgaccatacccctgtccacctggcgttgctggatgaggtcctgcagctgcttgttaagctttttgagactgagcactcccagctggacgtgatggagcagcttgagttgaagaagacactgctggacaggatggttcacctgctgagtcgaggttatgtacttcctgttgtcagttacatccgaaagtgtctggagaagctggacactgacatttcactcattcgctattttgtcactgaggtgctggacgtcattgctcctccttatacctctgacttcgtgcaacttttcctccccatcctggagaatgacagcatcgcaggtaccatcaaaacggaaggcgagcatgaccctgtgacggagtttatagctcactgcaaatctaacttcatcatggtgaactaatttagagcatcctccagagctgaagcagaacattccagaacccgttgtggaaaaaccctttcaagaagctgttttaagaggctcgggcagcgtcttgaaaatgggcaccgctgggaggaggtggatgacttctttacaaaggaaaatggtagcagcttcagtgagaaactgcccttacaaacagtcccttctctgctgtcaatccaatactgctcccaaatcctgttttcagtgttcatttccctcaaggcaggcgctgggctcccacgacccctcaggacagatctggccgtcagccgcgggccgctgggaactccactcggggaactcctttccaagctgacctcagttttctcacaagaacccagttagctgatgttttattgtaattgtcttaatttgctaagaacaagtaataagtaaatttttaaaaagcctttctgctgggttggattaaa

SEQ ID NO: 300379 - DNA, 1748 bp, Homo sapiens
  misc_feature (66)..(66): n is a, c, g, or t
ataggctagtacgaggctgggtgtgaatcggccgaggccatccagacgttgatgctgaacttcacngttaagcttatttctgacgcagggtaccagggggagatcaccagtgtgtccacagcatgccagcagctagaagtgttctcgagagtgctccggacctctctagctacaattttagatggaggagaagaaaaccttgaaaaaaatctccctgagtttgccaagatggtgtgccacggggagcacacgtacctgtttgcccaggccatgatgtccgtgctggcccaggaggagcaggggggctccgctgtgcgcaggatcgcccaggaagtgcagcgctttgcccaggagaaaggtcatgacgccagtcagatcacactagccttgggcacagctgcctcctaccccagggcctgccaggctctcggggccatgctgtccaaaggagccctgaaccctgctgacatcaccgtcctgttcaagatgttcacaagcatggaccctcctccggttgaacttatccgcgttccagccttcctggacctgttcatgcagtcactctttaaaccaggggctcggatcaaccaggaccacaagcacaaatacatccacatcttggcgtacgcagcaagcgtggttgagacctggaagaagaacaagcgagtgagcatcaataaagatgagctgaagtcaacgtcaaaagctgtcgaaaccgttcacaatttgtgttgcaacgagaacaaaggggcctctgaactagtggcagaattgagcacactttatcagtgtattaggtttccagtggtagcaatgggtgtgctgaagtgggtggattggactgtatcagaaccaaggtactttcagctgcagactgaccatacccctgtccacctggcgttgctggatgagatcagcacctgccaccagctcctgcacccccaggtcctgcagctgcttgttaagctttttgagactgagcactcccagctggacgtgatggagcagcttgagttgaagaagacactgctggacaggatggttcacctgctgagtcgaggttatgtacttcctgttgtcagttacatccgaaagtgtctggagaagctggacactgacatttcactcattcgctattttgtcactgaggtgctggacgtcattgctcctccttatacctctgacttcgtgcaacttttcctccccatcctggagaatgacagcatcgcaggtaccatcaaaacggaaggcgagcatgaccctgtgacggagtttatagctcactgcaaatctaacttcatcatggtgaactaatttagagcatcctccagagctgaagcagaacattccagaacccgttgtggaaaaaccctttcaagaagctgttttaagaggctcgggcagcgtcttgaaaatgggcaccgctgggaggaggtggatgacttctttacaaaggaaaatggtagcagcttcagtgagaaactgcccttacaaacagtcccttctctgctgtcaatccaatactgctcccaaatcctgttttcagtgttcatttccctcaaggcaggcgctgggctcccacgacccctcaggacagatctggccgtcagccgcgggccgctgggaactccactcggggaactcctttccaagctgacctcagttttctcacaagaacccagttagctgatgttttattgtaattgtcttaatttgctaagaacaagtaataagtaaatttttaaaaa

SEQ ID NO: 300380 - DNA, 2093 bp, Homo sapiens
  misc_feature (66)..(66): n is a, c, g, or t
ataggctagtacgaggctgggtgtgaatcggccgaggccatccagacgttgatgctgaacttcacngttaagcttatttctgacgcagggtaccagggggagatcaccagtgtgtccacagcatgccagcagctagaagtgttctcgagagtgctccggacctctctagctacaattttagatggaggagaagaaaaccttgaaaaaaatctccctgagtttgccaagatggtgtgccacggggagcacacgtacctgtttgcccaggccatgatgtccgtgctggcccaggaggagcaggggggctccgctgtgcgcaggatcgcccaggaagtgcagcgctttgcccaggagaaaggtcatgacgccagtcagatcacactagccttgggcacagctgcctcctaccccagggcctgccaggctctcggggccatgctgtccaaaggagccctgaaccctgctgacatcaccgtcctgttcaagatgttcacaagcatggaccctcctccggttgaacttatccgcgttccagccttcctggacctgttcatgcagtcactctttaaaccaggggctcggatcaaccaggaccacaagcacaaatacatccacatcttggcgtacgcagcaagcgtggttgagacctggaagaagaacaagcgagtgagcatcaataaagatgagctgaagtcaacgtcaaaagctgtcgaaaccgttcacaatttgtgttgcaacgagaacaaaggggcctctgaactagtggcagaattgagcacactttatcagtgtattaggtttccagtggtagcaatgggtgtgctgaagtgggtggattggactgtatcagaaccaaggtactttcagctgcagactgaccatacccctgtccacctggcgttgctggatgagatcagcacctgccaccagctcctgcacccccaggtcctgcagctgcttgttaagctttttgagactgagcactcccagctggacgtgatggagcagcttgagttgaagaagacactgctggacaggatggttcacctgctgagtcgaggttatgtacttcctgttgtcagttacatccgaaagtgtctggagaagctggacactgacatttcactcattcgctattttgtcactgaggtcagcaatgcaccgttggtttcatgtttcatactgtttacactagcactgccctttttggcttaatttagttcattttgtacctaactgagaactgtgctttctgatgtagtgatgacaatgacagatactcgtttaccaaaaagcaccttctgcctgcagcagctgtatgacacactttacctccattaccaccctgggcatctgaatgttggagatgggtggtgtcaccggccggtgggggtggggagggattttttccaaactgatggccatttcacccggatgtcggtggatgccccgcactagtgtgcggaagaagtcaccctgtgctcccccacgcaggtgctggacgtcattgctcctccttatacctctgacttcgtgcaacttttcctccccatcctggagaatgacagcatcgcaggtaccatcaaaacggaaggcgagcatgaccctgtgacggagtttatagctcactgcaaatctaacttcatcatggtgaactaatttagagcatcctccagagctgaagcagaacattccagaacccgttgtggaaaaaccctttcaagaagctgttttaagaggctcgggcagcgtcttgaaaatgggcaccgctgggaggaggtggatgacttctttacaaaggaaaatggtagcagcttcagtgagaaactgcccttacaaacagtcccttctctgctgtcaatccaatactgctcccaaatcctgttttcagtgttcatttccctcaaggcaggcgctgggctcccacgacccctcaggacagatctggccgtcagccgcgggccgctgggaactccactcggggaactcctttccaagctgacctcagttttctcacaagaacccagttagctgatgttttattgtaattgtcttaatttgctaagaacaagtaataagtaaatttttaaaaa

SEQ ID NO: 300381 - DNA, 2038 bp, Homo sapiens
  misc_feature (66)..(66): n is a, c, g, or t
ataggctagtacgaggctgggtgtgaatcggccgaggccatccagacgttgatgctgaacttcacngttaagcttatttctgacgcagggtaccagggggagatcaccagtgtgtccacagcatgccagcagctagaagtgttctcgagagtgctccggacctctctagctacaattttagatggaggagaagaaaaccttgaaaaaaatctccctgagtttgccaagatggtgtgccacggggagcacacgtacctgtttgcccaggccatgatgtccgtgctggcccaggaggagcaggggggctccgctgtgcgcaggatcgcccaggaagtgcagcgctttgcccaggagaaaggtcatgacgccagtcagatcacactagccttgggcacagctgcctcctaccccagggcctgccaggctctcggggccatgctgtccaaaggagccctgaaccctgctgacatcaccgtcctgttcaagatgttcacaagcatggaccctcctccggttgaacttatccgcgttccagccttcctggacctgttcatgcagtcactctttaaaccaggggctcggatcaaccaggaccacaagcacaaatacatccacatcttggcgtacgcagcaagcgtggttgagacctggaagaagaacaagcgagtgagcatcaataaagatgagctgaagtcaacgtcaaaagctgtcgaaaccgttcacaatttgtgttgcaacgagaacaaaggggcctctgaactagtggcagaattgagcacactttatcagtgtattaggtttccagtggtagcaatgggtgtgctgaagtgggtggattggactgtatcagaaccaaggtactttcagctgcagactgaccatacccctgtccacctggcgttgctggatgagatcagcacctgccaccagctcctgcacccccaggtcctgcagctgcttgttaagctttttgagactgagcactcccagctggacgtgatggagcagcttgagttgaagaagacactgctggacaggatggttcacctgctgagtcgaggttatgtacttcctgttgtcagttacatccgaaagtgtctggagaagctggacactgacatttcactcattcgctattttgtcactgaggtgctggacgtcattgctcctccttatacctctgacttcgtgcaacttttcctccccatcctggagaatgacagcatcgcaggtaccatcaaaacggaaggcgagcatgaccctgtgacggagtttatagctcactgcaaatctaacttcatcatggtgaactaatttagagcatcctccagagctgaagcagaacattccagaacccgttgtggaaaaaccctttcaagaagctgttttaagaggctcgggcagcgtcttgaaaatgggcaccgctgggaggaggtggatgacttctttacaaaggaaaatggtagcagcttcagtgagaaactgcccttacaaacagtcccttctctgctgtcaatccaatactgctcccaaatcctgttttcagtgttcatttccctcaaggcaggcgctgggctcccacgacccctcaggacagatctggccgtcagccgcgggccgctgggaactccactcggggaactcctttccaagctgacctcagttttctcacaagaacccagttagctgatgttttattgtaattgtcttaatttgctaagaacaagtaataagtaaatttttaaaaaaaaaaaaaaaaaaaaaaaaaaaaaaaaaaaaaaaaaaaaaaaaaaaaaaaaaaaaaaaaaaagagaagaaaacagagaaaacagaaaaaaagaagacaacaaaacgaaggaagaaagacaaaagaagacagaagaacgaaccgcacagaaacgagagaacagcagagaagcgagagatggacgcgcacggcggggcgggggtcggcaagcgacgaggtgcgaggccgcggcggaggcagcgggggaggacgtgggcgcccgccgggggagagcggtcgaggaagagccag

SEQ ID NO: 300382 - DNA, 1772 bp, Homo sapiens
  misc_feature (66)..(66): n is a, c, g, or t
  misc_feature (1605)..(1605): n is a, c, g, or t
  misc_feature (1616)..(1616): n is a, c, g, or t
  misc_feature (1620)..(1620): n is a, c, g, or t
  misc_feature (1666)..(1666): n is a, c, g, or t
  misc_feature (1746)..(1746): n is a, c, g, or t
ataggctagtacgaggctgggtgtgaatcggccgaggccatccagacgttgatgctgaacttcacngttaagcttatttctgacgcagggtaccagggggagatcaccagtgtgtccacagcatgccagcagctagaagtgttctcgagagtgctccggacctctctagctacaattttagatggaggagaagaaaaccttgaaaaaaatctccctgagtttgccaagatggtgtgccacggggagcacacgtacctgtttgcccaggccatgatgtccgtgctggcccaggaggagcaggggggctccgctgtgcgcaggatcgcccaggaagtgcagcgctttgcccaggagaaaggtcatgacgccagtcagatcacactagccttgggcacagctgcctcctaccccagggcctgccaggctctcggggccatgctgtccaaaggagccctgaaccctgctgacatcaccgtcctgttcaagatgttcacaagcatggaccctcctccggttgaacttatccgcgttccagccttcctggacctgttcatgcagtcactctttaaaccaggggctcggatcaaccaggaccacaagcacaaatacatccacatcttggcgtacgcagcaagcgtggttgagacctggaagaagaacaagcgagtgagcatcaataaagatgagctgaagtcaacgtcaaaagctgtcgaaaccgttcacaatttgtgttgcaacgagaacaaaggggcctctgaactagtggcagaattgagcacactttatcagtgtattaggtttccagtggtagcaatgggtgtgctgaagtgggtggattggactgtatcagaaccaaggtactttcagctgcagactgaccatacccctgtccacctggcgttgctggatgagatcagcacctgccaccagctcctgcacccccaggtcctgcagctgcttgttaagctttttgagactgagcactcccagctggacgtgatggagcagcttgagttgaagaagacactgctggacaggatggttcacctgctgagtcgaggttatgtacttcctgttgtcagttacatccgaaagtgtctggagaagctggacactgacatttcactcattcgctattttgtcactgaggtgctggacgtcattgctcctccttatacctctgacttcgtgcaacttttcctccccatcctggagaatgacagcatcgcaggtaccatcaaaacggaaggcgagcatgaccctgtgacggagtttatagctcactgcaaatctaacttcatcatggtgaactaatttagagcatcctccagagctgaagcagaacattccagaacccgttgtggaaaaaccctttcaagaagctgttttaagaggctcgggcagcgtcttgaaaatgggcaccgctgggaggaggtggatgacttctttacaaaggaaaatggtagcagcttcagtgagaaactgcccttacaaacagtcccttctctgctgtcaatccaatactgctcccaaatcctgttttcagtgttcatttccctcaaggcaggcgctgggctcccacgacccctcaggacagatctgacnttcagccccgnacantcgaaaattccatcacacccccaccacccaacacacacctcaacancaccatcgcctccacaatatcccacaaccgccaccattccataccccactctcttccataaaaaccccacacaccctccntcaaccccatcccacccccccccaca

SEQ ID NO: 300383 - DNA, 1586 bp, Homo sapiens
  misc_feature (66)..(66): n is a, c, g, or t
ataggctagtacgaggctgggtgtgaatcggccgaggccatccagacgttgatgctgaacttcacngttaagcttatttctgacgcagggtaccagggggagatcaccagtgtgtccacagcatgccagcagctagaagtgttctcgagagtgctccggacctctctagctacaattttagatggaggagaagaaaaccttgaaaaaaatctccctgagtttgccaagatggtgtgccacggggagcacacgtacctgtttgcccaggccatgatgtccgtgctggcccaggaggagcaggggggctccgctgtgcgcaggatcgcccaggaagtgcagcgctttgcccaggagaaaggtcatgacgccagtcagatcacactagccttgggcacagctgcctcctaccccagggcctgccaggctctcggggccatgctgtccaaaggagccctgaaccctgctgacatcaccgtcctgttcaagatgttcacaagcatggaccctcctccggttgaacttatccgcgttccagccttcctggacctgttcatgcagtcactctttaaaccaggggctcggatcaaccaggaccacaagcacaaatacatccacatcttggcgtacgcagcaagcgtggttgagacctggaagaagaacaagcgagtgagcatcaataaagatgagctgaagtcaacgtcaaaagctgtcgaaaccgttcacaatttgtgttgcaacgagaacaaaggggcctctgaactagtggcagaattgagcacactttatcagtgtattaggtttccagtggtagcaatgggtgtgctgaagtgggtggattggactgtatcagaaccaaggtactttcagctgcagactgaccatacccctgtccacctggcgttgctggatgagatcagcacctgccaccagctcctgcacccccaggtcctgcagctgcttgttaagctttttgagactgagcactcccagctggacgtgatggagcagcttgagttgaagaagacactgctggacaggatggttcacctgctgagtcgaggttatgtacttcctgttgtcagttacatccgaaagtgtctggagaagctggacactgacatttcactcattcgctattttgtcactgaggtgctggacgtcattgctcctccttatacctctgacttcgtgcaacttttcctccccatcctggagaatgacagcatcgcaggtaccatcaaaacggaaggcgagcatgaccctgtgacggagtttatagctcactgcaaatctaacttcatcatggtgaactaatttagagcatcctccagagctgaagcagaacattccagaacccgttgtggaaaaaccctttcaagaagctgttttaagaggctcgggcagcgtcttgaaaatgggcaccgctgggaggaggtggatgacttctttacaaaggaaaatggtagcagcttcagtgagaaactgcccttacaaacagtcccttctctgctgtcaatccaatactgctcccaaatcctgttttcagtgttcacaatgaaataaagttattttctcattcccaaaaa

SEQ ID NO: 300384 - DNA, 1664 bp, Homo sapiens
  misc_feature (66)..(66): n is a, c, g, or t
ataggctagtacgaggctgggtgtgaatcggccgaggccatccagacgttgatgctgaacttcacngttaagcttatttctgacgcagggtaccagggggagatcaccagtgtgtccacagcatgccagcagctagaagtgttctcgagagtgctccggacctctctagctacaattttagatggaggagaagaaaaccttgaaaaaaatctccctgagtttgccaagatggtgtgccacggggagcacacgtacctgtttgcccaggccatgatgtccgtgctggcccaggaggagcaggggggctccgctgtgcgcaggatcgcccaggaagtgcagcgctttgcccaggagaaaggtcatgacgccagtcagatcacactagccttgggcacagctgcctcctaccccagggcctgccaggctctcggggccatgctgtccaaaggagccctgaaccctgctgacatcaccgtcctgttcaagatgttcacaagcatggaccctcctccggttgaacttatccgcgttccagccttcctggacctgttcatgcagtcactctttaaaccaggggctcggatcaaccaggaccacaagcacaaatacatccacatcttggcgtacgcagcaagcgtggttgagacctggaagaagaacaagcgagtgagcatcaataaagatgagctgaagtcaacgtcaaaagctgtcgaaaccgttcacaatttgtgttgcaacgagaacaaaggggcctctgaactagtggcagaattgagcacactttatcagtgtattaggtttccagtggtagcaatgggtgtgctgaagtgggtggattggactgtatcagaaccaaggtactttcagctgcagactgaccatacccctgtccacctggcgttgctggatgagatcagcacctgccaccagctcctgcacccccaggtcctgcagctgcttgttaagctttttgagactgagcactcccagctggacgtgatggagcagcttgagttgaagaagacactgctggacaggatggttcacctgctgagtcgaggttatgtacttcctgttgtcagttacatccgaaagtgtctggagaagctggacactgacatttcactcattcgctattttgtcactgaggtgctggacgtcattgctcctccttatacctctgacttcgtgcaacttttcctccccatcctggagaatgacagcatcgcaggtaccatcaaaacggaaggcgagcatgaccctgtgacggagtttatagctcactgcaaatctaacttcatcatggtgaactaatttagagcatcctccagagctgaagcagaacattccagaacccgttgtggaaaaaccctttcaagaagctgttttaagaggctcgggcagcgtcttgaaaatgggcaccgctgggaggaggtggatgacttctttacaaaggaaaatggtagcatttccctcaaggcaggcgctgggctcccacgacccctcaggacagatctggccgtcagccgcgggccgctgggaactccactcggggaactcctttccaagctgacctcagttttctcacaagaacccagttagctgatgttttattgtaattgtcttaatttgctaagaacaagtaataagtaaatttttaaaaa

SEQ ID NO: 300385 - DNA, 2009 bp, Homo sapiens
  misc_feature (66)..(66): n is a, c, g, or t
ataggctagtacgaggctgggtgtgaatcggccgaggccatccagacgttgatgctgaacttcacngttaagcttatttctgacgcagggtaccagggggagatcaccagtgtgtccacagcatgccagcagctagaagtgttctcgagagtgctccggacctctctagctacaattttagatggaggagaagaaaaccttgaaaaaaatctccctgagtttgccaagatggtgtgccacggggagcacacgtacctgtttgcccaggccatgatgtccgtgctggcccaggaggagcaggggggctccgctgtgcgcaggatcgcccaggaagtgcagcgctttgcccaggagaaaggtcatgacgccagtcagatcacactagccttgggcacagctgcctcctaccccagggcctgccaggctctcggggccatgctgtccaaaggagccctgaaccctgctgacatcaccgtcctgttcaagatgttcacaagcatggaccctcctccggttgaacttatccgcgttccagccttcctggacctgttcatgcagtcactctttaaaccaggggctcggatcaaccaggaccacaagcacaaatacatccacatcttggcgtacgcagcaagcgtggttgagacctggaagaagaacaagcgagtgagcatcaataaagatgagctgaagtcaacgtcaaaagctgtcgaaaccgttcacaatttgtgttgcaacgagaacaaaggggcctctgaactagtggcagaattgagcacactttatcagtgtattaggtttccagtggtagcaatgggtgtgctgaagtgggtggattggactgtatcagaaccaaggtactttcagctgcagactgaccatacccctgtccacctggcgttgctggatgagatcagcacctgccaccagctcctgcacccccaggtcctgcagctgcttgttaagctttttgagactgagcactcccagctggacgtgatggagcagcttgagttgaagaagacactgctggacaggatggttcacctgctgagtcgaggttatgtacttcctgttgtcagttacatccgaaagtgtctggagaagctggacactgacatttcactcattcgctattttgtcactgaggtcagcaatgcaccgttggtttcatgtttcatactgtttacactagcactgccctttttggcttaatttagttcattttgtacctaactgagaactgtgctttctgatgtagtgatgacaatgacagatactcgtttaccaaaaagcaccttctgcctgcagcagctgtatgacacactttacctccattaccaccctgggcatctgaatgttggagatgggtggtgtcaccggccggtgggggtggggagggattttttccaaactgatggccatttcacccggatgtcggtggatgccccgcactagtgtgcggaagaagtcaccctgtgctcccccacgcaggtgctggacgtcattgctcctccttatacctctgacttcgtgcaacttttcctccccatcctggagaatgacagcatcgcaggtaccatcaaaacggaaggcgagcatgaccctgtgacggagtttatagctcactgcaaatctaacttcatcatggtgaactaatttagagcatcctccagagctgaagcagaacattccagaacccgttgtggaaaaaccctttcaagaagctgttttaagaggctcgggcagcgtcttgaaaatgggcaccgctgggaggaggtggatgacttctttacaaaggaaaatggtagcatttccctcaaggcaggcgctgggctcccacgacccctcaggacagatctggccgtcagccgcgggccgctgggaactccactcggggaactcctttccaagctgacctcagttttctcacaagaacccagttagctgatgttttattgtaattgtcttaatttgctaagaacaagtaataagtaaatttttaaaaa

SEQ ID NO: 300386 - DNA, 1931 bp, Homo sapiens
  misc_feature (66)..(66): n is a, c, g, or t
ataggctagtacgaggctgggtgtgaatcggccgaggccatccagacgttgatgctgaacttcacngttaagcttatttctgacgcagggtaccagggggagatcaccagtgtgtccacagcatgccagcagctagaagtgttctcgagagtgctccggacctctctagctacaattttagatggaggagaagaaaaccttgaaaaaaatctccctgagtttgccaagatggtgtgccacggggagcacacgtacctgtttgcccaggccatgatgtccgtgctggcccaggaggagcaggggggctccgctgtgcgcaggatcgcccaggaagtgcagcgctttgcccaggagaaaggtcatgacgccagtcagatcacactagccttgggcacagctgcctcctaccccagggcctgccaggctctcggggccatgctgtccaaaggagccctgaaccctgctgacatcaccgtcctgttcaagatgttcacaagcatggaccctcctccggttgaacttatccgcgttccagccttcctggacctgttcatgcagtcactctttaaaccaggggctcggatcaaccaggaccacaagcacaaatacatccacatcttggcgtacgcagcaagcgtggttgagacctggaagaagaacaagcgagtgagcatcaataaagatgagctgaagtcaacgtcaaaagctgtcgaaaccgttcacaatttgtgttgcaacgagaacaaaggggcctctgaactagtggcagaattgagcacactttatcagtgtattaggtttccagtggtagcaatgggtgtgctgaagtgggtggattggactgtatcagaaccaaggtactttcagctgcagactgaccatacccctgtccacctggcgttgctggatgagatcagcacctgccaccagctcctgcacccccaggtcctgcagctgcttgttaagctttttgagactgagcactcccagctggacgtgatggagcagcttgagttgaagaagacactgctggacaggatggttcacctgctgagtcgaggttatgtacttcctgttgtcagttacatccgaaagtgtctggagaagctggacactgacatttcactcattcgctattttgtcactgaggtcagcaatgcaccgttggtttcatgtttcatactgtttacactagcactgccctttttggcttaatttagttcattttgtacctaactgagaactgtgctttctgatgtagtgatgacaatgacagatactcgtttaccaaaaagcaccttctgcctgcagcagctgtatgacacactttacctccattaccaccctgggcatctgaatgttggagatgggtggtgtcaccggccggtgggggtggggagggattttttccaaactgatggccatttcacccggatgtcggtggatgccccgcactagtgtgcggaagaagtcaccctgtgctcccccacgcaggtgctggacgtcattgctcctccttatacctctgacttcgtgcaacttttcctccccatcctggagaatgacagcatcgcaggtaccatcaaaacggaaggcgagcatgaccctgtgacggagtttatagctcactgcaaatctaacttcatcatggtgaactaatttagagcatcctccagagctgaagcagaacattccagaacccgttgtggaaaaaccctttcaagaagctgttttaagaggctcgggcagcgtcttgaaaatgggcaccgctgggaggaggtggatgacttctttacaaaggaaaatggtagcagcttcagtgagaaactgcccttacaaacagtcccttctctgctgtcaatccaatactgctcccaaatcctgttttcagtgttcacaatgaaataaagttattttctcattcccaaaaa

SEQ ID NO: 300387 - DNA, 1611 bp, Homo sapiens
  misc_feature (66)..(66): n is a, c, g, or t
ataggctagtacgaggctgggtgtgaatcggccgaggccatccagacgttgatgctgaacttcacngttaagcttatttctgacgcagggtaccagggggagatcaccagtgtgtccacagcatgccagcagctagaagtgttctcgagagtgctccggacctctctagctacaattttagatggaggagaagaaaaccttgaaaaaaatctccctgagtttgccaagatggtgtgccacggggagcacacgtacctgtttgcccaggccatgatgtccgtgctggcccaggaggagcaggggggctccgctgtgcgcaggatcgcccaggaagtgcagcgctttgcccaggagaaaggtcatgacgccagtcagatcacactagccttgggcacagctgcctcctaccccagggcctgccaggctctcggggccatgctgtccaaaggagccctgaaccctgctgacatcaccgtcctgttcaagatgttcacaagcatggaccctcctccggttgaacttatccgcgttccagccttcctggacctgttcatgcagtcactctttaaaccaggggctcggatcaaccaggaccacaagcacaaatacatccacatcttggcgtacgcagcaagcgtggttgagacctggaagaagaacaagcgagtgagcatcaataaagatgagctgaagtcaacgtcaaaagctgtcgaaaccgttcacaatttgtgttgcaacgagaacaaaggggcctctgaactagtggcagaattgagcacactttatcagtgtattaggtttccagtggtagcaatgggtgtgctgaagtgggtggattggactgtatcagaaccaaggtactttcagctgcagactgaccatacccctgtccacctggcgttgctggatgagatcagcacctgccaccagctcctgcacccccaggtcctgcagctgcttgttaagctttttgagactgagcactcccagctggacgtgatggagcagcttgagttgaagaagacactgctggacaggatggttcacctgctgagtcgaggtgctggacgtcattgctcctccttatacctctgacttcgtgcaacttttcctccccatcctggagaatgacagcatcgcagctcactgcaaatctaacttcatcatggtgaactaatttagagcatcctccagagctgaagcagaacattccagaacccgttgtggaaaaaccctttcaagaagctgttttaagaggctcgggcagcgtcttgaaaatgggcaccgctgggaggaggtggatgacttctttacaaaggaaaatggtagcagcttcagtgagaaactgcccttacaaacagtcccttctctgctgtcaatccaatactgctcccaaatcctgttttcagtgttcatttccctcaaggcaggcgctgggctcccacgacccctcaggacagatctggccgtcagccgcgggccgctgggaactccactcggggaactcctttccaagctgacctcagttttctcacaagaacccagttagctgatgttttattgtaattgtcttaatttgctaagaacaagtaataagtaaatttttaaaaa

SEQ ID NO: 300388 - DNA, 1950 bp, Homo sapiens
  misc_feature (66)..(66): n is a, c, g, or t
ataggctagtacgaggctgggtgtgaatcggccgaggccatccagacgttgatgctgaacttcacngttaagcttatttctgacgcagggtaccagggggagatcaccagtgtgtccacagcatgccagcagctagaagtgttctcgagagtgctccggacctctctagctacaattttagatggaggagaagaaaaccttgaaaaaaatctccctgagtttgccaagatggtgtgccacggggagcacacgtacctgtttgcccaggccatgatgtccgtgctggcccaggaggagcaggggggctccgctgtgcgcaggatcgcccaggaagtgcagcgctttgcccaggagaaaggtcatgacgccagtcagatcacactagccttgggcacagctgcctcctaccccagggcctgccaggctctcggggccatgctgtccaaaggagccctgaaccctgctgacatcaccgtcctgttcaagatgttcacaagcatggaccctcctccggttgaacttatccgcgttccagccttcctggacctgttcatgcagtcactctttaaaccaggggctcggatcaaccaggaccacaagcacaaatacatccacatcttggcgtacgcagcaagcgtggttgagacctggaagaagaacaagcgagtgagcatcaataaagatgagctgaagtcaacgtcaaaagctgtcgaaaccgttcacaatttgtgttgcaacgagaacaaaggggcctctgaactagtggcagaattgagcacactttatcagtgtattaggtttccagtggtagcaatgggtgtgctgaagtgggtggattggactgtatcagaaccaaggtactttcagctgcagactgaccatacccctgtccacctggcgttgctggatgagatcagcacctgccaccagctcctgcacccccaggtcctgcagctgcttgttaagctttttgagactgagcactcccagctggacgtgatggagcagcttgagttgaagaagacactgctggacaggatggttcacctgctgagtcgaggttatgtacttcctgttgtcagttacatccgaaagtgtctggagaagctggacactgacatttcactcattcgctattttgtcactgaggtcagcaatgcaccgttggtttcatgtttcatactgtttacactagcactgccctttttggcttaatttagttcattttgtacctaactgagaactgtgctttctgatgtagtgatgacaatgacagatactcgtttaccaaaaagcaccttctgcctgcagcagctgtatgacacactttacctccattaccaccctgggcatctgaatgttggagatgggtggtgtcaccggccggtgggggtggggagggattttttccaaactgatggccatttcacccggatgtcggtggatgccccgcactagtgtgcggaagaagtcaccctgtgctcccccacgcaggtgctggacgtcattgctcctccttatacctctgacttcgtgcaacttttcctccccatcctggagaatgacagcatcgcaggtaccatcaaaacggaaggcgagcatgaccctgtgacggagtttataggtgaggccgactgcctagccctttactacaatagaaaatgtcagctgggcgcggtggctcatgcctgtaatcccagcactttgggaggccaaggtgggtggatcacctgaggttgggagttcaagaccagcccgaccaacatggagaaaccccatctctactaaaaatacagcattagctgggcatggtggcacgtgcctgtaatcctagctactcgggaggctgaggcaggagaatcgcttaacctgggaggcagaggttgcagtgagccaagatcgcgccattgcactctatcctgggcaacaagagcaaaactgcatctcaaa

SEQ ID NO: 300389 - DNA, 1313 bp, Homo sapiens
  misc_feature (66)..(66): n is a, c, g, or t
ataggctagtacgaggctgggtgtgaatcggccgaggccatccagacgttgatgctgaacttcacngttaagcttatttctgacgcagggtaccagggggagatcaccagtgtgtccacagcatgccagcagctagaagtgttctcgagagtgctccggacctctctagctacaattttagatggaggagaagaaaaccttgaaaaaaatctccctgagtttgccaagatggtgtgccacggggagcacacgtacctgtttgcccaggccatgatgtccgtgctggcccaggaggagcaggggggctccgctgtgcgcaggatcgcccaggaagtgcagcgctttgcccaggagaaaggtcatgacgccagtcagatcacactagccttgggcacagctgcctcctaccccagggcctgccaggctctcggggccatgctgtccaaaggagccctgaaccctgctgacatcaccgtcctgttcaagatgttcacaagcatggaccctcctccggttgaacttatccgcgttccagccttcctggacctgttcatgcagtcactctttaaaccaggggctcggatcaaccaggaccacaagcacaaatacatccacatcttggcgtacgcagcaagcgtggttgagacctggaagaagaacaagcgagtgagcatcaataaagatgagctgaagtcaacgtcaaaagctgtcgaaaccgttcacaatttgtgttgcaacgagaacaaaggggcctctgaactagtggcagaattgagcacactttatcagtgtattaggtttccagtggtagcaatgggtgtgctgaagtgggtggattggactgtatcagaaccaaggtactttcagctgcagactgaccatacccctgtccacctggcgttgctggatgagatcagcacctgccaccagctcctgcacccccaggtcctgcagctgcttgttaagctttttgagactgagcactcccagctggacgtgatggagcagcttgagttgaagaagacactgctggacaggatggttcacctgctgagtcgaggttatgtacttcctgttgtcagttacatccgaaagtgtctggagaagctggacactgacatttcactcattcgctattttgtcactgaggtcagcaatgcaccgttggccgtcagccgcgggccgctgggaactccactcggggaactcctttccaagctgacctcagttttctcacaagaacccagttagctgatgttttattgtaattgtcttaatttgctaagaacaagtaataagtaaatttttaaaaa

SEQ ID NO: 300390 - DNA, 1165 bp, Homo sapiens
  misc_feature (66)..(66): n is a, c, g, or t
ataggctagtacgaggctgggtgtgaatcggccgaggccatccagacgttgatgctgaacttcacngttaagcttatttctgacgcagggtaccagggggagatcaccagtgtgtccacagcatgccagcagctagaagtgttctcgagagtgctccggacctctctagctacaattttagatggaggagaagaaaaccttgaaaaaaatctccctgagtttgccaagatggtgtgccacggggagcacacgtacctgtttgcccaggccatgatgtccgtgctggcccaggaggagcaggggggctccgctgtgcgcaggatcgcccaggaagtgcagcgctttgcccaggagaaaggtcatgacgccagtcagatcacactagccttgggcacagctgcctcctaccccagggcctgccaggctctcggggccatgctgtccaaaggagccctgaaccctgctgacatcaccgtcctgttcaagatgttcacaagcatggaccctcctccggttgaacttatccgcgttccagccttcctggacctgttcatgcagtcactctttaaaccaggggctcggatcaaccaggaccacaagcacaaatacatccacatcttggcgtacgcagcaagcgtggttgagacctggaagaagaacaagcgagtgagcatcaataaagatgagctgaagtcaacgtcaaaagctgtcgaaaccgttcacaatttgtgttgcaacgagaacaaaggggcctctgaactagtggcagaattgagcacactttatcagtgtattaggtttccagtggtagcaatgggtgtgctgaagtgggtggattggactgtatcagaaccaaggtactttcagctgcagactgaccatacccctgtccacctggcgttgctggatgagatcagcacctgccaccagctcctgcacccccaggtcctgcagctgcttgttaagctttttgagactgagcactcccagctggacgtgatggagcagcttgagttgaagaagacactgctggacaggatggttcacctgctgagtcgaggctggacgtcattgctcctccttatacctctgactgcggctcgcgccggggatctcaagagtcggagtgcgtccataagtcccctattaagaaggctgctcccct

SEQ ID NO: 300391 - DNA, 2414 bp, Homo sapiens
cgagcatgaccctgtgacggagtttatagctcactgcaaatctaaattagttcaccatgatgaagttagatttgcagtgagctataaactccgtcacagggtcatgctcgccttccgttttgatggtacctgcgatgctgtcattctccagaatcatcctcctgctggccgtgccgggcgccatcatggacgaggactactacgggagcgcggccgagtggggcgacgaggctgacggcggccagcaggaggatgattctggagaaggagaggatgatgcggaggttcagcaagaatgcctgcataaattttccacccgggattatatcatggaaccctccatcttcaacactctgaagaggtatgtgagaaaggtgtctgtattgggaggaggctgggggtaatttagagaaagttttgtaatacacccagaaggtgctatgtaaagcaagagtaacgcgaactgaactaaaggcttcaagggggggtcccctctgccactttttttttttttttaaatttttttaagacagagtcttgctctgttgcagtggcacaatcaccgctcactgcagcttcagcctcctggaatcaagcagttctcccacctcagccttgcaagctggccaccacaggcgtctgccatcatgcctggctatttttgtttttgttttttgggagagacagggctccttacgttgccctggctgctcttgaactcctaggctcaagtgattctcccacctctgcctcccaaagtgctgggattacaggtgtgcaccactgcacccagccccctccgctgctttaaaaattttgaaacctgattctcttcctccttccttaccttcctgttgtccatcattccattcattcgggtgtaattgctgttgttactttccctaggtattttcaggcaggagggtctccagagaatgttatccagctcttatctgaaaactacaccgctgtggcccagactgtgaacctgctggccgagtggctcattcagacaggtgttgagccagtgcaggttcaggaaactgtggaaaatcacttgaagagtttgctgatcaaacattttgacccccgcaaagcagattctatttttactgaagaaggagagaccccagcgtggctggaacagatgattgcacataccacgtggcgggaccttttttataaactggctgaagcccatccagactgtttgatgctgaacttcaccgttaaggtaggaagagttctagagttaaggagaaaagtgtttatgaatgtttatttttggttgttggtctgtttcctttgacagttcatatttgctttttttccataaaggtctttattgttttattttcataagccttacactgagaaagaaaagtgtaaaatttgtatctgtttttgggtcagtgttgactgtgttttaggatttagcagggatacaagaattctcttgtggttggagaggagctttaggcgtgcctgcttgatcttcctcttgcatatgaagaaacgatggagaggtggtcagcccagggcacacacctaggtgatagcagggtgagggcggagtgaaggcctgagacccacgaccagcgcacacttactccacctcaccatgaacactgacaagccagcttcccgtggaggtgcggtcactgcatgcctcccctctgacttcttgttttgtgtcctagcttatttctgacgcagggtaccagggggagatcaccagtgtgtccacagcatgccagcagctagaagtgttctcgagagtgctccggacctctctagctacaattttagatggaggagaagaaaaccttgaaaaaaatctccctgagtttgccaagatggtgtgccacggggagcacacgtacctgtttgcccaggccatgatgtccgtgctggcccaggaggagcaggggggctccgctgtgcgcaggatcgcccaggaagtgcagcgctttgcccaggagaaaggtcatgacgccagtcagatcacactagccttgggcacagctgcctcctaccccagggcctgccaggctctcggggccatgctgtccaaaggagccctgaaccctgctgacatcaccgtcctgttcaagatgttcacaagcatggaccctcctccggttgaacttatgacggggagagagacaggggaatggacagttggtggagcagtcagaacacacgcacatttattaattatgttcgctattttatatgagcatggttcatggcacccctaaacaatgacaatagtaccatcaaagatcactgattacagatcaccataatgaatataataataatgaaaagtttgaaatactgtgagaattgccaaagtgtgacacagagacataaagtgagcacaagctgttggagaaatacgccgcgacttg

SEQ ID NO: 300392 - DNA, 899 bp, Homo sapiens
agccagtggtttctgtgagtcttccttgccagcagaagatggctgtgccacccacgtatgccgatcttggcaaatctgccagggatgtcttcaccaagggctatggatttggcttaataaagcttgatttgaaaacaaaatctgagaatggattggaatttacaagctcaggctcagccaacactgagaccaccaaagtgacgggcagtctggaaaccaagtacagatggactgagtacggcctgacgtttacagagaaatggaataccgacaatacactaggcaccgagattactgtggaagatcagcttgcacgtggactgaagctgaccttcgattcatccttctcacctaacactgggaaaaaaaatgctaaaatcaagacagggtacaagcgggagcacattaacctgggctgcgacatggatttcgacattgctgggccttccatccggggtgctctggtgctaggttacgagggctggctggccggctaccagatgaattttgagactgcaaaatcccgagtgacccagagcaactttgcagttggctacaagactgatgaattccagcttcacactaatgtgaatgacgggacagagtttggcggctccatttaccagaaagtgaacaagaagttggagaccgctgtcaatcttgcctggacagcaggaaacagtaacacgcgcttcggaatagcagccaagtatcagattgaccctgacgcctgcttctcggctaaagtgaacaactccagctgattaggtttaaggattccctccagaactctaacagcccggtatttaactggacactgtcgctcctccggatgggcaagaacgctcattgctggtggcccaaaccttgtttaagacgggacattcagccttattgat

SEQ ID NO: 300393 - DNA, 760 bp, Homo sapiens
tgctgattctagagttcccttcggatacttggacagcaagtattaaactgacactgtcagctcttctggatggcaagaacgtcaatgctggtggccacaagcttggtctaggactggaatttcaagcataaatgaatactgtacaattgtttaattttaaactattttgcagcatagctaccttcagaatttagtgtatcttttaatgttgtatgtctgggatgcaagtattgctaaatatgttagccctccaggttaaagttgattcagctttaagatgttacccttccagaggtacagaagaaacctatttccaaaaaaggtcctttcagtggtagactcggggagaacttggtggcccctttgagatgccaggtttcttttttatctagaaatggctgcaagtggaagcggataatatgtaggcactttgtaaattcatattgagtaaatgaatgaaattgtgatttcctgagaatcgaaccttggttccctaaccctaattgatgagaggctcgctgcttgatggtgtgtacaaactcacctgaatgggacttttttagacagatcttcatgacctgttcccaccccagttcatcatcatctcttttacaccaggtggatgtgatgaagccaataattcaggacttattccttcttgtgttgtgtttttttttggcccttgcaccagagtatgaaatagcttccaggagctccagctataagcttgcaaggtctggggattgaaatacatggtgca

SEQ ID NO: 300394 - DNA, 521 bp, Homo sapiens
cgctcgcgaacgtgttatcctaaacctatcagattgaccctgacgcctgcttctcggctaaagtgaacaactccagcctgataggtttaggatacactcagactctaaagccaggtattaaactgacactgtcagctcttctggatggcaagaacgtcaatgctggtggccacaagcttggtctaggactggaatttcaagcataaatgaatactgtacaattgtttaattttaaactattttgcagcatagctaccttcagaatttagtgtatcttttaatgttgtatgtctgggatgcaagtattgctaaatatgttagccctccaggttaaagttgattcagctttaagatgttacccttccagaggtacagaagaaacctatttccaaaaaaggtcctttcagtggtagactcggggagaacttggtggcccctttgagatgccaggtttcttttttatctagaaatggctgcaagtggaagcggataatatgtacacgttcgcgaggggtaccgag

SEQ ID NO: 300395 - DNA, 1932 bp, Homo sapiens
acgctgtcccgggcggggcctgggggcggagcgcgccgggccgggcgcgcaggaggggaggcgggtccgcgccgccgccgtccgcgccgccccgcccttggcccagccgctcgctcggctccgctccctggctcggctccctgcctccgcgtcgcagcccccgccgtagccgcctccgagcccgccgccacatcctctgagcagaagatggctgtgccacccacgtatgccgatcttggcaaatctgccagggatgtcttcaccaagggctatggatttggcttaataaagcttgatttgaaaacaaaatctgagaatggattggaatttacaagctcaggctcagccaacactgagaccaccaaagtgacgggcagtctggaaaccaagtacagatggactgagtacggcctgacgtttacagagaaatggaataccgacaatacactaggcaccgagattactgtggaagatcagcttgcacgtggactgaagctgaccttcgattcatccttctcacctaacactgggaaaaaaaatgctaaaatcaagacagggtacaagcgggagcacattaacctgggctgcgacatggatttcgacattgctgggccttccatccggggtgctctggtgctaggttacgagggctggctggccggctaccagatgaattttgagactgcaaaatcccgagtgacccagagcaactttgcagttggctacaagactgatgaattccagcttcacactaatgtgaatgacgggacagagtttggcggctccatttaccagaaagtgaacaagaagttggagaccgctgtcaatcttgcctggacagcaggaaacagtaacacgcgcttcggaatagcagccaagtatcagattgaccctgacgcctgcttctcggctaaagtgaacaactccagcctgataggtttaggatacactcagactctaaagccaggtattaaactgacactgtcagctcttctggatggcaagaacgtcaatgctggtggccacaagcttggtctaggactggaatttcaagcataaatgaatactgtacaattgtttaattttaaactattttgcagcatagctaccttcagaatttagtgtatcttttaatgttgtatgtctgggatgcaagtattgctaaatatgttagccctccaggttaaagttgattcagctttaagatgttacccttccagaggtacagaagaaacctatttccaaaaaaggtcctttcagtggtagactcggggagaacttggtggcccctttgagatgccaggtttcttttttatctagaaatggctgcaagtggaagcggataatatgtaggcactttgtaaattcatattgagtaaatgaatgaaattgtgatttcctgagaatcgaaccttggttccctaaccctaattgatgagaggctcgctgcttgatggtgtgtacaaactcacctgaatgggacttttttagacagatcttcatgacctgttcccaccccagttcatcatcatctcttttacaccaaaaggtctgcagggtgtggtaactgtttcttttgtgccattttggggtggagaaggtggatgtgatgaagccaataattcaggacttattccttcttgtgttgtgtttttttttggcccttgcaccagagtatgaaatagcttccaggagctccagctataagcttggaagtgtctgtgtgattgtaatcacatggtgacaacactcagaatctaaattggacttctgttgtattctcaccactcaatttgttttttagcagtttaatgggtacattttagagtcttccattttgttggaattagatcctccccttcaaatgctgtaattaacaacacttaaaaaacttgaataaaatattgaaattcaaaaaaaaaaaaggggggg

SEQ ID NO: 300396 - DNA, 1384 bp, Homo sapiens
acgctgtcccgggcggggcctgggggcggagcgcgccgggccgggcgcgcaggaggggaggcgggtccgcgccgccgccgtccgcgccgccccgcccttggcccagccgctcgctcggctccgctccctggctcggctccctgcctccgcgtcgcagcccccgccgtagccgcctccgagcccgccgccacatcctctgagcagaagatggctgtgccacccacgtatgccgatcttggcaaatctgccagggatgtcttcaccaagggctatggatttggcttaataaagcttgatttgaaaacaaaatctgagaatggattggaatttacaagctcaggctcagccaacactgagaccaccaaagtgacgggcagtctggaaaccaagtacagatggactgagtacggcctgacgtttacagagaaatggaataccgacaatacactaggcaccgagattactgtggaagatcagcttgcacgtggactgaagctgaccttcgattcatccttctcacctaacactgggaaaaaaaatgctaaaatcaagacagggtacaagcgggagcacattaacctgggctgcgacatggatttcgacattgctgggccttccatccggggtgctctggtgctaggttacgagggctggctggccggctaccagatgaattttgagactgcaaaatcccgagtgacccagagcaactttgcagttggctacaagactgatgaattccagcttcacactaatgtgaatgacgggacagagtttggcggctccatttaccagaaagtgaacaagaagttggagaccgctgtcaatcttgcctggacagcaggaaacagtaacacgcgcttcggaatagcagccaagtatcagattgaccctgacgcctgcttctcggctaaagtgaacaactccagcctgataggtttaggatacactcagactctaaagccaggtattaaactgacactgtcagctcttctggatggcaagaacgtcaatgctggtggccacaagcttggtctaggactggaatttcaagcataaatgaatactgtacaattgtttaattttaaactattttgcagcatagctaccttcagaatttagtgtatcttttaatgttgtatgtctgggatgcaagtattgctaaatatgttagccctccaggttaaagttgattcagctttaagatgttacccttccagaggtacagaagaaacctatttccaaaaaaggtcctttcagtggtagactcggggagaacttggtggcccctttgagatgccaggtttcttttttatctagaaatggctgcaagtggaagcggataatatgtaggcatccagaggacacttgggggtaccgagct

SEQ ID NO: 300397 - DNA, 2405 bp, Homo sapiens
gcttttcccaatccacgttttgttttattttgtctttttgcctctcaaatgcatggaaattggctgctagtagctttgctacaggagaaaatcgctaatctgtagtgcaaaatcggcgcacaggggttttctctgagattgtctagacgccgcgcgggcgggtcggaggcgccagacacattgtatccggagcgcggagctcgggagcaacagtcgccgcctctactctgtatctgcgccgccccaggcgcccagtgtccgcgctgggcctgggactgccctcgggggatggggcccacgcgggctttgatggggggccgggggccactttgtccacccaggcgaggcttgggtccagcgccggccacatcaactcccgggggatctagcagcgcggaggccaagcaggaggcccaggagccccgcgcgtcttccattagcgcagggacctccgggccacagctcagagaatcggaaggcctcctcccccttcccgagcgctgccactggggccgaggtttccagcaagaacccgcgtgtccctgcgcacgcacacacggtgcacacgtcagtccggcgcctccccgtgccccgactcacgcaggtcctcccgcgcgcccgcaacacgcccgcaggctcctgtgtctgctgccggggcagcggggcccggaaggcagaagatggctgtgccacccacgtatgccgatcttggcaaatctgccagggatgtcttcaccaagggctatggatttggcttaataaagcttgatttgaaaacaaaatctgagaatggattggaatttacaagctcaggctcagccaacactgagaccaccaaagtgacgggcagtctggaaaccaagtacagatggactgagtacggcctgacgtttacagagaaatggaataccgacaatacactaggcaccgagattactgtggaagatcagcttgcacgtggactgaagctgaccttcgattcatccttctcacctaacactgggaaaaaaaatgctaaaatcaagacagggtacaagcgggagcacattaacctgggctgcgacatggatttcgacattgctgggccttccatccggggtgctctggtgctaggttacgagggctggctggccggctaccagatgaattttgagactgcaaaatcccgagtgacccagagcaactttgcagttggctacaagactgatgaattccagcttcacactaatgtgaatgacgggacagagtttggcggctccatttaccagaaagtgaacaagaagttggagaccgctgtcaatcttgcctggacagcaggaaacagtaacacgcgcttcggaatagcagccaagtatcagattgaccctgacgcctgcttctcggctaaagtgaacaactccagcctgataggtttaggatacactcagactctaaagccaggtattaaactgacactgtcagctcttctggatggcaagaacgtcaatgctggtggccacaagcttggtctaggactggaatttcaagcataaatgaatactgtacaattgtttaattttaaactattttgcagcatagctaccttcagaatttagtgtatcttttaatgttgtatgtctgggatgcaagtattgctaaatatgttagccctccaggttaaagttgattcagctttaagatgttacccttccagaggtacagaagaaacctatttccaaaaaaggtcctttcagtggtagactcggggagaacttggtggcccctttgagatgccaggtttcttttttatctagaaatggctgcaagtggaagcggataatatgtaggcactttgtaaattcatattgagtaaatgaatgaaattgtgatttcctgagaatcgaaccttggttccctaaccctaattgatgagaggctcgctgcttgatggtgtgtacaaactcacctgaatgggacttttttagacagatcttcatgacctgttcccaccccagttcatcatcatctcttttacaccaaaaggtctgcagggtgtggtaactgtttcttttgtgccattttggggtggagaaggtggatgtgatgaagccaataattcaggacttattccttcttgtgttgtgtttttttttggcccttgcaccagagtatgaaatagcttccaggagctccagctataagcttggaagtgtctgtgtgattgtaatcacatggtgacaacactcagaatctaaattggacttctgttgtattctcaccactcaatttgttttttagcagtttaatgggtacattttagagtcttccattttgttggaattagatcctccccttcaaatgctgtaattaacaacacttaaaaaacttgaataaaatattgaaattcaaaaaaaaaaaaggggggg
